United States Patent 7,468,248 (METHODS AND SYSTEMS FOR INFERRING BOVINE TRAITS) - sequence listing, part 15

SEQ ID NO: 48426 - DNA, 1541 bp, Bovine  19866881073305
taagttccctgcttgcaacaacaattctcagattcaaagtcattcttgaagactgagtttaaaacaaggtaccgcatttcttagagccttcgtacaaggctagtccctgacatggctgcagcttcctcctctgcgctccaccaagactctccctgctgcccagcatgactacactttagctctcaaccacggcttgccttatcctcttcaaaacacaccctctaagaccgtcagccactcaccattggagctactcctaggctgcaagacaggaggctccattccactgacagatttgaatttgacatcccatgtcttcgaccataacctccttatttcttatcttctattctccttaatgggcttccttggtggctcagtagtaaagaatccacctgccaacacaggagtcatgggttcgatccctgagtagggtaagatccgctggagaagaaaatgtctacccactccagtattcttgcctggagagttccatggacagaggagcctggcaggctacagtccatggggtcacaacgggtacaacacgatggagcacccttcatgtcacttactgcagccttctttatggtccattttacagagttcacatagtttacaaagcactttcatatatctctgaattctcaaaaactccttggaagtgcctatgctgggctgaaagagaaggaaactgagatgcaggaagactgactgtggccaaagttatacatattcagtgagcagggaagcaccctgagtcatctgacttcctgaaatgtcctgagtggatcctgatcacagttctaggcctggctgggaccactcaagatcgtacagttctttccaatgagaagagagactgggagagggaaaatgcaggagaagaaaggaatactattatattcattttaaaaaatctttacagtgactagtttatcatacttgatacagatgggaataagcctgatataaattatttatgatgtgtaacagtttaatggagtataaaatagactccttttttttacagttagtaaaagttgcagggttcttaacggcacatccagaaagagcctggatcctactcatctagacttctgacagaagcatcaatttactaaactgttccctaccaactacacgttaagaaaaaaaaaattactctcagggttaataactgcaattttctgaaaatactgaagaatccactgtaatttcacatcactgaatcctgtgcctttgtacattataagaatttttagacagtttctcctgttttttcttattaaaagaagatatctatatgaaatacaccgaagaactaaacagatgataggatctagaccagtattatagacttgaaaatactatatgacaacatccataaaacatgaagaaagaaaaacatatgacataaacgtcctctgaaaaagcaaacaagtaattctctctggtcataatgaaaacaggaagagtaatctaaatgaagtccataggtcgacttcaataaataacacactcatgttatttataaatag

SEQ ID NO: 48427 - DNA, 712 bp, Bovine  19866881075910
ttctctctcatgcagatttcattcttcaaaatggggttcattaatcattttcctctgacactccaactaacacctctcatcaccattcgtgacaggtcctggtttctcaccatcatacttcttgccattgttcccaaggcagacgatgtaaataaccatagcctaccactgcaaacattgaaaccaggaagagaaccaggcaggcttcacctgcaagggctcatgaatgcccagagggcagcttgtcatgtgcttcgagagggacagaactcagagggaacagaaggaagcactcttctatctgagcagaaacacccaggagtgtgggctgtgctcttaccagcatgtcggtggcactgagatagtgcttgctggccatgcactgttccagcttttgaggcacttgcttgatattctcgatttcatccagcaggttcagaacatgtttatgttcaattccttcaatccacagcttccgaagctcatctcgtttgcaatgcaatagcatcttgcatgaaagcagattctctttcacctggaacagaacagtttccatcttggggtcagtgcaaagtcttgccagactaaacctacagtgtgggtttgtattcttcaccattaccgctgtaacagtctgtagttctcactgccacccgttttcctgaggctaatctacatgtggaattctaatcctgattaacacacagattca

SEQ ID NO: 48428 - DNA, 1767 bp, Bovine  19866881090841
actacggcagaaagtaataacattctaccctagggtttaatcattttatcaaatgcttataaacatgccaaggaaggaggtcagagcctaatacaatcttttgactaaacctgtcacaacacctttctgtgcttcactaatttgcacatgtgcgactaacagtggttacacagcagaagtatctatacactcaggaaaattctgaatgttttcttacctaatgtgagtactgaaagcaaagggaaagcacagggctatgggtcagggacactctgatccgtcaattacagaacactcatttaatcatcccaaggattaatacagggagcaatttaacatcaccttcataatcaagggcaagggaaagttctgtgatttaaatgttttcaaggtacacgtaaagcaataaaaacagcttaaatgggagaaagacagatacccaaatttggacatctccatcattttattatatgaaagtaaatgatctctgtgtttctactgttagaggcaacaatttaacatccccttcataatcaggggtatcctactaaaatcatattccaaatgaaaacaccaccaccattgctttcaagttcaccagagttcataaaatggagttgcaacatactttcatcagaggcctgtcccttgcactggaattccatgatagcaatattggtccaaacacacttccaagtattccagagggctaacgtacgtgccaaagagtggtaaaggcgtgctttcgtcttgtcgggaagggtacataatgataatactattaaagacttacttgaactttgcttccacctcctcagcagctttctggtattgctcggtggtaactttgtagaactctgagctctgtggataaagagatagcagagttttcactactcaagaggacaacatgtgtgcaagacttacgatttcaaaaactacataaaatcttgtgtctgccgctccagcaaaaggaggaagatttcttgcatggtgacaggaatacttaaaataacatgtaagattatatatttaataatggtatcattgttggcatacacattgtaatcacagactaaacattcatgtaagtcatcaatatttgaaccttctgaaaaaattcctaacgtagttctgaaagactattttgatctcccgtatttggaatctaccactgcaagaccaaagagcacttgagatgaaatgtgaaattcacacaccatattttcctatcattccagtgttccacctaggatattaaaggatcatttctttttacactgtatatttgtcctcaagatggattctttaccaagtacaatttgttctgtcatctccatacgaccacaagagcatcaacatttataacaaattaatcagtaagaacaagggggcagatttaggtaatttttattaaaaaatgtttccactattacatgaatgaacacataagcaatataaatcaagttgtaagagccaagtaatgcctttcctggggcagcaatattaaaaacgatccattctgactagctactgtgaaacctgtcttactgcagggggtggcctaaatgacccgatgagccttcagactccatgaaataccctgcaaaatgcactgcggtacaaaagaacacaatgcaatgcagtggtctattgtgtcccttcgttctctattcactcaggtttcacatgcatgacttggggtggtttattttttaatacatcattgttggttggtgagaaaagaaagtaaatcctcttcacacc

SEQ ID NO: 48429 - DNA, 2678 bp, Bovine  19866881094930
ttccttctgagtaataagaaaaatagtactattttcttttctccttatgcccgcattcctaactttactcacatccattgaatatatttcttaaccagtttggttattctgccatcccctcagtgatccttggaagatacagcaaactcttgtatgtgtgtgtgtgccaaactgcttcagtcgtatccgactcttagcaaccctatagactacagcttgccagactcctctctctatgggattctgcaggcaaggatactggagtgggttacagtgtcctgctccaggagatcttcccaacccagggatctaatccgtgtctcttttgtctcctgcgttggaagatgggttatttagtactagcaccacctgggaagcctgtaacaaactcttaagctgaagtaagaaatgggatctgtgacattagaggtgtcaatattaatcgtgggagaaatgactgctaaaaaacattgaaggaggagacaaaatataaacagtggggactgtattaaattactccggtgatgagtattcctaataacggtcttgattcgtctgtaaaacaaaaccctaaattcaacagcatgtcactatgctttccattcggttgcctataaaggaaacagggaaatgaaatactcagaggaaagattttccttacagatggccacagatgtaatcagggatttaggatgcatgaagagataagcctcagttatgtagaaaatgcacttacgtggagcagtttatttcccagggacgccagataattgagttacatctaaaatcttgacccgtctaagacacacatgtacatgtctagtttcagtgagctgagaggtgttaaatggtttgaaaactgtaattaaatagctgaaattgtgctgcaaaatcactatcagcatctccttattgtagtatttcagcgttaagtgctaaaatttaatccgagtagctgtgactaatctagtctttattagtaacacattcaaattaagaggtgtgtgttcctgttcgtgtactttctcattagcactaatactgctaatggggagtgacaaacgtactgtgtttttgcctgtcacttacccccttttagatagctagctccttagagaaggcaatgttccctgtgatacatttacagagcttgtgtttaatagtttcctcaaaagagaatatgtccatggggactgtttattagttgatgggctctggggaaaagagtttgaattaatcaatttgaaccatagaggaaattatgatggcaattaatataaatgagaatattacacactcattggttcctatagacctttcaggctcttttctcctcttacttgttatgagatttcaaggttttttcccccagactcttggctttgctgcttgagtggcccgtctttattcctctcctccaaatcctcctgattgttcaaaggactccttaatgttcaagagagtgactgaacagttcttagtatttaaaatgatgtaaagccatcttcttttcgtgaatactcagtaagggctagtatgtttggtttttgtattctctccaaccaccttagcaaatactctggggttggttgattggatttttaatgtgagatatccagagtgggatctcttcagggaatgtttgctgctacccagcgtctgcagctcccatgacacactctcctcacacatactcacacacacacacttacaatttattcctctccccccactccatacctattatgaacagtggttgtcacacagacgtacacacgcacacacactccctcctccacttctctcattcacactcattgcccccctcacacaccccgtggaacagtagccaggcagttctcccagctgcagctcttctcggggctccttctgtcttctcctcagggctcagagatctgaattttctgcctggagagccttctccagacactcaggggacacaagtgtgcgcagacagaggaggagccctgtcattctggcctgtaggcatagcttcctggtgttcctgtttctggtcaacatgcatgtttccttagagacagtgttacgaggagtgattaggggtacctaggacattttcaaggctgtacagttcagctgtattatgaattcagttacaacttgtctagacagctttgggacctaagacattgatttcccaaaaccaaattccaaatgacctttgggaatagcccatttctaaattgtgtactgtccatatttctgactcaaattatttacttgcatcctggaaatagatgagtcaagtctgtggtgtagcagagaaagaaagaaaatgttcagatcaagaaatgagaatgaatccttgctcttagtagttttatattcttgggtgtgagcccaaatatttctgcctgttaaacagaggtgataaatagacatagtaacttatttcccagaacattttaggagacagtgtacatgcagttgtctgtaacttgacaaaaaggaatgtaaacaaaaggtacaactatttcatagttggaaacatagaaaacagctatattttgcatgtctccaaaatataaattttaaattgttgaggaatttgctaagacttttttttttacttctgccaccttataacatcactgttatattatttttaagtaataccgatttttaagagttaattt

SEQ ID NO: 48430 - DNA, 1799 bp, Bovine  19866881097164
gtggttctgagagatgaaaattgttggaaactgtggttctttctgctgacaaactccctagagttgaccttgtaacccaactaaatctagtgtttgagttgcacagcatgccttcctgcagtctaatttgctgtagttatgataatgccagttagtgtaaatttctaacatgctggaaatatgggagggtcagtattgtctggatagctggaaaataacagcaaaaaccagtgtaaaaactggaaccaagatttattaaaagccggtgttgtcattaaagatcttgtggcttgaggcttttatctgttctgctcctgtggcgctggtctgactatccatagtgtgccagaaattcctttctttcaaggtttttggtagaagcaatgttgctaatgttaagttcattttattaattaaaaatagcttctgatatgctcttaacaatctccaaccatctatatcagtactgactaaagcacatggaacctgtaagttggattcatggatttttctagcttgatgtaggtgctgtatccaggtgatggtggtagtcagtgcagagaatggcggggcaaagtgtatatttcgacaccggcgtcttgtaacacaggtgcccatgtccacgatgtgatctgtagcatcactgaagcagtgcctgcaatggcgtccagagtgttgactccgtcctgattgtctgggttgtgttgaactgtgtacacaccacctggtgagatcagtagcccacattcatagagtaaaacaaaattaacttgtgacaaaatcaaatataccacatggtacagcagagggtttgaactgggcaaatctgggtttgtatccaggccctgttttttactggctctgtagccctgagccttgtgaagtgaggtcatatcatttacagtgttgtgaggattccatttctgtagaatattcaggaagtctaaagtttttcctttcttgcctcaactgtgccaaaaccaacttattggccaaaagcagcaaatcactgctagtgattcccaagggggcctcccgtcctcccccacccctctcctctgcagtgtaatataatgctattttcagtgagtgtgtttctagtgcctgttgttttcacagctgttatattcgagtattagaattggagtatataacactaggtagtattaaaatgatatgtccacgaaaccttttaaacctaagatgagcggcattgaaatgggaagtaccggtaacaccctgtatgtctatagatttagatttcaaggtcatttcacatccattctcttatttgtttttttatgacaacttgagatgtaaatagagatggttttattttcaccattttacagttgagagaattgagacccagggaagccatgatggtaaatttaacaactagaccaagacagagcctgccataaaacaacacatttaaaaatagtgtttggcttttgagttgggtgtgtgaagagacatccaggaacacagaaataaggtggtgagggaaggacaataacgaaggaagtgaaaggggaaaacctgaagactgaagtcctctttgagactgaaagtaacaaatagaggggggggggttgtgacgacgaaagccaaaggtgcagttgagcgctgtcccgttttaaggccatgccagaatggccagtgtttcctgagcgctcactttcccaccaacaccacgttttcccatgtgtgtgaagttagcctgactttgtgacccccgttctgcgcctgttgttggagactttgggcaggatacctggtcccgacccttcatttgt

SEQ ID NO: 48431 - DNA, 1226 bp, Bovine  19866881125066
tatggactgtagccctccaggctcctctgtccatggaattttccaggcaagaatactggagtgggttgccatttccttctccaggggatcttccctacccagggattgaacccaggtctcttagtttcctgccatggcaggtggattctttaccactgagccatttggaaagtcctgtagagatgctatattctaattaaattagtctctctctgtcctccaaatatgacactgtcccttctcacagcaacacctgttgatcctgtacatccttcccactgtctttgccctcatgcctgaataccttctctaatatactccagtcttctctatgttatctggaagcattcactgagcatttcctttcaagaactcattgcccttgtgttactacttgttcaacacgtcttgtagttctctattttttctttgcttaatctacatcttttcagtcaggtagaagtcctctggaggatcatttcttatacgtcattcagtttctcaccgtgctttcccacattcagttttttttttttttttaattttattttatttttaaactttacataattgtattagttttgccagatcagtttttaattcctttttcaactggtctttaagccttttgagagaaggagtgggactattgtttattaactgtgagttccccacctgcccccaaatttggtaccacttcctatgttcagtatgcacctaatcaacatttcttgaatgaatgaatagtagatacccaatacatatcaattgatgagttgattttaggattgtattttatttatgttttttaatgtattttttgggctgcactgggtcttcgttgctgcatgtggaccttctccagttgcagcaagtggagactgctcgctagttacggtgcatggacttctcactgcagtgacttctctttctgcagagcacaggctcagtagttgtggtacaagggttcagttgccctgtggcatgtggaatcttcttgggccaaggatcaaacctgtgccccctgcactggcaggcagattcccaaccactggaccaccaggaaagtcctaggattgaattttaaatgctttgtaattgtgatgaactttgtagagttaaaagtcatgtattaatagcagaggactcataaagctttgtgacgatgaagacttgaaagactgctgtgttcccaggagagcagttcatcctctccttcattggat

SEQ ID NO: 48432 - DNA, 1285 bp, Bovine  19866881168941
tttatgttgtgtggcatgaagccggtctgctcagagactaaaggtcctcgtgtggaatttcaggtaccttacaggcaggtaggtagagtcaggtgataagaaagtgtcttctcagtgccccaaatcatactgaattggtggccactaacataaggcttgtcgtggagaaggaactggcaccccactccagtactcttgcctgaaaaatcccatggatggaggagcctggtaggctgcagtccatggggtcgctaagagtcggacacaactgagcgactttactttcacttttcactttccactttcatgcattggagaaggaactagcaacccactccggtgttcttgcctggagaatcccagaaacccgggagcctgaggggctgccgtctatggggtcacacagagtcggacacgactgaagcaacttagcagcagcagcagcagcaacataaggcttgtcgagaagaaaacatcctaagataaaggcagagtaaagaaaaatcatgaaagactgacatttagtgacaatctggctagtgcatttattccagttattgtcattttgcctttgattgttttatttttaaattttatttatttatttttggctgtgctgggtcttcgttggtgcacaggctcttcttcgctgcggtgagtggaggctactctccagttgtggtgagcaggcttctcattgccgtggcttctcttgttggggagcccaggctctaggacacgcgagcttcagtagttacggctcatgggctctagagcacaggctcagtagctgtggtgcaggggcttagctggtccgaggcatgtgggatcttcccagactagggctcaaacctgggtttcccacattggcaggtggattctttacctctaagcgaccaaagaagccctctctgcagttttataaagagaaaaatctcttctcagatgtccctaattgtacctttaatcataaaaattaatcacagcaggtaacaagtgcatatattcactaaattctgaatcagtagattctcgcattcatgaattttggtttgtgatcacagtaactccacaggcaggtaaggtggttttttttatgtcaccgaggcatgagtttggatcacctgtgctaggtgacaagtaacgggaaaggggcagacagctggtggcggcacccccctgctgagcagccgttcagcatctcagctctgtccttcctgtaggcagcaacttactcgaacgctgtgaagaaatgatgttactctgacacttccataaggcaaaa

SEQ ID NO: 48433 - DNA, 2101 bp, Bovine  19866881215913
ttgcctcaaaggcctaaagaacagcatgcttcccaatgggttatttgaacaatatgcgattattatgggccgatgcctggggcttggatatatttttgttaaggtgaaattttctttgtaatggacttggttataatgggatttgatctccattcatctcacttacccgttctccctctggcggttttgataaccttgctccctatgcagcagccagcccagctgagtctaaggagcctaacatgctgctaatttgtgaccaaaggctctccaacagagctctctcctgagaagcctcagatctctttgatttaccaagcatccatccatcatccttggccttactcaatcttctttccaagggcttttatcatcttccatggtatagctctctcagaacgctcccagcctgtatagacacgacctgtatagacacaatcccactttgtggatgatgaacggttatgttctagagggttctgagttctcatttccagctggggtgagtgccatgtctgtctggcaaggtggtagtcagttataggatgaggataacagccttcatattacaggttttgaataaaggcacatctgccatctaccttgcaacggtgtttggagttttaattcataaatttggcctagaaggagggtgtacacaatgcagtctgccgtgtcacccctccagcctactccattcaaaggatatgccccacggcactgggttttgttagataatctaagtgcaaataaatcattcctcttctcctgagtgctttgttatgtgtcctaaacatttgctctatttatttaatcgttttctttcttttcttattctgtacatagtccgattctgcaagaagttacaacatggaagttacttatggcatttcaatcgaaaggtgaatagagagggtcaagggcccccctcaccagacctgtttcctctgccaagatacccaaagtctcaccaataatggcccctgagaaaatgcgactcaaggttggatgatgtaaattgttgtcactctcaggtgatgattaattaattaatcagctcagtcagagatttgggtggggcccacaggaagtacagggcttccctggtggctcagtggtaaagaatccacctgccaatgcaggagactggggttcgatccttggtttgggaagatcccctggagaaggaaatggcaacccactccagtattcctgcctggagaatcccatggacagaggagcttagtgggctacagtccatggggttgcaaagagttggacatgagttagtgactaaactgcaacaagaacaacacaggaagtataacacaacattcattcattcagaaaacttttattaataagaaccagtgagcatgtgccactgctctgtgattcaaagacatggcccatgccctcccccagacaggcacagagtcacgtggtgtctctgaaagagccctaggctggggccttggtctcttgtaccagctgactctcagatctgagcaccgagtgagccagggagccccacggggagagggtggaacaggatccaggtcaggcctgctctgagcggaaccggagttatgttcacctgctggaaccatcaaagggaaatccctttctcctgtcctcatgcctcaggggcccagttctgtcttcccactcaagtgaggggcaccattggtgttggctccttgcttatcctttcagagattttaaaaagtgggctagtccatgggcttccctggtggctcatccagtaaggaatctgcctgcagtgcaagagtcctgggttcaatccctgggtcaggaagatcccctggagaagggaatggcaacccactccagtattcttgcctggagaatcccctggacagggaagcctggtgggttacagtctatggggtcacaaagagtcggacacgactgagcgaatgagcactttacacttaatccatccaagtctaccttctgtatcccttttcatttaacacaggatatagtgtaccatcaacactgtcctgccctctgcttttttccaattagcaagaagtcttggagatctttccatgtcaatactgaaagatctttaatc

SEQ ID NO: 48434 - DNA, 1060 bp, Bovine  19866881223923
tgggattttccaggcaaaagtactggagtggggtgccactgctttctccggtcaggggctgaggggaggggaaatgaagaattactggggtcagcctggacactgtttaataggtgttgagcttcagtttgtgaagaaaagttctggcagtggatggtggtgatggttatagaacaacatgatgtgtactttatgtcactgaacgcttcaaaaatgctcaaaatggcaacttttatttatatatattttatcataataaaaataaatgaaaaataaaagaaatttcacaaagagtgtgcaaacatgaatgctatgacttaattacagcagttactttctaatacacatctattatacagacttatttttctatgtagtgatggtgacagctggggtgaagaggagactggttaaaagtgtgtaatttccatgttttgccattctgaatctattggtcagaaatgaggcctataattttttccagagagctgtcacaaaatgtgggcagtcctgtcctcccatcaatttctctccagagaagcccatggtgcccaagggtggcctgatggaggggtgtcatcaccaggatccctgacaacgacagctggtgagagtggagcaacacgaaagtaggtcaatggagaagccgtttgccagcttctggagacttcatctggggagcagaagggcagggctgcttgccagctgtgattcagggcacaagcgcctccttatacgcaggggtaaaggtggttaatatcacgaggtggcaaagagctctgtagaagccaaacggcaaggctcagagactctggcaagctccccagtgctggcaaacgagggcatcacgggactctagtctctctacaattaaacagataattaagaaataagaacatatttttccaatataaattgataggcgctgcttggtaatgttagcatcaggaataaattgagcagtaatctgcaaaggatgttattgctattgtaaaaataaagatctgtctccgcaaccaatcaattcagcagatatataccaacaatcaaattgttaaaa

SEQ ID NO: 48435 - DNA, 801 bp, Bovine  19866881251400
tctgaaggtagcatacacctgtttctgcttttagggtgagaaatgaattgccaattactgtcgacgtgtgcagacatgacacttcatatgctagaagcttgctcagcctgctttatgctgggttccccactatgaaactgtcagttctgaaaaaggggtgtgtgttggcaaggaggagaagagggaaggggatcagtccttgatccattcctgtctttttgtgctcctgcaaagtggcgggagggaggtcagtgcctctcacctctgtttccccagcagagctcttgaacaagatgaagtgatcaaagccggacgccagcacgtcatcacagtctcattactttgcaagctgcacgcccagatgctgctgttttctgcatcaggcttcgctgatttacatgcataccacctcagctacagctcatttggtactattcacaattaactggttcttgtcatgatagagtttctctgatacagaagaccttaatgtaaagagaataacatcgctaggtgtagcctgtttctctcagacctcctggttggttgacaagaaacagggatcaaatgttttgtcactgctttgttatttgtgttattggtgtggttagtggggtgtgggtttggaggtatttttgaagtctttgagatacgagattttcctggagaccaatttcatcaactccccgatcttggaagttcttttcaatgagtagattctgatatcctgttttcatttgttcggtttcttcccccagtgaagagctgctcagggacatacatttgtttgaagggtagtaa

SEQ ID NO: 48436 - DNA, 1160 bp, Bovine  19866881254482
aattcactgctgaacagcagccataaaatatgatctcttagtggtaaaaatgcaagagacagagaaatcggagctggaatatttaagcaaagagatcttgtcctccaaggcaacactgacctcatttccccaacttgggtcaaaggttttcagatttatatggacaccttaaagcaaatcagaatggtgctggccttaagagtttaacctgtagttgaaactgtaacagcccataacttattcctaaatttctaggcacctcctgatgactggagcatttatgtgccaatgccagccataacacacacacacacacagatcagaaaaaataaaagacatccaaattggtactttcctcacctcctttccccctgcctcatgtgatgtgtgcactaaaggagtaaaattacagtcatcagagacaaggttgccaatgatggggacccatacctttcaaacaaaatggaaagtcagtaattttcagggcagcccatggatagctgccacagactagctcctgaactcctgaaactcacagcaaagtcccttactcttagcaaacccccctaaccctctcccgcccagccttcccaccttgagtcccttgtcatattgcaaagaatgctgcaaggcccttgattcatgcgggagattattacagggctcagagaagccggctctgtaattacggtggctgtatgatttctattatcctgagcccccagtttcagtagctcacaaaacttcccactaaatcctcctgcagccccacagctttccacggctgggcctctgcccaaagagtgaatggggtcctgataacctctgggaaaagcaggacagagttatgacaggggaaggggagtggtactcagtgagccagagtggtggggaattctattgtttagaaaaaaataaataaatgggccagtttcgctttttattatttcaaacaacagacgcggcggcccagctttcctttccctattcagactgtcccccagggccggctgagtctgcaggagtgtagctgggcttcagcaaaactattaaaaaggccaccactctgagctcgtggagcagaaagtttggctgcccccatggcctggctttcccccaggagggccactggctcattcccctacacatgactctctggc

SEQ ID NO: 48437 - DNA, 1257 bp, Bovine  19866881254884
tctaaatgggcaattataattaaatgtatgcagaactgatgcaggtggaaacctaactcccaagtggtgttagtgtttcttggcatttaatcttccgttaccttagagaattaagcatgtagactaaggatagagctcccacttgaagaagaaactaactagctaactagacagatgtgattaggagggatccgatcttaaaggcggggagaaggccttaatcacctagtttccttagaaatctaagcaattctacaagctcatcgtaagaagtagagtcaaacactggtgtgttccaaagcaggtctcacttgccttggcactagtctgctattttggggtatgtgggggaagagaatgacacagcttcttgcggtggccagctccgctcctcacatccccggatgaaggacagaaggggctgccatacccatggtaggcggcgtcttagatcgaagtaaaatagctacttaggtccattttttagatgaggatcaataataacttttttttttctttttcaactttaaaaccttctcagcttgaatgccctaaagagaatggcagttaaaatttacattttagagatggaaaacacaagacaaagatataataaataaccagcctgaggagtgaggtgttccaggtaatcaagactacgtttcagacaagtgggtatttgctatcagacaaactctagtgggaacgtgaaacactgtggaagatgacagaggtgagttgatgtttaaaaaaacaagaacaacacacaacgctatacttctaactaggcaattatagccaggtgtacatacaaggagtacaggtatatttactttttctagaatttaacctcttccgttgctaagtctcttacaaaataatcaaggcattgcttgactctaaggatcgtagggaataaaatgtcaccactgcagctgctgtatttcctgttcacagcccttcaaatttaaaaaaaaaaaggaggggggtgaaggcccaatacaaatgtggaatttaattagttagtaaaagccccaatccttgcccgaagtcttgttcttcctgtaatattgcattcttctcttcttgtgtaaacttttcattatggaggagacatctttataatacaataactctagttatactgtaactgctggtaacataactcctgcattggaagagccagcatgttcaagtaatgttgttttaatacaatttgtggttcagcagaaaaccaagttgacttggtcatttaga

SEQ ID NO: 48438 - DNA, 695 bp, Bovine  19866881262541
ttgcaaaagcttttagcctgaatttttataagatttttgcttacagcaggggtggagcatactattatctcctgattatctgagaacaaatcattttaaatttggcatgtaagttgaatagtacattttttttcttttagtacctcttcttttgtaatgatatttttttggtagaactgtccttcccccattaatttttattttgctgcaacccattaggaaacttcctgagacccacaacataggtgtttatccagttattaggagagtttgaaagaatccatatttgcttaggtttttattttgtaccattttaaagcagtgtttcccaagtggggacttgaataacagtatttggaagagcacgttgctgccaaaagctctaatggaggcttttttaaattctcaataaatccagcaataaaacaattattaaattttttttttgcatgtctaatgaattttgtgatagtcagtggagataaagcaaaagggcttcggttcctgacttgctttatcacacagttggtttacaacatacgtatattcctgccatggggattagatgtttatgtggtttaaaatttttattcatagtcatgtagtatttaatttatggcctatggtggattatggctaaagtctagaaacatccaggactctgttgatgaaaagcaggttaagaacatcataaa

SEQ ID NO: 48439 - DNA, 2013 bp, Bovine  19866881266897
gcccaccagcctcccccgcccctgggattcttcaggcaagaacactggagtgggttgccgtttccttctccagtgcatgaaagtgaaaagtgaaagtgaagttgctcagttgtgtccgactcttagcgaccccgtggactgcagcccaccaggctcctctgtccatgggattttccaggcaagagtactggagtggggtgccattgccttctctgctccaccactttagtttgtacttaatgttactcagaactgtactgagtgcccttcgtgacgtaacaggtatatgttactttcaggcatgtctcaggttggctgttattaatgttattttcgaggaaaagaaaatctgattcacactttgaaataagggctgtggtggtggtggcttagtcactaagtcatgtgctctttgcgaccccatggactgtagcctgccaggctcttctgtccatgggatttcccaggcaagaatattggagtgggctgccgtttccttctccagggaatcttcttgacccagggatcaaacttatgtctcctgtattgcaggtggtttcctgtattgcaagcagattcttcactgctgagccaccagggaagcccttgaaataagggccaagtggatctaataatgttgcttaatatcttctagttaaacgcattttaactagaaaaaaacagttcacaatttcaagaatcatgtcagctctagacttttttttttcttacatcggggccaataataaagaatattatgttctagaaagatcaggaaattgttttcttcctgcttggagtgaggttcaaaaattagttcagccttgaatatctgagaatttaccaattctcagtttggggcttataaaatgttagaatgttgtaaggatgactccttattttctcctcttcccatgatgcaatttaaaaaattcataagaattgtcctaatgagagaaggccgtactgatggagggattcaggtgcttgatgagtgggggaaaaaaatgcgggggctcagtgacctgtagtgtgtctactgagagtcccgttgagtacttcccagaatggggatcactgaagaggcttgattttactgtgggttttgctgtgtagaactgctgggtcccggtaagttatttctggatatgtggagccttacttgtaattagtttttctgagttgcttggagggatttccattaattgttctgtgaatctttattattcctggaggagaggtcactggatgccgacaaggaatgcccttagtagacaattaagcgtattaactgttttcagaaagcctgacttaatgctaattataccgcaggtgtcaccaaaattcaggtgtatgatgttaaatatttcttatagcaggttaattaattcagttatctgagactcgtatcaggcagctgactcttctcgtggaagaatctgtgttgctgtggttaagtggggggtaactgacaacatctgccttgagagtttacccaagcagaataacacagcttgtgttttacagggtgatgtacttctctgctcaggcagctgtaacaaaataccacagactgggtaacttgggagactagaatctcctagtctctcttctaggcgactagaagtctaagatgatggtacagtcagggctgggtgactgttgaggcctcctcttggctgggagatggtcaccttctccttgggtcctcagatggcccttcctctgtgagtgcgtggagagggagagggctctttggtgtctcttcctctctttataaggacaccagttccatcccattaagaccctgctcatatgacctgatataatctttatgacctgccttctaggccctgcttccaaatgcaattatgttagggcttcagcataatgaatttggtggtgtgtgtgtgtgtgtatgtatgtgtcagtgtcacaattcagtccgtagtatgtgggaatctgtgcactcttagttgttaaaatatcctaaaatgctttcagagtgacaat

SEQ ID NO: 48440 - DNA, 1178 bp, Bovine  19866881310824
ggaccttgatggggggagggtgggttctgggatgtaactggtttctatgctaagagcaaagaagaccaaggttgcctttgggctcctcttttaactgtatcaatgtatttgttatatgaataagtgaatgtgttagaggatcctacaggatgtggggtaggttaagatacttcttgggaaagatgagaccttgtaaataaattagaatgaagtcttaaagatatctgacagattttgttttccagcagattagtctttctcactgaagcatacttttgagtcttatttaaggttgagttcttccagtgcttctgaaatctgttctgactttctgacagtagacgtggacatccagttccaagaatagccttaaattaaagactgtcaattttaaacagtttaatagatatgtaagtgatagctctattttaagtgtctttcattttttgaaaaataacgcttgttttagaaattcaagctgttttaaaccagttgcttccttgtaacttggcaacagccgttaacctatgctaaatggtctgggcaaggttcatccttacaaacttggagggtctgaagtttgtttcgaatttgttatgaatcaccagcctgtcccatcttctacagacttgtgtagattgtttcattcctacctgtctagattaggagtggagctggcaggtgagaagttagaaatgaatacagaggttccagaaacttggttcctgtgcacacaaggtctcccatttaacttcgttgtggctaataaaggcagctgaggaagggaccagcagcatcagtagtttgcagaaaactatggttttccgtgaaactgcttgttgatactgccttttagggaatgagctaacgtctgtttcataggcttgattctagtaggctcttattttagtggttctcatccagggttatggatttatgtgtaatcttgtgaagacatgtttcaataaccagtactgcctaaagttctgtcatattttgggttctgatcattgcacccatatccatgtaatatagttgcttgtatagacagatcagtagagattcttgataaacagggtggacactgatgtggtattaaaacaaaaacactcaagtatcaaagatgcagatgacaatacattcacgtacatctcattgctgtcacagcgtccttgcaa

SEQ ID NO: 48441 - DNA, 2130 bp, Bovine  19866881317583
tatatatagttctaatggagaatgtccgtttgagagcaacttcttgagaaaactgcccagagaggctagtaacttgcccagggtctcccaagttgctgatgggcaaactgggatcaaacctcagctagtccgtacatctttctctggttccttgtccatcattcttttcatttatagtatattcttttctcagctttattgagagacatttaacatattgtactattcactcattaaagtgtacagttcactaatttttagtatttgcagattgtgcaaccatcttacagtctagtttagaacatgttcaatacccccaaagaaatcctatacccccttagctgtcactctccatgcccccactcccctgccccagacaactactcacctactttctgcatctgcaggtttgccttttctagacatttcatatcaatggccatgtacaatacgtgacctttgtgtctgacttctttcacttagcattttttcaagatttattcatgttgtagcacatattagtacttcataactatttatgattgaataatatcacactgaatggatatactacatttgtttatccatccatcagttgatgagcatttagattgtcttcacttttgggatattatgaataatgctgccataaatattcatctagaagtttttgtgtagacatgttttcagttctcttggttatacacggtatctaacagtggaattgctgcgtaatatggtaactgtttagcatcttgagaagctgccaaactatttttatactgactgcattattttacattcccaccagcagtgtattaatatgcaggttttcagtttctccacattctcactaacccctgttaattgtctttttcattaagtttgaattggtaaatcacgtggctttggtttgcatttccctaatgatggatactattgagtgatttttcatgcagttattggccatttgtgtatcttctttagagaaatgcctgtttatgtcctttgcccatttttagttatgttaccattttattgttcagttctgttgtaagtgttcttttatattctggatacaagcacctcaacagctatatgatttgccagtatttttccccattctgtgggttgtcttttcactttcttgatgatgtcctttgatattgctattttctgatagtccacaattaacagaaaacatccttaagagctttcatatattttcttttcttgctgttacccagtgtcagctaaatttttgcgtatttcctaaggcaaggttgttataatatcaagattatcaaataaaatgtcatcaaagagcagagacagtactgtctagtttccatctaataggctcaaccagttgaaatcctgggtgaggtcctgtgtgtattcctagagtttaaatgtttctggtgctttcttggtcatagttttgggtagtgggttttgggtagtgaagaggaaatagtccttgcttatttcttagggagggctcttaaagagtatataaaatttgtcaatttatttgctgtcatagctgtaagactcttacaaaacatattgtacaaaatcatttaattggaaagaccagctgtttcaagtcaagtcaccaggtacttagaaagctccagctgtgttctcagcactgttctgtgtctctctctccaattgttgggacttgaatttgaaggacacgttttccaaaaaatatggttttaacattttcatgagtcagtgaattcctttttcataaatcatggataagtgaatttaaccacacatgattttatttctctaataagtgattttttaaaatgttcagttatcaaagtgggaatgttttgatgtcattttcttctctgaagtcccttccttgcagcctctcctctttctctatgcaattgtcagactttagtggtaggacatcattttaaagaatttgtacttaatgggctcagtccccactgggcagtaagcagctccttgagtttattataacttttggcaggtatgggagatttctaggtcgccagagagctcttgattaaattacttctgaagtgcactaattggtcttttccacagtgcttaaggtggttccaaggagatacgaccagcggc

SEQ ID NO: 48442 - DNA, 3058 bp, Bovine  19866881327373
atgtctgggtccatgcgcgtgagtggtggccgtaccttcccaagtcatggtgatgatgggctgtcaagatggtacctggagcagttggaggtggggcagagaggctgcagagtatggtagaaagaagactccagggatctgtgactttctgccatgtgactttctgcaatctacctagatgactgttgacaggcaacctagtttctttggagctgagtttttcatgtgataaagcagagatttataccaggtgattcatttctaaggactctgctagctccagagtttcctgactcagtacctccgagagttgcccagctgcttgcttctaattcttctccctgttccttttcagctcttaaccattgatgacaacttctgtggcctggatatgaacgcccccctgggcgtgtcagagatggtgcgtggcatccccgtcttcacagaggacagggaccgcatgacttctgtcatcgcttacgtctacaagaatcactctctggccttcgtgggcaccaaaagtggcaagctgaagaaggtaggacaaggggtagtcattttggtgattgtatggacagcctgtccccagcaggatggatattggctttgtgttctcttactaccccgggcctggttggtgagtgatacaggtttgcaccaagaaaggtgtcttgctgttttgaggtcgacagtggtattcttgtcccttctctgccttcacatgaggattgttgtaggactcacactgggtgagtgtgtggctccacctcttctgtgggctggtgtgctcctgagaggtgtgcgtctccaggctcctagtctaaatggtgtgctctggccaacgtgggcttatgccctaaggcaagacccttattaggcatggatggttgggaaggatggacaggggcaagggatgtgcctgttcctccctcttcagcctttctggtttgtgcatccatctggaatccatttagggaacagatggaggaaagtatatagtacccactggaattgctattggggctaagagccagattgtgggacgaggaaaccatggatgctgtgggagcacagaaatgcctgcaggtggagttgaaccgtgtgatccggggacatgagctttcctcctcgttctccagaagcttgctggcttcagtggtactgggtgaccatggcttatccgctgtgtttcatgtccccatctatgcagaagtactctgtcacctgcttggcttgggctctcatcttagtgggttgttggcactggtcccccagagtgcccttcttgcttggaccaaagcctttctaaaactcaaggcagtaggtcctgttttctattggctgataatcatacttcacgctttctcctgggaaatactgatgatgccatgcggagatcctgcttgttttaattaggcttcccctggaattttctggacatcgtgtggttcagatggatgaagcagcggtgccttatctgagaccgagttttgatgcctgcttttctcttgtgctatgtttgtcggtatgagcttgatggtcaaggggaaatgctgtctgcaaatctcgagattgtacctgttaccctgttctatggtgtgacagcccattccagccattgtttttctctcttcagattgtgcatctttgtggaacaggtggtggggctggagggtgggagtgtggagggggagaggcagggagcagagtgtgtgtgggttggggatgtgtgtggagcagttacatggctagcggctggaagagaaagcgtatgttggtgaaatgccatggcacgaagtgagagtgatgcaggcagcccaccacgcgttgggatcaccctcctcattgtagtgtcctgccttctatgtcaatgaacagattcatttaacctttgtccttacagcttgaagaatgatattacctagtcacctgcctttctgcgaagactatgttaaacgcaactgaatatttccttgctgccttggccttctcgttgtgattactactcacacagtggacagggctcatggacgcccagggaggatgctgggaagtgcaggcatgttgtgtctgatcgttgcggccttcccagctcttcctctagggcaccttgtcacttatcccttccagatgctgcctggtccacatcagcaccctgcctcctccctgagctgtagcttcagctttcagtgagctgggaaatcagataaccaaacttgctgaaattatgtctgataagcctccatataagccaaggagggggaagtccacgagctttagagcagggacttcgggaaaagatgtttctgttggttgctcaggtgatttcattcttcatgaggattcaacgagttcgatttgctggcaaagtggattctaaataccaaagtcattcccatatacaagtcacacagtgaaatgtctgttgacctgctttgcttgctctgatggttaaataagcactgttgaggggttgcacagagtcggacacgactgaagcgacttagcagcagcaaagggtaaataagtaagtgaaggaactgggagtgctttaggtcttgtctctactaagcccatctcagtggaagggagaggtgacttttttcaatgttctggaaggttccaaccccctcaacttcctaccaggggccagccaggatcttttcacttgctggccagaccaagtagaccataaagaattttttttttttttgctattgtctgagctggtgggtatatggtgtctgtgatataaacattgagaattcactgcaaacaacagaacagaaagttattttctcttggggggcgggggggagatgtttcctggccatggctgcatcgtaaacctaagttggttgacttgcaaataaatgtgtgctcttggtcagagggtggtcagaggctgatgggggctgactctctcacctgtggaagccggtcccctgttgggggtcagagcgaggcccatctctgtgagtgggggctgaagacacctccaggaccccgggcaagccaagtgcacacatacatccattgtggggcaggctgtgagcag

SEQ ID NO: 48443 - DNA, 1310 bp, Bovine  19866881332272
ttttttgttcccctctaatactacagtttacttctatgtatggcctttgaaaggaagaggtaggaccccaaatcttaaattgaatcattagataataattgcctttcactgagcttgtttgtagggcgtgttgcttttgacgttgttacttggctgttggccaaagttagttctgctctgcagtgggcagtcttaactgtagcccttgtgagaccttctaggctatgccgtatttctgactttgcacttgctgagtacctgagttttcagctcttttgggtcaacagttggtgggctggcattatctgattaaaaaaaagtggcatgttgtcatggggcatttggaggatgagacatgtttttgttgaaatatatttgaatagtttaatattcccatctttatttggggataagtctaattctttttctttacagtattgttagtttctaccatacagcaaaatgaaccagccatccacatacatatttcccttcccctttggacttccttcccattcaggtcaccacattgaattaagtagaatatcctgtgctatacagtaggtcctcattagtcatctttttatacatagaatcaatagtgtatatgtgctaatcccaatttcccaattccttgcacccacccttccatctccttggcatctatatatatttgttctctgcgtctgtgtgtctatttctgctttgcaaataagatcttacatattcaggtacaaggtttcttagcatctacaggtagcccaattctgcaacctcatggttatgtgttcacccgaaacaacatgtagaatcaaatagcctcttaattaaagcacagtttggtcagaagcctaatttatatgacaacagcaatcataagaaaaaaagcaattatgaaggacattttcccctaaataaactcccaagttttatttaaatttaagggcagagatcaattttgagggtttcttttttccccatgaacatagaacctcgaagtttatagtcattctgttgtctttctcaaaacacttgtttgatggcaacgtactaggcaagcaccctgcctctttcttagaggtgctgaaggcattgttggtgctcagttcatgtttaataataacattagtcagggttgaaatgtggctggcacaccagggttaatgccagcattcttaggagaagggtgattggcattttaatcagtgcaaatgttcagaacctttgtctgaatgactgtatttccagctcttcaggtttccctgttctgtggttcagcaccgattcggaggggacagctccatctactg

SEQ ID NO: 48444 - DNA, 802 bp, Bovine  19866881349427
atctgtaactggatcagtttgctgtgtacccaaagcattgtaaatcaactatgttttgtctttgctcatgctcagtcatgtctgactctttgcgatcccatggactgtagcccagcagcctcctccgtccaagggattctccaggcaagaatactggagtgggttgccatttcctcctccagggaatcatcctgacctagggatcaaacctgcgtctcctgcattgcaggcagattctttactactgagccacctgggaagcctatgtatttcaatttaaaaaaaaaagaaaagaaaaaggggaatttgagaatctgaccatgcaatgagctgatgaaactcatctagaagctttccaattttctcccttctcccctcaatgatctcttggcatctcagcataattattccctagacttagtctatagctgtctttccacaaggcagaaaatgaaggtgaagatggactccgtatgtttagagttgaagtaatattttctttgctaccctgcccctcatcaaatcatgcaaataattttttgcagtccttgagtcatgaaaaaagtttaaaatctcctttaagccatttgcattttttggtattaaaatgctcttccacatgtgaattctaaaggcaaaaatatttgcacacaatcatttttattaggacttttacaacatataatctttacaaactactttcttatgcaatcttcctcagaaaagcagttcacttaagaaaagcagtttctgaaagtttgtcagttgcttaagaagttactaaggaaaatcattttatgtg

SEQ ID NO: 48445 - DNA, 1271 bp, Bovine  19866881360804
agaaaaaaggatattgtgtaaaagcgccgaaggtttccagaatttccctttcttgcccattataaacatggtctttccctttgctctgagctcccccctctggcattcatggtatatttctctttctattattacaaacttcaaagctctcccgccatgtcattttgtaaaccctctcgactgtaagtgatggtttgcgctgcttttctttcttatttggggggttgtggattaaggaacgcagaggaactgcctggaacatttattaacttttaattcagtgcagagaaaaaaaaagtcggaaagccagtgcaccattgatgttgcctcaaagatgctttgaccttgtttaaccaatttttaaggcttgtgtgccaggactgaaatgaggtgccttttcacagacctcaggattgtgctcttgaaacaaatagatccatatggctctttgtttttgcgattcaagtgttatccttatgctttttctatttaaatggctatctttgttctgatgaaagctgattatattgtcagtaaactcttaactattgaatatttttttttagcaagaagattggtaatgcccaatttatttagcactgtttaggaattggattgtcattgtagcttgatttttcagaaaacaaaatctcacccttttgaagcaccaaaggttgtattttaacacttctaaatggaaaattttgtacagcacattaatacatttttctcaaattgggtctgtggaggaggatgaggtttttactttcctttagggtccctggctgggtctgagccttaaactgatgggaaacattaatagaagaaaagcggccatatttgtttgttagttttgtgtaataagggaatcttcataaggaaatgaagactcatagacatgtaaaacctacttgccagcttccttggtggtccagtggttaagaacctaccttgcaacgcaagggatagttcaagggatagttggatccctaatccgggaagatccacttgctgtggggcagctaagcccatgtgagacaactactgaagcccgcccaccctggggtccatgctacacaacaagagaagctgccacagtaataagcccctgcccacaaccagagaaagtcctctcagcagtgaagacctggtgcagccaaaaataaataaaaattaaaaaaaaaaaaaaaacaactggatgcatggggctggtgcactgagaggacccagagggatggtacggggagggaggagggggcggggttcaagat

SEQ ID NO: 48446 - DNA, 1220 bp, Bovine  19866881391033
agtaggagtctacaccaggcataacatccaataggaaagaaaactggatttggaaaaagacgtaaagagatgtgaataaaacatagactggataacccaacccttctgtaattgttggttatagaaagcagttgtctctattaaaaatagaaaagtgacacttgggaaaaaataaagacaaaagtagcagatggctaaagatttcaatacctagtacatacacagcactttcaatcatcccccagtgaacagtaccgggtggctaggatgtgatctatttcattcagatggagttaagtctttatatttaagcagaatggaatagaaaagcaatacaacatacatttaaaaaaaaaaagctttaatgaggttaataaaaaaattaatctaatacactgggatttttatattatagaaggatctcgcaaatgtcagagcacacaaagaaacagtttgcagataaagccaaccaactgtccactgcccctaccggagccagacactgggaaatctgttcacatcacagcagtgtacgaactgtaatcactttctctgcaaatacctataaatcagatggagaaggcagtggcacccactccagtactcttgcctggaaaatcccatggacggaggagcctggtaggctgcactccatggggtcacgaagagtcggacatgactgagtgacttcactttcacttttctctttcctgcactggagaaggaaatggcaacccactccagtattcttgcctggagaatcctagggacggtggagcctggtgggctgccgtctatggggtcacacagagtcggacacgactgaagcgacttagcatagcatagcatagcataaatcagaagtgagattcaccgcctgtgactgctaactcatcttttcaggtcccttacaaaccatatttttatgataaaagagattgataaatattagtaatcaacagaacttactccctgaaagtggctttattttttaattactatatacctagagattacttgcaggttggaggtatgtaatttcataataacaactgcgtaatatgtgctgatgactagaaaatggcatttaatttctcaagtaattaaaactggggtaaaatctcaaccaacattcatccaaaagcagcatcaaacaatcttggtggatctacagctagttacaacatcaagtagctattccctttctttcttcttgattt

SEQ ID NO: 48447 - DNA, 974 bp, Bovine  19866881512480
tattattattgagtacaaatgagatgttactacattagaaagcttcagaatctatcggatctatcagtgtctcttataatgactgttatagcaacaccaagaatagatgaatatgaatggatatgagttggggacttgggctgtgtgggtagggattgttggtagtagttgaatttgagtgtttctcccatcctgtactaagtagatgagaagacaccagatttctttaaagatgctaagtactcatctaatgcttatggaagcaggtaggctgaagctgggaaagattgaaggtgggaggagaaggggacgacaagatgatatggttggatggcatcaccgactcaatggaaatgagtttgagtaaactctgggagttggtgatggacagggaggcctggcgtgctgcagtccatggggtcacaaagagtcggacatgactgagtgacaaactgactgaggctgaagggaaaacacagaaaattgcctctgttgtgatgtgtgcgcaaactctttacattttgccccaattttggctattctgttggtgctgaaccaagctgttaaatcatttttcttgcctgtaattggaaataaccatatgtgaatattaaagtgaagttgttagggcttaatcactgagtaatgtaacattcattatttaacatttacataaaataattttgtgactttttatatgaaagtatacattgaatggtggaattagagcaaagcataaccttagttaatataaaaaagaaagtcacaggagaataagatgattttggtaggaagttattttaagcccagatgtaagatagaaaaccctagctgctcgtatgagaaagggaaaaaatctagaaatgtgggcaagaatgagatagcatcattgaaaatctaggcagtagtctgggtcatcattgaaaatctaggcagtagtctgggtcatgaatgtggtcacaggaactacaagg

SEQ ID NO: 48448 - DNA, 1292 bp, Bovine  19866881524551
acattttaaagtgaaaagaattttacgttgatgcaaacatttgactatataatactttaaaaagccattttatctggaacagtttttgcaaagcattctgcagaatcacctaaactccttccacggggtaactaatcttttaatacgttacaaggataacccaggcttcttccatgagcctaaatttgtaagtcaggtttgaacaacttcgttcaaggataaaagtgaaaacccttgctaacgcctggcacacaaaggagcattaccagcattcacatccgaccgcacagaatcacactcctttacgagtgcttcatccttcaaagacactgaagccaagctaaaaagttacacctctaatgagatcagtccagaagtattttcaatagatctatgtcacttgccatatacgttgttatggaaggtagaagtggccagtccattatctaaaggaaaacatgggacggaaagatcagtcatctctgaaatgtttgtttgctattacattgtcttcccgaggtttacactgcctttacgatatctcacattgctttgatattgctctacacatttgtttcatgtttgtttctgtattttaaaaacaacttgtgtgtacataacactgtggtaacgtttcctctctgtaggtgtggtatattgacaacaagccactgaaggcaactggattctgatgctgacctaacacagagccctgcagcaccgtctgcacactcctgattctgtctgtccatcctgagagctctgacacagcgcgtactgggctgtcccgtcttaagcgctttacatgccgtctcccggctggactatgaacttcccatggctatgatctctctctaatgctcttttgggagttctttgtttttttctaaaaacaaatacagaaacctccacaagttcctacagtgtgtttgttcttttgttattttaaaaaaatttttctggccccgccccatggcatgtggggatcttagttcccagactacggatggagactgtgctgcctaaagtggaggtgcagagtcttagccactggaccgccagggaagtccccgggaggttttaacatcatctcgattgtgtctggaactagatatagaaatttctccaatggtgcagagttttacaacatgagttggatataacaataaaatactaatataaaaacaatatataataaaaagaaaaaaaaatctaatagttaattaagcaatttactttgtgctagacctgtctgtgctaataagcactatcaatataacaattaatataat

SEQ ID NO: 48449 - DNA, 1312 bp, Bovine  19866881660145
ttactcagagatctctcaaactgctttacagcgtctcattcaccacctatgtgtcatgtacacttttgtttagttatagaaggatgggcagaaaacagcttggctgccaaatctatacctataataccattcaggtgctggaaaaaacctgagcccttcacagaagaattgtcttcagaattgttttaagttattttatccttaagattatagccaattgtattgcattcaaaggtgcaattttttttttttttttttaagtatttctggtcttcccagaagtctttgttggcacagtagtgagtggcatgagtcttttttgatgagctccctaaaagtttggaaggatttttaaaaaataaaaagtgaacagtgacagcaaaatgcaacacttgggataggattccatctaaggagaacgagggctgcctccaagtgaactgcagcagatgacgaaacctcagcatggaatagccagtttcacgggggtgataaatgacagcacattagttatgtgttagcagcgtgatatggcagtgaaaaaggccagcgctattttgggctatgctgcacgaaacagtgtctcctcctggagctgagactgatcatctccatctccccggtttgagggagatagcatctgggttgctgccttgagtgtcaggcacgtgtgcaccagaatgacagacaaacgggtgggagtcccaagccgaggatctgtagtgatggacttgagatgaggcacgtttcagtgctttttggagaactggcatgtttaggaacaagcacggaagccaacagaggttaaccttttcagagatgggatgacactgaagaaacaagcgtcattgtgaagttagtcactcagggagtcatgaccttcaatagttggcattgatttgatacagagcacttttgaggggttgctcatgtgttttcacagagagcagatcatcaaaaagggccccaaagtaaaattaagtacttgtgttttatagtcaaccatatttttaatcaagggatcaacaaggatggaagtctctgcttatagtgagaaaaggaatacaaaatcgcgatggatgatgtaggtctgatgcttttgattggaaattcgaatgcaggtgttgaacttgggaacaatgggggtgagacctttacagtgatttttaaaaattcaaatgtgaagtgaacacagtagtatacatgagcacagcagaaagacactcagaatgtcagctgacgggtcggggtatttctacactgagaactgttgggccgtaggagggtcccctaggaaagggagttaatttca

SEQ ID NO: 48450 - DNA, 771 bp, Bovine  19866881764360
ttatgaaggtggggatgtgattttttaatttacttttattgaaaatatgctcagccttgctgttacatatgagtgcccctccaccctctgaattagaatttgttgcttttctgcatgtgtgttgaagacagaagagtcttcattttgatttttttttttcccctaatcctgaaagccatcagtaatttaaacaaccacgtctgggaacgtttggtgacagttctgcacataaaaacagttgtccttactgtgtaactaatggcaaaatgttgaagaacaggaagatctccatacccgacccttttgatcactcagttttgtcatttcaagctcagaaatattcatcgctttgcacgatgagggactccttgtacctcacataggaagccagttctcttaaaagcgtcgtccagtcatgaatgatggcactgtgtcctcatcccttccagttttcatccattagggggaaaaaaaaaggaaacagaaaaaaaaaaagaaacaattaccccatcagatgattttccccaacatacagatttcagaggtatccagagcagcaggaaggacttgaaagatacacctggaaaggttattctgtaaatggcaaattgagtgagattttgcctgtagaacatcaagttaataggcttggggagaaatgggatgcttggatctaattcacggctctaatataatagtcctgttgtttatgggacatctgatatcacatgttgagaagccagacagctattccaggaaggctgtaatgaa

SEQ ID NO: 48451 - DNA, 1200 bp, Bovine  19866882121306
cacaccccaattaaaccttcattcatacattgttttcacaggaaacctttgtaccattgtacttttcatcttcaggtgacaaccacaccctttctcattgcttctatcctaggggatctaaactaattctaaacttgcactaaactcttaacatggggaaaaatttaggggaaggcacagtgcgtctgctcatttgtaacattcaaccttcaacgcaaatttccaaactcaccaggctacttggaccaactaaggctatgaacatcaaagtgatttgatggcatggtaaagaatcctcctgcaatacaggagatgcagaaaatctggtgttagattcctgggttgggaagatcgcctagaggaggaaatggcaacccactccagtattcttgcctgaaagatctcatggacagagggctacagtccatgggatcacaaagagtcggacacgactgagcactcacatgcaagcaggggattgatgatagacttctctgtgtggaggggctgacatgctatacaggaaaagaaatgaccgtgaaccacagcattaatgcccaaagaacaagagtgtatacgttgcagatgtttccatgggaaataagcaaggaaggccaggttcctacagtggtcttcatggtcttcataggtgggttataagtaaacttgacctcccccacccgcccaaaaaaagagtacagacttaaaacacctacggaggaggtgaagggccttgcagaacatgttaaggtaccatacaaagtggagacatgcatcctatgttaaatgattaatttgagtaaaacaaagaattcacagagaaaaagtggagtcacgggtgaaaaaatacatggagatccgctcagaaaggaccttgaaccccacggccaggcatcagatatgtttgtgcagtgaaggtgagaggcagtgtatgctcaggtcttgttttatgctgtctattatattgtaaaccagagcagactgtttcttattattacatttgtaaatatacccagaggctcttaaagccacaggaacatccagattaaattaaaaagctttgacctctttggatgagaggctctatataaatccaaggtattgatattcttattatggtggataaatgaaatgtgtgagtgaggctagctcagcagcagaatggtttccctgagattcataaaaaaagtaataataatg

SEQ ID NO: 48452 - DNA, 1802 bp, Bovine  19866880384295
tccaaccaaacccatgtccattgagtcagtgatgccatccaaccatctcatcctctgtcgtccccttctcctcctgccctcaatctttcccagcatcagggtcttttcaaaccagtcagttcttcacatcaggtggccaaagtattggagtttcagcttcaacatcagtccttccagtgagcaccctaatctgtctctatagatttgcttattctggacatttcatgtacatgcaatcatacagtgtgatattttgtgactgctttctttcactaatgtttccaaggtttatccatgttgtttcagtacttcactcctttttatggctgaatagcttcccatgtatggctgggtcacattttgtttacccatttttcagttgatggacatttagattacttctattttttggctattatgaataatgctgctacaaatttttgtgtacaagttttggtgtggacatgttttttatttggggttagactaggagtaaaatttctgggttgtgtggtaattctacgtttaaccttttgaggagcaggcagatggttttgcaaagtggttgcactattttatattctcatcagtagtgtatgaggttaataatttctccacatcctcacggacatttatcttttttattctagccatcccagtgggtatgaagtaatctctcattgtggtttcaacttgaatatctttgatggctaacgatgtctagtattttttcatgtgcctattggccatatttgtatcttttttggaaaaatgtatatatattctatttgttttttactctccagcctctggtccaaactgggcatacagctgggactcaataaacagaagtcacaaaccatttacagtagaatcatccagagctcccaggtccctactgagacctactgggtcaaactttccatgctcaggactctgaatccacatgtaaataaggtctggggaggtttccaccacacactgaaatttgattgaactaaattaattgaactaccttaaactgaactaaagattctttaaacatctgaaagccatgatatattcagaggtaaacctgagatctatgctgttctagaatgcaggtgtgggtctggtggacaacagtcacaggaagacatcacttcattatgtggttgactaagcttggcattacgttggtctatttgctatgaaagttgcagaagagagtctgactggctgagatgtagaacagaaggtggtctttgtagggaaagtacctggtagattctattaattttaaaatattctgtcctatgatgacatatcctggtatatgctatatctaaaatggaccaagtctctactgaagaagaatgtgtatgtttttcctccctctcggatgtatattctatgttttgcttttctctgagtcccccagacttatacaagctatctcactctagagaccataatacatgtcttatcttcctgttgtctgccacatttcttggttccaagcaacaaaataagagtttgttaagtgaagcccaaaaggaatttattacaaatttagtgggtgggtcacagagtcaccaggaatttcaggaagactggagcagggacaacctccttgctgacatcactggccctgggaactgcaccttgtggccactgccaacaccagaggtggctgtcctgaacccctgattcttgatgtattcttgatcagtgccttgttttaagtccagggcatcaggttgtagagctacaatgctcaactgatgaatggctgactcgactataagtgaatttaatggaca

SEQ ID NO: 48453 - DNA, 1595 bp, Bovine  19866880540987
ctctatatagtgacatgcaaagctctcccagcatatcttggcatatgaaaaaaaagcatgaaacaatagtgtataatatactagtttttatcagaaggggacaaaaataagaatctgtattccagatatgcctatatatgcacaaagcatctctggaaggatccacaggaaacaaacccattatatcttggggaagagaacgggaactcagaaaaaggggaacgaggatgagaggagacttttcacagcacagctttttatattttttgagccatataaatgtataatctattaaaattatattaaaatttcaaaattatgcaaatttttattctactccatgacatagtcatatttgctctaatttttttttaattacacatatattttcacaactgtaaaatgaaatccatatttaaagtcctgcttcatgggtcatctgggacatcatatgtgtggttcagtgtgaaaagtatgggttctggccatttaaatcttgcttaaatatttagccttcatttcatttggagaaccaacatcagcacacaaaaaatctgagaatgctactaaaaaatgctttctcaacagtttgggatttttatctacaggctggggtttctaacggggggaaagattaaccccagcatcttagagctcttatgcccaaaatcaataccaatctatctttggtaattaaaaaaaagccaccacactgagatggctcccagagtgcaaagctcacagacttctgcccattcgtcaacgctagtgaatccagcggcagccaaaccccaaaaccaaacctctgcttcacggcgcaagtaactgaacttcaaactcttcagctattttctacacgtatttaaaagattggtgattattttttaaattaatcagtctggcttaagtcaatttcctattcccttaatggaaaaaaataattaggcttcttttggttatacttccacacttttattagaatgcttttcatatattatatgtgaaaaaatacagcatttcttttttatatgaaagatatgggctaaaaataaataaaatacaactcagatataactgatggaacaagcaaatgcagcatgactaatgtcaataaaaggtacaatacgtacctagtgcattttgtcccagaaaagatattctaaggacaagttttgcatcgttgtttgcctcccaggagtagtttaataaaccaacagtgctataaatgtctcccaaatcctcccaaactgaaattttatttctaggtgtaaataaggccagagttaaaaggacaaacagcgtgcagagatgaagcactggagcatgaccagcagggagtcatctgctgctgctttcatcctcgctgcttccatttcagaaggctgttctctctgggatcccttcagacaaacaaacagagagtggggaccacgaggacttaaaactctactgcaatctcctgacgaactgttgggatattcatgaggggcagaatgactccacctttagattttatatcagctgtaataatgagttatgaataattgatctctaggtagtaaattattcaggcaagcacacagtttccaaggaat

SEQ ID NO: 48454 - DNA, 1055 bp, Bovine  19866880545513
taattttatttctaactttcaggtctgcaattgaagagggtaaagggatttataataacattaaaaattttgttagattccagctgagcacgtaagtttgtaagaaattgtgacaaacttgtgggtcttacagataaattattcaaaaagtagaattgaaacaaaagcctataagcttctggctctgattctcatatgtaagttttccattgtgaaaactggattctatcctaaaactaaacatggcatgataattataattactaaatatagtaaatataaagctaaatataattacttgtgtatatcatcatcaaaatatattaattgttgtggcttatttaataccttctgaagtaactaagaaaggggtgtcaaattttaatttttcttcttggtatctttttccaaaagcagaagggcttttattgtagtctattacaaaacacagttataaaaatatcattgaaactcttaactgttatctgaactcagttaaaaaaatcttcctctttgttgttgttatctaaacactttgcaaatcctttattaaattgctgtggatcataagggctaactctttagatcataagggctaaatagtcacactaatgaagcagtagtttacttggaaatataggcttcctttaaaagaacagtagtaacatgagagttttaaatgataagaaagtgatttcataaaattagcaagaattatacaatgttgatacatttttaaaaataactctttctttcgataggagtatagcagcattaactttaatctcactggctacattaatgaactttccccaatcctctcaatgccatgcagattttgtggatcaatattattatggatggacctccagctcagaggtaagaatttcctcatttgtaaactagaaggacaaggatagccttatatcctgatagttaagctctaagacttcattcccagtagcatcggaaatctctgcagcatcatgtttgttttaagttgtgtgatgtgagcgtatcatttactcttctgggatgctcattcatgcattagg

SEQ ID NO: 48455 - DNA, 1270 bp, Bovine  19866880847614
tcttctgcagcaccacagttcaaaagcatcaatgcctcaatttggtgctcagccttgtttatggtccaattctcacatccatacatgactactggaaaaaccatagatttgactatatgaacctttgctggattttcatatctgttttgcatttagactatggtgatgttacatgtcacatagtgtctaaaagactccactgtgtacacctgagtgtattagaatgaaaaaggaaaataacatctttctattgttatgaagttagttctggaatcccttgaaagtgtctcaggtactcccagagtcccttgaccactctgagagctgttcctctgggcatgaaaggagacactgaaagagccagcattaaatattcctgggtctcttgaataatttctccagttgtactgccctattaaataattttttaataagctagaaaaaaagatagttaagcagcaggagaccttttcatgaataaggtgctctaaggtaaaagctctatttgaatttcatgggtgtgagatcattaataagcaaaagtaatgctgccagtgttattgtaatagtcataaaaatctgcagtcttactgagatgatgcacttttatgcgttaattgacatcattttatgtactgagtggatgcaagatcttgaaactgtttgaggggcctcctgcagggttaattgtgcaacacattcactcactacatatttcctccaaagaacctgggagtttctaaatcagtcacccaaactctgggctcctgcattctctatgcaaacagtttttcatcactgaaaaatcccaaatatgatgcaaatcatctgattaattattttgtgttactcttcaacttttcagaaaaatagtccttagagagctgtagcatcagcataatgcagtcaatgctttagagcaggttgatttctggctctcatcgtcatggagataaaaccttcagacacagggagttattgtgatggtaaaccatgctctttccctggtggcatggatttttgcagcttgtcttttgatgaatttttctatgtcactgttgataaattacatgtatagggatctctgttttaatttatctagctatattcttaaacgaatacatttctattttgttttaccttcgggaagatataagattatttttagttaaatggcttgtgaaaaattagatgcatttgacaaaggtacttaatgtattgatggaataaatacaattctagttttctagttgaatgcacaacaaaggca

SEQ ID NO: 48456 - DNA, 1377 bp, Bovine  19866880873716
ttcaggtcctgtgagattctggccatcttacataattagggtttgggagctgaaagggaaaagggaggagagagagtgggtgcacactggtttgccccaattgtgataatgaagttgacgttctggggtaagtgattcacgtcttcctgaggctgcatgtattagcaggaaagaaaccatgagctttttatcttggatgtaatacttaggaatgagggatgactaataaatacaataccttaggatgagtagggtgcaaggaaaccctccacttcaggagccaaacaagcctgccttgaagactgaaccaccaagaagcattcagaaggaagacaacaacacacaaaaagcctttttttaaaatcctttttttcttacattactgttgtttgaaagaaagcaaaagtgatttatttaaaatatgttgacaggagaagagtatagataaattactttagtatatttattacgttttcagactatttaaattctttccttataccactctgttgttccagtgtattgctttggtggatttgtgagtagagaggctaatggttttgctaacattgaataatacccccaggtaaatagggaatattattctttataaatgtatgagatgtgggtagggatatctaagctattttaataaataatattttttaatgtatttgaatatgctggtccctttaacattgtcattgctgactacttcaagttttaaaaacacaagagtgtgtaagcctattattttaaatgtgatttttgtctaatttattcaataaactggagaaggaaatggcaatccactccagtattcttgcctggagaatttcttggacagaggagcctggtgggccacagtccatagggtcgcaaagagtcggacacgactgaagtgacttagcatgcacatatgaagtctattgggaacataaaatcctaacatcccaccaaaatataaaagacaactgcagatgaaatactttctggatgatgtgtaattttatactttctttactgctatctcccttcatcatattttattgctcttcattcctttccgaaggaatatatcctaatcttcctaataaatctctaatcttcgaagtgaaacctttcttctccctgaagaattattaaagatttgctgatgatgaactctctgtttttgttacctaaaaatgtaattatttcacttaaattcttgaaggatatatttactagcaacaaattttaaatgactgtggttttgtttaactgcattaaagatattgtttaactgtcttttatcatccatattgccataagaagtcagctaacagtctaataagtcatgcttttgttttctctagctattcttagacttctttt

SEQ ID NO: 48457 - DNA, 763 bp, Bovine  19866881073647
taaagaaaaaactatcatttaagggaggtaacacaaattcttgataagaattataaactgagtttatttgagctctggggcctcctcgttctccaaggtctccaccatcaacagctcaaacggattgcttccttcatgccaactcctggcgttcagggtggtacccactctgttctctgaccagctgatacctgatttcttctgctttcttctttttgaatttaatttaccctttggtaggaatagttcagcaggggcacaggatcttgtggcactgaacagatgttcgtagagttgctgggcctcaggacacaagcgcaggaggctctccaccgaggccgatgtcagtagttgtcggcacagaccatgcaccaggctgccactgtacagtctgctcagggaagaggagagggtatcattacagtcgaggctcctgcgctgggacagctgtcactaacgtggcttcaacagatgcatcaaatactgagaacactgcttctataaaatcattattacttactcaaggataatctgtttcttgaaagaaggaactgaattgttacaaagattacttcttggctggtaatacttagaactttttatctacaaagtaaatgatgggtgcttgctggttctgcaactggccccaatttgagcaggcctcttaacacttcaaagaaaaggagttaaaatgcctctgattaaacacacaggtaggctgttgaatacaagaaaatttaatttcatcatttgtgaggtcatt

SEQ ID NO: 48458 - DNA, 1273 bp, Bovine  19866881119100
ttgacagaaatgaggtgggaagcagctggaagcaaatggtaaagaattcgtcaaaaggaaagaaatttcctgagtactaactctttgtggctcactacacgggctcatgatgcaacacaaaaatgaattagaaaaagatcagtcccacatgctgagagtctaagatggattatactatgtataatgtgctaagtgtcacccagctgaaacgctatgagactcagggattgaatgaggggtgattttcagccaggagataacaggagtctttgtagagggggtggcatttcacaggacctgggagaatgggtgggaagtgaaaacttggagccaggaggaaggatgttgtgaaagggcagagataaagaagtgtgagactgtggagaggaggcaggggacagcaggtagtcccatttcccgggctggaagagaataaagacaccgatatttgaaatatcctgtcacttttgtagtttgggtactattccccattgaagatttggttacatcttgacaggaacttgtgagaatcaggttatttgctttttacattcataactggtcttccctggtggttccatgataaagaatctgcctgcaatgtaggagactcaggttcaatccctaggccaggaagatcccctagaaaaggaaatggcaacccactccagtattcttacctgggaaattccatggacagagaagcctggcaggctatagtccctggggtcacaaacagccaaacaccatgttgaactaagcaacaacacaacactcataacctgatgtgacgagtccaaagctctgggtggtgaatataaggggcctcgtgaatgcatttatatgtatttcagtcttgaaaggcctcagattaaattacagaggaggaaacttggagattaaaaaacaccagctatttcaatggtgataacattccctatgaggtgcaagtctggccatctgccatttccaatattattactttacctcaataaaaagaggataataccaggcttctgtgagttaagatgaagtttgggtgtgaagatgagaaatatctcggttagcaaggagaaacagcgacccacacgtcgtcatccctccgagtcacaagctgacagctcagcaggtggagccaggaagccccgcagctgttccctggctgctggccaaggccattaccatggcaacgcccctggggtggggaggggcagcttaacctgcggaaaccaccagtatttaaaaagtaacacaaatgatcctggattggatc

SEQ ID NO: 48459 - DNA, 751 bp, Bovine  19866881357159
aaattaaggagcttcagtaacttgatgtttcaaatccctttgcccgaggtggtagcaaattgaaaccataaaaggttaaacctctacaaacctctacaaaccataaaaatttaaacctctacaaagctacaaagcttacagatctgcagggtagctctgcagttgcactgtaagtatataaagaaatttatctttcaagcatttagtgacatttatgcttatgaacattcagattaagcataaatggctatcacatattgtttatttaacaggaactggcagagtatctattgaaaagttgacattgtggagtcttggaatgattgaaaataagccagaatttactttcttgagatgtacataagaactagagaatgtgtgtttcatatttctctctcctgcctgattcagagttcctatgccataacttacaagagcctagaatactattttatgtcagaatagccatgtgcagctgtgcaggctgttactgcacaactccagagggcaccactgatgagaccaaatctataattttgctcacggaactgtatttaattttgtgaggacccaatgagagtgacagtccctcccagagctgtgcaaggctgtgaagtaagaactttagccattaacagcttgatcttcaaggccaaattacacaaatatgcttctctatctcccagtccagtgggtttggcaactgtgctggggtttggcttccatatccacattcaaactgagggaactg

SEQ ID NO: 48460 - DNA, 1049 bp, Bovine  19866881427327
cattctcataacaccaagggctagagtcactgtgaccacaatgggaagaccttcaggaattgctgctacagccaaactgtagccaacaaagacacagcatttaagtataaattcagtagtacccataacaataatttcaattagctgttacttagagactaaataatgtaaaatcaatgctgtcaaacccataaaaggccttacttagtatgtggaaaaattgattaacatttattggctacctacaagctaccagattaagcacagtgattaaagaatatacattcttacttcacactgcctagatttctactccaagcttcaatttttaccttaagctattatgctaccacccctgtagtttagtttcctcatccatatatatagtaacaggtgttcacacaaaaacttgcacatgaatgttcaaagcaccattattcatactcaaaagatggaaagagcccaaatgttcaacaattgatgaatgttaaattgtggtgtatgcccgtacaaggaagcacataaaaaagaatagagtatgattcatgctaaaaatggaaaaaccttgaaaacatcatactaaggaaagcagcaggacacatgttgcaagatttcacttatatgagatgtcaggaataagcaaatccaaaaagacagaaatctgtttagtggctaccagaaggcaaggagagggcagaatggggaatgaacaggcacagggttttctttcaggggtgatttaaaagttccaacactagacgttggtgatggtggtaatgatgttggtgatggtggtaacaatatgaatgtacttaacaccactgtactgcatactttaaaagggagtattttactggtatgtgcattttatcacaacaaaaaattacttatttctcttcataatattaaaaaaaaaaaattaaaattaaaactccacttgtcccattcccggtattaccccctgactctggcacagatgaggacaggtaggtacacatccatccttcactctaacactgctccctgcacccacctctactgctcaattt

SEQ ID NO: 48461 - DNA, 2915 bp, Bovine  19866880420967
tgtcacagaatgagtttcatcatgtccaggtccatcagtttttctttggtcgtggagggtgctggttggtgcccatggtcattgagaagcatggtactcagatgcagcagttggaagtgggtcagcaacgtgttgggtcatagagagtcactttggttggctgactccccagtgaggtgcccacagctgtgaatggaaagttttcatctgccagagagaagctgttcagcctaagggacccatagtgatgatataaacgataactaaccaagctttgtctggaggcttccagactttgtcatttgttcagggaaagtcctgggccacttccacctatttccagtggattctcagacctgttccccttgtttgaaaccctctgcaaaacctgctttaaggtcagggccctgcaccctctctccaacccctccaccctctctccatcccctccaccctcaaaatccaggtgactgtcatctggtttcccctggcttacagtttgaagatcttttccttctcaaaggcactttcttttctcaatacaacctacttcaaaataagcatttttgcttattttattattttgcatgtttctcttgtaagtatcgcaaaaggattaatagcttgagacaatatatactagccttttttgattctctcaggagcagccttggaacatatgtagagaaagcattatgtctatttttaagagaaagaaatgagacgtgaggtgatttgatgaaggtctcaaagttagtacacggagctgagaaagcatgtttaatttcctggctcccgatccagcttttctgtcaccagcaaacattgccagttctggtccctgactcctactattgcgtttaccacatttttggacatctgaggctgtgtttgcaactatgttaccatccatcccccttgattctccaaactctagaaattccagattattctcatttttgtgtgtgggagagaaagatggacagtttaagtccactcatatttcatattgtctttttataaaaagtatcttttaatctcactgacatccagatcaaactctgaaaggataggaaaggtcttgcttatggaattcaacctaaggggaaagtaaaaatgggtgaattgctgagcaccagtgatatccatctatacccaagaaagagggtcccatccctggctaacgccacctctgcactcagccacagtgccactctgcgaagacacagatgagaaatacaaacgttggttgcaaagggtttcatataaccagtgacaggctagttgattaagttgggtccagaatttcgaaatgctatatctcatagtccttcgaaaaagaagatgcaaatgtacagctataaaagaagaaacagttcagaatggttggaataacctcctgaaacttttcatatgggcaggtaccttctgtgtgtgcatgtctactgacagtctgctgacatggttttccaggaggccatgtttgcacattaggagccctcggagaagacttttattcttcttattcactattatttgctgaaaatatgctaggattattttaaatcaaaggcagtgtgtttgttactcaccatttctggtacataaaggactcaaagtatgagacaactgtcttaagatttttcagtgactgtcatgcttgtctagcttattttgtgggaactcagggtactggattagaactcctggatagaagactcaggcaggtggatttttataaaacataagaataaaatttgagaactttctgaagattggatgcttgagttcccaagctcagcaggtgttcaaacagagactggaagaccttttggcatttgttatcgcgatggaattcaattcttaaatgggcaaacgaaccacatactctctaagacgtcctccagctttgaagtgaggtgatcctgtgttgtcagttggaagttagactttggaatttgaccattgcatcagtgaccatttagcagccatcaaatagggcaccatgatgtaagattccactgcagaattacaggtcaccatatatccattgtctacaggaaaggggaccatggacaaccctgggcatagcgctcctcagtctaatagaggcagagatggtgcatggattccttagaataccttcagatttttttctctaatttctttgctggtaccattcagagtttccattcagaatatactgttcagagtatcttctccatactatacaaaagcacattgcaaatagaaatcaattgagaaaggtttccttccttttgcagggctctggcatcttagatccctctctttaccctcctctttcacctccaggctctgaactaactcttgggcagctgagaaatgaattgatagctgaaaaaggcttaatttagtaccccttgagaggtctttgcattttcatagtgagttctggatgatcaagacaaaatgaaacaaacctctaacacttagtagaaattgaccttgggactggcagaaaggtttttggtggagggagtggaagggagaagagccttcctggcatatagatcatgatccaacctatccacttacaaggcctgctctgataggaattcactgaaatgtgttaactggaatggaatttactcactactgaaattgggtcgaaaggtaatttgtgccttttccatgactgccacgtctcctctgacaaaaccttctctgatccctacaaagaaaaccttattcaatgagacatataaagataccaaattcactctcatgaaatgacctccataaatcaactgaagcatcttcagtgatttatactttgagaggccagagaacatttataatctggaaacacaggagggcttttagagggttttagtggcagttcttctggtgcatattagactaaagcatactag

SEQ ID NO: 48462 - DNA, 1016 bp, Bovine  19866880526399
ccagaaaacaaatttcctagagttaactgtaggacctgtcagaatatcaagcaatgcacgtagacatgataaccatcgcataaaatatgccatgtcattaacgggggcataaaagccagccatttgcctaaaagccttccagccattttggtgtttttatgttcaaacacatggatggtaccccataaatacctgacctgtaaataaaaacaatgctaaagccaaacaaaatagctgggattatctgataataaaatggattgattttacttttgccttttttctttctttttcttttttggtaaatgccaggaggtcttgcctgtgttgtgatttcactgtttccaaggcaaccaccaaatctggtttcaagcagaagcaaagcacagaaatacaaagaagctcaaggtctaataaaaataaataagtggcatgaattaaatccatgctgtttttcttttcaaccaaatgggtgatccacagaatccactcagacttgtccagatgggaaaacattgttgctcccaaaacctgtgataagaaactagtgaacccctagtatatgactgcacacaaatatgaagacatactctcactatgagttactttcaagtttcacctctgaaatgcttccagcaaatatgctacatccaggcatccctctgccgtgaccatgtacgtgagcatgctaagtcgcttcagtcatatgcaactctttgcaaccctgtggactgtagcccaccaggctaccttgtccatgggattctccaggcaagaataatggagtgggttgccatttccttctcctggggatctttccaacccaggaactgtacccatgtctcctgcattggcaggcaggttctttaccactggtgccacctgggaagcccatgaccacatctgggttctgtctactgggttaaagccagagctggttcctgacaatgcccatctggagcagctgccaccatcacacttactcgaacaacatccagctccttgttcctctgcat

SEQ ID NO: 48463 - DNA, 1801 bp, Bovine  19866880648820
cagaagtgagggaatgcaaagacaaaagcattgtcagtggttgataagtggccccccccaactggtaagtgaacacatttccaatgtcctcatccaatcgtctgttggccaggcccctctacaattccaggcccttcaaaatctcagatctctgggaaggagaaggaaagggtgatattcgtgtgagaaagaaacgtctgacattgtctcctccacattatcagcaacaattataggcctagtgggaggcaagaaccgtcttaaatggactcttttattttgtatatttattcccttccttgctccccaaattattcaggacaattttgaaaaatattaggattttggaatgtacccaatatggattaaggctgtccttgctggcgaaccacaaggttactttatctcagattaatcaattaaaaatctccctcaagtttgttctcttaagcatttctgagttttaaaacttcaagaataaattaaattctccataagacttttaaagcccaccataacaatgagaataaaagtgttaaacaggatgaagaatagattttgatgagaatgacaacctccagaagcagaggttccagcacatgggaagtgatattgtcaagatactttagagcgctcaggctagtttctattaatagaatactatttgttctcactatggatcccagggcctatggaacatggctgaaagacttagtatcagattttggctatgccttctagcctaacatatgacaagggtcttctgctacagcatgagagcccctcatttgacacaggttggctaagtatgccaagaactgcaccagaggctaggaagcagttgtcatgaactccagcttcaaaaaggcagtgaacttggccaaatccttatttgggtgtttctatctcaaaacagttataatggatttgccacaagatggcgctcatagaccacactgcacacctactgaccccgtcacagtttatctaggagggcaaatagcttcccaagagcttacttacaggtcttcactgtggacttctgtttcattacgttctaaattagtcatatctgagaatcttggcttggatagaaataatattattctactcatggtttgatgagtgctctaatagggtagatattgcaataacccgctatattcatgatgtcatgaggttctcgcctttgagtatgaatctgagaaggcatttgtgtagtattctgcatcccactgatttacaaaatcagtcattccacgaaaaatgaatcctgcttagacccaaacttcaatttttcctaaaagaaatacgtctgcacacagtacggaagaatcgtggtgttcttgagtcagtataaactacctccacacatgcttatttatctgacttctggttttaggaatctcaaagctaaaaaacatgctgaggcaagaaacaccgactaacacatttgaagtattccataacaactcaacgtgatctgactcctggtggatctatatttttctcattcttcttgctttgaccaaaagcacctaacccctcccaagtgagggcacagcacttaagatgacattcttctcttcctaggggtgagaggaagagaaagaattgatgtgaggcagccagagtttccctggatgatctgaagggaggaagtactttatggagagatttttcatttcccagttggttgaaagtcagccagggcgcccatcctgtagccatgccatcagcgggctggcagtactgctgcatgccccgcgtccttggagctgcctgccaaattctacagcag

SEQ ID NO: 48464 - DNA, 1783 bp, Bovine  19866880665804
aggagcctggtaggctgcagtccatggggttgcaaagagtcggacacaacccaaagcaaattccctttcacttttcactttcaagcattggagaaggaaatggcaacccactccagtgttcttgcctggagaatcccagggacggggaagcctggtgggctgacgtctatgcggtcacacagagtcggacacgactgaagtgacttagcagcagcagcagcataacaatatttacccagcttataaaatcactttggtattttcttccagttatagttggaggaaatatctagcttctacccaggagaaggtctaaattgaattatagaacaccttgagaattttgaaccaatttgatgtgatatttcatcactaccaaagtagtttaaattacattgttttgggaagaagcaaaatccaaaagagatctaagcatttagctcatgaaggaatgaggattatattaattgaagttggtattatgggcacatttagtgaaaattgcaagtaatttccttagagcagggaagatttcccatgactggatttcctcctaaagttagatttattcattccttaatccaactagctattagtgagaatcatccaggttctaagcacagaactggaagcccctgggatattaaaaaaaagtagatgatgatacttgggacttcttgctcttctaatacaatgggtcctaagttctatatgggcttccttgggggctcactggtaaacagtccacctgccaatgcaggaaacatgggttcgatccatgagtcaggaagatcccctggagaaggaaatggcaatactcgagtgggtactcttacccgggaaatcccatggacagaggagcctggggggctacagttcatgaattctcaaaagagttgaacatgacagtggctaaaaacaacaggaacaacaagctcttatgcataagaatcaccagggtagcttgttaaaaatgcatacttcttgggcataccatagaaattctgattcatgacattggggctaaaaatcttcatcagtcactccagattatccaaaggcagatcgactaagaactgtgctatgaagcacattattttccagctggaacctgtaaggtagttggaaaagtaaaaaatatacatttcagaaggtcaagggtatggaatgacaactcaggatgttggatgccaaggcagagacaggcaatcagaatttgctgctttgaaaggcagatgatcctgacatttgctgggaagctgtgattacaggtaactagaactagacaaataaacagtcccaattagagcatataataatgccacaagtcaggacaaagccaataattgagactaagcagaaagcctcaggaaccaagggcaatcaagaattacagactaaaaaaaaaaaaaaaaacctacagtaagtcccctatatatgaaagagttctgttctgagactgtaagtccaacaaagttagcccaggtactgtagaaatagctaacagacactggctcagttagtaaagaatccacccgcaatgcgggagacctggattctttccctgggttgggaagatcccctggaggaggaaatgcctacccactccagtattctggcctggagaattccgtggactgtgtagttcatggggtcacaaagagttggacacgactgagcttctttcacctttttcactgtagaaataaagagatggtttgggtggtacccagaagttccttacaggcttcccattgggaaagaaagcagttccagggggatg

SEQ ID NO: 48465 - DNA, 884 bp, Bovine  19866880675462
atttgtcagtaactgcagttcctttcagatgcctgttgcatctctctaaaggagtgtggcagaacaaatttaccatttgttccttcattttgtgtgtcttgcatctgtttcatttgatcttacacatttaaggccagtaatgtcctttgagactttattttctagatgagaacaatgagggtctaagatttgggagggaatcagagggaagacaacatcaatctggaaacaaagctttgacccgactagagtaaaacagtaactcttggcacccgcatttagagcccttccttgaataagtttttttccagagctatttctcattatcactgtgccttccagctccccagcagccggtttggaatttgcctaaattcaaatttacaacatatggtatttacatcgaatctgtgaggtactcagtaatgtggcatgctgtcagaatcggaaacaattctactttccaggacctgtaatcacccaatttgaaattctccgtactggcaatatgttgaagagtgtgtagtgtgcacagaggtgaaaatggaaatttactacaggaatcctcaatttatgatatgtcataatcatgtacctgataatgcccttaaaggatactgaaagttgcccttttttcatctctacctaccatctctatttgatttccatagtctttcatttccacagaagttcacgctcacctctgttctctccgatgcagaatgattgttgttttcttatagcccagagcctttttgctgagatgagtatacaaacctgataccacttgacaaaaggggtggtaaggtatggagctgtgatggagttctatcttattctttcataaatcaactgcgggggtccgagccaaattgtagacccaa

SEQ ID NO: 48466 - DNA, 1707 bp, Bovine  19866880695692
tttggactctgtcttgtgggctgctgagagcaatgagcgccgtcaactacaaactgacacttgccatctacctctataagggttaaagcatgtgctctgaccttcaacagcctctgaaaggagttcagggtggagcgcagaaatgaggcattctgtgcttgggatggggtgggggaactggcaggacagatcttcagataggtattttgaggatctcattttataggtccaattcttatgtctcctcatatctagaaaagcactaaaatccttcatggtgatgattgtttctcatcactggcaaaaagcttcatgagacttagcagaaaccttctgtacatgtgcttaactgtatgtatttcctcctttgccagaatcagtgtatactgaccttcacccctgcctctttggagcagtctctcagaagtacttgaggcaccatttcccaggctgcagtcctcattttgccccaaataaaacggcacgtaactcacattgtacatttttttttaagtcaacagtgctttttagaaaagagtgagttgagtaaacagattttaggaaaatggttttgcctgtagtgtgtagatagaatgaagtgtgtgggtatgtgtgtgtgtgcaggtgtatgctcagaggaaggctggaggcaaggagattagttattatactcttacaaagaattgaaggcctggattaagtgaagcggatgggaatggaaagaaagtgtctggtgtatggcaaaacattatcaggacctcaataaggccaaccaattgttaaaagagacatgcagtttcgctcataaaatactagaacccaaggtgataggggctgatgtagtaatttaagatatcacgcaaattttattcatggatttctcttgcggtaactatttacaattaaacagggtctctttatttttgaattcgcatgtttctcttcctgcttgttacttcaagtcctcctccccacaattcgcttttatttgttctccagttaatctctactatgtttttgcaggaggaaatttagggttgcaaaacgccaaagacgtatgatttcaaagatgagttttctcccttgaaaacagatatccgcctagaaaggggaggcacgtggccaactcttgcctttcagcacgtctatgtgaccttcaaaactccttaggacacgccggtttgcggcggggctgcatccccgtcagactcaggttggcagaatctcccggggctgccgggtgtgcacggcttgcggttccgaagctagagttcacagaacaatacaaagacacggacaaaagccaaaccacagaaccccatgccttaccacaatgggctgatgggtgaagtcgcggaagaaaggttctgctcttgcccttttaaaattccagtgcagcaaacacacacccgcgcgctcgcgcgcgcgcacacacacacacatacacacacgcatacacgccggatcgggttttcccactccctgctactctgcaccagtgtccttccccgagtcctgattcatgaaccgtgccacctttgtctcattttaaactgtgcagactattttcatcctcccacccccctccccggttccccctctcccttcctccactggaaagctctgatgtaaggcgctcgctaggtgggagagagcttctttccatcggctcgggtcggcgagatcccgagagcccccctccgcggg

SEQ ID NO: 48467 - DNA, 1620 bp, Bovine  19866880719800
catggcccagattcacacgcgcccctgcacgggttgatgcacattctcctgactccagctgcgtctcctgttttacagcacagaccagcccaagccccatcactgctctcattcacataaccagttctccttcagacaaaccactctttaactgcacctttgaatatttaattattcaaattcccagataatgatgcagtcatttcatcatcatcatgcaatatgtataactgtatcatttgtatctgtctttctgggaaagaagcagaagagattgtattattctaatgtcttgttcttggcatctgaccaagcctgagaccaaatgagcagtctgttggtcaaaaatatttcatgtgtaactacgtggtgaacagcttgcagtgagctttgggggagtcaaggggaaaggagcagtggatccgcacctttagcgcttaaattctaatgaacaccagggaactcacacacgtggacagcagcaaggaaaggacagagacacgaacaagcaccagcgaatgctgggaatggaaaacaaaggagcggtttgtttcagaaggctttgtagaatatggcgttatatcgctttaaggagaaaaatctaggttgttagggagaggacatcacatcaaagggaaacaggccagagctaaggagatggcccatactggtcacatggaagcaaaggcaatatcctgataagaggagaccacagaaaaggctacacggagtagagaaaggtatctcattttcttccattttacaaacactcacactgctgagattgaggctgatgtcaaaggatctgagggaaggataaactgggagattgggactgacatacaactaaataacgaataaggacctattatatagcccaggaaactctactcaaaactttgtaatggcctacgtgggaaaagaattgaaaaaagagaggatatatgtataacattttgtgaaacagctgaaacgaacacaacattgtaaataaactatatcccaatgaaaaaaaaattcttaagaccttaaaaagcaaagaaacaacaaaacaaggccgggggggaaagttcattcaccgcatatccttgggtctaggtggaggacagggtagtaagcagggcagacgaggggtctcagtttcagggaaaaagtgttaggatggacaaaagataaggctgtgggccaacaagatacttgaagaagtaacactgaattgagaaactgcaggacagaaagaggacctcaaggaagggtgaccagccctcctggtttgcctacaacagtcttggatttagcacctaacatgctaccctcaccctgggaaacccgtcagctcccagaactgctggtcaccccacttcacaaggtagtaaatccaagcaagtgtatggtattatgataatgaagcaaggacggcatgaaagtctgaggatgaatcacgactcgaatcgcagtcacgtgttacatgggacatacagtttggctcggaaggaagacactctagaaactggaaacaggggacaccagggattcgagagcaggaaggagactgggtgcttttcctctggaccttcactattgacaggtatcatctcttcatccttacctgctttctca

SEQ ID NO: 48468 - DNA, 1360 bp, Bovine  19866880778967
ctgcacagcagaaacaaacacaacattgtaaacaaattcaaactaatttttttaattaaaaaaaaaaattaccttggaagtgtatgtcaacaacacaaatcctaagccccatcccaaactagtgaactgaagtttctgagaggaaggctgggaaacatacatacccatctagtgttaactgcatcccaccctgcaaaacgcaaccaatttaagatgctgagattgttcccagaaaatatgtgactctgtgtaaataactagatgagcctttccccagctacattctgcagaataccagttcttcaaatagttaacaggcattcactgggggagcaaaaaatgggttctgaggtcaaatgacttagggatatctttgggttaaataagctgtaactggtttatttattacagaatgcaagagatttgaaaggcctactgtgtgctgtgaaagggcactgaatgtggtcattaccaaacttacttgataactagagaccaacccctttttctttctatatcaatggacatactaaatgaataggtaaaaactcctgacaaaattaagagagggagatacgctgggaaaaaaaaaattatgatcttctactgcttaacagaaaaagaagcatatataacagaataagattttaaaaatggtttttccttctgatgactatttaagcaatatcccaaatgcccttcttggtagtctggttgtcaccaggaaaaataactcatttactgaggaagaggatgtttaaaaatcaatttgaagatttctttgctaaggaggtcctcaagaccaaagctagcagactatggcgtgtttcctgggctcgagatggagacggctagaacataattactgtgcagccagctcctggtctccgggcatcctggatctccggaacaaaactatttcacaaccttgggatgaagccaagtaattttcttagccaggaatcaagatcaagcgctggaagactgaagccctcagaatctggacactgtttttaacttgagctccttggggttaattcaaaaggcatcagaagaaacggcctagttttccaatctcagtagcatacaactaaccagtcagtcacccaagccagagtggaatggttcatcccagactctgctcccttcctaagctaatgagttattaaacctgctgcatttatgacttaaatatttctcagtcctcctcctcttctattcccactgctactgccctacttgaggcctccatgatctcacacctggactatttcaagagcttcctaattgaactctgcctgaattctctctcctcaaatccatccttctaccctgacctatgcacatcggcatcacacca

SEQ ID NO: 48469 - DNA, 1618 bp, Bovine  19866880782693
ggaaagaatcctcattgagcaagactgtcactaaagaggaaaagcttccctggaagaagcagaaggctgaacatactggggactgaaagggttaagaactcaaagtgacctacaaagctataaatattttacacattcatcacctttccatgtaggtttcccaactttccacaaataagatactaagcggtgcttaattcatagagcactgttgccatggtgcaggtccaatcatgttctatctagcttctcctggttatcctaaggcttcctcctacacatacacacaaagacactgttcactgaaggcagatgagattattttcaatctttttgccactgtaaaaatcatcttcttaccttctccaccaaagtaaaattccgttattctttaatattcccatctaaatccatgccttcttttgccctcttccaaataacagaaagcttcatctgctcataaaccaactacctagaaagatttatatttccagatgaaaatgagccaataattgcttctatcctttcagctgagaaaacctcgtatgttgtccccctaaccccaaacgctaaagattaagaataaggggaatgtctatttgcttctacctattaaaggaataactagagtcttaccctgagaacaatcggttcgttcttgacctagcatcctatttatctttctattctcaaagctaattgctcatatgagcgtgccaatttgccttgattataggagtcttaataaatgaacgttgtttacatttcacaagtgtatttgaatttcactccaggaagccaagctcatcaagtctttctaagtggtaaaaccagagatcaaagcaaaaagcctgcattgaaccaacaaaaaattaggcttgagaatagaggcctaagcaaaaatacaattgatttattgattgctctatcccagtagtaaacctcagggtcactgttcactcttaagctagaatgtatagaactttctctgcaaattatcattatgatttgacagccatttcttaaatgcatagttaaataaatctaatattcaacaggctttgacccatctctcctatatttctcatcttggtgctttcagttgaatcaagtatctttaggagctttttttttttaaccctcctcaactttgcctaatttctctagattttcactgtggttttaactcttatgtttggtctcttgggcagggagggagaggagaaaaactactctggcacgtggctctcaaccacagctgcacactcacatctaaggagctttaaaaattctgacacccaggtcacactccagaggaactgatcagaatctctgggggtgggacccgggcacctgtctttttgagggtcccaggtgatgctgactatagccaagtttgaaaagcaccactgtggcttgtcaatccctttgtcacctacttcaaataaagtactcagccaaacttcacagggaaaagaaacaccaaggaagagagggcaggttcctgagcaaagcctcaactcaaggcaggacctgagagaggtgactgaccagcaccagacatggggccaaaacatgaacaacttgacacctttcccaaagccaacaagatttaagg

SEQ ID NO: 48470 - DNA, 716 bp, Bovine  19866880825527
atgaaatgctctgaagagactaatagcattctatgaaggcttataaattggcagtgaatttatgatgactttcagagagcatttcaggatagggtgatgagacaagaagccaaatgctcctgtctgagaagtagactggaaatgaggaagtaaagtcaatgcatagaaggctgctcctcccagtacaggaaggagacagagctccagcaggagcagtagtcatacagcggaagtgtttgtttttattcctgctttgatttcagaatgggcttccccggtggtgcagtggtaaggaatctgtctgccagtgcaggagacacggattccacccctgggtcggcaagatcctctggagaagggaatggcaacccactccagtattcctgcctggaaatcccatgggcagaggagtctggcaggctacagtccatggagtcacaaagactcggacacgactgagcgactaagctcagcacagtacagcttagttgatttacaatgttgtgttagtttctggtgaactgcaaagtgattcagttttatattatatactatatatcgttccctgtgctatacagtaggatagtgctgcttatctattcattttatatatagtggtttgcatctattaatcccaaactcttaatttatcatccccccgcccccgtcacctttcccctttggtaatcataaatttgttttctatgtctgtgagt

SEQ ID NO: 48471 - DNA, 1023 bp, Bovine  19866880859204
taagtggagcttatgtcacaaattgctgccattactttcaacccataagtaaaaagtggggacatcacggtgcaaggctgagatcaaaagtacccaaagcacagttggcgaacccaatactaactgtgagtattcaaaaacaatccacaattggtttgctacttggaaaaaaaaactaaatcgagacctcagaatcccactatacaccaaaattaattccagatgaataaaagttaattctttaaaaaagaagtcgctaaagctaaaacaagtcatgtgtatttttggggtccatctttagcaaagaccttttaacattcaaaataaagacaaaaaaatggtcagaaatttttaaatttttgattacgtaaaaacattgtacttctgtagctctaaaacgctgatctaaaaggaaagtgagaaaaacagtcaaaaacaaatcgttaccatctattacaggcgttggcaagctatagcccaaggaccagatccagcccgcagcttctttttgcacagcccatgagctaagaatggttttcacatttttaaatggtggggaaaaaaatcaagagcaagattaattcaggacatgtaaaaacgacatgaaattcacattcagcatccatattggagcacagccacactactgcttcgcccagcgtctgaggctatatctgccctgaaacagtggggctgagcagctgggactgaatctacaagccccacaaagtccaaagtatctactatctggccctctgcagaagtgtgctgacgtctcatctgttatacaaagaccttacgcataagaaaacaatgaggcccagtaaaataagtaggcgaaggagattttttttattatatttcttttaattttattttatccttttaatatatcttttatatacctttaatatatctcccagagtttgctcaagttcatgtcctttgagtcagtgatgctatctaatcatctcatcctctgtcgccctcttctcccttgccttcaatctttcccagcatcag

SEQ ID NO: 48472 - DNA, 1573 bp, Bovine  19866880902422
gtggcaggaaagaacgttcaggaatggagtgttattttgatatagtgattgcttttgtttggtggttgactgtgatatatctgattcacaaaataaactgacctaagttcattttaatggaataataatggaagccatggctgcagactaggtgtaagctccttccttaattaaaatctcagataggacaaggcggtgttttgtcttgcagtttaaagtttattgcaattgttggtattcacgttttcagaaagaaaaatgactactaagtaatagctacttcccaatggaagaaacatttcaaaatgacttcggctagattctctggccagtgacagaagcactctacttgtattttataagagccagaatcacaccagtattacatgctgttttgcttgactgtaaatatcgagggcaaagtacatgtttttggctcaaattcagtttgaagggcccattagctgactcttctacacaagctgctttgattggctgccagctggcctctgtcttgtttagacacatgatattacagattgcaattctctcattggtgctctcctctttacagatcttagaaaccaaccatacagacgagccgatgcggtgaggagaagtgttaggcggcgctttgatgaccagaacttgcgttctgttaatggtgccgaaatgaccatgtgaaccagagacctgcttgtgtgaatagagggtgtgcgtgaatgaagatgtccatgtgaactttctgtgctaccatttaactgcagccttgaacatagatcaaatattctaagggctcagatttagcaaacacataggaatttttaaatgatgggctctgctttcaacctttgttaacaagtgcctaaaagtggaagtacctgctcagattaatcaaagcaataggatttgatttgattagtatctttttacaccagtatgttattttttaaccaaaatataaatttcatattacattcattatctgccattgtgattgtcccatgatggcccaccctggtttcctgataagttgtaaataacatggaatgcatctgctgtgggcttcctttgctgtcttttaagaaagttaattttgttttagccatacctgtcaactttgtatttttaagggcttgcagcacggaaggaaaaagtcatgtgataaaactccttttgtctatacccaagccccagccaagtacaaataggatataactgcagtggcacagaagtcagtcaacttgtttcacattctgcttctgtgttggggcacgatgcctcatgagatattcaatggtatgaatgagaccatatgatggcatacagatgtgtacaagacttatttgcagtactgttcttcagctagaggcagcttttaaaaatacaaatgtttattaattaccactaaaattaacatctcagtagtcagtattaggatttctgaggaccactatgggtcaatcctgagaatagaaatcagtgccttgctagccaggggagaagttcactagctccatgaacaagcattcaagatttacttccgctagcagagtagtattagtaacctggc

SEQ ID NO: 48473 - DNA, 1830 bp, Bovine  19866880923710
gggtgcgtaagggtgcgtgctggagcaagaaaggtgccgtggggccgatgagaggctgagcgcccctggaccagagcactacccgcaagcagtacgagggaaggcgagccgaggcccaagggagccgagtttcctccccgtgcagcgtttagtctctccgccaaaaacctccgccaccttcacgtcacctctaaactagcgcgtgccttcgcagtcccaaagccgcacctcctctacgcccggtcctagcgcccgccaacacacattcccgaacctgtttgctttctcctatcttctctacaccagcactctcccccggcttccctcagtaacggaagctcagcgcctggcgccttcatctcccttaggcccaataccgccttccctttcacattgttcttcccgtccctaccacaacttccctctacgccgcggggcaggtctccacccccgccccaccctggcgcgcgccggccagctggtgcgtaaagagctcgaaccggctccgggcgacccctcctctagcttgccccgcccccttcctccgcctgtagtcccgcgcgcaagctactggctctggtcaccgctaacgctagaggctgcttaccccacccccatcccatcccacctctggcggcctcaggtttgtggggcataggtgattcggaaggggggcagaggttgaaggtggcaggcctccactggtccactccctacggggtgtggcagtctaagttcgagaagctgggacaccgttgtcttcccttccccggggaaagttggagtcttccctgcaggggaatccgcgcagaaacttcttccgtccccctcccccaactccatactgtcgacgctgagttaggctgaggctgggggcgaatcgccgaagagctgagagtcggaaacgcagtctgattggacagcagggaagcctgtcagcctactggccccgctgatcccgccccatagcgcagggcagcctttaacctttggccccagtgggcgccagccactcagatcgctttttgttggtatgtgtagcggcagtggccgccggcggagcagtctgagcccgacgatgaggccggggacgggagccgagcgtggaggcctcatggtgagtgaaatggagaaccatcctccctcgcggggtctcggggacggggagcggagattgtccggctcaagcctctgctccagctcttgggtctctgctgacggcttcctgaggagacggccctcggtaagggagcggtggggcagggggaaagcggcacaatgaaaaacggaatcagagagacaggaagcattctccaaaaggagaagaagatcagagtggacgaaggaagagctcgagatgctgggatttgttccgagggagagaaatggagagcggggatgcacaaaggaaaggaagtgggaccctggaagttttcagtaggttcggcctaggcagatgcgcggtggaggtgctgggccctgggcggggtgagcgttttggagaggtaggctgggttaagcagggagggggaggcggagacggagactttttccgtagactttgttaacagagtctgccagaatcttaactaatagtagtggtgttcgcagcggggggatcgctgggagaattgtcagcagataactacctggttttacgacctggaacaatggacacgtaaagaaaggagttgtcttataaaaagcgcattaaggtgcctaaattagttgtttacgtttagtgttcgtaaataacagagcttagtctttggggggggggtatttttttgcataagttattttagctgtgttagagattctattaggaaa

SEQ ID NO: 48474 - DNA, 1990 bp, Bovine  19866880943679
aggcagctttgtctagcagggggtgtcattttagctggggtagtctgttccccataaaaacaatcccagcgcagatttttccagtagccaagaacaataactcctgcttagagttttattagaatgctgaggaaaatcccagttctaaattctaactctgcaacccacttttgaaaactttatgcaagttattaaaccactccaagactcagtcttctcatctgtaaaatagtagtcacacaataaatagacattatcattcttgtttcctagtgctgatatttctactatgacttaagaaaaaagttaagagactctaatcattttcaactcacttataatatatatgcacaatagcccatcttgaaatgtatctgttttattgtatttactgcatagaagacatagttttccccccagttttattgagatataattgacatataacactgtggaagtttaaggtgtacaatgtgttgatttgatacatttatatactgaaaatgattatactgtaagtttgataactgcagtgagtccaaatccgtgcactctatgtactgctttgttttttgttttttaatttttacaatactgtgctggtttctgccgtacaacaatgtgaatcagccataactatatatatatatatcccctccctcctgagcacccctaccccatcccacgcaggtaggagcgccaaggtggactccctgtgctatacagcaacctctcatcaaccattcaccctacacatggtagtacatatatgttgatgctacttaaaaagtgccctttccagagaaaatgcatttgctaaccaaataatagtcaaattcctctgtgcaaatctactgggggaaaatctggaccttcaaaataaataaatacaggatgacaattttatatatacattcattgctttaaaaggagctaccttgaaatcctttaaaatgagagtttctcagaacaaagcttttgtccaaatttaggtatacctgcacaaaatccagagtaagagagaaagcaaacaatgtttctaaagaatatatgtaaccagttttgtgttagttccaggcaatgctttgctgaagtgtgatgtctgcggtagaccaatttaaggtgttagatgtctggactataaagtgattacgatgtgggaagtcagggaggaggcacttgttctgaaaacacgttgtggagaaggctaatgattatagttcacaagaaagcaggctgcccactggagcaatgagtcaaacagctaaaatacacaatccactgttgacactaggaaatggctaatttcctgaaactgcgttaatgacttttcaaatcctggcattcaatcatctgcacacacaagaagtgactcaaagactcctgcaagtccactttattttgaaatgtgaacaagaatttcaaaattacttaataaattctactactgccaaaaaatgtaaaagcgtatagtattctaagaatattggtagaaggaaaaataaagcactgtgatatttactttcataattacagtgtcattggaaggactgatgctaaagctgaatctccattactttggccacctgatgtgaagagatgactcattggaaaagaccccgatgctgggaaagattgaaggcagaaggagaacggggcggcagaggatgagatggttagatagtatcaccggctaaatggacatgaatctgagcaaactccaggagacggtgaaggaccagaggagcctggcatgctgcagtccatggggtcacaaagagtcagacacaactgaacaacaatgacaacaattcatagcatttactccggattttgttttttccttcattgatatccacatttctttgaaggtggaaatcattgctgctgactctcaaggtcctagagatagcagaggtccaatgtcaagagcccaaatttggcccatggacacgttctgctgatttggcaggggactagtttcttgcgt

SEQ ID NO: 48475 - DNA, 1341 bp, Bovine  19866880968517
atttactgtttttgaattctgatgtatttcacaatctgtgtgatgcctttgcacaagaagaagatagtgaagatatcagtaaaaacagtgctgctcatttctctgccatataacctataaagatatgggggtaaagctttcacttatttaaaaaaaaaaaaagaatcagagaggaacatcccggctggtggtgaagaatagagaacagctggcaaacttatcaaatagaacagtgtttattgtttgagctggtaaaaaaactcagtgttcatgtgtatatgtgcacagatgtatgtatgtgcacatgcatacacatgcacacatgtgagttggcctgaaaatgaacagactaagacagcctgtctctccccatgaggactgctcacaaaacccctcaggcatctctgaccttatttgctgatctgctagattgctgctctccacagtttaggagggatggaggttttggaatgaatccagggagcaactaaatgatttctttgaggaaaggtgagaaggttaagtatttcgttaaaaaagagagagaactaggggtgacccagtagtgatcccaaagggcacaggaagactgtcctttggaaatgtggtgggctgttctgtcttcatggaggctgaactcaacagttggctacaattagaaaggaatgatactttatagcaagactttccaaagagtgttgatatcattgaaatggctttccaagaaaggctgtagaattttctctccggagatcacttttgacaggctatttataaatggattgtttattcatgctttaaagttttaggaagcacttaccaaacatttgatacgtacctttccctgcagtagatactgtggaataggaatgaaaagatgaatgagacacagcccctgtacctaaaggattttctgatatagttacagagacatagatgtatacaattaatatggtgaaatggagcaaggaattagggtgtctgcagaatgcccatgtgtgctgagtatatgagataccgtgggtgtcacagcacatacagtttgtgtggcagagtgctccaggttactctcactggggttactcccagttttttcctcctctggggttcaaaggaaaatctgatcagagtggcttgttgacttctccttaagactgcccttattattgacttctccttaaaactgcagagtcttacaagacctggatcctaccagcttccagcctcatcctaggccagatcttagttctggaaacagatcttgaacataccactctcccacctgccacaggccctatgcacatgtgaacttctctgtgtgggggctctcccctctgccta

SEQ ID NO: 48476 - DNA, 805 bp, Bovine  19866880976403
ttgacagcaaataagctgtcattgggcaggaacagagtgatctgagtccgagtctatttaccaggcaaatagtaataccaggttgtaaacatatgtgcacaggtctgtctctgtgtcaggtactatagaatggctcactcctacatttattcccaatcatctcctcccctggcttctctatatagaggctgaaagcaaaatactcactttcccagactcacttgctgttaagggtagcctcttgacacagtactgaccagacatgtaggtgaaaatctctggggaacggtttcctaggaaagaaatgctaaaacttacttttgtcttgggttctaggtcccattttttaaatttagacaatgtacttttcacaacgcttgtctgaagttacttggaagaaaaaaaacttacatgatagctaaaggcaaatctctacattgtcacccaacatatctgtctgttcatgggctaatctgttgaccaccaggaatgatatcctgacaagctagcactgactccccttttaggtatgtgacagaagtcaccagatgaggacaaggccatcaccttttagaactgcaaactatacagctatgcagttgatgcactgcagctagaggacttaggttctagaactgactaccattagcgtatgctatagcagtgtcaaaaagcaggtggtgaaagaaccgtctcttcaacaaatggtgttgggacaactggatgcccatatgcaaaagaaagaagttggagtcctacctcacactatgcacaaaaattaaatcaaaatgggatcaatgaccta

SEQ ID NO: 48477 - DNA, 1105 bp, Bovine  19866880995596
cccatgcagtcttggctccttaaacaagcagtctgtcgatgagttgtggtggaacaaggacagcagcaagttcctcatttagaaagtttcttacctgttatcctcattctactaagcagggaaatacacagaaggcactcatacactttttgcccccagtcactcacacggaaacgttgtggttttcttagtggccgtatttgaaagctccttccttatgtgagatagtctaggcttaatgctgtagttcctttcaggcagcggatgtttctgatggaaaaacaagttttcactgtgtccttttcatggtagtgcgtgctaagtcactcagtcgtgttcaactctctgcaacccggaactgtagtccaccaggctcctctgtccatgggattttccaagcaagaatactggagtgcgttgccatttcctcctctagggagtcttcccaacctagggatcgaaccctcatctcctgcattggcaggcagattctttaccactgaaccacctgggaaagcccttttacggtacagcatatgataatctttgccaatgaatttttttttccctcaaacagatgggtcagagagtttctgaatgaagaaaacaaaggtctcgatgttctggtagaatatctatcatttgcgcagtatgcagtaacgtaagtaaaacctggcttgtttccttttaaattttatgtggtcacagaagatgcagctcagtggtaaaattagataccacactgaggggaaaaacccagaagcagatgtggtaaggcttaagaaggtttgtttctgttcaagtaactaaaagcaaatcacataattgttggtagaaatgcttttatggcaaaaataaaacgggagtaagatcacccttagaggagtccttatttcaaaagaagtgctttctttgatgctcaggtttcatatgttcatatggcagaatactctagcaattattggaagaggtattatgatatattattgagtgaataaagcaaggtacagaagagtgactccttttttattaaaaaaaaacttgtatgtgtatatttatatgtgctagtgaatacagagaaaattaatgcagaaatagatactaa

SEQ ID NO: 48478 - DNA, 1386 bp, Bovine  19866881024765
tagtctccaggctcctgtgtccaagggaacttcttgggcaagaatactggagtgggatgctgtgccctcctctaggggatcttccccgacccagggatggaacccattctctctttatatcccctacactggcaggcaggttctttaccactagctcctgggaagccctcattgaagttagtattcatgtattcaaaatgagaccaattcgaatggtgatgattttctagccatgctcggctatgtgagtgcagttgccccacaggcaaagagaactatacctggactggggttttgctcagcaagtattgtaagagttgaaatatactcaaaggaatgataataatgatcgctcatggaagtcacctataccaggtacagagggaagacatgagggatgtggggacagtaaaaaggtgtcagtggactgtagatcccagtggttatgaggactgctggagtcagagtgtgcaagggacaacacgagtcctgcaggcataagtgccgtggaaaatcagaaaagctacaattcatatgggccagaatagttgaggggaggcttctctgaaggatagggtttagtctaagaataaaggacatagaagagctcaagttgattagacaaaggatagaagatggaatatttcaaattaggggcatatctaagcaagggcatgaaacctgctctaaagatataagatttaggaaataggaaggaaaccagttttactaggatataaagtttggggtgcaaagttgatagggcatgaatttttatagtaagtactgcaagataagattcaggtacagaaatacaaggactatttccatcttctgaatattccaaacaaatttttattcctttgtttgcagttagtatgaataaggtttctgcaatttaaatggataatattgcccctgtttgaaaaccttgtcacactttatcagtaacttttcccctatttttaacaccttttattggctccatatggtgaatttatgtgtttgccttacagtgatcttagtgcagatagagttgactgaagcagagattcaatacacattcaaaacttctagaaacttaaccaaaaatatccaactaaatagatttacatgatgacctagagcaaggtggctggtgactgccactgccagttaaaaacaaccaaacacaaatgattaatataattaaaaccaactctccatgaaggaaagttacatggctcaaaatagcctggagttaaaactcccctttccgggtcctccccaccattctatgcaaaacaaagaactctcttacccaaagaaacaaatggacattaagggtggattacgtccagctcccagccagtccagcctctgggccgatctccagaattccttgcc

SEQ ID NO: 48479 - DNA, 1086 bp, Bovine  19866881027004
ctgtgatctgttatctaaagtgtgagcttctgtaatttttttcttttgcctctgtagcatgaatgtcaacatcatcattcaaaaaacaagaagcattctaagaaatctaaaaaacatcacaggaagcgctcccgctctcgatcagtaagaaagtttatttaaaatggtaccataagtatattgaagtatttgttagcatcattatgaataaaattgtttatgttgtgtaggggtcagattcagatgatgatgacagccattcaaagaaaaaaagacagcgatcagagtctcgttctgcttcagaacattcttctagtgctgaatctggtaaacataattttaacttgattaaagtcgttggcatttggatgtcctcaaattctgacacttttcttttcatgctgcttagagagaagttacaagaaatcaaaaaaacataagaagaaaagcaagaagagaagacataaatcagtaagcaaactcttgatttttatactgcacctaagcttttgcccttagctttctcagtggcagtagacatttctgcttggtcctatgcagagtttaggtgagcacctaaactcaagagtttcagagttgtggttcaccttaatcttgcaataaaatcctttggtgaacttgaaacaaataataataaacagcgttaggattcccactctggttttttatattaatcttagagaaagagccaagtgtgtgtgtgtatgtgtgtgtcacagctgtcttagagaaagagccaagtgtgtgtgtgtgtgtgtgtatgtgtctcatagctatcttagagaaagagccaagtgtatgtgtgtgtgtgtcgcatagctatcttagagaaacagccaagtgtgtgtgtgtgtgtctcagctatcttagagaaagagccaagtgtgtgtgtgtgtgtgttgtgtgtgtgtgtcatagctatcttagagaaagagccaagtgtgtgtgtgtgtgtctcatagctatcttagagaaagagccaagtgtgtgtgtgtgtctcatagctatcttagagaaagagccaagtgtgtgtgtgtgtactcatagctatcttagagaaagagc

SEQ ID NO: 48480 - DNA, 1272 bp, Bovine  19866881037961
gtgcaaagtaaatgaggcccaagtatctctgaattatttacacagagactctaagtgcctcaagggttctttgcaccagggcaatctagtttgcctcactgccttttttgctacttcagaaaacattgtattaaaatttgaagcttaaagcagtataaccttgttttagtacagtcccggccaggagttacattcaacagtgacagtttaatggaaaaacaaacaaacaaacaaaaaaacctacatcccaacagctaaaacttactacaataaaaacagactttattttccaaacttttccattggaaaaaaatctttctgtttctgacatatgagggaaaaaagggacaagtaggttgttgttgctaataaatgtagactgtatttcagaattttgcacataagccaaattgtccagattctttacattgctatattgaaagctaggcaccattcaaagtaatgtgaaatctttcaggccattggtattggataatatgatgactttttttttttttaatggaaatttattgcctcagaattctggaggctagaaatttaagatcaaggtatcaacaagattgcttccttttgaggaatttgagaaagactgtcttccatgcgtctctgctagtttcttggggtttttctggcaatctccagcattcctctctttagaagcatctctccagtctctgcatccatcttcacacaggttctcctctgtgtgtgcctgtctccaaatttccagtttttataaagacaccagtcgtattgaagtaacactcaccctaatgacctcattttaacttgatgatctctataaagaccctatctcaaaaatgaggttacattctgaggtaccagggggttatgacttcaacataggaatctggagggggatgcaattcaacccattacaggaaggaaatccgagaacatgttgtgagtcagaagttgaactaaacagcttctactaggtcctgctgactctttaaattaatacttctaatacaaatcatgcattaaacatcagtgattttgtgggaaataagaattttataagaattttatgctattatgtggagccctagaaaatagttaacatgatagacttgagctcatgatcccacacaccctgtcagtctattcggttaaaaaggagatcttttggtgattgacataaatttgtgtttattctgaataagcaaaacaaatcctgagattctggcacatacccttttcaatgaggatattttagagtgacatcaa

SEQ ID NO: 48481 - DNA, 860 bp, Bovine  19866881042110
caacttcagttataacaaggaaaacgaatcatcatatataagtaagatcaatttgagttaaagctttgaataaaagagaaaagaaaataagtgatcaagaggggcatggcaaacattttacctggaaactgattacataagagtggatttttatatctcctgaactatgtgttcagaggaaacgagagaacacaagcttccatttcttcagatgtgaccacagacacagttgaccacagaaacaactccttcatggagaaaacaggtatattattaacacaaacacaaacgcgctctgtggctcaactaggtaaaaagacgttaaattataaaaatgttaaagcaaacacttctggcctagagcaactttatagaacagtcgttaagatgattatcttccttccataatttcttccttacagctgtcactggtttcaacttgactgtggcaaacagaacaatctattttgcccttttgagcatatgcccatcacccttcggactcaggctcacttcctttctgtttaattctcctcaattagtagtgccatctattcagcaccacaggctgaacactggaagcctattcagagagcccttatttccaccctaaaaaagatgtcagcctgggcagagacctctgatgagggggggttaagatacacatgttgggcagcaggcatctcaaaaggagatgagaattctgcctgcttttcatcaaacctcttcttttttaattaagttaattaacccagaaattctcatcagtttatatcatctcaggcagcctgcccaagccctgggtacctggactaacctgtctcccgatgctttcatcagttaggagaaagtgtctctgt

SEQ ID NO: 48482 - DNA, 1274 bp, Bovine  19866881048123
acagggaatatcctattaactgcttcgtagggcagtgatagtctccaacctatggattcaggcccagacatgagatttgctatgaacaatgacctgtgagcagaaatgtgtgtcacttctggagagaagctttaagagtcagtaaattgcttcactgggatctctgttcactctatcacggggccagcaatgttccagataagacctgttccatccacccaggtctcagagtgcagatggcaggagaggagctacagcaaacctgcggtaagcaggaagcacaagtgagaaacgaatttgtgtggtcataagccactgagacttttgggtgtgcttgttaccgtggaaaacctagcctatcctcaccactaaacctgccattaccaagtcagtcggtatctggagaagacttgctcttcgtgatcacaagctccagttttggaatcgtttcaggcagatacatgctaaaatacgtctttgacaaaaatcaggcatttactcagatgcttttcctttaagctgtcactaaaaataggttgacttgctaacctgggaatcctccaacagttgctctcgctctcactgattactacagtattagtcagaaaagtcaaaaatacacagtgcatctgttatgagcaacaaagtgaaacattagctattcatagcaaaatgagcactttaaggaggcttgagactctcattcagagatacagaaaaaaaaaacatgtaggaatgctagtagtacaacaacattaaaattattaatggcaagataagttaaaagaaaaaaatgttccgtttagaaaatgctctgcataaactttatattccataactacaggaggaatgaaacttgctttttctactctggagaggcttctaagagcctattttgaattcaggttgctgtggaaaccattagaattctggaagggattccatcctaactgctgcataacatggaatagccctatctcactggctcaacttaaaacaaagccatgactctggtttgaaacactgatgagtctctgaatttgaggcttaaatatctataaaacaattaaggctgtgacagtgatactccttcaaacttacatattttgctttcaaagaggtaaagcaactgtcaacatgaccatgacttatagttgaaccatctgaagccaagtcatgatgtggtaccaagtcattcatggaaccagaggacatgcctgtgtatgtgcgcttaagtatgagggtgtttggggaggatatttttatttgtataa

SEQ ID NO: 48483 - DNA, 741 bp, Bovine  19866881083803
actctatttaatcttaacaaaagcagaaattaaaatcatggcatattcatgaagggcctcattccaaaaatgcttggttcagtgggaattcagatttgggggtattctttgcattccagtcatctagaagaactagtgatggaaaagggcactaaaagcaccgagttccctctgcaagttcccaagaattagccatcttccatttttcaaatcttttccacaacagaatttctgcttttgatacgtcactttaggtccctgaaacacagaaaagttaaatatagtaaatctagaggcttggccactttgccatcttcacaggttatttccaaatcactgttgatcttacccacttccaccagagtgcacagactggctctgtccctcactgaactttcaaaaatgatggtgcaccgtttggtgccctgaactctattatacacttcccataagatcctctttctctttaggttcaaactgtcctgcaaaaaaacaggattcattcccccccccccaaaaaatatcatgatctcctctacaagaacaacatgatgttcatcactacaggaggacaggtcattcacctctgctctcaacgagttcccagcacaagttgtgtgtgggctgcctctatcagcatcacccacagggtctgttaaaagccaaactcctgggctgcatcccaggccattcaatcagtctatctgagggtgagtcccaggacactgcctttctaacaag

SEQ ID NO: 48484 - DNA, 1193 bp, Bovine  19866881096696
aggaaagatattggctaacatcaaaagattggcagatgaacataatttctatgttgtaagttaaaacaaaatatatgcatcattttttgatgattttccacttaatcaactctctttgattagttgatgtacaaccagtcccaattcaactgtagttgaaaagctgtcattcacttagatcaacagcaaggcaaattagagtccctagatcagcaagtgactggcatataataaaaaaacatcagctagtattatcactatccgcgtttggtggcaaccaggactagtaactgctgggacttaactttgacaagtaagtgtcaagtgacaatcattagcaaattgattcaaaccagatgcagatctcagattcttgccaaaatataatgatgctaattagatccttgacttttccttcatccaatatttaagtctaggaaagcttttattgagcagaggaggtttttttttttttttaagagatctgataaaatctaatgtggatgggtttacatcagatcctggtagagctatagggagggaaaaaaaccttctgaaataagtgacttcagtcagaagcttcagcccaggcatgtttttggaagaaagctgttagaaggacaatgtgtctcatcactgcttctccctaaagtccatttttaattattgatgtcactctttccttccctctctgcccaaacaaatataacatttaaacattaaagaggctacagagtcaatgactgaatggaataaagaatgaatggtttaaagaagcagatctctaaacccggttaccacctaagctctgacttactccatcactttcctcataggcaggatttgggggactttgtcatggcagaacactattcaccccattcaagccagctccaaggaccacagcagagaagagaagcaaaaggaagtgtatacattggtgggtgtgtcctgggtccttacctcacttatttcatcttacccaacagttctctgtacattttttatagtgttagaactgtagtttgtgctcaaatagatgaaaaaattatccatatgtttccctgggacacataagggggtagtcaagcctttgtacatgtggctggtattgaggaaaatggtaagaacttggtatatacctgatattgatgaacactgagagattacttttgaaggcagaaaactaccta

SEQ ID NO: 48485 - DNA, 1116 bp, Bovine  19866881174391
cattcccatgtttccaaggagaagcaacacttgaaacagtaaaagaagtcctcagatattccaagcatactactcacacctgcatccccaccttgatgcattttattgtttttcctccatttcatcaatcatctccatttgtcctgttggttgcttttttgatctatatgctcctcgaccagtgactttcccttgcctggcagtttgatgtatgatgttgagctggtaatcctatatggattagagccacttgttttcagattttgagatctcaaataaggaaacatcttaggaagagaaagtgctcatcattttcaggaaagcaaaatgagaagaattggaatagcactaacgtgaccttgccaggaagctggcatgtactcccagaacatcaacgcacgtgaacgtatttctataatcgagttgtagcctttcctctcatccataacctcgaaggccatttggtatgctctattttctgtactttatcagtaatgaaaagcttaaaagtagagaaaagctacagcagtccttatcacatacaccaaatgaccagtgatttaagcccttgaatgtacaatgtaactttcctctaagtggctcaaaggactttcattaacattgagtcagattttcactgtgctttagctatttcctagaagaaagtaaatggcaccccactccagtattcttgcctggaaaatcccatggacagaggagcctggaaggctgcagtccatggggttgctaagagtcggacacgaccgagcgacttccctttcacttttcgctttcatgcattggagaaggaaatggcaacccacccagtgttcttgcctggagaatcccagggacgggggagcctggtgggctgccatctatggggtcgcacagagtcggacacgactgaagcaacttagcagcagcagcagcagaagaagaaagtaaaacatcttgggaagttacatcaactatttcaggaaccccttcaagatcatttgggtagcagttagtaagttagtgttccggtgggttaatttgatttcaggaggtaacttaagctgtgggaaactatgactcactggtctgttttgtccccaccacagtaaaacttaa

SEQ ID NO: 48486 - DNA, 624 bp, Bovine  19866881301092
tgactatttacctaagatctggcagagaaaggtaagaatgctgcctcctgcgtctttaacaaggctctactgtgctcagtgtagccaaggtcacctgagcaaatccactgggctcctctccatggtgaaggagagttcacaattgaaatcagtttgtgtaaagctggccaaggcggtgtgattttaagaggcaactctgagaattacccaaacacctgaatggagtcataaaggaaggcagtgattccccaggcaagcattaaggttttatttacgcaactaagttttcctccatcagtctactaagaatggtccaaaagcagtaaactgaaaataggatacaaataaaactttttcgacaggatgttaatttcctagaagatgtatcaattatcaggttgatctgaacaacagagatgacatacctgaacaatcctacatgtaacaaaagcatctaacctgaattgcttagtttagataacacagtatgcaggtaggctgttctacaaattagggtcacctggagaagtttcattaaaaagtatggatgcctaggctctgccctaacaattaaagcagaatctctggggaaggtgagattttttttaaagctccccacttgga

SEQ ID NO: 48487 - DNA, 771 bp, Bovine  19866881306845
ctgataataaagctctgaaagttaaaaatgtcttcctctccctttgtacttaccacaggctacacaatgtcctgagaggattcattatgagaaaaatgtcaatcacagctttaagaccttgctttggaaggaactaataagaaagcagattgaaaggtgaaacttcatctgtgttttcaaataagtggtcttaatttttcttcttatagaaaaagtttaaatgtttaaatcagtttattataaatatatctaaaccattaatttttgcagctttcaggtaaggtccagcacttcatttacacaaagtctatgagaagaggtcagtagagatcatctaatcttaagtcgtgacatcatccattcaagtccttggcataatctataaagaaaataaaatatcttgatcaaattctcaactaaaaagctatgaagagcaaattaaaagaagatacaattttttatctaaacaacaaagattagaaaaatcagtaatattcaatggtgggtgctatacttccatacagtacaactgcacatttttggttctgttatatctctagtgcatagagtactgcctgatacataagagaagctcaataagtacatagtgaatgctcatagaaagtcatttagtaagaagtatcaaaaatgcttaaaataccaacactctaccctttttttctacttttagaaatatatcctaaaaaagataaagacatgggtttatgtattattactggtcataaaagcatttttaataggaaatagtaa

SEQ ID NO: 48488 - DNA, 3281 bp, Bovine  19866881315059
tttctaaaggtgctacatttacagacattcatccggtggaacagacagagtgtgctcaagttcactgtgctaactcaaatccggggtagtaattggaaccaggagagcttgaaggtaaaatactgggctggaacacaatagaaaatcatacagagctttgtaaaaacacattggtgcttatttcaatgtgccatactgggagaggaattatttactatcatgagttacaaataatgaggtgaaacaaaatgggaaaatgtagggaggctatctgacttcttagcggtgagacttatttaatagtgaggtatgttctgctaagaaaaaaaatccatatcaaatgaagcactgaaaaccagcctggacactgcactagaaaatgaagggttaaatccttcccaaaggggaaatacatggactaatcctcagtgttccatctcatttcagcattttaggacacagtgttcctaaagaaattgtttcttcccattcatatgtccccacagaaagctacttaatccaaaatcctcagaaattagttataaattgctatgggacataatgaaagtgaaggagagagaaaacatctaagtaatttaggctcaataggcagtccataatgaaattaaaagacacttactcctgggaaggaaagttatgaccaacctattagcatattcaaaagcagagacattattttgccaacaaaggtccatctagtcaaggctatggtttttcctgtggtcatgtatggatgtgagagttggactgtgaagaaagctgagcaccgaagaattgatgcttttgaactgtggtgttggagaagactcttgagagtcccttggactgcaaggagatccaaccagtccctcctaaaggagatcagtcctttaggatgacctgatgctaaagctgaaactccaatactttggccacctgatgcgaagagctgactcattggaaaagattctgatgctgggagggatttggggcaggaggagaaggggacgacaggggatgagatggctggatggcatcaccgacttgatggacatgagtttgagtgaacttctggagttggttacagacagggaggcctggcgtgctgcgattcatggggtcgcaaagagtcagacatgactgagctactgaactgaatgagtcactgggctttgccactgttagattccacttcattgtctgtataattcctttcagccttgtctcagtccctaggctaattcaaacattttgccctctcactcctttccctgcccccaatccaatggaacttaatattaagtccattattaggctagggctctagggacttggtgactactgctgcatcctggtggctcagatggtaaagcatctgcctgcaatgtgggagacctccgttcaatccctgggttgggaagatcctctggagaaggaactggcaacccactccaataatcttgcctggagaatcccatggatagaggagcctggcgggctagagtccatggggtcacaaggagtcagatgtgactgagcaactaacacacacacactcgagactcggggactactgctgtacccaggggtttgttgcccagattcttggagtctggctcacagttccttattgcaataagtaagactaccacaatcatgtgtgccttacacccaagtgccaagaaatgacagctacttttgctggcacttcctgctgtcatcacccttagctccaggccttgaacttatgggttatggtgctaaactcttcccctagtgtctcgcagggccctttttaaagatagtttagttgttgtttaacaacaactgtgttacttttaaacaaatctggcttctcctaatttcttttttttttaatgtttatttatttggctcattaggtcttaactgcagcacacaagatcttcattgtggtgcgggctcaatagctgcacacacaggcttagttgcccctcgacatgtgggatcttagttccccaaccagggatgggtcccgtgtcctctgtttctttttaagagcaccactgtactaaaagagtgagggccttttagggtggctcagaggttaaagtgtatccctgcaatgcgggagacctgggttcgatccctgggttgggaagatcccctggagaaggaaatggcaacccactccagtattcttgcctggagaatcccatggatggaggagcctggtgggctacagtccacagggtcgcaaagagtcggacatgactgagcgacttcactttcacgttcataaacatctaggtccaactctttaaagtagtctccgtgttaaagtagtctctgtggtccttggttttagatatattttgcccaagtcttttccagatttaccctgttctgctttactgggcttccctggtggctcagtggtaaaggatctgcctgccaatgcaggagatgcgagtttgatccctgggtcagaaagatctcctgaagaaggaaatggcaagccagtctatggccttaccaccctgaatctgttggatctcatctgatctcggaagctaagcagggccagacctggatgggaaacaggcaacccaccccagtattcttgcctgggaaatcacacggacagagaagcctagtgggctacagtccatggggttgtaagagtcagacatgacttaacaactaaacaacaactgctttgcttttaaacaaatatggcttctcttaatttcttttttttttttttttaatgtttatttatttggctcgttaggtcttagtagcagcacacaagatcttcattgtggtacaggttcaatagctgcacacacaggcttagttgcccctcgacatgtgggatcttagttccccaaccagggatggatcctgtgtcccctgcattggagggcccaccggtgaagttctttctaatttcattttatgtctctaagctcaattggccactgaagaaatagtgattttaccatgttcttaaggtcccatcaagacctcaggtacactttacccaggatcttttacaccatcagaccctaccctgtctccagtgtcttacaagactctgttctgttctaactcttaatcattttttctctgattctcctcttaatttgttatctctttctcactggtaggcctagatcctacctgtctttcactggtgcccaatctctcctggctgtgtggagtatgactgccaaaatagaatacgtaagtgcagaaatttccaaataagagtatgagatataagtatgagatacaca

SEQ ID NO: 48489 - DNA, 1338 bp, Bovine  19866881332022
cccaccaaatggaagttgttaacttaatgaagcctccttcattgcagacagaaggtcacagaagaacctcaaaaaccacagaagctcatccaaagaccacctgatgccagatgacctctggattgaaggaatgcaggccccgcatgcaccctgatcctcatcagcaaccctgcctacaaactctaaatataagactcctcacagcacattgtagggatgcacaattgtgggcttgcacaattttgagggcattaacctgcagtggccccctttacttggtaaagcaatgttctttcctaaatcgcccaaaattccgcatctgagattcattttggtactggtgcacagaggcaggttttcagtaatattgtcacttcatgtgtgtgcgtactaagtcacttcagttgtgtctgactattgtgaccctatggactcctcagaccgtgggattctccaggcaaaaatgctggagtgggttaccatgccttcctccaggggatcttcccaacccagggattgaacctgtgtctcttcttaaatctcctgcattggcaagtggattcttaccactagcaccacatattcactatagtctaattaaatacactgagtagtaatgcagaatgaagtggtttctggtttcagagtgtgtttaactcctttcaacagtaggtagagatacactttgttgcttcatgaggctgggggactcacctagacagagtttgctgttgttttttcctgagtcattttccctctgtaccatttgtccaagaagcttgaaaggatgatgagttataacaaaaagggtcatgagggaaggaccgtttcctagatattgaaaaagtgtggcttgtcttggggttaagcccttcccaggaagtggaatgggctctttgttgccttgtaggtaaacacaccacatagatgccttccaaagtctgggttaaatactgaagcccaagcagttatctataaagtctgtgctattggcaagctccccctaaagttgtagttgaacagaccacactgcagttgaaaatgatgcttttatgttatccctattggatgagtttctacacagatgcttttcttaatgacaggcaccagaccggggccttgttttgtagtgggcctttgataaatgtttgttaaattttaatattttggcagtttgttgattgctgatgtgtgatttgttgttgttcagttgctaagaggtgtctgactgttttgcaaccctatggactgtagcccgccaggctcctctgtccatgggatttcccaggcaattatactgggtgtgaacagtttaagcctaattcgttgtaactaaga

SEQ ID NO: 48490 - DNA, 1544 bp, Bovine  19866881351598
cagagctctcagtagctagtttttatattctgttatttggttggagtttcagtctattaggagtttattcctcagtgctgggagagaaacttttcccacgtcttaagttaccaaatcatgttttaggaagaaatgttagccaaagcgactcaaaatttagtgatggctgacatagtaaaatatgccctggcaccccactacaaatttattgatgagggttaatagggcttttgccctccattgtagcaatgccacagctggccaacccacccactgtctttttagggttgttcctaaaggcaaggacaactgtgaataaactggggctggttttgtcctaagcctttcagatgtccttcacaacacagtttattgtaaatcactgactttcagtatggagaactaatttcttagagacagcccagaaactctggctttttcatggtcatcatggtcactggcggatttataatgtttcagcaacaatctcccagagcagacatcactttattagcgctttctaggtggcagagttcatttacctcagagacccttcaaaagcactcatcgctgtatttttgttttgaaggatggaagggtgaattgcctgaaggctgtacaaatcactgtggttaatgtgtggtaggctgacccaggcccctaggaggacaaatcgcatgttcgaaagcatctaatgatacactgtatataggatgttggacatatatttaaatataaaacttgtcaaaaatattatttttttcattcttctcatgtttacaaatgaaatcatctcagtgaaatttggcaagtctgaaaatgttccaagatccttaaactggcctatacatcttgtaatgacagctatgggaagagagaatgctcatgactgtaagaaaaagttgtgtcctttagatctcaaatgttgttttcttttcaacaggtagcttcatgtcatgtttaaatattttaaaggagtgtttctcaaaatgtggcccaataacctcttgcattaaaatctcctatggtgttgctaaaaatgagaattcctaaccttactttagctctagagaatgaaaatcatgagtaaggggggcaggagagatgggcccttcaatttgcatatttgtcaagcttcccagatgaatctcatgcatctgaaagagaagagaacaactacattagattcttagaaggatattcttcagcataaccatgccagtaaaatgacgtaacacattctgagaattttttctttttatctggtacattcactgtgtgtctcctaactacaggaagccatgctaggtgctggtgggatgagaagatggataaagcatagttcctttcctgctaagggaagagcagagagcccagaatagcttgattggggaaaaaagtgctgaatgttctaactgaaatgtgatttgtaatgaatatgtctcatcttaatgaatttttcaagttgtctggattatatataaaatagaaatcaaattaatgagggactacactatagatccatcctcagagactgctataaa

SEQ ID NO: 48491 - DNA, 783 bp, Bovine  19866881416685
ggacaatatgcctttgttaaatgcttgcatttcttacagtggcctgattctaaaggatcctgagagacgtgtgaaggtatagctgcggcagtcttctttcagcacagaaattctcaaataggcatttgctaacaataacctgatgtaataatctataggttccctccgtaagcgtgctgtgactaatgactaattacccagatcctttgaaatgaatttgtaaacatagccagtgttttatttttggaaactctcagttgtgggctaaaggaagctttattctgaaagtattagattctctcatgctattattttagagacaaagaatccttctggatgagcaagtagcacttagaaagtagatttccatttagtacctccacagaaatgaaccaagccagaccacgagggaaagaaagactcctgcagctgccttcctaggaagtccattttgactgccccaaagaacagtgaattgttaacttcaaaatgattattgttatgtgaatttttccagaattaaaaaattgggaaaaaaatgtaagactagcacctcccatcaagaagtttatggttatgatctgatcaagataacaagcctacttgtactcatccaacaaatatttccttaacctgtgtttctttccgaacagaaatgtaacaccaagcaatgtatataaacaatgcaaagcaccctaaggttagagactaaatgacagcaaaactgaaatgtttggaattaacggagaggaggggagtgcggtttcttcaccagaaagagca

SEQ ID NO: 48492 - DNA, 754 bp, Bovine  19866881424093
tatctttgttgtgaagcacttagcagcagcagcagcagcagggtgttgagctgtatttctcaggattcttcagaagaaaaatcctagagctctcaggcctccaagatttcctgagtgagtcctgcaaaccaggagattcattctttgaagtcgggctgaggtccaaggagctagacaggcagtaccattgaccagaaataccagctaaatttactacatcacttactgctcatactgtgtggccatctgttgaaagcaaataatcattagaagatgatcaagaggaagaaaaatagtattttccatcttagggtgttccttctggctgaaagtgttgttgattttttaccttcacacttggaattaaagggtgcatgtgtgtgagagtgtgtgtacacaggcacatatatacatacattcatacagatacatatatacacatacttggtttttacatacttgtggggaaaacatatataatttacttgtttcttttgtaaaataaatacatagaaacatcttcattcttcaaatagtcaactgttaaactgagaggtcttcttgtccagggttcacagagatttgattcaatcatatttatttaataaaaaataaaattacatggaaaaaatcaaaataaattactgatgtaaaataactatcaaaaataaaaaccttgctcctttctttgaaccatgggagaatgtctgctaagatcagctcaaacacctctttttaaacaattaaagagaaa

SEQ ID NO: 48493 - DNA, 1117 bp, Bovine  19866881553527
acataataaaatagttaaggcaggaagaggattgaaactggcaaggggcccataagaacttaaaaatatattttaatgttttgtttcattaagaatacaaccacaatgttctttataaatatttgaagaggaaaaaaataaaaagactcatttgattcaaacatccattaacatttataaactctcttaaaataatcagtgagacaatgatgactcattttttttttttaatgtgaaagcctgtagcaagtatggattaagttttccttggagaaatcggatctacttggtagaacacttttgtactaatcttttttgttcactagatttttctattaatatagtctgaaaagaagagttgtgctttcacagcatgcttgttgtcaaagagagctgctattttgtcaaattgcagcttcttttgtgctggggaaacagtcttaccttcctcaccccacttttggaaacctctcatgaaaattactggatcttttatagatagaccatgggtctctaacaaaattttactggcagatactgtttgaaacttgtgcagactgggtcttcattttcagaagtcaacatgttaaaaccattctcagatacgcactgtggaatttgcccttaaatatccttaaacgtgctcttgttcacagatccccatgacaccttcaggaactttgtgcaaaatgattcagaatctaccccccagatttgctctgtcagagcaaattagtgactctgcactaatggcccttttgtccttctgattcaggaactcacagtgacaagcgatgatgatggtactgaccaatgaaacgtaatcattagtcaagtgcaggtgggagacagttcttgctttggatacaagtgagtggtttaactcttgtactgcacacatattactctcagagtatgacaactgagttttaaatgcacacaatggatttttctctcaagcactgtgccatagaagcaatggtgaatattatctagcgagaggctctcatctaaaagtcacttttaggagacaatttcctacctggaaaaccgtcttcagtagacagcctagttggctcgtttcaaattcctaactgaaaacctgctggccacaaat

SEQ ID NO: 48494 - DNA, 1175 bp, Bovine  19866881568250
atggcattggcacccttttgctggcagtctgttgatgaactttggcatgcagtagcatcacaatcaccaagactacttactacctgcagcaattaggatgaaataaagatggaagaagcagcattggattatgcgtaacacttgagtactatgtggctatggtaattaaaaggattgtggagtttgaagttctcttgagtctagccatttgctagagctttattaatagcttagagacctataggtgtaggagattccagtgatcagcgaccttgcctgttttcaagattgcactatgttaaaaataagagtattgtttgtagacctttaaacctcatagcattgagctgccagccaaacctctttcaagcaaatgctctacaggagccagtggatacatggccaaactgttcttgagatgcagttcctaagattcccagaaggtcctgggtgattcgtcaactcattgcccacagtggtggtcagctcagtcatgcagcctgtgttggctccccttctctcttttactcccctgtcctcactcatacaaagcatttgtctcaggctctgagaatcccaaggacagaggaaccttggaaggctacagtccatggggtcacgaaagaggtggacacgaccgaagcaacttcgcacacacacacacgcactgatgctggaggagagaaagcaacggaggagaatacatgagatggagctggagggtgggcaggaccttgcgtttctcttcactagacatttctttgtcaccagaaaaactccaatccactaagctgcctccttttttctcctgtattcctgtacacaatgtcttgaaaattagaattgcaatgagagccaatcagtgaaaatgaagaaatcctagttcatattttggctctttcattgacttgaagtattattttggacaaattacaaaagttctagtagaaaaggtatggaaacaataaatatcacatgaataaatgctctatgtaaaatacacggtattactatcatcatcacaagctatgaagcacaggaggtcaagtacacagtccatgtttcacagataaatgaagtaaaaactgaaagcatagtcaacagccaaaaaagacagttccaggaagcctcaccttcctcacagaaaaaatcacagaattagtgatagaatttgg

SEQ ID NO: 48495 - DNA, 1041 bp, Bovine  19866881605770
tctatttgctctagtctgcacatctcccacataatcaactggaaatgactctgaagctcagagttgactatctggcaattttcagactcggaggtgaatggtcagctacttcctgaaacacagatgaattcgccactagtgctcaatggccgcccagtgtaaggtgtgatcctcgtcacctccgctttgtaggacaagtattatccagtgtctcgtaggaacctgattaagagctggttctttcagatatgactcagaaatggatgcttctttcccacaactgcaggttaaaaagtagtaagaaacgatatgggtgttttcctaagggcattttaagtaatatttctctttggtcttagaaatgtttgcaaatgaagtaaacatttctttaaaactcagctctacaaagagttccacttccctctcacaagcattctctgtatctttctgaaagtttctataatttttggagaccaaattactcttcgcacaaagcactcatttttgcttcactattcttcatttaaatactctggcgtttagtaaccgtattctgtcatcactcttaatgggggtgttttaagattctttttcaaaggctttgcttaatcacagccttaaccttctggtaaaattcagtcttttaacaaactggcctgtaggggacaagtttttaaataactctcaagttttccctcccccttcaaagttttcccaaactacttaaaagcctctcagccttggggggaaggatgataaattagatgatttttgttctgtctctgttgcttggtattaccctggtctaatccatttttgtctcaccaagaatttgcttcttgcaagcagacttcctcccatattctgcagcaggcagagtgcagattactggtgaagttgcccagaggcccaaaccaggcataggaagcccttcagtttccccgtgggggtttctcaggggtggctacacactcttttaactcttccctttccctttctgtagtgaaggccgtgtttgtgtccttgcttcaaaatctaatt

SEQ ID NO: 48496 - DNA, 1397 bp, Bovine  19866881613798
acataaagttctctttaaattagatatactaactcaagaatctctgaaaactttcaaattctcccatattctaaaacaggggttggcaaatttcttctgaaaaggaccaggtaataaaatatttttgaatttgcaggcactcaaagcagccacagataatatgtaaagagataagtacagctatgctttaataaagctttatttatggacactgatagttgaatttcatataattttcacaagctataaaacactggtctttgacttttttctccaatcatttaaaactgcagaaaccattcttagctgcaggatacataaaaaaacagtagcaggccagttttgacccatgtgccatagtttgccaacacttcctccaaagtatgtgttttttagtgcttatttaacttttaggcgaaatattctctcaatgacagtgccagcaaaagtataataaaaacgacaatcttatatggaattactctaagagtctaatagtgggaaggaactgaaatttaagataataataacatttacagagaagagaatgagacatttatgtcattatgtaagtgtatataacataagataatctttacttaattaacataaattgcagactgtttgagcaaattactaattcagtgtaaatgagctggctgtataactggttacttgacattcagttattttgcacatgtttaattccattttatttttgttaagaattaaacacaaaatttaatgtttttaagcaaatctctagagaaaccattggcttcttaaaaattgtaataaaaaggtaaaataaccataagtgaaagacccctaaataaatgccagttattcaaattttaattacccaaaatggggacatgtcttctgaagtatatatttcattaaaatttatcttgtttacccaaattttcagtttgttgttgttattgttctgtcactcagtcatgttcgtctctttgcaacaccatggactgcagcatgccaggcttccctgcctttcaccatccccagagtttgctcaaactcatgtccattgaattggtgatgccatccaaccatcttgtcctctgttgtcccattctctacctgccttcagtctttctcagcatcagggtctttcccaatgagtcagctcttcgcatcaggtacccaacctattggagcttcagcttcagcatcagttctttcagtgaatattcaggactggtttcctttaagattgactactttgatctccttgctgtgcaagggactctcaatagtcttctccagcaccacagtttgaaggcatcaattcttcagtgctcaaccttttttattgtctagctctcacatccatacatgactactagaaaaacagtagctttgactgtacagac

SEQ ID NO: 48497 - DNA, 1186 bp, Bovine  19866881637974
ctacactatagtaattataggaacaaataggtgtacctgcagtttggtgtgattttcaacttagtaggaatttgggatttttttgttttgtttttgcagagtgttactatagtctgttgagggtagattcaggtcctgtgtggattccacattctccctgcttgtgttatttttatgtaggcattcaggttaagctaccaggggcagcttggaaagggcgctaccagaggacagtgtgaagagtgggtaaggaaacacggtctccgctgtgctgactgagagaaggggacagtggaagacgggccaaagggtacttgggctggggttctgctctcagcacagctggtcaagaacaccaggggcagaaacaacctgcatctctcagaagatttccaaatgttttccatgagagattttggggaaaacaaaattagataggccttataatcctatattttattttacttgaagtacttccttcttcccaaatatgaaaattacattaacagtgttggatagctggagtggttaaatcataatcagaatagtagagctatataaacttagaaatatggaaaagacatttttattttgtcacagtgattgatctccaaccgtaacccagacaatgcaaagtaaatatggttttctttttaaaattttgtttgcagcactggacaagacactatttccaatcctacttacatgaaccagaactctaaccttcaatcagctcctggtgcagctgcttacacacagcagatggggatgtctgtggatatgtcatcttaccagaacgctacttccaacttgccgcagttggcaggctttccagtggcagttccagctcattcagttgcacagcagcaaacaaattaccatcaacagcagcctctcctttaaaatcaaaccaagcattttcttgaaagccttcataagtgtactactcaacccttgtgattataatctgaaaatactaaaagaaggaaaaaaaaattttctcaactgaaaagacccatgaataaataaagcacaaaaacctgtctttctttttatgctataaaaagttcttttcaagttccagcttgtttgaagtcagacttttgatcagaggccgcttcaatttgcttcccgttagttttttcttactttcaaatctctctacacaaatcggacaaacaaacaa

SEQ ID NO: 48498 - DNA, 613 bp, Bovine  19866881857330
tgtcttgctgctttgtttactagatgtaggctctcagaatgcctccttcttggagaccagaggagggaggtttaatcagcgtccttgtgtacagtactccagcctcctcattagtcttttctattaggaagaaacagaggcgcagccacggcagaagctaaacactgcagtctacaagcatctctcaagctacttccccagaagcttgctgtgtgtgtttctgcggtgggacctaaatgttcctcccaggcatggacttacatttatgatatatcacatcctcttaaactatcagattccacaactcagaggagcaaactgaaatctgttctcgctgccctccctggttctgctggtgcctctacactgtcagcatccttcagggaaactgaaaaatgaaatgtggtcatctgtggctgtatgccgaaacttggaggtcttgctctggtccttaaaacacttataacatccttataacacttcagttaatcacatgttctgattatagggggaagaggattggagaaagaggagagtaaaattgggtcataggctttcagaattttttaattgaggtgaaatttatataccgtaaaattaaccatagtacatt

SEQ ID NO: 48499 - DNA, 707 bp, Bovine  19866882056906
aactgtaacattttatttcatttaagtcttttaaagttttaatgtattgctaggcagtggtttgggaaatcagtgagtcaaccttttctccttggttaacagacatacccagttcaaccacatggtggaaactatatgggtcaaagtattcaccaagtcactgttgcccaaagctacagcctaggaccagatcagattggtccactgagatctctgcctccaactgtgaattcctcagtgacaacacagcctgctcaaactccgtacttaaggtaagttttggggagctatgttaattttgtaattacatacattaaattttcacagatgttcagaatgagagtaattagacccttttctttataataatagtgccctcttttgctgttgagatgaagttataaaagggctcattcaagatcccatgaaataggaatgctgctgtcttagctttgctacccatactgagatggtgcccagacctggattatagtctgggtccctgggaaaaaaatacagctaacttggagaagaaaatggcaagccactccagtactcttgcctggaaaatcccacggacagaggaggctggtaatctacagtccatagggccacaaagagtcagacatgactgagtgacttcactttcactttcacttcccttatagaagccaagccaatgatatacttagcacggtgctataatt

SEQ ID NO: 48500 - DNA, 1520 bp, Bovine  19866880370238
atcctgcctacttaacgtgcaatttctctcttgccagccattctgaaaggagtgcactctgcacttaagaccacttgtcctgggtgatgctgagagctgcctccctaatctgagatctgggccctgattcaaacattaacagctccgtctggatagtagccttaatgcactgtgttggtggaggcggctcctctgattctcacaggaatgagtgagatacttttccatgttttcatctccttggatggaaatttaccagtgaggttgatgtgattgtccttattttagaaatgaggatactgagcctcagagaggttaaatcaccgtcatgaattgaccccaactacggtgtcaattaaaaatctaagatcatggcatctggccccatcacttcatggcaaatagatgggaaaacaagggaaacaatggaacgttttattttcttaggctgcaaaatcactgcagatgttaacttcagccatgaaattcaaagaggcttgctccttgcgagaaaagctatgacacacctagatagaatattaaaaagcagaggcatcactttgccaacaaaaatccatatagtcaaagctatgatttttccagtagtcatgtgagagttggatcatgaagatggctgagcaccaaagaaatcacgctttcaaactatggtgctagagaagactcttgagagtcccttagacagcaaggaaatcaaaccaaagtcagttctaaaggaaatgaatcctcaatgttcattggaaggactgatgctgaagctgaagctccaatactttggccaccttatgcaaagagctgagtcagtggaaaagatcctgatgctgggaaagactgagggcaggaggagaaggggacaacagagggcaagatggttggatggcatcactgactcaatggacctgagtttgagccaactccgggagatggtaaaggtcagggaagcctgctgtgctgcagtccacagggtcgcaaagagttggacatgacttagtgactgaaaacaacaaagaggatgaggtggttagacagtatcatggactcagtggacatgaatttgagcacatctcctggaggacaaaggagactggtaggctgcagtctgtgaggtcacatggagttggacatgactgactgactggaaaacaacaacaatgtcctgttggaatcagaaacgtcccagctaaaaggctccataatatcagtatcttggctgccgctaaaaaaggcagcatcagtattttccagcattatttagttatctgttcacccaaccggcaagaatttgccaaatccctgcctctaattgatctcaaagagaagagctttatcaaactgaatgggttagagcaatgtcaaacactcggagaaaagaacagtactaatcacacgaatgttacagtgataaggagttaacactgcgacgaaccataaaagagcctttgtgacagacagcagatggtgaccattgcaggctagacttcggaaggtgtccttcctcagaa

SEQ ID NO: 48501 - DNA, 1620 bp, Bovine  19866880553843
ctggtgagagccctgtgggcttagtttttaatagcccctaactattaatagggcttgcgtcttgaatgtagcgctagaatgttaagctgacttatccagctggccccaaatgattatactttgtcactcaattattctctcttcttactaatacttttttaaggacctgcgtgcccaccagagtgaaatgtactttgcatattgatgaatctctctgtctctctctgcccacctttcccttcctccctttctttctcccaatgaaattatttgtaataaatatttttaaaagaaagggcataacaaaatcctgttcttgtaaggctctgatctcactattcttgtttttaacctaggtatttatattagcagacttattgtgacccataatgctaaaccaggtaattttagtgtatattaattcttcttccctggtggctcagtcggtgaagaatccacctgcaatgcagaagacccaggctcaatccctggattgagaagatcccctggagaaggaaatggcaacccactccagtattcttagctggagaatcccctcggatagaggagcctagcgggctatagtccgtgggctcacaagagtaggacacaacgaagcaactaaaccaccaccatattaattgttgtgacctcagtcacttgctgtcagaactttgaggaggtgcataaggaatttctgagaaatatcttagaattaaaattatttttctccaggccttcttagaagcagagatgtaaagatgactttctaagatttcctcttccccaaccatattcctcattccagagctaccgctacctgtgtcagactttgtttcgctctgttgctgctgctcaccttcttgcccatttatttgtgtaacaggtagtgaattttctttcctcagggggcacactgtgaaggcagtgtgcgagtccttccacctggccaaagattctggcttcaaagtggtggctcacatgatgcctgatctgccgaacgtggggctggagagagacatcgaacagttcacagtaagtgttgacccaaaccaggctgccgtgagaatgcctgtgcgtcctgctgctacccgctctgctttttttctctttttttgtttaactttttattttgtgttggcgtatagccgattaacaatgttgagatagtttcaggtggatagcacagggactcagccatatgtatacatgtatccagtaagtataattcttccatcttttgggaattgttctctgactgattcctccactggatatgaatatttttaatgttaattatatgaactttctaggcaatttgttaaaaatattttccccacactattaatatttttcttggtcttttacttttttttctgttgttaagctttcctgtttacttatttatttagtgatttcttaagatgcttctaagcttagaactgcctttctctttcaggatttccctaaacagggaaagaaactattctgttttcttctagcctttctgttctttgaattttaatacctaactctgggggtttgtttgcttttttaaaagataatttattaatgtatttttggtcgtgctgggtgttcattgctgcactcgggctttct

SEQ ID NO: 48502 - DNA, 2796 bp, Bovine  19866880595928
gctgatgccttggcctcactttgtcagcctttcatatctcctagagataggtaggaattgagcatccctccctctgggtgggagtcaggagagaccaccatggcctccgtgcctgtgtcccatcatctccatcacagtgggatgacctgtgtgtgagctgggatgctcaaagtatgagatcctccacctgatcccttcctgagtccatgagctctgcttcttcctggttagagaaggtggaccaaaatccagaccatcaccagcctattctataagcagaaactggggagaagagcccggctgaccgggggcaaattcatcccacccccaggaatcacagaggggcagcaagttgaccacaaccctgattaacctcagcaatgaagtgtcttgtaactatttccatcatatcccaggacaggggaaccagcctactcagtacaaaccacagcacagagctccggggaggcccagggtaatgcacaatgtcaacacgatgagtcaggacaaggcagaagcctcttaagagtggctaggtctctgctctgggacttggagatttctcaccctcacatccaactcacccaacatgacataagcaatgctgctcgggatcatgcctggtcagaaagaccagccagcttattcctttgtggtttccatggtaacaagggcagtgtttggactcctgactgtgggaatgaacagcagaggctcccactcccccatttcccatccgctctcacctcttgctcacttccttaaaggccagggtggcaaaggatgctcttacctgctaagatgaagatgcccacgagaatcagaaagaccagcaggtagagcccgaggactgcatgcttcagggctgacagggagcccagctgggtacagcagccacctgctcgtcctttgtggcatggacctaacaagaagggtaggaagaagaggggaaaagacatttgagaattcccaaagccgctttgctctttttgtctcatcgctccctgatgcatgtggatgttcatgtggcagcactccccacccccacctcccgtcaccacacacaccttctgcacatctgtaatgcaggtggaatggtagggagcatctcagaactgtgataagcttttcagcttctctctctcctcccaacctctgctcatgaacgagccagaaggcatcccaacagctcacatggccatacaaacccaccctcctggagccagtgcaagtagcagagaaagctaggataggctgccctttacaaacgttattgtcccccgtgatcaggagaagatggagagcattttaaaaagaggttgcaaactccagggaagggaggtgggccaggtgggcctggggaacccagcagtgcatgccccatctggaagcggttgctatgtcagaatgagggccaggtgttgacaggtccaaaaattttaagacaagccagagattatttagagaaatctcccttttttatgtgttgacaactaattagggggtaaaaagacaaaggaaaggaaaaaccactagggagtgtaaacaaaacacatttatacggcagggctgaccaccagtttacaaccttgggtttagatttacaggaaaacatagtacagaacttcttcctgtgaaactattcaaggctcaccaggttctggtcaaaatggaacagcaaaataccagagttctaaaggaccttggggcttcccaggtggcactagtggtaaagaagacacctgccaactcaggagatgcaaaagatgcaggtttgatccttgggtcgggaagatcccctgggggaggaaatggcaccccattctggtattcttgcctgaaatatcccatggacagaggagtctggctggctacagtccatggagcttcaaagagtcggtcacgactgagtgtctgagcacaatggaccccatggattgtctaattcaaccccttcagttaataaaggttgtcaaatgtaagggatagaccctggggtgaggatgccaggtcctgattccaggtcatctttccatgagaattcttcttcaaccctccttaagacgactgctacagaggccagcaagctcacccatctccacctcctcggttgactgacagtggagaggaagagatgccatcctgccctgactcccagcatggcagataagaaatgatggagggcttttttttttttttcataacatgcccatattatgttcaatccccaccccctgcaagggagagtattgccaactggagaactgttcattgcacagggaggcagatgtgggagcccaaaaaggctgacaacagatgttgaaataattggtattcaaaaaacatttgtagagatgctgtgataggacttgctagcagtccagtggtaaagactccatgcttccaaggcaggggacacagattcaatccttgatcagggaactaggatcccacatgccatgaggcacagccaaaagatatccaatttttatttaattaaaaaaaaaagatgctgagatgtttgtgatccttggtaccttggggttcaccagggaggtgcttcgggggctccttactacctatcaggtagcattgccatagctcaccagaggtattgttcagtgaagaaaattttcccacacatttattctatttgattgaaaatactgttgctaaaacagctaagtagaactcttacacaatacttccataaaacatcgggtacaacttggaacaagttgtcgagaaatacaaattcaattaccattctcgtcaaccctcaagtgttagcaaatt

SEQ ID NO: 48503 - DNA, 2151 bp, Bovine  19866880607706
ctttccttacctatgggaatagcaacatctgttcaaaataatgcatttaatgggataagcaggggcttgctgtcttggggagatggagtcccttggagcttcaggtccctgagccctgtgtttcatacagagtagtgcatgcatgacagccgtgaataaaggacactgctggttttgtaagcagatgaggaggtaggtgtgaaggaagaggaagtacagttgttcctgggctgaactgtgaaaaccctttccttccctgtgggcagcgcaaacagaatggtctcttttacttgactagaatggctcttttgcattcacaccaacaaaagtatttgtggatcggagtcatttattgtttgctggagaaaattcagtgtaaccagataaggtgacctgtttctgcagcctgtatgctgggatatgaaaatagcaccgctctttggggccctaattttccccttccattttgctgttacttctattactcaatgatgggaaggctgggccctcagttacaggagatcctgtggagaagatccagccctgaaggggagatgggcagcctttaagatctctgccagtcctgatcgcctaattttaattttactagcagtctaaactgttatacattgagacagtataatccggtttttaaaaaccttcagatgaagacacgactaagatgacttgagaatccaaatggtcatcctctgaacagctgatttagaaatcttggcattgaatcaattactaatatgctcaatgctatgatcttaagctcataccatgaaaaaactaaaatgcacactacacatttaaaaaatggtgtcatagggcctgatgtgtaacttgagagacctagatgttttagcacaggcccttggctactcttggagatttttctgtccaaaaccaggctgagaaaaaggtcctctgggaagaaataatcaatatatgctcaatgaagtgaggtgtttttgttgttgttgttgttgtttttttttacttttcctggagaaggcacccagaagaaaataaagcttgagaaccaggtaggatttgggcagtgaggacaaagtatgacaacttgcttctttctgccaagcaaggttcagatggtgaggaccacagacatatttgcatataatcatcagtatgctgtggacgcatgcggcatctctcaacagagatcatccctggtcaaggattgctgaaaaatgaattgtttgggaccaatgaattgtcctattctccactgaattccattaggcaataaaagatgtggtgtgctgcagcatttttgacctttacgtgagcttagaatgtcacgtggaaggaagacattaagtgaaaatgttacagatttaaaagaacataatagcaacactgataaaagattaagaacaatatgcaaaatattagccaaagatctaaaaactcaaatcgttgctctgtgcagtggttactcaggggagatcataaaacagaaagctgaggtttagtggggaatctcagcagaggagtgacgcccctcaccttggtccccaaattattcattagagaagcagcagtcttccacgctttggcatgtgaaagtcttactccaagcctcaccctctttaatgacaaaaacaaacaggaaaacaaaacaacccctccccccgccaaaaaaaaaacccctttggttgtgtaatgaatcagtttgactctatgacctgtgtcctgcaagtgctactcagtgatgtcatagcttgttgccatgggaggctaaagagagcaatcattgtgcatgagggcatgcacacacacacgtggatgtgctgagacgaggggttgtctggcaacagtcacatgtcaaatggcaatttgcagcttagaaccacagagagggtttgttttcttcttctgtctgttccagttattaaactgatggcagacgtcctcattaagagctgttagcacgtcagaagatgtttgctgagcttggaaaagggctcaccgctttggacatggaccaaaatacatctccggtagccaaccgcaccctgggggcgggggacagcagagggcatgagaagcaaagacaagcaggttctcttaaaactctacatcagccaaggaagtcttttttagcatgagtttatgttttag

SEQ ID NO: 48504 - DNA, 1415 bp, Bovine  19866880611575
cctgcagcagccacccacaggcaggcagagagcagcaatttccttgggaggttttgaggagaagccaggcagtcacccgttttcccacccccccgccccccagccccaaacctttttatgttgaaaactcccagtttcggcttgctggcaaatgccatgcaaagctcatcttttgttagtctgccgaacaatgttattggttataattggggcaattatgggctgctcgaggaagcgaaacacagatgttgaaacccaggatcagggtattcaagtccaaagctgcttgctttaaatagtccatttcccgaatcatcctgacttacttgaaattcccccagaacttggccatgttcagaatgagatgcgggaggataaagatgggtagcggtgggaggggaaagccagacccacagggagagagacgcacaaagacagaggaaaaggaggctgagcgagagccagagtttggatgagttctgaacgtcattttcgcaggaccccagcagaaacctttaggtggcagagatgggtaggaggaggaaagatgcaaaaaagagaacagacttccgaaagaatgagggactggagaccaaggtcaacccttcggaaatacacagcggaattcacacacagcgaccgtgatcggctgggtaccggtcaagcccagggcaggctccgactcttccccacatcaccactagcgatttgtattcggtgccgaggggagcagggttccctcgggatgaaaaagccaaatcgcaatcgagttcagtgatatgttgaaaagcagcctgcactcactgtgaaaggaagtcatcacagagagaaacccctcctaaagtgtgcctggagggggtaggtcgggagtggggggcgctttcgaagggttgccttgcaaggcaagcccccgccccaccccgccagtgcctgccgctcccctaacctcacttctacaaccacctcttcgccgcagacaagtgacaaagtgaggaccacacctggagaatggaaacttttccaatcctttccaagttcagctcttcttctgcatctctcttcagaataaaagccttagccctcccctccacctctaccctccgccctcacccccatgagagcacggaaaagatgaatgaataatctaaagggaggccagcagcatctacactggacaaaggagaggggctggggagacagccttgccgcccgcccgccagtccgccacttccccaggctcccagcagcgtgtcttggggcggagggcttcgcgcgcagtcgcctacctgcgagctgtcagtaaccgggctcctccgggtgtgaggctccgctgtgtcagccacaccggcatatatatcctcccccaacacgcacagccctccccttccctgcccacctcgatacacatacacacg

SEQ ID NO: 48505 - DNA, 2883 bp, Bovine  19866880623230
ttgcagctggtgaccaaagcgtatctgtggctccgtctgttgaggcacttagagggctaccttgcctggggtccttctctcctgttcggtgtgtcatgcacatagagggcccctcctggctgagatcctagtgtgtaggttggcgcctctggcatgtaaagtggcaccctgggtggggtcctattctgtagtgcagtgtgtcaggcatttgatggaccaccctctctattgttcagctgctgatactggcctgtggggagagagaggccatggtgatggctccatcccctacctgtgactcagcagtatcgccttgcttccatggctgcctggctttcctccctcatatcccctcaacccgtctcttctccctcacatcccctcaatccatctctccgcagtcaacagcagccctcgccctgggattgccccacaatccctaaactccagctcccagctgctgtgccttccagggaacctgtgtccctgtctagggtctgtatggctgcggcaaggactgtctctcactccatttaggctgccacagatcaactgtttcactcagccttaaatgtttctcctctgactcagacagttgccccgatgtgggggattggacccctgcctcagttcccccacccaccgagggcagggtccagtctttctaacactcctgtttttccctgtatttccttcctcctaccgagttttgtgtggttctatatattattttccactggtcaggtactcttgtcctctgttagctggtgttctgcatgtacttctgtctctgaaggtgtattcctgatgaatccttggagagagatgtactccacgttcactgactcctccgcagtcttgttctagggaagatttttacctcttatttttaagaaagttctgtttgagtctagggtaaattgaggactaccttgtaattaaatgttaaaaaaaataacttttagctagtattctactggagctttttatgtatgtttattatatatatatatatacttatttatagtttgaaatcttactgtaaactgtcttaataaatagtattaattacactatttattaatggctatgcctgttttaataaagagtaccatttttgaagccaaaacaaaattaagtatacatttttcgtttttttgtcaactgtggaatatctcattgtatgacccacaagcaagatattgcattatttcttcgacatatcgtaatgttctccaaggacataagcataaataagccgcaactgctaaatgtggaaatccaaatcattgggttcataagtaaatgattcttgtcttgtgtttttaggttcccagattgtggtgagctgtatcctcagctggtggacctgaatttagctggtgatcctactgaaggagcctcagtggcagtgcagagggactatggcttttggtgtgcccgagttgaaaaatgatcctgatcttggctattcctttttgcacatgcgtgattgttcacctccttgtccaaatatgtactttaggagagagagctttcatttgctctatatttcataggattgattccaatcatttgcctctctgccatgttgtttacttttttaacttttttgattgatgtgataagattctgttatcctgaaagacccattatattttatgccgtctgctacatgatggtgtcattaattttgtttattgggtttttgcttgaggaccgagtcgcctgcaatgcatccagccctgcacagtataaggcttccatagtgacccagggatctcataacaaagcctgtatcatgctttttatgatactctgtttttttactgtggctggcagtgtttggtgggtgattcttaccatcacgtggttcttggcagctgtgccaaagttgggtagtgaagctgttgagaagaaagccttgctgtttcacgccagtgcctggggcatccctggaacgctgaccatcatgcttttagcaatgaataaaattgaaggtgacaatatcagtggcgtgtgttttgttggcctctacgatgttgatgccttgaggtattttgttcttgcacccctctgcctgtatgtggtagttggggtttcactccttttagccggcattatatccctaaacagagtgcgagttgagattccattagaaaaggagaaccaggataaactggtgaagtttatgatccggattggtgttttcagcactctgtatctcgtaccactcatggttgtaattggatgctacttttatgagcaagcttaccgcggcatctgggaaacaacgtggatacaagaacgctgcagagaatatcacattccatgtccatataaggtaagggaaaccttgttctaaatttcaaaatatttaacagtgaaaagagctaatcttagctgtttttctttttttttttttaactcttcatgaaaaacctgaacattaaaattttgaagtgaagttaatgaacaaatttattgtaagtaagaatgtcatacacacttttctgttaacatcttcgttttaaaagatcacttccgtgagtccaagccatgggcttttaagcactttacttctgttatcacaaaatagttgcttgttgattacttagaagtctgcaggtttgaggggaagatgttgattaaaagacagtgtctgtggaaattttactgatacttagaactgaagttttaacagttttgaaaaaaaattagaatgcatttgtacaaacagtttcatcttttagttggtcttagtttttcttttttgcatactgaatattttgtgatttatcttttaatttaaagacatcggataatcacagaattttagatctagagaggaccttagagatgggttattcaagttccctctgt

SEQ ID NO: 48506 - DNA, 3014 bp, Bovine  19866880644212
ttgtcttttctattttgagtactctatgaatactttccggcttcccttggggctcagctggtaaagaatctgcctgcaatgtgggatacctgggtttgatccctgggttgggaagaccccctggagaagggaaaggcttcctacttcagtattctggcctggagaatcccatggatgtccattgggttgcaaagagtcagacatgactgagcgactttcactcatttttatgaatactttatagaagtgaacataaaggagtagtggaaaacaacctcattagaaattttggtaaaaattcaaatagtaaacccctttgaatcaagcaaattttgtggcacaaatataataaaaaaataagacaatgctgttaatattgcatgtccttttagcaaaatgggataggccaggtgcttgtaacaattatccatcctttgactaatgattagaaaatactgcattcccttttcaaccttaaatatacatcgttcacaccttggttcttaaaatttgggaagaatcatcaggataccatcatctgaggactcgcagtctgaggtttcacttacaggtttcattttcccatcatgattcaagtctagagtgctgctctctgtcgcttttcattttctggtttatcaaataatttgaaatgtctttctctgttcgtcttcttttctttgcctttaaaggtaggaaattaaaaattcctgagttgtcatttgagtttaatgaaggctgagagcagactacaaagatagggcccactggcttcttttataccttcttgaaaagatgacgtattccttttggcaacaagaaaaccaaagaatgataatttcttcattttgcttcatcttcctaggcagtgccatcatccttccatttaaaaattattttcatcttcttttagcaaagttgggaacagttgatgagtaatgatgaggaaagatgagcaacaataccttccaggtaatggaaaagtagcatgctttaagagacaggaaaaataagaccattaagatcccacatcgtgtcttaggcacattgccctttgataaaagggtttacatagtttagaagttttatttaattaaaaagatagagcttttatttaattaaaaatatgcaaattctctttttgtttctttggaagatttataagaaagaatcataaaataccagtcctcaaagttggaaattaagaaagaaatgcaaaaggagatctggaaaagtgggtgaagatggacaggcactccagttgtggggggaagagttggcaagcagatgcaacagggagaggcaacggagccctgtgtgtatgggaatcagaatagatctgatttatcacagctgactttttgttgagtagagtacactcggttggggatccaactgtggccaccattaatttgagcaatatagcctggattctgcaaggcaaggcatggttactctgaaaccacctgagacctgatgcaggcacactttttctggcagttttgtactatgattgtgatgctttcttcccaaggaaaagttgtagtttttaacatgtaataaaaatcacccataagaatcttaatattcagttcagaccattatgcatttattttcaagtacttcagtatggattacattctttcatacaaattaaaaacccacatgctgttcttcaaactcaattaaaaccatacacaaattaataaataacctacttagttaaatttcatttcactggggatttgtactgcctccacagcctttgactattttaggtaccacactggtttgccagtaggggatatggtaaaaaaaaaaaaaaaaaaaaaaaaccaccagacttctcagtctgggaaggttaagtttgagagtgaataggattgtgttctgaaatggttaagtgtggtagagaaatggagcacatgtttgcttttcaaattctggaagtgtttcatatgcaagaagcttatggacccattatcccaagagatgggtagtgcctgaaaatgtaatttcaaagattacgataaatgtgaagatgacagtcataattggttattaaagaaaactaaatgttttgagtcacccttctctaaggctattgtcagggccatggatttctagctgcttagacagagtcacatttgtttatttttggctgtgctgggtcttcactgctgcaggcagcctttttctagtcgtggctggtggtgatacgctctagctgaggtgcacaggcatctcactgcgggtggcttcttgtgttgaggagcatgggttcaggtgtgtgggcttcagtagttgcggagcacaggcttagttgccccaaggcatgtgggatcttgctggaccaggaattgaacccgagtcccctacattggcaggcagattcctaaccactggcccgccagggaagtcccagagtcacatttaatgcactctttcttacatcctttagaggcagtgtgtactaagaggagcatcttgctttcagagcacatgctcattgatttatttttcttctttttttaaaacaaaatgatcatttattgttgactgggcttaggaggtggttctcacttggagtctctcctgaggttgtaatcaggtagtggctggagctggagtcgtctcaaaggctgtctgtttgttagcctcaaaggctgaacctcaactggggtgagggttgaaaccctactcttgggctctccattgttacttgggcttccttacatcatggtagctgagatggaaaagcagtcatgtcaagagaggaagagccaggctaaagtaccttggaagtcacacaaagtcacctctgcagcatttcttcattagaagtgagtctctaagtccaactcaactcaaacgtaggggaattagactctgcctctcaatgggaggcctactgacttttaggaaaatatgctagtttctttcccacatcttgatgataattacacctaacatctctcccgtgctattcaatcaatcaattattcattcattca

SEQ ID NO: 48507 - DNA, 587 bp, Bovine  19866880681316
tctggagaggttaatgaaagaatagcacctgcacacacgaagtgaaagaacgtgggaaaattgcccaacacacaaactcagcaatgcttcaacatgaattgtaatttattgggttaaggaattcaggccgactaacagatacaccagggaaccagcagatggcatgcctgaataaggataactccaaatttgggaaattttctgatctggtctaatttaattaatgaaatttatgaagcatctaccatgtaatgagaggcagagtgagaatgcaagaataaaaaaagaaatctaatgaggatgtgaaagtgcaatgtagaaataactactggtgatagaactataaactaatgctggagaaaaacatttcagaagggacatctgggaagtgtaaaacagttcttatgggcagcagctaaccaaattcaaaaaagaagacttttctcattatctcactttctctaaaatacataaaaatgtactctcttccaaggtaaataaatgtaaaccctatgtttatattgtttcattgttttgaaataggcagcattcgtatatctcccatttaaaaagaaaatgaaaagtaa

SEQ ID NO: 48508 - DNA, 1815 bp, Bovine  19866880689385
acatgaaggaaaaaaaagtgttctgtgcagcactgcccataatagcaaacccttggaaataacttaaatgaccatcagtagaagatggctaaataactacagatagtaatattaacacaattggccattacacagcaattaagaggaaagaaccagactaacaaatataaacaacaaatacagatataaacacagatacataaacattatatatttatatatatatgaaacataaaaaagtatataatgttgcttatggatttgtttgtaatgtatagtaagagtataaaaacaaacataagaagaattaacaacaaattcaacataatgattatctcatctctggggagaaaagaaggaaatgaaatcaagatggatactaatgaaggaatcttcaactcttcctgtactgttttatttctttaaaaaagaaatctggggcattccctggtggtctgatggttaggacttggtattctcactgtctgggtcccaggttccatccttaattgggggaactaagatcctgcaagccatgggggatcttgggtgtggccaagaaaaaaaaatctgaagcaaacactgcaaaatattattggacaaagctagatagtgagagttttataggtattcatctatgctttatccttgaaacatttaagaaaacaaaaaaggcacaacgttatagtataaaaaatgcagtattactaccatacacgttattactaacaattatgttctcttatacaaatctataggactgtcaggtaaatatcctcaagactttaggaactgcttacaatctatatattggaaatgatctgaaaagtatctgacattttctgggtctgggtatgttaatacatgacagtaaaacagaaccaagggactttcctggcagtccagtagttgattctgtgcttccagtgcagaggccatgggttctatctctgatcagggaactaagagcccacatgttgcatggtcaaaaaaacaaaattgaaaaaaaaaagaaaagaaagaaagaaaaatagaaatgacagaactactatagtcattaacactgaaatcataaagatattcaagtcccattaaatcattaaagatatttaataatgaggcaacaaatgattatgttctctatatcttctcattttttataaatggcattacttttataaccaggaaaaaaaaaaaaagtaagggaaagatatcaacaatcaatatcttgattatgtttttcttaattgtttttaaaatttcttcatagaaatgtttttctttttctacctttttcatttcattccaaattcctaaggaaatgaacagctctgaggcatgaaacttctgttcaaaattataagtaatatacacactttgaaaagttcttaaaaactgatgaactagaagacaaataattttaaatatgctgcaaaagaagcaatggtccatgaaaaatctatgattttcacacctactgcattccatatcttcaggccaagcaacaccaaacagctccatgagcttcaaacactcactgtgagcccgctgacagaacctatggcagggaggtgtgacacgactgtattccacacagataggagcacagagtgcacagggagatggccggaaaccccgagagcagtccaaattcaccactgggcggaatggccaggaaaaagttcaaatcagatcattagatggagagttgtatgtatacaagtcaaagttttcttcatatataatatggcaatattcttgttttttctgttttggaagatttctgaaggcaattaaaattttctaaggtaaatt

SEQ ID NO: 48509 - DNA, 867 bp, Bovine  19866880693832
attcttaaccccctggaccgccatgaagccctgaatcctgatttttcagtcttctgaaaatgtctataggttgttttttttttaattttataggttctcttctattttctttttctttgtttgcttgttgtgaccacaacattggcctgtggaaccttaattgcccaaccagggatcaaaccctcactttctgcagtggaaacacagagtcttgaccactggaccaccagggaaatcccctcttctattttcatctagaaattctaagattatctgtccctgttatttgagggtcctagtagcccagggggcagttaattaggagggaggagaaaatggtattctttttcttcttctataaagtataaaaagtgtctacctgtgatatatgatattccctggttagtagcaaagatggcattttacaggccttgaggttgttgttgaatcaattatttcagtctccattttgcctgccctttgaaagcagaatttgagagtctaaaaaaaggaaggaaaacagatctgttggaagcatgaaaccagctcctcatcctcctccacaaaagggaagaaataggcctgagctagtttctaaataggaatgttctgacagtgtgagagaatttagaaagtgccaagaggaagggaaaaacatggagcccaattttgaaagccaacagagggcagggtgggcgtgagagagacagtcacacctgttcctgctgtgtcttgcttcctggctccagatcgccctcctctgccaaaccttctcactctagttgtcccttcctcacccattcagacagatacacaaagactgaagctcaggaaaacacctctccactaatatgtaaatacactcac

SEQ ID NO: 48510 - DNA, 1160 bp, Bovine  19866880730198
cttttaaattaaacttccatttttgtttgtttgtttgaatgacatttctttcctcacataattgttttagggagtgcctgtgaaaagaatgtgtataatgtaaagcaggatagattagatagaaggtcctattacttcatctccagtctggattactgctgtttactgctgtaatctcctaactggtcttcttgtctttggttgctcccttcaacaacccagtgtgtatatggttaccaaagtaatctgcctaaaagcacacctttatccttgccgggccttacttcccacagctgacagtggggcttaatccattttctctgggaagtctgatgtgccatgagctgaaccaaggtggtctgcccttgtgacccttccccagttcatagagaaaagaacacttaatgggtagaatttcctcaacttgtaagtccccccccgccccatttgtttttctatagtaaggatccaaactcttatctgctagcattgaagtgttagtcgctcagtcatgtctgactctttgcggccccatggactgtagcccgctaggctcctctgcaattctccaggcaagagtactggagtgagtagccattcccttctccaggggggtctaacccctgaagaagacccagggatcgaactggtgtctcctgcattggcaggcagattctttactgtctgagccaccagggaagcccatctgctcgcattaactgatgacaaacagcaagtaaataataaaagatttggcaattgcaggtcatatttattttaacagcttggttttctcccaggcactcaggctggtagttgcgatcattacaatgttaaagatacggtctttttctttcttaaaaattgtttctctttgggatgatggaatgaaatatatcaaaatttcatcatagcacattagagaaaacaccgccctcccaagtaaatactttggcctcttcttcagagtttattcaaccttatcactgctactccccttcatgaatccttgacttcagaaaaagttttctaatctctgttcacatttgcttttttctttccttctttgcataaacaattttatctccctggaactctgtcctggcccacgccttgcatataaatcccatccagccttaaaggaacaaatcaactctcta

SEQ ID NO: 48511 - DNA, 4692 bp, Bovine  19866880758963
tgaaactggaggggtgaatccatacaatgtttttatggtgcagagcccaatgagtttcacgtgaccacatctttttcctttgcccaaacagagaggccagcaaccaggaaaccccttcattactgggcaaacctgagggtcggtcaacctcatgtgaggctatacttcaagacttctttcatctgcatcctttctctattataattcacttttgcatggctgcaaatgtagcatgttgcataggttagtttttcatctaaatattttatagagcaaacaagaccatccccaagaaaaataaatgcaaagaggcaaaatgattgttgaggaggccttacaaatagctgagaaaagaagtgaaacacaaaggagaaaaggaaagatatacccatttgaacgcagagttccaaagaagagcaagaagagataagccttccaaagtgatcaatgcaaagaaatagaggaaaacaatagaatgggaaagactagagatctcttcaagaaaattagagataccaatggaacatttcatgcaaagatgggcacaataaaggacagaaatggtacagacctaacagaagcagaagatattaagaagaggtgacaagaatacacagaagaactatacaaaaaagatcatgacccagataactacgatggtgtgatcactcacccagagccagacatcctagagtccgaagttaggtgggccttaggaagcaacactatgaacaaagctagtggagatgatggatagctccagttgagctatttctaatcctaaaagatgatgctgtgaaagtgctgcactcaatatgccagcaactttggaaaactcagcagtggccacaggactgggaaaggtaaattttcattccaatcccaaagaagggcaatgccaaagaacgttcaaattattgcacaattgcactcatctcacacgctagtaaagtaatgctcaaaattctccaagccaggcttcaatagtacatgaactgggaacttcccagatgttcaagctggatttagaaaaggcagaggaaccagagatcaattgccaacatttgctggatcattgaaaaagcaagagagtttcagaaaaacatctactcctgcttcattgaccatgttaaagatttgactacgtggatcacaacaaactgtggaaaattctgaaagagatgggaataccagaccaccttacctgcctcttgagaaatctgtatgcaggaaaagaagtaacagttagaactggacatggaacaacagactgtttccaaatcgggaaaggagtatgtgaaggctatatattgtcatccagcttatttaacttatatgtagagtacatcatgcaaaatgccaggctggatgaagcacaagctggaatcaaggttgccgggagaaatatcaataatttcagatatgcagatgacaccacccttatggcaaaaagcaaagaagaactaaagagcctcttgatgaaagtaaaagaggagagtgaaaaagctggcttaaaactcaacattcagaaaactaagatgatggcaactggtcccatcacttcatgacaaatagatgaggaaacaatggaaagagtgatagactttatatttcggggctcccaaatcactgcagatggtgactgtagccatgaaattaaaagatgcttgctccttggaaggaaagctatgacccatctagacagcatattaaaaagcagagacattactttgccaacaaaggtctgtctagtcaaggttatggttcttccagtagtcatgtatggagctggactataaagaaagctgagtgccgaagaattgatgcttttgaactgtggtgttggagaagactctcgagagtcccttggactacaaggagatccagccagtccaccctaaaggaaatcagtcctgaatattcattggaaagactgatgttgaagctgaaactccaatactttggccacctgatgcgaagaactgactcacaggaaaagaccctgatcctgggaaagattgaaaggcgggaggagaaggggacgacagaggatgagatggttggactgcgtcacctactcaatggacatgagtgtgaacaagctctagcagttagtgatgggtagggaggcctggtgtgctgcagtccacggggtcgcaaagagtcggacacgactgagcgactccactgaactaaagttccagtgcaggggacatggttctgatccctgatcagggaactaaaattccgcgtgcctcagcacggacaagggaaaaaaaacaaaaccatgattgtaaacgagatctcagattctctatcctaggaaaaactgttcaggtgatttccttcatgccaacaggaacaggtcactctttctccatagttacattaatatcagtgaagaatgcctgttgctactctctcaggggctctagaacagggataacacacacatggtcagtgcgtcctctcacactcagtataggatctgggttggagcagatccggaagaggaaacactgattgagatcacaggctcctgcaacccaacaccacactgctgaccatcaccctccacccatctcctggctcatgaatgagtggaggaatgaacacatggatacagatgacactagcaaagcagcttggacacctgtcttatccccaacccctctatatacagagagcattcctgatgtcccatttgttcccagaccctctgtctacagacagcattcctggtgtcccatttgtaatgaaaaaaaattcaaacccatcaattttcaatgacactgttctcattagacactggatagacagacttgtcagtaatgactgcgggcatgaaagataacacactacctctgcacgcggtacactcgagtccacgggggcacgagggccaggatccgggccaccaactcgatcaggtcgctgggggaataactcttgtatcttcctgacttccacagctcatagagccctgtcccacgaatcaccagggtagggtagagtttcaacccgtcaggacggaaagctgggttctcgaaaaactcctgtggagagggaagatgagctccattagttacatggagattacccacggtgaagtttccatcctgggccgacttctctcacacacctgcctggtccctagactactttccatcaagcgtggggaaacagaacagaaactcactgtttttacagtctcacgggagcaagacacttgggtgctgggtgcccaagccctggctgacccagctcctggccactgctgcggggtcatcacttgccagcctcccaaccttgccttcctgccgtggcaaaggcaatttcctctgcctggaaatcttatcaggttttcttcatctagctcacctttaggtctcagctcgaatgccaattcttcaacgaggtcttactgaccttcaaatacaagttgcttcacttaaattttttttttggcgggggggaattctgtattattgctttcttaacatcatcacactgaagattcatctgatgcctgcctttacctccagaccacaatctcctttaataatgaagtatacttaaaagtgacttttaaaagtgacgtagatcattatctgggctgcaaaacctagtgtttcctgtgtggccctctgcagagaaagtatgccgacccctgggtatgactgtgttgctctcaggccagcgggcaccgttcctaacccagaagacacacacagtccatttgtcacctggatgctgagcagtacagctaattcatctcttttgacacagtcatttcctgcattgtatcacctcagctggcttatttctttacttgggatgaagcaaggagacatcaagccttctcctttctatgattttgcactgcaaatctgctcttatctagattccacttgacatgtgatggaggaattaaagtggattcatatagttccctctcaccccgacctggcattagtgtctaaatggccagagtactgtatcttgtgaatggagtaaatgctttctatcttgtgctgttattactccagggcttcccattgtgtaacttgctttccaaagagatataactactgagttttcgatctctctcattgattcctattatcatcttaaatgctgtaatctttgtgcaccattggctctgagggacagtctgctgtaactgcgtgtaattttccctgtaacatttctattttaaagagtcatccagtctttaataaatattctatagccatccacaaaaagtatgtatgcaagtcactctccacctagtctgcatccatacggggaacataggatttcagcaaagtacttctggctacttgcataataaatttaggagatataagggctgatataatcctttcataagaatgatgatagatggaatgggcgcaggatttctggtaaacacagagaattgaaatatgtgtttctttcctttccttccaaaatcacactaaaataacaggaaataattttttttaaagcataaactcggaggaacaaagggaacatcagacgagagaggaggaggagtaagtgatggcagtaatttctggaagacagaaaatggaagactgggaaatgactgcaaatgaagaaaactgcaaacaaaccatctgcaaaggagggtacggaggaaagggcagctcagccacacgagagtcc

SEQ ID NO: 48512 - DNA, 876 bp, Bovine  19866880806034
agttgatggccatgtgttatagtagggacagaccaaataggaagaaaatttctattttacttctttatttttaataatttattaaattaataataaaaaataatttatttttttaattttggttgcactgggtctttgctgtggctcgcaggcttctctagttgcagtgagcaggcttagttgccctgtggcatgtgggatcttatttccccaaccagggatcgaacccatgtcccctgcattggaaggcagggtcttaaccactggatcaccagggaagtcctgaagttttctattttaaattaagtgtggtctcagatttagaggacccacacctggagcagattctgccactaatgtttgggtgaccacaggcatgtctttttccctttcctggacggacctttcttgtgtgtaacagtgagtttcctgaaatagagttggaaccagctgccattctggctcacaaagttacctgggctgggcaggcttttctgcctcttagaatgggttgaattttaagcctttttgctgttgggttgggatatatgccacaggctcttcaaggtaaactagaataccccctggagaataatgttttaaatggctctacaggaaaatttattgtgagtgttaagtggctaaagaacagagaatccctagggagtgatccgatgccacttgtcagcgctggaaaaactttagccttttggttaatgggaaagagcatgcagagtttggggtaataactatggtgtgcctagcatttgtggagaacgtttttgtgtctttcctgtttttttggattttacttccttcccgaaaacacttccctggcctcttctgtgtcttgtaagcttcaacttaaattgcaca

SEQ ID NO: 48513 - DNA, 882 bp, Bovine  19866880825768
aaactctcagaaattaatagaatgaatgtagaaagaagaggaagaatatagtagaactgaaaagcattatgaaccaattcgatataattaagatttacacaacttgagtcggacgtgaatgagtcagacacgactgagcaatttcactttccctttcatgcattggagaaggaaatggcaacccactccaatgttcttgcctggagaatcccagggacgggggagcctggtgggctgccatctctggggtcgcacagagttggacacgactgaagtgacttagtagcagcagcagcacacaacagtaggatacaaattctactcaagttcccatagactataaactgggagacactgggacatatccagaaacataagatcagctgcagaaacctcatggtctaaaggtattgaaatccacaccttgcttttttcattccataatcattttttagctttgtccatatatgagccctacttcattcatttaagctgctattagtatcccaaaactcatcccttttcaacagccaaaagccatgctgaaagtccaatgtttcccttctttccacccttagaactgggcatcagaatatggagccagatgggctcagtgacttctcctgggcttccagtgggctcatcccctgctatgttacagcctttactaatttccactggggcttatcccaagtgattggattaatgagactgttgatatcatcatttcactgccatcttcgtaattagttcttagtggaaattgttatagtcatgatccttctcagtaggaagaagtcaagaccaaattctgggaatagagcttttcgaaactacgtgaagcaggaaatttgaaatggaacctgactcattcctagttga

SEQ ID NO: 48514 - DNA, 1719 bp, Bovine  19866880878536
ctccccttgtcccccaaagaaccggaggatagacatagagcagaaggaattcttacagactgctgctaggaggaggaaccaacaaccactcaggtgaatatgataaagttaggatttcttacttgacggcctcataaatattgttggaggtatgtcctgataaggcatcatgtaaatttcgaataaaataatctctgtattcttctggaagggccataaatgttccacccatcacgataaattccactttatccacactgtgaccaagctgttttaactgaaagacataaattcgtcagcattagcaaggtatagtcaactactcttaagtggcttactgaaattttctaattttacttggcagtgtttttatcactacagtttaaaaacgagaagcaaacatgttgagcaaattctacagactcaagaaaataggctccagagtctgaaagaaaaataattacggttcaaataagaaggaagagtaagaatttaaaataatcaaaagtttgatgtcaacttacagagttaagtgaacattcaaaaatacagaggatataaattagcagcaaatataatcacacaagatataattgtatacattgtaacagaatgaacaaatctttcttgattatgtattttttaagacttcactgaatttgttaccagactgcttctgttttacgttagcttttttgcccaggaggcacatagaatcttagctccccgactggggcctgaacctgtctgccggctctggaggcagagtcctaaccactggaccaccaggggagccccccagtatgtattttatgccagaccttggggtcagcattgaggacgaagaagcccataggcagtataaccaggacttgatgcaaacgaaagaaagggaacaccagatgagaaagcagcactaggaaagcagtttcacatgaaaacttagctgttttgatttgtgaagattctggatacaggtggcaccttttcagcctggtttccgggtgggggagtaatcagtctgaaatgtaatatctcctctacatggggacacaatgatacagatctttccagttttcaacaacaagtcaagattctactttttaaaaacaggtatttcgatttcttgccaggtgttaggcttgagaaaaactcagtcaaggtgactacaaattatgaactctaatgtactaagtaaacaggatatctgcacttaatatgagcaaaaagttatctttttgaatacttatttctgaaaatggaacatagcaacttataaatacatacatccttatagtaggttggcccaaaacttcactccggcttttccataacatcttatggaaaaacccaaatgaactttttggccaacccaatacatatgtaaatccttacacaaacataagcgtatgtgcacgcatgtgcaacatatacaaatatatgtgtatatagctatcaacactaaaagaatactccagctgtggtcgttcaccaggggtacacagttaaatctttctggtagctttttcaaaatatcttgcctggaccctaaatcagacagcactgcataactccagtggcgaaacggggcgcgtgttttgacaaagtcattcaggtgattctagtacatttacagctgggaaaaaatcactgctctctggtactttctacatcttccagaacccatactccttttggtaaacagaaacctttcaagct

SEQ ID NO: 48515 - DNA, 1953 bp, Bovine  19866881072384
ttcctacagaaattgcctcttgcagtagtttatcctcattctagccccattcctctaacccaccttcactgaagaactaatattcgaataatagactttcacatgtacattatttcacttggttcttgcactggtcttgtgaaatgtgtatgtattatcccaattttgccaacaaggaacagggagctcagaaggcattgatcttcccattacgacatagccagtaggatttgggagctagggactgagtctgtcatccaagtgttctgctttaaatcttctgtgttttttttttaaagttatctttcaagagccttttacttagtatgcagattatgtgtattctttcatcttctgaatcgttttttgtatgctcattttctgtagtgtattttgtatatagttgaccgttgaacaacccccggggttggaggcactgcccccaccaccatgcagttgaaaatccaaatactgctatctctgcctcaaaagcaaagaaattgacaaatgactcacccaggggcagtaagctcacacagtttggatagcattaggactcaaatcctagttcttttgtttccacatattgtggtcgctaattaaacaaaaacttttccccatacttagttaatttaaggatctgaaaaatacaggtactgtatttattgagaaaaaaaaacacacatataagtggacacacacagttcaagccagtgttcaaggatcaatctgtacttattttctttaaacactactttgatctttttactcccaaactcaagaacatataattctccactgtgtattgcatcttttgtcgagtagccagtgtaccctgtgatctgattttacccaaccctgtcagaaaggctccattccagtttggcaacactttcatataaacatgattggtaattcctatacctaacattgttccttctggattgccctctgttttgcttgtccaaaccctgccctttctctaaagatctctctgatttcctccatgaagacttttcttactaatttacttctccagataattttcgatacaccgaagagctgtccaaatgtttttaaatcttcatctccatgtatgcctcgtttcactgtgtttagctttaatgtacttcacagatactgtgttttgtttgtttatttttaccaaatgaaggtttggagcaactctgtgttgagcaagtctgtcggtgccatattgccaacagcatttgctcagttcacaactcagtcgtgttttggtaattcccacagtatttcagactttttcactgtttctgtgtgtgttatggtgctctgtactcagtgaccattgatactactattgtaattggtttggggtcccacaaactgccacgtaagatgacgaacttaatcagtaaatgatgtgttctgactgctccacctgttggccattcccccatcttcatccctctccttgggcctccctgttcctttggacaatgaggactgataaatgctactgaattaggccagttagtacccctacaacagccttcaagggttcaggtataaggcagggtcatacatctttcactttaaattaatagccccaaatgattaagcttagtgaggaaggcctgttgaaaactgagatagactgagtgctaactcaacagccaagttgtgaatgcaaagggaaagttcttgaaggaatttgaaatgatattctagtgaactcatgaatgataaggaaacaaaccagccttattgctgctaatggagaaggttttgggatctgcatggatcagccagccatggcattcccttaaacccaagcctaacctaagacaaggccctaactctaattctgtgagggctgagagaggtaaggaaactgcagaagaaaggtttgaagctagcagggctcacttttgtgaagtttaaggaaagaagtcatctgtacagcatcaa

SEQ ID NO: 48516 - DNA, 1057 bp, Bovine  19866881096972
tccccatggatggaggagcctggtgggctgcagtccacggggtcgataagagtccaacacgactgagcgacttcactttcacttttcactttcatgcattggagaaggaaatggcaacccactccagtgttcttgcctggagaatcccagggacgggggagcctcgcgggctgccgtctatggggttgcacagagttggacacaactgaagcaactaagcagtagcagcagcagagctaggttacctggtcccaaattcccacacttgtaacttgctagctctgtgacctgttgatacgcctctgtctgcctcagtttcctcatctgtaaagtgggaacgactgtagcaccttatctcaccgacttgttggggattcaataagctcatgtttgtgaagtgcttagggtcccctcaagatatcacagtgatcttagtgatgactcaggaaagagaaagatgcaggagagagctggaggcactgagtttctgaagtcacagactgagacaagcgcgagccagcacgtgatggcggtagaggtggaagcagggtggaggctggcccctaccccggcatcatgggcgtcagtcgagcccactttgcagaaggcatttggctctatctgggctcaaacaactactaattcctccatctctgcccctccttcccgtgctccccaaggagtcctctgggaccggaatgcaaactgcataagtcgaataccttcagctgctggaactggtgctgcatcctttcttgcgcccgttcgaacatgccctcagccacctgccggtccacccctcttctgaggacatctttcattctttcacatgcttttttgcctgtgatctgtgcggcctctggcaaaaatgacagccacagtaacacctcaacaaggacttgcttagatatccttagcatcagaaataaagacaagcaaaccaactatacatacatacacatatgcatatacatacagacacacatatagacacacctggggcttcccaggtggcacagggttaaaaaatctgcctgcaatgcaggagagtcaagag

SEQ ID NO: 48517 - DNA, 1066 bp, Bovine  19866881102146
acataccccatcaacagcatcacccaccaccggaggagggcctccttcccagcaaagatcccagcaaaggggctgttccacggggcccaggatcagggatgggtggggtcctcagccagccagtttctcagaagcatttgggggcgtgggtctcggggaatcagcgggtggaggagggctgaagaacgccctagacagaggagctctgcgtgcatacccaccccaggtggagggctttcacgtgtcgtttgatgcccacgatagagcgcaggactttgccacagctgggccacaggcacttgtacatcaccttcaccgagttctggagggaaaggaacagggatgaggaggtcatgtccccccgctcagcctcacccagtggggctccagtcacatccaacaggacccagcagaaggctcaatcgagacttcgagaaggctaaacgggttcccagagaccagaaagactgacaaacaggggcagagagctggtcctgggggccggcatcggtctgcagcagagatgggggtgggctggcgggagggggatggaggagaggagatgggctgggggaggggagaatagggctaggggacaggggaagacctgacggaggtctctgcaggggagctgggttgggcagaggtgcagaggccaacgatgcggcattggagaggaggggcgggcttctgggaatatcaagaggaaagagaagcagcaaaagagagctgaaatgatggtccagggcctgggactcggctcccaatgcaggggggccagggttcgatccctggttggggggaactagatcccacatgccacaaccacgatctggtgcagcctaattaattaattaatttttaaaaaaatggatcactgaaacaggatggggcccgagaaggcccaggaaaccaggcctggcccctctgtggctgagcttgaaagctcaagctactcacctttctttttcggggagctggttcatccaacaggaaagcgtctgggtcggtctcaaatccattatcagtctggggagagccgaaggcgtcccccaggtacttgggg

SEQ ID NO: 48518 - DNA, 1162 bp, Bovine  19866881159595
agtccatgggttgcaaagagtcagacacaactgattgagcacaaattcggtgtgatggctttaggaggtagggcctttgggaggcttttaggactcaagatggagccctctcagttgggatgatgccctttatagaagagaccctagagggcttctgtgcccttctgccacgtaagcacacagcaaaaagacagcccacccctaaaccagcaagtgggcccaagcagacaccaaatctgcctgcaccttgatcctgtacttctggcctccagaatactgagaaatgtctgttgtttgtaagcttcccagtctatggtattttgttatagcagcccaaatagactaagacagcccagactaagaaaatgagtcccacataagagtcttgaggattcaaaactaaaaagtaatctgcaaaaaaatgacatttctttaaacttcactgccgtggatggtatttcatgatattggcaaaaatgaagtcagtgagtctgttaaaagtggattcaaatgtttatatagctaaagactcttcgaagatacttcctgggaactgagtctgtatgacaatctcagcacttatgattggctgcttttcaggggaacaaagcttactgcctccaggatcacttctctctcctccatcctgctatgttctggatctcatggcatctgttattaggcctacccagagcctagacactccaagggaacaagtaggaaaaacaggcaacctccaaaatcctgctgggaagaaaaccactacctaaactcatcgccctcttcactttataaggatcttacctcctggatcaggaaagtctttttatagctgtcatatttccagccatttcttatcccaatttcagtcatcttctcctgcagagagagcttaaaagcatctatgtgggggatcagagctgaaccatcagtgggcttcccagacctgaggaaagcaaagtaaaatgttaagagatagcagcagctattgtgggattaaaacaaagaatcaactagctggtattcttttactcatttttaagagaagggggatgagatcattagttataaaatttctataatgttccaagcactgtgctgtgctaggcccttgatataaaacctatgaagtcagtgcaatgacacccattttatggatgag

SEQ ID NO: 48519 - DNA, 974 bp, Bovine  19866881322430
tgggccctggaaggggtcccccctcctgcaacagcctgagatacttttaattgtggtaccaagttaacaatgtgaatgaatcatgaactttgccctccccctatgcctacccccagttacctgatataacagctattttcccagatccatgttcttctctggctattcgttctgcttcctccatcagcagcatgccaaagccctacaaagaagcaataaagggggttagggaactgtgaaggagagaagtcattaagaggggtccataaaacaagaaggctgatatttagtagctgctaaactctttaaaagtgacaaaaacccatttataggcataaggaaagaaatgattcaattataccaaaagtactcagtggcagactaggaataactgcaacaaaagccatcccaaggtattttgcggatgatgtaatctagtcgcagcaagggaggaattgcctgtcaatttctgtcgctttttaaacaagttctaggcaatctccaggtgatgaaagtctggagcatctaatcttgtattattagtcaccctttcagtttctaaaaggcttttggaaaccaggcaatattcttaaatcatcaatagattgggggtttaatgctaggtccaccattagcagttttaacttgctctcctgaaagtgaaaaaaagtggttatttatttaggttgtttgggggagtagaatagtgtgccactatcttttagcttgcattgacaaagtgctttaaaatttcataagtgctttctttcacattatcatcttccttcgattccaaactagttgaatcacacaaaattgctggtattagatcatttctgactttcaaaaatagcaatttcctatgggttcagtctattattatattccacttgattgagtctcaattcgtctctccccctccctcatgcccaaagggctacaatttaaagagaaaacctctctgaacaacagta

SEQ ID NO: 48520 - DNA, 1030 bp, Bovine  19866881329983
atggaagaagcattatattcaaatggtcaaagaactccatgttaccaagcccaaggtaaatttgggaaaagaagcaacagaattactaacatcagctacttaggaattctggaactaagttggggaaggcctttggttcaaaagaaatataccatgactacaaaattcccttgttctaagaactcaacagctcttttcaagatatccatgttagttgaaagtcatctgacacaaaccacagttccacctaggttaggacttggagctcctcattctctctggattcctggatttctgtgtctctaatgcctacagaacacaattctgacacaattctgcacattctgtgggtaatgtgcagtatttattacctatgggtcatcaaattttacttaaccaattcaagttttctgtgattctaccaggcaaactgaagtttatgtttctatcacttataaagaaaagttttgcaataaattagtaattaggaaagggcataatgggcatactaaaattctttttactttagaaactagcaatgtaaagtccttacatagaatcataaacagtaaataatatgagcatacatttttctaatgggtttctatgcattataaccaatgtttatgttcattcttatagtcacagttaattagataacttatgggaaatttttatgagctttttctttatggcatgatctatatacatgcagagttgtgcatcgttttgtataatagaagagttcctgaaaattatgtgtaaattaaaattttttaattatttttaaaaccacagggatttttttttatagaaaagctgcagtgagtcctttttgaattgaagaatccttttgaaatacgaatagttggttcttaatatgctcatttacgtttcctgttattgtgtttacttgaagtagaaaccctctacatttaatatagtaatgaactgcataattaatactgttataattacaatgataaaagcagcctttctgatttcaatgatggctgttcttcatgagaat

SEQ ID NO: 48521 - DNA, 1111 bp, Bovine  19866881334493
cagaaagactgaaagtcaaggaaggagaagatggggttcagagcatggacagaaaaatgaataggaggaacacccagacccctccctctcagatgggtaggaacatcgatctgcttggtgggggaagaggaaggctcatgcagttcgcccatgccatcttaccggttggtatctctggccacatcctcatagacactctgcaccccaatctccagccttgtgcagccataggtcaacatgtcactgagatgccgcttcatgcagtaatctggtctggtctcaatagtaattccaatgcactttgtgaggcttctctcagaatacctatagagaaaagagaaaagtaaatagcctgccaaagctttaggacgttggctctcatttcaaggacgtcttccccttgtcctcccagatctaacccagtggttgagagcaccagctctcgggtcagactgagttcaaatcctggttctgctacttcttaactatgcaaccaggaacgtgattaacctcctcgtgcttcggtttcatcctcggcaaaatgagggtaatagcagctacgcctcatgggacagacgtgcctgagctggtacacagtgtacggtattcatcgtcaccatcaccatcgtgttcctgcagcgtgcggcagccataatctccttgaaaagcagggatgtcaactgtgaaaaccctcattttcagttcctagcaacgatttttcatgtaagtgaaaaccatctgcatcatttatttcctactccatgttttagagtcatgttaaaagaaggaaaacaaaagaagggggagggaagggtatgcataatgattataatgatcaaaggaagaattcaggtgaaatgtttccccccaccccacacacacacgtcttcttgtcaagcctatgaatctcagcaatgacttacaaaattaggagtcatttttctctttcactaaaaccaggtatcagagtggtgagcaccacttaccacttgagattcaagctgttttgagttaatagtcttaatgctggccagaaacccaggaaaatgaaaatgactccctaaggggaatgctgacgtgcaggaataggacactctacctacagaggcca

SEQ ID NO: 48522 - DNA, 1294 bp, Bovine  19866881383071
tgggctctggagccaacaaatgtatggtcctcccggggtacagatccactgtagaccttcgattggttgtactagccagtgccaggaacaaatacagaagatggatcaggcttccccgactgccaatgcaggggacacaggttcaatccctaggttgggaagatcccctggggaaggaaatggcaacccactccagtgttcttggctgggaaatcccatggacagaggagcctggcaggctgcagttcatggggtcgcaaaagagtcggacacgactgagcaactatacaaacagtaacgatagtcaaaaggagcacgattgataatacggtgatttcaggttcattttaaagagcaaaagacccagagtccttcctcaaattatgttgggctccactttctcccccaaagaggcagcaaccgtggtgtgttttgtgaaacctgtttctgcagagaagcagttgaaaacgtccacacgtgtggctcacagggcaaagttttgatgtgtggtttatttcgcttgtatttcaactgtgcggttagcgtgtaagttttgatttgagtacttatttacattcatgtgcagagagcctaagaatagcatcttttaaaagggactctgcatatttagctagatgtgggaaggctgcacagcaccagtttcctgtcaaataattgtgacttttgacagtttttcttgcttctctcactctccctttcctctttttgtgtttgcgtacactcttttttccttaagagaacataacagaggtgacaccaaggcagtggtcactcctgtcctagaagagcttcctagagtggaatgaaataatgttcttgagccccttctacagatgtggacactgaggcctggagaggggaagggacctgttcaaggtcagacagtgagtccaagttcagggttctcatcattccaccaagaaacctctaactggtactatttaaaccatctctggagcttcagagtaagagatggagagaacagtgaacacaaatgaggggttccctttaatgcacgaggaggcatttggggagtgaaggctgttgagtaggagcgagagtggtagcttgatgaaactgggcttaaggacaccaactgaatctagtgacctcagaataaaacaaagccagactgccggggggcattgggggggtacacgtgagcatgcgtgattgtgtgtgtgtgttgggggggcagtgagtagttcattgctttcagtccatgtccagagcagaatttaatgtgtttatgaagaattacaaacatctaagt

SEQ ID NO: 48523 - DNA, 1156 bp, Bovine  19866881748626
atgggttttagaaaacacccccctggcaggattcacctggtaagaaaaggacagtacgggggtctttggggtcaagactgttggaaacggccgaacccagtgctcctgggggtggtataaaccttagcaaatggccgtgaggtgacctgggaaaacagttgaccccaagagtcataactctctaagctcatataagggcatgaggcccccaaactgagtgtgacactgggaggtcatcttccttcaagaaccacagaaagggcgcatcactcagggacccaggatggcaacctgagcagaaggcccaacctcccgcatggggctccaggcccgagtctcccagacagctcaggcagcctcagtctggcatcttcctgcacaaattcctcagtgttctgcatccagctcacaccccagggtacctgcagtgcagggtgagctgtctgccaaggcctgaatcttggcccactcctgctcacgcagtgacagggagttgaaagagcttgtccgtagactcttccatctcagacattctaaccttacaagtatgctccacacaaagaatttatcctggctcagtttaaggactgccttagaactaaacaccaagtggttgctggctcagtggctagagctagagagaaaggggcagagaagaagaaaaatgtacgccacgagctaggtagtttgggatggacatgtacacactgctgtatttaaaatggataacaaacaaggacctattgtatagcacaggggactctgcttaatgctctatgatgaccttaaagggaacgaaatcctaaaagaggggatataggtacacgtatggctggttctagatagcatattcaaaagcagagacattactttgccaacaaagatccgtcaagtcaaggctatggtttttcctgtggtcatgtatggatgtaagagttggactgtgaagaaggctgagcgccaaagaattgatgcttttgaactgtggtgttggagaagactcttgagagtcccttggactgcaaggagatccaaccagtccattctgaagatcagctctgggatttctttggagagaatgatgctgaagctgaagctccagtactttggccacctcatgcgaagagttgactcattggaaaagactctgatgctg

SEQ ID NO: 48524 - DNA, 1343 bp, Bovine  19866881804989
ttccctggcggcacagtggtaaagaatcccctgccgggcaggagacacggattcagaccttgtgcggggaagatcccctggagtaagaaaaggcaacccactccagtattcttgcctagagaattccatggacagaggagcctggtgggttacagtccgtggggtcgcaaagggtcagacacgactgagcatgcatgcatgcagactaggaaaataaacatgaatttactaccttacatctgagagaggtgagccacactagggaacccaaatatttttcttaaataccatctatacaagagaatttagatcagtgagatgaatgtccatccaaaaattttgcaggaaatgttatgtccaaaacacagtatctctgggctgctctacattttgcaaggatgtcaacgtttgaaaagttttctgcgttctgtagtaccaaccagacaactatttcttcaaattacacaaagcttccctaaaaaacaaataccaactttattatagggagctggcagtaaaaatttacctccacaaacacaagactgcaaattggctttctctagattatttcataaaagcatagaggccaggagaaaaaaaagcaaaacatgccaagtgggctggcaggactcagtgtagcatttatggctggctttatggctcccagactgtacttttactacttcccgagagccattcatatttgccgcaatgaaaactcaaatcacatataaatttttatctgaaaataaagtgtttgttgcccccttgaggtaaattaaagaacagaaacaaaacaacgccagctctggtctgtcctttagagaaagaggctttcttcttcaaaagactttttctacacacataccgtgatctgaagttacagagtaaaagttcatttcacccccaaaaaggacaatttatacacaccactaggcatcagaccatttctgtaaaaatagagctaaaacttcacacaaagaatatcagttcagtcattcagtcgtgttcgactctttgccaccccatggactgcagcatgccaggcctccctgccatcaccaactccggaagcttgttcaaattcatgtccatcgagtcagtgatgccatccaaccatcttaccctctgccgtcctcttcttgtcttcaacctttcccagcatcagggtctatttctaaggagtcagttcttcacatcaggtggccaaagtattagagtttcagcttcagcatcagtcattccaatgaatattcaggactgatttcctttaggattgactgatttgatttccctgcagtccaagagactcttaagagtcttctccaacaccacagttcaaa

SEQ ID NO: 48525 - DNA, 1726 bp, Bovine  19866880698234
taaagaatccatttgccaagtaggagacgccgggttgattcctggattggaaagatcccctgagaaggaaacggccaacccattccaatattcttgcttgggaaatcccttggacagaggagcctggtgggttgaagtccacggggtcacaaagggatggacaagacttagtgactgagcacacatgcacacatcagtgctaagtaagtggccaaaccaggactgcaaacacagatctgtctgatccaaagctcaggccccacaggtatttgtctctaagtttaagattgtagtgaacataaagataaaaagcattaagaagtttgcttcatctaaacgttgggtaatccatatttaaaatttttaattgaggtataattgtcatataacatactagtttcaggcatataccataacgatttaatatttgtatacactgtgagttatcaccacaatatatctagctaacagcccttatcacgcataacccagagtaactaatgttttcttagaagtgcttactagggcttcccaggtggtgcagtggtaaagaatctgcaggttcaatccctggattgggaatatcccctggaataggaaatggcaacccatttcagtattcttgcctggaaaactctgtggatggaggagcctgatgggttatagtccatggggttgcaaagagttggacacaattgagcgactgagcacacacacacaggaagtgcttattaagtatttgttgcatatagcaccataagtcaaggagttcttactgtccccatagcaggagatgtccttacctcagtgcctttatgcaaacccttgtcctgtaaggttccctcatagttccttccaaacacaaattctacttattcttaaagattttctaatgctgaacatgcaataagacctcagtctgcttagaatataagtacatgaaattacaaagatttttgcaaagtcatctctgaatcccctagaggcaagcaccagctacaagaaaggtgtcaataaggatttgctggactgaattgactatctgtccatctagtctaccttgcccaatctttcttatcattagttaaatcttgtgacagactgctaaatccattctctgtttcttctctagtattagctaggtgttagctggacacatggttttgctgagactacatgtctaagccttccctgcagttaggtatggccagccatgtgaactaagttcaggactagagaatgggttttttttgtgtcttggccttcaaacactgggtatattttttttctttctgtgggctgaaacatgaatgtagcagtgacctagttttgacagttcaacagggtaacatcctggagagtgccagagcaatggaaagaatctagattactgaattactatatagaatacagcaacttacctgctctgacccaccttctatctctgaatgtgacatcagagagaagtatactcctgctttaagctactatatttcgagtcctcttagcctaaatcctaatgcatattattctagactgttttataacaattgcatgctacttaacaatgagatgtcctgatgtgatgggaaaaatattggatctgttcttatctacagtctcatgcacttataaggaaaccaggcttcttgctggacaaaccatggtttttttttttttttcctgtatctatcctttttaactgctaaggactttacatatttca

SEQ ID NO: 48526 - DNA, 1001 bp, Bovine  19866881049873
atcatcatcggatcctttggtatacttctcaaagtattggggaaatgtttactctgaatcatcttaaaatgaaaggaaattatttgaatagacacattttcctgaattttaattgtccccttgggtaaatagagaaatatacacattaaaattattttgaaaactatataataccttcagcaaactgctctgtggtaaaagtatcactgttctacataaggaactatttttattatttaaagctcccagaacccagttcaatataacagtgtaactaactcaagacaaattcaactgaaaccaacaggcatgttaactttttctttcctgtaagtctgtgattatttgcatgatagaaagaaactgtttaacacttggtcttcttcaacctccatgcacaccctttttctcatgatcttcaccctgcaatcctgcacagtttcactataactgctgtggaacagtggagtatctttgtgctaccttgcagaggcaggccaggtttacctgcagccatgatccaactctcacccccttagaaatgttactacaagtgtttactgccaccctccaattcaaatgatgctacagaatggtagctaaaaatatactttgcatgactgaaagttggccctgtaagggaaagctaatagaaaggcattttataaatcactgtttcctgttaggggcacccctagcatttgaatagggtagaatagttttccgatacatgggactgtcctgcatattacaggagatgtagcatccctggctctgcccagcaagtgccactgtgacaacagtagcactctcatacatttttccacaaccccaccagagactgtcacaataaaggaaataccatctcttttcagacagaagatgactgccagggttacactcaggcataagaagagagctcccagagtcaccaagtgattcctcttttttgctggatctagatatggttctgaaaaacaaaataaagtgaaactgactaa

SEQ ID NO: 48527 - DNA, 1063 bp, Bovine  19866881109130
catcataaagttataacataaccttgtgcaagttaccttgtctgttacatccctgcagtatgtgtccactcgttctcagttgcctgagctaggaatctgtgagaggcagctaagacactgatacatgtccttgaaagggagtaaaagcgtttccctcccaaaagttgaagaggatcctaggaagaaccctacataatgcatttgactactgagatatagagagatgagtgcgggatggttaacagggcttaaaaaactcctttcttcatctaacaggcacccctgggtacttaaaacagtgacacattggggaatttaaaaatgtactaaagtacaaacagaattcaggaaacatgaagaaaataatatgaggttccatcacacaatgacaattatggacattttttatgattatgagcagtttaatgttttttattggcattttaatgtcttcattttggggggagaaagcaggtatggtgggtatattaaatactttctttaaatagagaactaattatatgatgaatatattcttatgctttatccttttttcttttttatatagaaagcatttttcctcagaaacagaatgttaaatggtaacatacggtctattgtttccctgttgtatcagtcaggatagcctagattatgctgcagtaacaaacaactcttaaatctcaatataataaataaaggtttattcttgctcatgctccatgcccaccgacagtcagccaggcgccctgttatttgttgttactcagaagcccaggctgatgtagaaatcactaccttgaatgttgcagatgaaaacagaaaatacagcaaagcacaggctagctattatatattctaccccaaagtaacagacatcacttatgcttacatttagttgatcacagcaagtcatatgaccacacttatgacctaattaatcacagagaagtgcaatcctattgtgtacacaagagcaagagatctagaattgtgtgaaataacactaagactaccacattcatcatggagaaggatgggaaagagccatctcctggctaca

SEQ ID NO: 48528 - DNA, 1075 bp, Bovine  19866881375934
taaataattattctgaatattagtgggtttatctgagccctccacagtaatctctctcctggtgccatggaattgctgagaggtaaaagttcttccaaattaccattgtttttattgtttaaagaagctaaccataaacctggtttgagattctgcctgaagcagttttcctgtcagtttatatgcttcatggcagttgactgagatatcagaggagatactgtggcagaaggtgggtggccctaagattctggctattcttaaaaggcctcagaatcataaaaacagaaacacaataaatgcagtcttttgtttgtttgtttaatttaggtcactgcttagatttcagtgatctcccaagcaatggaattagaaacttttatcaggattcctaagttgtgactgacagatgatgattatagttgaacttgcctgttaggcgcctctccatgaaggccagggcaagcagcaagattaaatctgtgaaaggtcactgtgggcgcccattgtgcagcagtagtacatactgttgcccaaagcaaagtttttgattaaatcacatcctcagaaagctctgccacaggacatagaccagagcttttttggagtcagaaagacaaatttatactcttgcttttctgctgatcttcaacaagttgtttatttctttgtttagaacatatatttttatttttctcttatctaacagtcctgtttttgggaacctgatttctttcattttggatttctgacactcttgagggcaggggattctcaatgtgtggtctacagaattctgggggtttctgagacatattcaggaagacttcagaatcaaactaattttcatattaatattgagatactatttaactttttatcctgtgcttatatttgtacatgggcattacactctgcattaccatgcaattataattttttaaaaagttctaaatgcataatttcaacaagttgtttaactcagttttctcatgtgtaaaatgagaatgatatacctctttttgagagtcactaggagaaatgaaagcgtgtatgtaaagttgaagaatatatg

SEQ ID NO: 48529 - DNA, 796 bp, Bovine  19866881621784
aaataaaactacagaggaagcatgataaataagagcaaaaaatgactgtatattttatacacttacccatcagattttctttcaatactataaaggcatattgaacagtctgctctaaaaactattaccatgtcccggaagacactaagcagtaatgtttctgcttgtgttttggtgacatgagcaaaagcattgtccagatttgaggttcgcaaatacactctgagctgtagaaaatagaaataaagacaactgtaaaaagaagatacctaccatggatgactaaatactttagacataccattttttcatctacttttttttaaataagaggagctaaagactaatttgagcattaataataagtggatgtttctattttgacaaagtaggcacattctacaaataactaaaagatgagtgatcaaaactgtgatgtactattatgagatactccttttagacctgcatatttagacatgacatcaggaaatgtagtttctcaaaaaataaatatatcaatcaaccaatcaatatatctctaaggacagacattcttataaacttttcaacttttaactattttttattagttacaaattttataacagagaatggctaaaatcattagaaaaagcaatcacagaagtcctgattattcctttaattttttttaaaacagtaacttgaaaatcccattagctaaaaacgtggaatttttgattaaaaggaaaatgtctcattcattttcagtaggttatttttatacagatcaaacaatgctgtgaaagtgaaa

SEQ ID NO: 48530 - DNA, 922 bp, Bovine  19866880533396
tctgcagcgaggatagcttcagaatagtcatccagatctccactctcaggaacttcaggaggggcaaaaaaattaaagaaagagtcattagaaactgttttggtcacagtacgaactgtcccacgtcccttgtgtttctgctgcttcttaatcgttttcaaagtgacattcttcccttttttccaatctatctggcaccctgtacaacccataatttctggtccatcaaaagaaaagggatcagaatcatctggttctgacctcatcctatatgtctttgtcaacacttcatttgtgaaatattcattgggttcaaagtgaaattctaagacaaaactcataggttgaccagcatctgagaacttcactttaatatctttcaagtgcttcagaataggctcacatgttcctgaaccatatcactgagcaagtcaacattcttaaaaatggtcaaccaaaactcaggaagtcccttgggatcttctttttcttcatcctttttctcatcttcaatcttggccttttcttttagctcctctgaaatttcatcttcctcatctggtttccattcacactcttcttctgtaggttcataaatggcattaacgatctcaaatcgcttatcaaacagaggctgataaagaacagcatactttcttccaagatcatgaacttcctcatagaatttggcttctatctgtgcacatttaacttgaaggtttttgagagcattcactcgtcttttaactaccctaagcaagctttcaatgtatcctgttggtgtttctaccagaccatcaagtctttcttgaagggctgcaagaatctgaggattttgcatcatctgaacagtcagctgacgcgctttgattttttgtttcttcaccagtttcttcttcttctacttcttcaacatcatcca

SEQ ID NO: 48531 - DNA, 1546 bp, Bovine  19866880690739
ttctttgagcctggatttttttatccaaaagtggaagggagaaaattctagatgaagggaaccttatacccagagacctggaggtgaaggttatagaagaccttgggcttgactaagatattggaaaaaggaagaaggtggcatggatataattagataaatggggtcagaatacagatgtaaacataactcagtgggtcactggcaaccagagtaacatgagaaaagggtgtgtaaagattggccaaaggagttagtaatatgcctcaaagagcaaagtgcctggaattggaaaagtccccagaagtgagttgcaataattcagatgtgaggtgaggagatgtgaagtagcatcatggtagagggactagaagggtgaaaatctgtataacttggtgagtctttcatatatacatatacacatacatatatattaatatgtacatgaaaagaggagaaggatgagtcaaggatgactgcaagttttaagtctgggtgatagcaaagatgatgatgtcatacacagaggaagatgatgggagaggaaaagagaaagggtttctaaaatactgaattagagtggtgatggcaagtcatccattgggaaacattgtttgagcttctggtgtatggacctggtgatgtggacatatccagattaagtatgatgatgatagttgaagccattggaacagatgagctcccttggtgaatagtgaaaagagagcataactcgggatttaggatagaatgttaaaaaattaaatatgattctgtatgtaaagtggtgggcatatagtaagaaatcaacaaatggcagcttttactacagttaagaacatgcagatttaaaagacaaggtagacaaggagctttcaaaggagaggggcatgcatggcgaaccacaggagcactcctatctgatcagagagtgcatctccatggtaaggtggtcaggcctcagtgtgaggatgccccagggctcctgagaatcaccttccataaaccttaccaactacaaaagagggctgaatattaacagttttgttggtaggttgaattcctaagagatatattaattgatcattcagctattagctgaaagtgatgtaaaatatgacccacagatattttcttaagccagagtttgtaggagcctaccagtattcttacctggagaatcccatggacagaggagcctggcaggctacagtccatgggattgcaagagtcaaacatgacttggcacctaaaaccacccaaccaccaccaccattattagtattctggtcagttaagatcaaccttgagatcatgaagtattcttgcttgagttcaaaggcagttagcatcacctagaacagggacttccactttgtaatatgcctgcaacatcatggccacttggcttcagtgctctgtacctggacagctctctaatcaagaagccctaacatgaggtctcataaatcccagtagtacccatggtatccatatagggagacagaaaatcagtcatccatttgctaacatatatgagtaccaa

SEQ ID NO: 48532 - DNA, 1208 bp, Bovine  19866880753550
ttgaggtttttcctacttaattgtcaaataagtatcttttataaaagatcttatttatagcaagggtccttttttaattttaaaaaggtaacttttcttgattatttttaatatttaaagggctaatcttttaatgtgtgttaaacatgaatgttttgatttaaaaatatgtattaagtgtatttttaaataagtgattaagttttagaaataaagaaaattgtatttaaaggatttatagaaggtagttgtaaagaacagaatataaaagctctaaaaagtgcataataagccttcctgtacagaggcttgattaaatggagcattcatagtcactgaaggcatataacaagaaggtattttgacaattttaattattccaaagatatttattatacagagttaaaaatggttaggacataaatcattctcaaccaactgactataatgagtgaaataatgtgttttggttgatgtatcagagaaatcactcatgatactttctagacttacataaaatattaggaagaagagtatgattttagttctattgaaggcccagatataccaattgttataaatggtatagagaatgactttgaatatattatgtaatgatgatacataatcaatataatgaattttaattaaaatatatagtttttaatgtattaattttagtagcttctgataactggattatgtatgtacagtaagtatatatcttgaattggaaatagcataaaagcaacaaataatggggttttaaatgtagatttaaagagtagccagagaaaattgttatgttttttcagtttttctgctctgttaatcacctgtacatttcagtcacattagaaatctagtactttaacttaaatgaagacaataaattagactatcaagaaaattgattggatggcttaatgttcagtctgatttgttcattgtaaattgactaaagacctgtctttaagtcttcaaactaaaaaaggttgaaaataagtagtacagtaaattgagaagttagattgtgtctgggggaaatagttactgtttgtaaacatttaagtaaatggaaatgtaaagctagcaaaagagaggtgagagaacttagcacaatgatatgaggaaaactcaaaagtagagacagataatctgaaaactttctttagaaagaatattaagaaagagaacttcaagggtgt

SEQ ID NO: 48533 - DNA, 1475 bp, Bovine  19866880885918
atgaattgtgtgagtaggaggtaggggacagaaatttaaaccaaattaaaagtgtgagagactgcagcacatgggaaataaatgctcattgccactagtctcaattatttttcattattttcaaggtcaagctggcaaattttcacaacttctacctgcaaatgcccttctcgattgattaactcttacagctagaagctctctttatacccaggaggcaagcctgcttttttattgtaataaaaaacctaaatgccaaagcaaaaagaataccaggcttctgtttatttttatctgaatatcaaagcccatgtgaactctaaagcaattaattcagtactaatccaggatttttaaaaaagtttaaatgatttaaaaaataatatgctgaggaaattattcttactgagaatccgaataaagcctattataaccctgctaggtaggaatcttctaaatcttccttcccacctgataaaatgtggtccctggtgtggcaaaagaagatctttccttcaccataccttcaccatgtttctgttgtggaataatgaatatcttatgttcacttataactgtgtaggacttttccttattaatatttttgtcctaagacgtcaaccgtagcccaaagaatcagggtaaatgttcttaattttgcatgtagagaaggtaagaggttcccagtgattcttaattgtcatactgataaacaaagagaatgacatatgtgaagcttggtagaagcagtggaatgtggttaaatgtgagaaggagagaacaaggtgggagatgggaactattagtaggagaattctctcttcaattaccaaaggagtggggtcagagtgagaagtcacagagggtccctgatgttattatctattattatcttgaagataatcccctggagaagggactgcaacccaatccagtattcttgcctggagaattccatggacagaggagcctggtgggctacagtccatggggtcacagaatcggacaccattgagtgactaatgctgactaatgctttgaagatgatagtaggaggacaaggatattcttattccattttctcagagaggggagaaattggacagttggggaaaatacaaaggttatgaaatagttgatatagcccctccttttttgctttttcccctctactttcttcttttcctttactaccaaacttcttaaaatactaatttgtgattaagtaccaattcttgctcttatttccattagctccttaaatccttaggagttgggaaaagatgacccactgaaggaggtgaaagagacctcaataaagtagaaagtcaacatcgaccctgtgttgacaaagctaaggataggaaaagattctgggagagctaaaggcaaccctctttattctttcaccccttcttcactgtggcaatagaaagaataatggtctagtctttcaatgtaatcacagggctctg

SEQ ID NO: 48534 - DNA, 835 bp, Bovine  19866881144560
tccttggggtaacagagagtcaaactctctgtagtttgactgaagcacaactgaagcaacttagcacacacacacagtttgtttgcatctctaccccagccagaggaaattaagatcactacagtggtgctggtcagatttctggcatcctgctgtcctcctgtttccccacatttcactattaaaggagccagagcaagcctagtgattgcttgcagaagtaaaggaaataactcacacccacctgaacagcaagcttccaactgaagcaggtccaagttaggggggaaaagatgatgtaactttaaatgaagttcagaatttttactattacactggatgaagcatattaattactcagctaagactgttttaggaagtcaaatgaccagaggagacgagactttatgatctgattgtgggcatgaaagctattcagtctgcccaagatttcatctgggagcaaaggaaatgtaactgcacaaaacacaggcagtgaagaagaagtacaaagttgttttctgatggcatcctactttttcctctatgtccacaggtcctgctgaaaggacaaacccgagacaaccaagttttaccccttgtaactccacttcactcccagttcctggccaaagttgattagggaagagtatctgtcctcagtcagccaaacaacagctcagccagagactataagatgctcttaagcaacaagataagtagggcaatcagtttccttggcatttgaatataagaaaaagaagataatgactatcctcaatcatggcagttgaagctaaaatattattcattgattcaacaaatattttgtgag

SEQ ID NO: 48535 - DNA, 1429 bp, Bovine  19866881284584
tgttgaaggacgcaggtatgaataatagaataccaggaagcgtgcgaacttgagcaccttcagggctacaggagagcttatcctacatctgactctggacaattctgcgaactgggcaactgttttgcagtttatcacttctgagcctcttcctgctctccgggtgcatctgcttgtctcccctcactgctatgcaacttgtataattgcttaacaggtcacatctgccaaatggaatttaattgctatagttacagaatttatattaatagcataccagatcccaaggaaagaatcgttcacgttgttccaatatatacacttgcttttccccccattttcatatatacgaaaaaaaatttgaaacatttttctcacttagtaaaccatgtcaagaatacattttaagctttttctatgagtcacagtaatcattttgaaagatgcactattcggtgcagggttttggttttgtttttgttttttaaaccagcatcagaaagggaagatgtggttctgagccctaacttgctactgaattgggggaatttgggacctcgatttcttcatctctgaaaataagggcctcgcaggggaccgtagccagctgtcgtctataatctgggcaatgcaacagaaagtcaaagtctctacagtccatggaattctccaggtcagaatactagagtgggtagcctttcccttctccaggggatcttaaacaacccacgtatcaaagccaggtctcccacattgtagggggattctttaccagctgagccacaagggaagcccagtgcaacagagttccttagtaatcatctcatatattcttacattttagagatcttctaggataacctcttcttttcttttcccttttattattttcttttcttttccccttcagaggaaggggatggaaggagtgagggatgaaaaggtagacctgaaagagaaatgagttgtctgatgtcacatagcaaggaaatggcagagatggaatacagcccagtttttggaatcctcaggtcaatgctcatgttcttttttattttcttcagtactattttactcctttggagacctcccaaagaaccccaatactgcctggtagtctgttattgccacagctagaaagtaacactattgtagtcaaacatggtactgtatatttctaccttattcagcacctgacataatgttttacatataaaaggtgcttaaaggactttgaataatagggttattaatagttactagtaaaagatctatgagatggtacccaactatatccagaaccatttggaggggtaaaaacaagggtagaacaaatgccatgtctgatgtaaactagtttttagtagggttccaaatactatagtgcttcctaacaatatatatcagtccttactctctttcttctctt

SEQ ID NO: 48536 - DNA, 701 bp, Bovine  19866881795532
ttgaaaaaattagagagagtttttaaaatgataagaattgataagcataatcaactaaacagagcagaaaaaacctgacaaagtgaaacatataattttagtaatgcttataatttcagtttggaggaagaaaatataaaagttttcatagaactgtaagattggaaaagactgtacttcacatgtttgattttgaaatttaagaaataataacacaaatctccattcaattatatcagcaaattaaaattataactttgtactatgctattgttatttgagggggaaataagaaaataagcacagggagagcttaaaggaaaaaaacaatagacggacctacagaattgtaatttaataggaaaactaccaaatttttaaagaatatttaagactcaaaaataggttggatttttgccactgtagattaactagagatgtgtacccttggaatttgttatacaaattgaataggagaaaaagattcagaccatagaccatagatgctctgaccctaatgtagatgataaaaactataatttgttgagtctttgctgagtttggactatggagataagtggaaacagttcttttataactggcctctcttgtttcctgaaactttttttttcttagctttttattttgaatcggggtatatccaattaacaaacaatgttgtgataggtttcagatgaaca

SEQ ID NO: 48537 - DNA, 727 bp, Bovine  19866880276884
aattgatgcttttgaactgtggtgttggagaagactcttgagagtcccttggactgcaaggagatgcaaccagtccatcctaaaggaaatcagtcctgattattcattggaaggactgatgttgaagctgatattctaatactttggccatctggtgcgaagagctaactcattggaaaagaccctgatgctgggaaagattgagggcaggaggagaaggggacgacagaggatgaaatggttggatggcatcacggactcaatgggcctgggtttgggtggacttcaggagttggtgatggacagggaggcctggcgtgctgcggttcatggggtcgcaaagagtcggacacggctgagcgactgaactgaactgaaccttccctgtctatgtttgtgacacactcttacaaacatgtattaagcatattatttctctagtatatagacaaggtttgatgtgcttgcagatggtggctattttgaaaaaaaaattaccctctggcattagaattccatggggtggaaatcaagctcaggcaatggaaaggataggaagataatagaattatagaacaaagatacataaaatggttagtattaatttccgaggccaatacatatttcaacaaaataattatgggttctttttattcaaattcattattacttgacttcatttctttcctctcaatttttgtctaaatgacatctatatattgaacat

SEQ ID NO: 48538 - DNA, 1550 bp, Bovine  19866880466186
ctccaggcaagaacactggagtgagttgccatttcctcctcaggggatcttcccaacccagggattgaactggcatctcctgcattggcagacaggttcttcaccactgagccacctgggaagctgataatgctcactcttctcccaacaaaacccccttccttcaggtctgggatcaaatgtaaccactaagaaaaaccttctctggaagtagcacctaatggcatttccaatctcagcactcttgcctctaatctcattttactttcttcttagtacctatatccactgaatatatctatttattgtcctttctcctccactaagaggtacactccattgatatgaatatgctgctcacagaagaaatagcagtgcctaaaaaaatgaaagattttattttggcaaggaaagaaataactgaccataaatttaagaattttaaaatggaagataaagagaagcacattttattttcccctataaactagaatagattctttaaaaagtaaagaatttcatactgtagatcatctgggacccagttagggaagatgaaaatccatacaaccttctggaaagtgactcaaggatgcagaacaagagatataagaacccatatcctttgatttcaatactttgtttcttgggcctatcctgtaaaaatagacacccaaactcgtttttgagaacatccctatgatattttttctgttagtacaaaactatatatccagtactgttacatatcggatattcttgttgttgttgttcagtcacttaggcatgtctgacctgccatcccatggactgcagcacgtcaggtttccctgctcttcaccatctcctggagtttgctcaaactcatgtccattgagtcagtgatgccaaccaaccatcttgttttctgtcctctcccttctcctgcctttaatctttcccagcatcagggtcttttccaatgagttgcttttcccatcaggtggccaaagtattgaagcttcagcatcagtccttccaatgaatatctagggttgatttcctttaggattgattggtttgcaatccaagaggctcttgaagagttttctccaacatcacaatttgaaagcattttataaagaaatcatatgaggatatataaacaggaaaaaagtactagcacaatatttcatatcctttattaatgatagtgggattatgaacaacttgaatatttttaaatgtcttcattttcactggaaccaaaaatgcaatttttaaatgaagttatatcattttcatgaagtttgttatatccaagttcttactgattcctcccggtacttcaccatttcttacaagagctctgtcatatcttattaaagctttcagaatgatttatagataaaaaaattattcagtgcagttcagtcactcagtcgtgtccgactctttgccatcccatgaatcgcagcatgccaggcctccctgtccatcaccaactcccagagttcactcaaattcatgtccatcgagtaggtgatacgatccagccatctgctcctctg

SEQ ID NO: 48539 - DNA, 2926 bp, Bovine  19866880501946
tggaaaattcaaacagcttttaatttttactcttgtagaaaacagaaccttagtaaagttatttaaatttgaacaaaaaaaattaagaagctagatttaaagaatgtatatagaactctgtatcaagcaagtagataatatattttcaacaaacaattttttataaaaatttttctcatagtaggtcaagaaggaagtctcaacatgtttctgagaatgggtacaatttgaaccttagtgtctaagcaagtaacagtaaattagatgttgatgaagatacacattttaaaatattttgtacaggaaaacatgtaaataagtcagggataaaaagtaacacaataaaaattttaaaatacattaaattgaataatattacattaaaaaatttttagaatgcaactaaaaatgttaaaaagaatagtacagctataaatacttttgaagaagagaaaaaagtgaaaaattaatgaacctagtatctatataaaaggttagtaaaagaacagaacaaacccaagggagcataaggaaagaagtattgaattactgatcaaagataaatgaacaaatagcattcacatgtggtttctagatagaaaagaactttgaaagcaattaagtcacagagtaaaagactgctgaattagaatatcttaacttctgtgcatgtgtgctcaattgctcagtcatgtccagctctttgcaaccccatagactgtagcccaccaggttccttgtccatggaattttccaggtaagaatactggagtaggttgccatttcctactcccagatcttaaacttctgtacctcaagacaaatcataatattaaactttcaacagcaaaataataaagtagctaaaatatatgattcatatatgaccaagaaataatataattatattaataaaaattttacttaagtgagaaaaaaataaaatctcaaatgaaatggatatagaatattaaaaactaattaatatagccattaataagataacaagtaattatatgaaaacattttcaaaaacatttgaagtaaaggaataaacaacaatgaaatatctcttttaattttttctcccaatcaggttacaggaataagaaactcaagagctatacatacaacttttgggggacaaactgaaaatatccattaaaaattacaatgttgatattttttcatatgtattgctttcttccaaaaaattaagagatgcagacaattacatagagctcccctggtggtacaatgagtggtaaagaatccacctacaatgcagaaactgcatgagtttcaatccctgggttaggaatatcccctggagaaggaaatggcaacccactccattattcttgcagaaattccatggacagagaagcctagcaggctatagtccatgggtcacaaaagaactggacacaacttagtgactaaacaacagacaattctgtgtacacttgtaaacagaaatgtatactctatgttgcaaaactcactctaataaataaaaaaatgttaaaatctaaaatgtcaggtatgagatttattaattacattataaactatctatgaagtagaatgttaataactcaaatgctcaatgacatgaacattcatgtatattatttaatgaaaaaggtaggatataagcataacactaattatgtacctggaaggaatttaaaccaaaatattaatggtagatcttagagaattgaaattatagatttttctcttttgtatttctatatttttctgtattgagtatacatgaatgaaaaaatacagaagaaaataaggtgaaattagttgctgttctctaagggaaacaaattcatattatattcaaatttattattttggtatattaagagtagtcaaataatcatacttaatcccttagaagttgcctattactgctattaaaccagcttaatcatatttgtgtttcattttcatcctaggactacatgtattttgaactctggtcataagagtcagcctgaaaaatcataccagacattactggcattaagttttgccagtcctcagcaaaattaaacaacttttacttagaatatataataaagttttatttcactaaaattatttgtatgattttttttacataataggacacacagcatttaattttctacataatgaaccacaccaaaaatttaggaactataaacaaatggaatctaatcaaacttataagcttttgtacagtaaacaaaacccattaacaaaacaaaaggacaacctacaggctggaagaaatatttgcaaatgatacaatcaacaaggacttaatttccaaaatatacaaatagctcatacaactcaataacaaaaatagcaaacaaccaagtcaaaaaatgggcagaaggcttaagggacatttctccaaaggagacatacagatggccaatagacaaatgaaaaaatgcttagtatcattaattaacagagaaatgcaagtcaaaattacaatgatgtatcatctcacacaagtcagaattgccatcatcaaatgacaaatagggtgtggagaaaagggaaccctcttacattgttagtgggaatataaattagtgcagcatagcaaacagtatggaggctccttaaaaaactaaaaatagcattgccatatgatcctgcaaagccactcctgggcacatatttagagaacactctgaattcataaagatccatgcaccccaatgttaaagcagcactgtttacaatagccaagacatggaaacaacctaaatgtccaattacagatgaatggataaacaagatgtgccacatatatacaatagaatactattcagccataaaaagaatggaataatgccatttgcagcaatatacagaacatagagaaacatactaagtaagctagatagag

SEQ ID NO: 48540 - DNA, 1667 bp, Bovine  19866880526887
taatgtctctgctttttaatacactgtataggttggtcataactttccttccaaggagtaagcgtcttttaatttcatggctgcagtcatcatctgcagtgattttggagcccagaaaaataaagtctgtcactgtttccattgtttccccatctattttccatgaagtgatgggaccagatgccatgatcttcgttttctgaatgttgagttttaagccaactttttcactctcctttttcactttcgtcaagaggctctttagttctttgctttctgccataagagtggtgtcatctgcatatctgacaaaggtatgtatagttaaaaatatgatttttccagtagtcatgtacagatgtgagagttgtaccataatgaaggctgagcgttgaagaactgatgctttcaaattgtgatgctagagaagactcttgagagtccgttggactgcaaggagatcaaaccagtcaatcctaaaggaaatcagtcctgaatattcactggaatgactgatgctgtagctgaagctctagcgctttggccacctgatgtgaagagctgacttattggaaaagaccctgatgctgggaaagactgaaggcaaaagcagaggatgagatgtttagatagcatcaccaactcaatggacatggctttgagcaaactctggaagatagtgaaggacataggagcctggcatgctgcggttgatggggtcacaaagagttggacacaacttagtgactgaacaacaacaacatcctaacaatattagttcaaatagaaacaaaataataaataaggtaacattgacacattgttatgaaaataactgtattttctttaaaaacccagaagagtggcaatattttaacattttttggtaaaactccttaatgtctgacagtagaaaataggtaggttttcacattcacttttgaattcattgtgttacaatttgttgttttggttgaaaaatgaaaaaaaaaaaaaattcagccttgccctaatatgcagttagaaaagggaaggggatttttataaccttttcagatagtatggatatactccttgaatttcacaccaaaatttgtgagcagtagtttcttagataagtttcttaaagattagttgcactgtgaagtctggaaccatatcaatgaaattttgtactctgtttcattgaaatccattggtctatcttgcactttgaatggaactttcagccagacataattttgtaacattgtactttggccatgtagaaaagaactggcttgctgatttaagcacatcttccaaattttgacgtatgtatagtatataatatcaaaaacaccaccaagctcatcagaaaagtcttgcagtattaggaagctgctcagctcacagcagaaagtcctaattgacaaggttttcctaaaaattcagattttagcttgaaaggtttgaattttatcattgtttacaatactatcagtaactatcattgaaacgacagactcattcttgttcattttttgagaaagtgctcaccaaagacctggggcttcccaggtggcgctagtggtaaagaaacctgcctgccaatgcaggaaacataagagatgcaggtttgacccctcagtcaggaagatcccctggaggaggtaatagcaacctgt

SEQ ID NO: 48541 - DNA, 1032 bp, Bovine  19866880776844
ttgcattcaattttgcaaacagattctcagactattttcaataaagattcattttctacctttcattatttaataagcaatagtgggtttgccaagaatttcctttacacttggaaagaaatcaactttggaaaaagtttagcagttgtcactaatgaaataaaattgaattaactcaatgagattgaatgtattcaatgaaaatagggctaagcaatagcaccagtggtttccttacagaattaatgtgattttgaaaatatgttccactatttattttcttaaatcctcaaacaccaaattccactgaaaaactggccttctcactttttcagagcaaatagaccttggactagagaacatactccaagttttaggaatgccaaagctatgtatttgttcatagtttcatctcatgtcattttactaaaacagtcttccagaaatacggcatgcagtacccatcaggcagtaggtacaaatagcttactatattgtcattataccagagaacaacagggtattttttcgattatggttcagttcagttcagtccctcagtcgtgtccgactctttgcaaccccatggactgcagcagaccaggcctccctgtccatcatcaactcctggagcctactcaaactcatgtccattgagtaggtgatgccattcaaccatgtcatccccttctcctctcgtcttcaaattttcccagcatcaggatcttttcaaatgagtcagctcttcgcatcaggtggccaaactattggagtttcggcttcagcatcagtacttccaatgaatattcaggactgatttcctttaggatagaccagttggatctcattgcagtccaagggaatctccaagagtcttctccaacaccacacttcaaaagcatcagttctttggtgctcggctttctttagtccaaatctcacatccatccatgaccactggaaaaaccatagtcttgactagatggacctttgctggcaaaataatgtctctgctttttaatatgtgtctag

SEQ ID NO: 48542 - DNA, 742 bp, Bovine  19866881073732
atttcatatttcattttagatcaaagacgtcaattcctttctgccaaagacaacctgcaacatatctataattgaaaaagtttgatttatttcttgttgcatttacatgagaatgcttattatggggaattctattataggatttgtgttttggctgtgttattttggagcaggactaaggaagcagggctttggatgttgtcatcaaacagacattagtctatgattgggtacttctttcagtctcatctgtaaagaaagcagactggagctagaatgaagtcgtagttgattttttaaaaagagcagcaatcactcatactagacaggagagaaggaagtttggtattgtgtagattacatgatgaccttaagttgtatcactttatcatacactcaagagtgactttatgttgctgttctgtgaaatggtatatgttcaataagagaacaacacagtttagctgtaagcatcagaccaagatatcaggaacctctttccctttccccagtgatttatttagataagcacttagaaggcaacttaattaaatctatagattacataaaattgcaaaaagataatcacaattaaaaagaaaaacaaaggctatgtgaactctagagataaactgtatgttagagatcataaaataagaattagtcttttataaatgagaagacaaattctaaagcaattaatgacttatccaagtgtaagggcaaacaaattaaagacaag

SEQ ID NO: 48543 - DNA, 1305 bp, Bovine  19866881096469
gatggtgaccgcagcctgaaattaagacacttgcactttggaagaaaggctgtgagaaaactagatagcatattaaaaagcagagacatcactctctggaaaaaggtcggtgtagtcaaagctatggtttttccagtagtcatgttctgatgtgagggttggattacaaagaaggccaagatgcttttgaattgtggtgctggaggagactcttgagagtccattggacagcaaggagatcaaaccagtcaattctaaaggaaatgaaccctgaatattcattggaaggactgatgctgaaagtgaagctccaatactttgaccaactgatgcgaagagccgacctattggaaaagactctgatattggggaagattgagtgtggcaggagaagggggcaaaagaggatgagatagtttgatggtatcactaactaaatggacatgagtttgagaatactctgggagagagtgaaggacagggcagcctggcattctgcagtccatgaggttgcaaaaagtctgatatgacttagtgactgaacaacaataaatcacttaatgattgaacaacaataaatcacctgttaagctgagagccttgctcacaaatagacgtctggttgagagagattttgaggggaaaatatgaagctttaaagaaacacacagatgtaaaacaaaatattgtatatttggatatttttctgaaatttcattcaagtaatagtattctatggcttcatttttcaaactgtagcctattagtgtgagagcagtttgaagatagtcttagaatctggtattaggatgaaaatccaggctgtgtacttgtgctgtttcttataattgtatatttgtgtacttgtactgagataaaacccggttctttagaagagtgttactgaattataatgatgtttttgcatctcctgcctctctcagttaacaataatttttagaatttagggatataacacaataacaagctctatgtatgtaacctcattgtctttgttggacaactactaattgtttcctatctgtaatggtcaaaatggacataattcaaaattttacatttttctattttacattttattttgcaaaattttctatttctattttatatttttctgtaaataagtgtatataaaaaaagttcaaggagaagctatattcattaaaaagaaaaggaagacaatataactttagacaatgaggaatttgacatcttgaaggtaacatatggatgttaactttcctttttttttggatgttatttataatcagtttaggatctcaa

SEQ ID NO: 48544 - DNA, 1438 bp, Bovine  19866881168885
tgctgcaactactggagactgaatgctatagagtccatgcttagcaagatgagaacctgtgcatgacaactagagagtagccccagctcgccacaactagagaaaatgtcgtgcaacaatgaagacctagtgtaaggcccaaataaataaataaaagagaagaccagatgaggatgcattaaggaggcagcctttctttcctgggaaaaaccaaacctactaacactttgatgttgaacttacagtctccagaacagtgtggaaattaatttctgttggttcagccacccaatctatggtattttcttatggcagccctagcataatattatacgtataatcagctttgtagcattgtatttatctgacttggttttcaaagtttttattagtttaaagctatttttaaaattcagtaagatgatctgagttgaacccaaaagtctagaggatttcaagcatggctgcactctagtcatttatcactgaacctgagtctcaaggtgaaaggttaataaactcctccaccatttcccactgccaagctttgaaccttgaaaatggtgatgaaataccagaagctagttctagctttctaagaataagttcggaaactttgtaagagtgctgtagatcttggctttgttataataatgtacattatctcgctgggtggaatcctgttgaggacatctgcacctgaattagatacacacaaataagttgtgataaactgatattcttaggggcttgataggatctgtctctctgccatatgatactaagttggctaaagtcttttactgttcatcagtgtgctaatgtgattacttttagagcagacagatgcttggatctaggattttcagaaatgcttatttggcatcaaagagattataaatctatgtatgtgattaaagtaaagacaccggcagactgatatatagacttgtgatttggccattcacagcaatgtctaaggagttgcctctaagctgccaaaagagctattcaatgtacttgtgtaaatttaaagatgacaatttagtgaaacatatcagttatgctagttgtgacataaagaacaagagaattttggtaagtttgatggttgttttatattttaattttacatttttgtcatttttttttagctattatgtatttttcattacctgatcatgatttgagcttagatttgatggaaattgtcaaagacgactgcagcaaagttatggagacataactttttagcatttttaagcagatttgtacattttggaataaataaaaagtggcataaataaaaaatagttagcactgttttattaataataagagctgagtgctatgtgctaaattctacattaaatcaaccacttgtaaaagaatgaaactagaacactttctaacaccatatacaaaaataaactcaaaa

SEQ ID NO: 48545 - DNA, 2078 bp, Bovine  19866881257727
cactcttttcagagagaataatgggtggagtcggaaacccccagagtagggaattagtttaacagacagaattggaaagcaaaataactgacctcataaaactgcagctaaagatgggtcctgagccatggttcagggaaagtggtcagccctaaatttatgatagaaacatatagtttactgttaagaatatagccttcaaatgtagcaaatatgagtagagcctaaaatatcaaataaataccttgaaaaaatttaagtacttgggaggcagtactgttttttgcacacatggaaagaagcatgaaacatatagttcagaacatgagaggtgttaaaacaacttcatagtaactgattaaagctgtaaaactagtataaactgagtatataggagtcactataattaaactgtcaaaaggaaactttaaatgaattaataatatgacttgtactattatttccaagagaattggggggtgggtgggcggagctagcactatcatccacttaaatagattttatttaagaatttaatatataatagtttaacaaattactttccattgtactgtggaaaactcgctgttttttccaacactaagaaagtagttaagaataacctagtttggcaaagaaaaaatcttaatgagttacaaggaaagaaattacaaaggaaaggcaaaataatgaaaagacaagaatatgaatgccaccgagtcccaagataatttggcctattgtcaaaatcagaccaaaaatatttatatattttaaaccactgtcttaatttaattaagacaggaaagaaagggagagaaggagagaggaaggtgggaggaaaagggaagagagagaaagagaaaaagagatagatggacaaagacaggaaggcagagaaggaaggaaggaaggaaagaagaaagggaggaaaggagaagaggaaagggataaaactacaatctttggtttaaaaaactaaaaaaacaaacatgtttgttcacttggaacatctgagtgaagtgggtaagctaggttgaagggtcattgcctctgtcaggacactactcttccattaagcatggcagaaagataattgctaagtgaagttgctcattaccttccacagaactgatttcgctgacttcataaaagtatataaaggcattaacagaaatggtccctagaaacatctttaaataagcatagctccctttagagctcaacaaaatcctagctttatccctcagtgatgacacagattagatgcacattatctcattcattcccaaatccctatcttacaaagagcattcattttttaatattcttccttatttgatgttatacagcctgaaactcatatttttaataggaagaaattgaggtttgaagagaatacatcatttgaccaactcacatagtgactgacctgggttgtgcccatgtgactgtcaactatatgcattttccataaacagacaaatttcacactccaaatatcaggccaaatatatagtttctatcaaatggatggtgattaccaataaaagaataaaagcatagatgttgttctcctgtgaagataaagtaaatatatagggaagtcgtcaagattctgtaaatgtttgaatctagatttgcagtttgaccatatctgtctgataaactggtggtttataacctcactttcttgattctaagtgtctctttatgtgagtttatatgcatagaataatggggcttgtcaagagtgaggttatcatggaaggggagcttttttgggttttgtattttctttcatttgtttttaacatttgccttagtttttgttttgcaccagccaaatgagtcaatgagtcagggatgagaggaacaagataatgacaagagagccttctgtagaccagtcccatggattcaatattgagcaccaggatagatgccagtcttttaaaagaaattgacaaagcttggtccaattgagacaatgagacagattgaggagcaagtgaaacctactttggacaaagtcagttgcagatttaggtagagtgttcttttcagtttcagcaagg

SEQ ID NO: 48546 - DNA, 1567 bp, Bovine  19866881263758
acttggagctggaggtcctgggatagttaggttgaggtgcagcttgtataaatgagcatcctagctctagataatgaggtggaggagagtgtcagaaggcagggaccatgtcagttgccagaaagttgcagcactaaatggagaaatggacagtgtgtagtcttggacttagggtgttttgttctctgagaaggttctgagcacgcttgatttccaggtgacagtaggcactcatatgtattgttatatttgttttgtgctataagaagataactgtcaagcaaggatattttatgtgaaaagttaattggttgttttatccatctgagataccaccaacatgtaccaagctttcaaatatagacattcttattatgtttaattctcatatacatttttttttgcatttccctgttcaagcatattattatcaacagtcaataataaattggaagagtttgcctaaggagaaattttcccatctttaatatgttctttaagtatagttatgcaaggtatgggcttccttggtggctcagatggtaaagaatctgcttgcaaggtaggtgaaccaggttcgatacctggcttagaaagattccacagagaaaggaatggcaacccactctggtattcttgcctggaggattccatggacagaggagcctaaagtcagagatgactgagtgactgacacaaattcaagatacatttaattaataatataatgtctctcatgacgactccttttgcccactggtttaggagaatttaccaaaataacatttactggttgggagaatttaccaaacagtatccctttgggcttgactaatcacatcaacatgaaataaccttgagcttttattaaattttccagggcaggcaaattccattagcacctgtcagagttcactggttagcatgggcagaaaggtcaaggactttttgacactataattcatttctcctctatctgatgttcttcaaacaacacactcccaactgtgctgcctgcaatagtagttattcattgctgcctgcaatgaataacacagcactgtaagattggaaaggaaataacaattcttgagtaacttctgtgagttaggtactctgttgagagattcacatatgctctccaggtaagctttccccaaaagttcatgatttaattatccccatttgctattgaccatcaatggctcagaacactattcagctctctgaaaaacctgaaaaacagtcgtacaatcagtaaaactcagagccttaactggaatccagatctttctgactagtagtctgtgagggtttccttcatggctcagatggtaaagaatcaaaaaatctgtccatgatgcaggagactggggtccgatccctggatcagggaagatcccctggagaagggaatggctacccactgtagtattcttgcctggagaatcccatggagagaagacactggagggcttcagcccatggggtcacaaaggtcgaacacaactgagtaactaacactaaaaagtaaatgaggcaaatccagggttagataacagataag

SEQ ID NO: 48547 - DNA, 745 bp, Bovine  19866881405295
ccaccatgaattaaattctatgataaaggcaatacatttgttactatttcagaagcctttgaaaatatatgaaaaaatagactccttgtattaatgaagcacatccatttctatcaagattttttcccttaatcactgtttacaaagaccttactttcaaaaccaataatctttcacaagaaaatgaaatataacaagtgagataaacaaggaagaaaataaagtaaaatctaagaacactaagaaaagttctcatgtatagaaccatcagagggtttgctcctgaatgtcatttaatattcattctgtggagcaagatcttaagaggagtcatactgaaagaccagagcactgggagaactattgtattaaagtaaaatagcctttagtgcttaggttttttctctattttacaaacttaatgtcacagaacacccagagtatcagtgcattttaaatctagtattttcactctaagttaaaaaaagaaaaaagatttgacaatgtccagtgctttctgaatttaaaagtaacagattaaaacccaaatattactaattgcatgttatatcattatccagactcaacacaatagtctactggaaatgctttttacagatgctacagctgttctcttgtaaccacttttccttagtctattcctcactggagtgttttcaagtgcaatattatacaaatacaatgataactagtgtcagtacaggaaaatataaactgccaaata

SEQ ID NO: 48548 - DNA, 1116 bp, Bovine  19866881501785
cacaacattataaagcattatactccaatttaaacattaattaaatgatttttaaaatgacagatacaaaaactaataaaaaatgctgtagtcagtttcttatcattttaatctcttgaaggatatcaaaccagaactttgagaaatacaaaggacctcatagtatcacttcaattcatgacagcataatctcatgatacaaatgcattcacaaagaacctaggctaaatttacagaaggtcatatagacactaaatttccccagagagggtagaggataggggcttataactcagtctgcctagttctttttgtcacacagcatagttttttctatacaattctcaaaataacttggtatcaaaaattccccaaccagtaaaatactttacaagtactccatagtcagcaacgtgagcaactgattaactcactgatttgtttgaactattcaaagtggaactgcccagaagtaaataatgaaattgtttctgagagtcaaaatatgatattaaagcataaaatcttataactgaaacaacacttagctattctatttcttctgcttttatacaatcctgttcatgaagtagaggtacacatttctttcagtttaaataaaagtgtaaacagagaatttatattagttcatagagctctgggaaaagtagaaactgttcaaaccacaggaagggaagtgatctgacccagaaagaggtccaactgtcttgtaaaatgttaggtcagccaaaaattcaagagaaaaactgcctgcactgatttatttttaatctcctgggagaagtagcctctaggtaaacttaccaattaaaatgataacactcatggcagaaagcgaacaggaactaaaagtctcttgatgagggtaaaagagaatagtggaaatgctggcttaaaactcaacattcaaataaactgagatcacagcatccggtcccatcattttcacagtaaatggaagggaaaaaatggaagcagtggcggattttattttcttgggctccaaaatcactgcagatggtgactgcagccatgaaattaaaaaacaaaaacaaaaaacacttgctcttcagaagaaaagctatgacaaaccta

SEQ ID NO: 48549 - DNA, 1452 bp, Bovine  19866880418963
tctttaagatccagttcggatgctccttcctaaagggatctcacctaatctctccttcctgtgcctcagtaaaaccgatgacaaccactaacagtgatgaagtgtgtgcaacagggcacgtcctgtgctaagcgtgccatatgtatcatctccccaacctcttgtaaaagtgggtgaggtcagtgtaaccatcacaatttccattttacaaatgaagatactgaatctccttgaggttgtgcaacgcccacactccccgttacctgggggtggagacctgtctgggtccccaggtctacctgccacatccccttactctcaggacccttcccaacttctaactgtgtcctgggtctctggagacacatctgatcattactacttgactccacgagtcttagaggcaggaagtgcttctacttccccttttattccccgtgcggtacctggcacagaacagacactcagtaagagtctgctgaaagagtgatcacatggggaacccattctgagctctgcttttgagaggcgagtcatatgctgtcggtcttcaccggttttcagcaggctctttctttatggaattgggtttcaggagaagtcatttgatgatggcatgtctgagtccacacatacaccaagagtctggtttatactcacacctgcagcgtcaagaggcaggaaggtcaggattttcagccaagaatccagagacttgggtgcagtcggcctgctggggtgaggagctgagagtgtcctctcaggcctggactcgcctctttttaaaagagcaggtgagcctccaggaactgagccgaggagccttgtcttctgagtaaggggccaggaggcggggaggtggggggtgaggagagaaaataacattcccctcgctttgggttctgggcagctgtgatcctgtgttaaaagctcccactttgccccaccattctttctggaaacctctagtttcagagcttgagaaaacaaagtaaaacaaagcaaaaataaaaaacaaaaacaaagcagggacttttgggggtcatgaggccagaatagtatttcatagtaggcaaaaatttttaatgacacctggcggatgaaaatagaacaaaggattcatttgaagactctagaagtgacattagcaagtggttagattcatggaatccaaatatctgtttcatcagtcatggccagatggagtattaacaatacctcgaattgatgaaattatttctttcttcccacttcaaaactttttgagtaacctcatatttatactcctgaaactactgtgatgtattctgtttcttgtttgagaaattacgggattgagatctgttgagactagattgatttcatccagggtagagacagaactaatttctagtttactcatccatccggttttttttttttttttcgaaaaacaaaaacaaaaaactttat

SEQ ID NO: 48550 - DNA, 2336 bp, Bovine  19866880537398
cctgagcatgagcggggtggctggaccaggccagtggagttgggcttccgggtgcccccttccccacccacccctccagacacaacgaaagggccaggtggatcaggagactaggaagagtgaagtgcttctttctgaaaagaagaaagagaagcaggtttttaaagaacacaaagtgcgtgctaaggaggtgatgggtccctttactctaaagagcttggaagtgatgggtccctttactctaaacagcatggaaagcccactgggctccaggaggctctcaggatagagggagatgaggaaggtgggcagagctgtgaactgcacaacggctggctggttggggcaggccccgcacaaaccctgatcccagcacccacttttccctttgaggcttattttgccttcagccttgtgccaggaaacaaacacttttggagggtgctgcactacaaaggcttgtggactcttagttccccaaacaaggactcaacctgggtccgggcagtaaaagcaccaagttctaacccctgaccctcaggaacgtccccaagaaacatttgaaacaggagcgataacgacaagagctcatatttacagctctctcacaggcactacgtgaaaacgttgtgttggctgtgttaatcctcaaaatcgggtccaccttgttctcacccccttctcgtacccagtaaactgaggctcacggagatgaatcagttatctcatggaatacaaccgtgggtgtgggggtgccagatggcagccaagctggctccatgcagggcctgcattgttgatgattctcgtaaactgctgttaataaagaagtttagtttctccttttgaaagtctgctctgagtaggccccactgcccctgtggttgttgataaatgaaaagcctgttccgaccgcatccagccccagacgcccagaggccgcctgccgtcttctcgaggggctggcttttcaggcccgcagaatccctgaagtttaaattctctaaatcctgttctcccccctcctacccgccaaacagcagctcggggtgtctttcctgcatttgactgggcttcaaagaaagcactcgtcaagccacgtctgccccagccgcccacaaagcaaggaaattctgagcaccttcaggcatgagtcaacaccaccatgttcaggaatctctgcccacagaatcacccactcttctgtttgggcccaaaatagatacctccttcagaagcctccctgctttctgtagcctcagcaataagaaaacaaaggcgagggtaggtgtgcatccaaggcatgatggagggagttcactctgctgtgaagttctctgcagtgaaaacactgccgctgagctgggcacgcaggacaggtgtggcagggggaaggggtacgcaggagggcggctggggacggtcgttcctttgttcattcattcccttggcgaacatttattaagcaaatactatgtgtcagatacagggtcgggagatgggtgcaacccaaccctgggtctccaggatcgggagatgggtgcaacccaaccctgggtctccaggaacccaccatccagcaggagaaaaatatatcgcacagacaatgccaaccgagctgagactcagaatgcaaatacaaagaaagagtggatggccacacagacaggcatttgttcctatgcaagtccctggacattgtcactcaagaactgcctcactgtcctaatacctgggacagaaacaagggctgaaggcattgctctgtcattactaaagctattgaaatcatacaccgtggattttgaatttagaacagcacagtcagaaaatgtgcagaagttgtcctttgctcaagaaactccctgaccaagaaaataggaatatttttggtgggagcggttactttccttaaaggagaaacggatggctctcacagcccacgggtgttatagaaataccgttaacatgcggagctgacagatggcacctcctcaccagtgtgtgagccactctccaatttcaaacacccaggaaggaactgcctctccaagaaagggatgaggggaacccagtcagtctggttatgctaggtacttaaaaggaacagtgtttttttaaactatatatgtgtgtatatatacatataaatatatatacacatatatatatatattggattcataaaaaaaatttgtgtttttctgtaacatctttcagaaaaacctgaatgacttttttggccaacttgatgtatacaggttgtatacacatgctatatgtattgtatacacatacatatatgtactatggatatatatgtgtatgtgtgtgtt

SEQ ID NO: 48551 - DNA, 720 bp, Bovine  19866880563350
caatatggtcacaaattcagtaaagacttttaaaatggtctacataaaaagaaaaaaaaaacttaaaaagaatcctctgggtttcctgtccttgccttaccatgggtgccctccccatggaatcatcaggctgtgactcaacgctcagccatatctctttttgttttcctcttagaacagtgggtcaggtcatcatcattctgagcccatccatgcctttcccaatttgcaagccccaaatcctgctcattctaagcagaaagccctccagcgtgattcatcagctgcctctttgtggtgttacaggaagtgaaaatctctagcccggattacaaagattgcaactccgcagaagctatggacgacttcatgaagagaattaactgctatgaggccagttaccagcccctcgaccctgataaatgtgacaggtaattcctgagcagtgactgaaccacctgcttcagggctgtgaatattattcctgatgaataatattcccatgaagcgtttgctcatggatacttttatacactctttttaaatgtctcaaaaaaaaaaaaaaatccttggtgatatattcggtataactatcgtaggccccgtgtgctgctgctgtgtgcaaagtgagtttctgagccctgtctctcccgtctctctccgtcctttgctctttccccttattttcctttcaatcctcttgcttttctctctcctatc

SEQ ID NO: 48552 - DNA, 1851 bp, Bovine  19866880691621
gttttctgaatgttgagtctttaagtccactttttcactctcctctttcactttcatcaagaagcttttgagttcctcttcactttctgccttaagagtggtgtcatctgcaaatagaaggggggaaagtggaagctgtgatagattttatttttgcctgctccaaaatcgctatggacagtgactccttggagggaaagctatgatagacctagacagtgtattaaaaatcaaagagatggcctccagaggggtcaggccattgagggctgacaatgattgcccagcccagcaacaatgcagcatggtgggccttgtgcacatctgtggtgccagaagcatctgccaggtgtgcttgcattgaactgagaagatgtccctgtacggcaacccgggagtggcgaccagtgactcaaaaacagaaggctggtccaaatacttcaaacttctgcattctcagcaccaggtgaagaaggtagctctcactcaagccaagagccagaggacaaaacaaagtgcaatccttcctctagcaattggcctgaatcgaagtggcttttcatgagcaacaaataggggaccccccaccacacatgaccacgggcatcaacgaccgtttccagccagttttctgcaggataagtgtttatcccctcagctgatgtataggatcccatgtttcctaatgattataagaaagtagtgaagcaccaaagagaagagcaacagagacagcaagaactggaaagacagaaggaaacagaagagagagaaaaaaggcataaatagacatgaagctagtggattttccaggtgcaccagatccagattctgttgaagatgtagattatgagtgagagaggaggaaaagaataagggcggagccaccatcacaccccgccacgtctcttgtggagaaggacagagttaccccaagacgtcccttatgaagaggattcgccacctcgctcacagtcttccaaagtttctatcccttccacagtgtacaaggaataggacagactgcgatcccagacaaccagcattggcaactctttcctcgccaacatggggggcagggtagtacataaatttatgcagaaataaggcttctgggaaggccagggtatcaggaagcaagagcagggtctgagcacagcaccatcagtggagaagaccaccaagtggggaggcaatcatcgtgggccaagccaccgagatagaggcaaccaagaagttgaattgaaatccactagctaaaatacttgtgccctaccaaagtgatcctagtcaggaacagggttggtgcaggagaggtggatgaagatttggaagttgaaaccaaggaagagtgtgaaaaatatggcaaagttggaaaatgtgtgatatttgaaatttgtgatggccctgttgatgaagcagtgtgaatatacttagaattcgacagggttgaggcagcaattaaaactgttgttgatctgaatgggaaaagttttggtggccaggtagtcaaagcatgtttaagaaagaagaaagaaagtcgctcagtcgtgtccaactctttgcgaccctatggactgtatcctaccaggctcttccatccatgggattttccaggtaagaatactggagtgggttgccatttccctatccaggggatcttccccacccagggactgaacccaggtctcccacagtgtaattttacatgtaaaacatgtaaaaagcatgtttaatttgcataaattcagggtcttgtatttggcagaacaagtttgattttaaaaactagaggctgagtcatctccagtgatccttatgataagtagtagtgaccatgctttatcacaa

SEQ ID NO: 48553 - DNA, 1460 bp, Bovine  19866880784566
gggagcttcgtgaggctgctcttcctcacttagccccctccaggcggtggaggtgggaaaatgctctctacagcacggctgctctttcagaagcacttttcagcgccttccaggtgcctagggtggtcgtctcagtgctgctgtgtgatcctttgacccgatggtgaccactatgctctgggaggccctctctactgtctactctttggggagcctcctcaggtccggagctgctcagtgaccagggcaacacgggaaggacccccaggaggcaggcacataggaccttgccctgctctgtagcggcctcagggacacggaaagactgagctgagaagatataccacattgtggcttctttctgaagctgagaatgctgtattattaaaaaaaaaaaaaacttggacctgcaatcaaagtaataaaaactgtaggaaaaatctggcaccttacctttgttctgacaaagaaggacttgtcttcagtctccatgaggtagaagaggaagttgctggaacacgcctccctcaccactcgctccagcttgacgcgcaggctggagcacaggtcggccaccaggtcctcataggaggtgggctgtgggccgcagacacagagctcgcggggcatggccgctcccaaagccccaggcgggttctgtgtcctggaccaccttggcggctgctcagcatcaccttgttgaactcggcatactcgctgagaatgacagcgatgtcattgcgcgagtctttcaaatgtactgttgtatttcagcttgtggaggtggaaggaaggcggtctgattctggtctgagtttgtgaggtgatttctaccatggccacacctcttcttccaggaggaggagcggtccacatggttgggcatctgatgcacgactgtcaccacaagaggactcctgcttcgggaggcgggaggcagccccaggcatgcgggcattggggtcccaggaaaagccccggtggtgacctgggatgggggctcctttggaaaggcactggggaagagggcagaatgctgagcggctcccatcttcacaatttgtttcagtttgtgcgcaaaacgcaggtgctccaagtctaaagtgttctgggtgaggtcgtcggttctctgccaggtgtccatccaggagctgagcaagccacacggggccatgcccctggggcgccgcctcaagccgtgcagggttcttggggtgtctctgagctctctggtcacggtgaagttggcgtagctcctggggaccccgcagacatctcggatttggacgtaacagggcacacacgtagcttccttcttcagtccacccagccaacttctgggaggaatgctggtctccagccctggagcctggctcgcgtagccccagtcgtggtgatcactggtgttcaggctcaggaaagagtcgtgactgtctttggatgcaccttctcttttccca

SEQ ID NO: 48554 - DNA, 3410 bp, Bovine  19866880900451
acctggctgccttggagctgactcatccccaatgtcagatgccttcatttaaaggctgttcgttaagtgaagtatttaagagtgaaatgatagaaggtctggcatttgctgtaaaatatttcagtatgggcacagatgaaacctgttgttagaccaagatccattatgcaattctccccttttgtgtatgcttaatttttcataacatgaaggtgtttttcaaaagttactctctatattaaactaaaagtttctgtaggattttagtatctaattcttttgttttaattttggattttttttgtttgtttaatgatagtatgttatgttctcagtgatgttcagatatttgacctttcttgtaccatttattttttaattttccattactcattagtgtccttcatgttttaacaatgagaaacaacatttactttcagcgttccatgtttcttgtatatactgtacaaatatctgacttttgagagatattaacattttgtacaaacttggtgaaatagttatacctaaacacatgtttagtataacttgttcttgttttcacaggagccaagcaataaaagagtacgacctctagctcgggtcacatccttggcaaatctaatctctcctgtaagaaatggagccgtcaggcgctttggtcaaacaatacaggtaggagcaagtaatgcagtgaggcaatgttttatagaagcctaaaatttgcattttctttgagctgtacagacaagtttgtactgttatacttaaatataattttcctcttttggaatatgctgttaaggaatattattgtcaaaacaatatttatataacctcattatattagtttacatcttagagcaaagcaagaacttggatagtttttattcccagaaagtaattttgactgacaaatattttataatactgtcagattgaagctggcataaatgacttttatgcataaagaaactgccagaaccttttaatttgtccctttttttttttttttgaggaaaaaataaatagtttctgtatcctccaaagctttttcttattcacttttctttcttttcttttaagtcatttacccttcgtggtgacagcagatccccagcttcagcccaaaagttttccagcaggtcgacagtcccagtgcctgccaagaggagaagcagcgccctgtggtcagagacgttagacggtagcatgaagcagtctctaacctccagggagatcagacgtcaagaggtgtgcaccccacagcaagactttatgtgcactagcataaaatgaaacatagactctgattcttaaacatgtgttttgtcggaagaatagcaaactaacacctccggcaagataaacttgcatttttgcatttgagtagccgttttcagcacttgcagaaggtggtggtcatttggtttaacaccctgatggggtagaatatgaaacgtatggcatcctcttattagaggttccattctgaattatagtgttcagactgagtcactttgaaaagcgctgttcaaacataagttaaataatggtaactatccattgcatgtaattttcctttctgaaaggaaggagtgacctgtgatgtttgctggatttttttaggcaatctatgaaatgtcccgaggggaacaggacttaattgaggacctaaaacttgcaagaaaggtcagtaaagaactttctctcctgtgccataggttttaagaattatattccacaaattctaaaggatgttacctttagaagttgaaaagtagagaatatctactggtgtatattaattttagatgaggtttattagactcatttcttcaaatatgaatatcaggaagagtttttcaagatgaacatgtactttaatttctgttatgtataaaatagtagtcatgctggtttttacatagtcaggcttgattcacatgcggacctctctttgtgttttatttgcttgatctgtgtgtgatgtacttctctcctccaacaggcctaccacgaccccatgttaaagctgtctattatgtcagaagaggagctcacacatatatttggtgatttggatgcttacatacctctgcatgaaggtaagttgtgctccctaattttcgtaagattctgaacagcaacaacaagtaattttaaatctaaacttctaatttagttcaggatatttttgaaatttttattgacatagagttgatttacaacattagtttcaggtgtacagcatagtgattactatttgtaaatattatactccgtttaaagctacggctacattccctgtgctgtgcagtatgtctttgtagcttatttgtatcatacatagtagtttgtacctcttaaccccctaccactgtcttgctcctccctgaattatttttaaataaacttgttcttggaatttctgctttcttacacttcagatttgttggagagaataggagaagccaccaagcctggcgggacagtggagcatgttggccagattctcgtgaactgggtatgtagcaggtttatgcagacagggcaggcttgtcacttgtgatcagaatcacactgatttgatccagttagtggattctgaaatcagataaatggggcacttaaactgaacaaatgtacatagaagttacagtcactgtttaagaaaaacatatcatgaatgacactgtttcatttgttttaagaatatgttcctccttggacagaattcccacattacatctgttaattacctgtcttactctctcagttaacatctgagtgcctgccgatgccaggccctgttctaggaggaatggctggggttctgtgatgaaagacagcctttgcatgtacagtcaagtgagagaacagtcacccattatcacctgcaggagattcttcacagcttgttaaaaactttcacgaatagctctaagtttcatggacggaggagcctggtatgctacagtccacggggtcgcaaagagttggacatgactaagcgacttcactttcactttcatgtcttagaaacagacatgttgcagtctcactaatggactattctttgatttctcttactgctctttagttgccgggcttgaatgcctacaaaggctactgcagtaaccagctggcagccaaggctcttctggatcagaagaaacaggacccaagagtccaggacttcctccagcggtgtctggagtctcccttcagccgaaaactggatctctggagcttcctcgatattcctcgaagccgccttgtcaaataccctttactgttgaaagagattcttagacatactcccaaagaccacccggatgttcagctcctggagaaggctgtaagtaacccaagaagtggttcctgtgctttgccagtttgcatgttag

SEQ ID NO: 48555 - DNA, 1061 bp, Bovine  19866880949992
tttttttttctgtagcagagctgtcatgaaagagagaggtggagaattcatgttgaaaagagaggctagggcagattataaaggaccctgagtaccaggccaaggaacctgggcttaatctcaggaacattaaggacattcctaaggttctaagttttggataaaagaagagaaaaaattacaaggttctttaggaagattaagccgaatctaatgagtgagaattgttgaggagtgagagacacatctgagcccagggaagcccatgtgggaagctgggtaaaggtctagacaaaaaaatgatacaggtctacgcaccctccgaatacccccagcccctgagcccagacgccacccagaacctgctccaggcaactattggtaattgatcatcactggcttgagagagaaaacacgttattatccatccccaaactagagccacagtggaagaggtgagggggcttttactgaactccatatagcaaacacatcctgctctcaaacagaaagggagaaaaggaacctcacttttggacaaccttggtggaatcctgctggaaaagtcctcataagcttcaaaatgacaacaaaatccctttttaaccattcgagatggaggacttggtttttggttcatgccaaccagctgtttactccctgtattttatgggtggggcaagccacagcttcttggataccagatgtgtgagtcggggagaggaatttgatgcatagtgggttttgttttttccatggtaccctttgactagtgagatctggtggaaattacgaactgcagaaattcaactcagcgtctcaataacaggatgcacctgtagatttcgtagaatttgcagcagaattctctcgacacgagtttgagagaaatgggactgttttcatagtaacaactggggcgaaatctgaggtactgttatgtccctctcagtgacagcaggtatcagccatggcagataccatctaccgtctaacaggtgtggtttgaagacctccacactgcagcctctcttgcattgattgatcagtttgggggatta

SEQ ID NO: 48556 - DNA, 1471 bp, Bovine  19866880979774
agtactggagtggattgccattcccttcttcagggtatcttcctgacccagggatctcctgcgttgcaggcagatttttattgtctgagccactggggaagccaatttataaggtcatatacccaaaaatctctagtatttatgaatatatacattatttgatttagagtttatagatttaaaaatttttgtgattttaatagttttgttttcatttatattagaaaatcgaaattttgaagctctagttttagtgtttattacattacatgatattgttttgttttttagaccacatgaactagattttaagtatgtaatgaaagtgtcatctttgaaagagagactaccagaagctgcttttaaaaaacagaattacatggagcacaaaggtctgttcagatgtcatggtacactgcgtgtcctgagctttgttccagttgttttccactctctcatacacacacatgcgtgcacacacactttctctccctccttacttctgtttttcccttaagtgattcttaaaagggtcttttgtgaaagggatagagtaaccatgtgattcagttcctgggaggccagctcaaagtgatgaatggtagtttcattcaatatggcagagactagctttaatatagaatactgagggaattaagcagagatacgcttacaaacagttggaaactcgtaatcattactttcaaggagaacagaggttttgtggttgtttttatttatttaccactgactctggaacaacacagatttgaattgcttaagtctacttataagcagttttttttcagtagtgcatattacagtaccacccagtccttggatgtggaatcataattacccagggtaatcatatattggaaatactgactgcacagggggttgagggagaggcattcaagggtcacctgtactttaaaatgaaataaagcagaaaacatgagaaggaaagttcttagtcatttagattaattcatggcaacattgatgtttttatttatatatatttatttgtcttgttaactttatattagtgtagtataaataaaagcattgtttttaaatactgtatacagtaactttttattaaggggttttataaccaagaacattgaatgatccatgttttttgaatagtattcctatttcttcttttaaaatataaaatgaataaaccggttgtaaaaaaaaaaaaaaaagcatcgtagtatttaaaaataagaaatgttctgtgtttctgatttttttccacagtctgttgccaagacatgtgcttcaatatgtatgaggtggagctctcaaacaaacggggggagaaagtagataaactaatagaatccattaaaagggaacagttggtaagagtcatccatttaacatataattattattttccctgaaattgagaacttgatacacagggactgtgggagaaacatatggagacgcacca

SEQ ID NO: 48557 - DNA, 1545 bp, Bovine  19866881074821
cttgatattccagttatttattatatgtagccctaacaacgcaaagattatttgagcagtaagggacttgaaaatttctgatactaggggacaaaattgttctgcttcccataaatactaacatttcaagaatctttttccttaacttttcataaggttaaaaatcactgaagaatgtggtagaaggagaaggaaattgaatcttctttcttgcttttttatgtttaaggcaatcatcaaatgcttagaagatcgagaatttttcattttacttacgtcatcagccctaatgtacgaaacaggtaaggaccacttttttgaaaaaatgttttccaatatgtttactagtatcaaatcagcaacctgattttcttctgattctcattatgtgtaggttttagagaggagcagacaggtctacacgggttgcatttattccactcacctccaccagcagcaggtaagggcacaggcagtccatgacagctgtgggccacgtttcagtcctcatcttaaacccccagcagcacatgactctggcaactgtttccttctctgaaataactttccccctttactctgcctggtcagtccttcatttctgcaggcttatccttgcttgtctgttcccactcagtatccacctgcctattgacatctctttccacttaggtgtctcagatattcttcacattcagcgtgtccaaaactggattcatttgttcttgaagagcgatagccaggaagtagtttcatcaaagtctccccgtcagtaggacttaaggtcttcacagaagcacttgcctttatctggactgcttgtctccttccccaggaccaggaattgtctattaggggcaaaaagtattactcatctatttatctagtataaatagatatacagtagatcggtggtattagaatttcagagggtagttaggaaacaaagtccagaaaggctctggtcaggggagataatgaataaaactggagaataagcatggtctagcctctgacgcagagctgtcaggtgtaagcctgattatcactttaatgagtccattaccactcttccttcattgaggaacacagactagtcagtctgctgctgctgctgctgctgctgctatgtcgcttcagtcgtgtccgacactgtgcgaccccgtagacagcaccccaccaggctcccccatccctgggattctccaggcaagaacactggagtgggttgccatttccttctccaatgcaggaaagtgaaaagtgaaagtaaagtcgctcagtcgtgtccgactcttagagaccccatggactgcagcctaccaggcacctccgtccatgggattttccagtcagtctagttacatagtattaacttgagggttacttaggggtttactttgtttgagttcagttggttcccatcacaaggaaaaaaactttatttctttaattttgtatctatatggtatgatggttgttcactagacttactgaggtaactgtttaatgatgtatgtaagtcaaatcattatgctgtaaatt

SEQ ID NO: 48558 - DNA, 1126 bp, Bovine  19866881150108
ggaaattgtgcgtaccctctcttctctagtctcaaatataggaagtggttttaaccaggttttttttttttttctttctcaagttcagttgctgggaggtgtgggctggggttggtgagaaggattggggttcgtttatgaatccgttctttggcttacccctgaaaaagacagggagattcccactgccgttaaagcagggtgagcaagcccttcttggcagtggtctcaactagagtttcataatctgatgtcaccgtgaaactgaggtcccggactcgcagctccccggggagtcggcaggtgccactcaagatggaggggcgccaggtcatgccaagcagtcttggccctagatgggaatttcctaaagctgtctgaccacggagcccttgaagaagtccactgggtcttcgggtggggtctccaatattcagataattgaagaggaagcacagactgccccacgctcagagctcctgaatattctcccaagacttacaatcagtactagccgtaattctctcaccatgatgccctgggtcctgaatatgagttgtcattttataagatattttgccaccagctgtgtttttttcttgaaagatcattactaaaagtggattttggttttcaacgttggactttttcttgttttccagagagttgaatcttgctttcctgtttaatgatcagagctatcttctgattttcacagaatagttgactatgttttgccctctagaaattcatgtcatggtgtatttatattaaaataaaatttaaaaaatattagcaagtaagcaaaaacattgacaaaaggaagactatccaggcatgacaaagcagttcatagttccaatatgtgttattgataagctctaagaatattctgacattctctaagaaagacaattactgggacttccctggctaagacttcaccttccaatgcagagggtggaggaggttcaatcacatgtcccaggaccaaacacccaaaacatgaaacagaagcaacattgtaacaagttcaataaagactttaaaaaaagatgtgtgtgtcttagcagctaagtcctgtctgacccttggcaaccccaggactgtactctccaggctcctc

SEQ ID NO: 48559 - DNA, 1891 bp, Bovine  19866881217740
tggtgtatgcattcccatggggtcgcaaagagtcggacacgacttgatcaactctgaacagcacccacttagaatagttctgtagcagcaaagtactacttgttgaaaatctcccctctccttcaactgtgttcttgctggtcacccaaatatatagtacttctttacctcaaattataaatgggtgggaaaaggcagtaaacaccatgagtttgggcaaaagcactgactttccagctgcagaggtcaaggaattagtgcgttgggcgctgctttgagggtaggaaattattttgccacatgcagtgggcggggatggggagggggcaggaaaatgctcaggactttgtgatctttctcacggcttgttaagtagagcagtggttttatttatttattttttcccgataaacattgtgctcagtacagtaaggaatagctgtgggtaatgctgtgtgttgtaatgtccactctcatctcatctgtggccaagcattgcagaagcagtgccttcctcagtggggcagtggctttacattggtgttgaaggagcctcagggggcagggagttgcaccctcctccccttggtcttctgtgtgtaatttatgtaatttatgcttcttcttcagatggtgtttggaaagaatgagggatttgcttaaaaggaaagtctgctgctggtctcaggaaacaaaggagctgagagggtcctgaaagtccataccccacctttttcttcgtgggttgttcttcctgtttgcagcgaggcacagggctttatgaaagtgtgtggcagaggattcatctggcagagagaaggggcaggggagaagggttggaggccaagcaggtgagacatgaggtgggggtttctgagctatgctgggagcagcaataagagagtgtaaaaaatgtggtggaaagattgtcagtttggattcaggggcaagagataaagacagataggtcagtctcaggtttcaagatagaaaattctgttttgaaaacttagaatagtgatgtctgccactgaggctcctgttccatgtgagtggctgtgcagtagggaatttccaaggaccctctcaaggttggacaagccagggatgcgcagcacggtttgcagaggccaggcctcggtggtgacggcagtgtgttctcattctttggtgggtgctgacgccatctgttctgttcttctcccagagtttccggttcggtgtagagatagcctatgtaggagctaccatcttggatgtctgcaagcgagtgagaaggaagacattggttggaggcaaccatcagagtaaggctgcaattcctcgtatttgttacacagattaccttccctcgttgcctggatcggccccagagtttgtgctctctccctcaaggtggcatccggggtgactcaaaggggcaggtggctcttctgtcccgcaccaacgccaatgtgtttgacgaggctgtccgggtcacagagggagaggtgcctgcccggattcacttgattggggtaggagtgcatgtctgtcctctgctctcactcggaaacctcacccacacacagagccgatgaaagtgcccctcgctcagactcatcctgcacacaggagttggggtaactgtcctgcgtctgcgctgggagacactccctccagctgttctgctccagcgagtcctgtaaagtaaggcccagcaagggccgcggaccttttcccctgctctctagaaaaaactccatgcccttcttgccctgtgtgcatacacaaaagctcaccgcatttatgctcttggtgcagtttgagaagtctgttccaaaaagccagctcatttcaaaatcccacctgtacatcctctttacattggcttgttaacaacagtaatgaa

SEQ ID NO: 48560 - DNA, 1054 bp, Bovine  19866881344651
cctagagccagcatctacagtctttgagcaaagatgcagcctttcctatctgaaagcatcattttgctttggtataatttttaccacaacttctagaactttttaacatcctcaggtgcatttttgcttagttcacttcctaaagggccgacagggcacggtgatcaccaccctcagaagtgagtcttggctcaggcagtggtcagtggtcctgagcccagtgtaaacgagcagtccatcagccagccgtgagctgaccagtgtcagataccctcccagagtgggctgactgctggtttctggttccagtctgtgaagcttactgctgcttcctcaagctctatgtcaacatgcctgccaggaaaagttctcttccttcttcaggaaaaggcattcagctaagactgattcaaaactactgagttctgctgcttaaagtgctaaatcatgtttgactcattccagtacgccctcactacagaacagactgtaacaatcaaatgaaaataaaacaccaagtaggcatcacctaccagaagactgcaaaataacgctacttttacagaacagccagtaagaaaattaggatgaaagcagccagaaaaaagcaaaaagcagagaacccttacaggatagagatacagcagaaagaataactgatatactctgtatggctctgtgttgctataaaaacacagtaacggttgtatcagtataacaaggctctttccggaggagaagcaggcatgccaggatttctggagtcctgttcatttctgccaaagcctctcatcttcttttcctcctacaggcgttctctgtcctgaactatttgtaaagatgggcctcagaactttgtttccaccacccagagctggaaggcatcacgatgaggaattctctcattcaggatggcctgcccccgcccatacccccaggagccctgcccgaggggaagcccacctttctcggaggcgtcgcccacaatgatcttgccgccccgcttgctggtcttctccaccgacagcgctgtgctcaggccctgctcatgctt

SEQ ID NO: 48561 - DNA, 1130 bp, Bovine  19866881706176
tggggttcacctaatgtttctcctcaaagtgaaaccagtgcgggcggtagtctccgcgcgtgcgttcgctgcggcccgcgggtcgcgtggtcagctcggaacctgagggtgtgggggaaggtcggggcgtctggggaagggtcctgacaggcagggtggaggaggatcgcggggcgggtccgggggagggtcgccaagcgttcccgcaggactcgagcccgtggccatgaccgcgctccgggttccgcggcggctgtgctggttggtgctggatgagaggagctgcacgcggctgggcgcgcgggctgcgcggggtctgccggagataccctcctgcacactttacgcgccacagccgctgggacatcttggcctatctgggacctggacatcgaagccgtccaccaggactacaagcgggctctctctgcacgaggctgcctccatgggacacccggactgcgtgcggtacctgctggcccggggggccgccgtcgactgcttggaaggccgactggtaagtggtgggccctgcagagagacccccaccctttcctgccgattgcagattcccacgcttggtcagcctccacaccatagcctctcaggcttcccctacagaacgtcattgctgtccttgtggggttaactgctccagccttctgtttcagactgcctcccatgatagagcagagagctgtaatgaacatgttcagatcccctggagaaggaaatggcaacccacttcagtattcttgcctggagaattccatggacagaggagcctggcaggctacagtgcatggggcctcagatttggacactactgagcgactatcactcattcactcactgcctatagcaagggtcccacgtgttctcgctaaatgattattgcacagatgacattgttctaattttctgttttgaaattcctagttatggcttatcagaaatttgcaaagacagccgggaagtcccatgcaccttttccctatcttgccccaaagttaatgtcttacaactagagtacagtcacaagaagaaactgacactgctatgacattgctactctcagggcccttactcccatttcacaggtacatagatgagcacaggtgtgtggggtc

SEQ ID NO: 48562 - DNA, 638 bp, Bovine  19866882018670
cccacagacttctggtgggtttctcaacagaaaaaaattttttattaatttagtgtatcattttatttatttttctctttttttagtttcaaacccttttgttgaggactgactttcaatagaccgcagtgagggagctgctctgcgaggtatgaaaccctgacccagaagcacgttgtctacgaatggtttagcaccagcttccccaaaaacatgcggtgtgtgacgggcaagggggcagccaccattccagccacaccccatgtcccaggaggaagggctctgcacactggaccccggctccatcgtgtagctgggtggaccacaccgctacctgagggatgagggcctcaacagaaaagttctaaggcgaggagaaaatgggatgatatattcaaaatattgaaagaaagtgtcaaccagtaatgctgtacccagcacaacttcccttcaaaatgaaggaaagagaaagactttgccaaactaacaaatgcttgtataaggaaaatcaaccactaaccccactttacaagaaaggctaaaggcagttatttgagtggaagtgaaaggatgccatttaacattattaaagcataagaaggtagtgtggaattcactggtaatggtgaatatatagg

SEQ ID NO: 48563 - DNA, 1015 bp, Bovine  19866880485496
gagttcacaatttcaccaggtaaccctcatatttagtcttttcttacggtacttagttttttttttttttttaacaatttttattggaggatgattgccttacaatattgttctggtttctgccttacgtcaacatgaatcagccacaggtatacatacggcccctgtctcttgaagctgcctcccatctctctccatcccacccctctgcttatctgtctttgggtccttggaggtgattcaaacagacttcattgccagtgaaccacattgttggtttacatttcccagaagtcatgtgtggtacatattatcttcaacccatatttaaaaatttacagtaaactagggacaattctaaaagaatccagcaaaataatggcactagatataggtcagtttcaagttacctaattatggtgtacaggactatattggactgtgtgcctctgcctcctagaatgatgaatttgctattaaggggaatgtcttagactgtatatattccctgaaatataatcctgtgattgggacactggggattgtatcatggggagtttcctggtatgcagaattcttacaagaaacactatatttgtagggttggccaacatgatgccttcttatttattatttagtattaccatgataaatagtaacatttatataatactttttatttaaaattattgcactaacattattttctactttgatttcccaaataatcctgtgaggtaactataatatgttcttgctatcctttttcttattattaggtataactacattttctctactttgtgaatgaagtcaatgttttgccaaaagtcacagttaacttgaactgaaatcagtgcctgaagttcaggaacagaatttctgattccacatcttgtactctcttcacctcttaatttaatatagtactttgggtggttcattgtttctttttttttccttacagattaaaaaaaattaattaattgtttggcagtgctggtcactggtgctg

SEQ ID NO: 48564 - DNA, 1197 bp, Bovine  19866880514254
cggtttggggattatcaaggcccacagtccttgtggcaggcagcgtggtgaggagcaggccactccccccgatattggtggtctgggcactgtcttatcactgcacaagtgcagggcaacctaacggtttcaggggccacaagaagaagattaccaccagaaatgcctctgctgacaagccctgtgagatgcccatgtactatcctggcagaatccctggtgaggactcagcccactaccccagggactgagtcctcaactcattggccctggaccatcctctgggtccccacccgaccctgccatcgggcactcacccctaggaacgtcaagaagaggacgtggacttctagggtggcatcggggatctgagccacacaaccctcagaaacctggcttgttacgtatgtcacctcggagtccacaggctgtaggtcacagtagactgtttctgcaagacctgtgggagatcacagtggggagagggacaagttaagaacaaggtggtgacaactgctcccactttccgaatgcctactggatgcttggcactgtttaaggtctttcttacatcttcacagctactttccaaggtgtgtgtgtatatgtgtgtgtgtgtgtgtgtgtgtgtgtgtgtgcttggtcactcagtcgtgtctgactcattgcgaccccgtggagcctgcccggctcctctgcccatggaattttccaggcaagaatactggagaggggtgtcatttcctcctccaggggatcttcccaacccaaggtagatatcatcacattcattccacagatgaagaaactgagcctcagaaatgaaaaatctcttacctgaggtcccagtgctagtaagtatagggtcaacagataaaatgcaggacgtccaaatttgaataaataaatacgtatttaaagtataagcatatcccaaacattgcatggggtatacttagactaaaaatttttcagtgtttatctgaaattaaaatttcactgggcatcctatattttcatttgctacatgcggcaacgctaatggtgtggcagggcccacatgtacacgcacccaagcctctcggctggttcgctccaaaggatcaggaggcaaaacttcccctcgtgagcctcaaggaggcttgagagtctcctggccccagcggagagagcgagtccaggttcagagggcagggc

SEQ ID NO: 48565 - DNA, 999 bp, Bovine  19866880904634
taaaaatgagaaaatactttgaagaattatgcttgacatggaagtatatctcccttgttatcagtgggggttccactgcttacagggtgggtggagataatgcccatgtctttggacataatggcttttgacagacagaccaaaataattcctttttagccatgcaattgtctgtaaatctgcttagttggtcattcaaagtgacgacattcgagatatagttgatgcactgtttatcttaaagaaacattttaaaattaattcgtcagacctgtgcaatattttatcttttcagtttaataatatccaaatgtgctttgggttgcttttgggaggcaaaaaaacacatgtgtttctgctcataaatcagtcagttagctttgaaaatatagtacatttcagatatgtagcaaagaccctcagaacagttattaaagcagcaagaggagttgagtttgcttcagttttggacttttaatagacttcactgttacgtagtgaagacagaattgtgccatagaagtctctggttaagagccaagatgttttcttttctattattttcgagccttttgtttcttttcgcagaaggaaacatatgcatttatactgttgggtaaaatttggctcagacagtaaagaatccgcctgcaatgtgggagacctgggttcaatccctggattgggaagatcccctggaggagggcatggcaacccactccagtattcttgcctggagaatccccaaggacagaggagcctggtaagctacggtccacagggtcgcaaagagttggatacgactgagcgactgtgcacattagaaaagataattcccataaacctactctcttgactctttagataaatatgttggcccatgaatttgaaatttcaagttatgactttgtaagaaatttccatgtacttccaatgaaggtattattgcactcgtgttctttgcttgatttatcataaaattatgtgagacctttatgt

SEQ ID NO: 48566 - DNA, 1916 bp, Bovine  19866881076158
actagagtctcagaaagactgttaccaagagggtgtttcaggagattctgggtagagcttgtaggaaatgaatcactaaggtccctcaaaactctgagattctatgattaaatattctaccaatgctatttcacaaatatatattttaatggttcctaacagatcctgttttactcatttttgaaaggtcatttaatttttttaagtgagttaattagtgagcaatgtagtcttgaatgactttcggtggcaattctaccctattaccctactaaaagctaaggtgacaccaattagattaagggtgactgataattctcctttattactatacctgtattcatatttatatactttttactaatgctcctggggtcagttaaaagataaaggggaactcaaatcggctcattaataaaatgtaaaagttgagattccgggctgtatgtgctaattactttctgctaccactaaggcattttatactgcaaagatgaacacacaagaaatgaaagagattgtctggaaatgaacctagaagaaagaaaaaacaaaaaaaaactaacatggagaatagacaagatcagcaatcctgccaattcttctcttgccccaatggtgcctttaacttattaatgttggctgatgctattctaggctgccctgctattataaaagcgtcattatttggtaaccaaaggggaaaatattcttacagctgataatctgattacgacttttgaagacaagggacacagcaggtaatgatctttcttcatgggacttctgtactttgtaatcactcaaagtttcaggccatcagaatgtgacctctccagtccttgtgcttcctacattgtgcaacactggttggtacaaggaaaatgccaatagaatcctaactggctctcaatacaagtggagtgatcaccatgcaaatcattaatccagactcatatcgtttattttaaataaaagagcattaacaagcctcttttatttgaaattccctttgtgtacgtgtgcctgtcatttaaaagtatgaccaggtgtgactcttaagcatttttgttagtagtataaactcctgctacatttgcagcttcttcctgacattagcatttcagttgaatggtaatcattaaatcaattttaacagaagcattgagagcattctttgattgcaatttttaagaaggtgctgtagggacttccctggtggtccactggttaagaatcaactttccaatgcaggggacgtgggtttgatccctggtcagggaactaaggttgcatataccatggggaactcagcttgcgagtcacgactattgagcccgtacataaataaaaggcgtggtacacatgaatatttcccttgtaatactgaaaactagtgaaaagactacattgataatattctgttaaacacagaaactagagttttactattacttattacttcttcattcacactgtggtggaagatgatcttccataagattattgcattttatctattctgcatattgttgaagggccctaagtctcctttaatctttcttaagaataactcatttactcccttgacatcagcacaccttacgtaaccttcaaacaatacctcttttgggaaatctttcctgataacctccaaaacaaattttctcctccttatgtcaccgtattttactttttctttacagtgcacaattctgaggggcatcattcacttggactctgacctgaacagcaaccccttgagttgtgtagacacaatgcacacagacacaggtagcagacctgaggagactgacctcattcaccttctctataatagtacctggaagccagggtatatcatttaaagcaataaaaataaaattgtagaaatataagcaaatttaagagtagaa

SEQ ID NO: 48567 - DNA, 763 bp, Bovine  19866881289464
taatttcacattcatggcttttctagtgctcaatttatcaaggagagccaaagccacatcctcctgtattttatcgcagtaccatcagggtaagaacgacaggttctctttcccccgcggtgactctgcagctaaatcataattcataacgatgcatctttcctgggttcaatttttaacgttgtttcccctttcggaatgcttacataacaggagaaaagagggcattgtatatgagttgcatccgtatcactctcacgttctctatgaggggatgaaaccagatagctgaataatacttggtgatttcagccactcactttggacattttttttttttttaattttggaagtcgcgcactttttcatcatcaaagacaagaaaaatgaggataaaggtgatgagggctgaagtcatgactttcactttccttctaagtttaaaccgtgaggtggctagtgatattgcacatcgattacacggtccaccaacaggtagaatggggagcatatggattagtgaagggtcattatccatcagcaagcgaagctccgtttttatgcttttcctcatgctgtgaatgggctttcccaggtggtgcagttggtaaagaatccacctgccaatgtaggagacacaagaaacataggttcgatccttgggtagggaagatcccctggaaagggaaatggcaacccagtctagggttcttgcctgggaaattccatggacagaggaggctggcgggccccaatccatggg

SEQ ID NO: 48568 - DNA, 3550 bp, Bovine  19866880201313
gggcatgggttctgtacctggtcggttaagatcctgcatgctgtgaggcacaaccaatagataagttaaaataaaatagtaacttaaaaataataataataacagaaaattaattttaaaaaagaatattcacctctagctggaaaggcttgtgaaggacactgaagacaaacgtacaaagacagtgtacattctatgaaagtgttattcactcagttgtgtccaactgtttgcgaccccatggactgtagcctgccaggctcctctgttcacgggatttcccaggcaagaatactgggagtggtttgccatttccttttccagggcatcttcccgacccaggggtcaaacccaggtctcctgcattgctgctgctaagtcgcttcagtcgtgtccaactctgtgcgaccccatagacagcagcccaccaggcttccccgtccctgggattctccaggcaagaacactggagtgggttgccatttccttctccaatgcatgaaagtgaaaagtgagagtgaagttgctcagtcgtgtccaactctagcgaccccatggactgcagcctaccaggctcctcagtccatgggattttccaggcaaaagtactggagtggggtgccattgccttctctgtcctgcattgcaggcagattctttaatgtctgagccatatctgccttatttgtacattctataggctgtattactggtttctgttttatggattaggaagctgaagctcagagaggtcacgtgacctttccacgttcacccagcaaataaatgatggacttgagattggattccagtggagtcttgtctcccatgcccaccactgtatctccatggggagcaactgtgtctgtctccttcactgcctttctgcagcaccttgcacaacgtttgacacaggaattaagtcaaggatgacttacagattggctggccagtgctgaagcacacagaggagttatcgtgttctaaaactgtaaccttggcgttgagctcaatttgttttctttcaagcagcctttacatgattgggtacaagacatttttttcctctgtagggcacaatgattacgctttctctgctaccttcttcatctgcccctgcctttagcaaactgggaggctctgactttgagcttggggagggcagtcctcgggtggtactggctgctgcatgctctctcttccccctagctctgtggacctctcccagtgcctagtcaggagcttggctgcagctggggtgggggaggccctctctggctgtctgacctcagaggctcaggcagcagggagagagcagaagggccctctgctctgagccagagcttgctctgcttgtggcttcctaagtgcaggctgggaaatgcgacttattatccttcattagaagatcactctaatttacaggccttagaatgaagttatgtgcgtgatgcacttttgaactcattactgagtatattaaatcatactgaaaggctgctcctgcagcaggtgtaccggtgactgggagctcagatagggccttgggtatgaaatgtcagtctggcaacgttattccctcttcttctgtcttctattgtcacattccttccacagtttggaacatctgttcatatttgtttattgagcctctggggctcacttatccaaaatcatgcttaacttcatgaaattgccattttaagggcagcttttttccccactctgctaaaaatgttgctgttaagtcgctcagtagtgttcaactctttacaatccccatggactacagcatgccaggcttccctgtccttcactatctcttggagtttgctcaaactcatgtccattgagtcagcgatgccacccaaccatctcatccgctgttatcccttctcctctcccagcatccagggtcttttccaatgagtcagctcttcacatcaggtggccaaagtatcggagcttcagcttcagcatcagtccttccaatgtatattcagggttgatttcctttaagattgacggtctgatcttgctgtctctgctaaaaatgaatgatacattaaaaaagaactgggatgggaggaatcatgacattgtagccccttttgttcgctgcaaatggttagaggacaaagactacatttacaaaaagaagatggctttggacactgttttccaagcttgggtcagctagattttcagtgtgggttttaaacttagctctcagtacagggaagtcaggagtggaaagtgacaaggatagcaaggtggagagtgctgctgtggctgccactgctgctggtgaggggtggggtgtgttagtctcctagggctgtggaaatagaataccacagactgggggagctcacaccacagaaaggattgtctcccagttctgaagaccagaagtccaaggtcaaggagtaagcagggtggttctctctgagggctgtgggggagactgttcttgcctgtctcctagtttccagaggtttgctggcaatcactgatgttgactaacttctgcatcatcctaatctctgccttcatttctgtgtgtatctgtgtccaaattgccccatttatcagggcaccaatcatattggactaggggtcgcactcatgacctcattaaaaaaattatttatttttaattgagggataattgcttcacagtattgtgctgatttctgccaagcatcaatatcaatcagccataggtatacctcatttcaacttgattacctctttagagacctactgtctccaaattaggtcatattctgagacactgggtttaaaactccaacataatattattattttagctctcccaccagagattgaaactgtgccccctgcagtggaatcgcaaagccttaaccactgaaccactagggaattcctgccaatgcaccttggatagaattcaacccataacataggaatgtgtccgtccccagttgtgcctgactctctgagacctcatggactgtagcctgccaggctcctctgtccatgggatttcccaggcaagaatactggagcgggttgccatttcctcctccaggggatctttctgactcagaggttcaacctgtgtctctggcatctcctgcattggcagatggattctgtaccactgagccacctgggaagcccataacataggactaggagaatttaaaaacagaaacattttctttgaaagaagaagagaaaaaacaatacaaaacaaaaaatgaatgcctactctctgagtgctgtagtgtttggtgtgaagtgtcttctacagtctttatagacattctgatgcctggggaatgctgttcttctgattgtgtctcttgttctcctaggatttgaaaggtaacactgatctcagccctcttctccactaggctcgtatgccgtccatcagtggggtgcatgagcatgttggctagcggggtttatattcactcagctgagcaattggtgttcatcagccattattggttttcttctaaataacttctctgacagctgacaaaacccaaggcag

SEQ ID NO: 48569 - DNA, 1701 bp, Bovine  19866880385658
cttttaacttctttcagcctaagtttcttcatttgggggagcgaaaaaaaagagaagttgaagaagataatttctatggttttttccaagttctaagtgttctaaacatgtattataaataattaatatcttgctattacctctccaagtaattgaagtacaaaccactacttgtggtctgtgaacaatccagacttttctctatgtaaacatcatcaactgcattattcaagacaagctgtggttactgttgtggggtcactaaattgtgtgtccagctcttttgggaccccatggactgtagcccaccaggctccactgtccatgaattcttcagacacgaatgctggagtgggttgtcatgccctcctccagagggtcttcctgaaccagggactgaacctgtggctcctgcactgcacacagaatcttcaccactgagccgctggggaagcccatcccgactatcaaaagactggcatacgctagtggtgtccaaacctgggtagtaatcagaatcactaggaacggttttctgttttttattttgttttgttttggtttttatggaatcagagtatttcatcatagagcccaggtttgttgttgttttttttttttttttttcatttcttcctctgattttgaggtgtagccaaatctgtgaaccactgttataaacaacaaatcttatgagttctgaacactgagggacctctgtgctccagattagtttggaaagctaataataatgtgcattattgaaattgatgtataattttttcttgatcagccagtgattgtacaaactgacagtggtaaaaccctgctgctgctgctaagtcgcttcagtcgtgtccgactctgtgagacctcatagacggcagcccaccaggctccccaattcctggaattctctaggcaagaacactggagtgggtttccatttccttctccaatgcatgaaagtgaaaagtgaaagtgaaatcactcagtcgtgtccaactcttaggaaccccatggactgcagcttaccaggctcctccatccatgggatttagaggtacaataatcaactcaactttccatacaactagaggatcgcattcaaatagactcatatgttctttttcaaatttcataacaataataagtattacaccttacatcagtatagtgttttatggattatgttgtgctccacatgaatccttatttgaatctgactgagttatgttatatccattttaaaaatcagaaaattagctttttcgcaatgggtttaccgccaggacacaggtgtcgtgaaaaccactgttaaacctgagccaaaatcggaaaggaaaagaaaaaggaaagatctacatcagcatcgttgtcattgggcacgtagattcagggaagtctaccatgactggccatctgatctacaaatgtggcgggatcgacaagagaacaattgaaaagttcgagaaggaggctgccaagatgggaaagggctccttcaaatatgcctgggtcttggacaaacttaaagctgaacgtgagtgtggtatcaccattgatatctccctgtggaaatttgagaccagcaagtactatgttaccatcactgatgccccaggacacagagacttcatcaaaaatatatttcaggcacatcccaggctgactgtgccgtcctattgttgctgccggtgt

SEQ ID NO: 48570 - DNA, 2506 bp, Bovine  19866880573551
atcatagtctcctccttatatgattctgggcctgaaatactgagctaaattctaaagacagtttttgaatccttgcagatctttgctgatcttttagtactatggtgacatatttattgatttattcattgtatacattaatatttaggatgaaaacttaaattaaattgtatttgacatgataagtgacttttaatacatttttaagccagaaatagcaagggctgcaaaataaaccttactgagaaatttatgtaactttcatacgaaggttttgctttaaagtttgttaatatgattaacaaaacaatccacaaatgacttttcacattttgtcctagacttcaaagaacattttcttttatagatattgaattaactctttgcgtgtctgtgctcagtcactcaatgttgtctgactctttgcaaccccatggactgcagcccgccaggctcctctgtccatggaattttccaggcaagaatactggagtgggttgccatttccttctccaggggatcttctggaccaagggattgaacccacatctcttgagtctcctgcactgcaggcgggttctttaccactgagccaccaaagaagcaactctttgcttactcatgttctttttccttctgcccaaagtattttaacctgagatagttgtctgtatacctctaaccatatttttaaacctccaaagttatttttatacagagttttatggagaccaatttaatctgcagagttacttataaaagaacaatgtcagattgctattttagaagtgtaactaatacccaagaactatctcccaccactgaatagcaactttctgaatacttagcagtgcatttacacactaggggatggaaattaatctaaattcagcatcctataaaggttccaatatctttgcctatttatgagcttaatatcttcttaggcgtctccatctgagtagctactttaaatttttagtcaaattcagtaacccatcaagtagatattaaagcacaatttatgaaaatacataattagatattccagacatgaaaaatcctctggttgctaaagaaaatataatactctaagtgattttaaagtggttacttcctgaatgtcttttttttccccacacattagacgaagttgcattgtttataaaaatttattcatacaaattttacacactttatataacagttatcaaagacctagttatagatatcatgtgtgtaataatacttgggtaagatgtttttataatcagttgcacacaaaataagagcttcaagactaacatctacctaaattatcactatatcataaatctgctccaggttagtaaggctcttggcatttctagaaagtatacaaaagattaaactgggtgatcactgtaaatgcttgcaactagccacgggaacactaaattagacttcataaagaaaaggttaactagcggcctatgtcaccactaacagctgacacaaatacagaaaactctgcccgttatccaaggaacaaataattaaagactaaaatgcaagccaatgtgttgcagcattgtagggccactaaatagccatctgtgaatcgtggcaatttaaaaggcgaagaaaggcactgaagctgcaaaccccatcctgtgtcacattgcccgaggagactgaagaattaaagaaagattgattccgtacacaggactgaggcccagatcgaaggcctctgtgctttcactgtctgcaacgtgatctcggggcagcatccatcccgcctggggaatgcaaatccaagtctgttttctttgatttatgactccatactgatcaaatccgtaaaggaaaaggaaaggtccttgacatgctaatgtttaatcttttcctgtttattttttgtgtgtttttcaaaagaacttgtgcctgaaatttggggagtttggctggctggtttgcctgctgttgcttgatctggttgctgggtgaaggtttcttttgttatagagattacctgacaggttcaagaaattgacaggaaacagacagacatgctttctgtagccaagaaagaatacaaggggacattctcagggcctgttgaagcttgcttacctcactcttgaccacaaatacaagatagtactcatacatatgaagatggggtttaaatgatttatcagttagtacaactgagcaacatgtgaacactacacattctaatatcacaaaggttggttttatgaaataaattttactaagcaataagccataaatgtagaaaaatacattttacctacaaactcaatcaacaagaaacaaaagattcatatatagtgcataattacttagtggtaaccacacaggggttcctacactttacaataagtgctagcatcaaacaacaggaaaaagaagcattcacaagtttaagagaagtgaataaaaaacggcaaacagtacttaaacagtgcgagaaggtgggaaagaggagtcttgaggaaaa

SEQ ID NO: 48571 - DNA, 2627 bp, Bovine  19866880578413
tggttttgaagaaaagatgcccagccagcacgagtcgggttctcatgccttgcaacacatactgatactacaaacaacaaacaaagctgacttaaacgatgcagggaatttatgagctgatttaacaggaatgttcaattcgggcttcagggttggtttgattcaagggtttgctggtgttttcaaggacgtgttacttcgtgtcacttctgtctttcatggtgttggttcagttgcaaggctggcttcttaaatgctgtgttaaattacacaccatgccattcagaaggaaagaaagagtttccttcctagaggtttccagcaaaaaaagaaaaataaaatctccaatcccactatcctgaaatgggtcacatgttaagccctgaactgtggtcaggggaccttatacttggaagtggagtttttattgtctagtcactaagccatgttcgactctttgcaaccccatggactatagcctgccagaattccctgtccatgggattctccaggcaagaatactgaagtggattgccatttccttcttcaggggatcttcccaacccagggattgaacccatgtctcctgcattggcaggcgggttctttaccactgtgccaccagggaagccagaagtggagtcagcattctgttaaaggcaagtcctgcatgagggatgtgtgtcaagagcaaatccaggtagtgaacaagaagaggacagatgtgtgcagatgcacaccacattgttattttcttttaggcttataggtaatcctcctccctgaattaggcttctgtaatacaaggcaaatttacagctagaagaaaataaacttagaccaaatgaaatcacctagggtgatggtccactgctgttaaaaaatatctttcattacgtccctttttctgtctatgaactaacgttccaaatcagatttctatagatgaagaaacttctgttgagaagtttctttggcagctgcagacaactagtaagtatcactttgagcgcagtccaggtcccagtctttgtctcaagaaatcccttttcctttgttcttggaaaaagtatgattttcctgagacataaagtgaattctaatttggaaacacagttcttctttatcaggatgaaaaaattaaggcctggtaggtagcttgagtgtatcacagccatttgcctacatatgaatttgaagttcattttatactggagtgggttgccccttccttctccaggggatcttcccgacccagggatcaaacccgaatctcctgtgactcccagattggaggcagattctttaccactgagtcatcagggatgtctaaggcagaaacatgcctaattaatttggcattcttttctatgtagcttttcctggaggaagatctagtttgatttacaatgagcacctaattaacaagttaattttacttcctatatatgctttgtagccatcctattagactaagcagggggattgtcaaggtgaattctgcaagtcctctggttatttccatcactcaaaagaggtatttattatgttcccagaagtgtgttgggcattaacgtgcaatttgtcatccaggccttccaggagatcatcgagctggggagacaagccatgcatttacaaggcagttcaggaatagagcagagcagtgtggaattagagattagacctagtgctgcagagaggaagggttacagggagaaaaagtgcaaggatggtgatgagaatgaagagaaggttgctcagagaggctgaggaagattcctatagaaggaggttgtgagttggcccttacagaatatttagtttgggtaggttgagagagggcattccaaccatggagcaattgtgggagatgaaaggaagcattccagtttccaagactgataagaacctgtgctactaaataagaaggatcatgttgggtccagagtatgaggaactctggaccctgggacagggcaggctaccccagaacatcagagggtaatgagaaagagaaggagctaaaactacctggttcatgggaaatgaccgaggaaggatgaccagttacaaaccaatgtaggaagccaagggtgaggtgtggactgcagcaaaaggagcaggcatcttccttcttcaaagaagggttacaatggaagagaagagctcatacttggtgttgacttccagccttgtaaccatgcgaacagttcagtggagtgtgaggtcacagggggcctccaagtaaaatcatcttgtaaacagccagattcaagccaaacgtggacatgatccagttgcaagttgacttctggacccgaggttactgccagctagctgcacaggttctattatttcattactctcccaatcatgtgactgaattatttagactctttttacaggatcacacttcttccagaagctcctttaacagagaggtccaaccagaatgtaaaataatgctaactatgggcttagtgacctaaagaaaatattgcatttttccaagaacctaatgtccattctaggagaatacagcttcctgatgtatttattactgtgtgcagagggcatggggacttcccttagtgggctcagtggtaaagaactcacttgccaat

SEQ ID NO: 48572 - DNA, 1810 bp, Bovine  19866880586552
aaatatgtttccttttctcctttgcttttcccttctcttcttttcacagctatttgtaaagcctcctcagacagccattttactttcttgcatttcttttccatggggatgatctttatccctgtctcctgtacaatgtcacgaacctccatccatcaggtttttcaggcactctgtctatcagatctagtcccttaaatctatttctcacttccactgtataatcataagggatttgattgaggtcatacctgaatggtctagtggttttccctactttcttcaacttaagtctgaatttgacaatagggagttcatgatctgagccatctcagttcccagtcttgtttttgctgactgtatagagcttctccatctttgactgcaattcactctcttataataacctataatggaaaagaatctgaaaaagaaaatgtgtgtgtgtgtgtgtgtgtgtgtgtatagctaaatcactttgctgtttacctgaaaacattgtaaactaactgtacttcaattcagaaaaaaaattgttgcgtgtatcactgctttcattcctttttcttggtgagtagtatttcaggtccccactcagcctccattgacacctcagggatggtatcttgttcattattctcatagtagtagtgttagtcgttcagttgtgtctgaccatttatgaccccatggactgtatgtagcccaccagactcctctatctgtggaattctccaggcaagaatactgaagtgggttgccatttccttctccaggggatattcccagcccagggactgaacctgggtcttccacatcgcaggcagattctttaccatctgagccaccagggaagtcttagctgattactaagcctcagtcctgggctggggtggatattcctgcttttgatgtgggtggtttcctctgacaccgcaagggaggtggctccttatcactggatagtggtgacagtcctgactctccagtggtcatgttgtgacaccaccccagtgaggtgttgggggacctcactgggtagaagtctaggctccccaccagggctttgctggcatgggtagatatgggggccgccagtgtttttgagcatggtgtttggctggggcacagcttttattatttaaatgtctgctgtcttgctaggctacccctgtccttgggagagtaggctcttgttgggggcacctttttcatctatgccctttgatgttgccaggttgcttgcttcaacactaagcatggaatggctgaaacaaacagaaataagaacaactctccaccatgtttttctgtgggtcctgagtttcctagctggtctgtcttctgttctccacctttcagggtcttcttaagtttgttttaaatctaacgtccagagttttagttatagttaacaggagagatggggaggagtgtgtccacttcatcttcctgcaagcagaagtcctaaggtttaatttttatcagcttggtttctccaggctctgtatattatgaacatgcggcattacttaacaaaccagaagggcaccaaaccacctgcaggaaacatttgtttctaggatttatgtaagaagaaaagtgcctaccacgtgcttggcactttacgcatcatttcacttaatcctcagaataacgccacagggaggatgttattaaccctgacttaccgaggtgagatctgaggttcagagaaattaagtaacttgttccagatcacacagctagtagttagcagagccagaattgggggccagttttgcccacatttttctcccaccactgtcag

SEQ ID NO: 48573 - DNA, 3159 bp, Bovine  19866880619350
tcttaaaaagaccttgatagtgaaggcaggtgaaatggatttaactaatgattacccatgatttcattgttgtttaatcactaagtcatatccaactctttgcaaccccatggactgtagcccgccaggttcctctgtccatggagtgggttgccatttccttctccagaggatcttcctgacccagggctctaacccacattgctgcattggcaggcagtttgtttaccactgagccacctgggaagctccatggtttcattacaatctacataaatcatgtatttgactctttatgtttttgtcttttattttctcttaggcattcccttcttggggtgtgtgagatgtgtgtgtgtgtgtctgtgtgtgttctaccagagtaacactccctcccaagcaggagtatgttgtttgactcatgagagaatccaagttgtggggaatgcactgacttcaccctccttcctgtgcaagacagtaagccccagctcatgcacaggacccacccctgccaggctgcacgactccagggaccgctggcattgtatcctggatctgggctccacagaggaatcagcacggatgacacaggcttctcggcctgctctctgccaaataggtacccaaggggaagcccagaagttgtcccggctgtgccagaggcagggtgggccagtctaatcagggatgacatagtagcaggttcattacagccacacatggaagacgctctgtccaagcctgacctgttcaagtccatctgtctgactgttccatttctcagtgaatatcctgtgcatctttttgttgtccttgattaagattaccttgcttctaggtgtccttagttaccaagctttgcatgcagcgtgctgagttgcttcagtctgactctttgcacccctgtggactgtagactgccaggctcctctgtccatgggattctccaggcaagaatactggagtggattatcatgccctcctccaggggatcttcccaacccagagatccaacccacacctcttatgtttcatgccctggcaggcaggttctttaccactagcgccatctgggaaagttaccaacctactagttattaatataatattttacaccccacttaaatcttgaacatagtgatgtcataattatgaaagtaaccagatttgcgtcaagtgtctaatcttaacaaaataacagctgtgaaaacagatgaaataattagaggaagaaactgtttggaagtttcgggatattttaaaagtaattagtactaataagcaataaagttctgttctcggaaattacacttaaacgggaaacatggtgactgcagccataaaattaaaagacgcttgctccttggaagaaaagctatgatcaacctaggacagcatattaaaaagcagagacattactttgccaacaaaggtccatctagtcaaagctatggtttttccagtagtcatgtatggatgtgagagttggaccataaagaaggctgagcactgaagaatcaatgcttttgagctgtggtattagagaagactcttgagagtctcttggattgcaaggagatcaaaccagtcagtcctaaagggaatcaatcctgaatattcattggaaagactgatgctgaaattgaagctccaatactttttggccatccgatgcaaagagtgaactcattggaaaagatcttgatgctgggaaagattgaaggcaggaggagaaggggatgacagaggatgagatggtaggatggcatcatcaactcgatggacatgagtttgagcaagttccgcgagttggtgatggaaagggaagcctggcttgctgcaggccatggggtcacacagttggacacgactgaacaactgaactgagctgaactgatggaatacatagggaaaaaaacctgccactagagaatgagccaccagtcttcctaaacattagtttcatttttaacaaaatgtgagcttgttgggacttccctggtaatctaatggttaagacttcactttcaaatacagggagtgccggttcgatccttggtccaggagttaagatcccacatgccatgaggccaaaacaacaacatgaaaaaaaaacaacggaaaaagcatgtagagtccagccatgacttcaagtgagtccaaatttggacaacagaaaagtaacaagaaaggttctcagagtcagagctggcactgatgctgcacaatttcctaggattgactttcccagaactggactcttgtcttcctgagaaaaagaccccaagtgctgcttcttcctttggccatgtgatcacctctcagaataagacacatctgtttgtaggggtggtttagatttgctcaaaagtgacatgaggcttcttaacataataatagtttagattttgctttgagctgatctgttttctagcagagttaagaggttttcaactaatattgagaattgccagatagttaagacagctaagggcttctcaagtggtaaagaacctgcctgccagtgcaggagacttgggttcaattgcttggttaggaagatccctgatgtaagaaatggcaacccactccagtattcttgcctggagaatccccatggacagaggagcctggcaggctacagtccatagggtcacaaagagttggacatgactgaagcgacctagcacacacacaagacagctaaatgagatgtggacaagacttctggtgtgtcttataattccctatccccgtgtccaagcagagcagagataaactccagactgcaggttgctcagacacaagggtcaacttctaagggccccaaaaggcaggtgagtcagtttagaacagtcagtgtgacctgctgaaaagtaccgagcatcacattaataagtagtgatcaataagtccaatcaataagcatcaataagtggaatccctccaaacttggaaaagggaccccaagacaatcttgagatttcagtagccagagacccagactacagtagctgctatggtgactctctaattgtttttagaagaatcatttgctgaatttttagctcagctaatcaatgagtatattgtagtgaaatgctcacctattacactctttataggctagatgttatcatttcatctagttaaaat

SEQ ID NO: 48574 - DNA, 1896 bp, Bovine  19866880635560
gaagtcctggagcttggtgattccccctttatagatctaggtctagagaggagatattagaacttctatttattttttaatttaaaaatcaactatggggaattgtttaatgggtacagagttttggttttgcaggagacatgggttcaatccctgggtttggaatatgccctggagaaggaaacagcaacctactccaatattctggcttgggaaatcccatgaacagaggagcctggcgggctagagtccaggggggtctcaaaaagagtcgacataacttcatgactaacaaacaaaagagttttggttttgcaaaataggaagaattctggagcttggttgcccaacaatgtaaatgtatttaatactattgagctgtattcataaaagtggttaagacagcaaattttatgatatatattttaccacaattaaacattttttcatgaaaataaagtttaaaaatgtggaagatctgggttcaatccctgggttgggagggatccctcctggaggagggcatggcaactgattccagtaatcttgcctggagaatccccatggacagaggagcctggcaggctgcagtccatggggtcgcaaagagtcagatacgactgagcatctaagcacggtacgcactcccaattttaaaatttaaaatactttgcaaattatttttgttatagttttgacaccctctttgatttaagggcatgttgaaaataaattttttaaaatttaactattctgagtgtgatgttaatcgttattgccattaaactatgagccatgcaatgtctgtaatttagaaatgtattgactttatactgtaacatatgaacagtttttaatatggcccatggatgtctgaatataatgtatattctccattgataaggtatatagtttagacagaaactattaagtaaaggtacatgaattaaattgatgaggctgatatactatttcacaggcactggtgctcgtgccaggccattgcctgtggccagctgtgcgtgaggaccctggggaagaggaactctgtacattccagaagcatcgacactggttgcctctgttcacttggagccagttgcagtgaattgccatttaagaggactcaggtaagtgagggcttcccaggcggcactaaaggtaaagaatctgcctgccaatacaggagatgctgcaagagatgtgggttcgatccctgggtctggaaaatcccctggagtaggaaatggcaacccactccagtattcttgcctggaaaattccatggacagaagagactggcgatgtgaccgaatgactgagcgcaggtaaatgacggtttttaactactttaaactagccctcactaaaagggcaggagactttaaaagattcttgggaaaaaaaaataaccagcagattaaaaaatatgaataactcctgctcaggtagataagaaataatggcagggctaacactttttcattatgagctctttgttggccttgtgtcagtaaaaatgatgatctaaacagatttggcaataagctaaaattttttcaaaatatgtagaagattatttgaaatatggacttggtagcaattcatgtatctaatttataaataaatgaaaatgcatatattcaggagtggatggtaacaataattacagtaataaggatgggaaagaaaaaaaattttgtagaccactgatctggtccaaaacttccaaacatttttgacttgacattccaactcaaaaggcaccatggaagcagttttaagaaagtagcatttcccaactagcattgaatcctccaaacacctgagtatgggagtctttcgaaggcataatctacaagaaatatgttctttgaagaaatttgaaattttctt

SEQ ID NO: 48575 - DNA, 3150 bp, Bovine  19866880673343
tgctatactaattttacaggttagaaaaactaggcctggagaaattgtgtggtttccccacagctgctatcccacagaggggcagaagcagttgccctaaatcaggtattttaatttgacaagtcagcataacttcaaacggatgtttggagattcacaaaggacagcccaatggtggtttttgtcatttaccataaaatgatatgggcttccctggtagctcaactggtagagaattcgcctgcaatgcaggagaccctggttcaattcctgggttaggaagatctgctggagaaaggataggctacccactccagtattcttggacttccctggtggctcggctggtaaagaatccgcctgcgggagacctaggttcaatccctgggttgggaagatgccctggaggagagaaagggataggctacccattccagtattctggtctggagaattccatggatagtacagcccatggggtcgcagagtcagacacgactgagcgactttcacttcataacatcatacgagaaaggacacaagggttttgaaaatcaggaataacctaatctcagaacaaaggatattcttttaaatcacttgagcacttttgaacaagaggccgtctcagtagcacacagagaacgcggagtgtaatgaacatgcgcagtgtggcctccacgctcaaggggcaaacgttagttacagtgtgaatcggagtcctcgggtgccagcccctcagctccccaccagtaacaggtaaccacgaccctaacaaggaggcttcccacattcactacatgcagggcaacttttgtttttcccgtgtggccaatggtgagtgggcgtggggtgcggggaggagcaatgagcatctaaggcaggcaggcctcatatttgggagccactgcaggagacgtgggtgtggagcgccctgctaacactctcagggaacaaaaacacctttcagggctcacttgcctgcgtctccaaaggcggacatctacctaactcttcacggtgacacatcctctgtactcatgttttctgggaacttcatggcatcatggactcaatggacctgactttgagcaaacttcaggagatcttgaaggacagggatgtctggaatgctgcagtccatagagtcgcagagtccgacacgactgagcgactgaacaatgaacaacatgagagcccctttcacatgacccgactgctgtgagtttgtccatgtggtttccagccagccagtgactccttcctttcacagatgggcccaaaaggtccagagagtcagggccttctcctggccacacagcaaggtgtagggggaggcagggatcaccacctgaaacaccctgtgtgcgggtttcctgggctccatcacggtggaggagctcctgctgttttagtgcttctctgggggtgccccaacaacatcgttttgcaaatacgattcgcatttccaacagaatgtgaatcataaatataaaaacaggaaatactaaatgccagcaaagaaaggaacaataagaaaaagaaaaaaacctaggaggatggagagtctctggatgccttcactccacttacaaaagcaacggtgccaaaggtgggaaaccttccaaagggccccctccgggtgccccgcgcctaaggggccctagcgtcggtggggcgggagggcaccgggacggacagcgcttaccatggcgtccgagccgtggcccccgagtgacgtggggaagcgcacgtcgtggaccgagagccgggagaccctgccgtgcaccatgcccacgcgcgctggggcgccaccaacttcgctggaccggacgcgggcgcgcggagagggaggggcaaggagccggcgcggattggccgtgtggccagggggcgtggccgcactcgagaactcagggaattgtcaaacttacgggggccggcccggttaagggtcccctgactcacacgttttccgcgccaagtttccgccccgcaactggcgcactgttccccaaggcggattccttcggcgtttccaccgaccccgcgcccactccccttctcccgtccctcctccccccaggatcctgctccgcccagactagaaattgtcatgtgaccttacccggagcgacgccccgagaggaagaaacccggtcggttcagagtgcgatcgcctcgcagcagatttggaccagctccaaatctgaagtcactcaaggctggctcaaccaggatagccttgggccagagaatcttgaaatgacctcagcctgtttgccatttgataaactaagaggcgggtcaccatttattacatccttgctgatgcagaaagctttaaatacaggaccgcttatctacccagccctgcaaggtaggcaggtattgtccattttaatgaagaaatgagattcagagagattaagtaatttaagagacttgcccgaggccacacagctagataagtggctaagagtactagctgcaaacccaaggctctgtcctctgggtggcaggaattgtggggttcagagctataggatccctctgacaacatggtgagggctacggacagccccccacgcccaaaaccgcagcactgtgcacagaggttaagtttttataccattttagggatggtccacgtaacctcttgcctacagcacgccacctttcagttcctacttctagggactgttttgacgactgtttgggaagcagtgctatacagatatatttttccattaataaatgctcctgtgggtatggcagggatgttttcagggatctccaggtcacgtctgctgctcaaggatgcatacacatagaaccctggcagatgaattcctctggctaaagactgagatgcttaactcagaagctacatggatgttaactcaatgctacagaggctgggtgggcaccaggaagcaaagagggatgagataagaagcagtgactgcagctaagggacagccaggcagcgccagttgattgtagccctgtaggaattaagagcgcagattgccgcatcttcctagtttccaagagaagtctgaaatttgaatgttaataggaagtagcctttctttccccctggcctctcctgcccactctacagcttagacagttaacttttttttt

SEQ ID NO: 48576 - DNA, 1711 bp, Bovine  19866880677094
acctcttctccttacacgttacagcttcattccttaagatgtaagcggtatttataggaaatgctgatcactgccaacaagtgaatactcccattaaacacggtttaaaacaaccttctctccagttgtttataataacctcttggaagtttgaaattaaaatctgtctcccatccagcctttttcccgcctcttatatgacgccaaaccaagaacttgcccttgaacatacttcaactccctggcccaccaccctgacatgctctgtagctcattatctcaatccctaaatattagtcttttctcttgtcttctctggtttcctggacatgattcagtctccctgggtatttcattgtttatgtcaacgaacagactctgtcccttcaagagaccccttccccttgcctggccccattgtccctcaacaccttcacgacaaaatgtgtgttgaacttctcttctttcatagggggagaccctgaagttgaaagaatccaatctcttcattaaaaagacaaggtccttgaccctaaatgggaagcaaatccaaaaagagggaatatatgtacatgtagagggccggtaaagaatccacctgccaatgcaggagacgtgggttcaatacctgggtgggggaagatctcctggaggacagcatggcaacccactccagtattcttgcctggagaatccccatgggcagaggagcctggtggggtacattccatggggttgaaaagagtcagacacgactgagcgactaacactttccctttcaaagattttttcttgtcaatagagaccacaccccatgatggtacgaggagagacccctgggtggtgcgggagccaccatattacttcagccccacagaccaaggaagcagtggcctcacctgccttgggactcccatctgagcggtcgtgaggatatattcttaaggaagaaacgtgctcttggcgtaaagccttggggttataagcccatcctttacaatcatacccaaatgagcacgtgttttcactgtgctggctccaggctggcagccagagctctgcctccaacagctgcccagggcacagcccaggctccaaggggggcgagggcggcctccactcaccagacagcgggtctttgccaatcatcaagacattaggcaaattcatgacgatcagctgctggagaacttcctatggaaacaaaggggaaaggatgccattaagaacagaaaacaaaataaagactgattaagaaaattacagtgtaccaagaaactggaggagtgtgcagccattatgaaaacagttgctatgaaaatactatatatatataataggaaggaaaacgtaagatataaataaatgaaaaatccaaacagctaactgtgcttctgccttgattattactaaataaaaattatgtctgcatttgtacagatactttggggggaaagaagatatattagatgctatattagtaggactagcagtgagtttcttttaaaggatgtctttatttttattgtatgatttgcttgtgcaactaaaaaatgcagaataaacattaaaagggcttcccttgtggctcagctggtaaagaacctgcctgcaatgcaggagacctgggtttgatccctgtgttgggaagatcccctggagaagggaaaggctacccactccagtattctggcctggagaattccatgga

SEQ ID NO: 48577 - DNA, 2585 bp, Bovine  19866880686479
aaaaaaaaaaaagactcaatttatctaaatctaccatttctaggtgtttgcaatcataaacaggaaaacaaatgcaatattcttccttctttccttccttcctttcttcttcccttcattcaaatgctgttgtttttgctcagtcactaagtagtgtccaatttcttgcaactccataaactctagcatgccaggcttccctgtccttcactatctcccagagtttgttccaattcaagtccactgagtcagtgatgctatctaacagtctcatcttctgccaccttcttctcctcctgccttcaatctttcccagcatcaggatcttttccattgagtcagctcttcacatcaggtggccaaagtattggagtttcagcttcagtcttttcaatgaatattcaggattgatttcctttaagactgattggtttgatttccttgctgtccaagggactctcaagagtcttcagcaccacaattcaaaggcatcaattttttggcactcagccttctttgttgtccaactctcacatccatacatgactactggaaaaaccatagctttgactatacagacctttgtcagcaaagtgatgtctttgctttttaatatgctgtttgggtttgtcataactttcctcccaaggagcaagtatcttttaacttcatttcaattttcaaagagaggttaactattttacaggcagagatggaaggaaccgacctaataatttcccagcaagggaaaaagtctagctcacaggctttttaaatatacacgctcccactttatataaacattatcttagaagaaggaaaaaagccccaagacacagaagaccacctggtactctctctcttgctcttttttttcttttttgggggggtggtatattctaatacttcatcagtaacccaaaaaagtgagaaagtcacagctcctggtaggccttcttcctaataagggacatggctaaagagatgctttccatttgttgataactagtagatttatgttctcattcaatatgtctttcattaatataagcagcacaatgaaaaatttcatactgtgataagtataaacagatcactgatttgagagaaactgaaaatttttcttggggattattaatggaaacattatgctccttattaaatttgcagacacatgtatttgaataattacccactgattttatgaagcttggagggaatagaatcttccctttttgagtgtagaaatctagaatatagtgagttcagaacactcaagcctagaaaatgctttaatatatctaaagctacatgaaaggaacatacaaccaaatggcaaccccaataatcatgagatcactgatataaggaacaaaactaatgagaagaaaagatagttttccatctgccaattttgctaaattttgtatcagatatctgggaaaaatatacctgaaatgagggttgttgttttcgttgtttagtcactaagtcgtgtccgtctctttgcgaccccatggactgtagcccaccaggctcctctgcccatgggattctccaggcaagaatactggagtgggctgctgtgccctcctccaggggatctttctgacccagggatccaacccctgtctcttaggtctcctgcattggcaggcagattctttactgctcagccaccagggaagccgacagataatacatgagtttaaaaatacccaaaagtaaatgaaataaagaatgggatctgtagcatagcagagggaaatagcgtgctgtgttagggagcccataagcgatgctatttttactcagtgaggaaggcttctcagaggaggtggtttcaactgagacctgaatagtggaaaggaagcagctacggaagagtcaggtgggaagagggttccaggcagagaaagtgaccaagtgcaaagttcctgtggtgggaacaaggaacgagaccagggagcctgaggaagagaaagaaggcgctggcggctgaccgtcagtccagtgaggctgggggcaggaggcggggggagactggagaggtcagagacccctgctgcctgttcagctcccccaggaggccttggtggtgttggaggagctggaggcactggaatcaatccctccgggttcaaaccctaaggctacatgaactcaggctgggcacatcacactcttggcctctgctttctcatctgtaaaatcggattaagaattgtcctcttctcccaggcaccatgagaactgatgaggtttagtgatcagaattcttgtccaacggggctgagccgtcctcccggtctcagccactcattcactgattcattccagtcaagccaacacgtacggcttgggcaggtgccacaactgccgtgcaccaggccccgtgctcttagtgcacagtaggtactcgaggcagcgctgctaccagggtctgcagccgctcccaatctgccaggcctcgggtgcgtttcctctccctccaccttggcgacaggctcagcctttgggacacgcggtggggggcagtccagggccagcacttgaagtcacgccctcctctaggagctttatgt

SEQ ID NO: 48578 - DNA, 1607 bp, Bovine  19866880686582
caatatttacttgcaagtccctgatcccaaataactaactcaacacaacaacatacgaatcacaagtatagaccacagttgtctatggagccacttaagtagcatcatcaagacaacccaatgcagagagatagcaaaggacagaatcatccagaagagaggaggaggctggacgtggatacaagaggagttggggaaagttcacctgttgttgaaaatcagcaagtacatcactgacagtagagggccagatgtcctgttaagaaatgtcctacttaaacagtctcaaaaagttggcagctgtccttgtgggaaccaacagcaggagcagcagctgtaatgaatgaatcagaagtgtcctttctacatatctgacttcatcatgatcatgtctcccctctgctcaagttcttctagtagtttctcacctcactgagatgaagagcccacaaggcccatcttctctccaaaccttccctctctgacctcagctactctgcggctcactcccgctccagccacactgcgccttgaacataccagacacatggccccagggcctttgcattttctgtttcctctgcctaggactctgtcccttaggtaacccgcagctctctctctctcttcctctcttactttttacaggtctttactcaaccatcaccttgttagagaggtttttcctgattaaccttttgaaaattgcaactccccatctcccttccttattttatttttctctagaacacttctcaccatttaacacactatctgatttactgatgtgagagttagaccgtaaagaaggccgagcactgaagaattgatgccttcaaactgtggtgctggagaagagtcttaagagttccttggacagcaaggagatcaaaccagtcaatcctaaaggaaaccaaacctgaagattcactggaaggactgatactgaagctgaaactccaatactttggccacctgatgtgaagagctgactcattggaaaagaccctgatgctgggaaagattgagggcaggaggagaaggggacgacagaggatgagatggttggatggcatcattgactcaacggacataagtttgagcaagctcggggagacagggaaggacagggaagcctggcgtgctgcagtccatggggttgcaaagagtcggatatcactgagcgactgaagaactgaacaacaataacaacaatctgatttacttatcttttgcaccccccccaacaagaatgtaagtttcatgtagacagagattttgtgagctgtactctctactgtatggctagaatatgaccagcacagtggataccaaacagggttgttgaggagattaaataaaagacacataaaacacctgaaaagcacagagcatataataagaattacataaatatttgctattattttatttttgttttaaactccatataacctaatgggtagtttgtattataatatgcattttaaaattttttattaaaatttttttaagtctttattgaatttgttataatattgcttctgttgtttatgttctagtttttggctttgaggcatatgggatcttagctccctgagcaggga

SEQ ID NO: 48579 - DNA, 1914 bp, Bovine  19866880741951
tcttctgcatggtgatggcagagggaggggtagtgtgtatcatagagtacaggctccaggaacagacccagactcctatcagtctcttcaggggtggagccaagaatctgaattttaagacctggtgctattttatttattcaagtttgagattaaatgcaaataaataaatacaccaagactgaaatgcgaatcttgaaaacatttaattttttttacaggactcaagaccagcctttctgttcaatatatgtatcttggtattccttctttcaggcaaaagagctactttaaatgtctgacatgtaaatacatgataaacacctaaacaccacaaaagtcagaaactattcgatttctgacttttgtcagaaagttggtgttgcctacgagacatccactttaaatataaagatacaataaaaaaaaaagtatagaaaaatatataccatgctaacactgaaatgaaaagattggtatggatatatgaatatcagataaagatttcagattccagagataaagataataatgaaaaggtcacttcaagaagaatacagaacaatcctaaacatttgtgcatctaatatcacagcttcgaaaataaagtaaaaactgagagaaatacaaggagaaacagatgaacctacagttaaagttggaaatgtcaattcttatctatcaatgttggatagaacaagtagactgaaaatcagtaaggacatagaagatttgattaatacaattcacaaacttaatctacttaacatttatagaatattgtgtccaacagtagcaaaatatacattcctttcaaattcacatagaacatttaccaaggttgactatgttccgggccataaaacaagtctcaagaaaaggaaaaaaaaaaatttgggggggggcggtcatgccatgcgtcattaggaataattcctctaccagggattgaacccatgcccaccatagtggaagcgtggagtcttcactactggaccgcaagggggaagtttccaagtcttaagaaattttaaaggatttaaatcatacaaagcatgttatcagaccacaatagagttaaattagaaattaagcagctctctgggaaatctccaagcatcagaaaactaaacaacacacttctaaaaactcaagaagaaataaaaaaaagggaagttaaaaagtatttaaatggaatgaaaacaaaaatgtaacatcaaaatttgtatgatacagataacacttggagagagattttttactttaaatacctacagtagaaaggaaatgtcttaagttaggattgccagacttagcaaataaaaatacaggatacccaactgaatttcagataaacaataaaattttatttagtgtatgtcccatgcgatatttaagataaattaaaacattttttatgtaaagctaaaatttaactgagcagcctatattccaccaagtaatctatctaaattaatgctctcagatttcaccttaagaaagtagaaaaagaagatcaaattaaagtcaaaggaactaggaaaagggggaaaaaataaagttcaaagcaaaaataaacaagaaaacaatagggaaaatcaatgaaaccaaacatggttcttggagattaataaaactgataaatctttagctagattcatgagagagataaattacaaatatcacgggacttcccctgtggtcccgtggttagactccacactgccagtatagggcaattcctgtttggggatctaagatcccacatgccacatggttaaaagattttaaaaaagaagaagagaaaaacaaacaaacataaggaatgagagagagggaatgcctctacaaatcctagaaatataacaaggataataagaaactatgaacaggactttcctggtggtgcagtag

SEQ ID NO: 48580 - DNA, 913 bp, Bovine  19866880780704
actcctatattttgcagccggtcgctagacggaaaggggagagtgtctagaaggacctggaattctaaaatgtgggtcagtcagtgtcagaaagggctgaacacggagtctcttctgctgaaatcactgccctgtcagactcttagattaacttcctcttcgtatttcctctttggtgaggttattagaactactaatgttgggactgttggtttcctttgtggtttttagcgaaattcagaatcatccttgatatacacaaaatgatacaatcatatgtgtcagtattctggtattctaggaatttaggaaactctatataagggtatgaaaaaaatgttttttcagctcactagatgaaccaaagataggcttagacatttacattaactaaaaggtgctttaatattagatttagctaccaaaccctcatttgctcttgagtgtcatgggcattaaaaatttcatgttggttcaccaaccatggtggtccactggttaagactgcacttccactgcagaaggcaggaggttccatccctaatccaggatctaagagcctccctgcctctttggccaaagtaaataaatgaataaataaacatgtcatgaaacttaacatttaacttttttttaactagaaaataaattccttgaactgttacttttctaaacttatattataaactagagattatatctttgtcctaaactcatcttcaaaaccaaaaaaacacctctcagcttcataaaatcaattctaaaatactagttaaaatatgctaaaatcaattctaaaatactaaagtcaactctataagggggtgaggtggctttgaaaatattctgtatggagttttaaaggtgggcaagggtgtcaaaatctctccatgttttgttacattcactcatc

SEQ ID NO: 48581 - DNA, 949 bp, Bovine  19866880788293
ccaaggggtgaggggagctctgtcttcccagaactcgagggagtaaatgtctgaactggaatcattccacatcctagtaagaagagccctagagaacacggaaggtgtggggatcagccctaaatactcagtatgagcatcacctgagggctgtgtcacgcagaagccaagcgtatcctgtgaacatgttcaaatactttcaaaatatctttctcctaaggtctgtctaaagtaaaactgtgtctctgagactaccctatgaagtgatgtgagaattttaatattgaagcaacggctatgccaaacagaaagtcaatcaacattttttataataaagtcattgctttgaggctaagttgattattctggccatttaaacatagttttatagattgagcaaacaataaaagggtctttgcagacagtttttttttttttttaactgattcttcatctgaaataacactacaaattcttatttaagtagaataccaaaaataagtaattgatggtaatgctgacccaaatgaaggttaaccttcaaattagtttaatgttcatgaagttttttcatgtactttaacattttacatgtaaatattaagctaattgcaaattcatttcatctttaatatagttacattgtgaattcaagatatcttctatacttgacaatgatgaaaagacatttctaaaaattctataaatcagtcttattacttgggaacaatttaatagcaagattgtgttttgcagctgacatatggacactttacaaagtgaacaggagaatgatttgggaacatgctttaaactttcaggtctatgttcttttcatgtggcagccaatcaaaatggatttgctctgttcaggaattaagctctgaatataggtgaacaactgttctgtttattagttgtaacaaccacagatgacatatttgaggca

SEQ ID NO: 48582 - DNA, 3587 bp, Bovine  19866880828121
gatggcagatggagggggctctcaggaggtagcatgatgttttgagtttgtttaatatgtgtggctacgttacacatatgatagaattacatagagacacagacatgcacatgagtgtgtataacagatgagaactgaagacactgaattatattaatgacaactccttggtttttatattgtactataataattgtcagatataaacactggaggaggctgactgaggggtacatggtacaagctatacattttttggaaacttctgtgaatctataattatttcaaaaataaaaataaaaaaaaattatttaggacttatctgcactgtcctgggcattgtcttcctttttaattttctgtgtattgaatgtttgtccctcctctgcatctctactgctgccctgttttagatctcctaagagcatggactgttgttttacttattgtacctacaacagtgtttggcagagagagagagagaaagagtgtgtgtgtgtgtgtgtgtgtgtgtgtgtaatgaacagaattgcttagcatccttacattgcctgaccctggtctgtctttccacattatctccctctgcttccttccgtatgtgagtgctccaactggctaacagttgcctgaatatatcctggttagttttctctccatgctagacattgtcccttccaggtctttctctcacttattacttaacctttagtgttcagaccaagaatcatttacttattcccattctctgggccctcttgaatgtgcccttctgtatcacaccactctacttgtgtgtatacctctattgcctcgcttaccttcctttatttcaacagtttatttacctgttgaatcaggatttgcacagaaaacagaaggcacactcaggtgaaatcatgaaactaactttatgaagagactagtcacagaagtcggtggaggtgaggaaatcggcgattggttatgggagccctgtgagcactggaagcttgcaggacagagttaccatcacagagaaatgggcagagcttcaggccaaaagagcacctcccactggctgaactcaatcagaatccacagagccagacaaccccagagatgcagctaatagagaacaatccttgaattgtggagcaaggcagagagaggaagagaatggatcgggggagacgatggcaaatcaaaagcaaccaatgcatgttttcctttccattagatggaatgttcctgagggcagaactatttccattcattcttattcatttatttatttttggttgtgctggatctttgctggcgcacacaggctttctctagttgtggcaagtgggggctactcttcattgcggtgcacaggcttctcttgttggggagcacaggctctaggcgtgcaggcttcagaagttgtgggctccagagcttgggctcagtagttgtggctcaaaggactagttgctctgaggcaggtggaatcttcccagaccagggaccgaacctgtgtcccctgcattggcagatggattcttatccactgcaccatcaggggaagccctctcattcattcttggagttccagcacctagcacagggcctggcccaggaaaatcattcaataaatccttgtggaagtgaattacaacttcagggcatgtactacatttaacttaatatttgtaggaaggtaggcaaactgtttacaatctactttcacatggaactgtttttatacattttttgatatcatatctgacttagatgataacagcacaaccaagacagaatccactggaaaggttaattttggtcgtcttgctttgctgagttcatgcaactgagtctaatgcaacatgaacctggatatagaagtatccatgtggggctatcagcatgagacacaaagcatgagaaccgcaaggcatatttcaattagtgatgcttgtctagtaattatacaatattgtctccagatcctggtgccaaataggcaattatgaataaaagcttacagagtcaggcaagccaggtacatttttgaggcatgaaaaaatccaggtattctatctaatgatatatatcagaccatagggtagggtgaccaactgtcctggtttgcctgtgactgtactggatacagcaagctccaggagttggtgatggatggggaagcctagcatgctgcagtccatggggtcgaaaagagtcgacacgactgagtgactgaactgaactaaactgtactggatacagcactgaaatcctttagcctgagaaatcttctgcctcaggtcacctgggacagttgatcaccttacaattagggttaattttaaaatgcagaattttggacttctctgttggtccagtggctgagactccatactcccaatgcagggggcccaggtttgatccttggtaagggaaccagatcccatatgctgcaactaagagttcacatgcctcaacttaaaaaaaaaaaaaaatcccacatgccacaactaaagatcccatgtgctgctactaagacccagcacaaataaataaacacatatttttaaaattaaaaaatgtagattttgattcctcaggatacagcttaactgaggctttatttagagatgataaagctgttctagctctttgatagttatcttgagttttgtaaaacttcaaatcttctttgactgggatctggtaactttgcagatgaattaattaagaagtcctaagaaaaacccttcactgacagtattttcttaaccccaaaccttacaaacaaacttaatctaattagttcctcaggtgtaaaatcaaaatgtactctagtgtatttatagaaataacaagtctgtctttccactaatttgctcacgtttctggatatatttctaaactcctggccagctttctctgcaaactgcaagtcccttgttcaaatattctacgggaggaatatgcacccacaatgattgtaccagtggctatttctaacttttgtatttatttaccaagtgagaaagtggttgagaactagtcaggactttttgcagcaagtcttcatcctcagacttttggctgaaccgtggaaactcaatatgcaataaaactgcctggttctggaaccagataaactccttttattagtgagaaacttcatatagatactgatttatgtgtcctatatggaagtacaaaaaagacttagccagtgtatagtatttataatttatgagagattttcaggaaaaaaaaaaaaaaagacaaatggattgccttgaatcttcatgggaaaggctagagctactgaagcaaattaagaaaaaaaaaaaattcaactggggacttccctggaggtctagtggttaaggttttgccttccaacgcagcagatgcaggttcaacgcctgggtggggagctaagaccccacataccctgtggccataaaaccaaaacataaaacagaagcaatactgtaacaaattcaatgaagactttaaaaatggtccacatcaaaaaaatcttttaaagactccaactactgtacatacagtaataacatgtgagtgataacaggccccttcatagt

SEQ ID NO: 48583 - DNA, 733 bp, Bovine  19866880855050
gggcaggacttaagggtccctgtgtgtggtttgaggacagactgaggcttgtgttttgatttgagaatcaaaactgaacctaagcttgtaaacattccatgttttatttttctacaggctagctttgctaaaatgcagatgaaacattttgttctttggagtttctaggaataagcatgcctatcagacaaccctcagattattttaactgtatctctgggtctatataataattttttgaaaaaaaaaaaaagataattattcaactaaatgccatgctcattgccaatgccaaggcctccctgggttggtttgtatgtttgtttgcataacctctagctcagttgattctttttccacaggcctcggcaaccagcaggcatgtttatttaaataaacaacgtaatgaataaatctgtgatgaatacctactacgcgccacacactgagctaagagctagagataaaaccagcaccaattttcctgccctaaggggtactggggacttcccaggtagcgctagtggtaaagatcccgcctgccaatgcaggagacgtaagagactcggattcaatgcctgggttgagaagatccccaggaggagggcatggcaacccattccagtattcttgcctggagaatcccatgcacagaggagcctggtggactacagtccataggctgcagagtcagacacaactgaagtgacatagcacacacgggcgcaagggg

SEQ ID NO: 48584 - DNA, 1027 bp, Bovine  19866880858513
gcctggagaatcctgtggacagaggagcccagcaggccttagttcacagggttgcaaagagatggacatgactgaagggacttagcactcatgcactgccccagaacgcttcccctactccgctcctttttttcatcatctccccaccccaacccatccttcaacaagataacacatgaaacttccagtcagggactcttgttaaatcatggagctgtgtctttacaagagggcttgaggcactgaatgtctgaaaggacagaggaccacgttggtcttctgaaaaatagcagcacagatatacttagccagctagccagaaagaaaggtgttttctgaagcacatggtgagtttctgcttttggtggagagaagaaggttgcaagagtttaccaagaagatgctgaattatctcagggaagctgcttaagataaacacttggctgcctccacttctggttgtttgggctcagggaccaggctgcctgcctctgctctcccgggactcttcccagaagcctggctgcatctttagatctgaagaaggcgctgctttgaagttgtccacctccagtaaaaagaagggatctagcatccctctcagcacagaccagtggagttcacccctttccctgataagaatgccaggaatttccatcatttcctgtagggaatggctaaaggagcccagcgtgaggctgtcctttcaacggcaccttttccaaacatctctaaatggaaagggtacaactgcaggcaaagtgctgaccctgggcagagataagtgatgatcgatgtgagatgaacacggtgtccctacggggttcctcttcaaagccgtttgcttccctgagtggcagagtcttctttatgtggctttgcaagtcctgatggagttgatatttatgattttataagaatctggagtcaaatggcatgtggagaagtggacacagcaaagagattcagaatagttcacctggcccctctccccctgcccctcacttccaggaaatcatcagggttc

SEQ ID NO: 48585 - DNA, 1748 bp, Bovine  19866880866223
aaatgcagggattcttattgaccaaatggccaacctgcttccatattaaggtattatacctgcacaccttcccaggtgactcagtggtaaagaatctgcctgcagtgtgggaaacctgggttcgatttgggttgggaagatcccctggagaagggaatggcaacccactccagtatccttgcctcgagaatcccatggacagaggagcctggcgggctgctgtccatagggtcacaaagagtcagacacgacttggtgactaaacaccttcacttttcaggctttttaagctagggcagatcaataactttctgtctttgcatctgcaccttcttcttgtaagtcctgccacaactcctgccagacagaatgctctcaaccacttctggtttggtgcccccagagtagaatgggtttttgttcaaataaactcttaacattcttcatatgcctcagtttacctctgaatagttcattcaagtcagagaggagcccagaccatgtcccccctgtgacgaggacaaaacctgttggcggtggtggtggatgggcacaaaaacagaatccgtagccagggcacttttcatcggtttcctcctaacttcccatcttgatgaaaaatgtgaaatttctctgcatgcttctgacagtcacctttccccctccagagtgatcagtaagggggtctgcagatgcttccagctgagacaggaggagaagacacccagcgagaggaaaggtgcggggaggcggtgtggacatacagctggagtcagacaagactgggactatttccttagccacactgatgaagggtttctaccaggtccttagtgaggagcaactggaacctgatatcaaaacccactgtatgtccttcctagtttattgtatataattaagtaccaccaactgtgcaggctttgcattccagggcatgggatcagtcattctcaacaatccttttgttgacttccttaagtcccagctaagaagcccttgagggcttccctgaactgggaggaactgatcaccatggtagaactctagtgcccaggaatgcccccctattccctcctccacctcacccccatcatctctgcccagtgtgcttcatggcacaggcacaggggagcatcagacaacagacacaccaggcgcatgccttgcctccaactgcagaagaggccagtgcgcagccatgtgactaggaatgcatatttctatcaccatactatgcaaagtcgctaggccttcctgttaaatccccctcttagctccccttctgagcctggaccttgtctagtgtgcgggccctgctctaccaaggacccaaggggtttgggagggtggtcttccaaatacctcaggcctaggctgctgtttcgaaccacttggctcatgtaaagctttgctagaattggaggtgtttcaaaggcaatgaagagcatatgagaacaaatgatctaatacagagagtgaattcctggagacttagtcactgagcaaggaagcaaaacagaccttgagtgatggtacaccttgaggaccttgaaaagacatcgtctgagggaccataatttatcctatcatttatccataatttatcctatttattctatcttgggaacactataagcaatatttgtcaaatatagattttacagattcttaatatttagggaacaaaaagttccctttaaacccctttatcaaatgtgtacattttcacatgcttgcacacaggt

SEQ ID NO: 48586 - DNA, 831 bp, Bovine  19866880933499
aaaataaagccttaccacatctctatattcataaagatgtattcaaatcagaaaaataatttacatgagttttatgaatttgaaatctttagcattcctcctgagcttatattaatattctgcacatttactaaatgtatagtttctttcattaatttttttcatgtatatgcatggggcttccccattgattcagcagtaaagaattcccctgcaatgcaggaggcacaagagacactggttcaaaccctgagttgggaagatccctggagaaggaagaggttaaccactccagtattcttggttggaaatcccatggacagaggagcctggtgggctatggttcatggggttgcaaagagttagatgtgactgaagcgactaagcacgcatatatgtataaaaagggcagccagttctgttttggttttaatgtaaaaagtatacatgcattatttgtttaaaatttataatgtatacgttgtctgctaaaaaaagaattgttaaggccaaaagccagataatgatgccactcagaacatacaatgtctgccaggatgtatactgtctcaaaagaatgccattactttctccttgtagttttataataagaaatcctttattatatgaactgtaaacaaatgccttcagttctgaggagaggattcctcgccccggggggcagttcatccatcacgtctcttacatctgcccctcgcgctggccgcttcctcctggccctcttcctattcatttcattctatgggcatggagtttattgtcaaccctcctaatgatacacttcagcagccctgactacttcattatcaa

SEQ ID NO: 48587 - DNA, 1496 bp, Bovine  19866881062578
gaataaacatgtgctttgagttttccaaatgagtcagacgcacgtcgcgagataaatgctgatcgcaagcagatgtgacgtgtatgtttcaagagggacgagcagagggggattgtgtcttggcatgttccacacttgagatgatggactgacacttcatggagtctggtcccctaacaagaaacacggggtggtgagtgatcccccccgcaagtccttctttctttccgtaagaggaatctacgttttaagacttcaatgtaaacgtgttctgtctgcaatttgtcggctgactctaatcgcctcggaacttatataaactctaggtgagtaatttccccaagtgcggtgcccccttgcaatgtgtgtgctgtgaactcagattaaacttttaacctcacatttttctgggaaggattattatccctgtttttattgtttaaaaaaagagggaatcagagactaaaatgtctcgtgctctttctgaggttgagttgatacacctcacccgagcctgtcctttgcgctgtgtatgcccggagactggggacacttagctccctaagctcgagatgagaggatctagggtgcccaagttgggactctccccctgccttcctgtgacactcccaactgaattgtgaactgtttgtaggaccctctgccatccccactcaactacagaaaccccaggtggctttctgctcatgtacaccacatcctgttgccaggtgacgtacaaaactcgttcgtcagcagagcgggtggtctgggtcttaggtttctgctgtgttcctccacgtttggctttcctgcacctcatctccttcttccagcaattgggtcaatggtaggctctccgagagtgtttgctgaaccatcccaaatgccaagcttgaaggtaccacctctctgcaaccttagtccctgtactctttatcactccctgggtctgtcagctgaatctgttagcccttcaatacaagggtttttttggactgcattggcatcaatgtggaaacaaatggactggcttattctcccaggagcttctggttatttgtactttggtttttgttgggtgactgccacgaggcagctagtatggtgtctcgggaggaatggtgggcagggagcccagtattggttctgctgccctggtctgtgtggccttggtcaagtcagtggtgtccgacggggcctcagcttgtccatttgtcagttggaggtcttggattcaattgtcttcctgttgaaacagtaataatccccttagttttactgtcaggtttcaaaggaaagcaaaccccaaagcaagaggcaaaaatgggaaagcttcaaggtggaaagtgcgtgcttgctgtatctctgagcaaggccctttttctatggcgtgagacagcattccgctgaggctgctgtgatgcgcttttcgtgttgtattttatcatcctgtggatattctggattcttgagcaaacaagaaacacactttg

SEQ ID NO: 48588 - DNA, 1923 bp, Bovine  19866881076263
cccagcccacctctccatcccagaaaaacctcaccctgggggcagctgtggccacatcaagcccaggaccaaagggtcactggaccttctccaggggccagaaaacaccagcattccaggcgctgggaaggccctgctaggggaccaggttcctgaggctgtggaggacttgtaggggacgtgtggaatcctctattatgctttgacattggagtgatatactgggaggaaggagaggtttgcaagtttcccagggtcctgaaaccttgggcactttctcatctgtgtattttgaaagaggactgaacagaatgcccagaaatggtcaaagaatggggggttgggtgagtattggaagtatccaaggagtccacgaaggcccacgccggaagggactttaaagacagacgtttcactttataagtagggacacaggcctatgtgtggagagggacttgtccaaagtaaaacaatggagagtggagggcagggagaagccaggccctagacccagcctctgcacacctcccatacacacaacacactgacacagaagctggccctgatacataatttaatgcgtgtgcaggtccgggtcccttatttctgctgctcacgggcccactgctctggggtcagggttttctgctcaaaagcgtgaatgtgcaggagctcttctgctaggcaaagtgttcacaagcctgggagagagatgaggttagaaatgggcaggctggggcctgggtcgcagtccctgaagctagggtctgccgggagactggaggggtcccccaggttgtagtccccgggacctgggaacaagagaggtagagggcttaagtctcaatatttgatgctggggccacgaaggcgggatccctggggtggtggtctgtggttgggccgcatggatgggactgagagttaaagtttcaggaagcggcccggtatgtggtcccagagctggggccgcgctgaagaaggtgttcccggaatctcaccggtgtctctgaagcagcggcttcccctcgaatttggccgacaccacgaggactcggaagctggacgcgcaacggttgggagtcgtgtcctccacttcctatggagcagaatggcgtggatggtgccaagtccgccccccaggagccctgttcccctcgttggacgagctcaggccgctcaactcaccacgtgctccgcttccaggtcccgctgcagcttctcccggaggtactcggcactgagttccattgtggcagcccagggagggtggcagcccaccggggatgggaccccagttctgaccccagccacactgcttccgcccttactggcgccacttccgctgaggcacctacttccgcccttactaagacgtccgtaaactcagcacttccgccctatcccaagcccagttttccgactgccttcggttgccgctcctgtcagagtcagcatgaggctccagcagactctaatcggtacccgccgcctgaacagcaacccgggttctgtgcgctggtttggacaccctagctccaactaggagagggtgcacgggtttgcactgctgtgacttctagggtacctcgggatagctcccaagcgctttttctgaaacaagcatcttgtggccctggcaggccagccctccccgggtcacaggccacaacaatcgacccccaaattggcgatgggccccggatgcttcttcggcgtctacctgctctactgtctgaaccctcggcaccggggccgcgtctacgtggggttcaccgtcaaccctgcgcgtcgagtgcagcagcacaacgggggccgcaaaaaaggcggggcctggcggaccagtgggcgcgggccgtggtaagagaaggcgggtcactgtctggaggaggacttcaaggagaaggcgggggccggcgaggg

SEQ ID NO: 48589 - DNA, 923 bp, Bovine  19866881129660
ccaacttccagaacctagaaaatgtgatttcttaatgacacacctacctctagaggagtcagattccttcataaagagtgtgaatattaaaaaccatgaaatttatggtgtagtacagctaattgaaaatgtaattagaaataaattaaaaccaacttcatgttttaatcactgtggaacacttaaagtattccagcaacagggcaagtaattttcttctggaaaatgtataatgatgtcattatttttttacttgggactccagagaaggaagaaatattaaaagagacagatatttgctgaacgcaacagataggtggtgctgtggttcaccaaagccttggaattagactccaaaggcctgggtttttacaaaggctatatcccaagtttaaaaatcacaattagaaagtcaaataagtgccttgaaaaggcatctgacttgcatagtagctgaatttttgccttgacaaataaacttctgtagtttctaagatgtccactaattttctatttggctaaggaatgttttgggttaacacttcaattttaagcatttgcaaggtctgtcacagacttctatcacttagagaaatcaaatactaatgcaacattggcttaaacataatgagtttattgctttatgacataattacaaacccaaggaaaactctgtgttggttacctatgacaaattgtccaaatgattctacttggtaaaggcagctttcttttttggctaaaaacacactctgcttggcttcagaaggcttgtgtctgatttcttggctccatcccttcctggctgctgcaccagctttgagttccttggctacttaatcgtctgagaatcacttttcttccagtccaggggttctatctggtgttctaggtctctccaagactcacagggaaccggcaaa

SEQ ID NO: 48590 - DNA, 1446 bp, Bovine  19866881167080
cactctggatttaacaccctccctggggaactctgctgatttctaggctgcagatgtttttaaaccctgccttgaagaatggctatgtcacatgctctggccaatggaggcaagcacagtatttaagcaaagcatatatggtcagcaagtggaccgagttctgtccatccgagttcctcacctctgaaataaaggtggggagttgttccaatctgtgaatccttcgatgaagtttgctgagctgtcgagaaatggacgcctgccaagtgcatgatttatttacttaatgtaaggtggtggttgttgtttagtcgctaagtcttgtccaactctttgtgacccccaggacttcagcatgccaggcttccctgtgcttcactatctcccagagtttgctcaaactcatgtcccttgagtcggtgatgtcattcaaccatctcatcctctgttgcccccttctcctcctgccttcaatctttcccagcatcagggtcttttccaatgagtcagttctttgcatcaggtggccagagtattggagcttcagcttcagcaccagtccttctaatggatattcaggactgattttctttaggattgactgatttgatctgcttactgtccaagggactctcaagaactctcagtccctccaatccccggccttctcagctgcttcctcgttttgctcctctcagcactccacaccaaggagaggagaagaaaagctttcttcactttgcatctggaaacatcactgccaacagaaacgggatccttgaccgttttgagcatatgattaaggggatggcatgtcttactggcaggatatgggtcatttctcaaaagttacagtaaatttatcttttaaaattcttccaagctacataaatacatcgtagactgcataaagatgtggtcagccagaggcactgcatcttctttggggcaaaaggaaccaggctagacctgccagaagagagttcagaccaggggagactgtggctgagataaatctcaagcccaagagttgggaaaagggaacaacattcagcttattggtgatcttctggggagggggtgtccatttgcagctattttattgttctaagttttcttaggacttccctggtggctcagtgataaagaatctgcctaccatgcaggagatgcaggtttgatccctgggttgggaagatcccctggagaaggaaatggcaacccactgcagtattcttacctgggaaatcccatggacagaggagcctggcaggctacagtcaatggggtctcagagagtcagccaagactgagcagctaagcaacaataaagttttcttatctgttaaatgagtcatttttaagaatgctctcaggggaggactacatcaggaccaaaaactccatcactgatttcctagctgtccttgaaacatccctctgagg

SEQ ID NO: 48591 - DNA, 769 bp, Bovine  19866881190033
tattttggttctgggtgttatatattgacttccctttatagcaaatgaggatttagttctcctacccttcacctccacctgactactatcacggatacctcctgatgcccctcatcatcccaatatagttgtatcacaatctggactagatcaatatttggggtttatattaataagatgtgtgtctgtgtgtgctgagtcacttacagtcatgtctgactctttgcaaccctttggactgcagcctgccaggctcctctgtccatgggattctccaggcaagaatactggagtgggttgccatgccctcctccaggggatcttcccaacccaaggatcaaacacgcatctcttacgtctcctacatctcctaaattggcaagtgaattctttaccactagcgccacctgagtttctgtaatatgccacagatgtgctagctgctgaggggacaacgtgataactgtcccgtttttagagggctttccatctgcgggaagtcaaaaccagaacaggaatgtaagacagatggagacaattgccgtcacactgatacagagcgggtgcagggcaaggagaggtaaattctaaccatggggatattgcacaacttggtccacagattgattggaacatattaatatgtatgactctcagttccccaagccaactaaactaaatttcacttgaactcatggcactctgaaatcagtgatgctcaaagaatgtcagcaagaatttctgttcagtgttctccatcacgaaacct

SEQ ID NO: 48592 - DNA, 985 bp, Bovine  19866881387941
ctatattttacaacattatatatctacataaggtaactttaagtatttaagacaccctataatcttattttcactataagtatataaacatcacaaaggctgtgtttttgtgcctctgctaacaattagcataatgtgcataaaaaagtgctaagacaccaaatatttgagtaaattagtacaggcttttcaaaatgatagtacagtaaaattttctagagagagatcatatatagaaaggagattatggtcaaaaaccagtagacattagaaccaacggaatatgctcttggcagccagcagtggtaactactaggaactcagttcagttcagttgctcagtcgtgtccaactctttgcgaccccacagactgcagcacgcaggcagctggactgactgaaaaagttatagatcctataatccatgtttttggttgcttcttactagcatttttacctctgttccttcttggatggttttctgtccccaccagccatgcacttttttatgtcattgaatatcttatcaggaagaagtgtgttttctactaacgggaattttaaatagtattaaagcagatcttgtacttctgaagaatttgacactgatcacaggtacagtagggatactgacaaaaaacgagccctgctgttgccatatgtgcacagaaagaaaccagttactgaagcaagctggtcaatactgttttaggtgcaaaatttccaatcaagtggacagctcctgaggctgcactgtatggtcgatttacaatcaagtctgatgtatggtcatttggaattctacagacagaactggtaacaaagggcagagtgccatatccaggtgagcttgcattcatgtacctggagtttatgggggagaggccttttttttcctctttgtttatctgttttctttcttccctccctccctccctctctctttttggcattgcatggtgagcagtctgtgagagccacagtc

SEQ ID NO: 48593 - DNA, 1601 bp, Bovine  19866881418249
atcatttgtaataacccagtgaaaactactttcttagttcttcccaacatttatagctgtgtttgctgctgctactgctgctgctgctaagttacttcagtcgtgtccaactctgtgcaaccccatagacggctgcccaccaggctcccccgtccctgggattctccaggcaagaatacatggagtgggttgccatttccttctccaatgcatgaaggtgaaaagagaaagtgaagtcgctcagtcatgtctggctcttagcgatcccatggacttcagcctaccaggctcctctgtccatgggattttccaggcaagagtactggagtggggtgccattgccttctccatagctgtgtttactcatctgcaaaaaggtgtttataaattttcgttgaattgggttctatttgtataaagactgggatatgtctgacccagccagacatgtatgacttctcttaaaattcaaatgttgggatttccttggtgatcccatgggtaagactccacacttccaatgcagggggcctgggttctatccctgctcagggaactagatctcacatgctgcagtgtgagacccagtgcagccaaaataagtaaatattttaaaaattcaaatgtcaatgtagttgtctccctatctcaactttaccctccatcccccagaatatgagcctattgagaagcaagactaataatagtccattgagaggttcttccttagcagtgaatggggctcagaaatattcagaaataaggagcccccttcctgtgtgtgcttccctcatggctcagatggtaaagaatctgcctgcaatacaggagacccaggttcgattcctgagttgggaggatcccctgaagacgggaatggctacccactccagtattcttgcctggagaattccatggacagaggagcctggcgggctacagtccatggggtcgcaaagagtcagacacaacacagtgactacgactactactattcctactttctgtgtgtgggatggactgtgtccttaagccgacccttgaagtcctaggctacagcctccacagttaaccccatggtgttcgagcagcctgattactgggcttcagccccagttcctggttttcactgctatcctctgctgggccgggagccaagactgaacccagtccagctggctgaaactctgaccctttctcctagtttctgccaactttgtttctggtttttctaccttgatccatatgtacttctttgggccaagactctggtcagcgggatgccaggaactcttatttcccagaatgccacaatcctccccttaccctcagaccaggcccctcccactgatgcttgacccaagctgaacctgaatcccctccaactgcacctgaatccacacgaagaccttgaacctgaactgttagcatctgcagtctgggtgagtttccctgccctgtgccagctacctcagcaaaatcctttctcacagtaaatgcccacatacccatcacttcagccagtcctgctgctctgacaaattagtccctgttaatgagaattaaacccagagtagtagttttcctgattacattaacag

SEQ ID NO: 48594 - DNA, 1027 bp, Bovine  19866881464415
ccactgcaaggagaggggtcgggaagagggtggcggggcgggaggcatccggtgagtagacgcggggtgagcaggcagacccgacccaacgagggaatcttcgggggagggcgcgagctctccgcgcccagcacgccaccctgcccggtcagggagcagtcgcagggagggcagcgatggtaaccctcgctactccctccccatcaaagatctcggggcgccaagtccttataggatggacctgggaagaggtcccgggccaaacgcaagcgatttaaccctaacccctctccaaacgctgccctctcaggtcggaccatcagtgcttttgcgctcaattgtcctaaccgttcccggacgcccccacccacgcagagagaaaagcaccaaagagccctgaatttcccgttggctgttgccgtggagtttacatcgattccgcaattcccagtcagaggggagcactgctctcctacgcgctaagttgaaaaacgtgataataatacaagtcgacaggctgcaggcaatacttttcatcacatgaattattcagtgcggaaaacgtattctggtgtcccatgggctctattaaaacattgccttctggtgacagaagctcccgcaaatcctgtgctttgggtttgtctggcacgagcaaaaactgtttgcttccttaggtgtccaaatttgaggatttgtttatttcgatttgaatttaacagtgaaagaaatgtggggaaagaaaaagtaaatcgtcccaagaaacttgaaggttttgatggtctggagaggggggaccacttattattattatttttttttattcaaaacggatcagacataccgattttcctgcccgctcccctcctcgcctcattcccgagctctctggccaaacttctggcacggtacctaaaccttagcctgtgggcagggggctggccctgtagaccctgcagcgcagacgcaccctcggccccacgtgcacgcaaggacgtagaagcagccccgccctcccagtgcgcac

SEQ ID NO: 48595 - DNA, 1200 bp, Bovine  19866880415729
tttggtgagcttggggcttttgtcctctggcgctatgcccaaagcaggtacatagctgagctggactctagtgtggaagatgtccgctccttcccctgtgagtttagacttgtgagcccctccacgtatttttatcttcagtgaggcaggctgttgaagtccctgtgggtatgtgcaatccgcacaatcagcttggggaccttagcagtgtgcctacctaggctatttaatttcacagccatatactcatgaatacctttatatgggttcctagcactttattccatgttacagtgtgatcaaagctacttgccacctgttctttttaaatctaatttgcaaatggaaacttagcgtctggctcacagtgggatatgaaagcacatctggctgcttttcctcctgggccctttatctccttcagtaaagctgctttctggctcaaggagagggaggctcctttcaaggtgccacagtgagtactgtttaccctgctgacagctcttaaattttttactccccctctgctcttgtcagcagcctcacagctactccttaattttcaacttgttgaacactgattttttttttttaaatcaagccttgggaactaaatgaggccattgggatgagaaatgagcatattctaggtggagattatatttagatgcatttggggtgtctctaaaaagctaaccactaagttgtgggaacacgctggagcctacttacttacttagactcccctgagccattgttcttaccaaaacagaacttgtcttaacctgaaatggcttgttgtggcgtgtgtagagcactaacttctgaaaacttaagaagctacaaagggaaaaggaaacagtggttactttttagaagatgtgacactgacttaaccatactgcccctgtgccgtacctgagaggtgggagaagcaggctttgatggggttggccttcttgattttgctggcaggaaacacacggtcctagaagatgaattgaattttgctgtagtcttctcagccagcaactgcaggcacctccagctgtcattttctccccagctgcagaccacttggatcctggtcttccgagggctgtctttgtgctttaaagccagacacagagtaagactgggcctcgcccgtttttgtcagccgggtgtgtgttgttgagcacgtcagcctggaggctccca

SEQ ID NO: 48596 - DNA, 2346 bp, Bovine  19866880516880
tttctgtttgctcacagcagagatgaaagcccccaagcgccggcagccgtttgtcccttttgctctgaggaatcatacaggctgcactctgtggtttgccaccctgaccaccacgcccaccaggtaaggaacacgggatctgtcacctggtgccatctctctcaccacaggctcctgtgtaccaacccagcagagcaagccgggccctctgtgaggctcttgggatccattgcatttgaatcaataacatgatgtcttgctgaggctaatgatggaggttctggttctacgtatagtctgtagtcggagaagtagattttgagtctgaaatatccaaactgtgatcttgatgcctgggcatccattgtttttaaagtaaaagttgagtagtttaaggatgtgaaagaaaagtcactccatcctttctcctcggtcttcattctacttccctctttaagaaaagctgtatgctattatgaaatcaaatggtttgcccatttttcttccaaaactgcttgaaaatacttctcatatccctcacctccaccccgaattatcttccaaacctgcagcacacttgagaccaggtggaactgggtggagttgggagaacaaatgagttcacctaagccaagtgagaaggctctctaacaactttctgcggatttagaccttggctcaactctccaaatgcagactgatcttcccaatttagcagtgaagtatatgaaatgaggcccagaatcagttgatttgagaacgtatttctcttgcctccaccaagtatggtagtgctctagaagaaacttttttttttttagtcagtttttttagtcacttaaaaaaaaagtcacttaaatattgggttggccaagaaattcattcaggttttctaatactacagttagaagtcacaactagcttacataactccttgggtaccagactctactgctggcagcaggtgcttctgcagtgattgctttctagctatttgtaaagtttcaaatgttgtgattgatcatgaagttaacttgagttactgacctttaaggtcctcttttgcagccaggttatatggccttattgctgcgaattgcctcctgagagggttcctgtttccagccctgagttctgggtgagagaggggtggagagaaagagggaccagctgatactgtctgcttgggttccagggctgcactgtctcacagcgggagtccaggggtggttccggaagggaacggaacgcttcttgatgatgctcacaacgttagcgagtggcgagaagtcctgacgggtgaagagattccctttgaatttgaagcaagaggaaagctaagacacaggtaaaatgtgtttttctttttgccttaaaaaaggggggggaatatatatatatataaataatcgtctctagtgttttgcctcttcactttcctttgttaatgactttactgttttatttttaaaaggcatttagaaaaccagtgtttcctttttaaaaaaatacaaagactatttgggaatacgtttctttccatcagttatccctatatttgacaggtgaggtggtaactggtatgttccatgtaactactttggttgaagcatagacagatcatagctctccagttcattgcatcctagctggttttcatgatggagtggtgacatggtcttatgaaaaacattatcaaagcacagtgagttttaagctacacatgtgccctttcagcaagcagatggtttcaggaagcaaagctgataagatgctttcattcttttttttcttaatatttatttatttggctgtgtcaaaccttagctgtggcacgagggatcctcactgtgtcatgtgggatcttccgatcttccattatggtgcacggactctctagttgcgaggctcaggctcttgagtgtgtgggctcagtagttgaggcttatgggtttagttgctccacagcatgagggatcttagttccaagaccgggggtcagacgcatgtcccctgcattggaaggattcttaaccagtggacccccaggaaagctgcataagatactctcattctaagaataactcacttaaggagaccacttactgatgcactcaaaaccaccagttgaaggccgggaataaatgcaaaagaacattgtgcctggtaactgagagggtgtaaaatgtgtaataaaatgttcttttacttgccaacatttttaagtagaagggctgtctggtggatactgaatagttaagattttagcgtttgagcctcatcatctaaaacttaagaggttggcttcagccttctgtggtcacgtgtgttcttggtgcgttgatt

SEQ ID NO: 48597 - DNA, 1564 bp, Bovine  19866880618017
acctgtacgtaatgtcccagcagttttatttgtctagcccaaacagaagcgatcccacatgtccatcaacaggggatgagacacacagactctcgtttccgaacaatggggttctgttcagctttaagtaggaatgaaactggttcacacagcaacatggatgaatctcaaaatattgatgccgagtgacagaatgattccacttacataaggctgtagaaaatgcaaactaatctacagtgacagaaagcagatcagtggtttcctggagacgaagggcagtgcagagggtaggaaggggggaccccagaggcacatgaggagtctggggggctggacggttcatcagctccactgtggtgatggcttcacgggtacacatgtatgttcaacacttgtcaagttgtgctttacatccgtatagtttaatatgtcagctttacctccgtaaggctgtttttaacattctgagtaatgacatcagtaaaatggcagaatggggacatccaaaaagcctcttatccataaaagcaatgagaactttggcaaaaatgatcggaatcaactgtttcagacctctggaaatcaaccaaagacttgcaatgaggaatgtttattcaagaaaaacagctgaatctcagtaagaacagcgagctctgtggcattttaacttgccctcctcccgtctgcctcccccacctccacagtagccttgaaaacctggcagctggtggagggggcagaaaggaggtgctgcccccaaccatcaattcccagaagatcatcacggtctgacatgtccctgaagaccacgcttgcaaggccatcttcatctgacttgagctggagctcacccaatgggaacagccatatccccaagggcatttgtttcttaatcaaaagcaagtggttaggattctgggcttttactgctatgacctgggttcaatccctggttggggaattgagatcccacaagacgtgcggcactgccaaaaaagaaaaaaaaaaaaaaaagaaaacaaaccagaggcagtcatttaacgttgtagctgcctaagccagcccataaatagctgggggaagaaaaagacaaacaaacaagcttaataggagacactggggagtcagatgtccacagggagatttggaaagctcccatgtattcctgggagcctggaaggccatgaacatgcccagcgctgtgcattgtttgatgaagccctgcattctcacttctggccaaccttcaggtaggaagtgaaggctaaggcagagttggcaactgctggctgagtgttgaaggtgccccagcacacacacacagagccccccagcaatgactgagacatattggtcagcagtttaaggagctctctgtccagccatcagctgacctctaaggtagctgaggagacgtttcagtagctacacaggacaaagaacacagactttacagattgactcagaaaatcagaaacaagaaccaccaaaatacaaatctgacagcaacaaaccttggggagggaagacaaactgacttccaggcttgccccattgcatt

SEQ ID NO: 48598 - DNA, 1528 bp, Bovine  19866880721497
actctacgaacagctgaagcagaaatggctcccaccaccagaggccaccctcagagagagcatttacacttcctcctaccccagaccaccagcaggtgccatgtcccggagggagcatgcgattccggtgcctccccctcgcctgcagcgtgtcccacacttctgagatctgtcaccccatcacagcacaggtggggccacctggagacccacctggagaccacctgccagacagcaggcagctgcagatacacccagagttttaaatcaagctcacctgaggggcctttgaaatcatggtctgtgttttatggttccagtccttcctctaaacctacaggttcctttctttttcatcccacaaataaatcctttgccacaaggtatcacatgtgtgcagaagagacacttgtatgtcaggagaaatggaaggacccttaagttccctcatttcacacaagggaaaactgaggcccagagaagtaacatgataccgaattctcacaacttgctacttactctccaggagtaaattttgttgaatgaatgactgatgggagaatagggaatagaggaagattgtggtgaagacgcaagggacagctgagctggagccaggtggcctcctaacgcctcctgcaccttcccattcatcccacaaacctcccctggaccatggtcaagccagcctctggcctcagagccatcaatccagcaggaaagggatgttacacaaatactgatgtgaaagggtgatgtcaggggggtaggctcacagaggtggggaatcagtgggccagtggggtcctaagagagctccctgaggtgtgttgaagtaaaggggtgcatgacagcagtcctgggggccatgaggacatgacctggtcagggagggcttccctgcagaggagacatttaggctgagactagaatgctgagagggaccaaccaggtgcagggacaggtagaaagggcagcaatggtggctcaggctgcaggatggcttgtgtgaggctccaagttgggaaggagccttgcaggttaggtaaaggcccagaaagttcttattgctgctgaaacaaatactgttaactcagtgtcttagagcaacacagatttagtcccttcagtttagttcagttcaggtgctcagtcatgtccaactctttgcaaccgcatggactgcagcataccaggcttccctgtccatcaccaactcccagagctttctcaaactcatgtccattgagttggtgatgtcatccaaccatctcatcctctattgtccccttctcctcctgccttcaatctttcccagcatcaaagagtcagttctttgcatcaggtggccaaagtaatggagtttcagcttcagcatcagtccttccagtgaataatcaggactgatttcctttaggattgactggtttgatctccttactatccaagggactctcaagagtccactccaacaccacacttcaaaagcatccattcttcggtgctcagctttctttgtggcccaatt

SEQ ID NO: 48599 - DNA, 1735 bp, Bovine  19866880728958
cttcactttctttttctttcttagaaaatgccagaaaagaggaaggagcaggggagactaaagcgatgctttcttcttcctcctctactcttgctgagcatgcagcataatatggtcctggaatgagcgtcctccgtctctgttctctccccataaatatgttttactttatttttattagaacatctcaaacatacacaaagtaaacagaataatataatgaacccctatgtacctttcacatagcgtcagtgattaatgtatttattttcacttctgatagtaacaactgtattacatgaaattagggaaggggtgggaaaaacccaccttaatcccacctatctcacctacataatctctcttgacattttgaggtatttcttccccctatagttttggcgtaatattttgattgggctgttttttcacaaccagtattgtaactgttttcctacctttctaggtagtcttttaaacttatttttaaatggctgcaaaatactctgctgagtagatggggaatatcttgaaaacattgattctcttaattttttttttaaaatttagcattaaatgatgttttggttaatttttctatgttttgattacttccttggactagttcccatcaagagtaggattattggatcaaagggtgtgagatttttaagtctcttgttatgtattgccaaactgcctttcccacgggtgaagcactgtgctgctggcagtgggtgagggcaccagtctcactcttaacagtgttcattccagtggttgttatgggtcttttataggagaggactgatggcttccaagatggcccccttttctcctggtggtgagactcttcctaaatcagacattaattcacgccatattgcatttcaccctctaggtgttttcgtgccgactggggaatgagcacgacacagctctttcaatcgtcgatccagtacaaattcatgtggagctggtgggaaattcttcttaccagaatagttcaggattgatggatgcattcaatagcgaagattttcctcccatcttagaggtaatgatgacaagtctggataacacaccgaggctctcccaaacacttccctttacttgaactacttatttactctgccagcctcaacaacagttccattacttcagcaaatacaaaatatatatgacattgtctctgccctagaagatctttgtcttgaggatgaaagaccttttgattgtttggtatgatcttgaagttctatgatagtttatagaaagcagagttcaacatagttaaggatattgactgtgagtgaaacaaaagaagagtctgatcagggggtaggatgtaaataggctaagaaggagagcagttctgaattaggaagcagcaaagtcagggggtagaagtggcccagcagagctgagactgagggaggtctcactgcaagaagtctggggacgtgaggaggagggagaggagaagcagagcaggtgaagccaggccaggaccagttaagacttggatgttttatttctttggtagagagggagtaattaattcataatccatttgaactgtagcaggtttgaaagagaaaagccattctgattttggggcttcaaaaaaaaaaaaaaaaaggtagaagcaagtaataaataaagcactatacccagacttcaagcagatatcccattttaaagtggtcttgtgtcggtgtctgtacagcttttt

SEQ ID NO: 48600 - DNA, 2436 bp, Bovine  19866880811765
aagaaacatgagctagttctatttcaacctcctcaaggtcaatcggcctgctgctttgaagcaagtgtgagaaagccaggggaatgaggcagtaacgtggctcagagccgtgatggagcagacaagagagtcaggtttattcttaagacagaaactgacaggttggaggcagcatgtgtgaccagtgatctggggtcatgccccaagttggtgacccaggaatctggaaggatgaggatgccatccactgccatgtggaggcctttgacatggatgagctgtgcaggcagtgggtggagcaaagcccagggcacaggtgtgcagggtcagcaaaactgactagtcatgcccaagccactgctgagagcccttccaaaaaaaagaaagaaaaaaaaagaaagaaaaggtcacaaccaaattctcagaaagcaaactagggtggaccagtctgagtcattactttttaagtgaaaaatgaatggtttagagttatggtgaaatctgtagagaaatcactctagatttcctggttcttaaagatcagttacgccttttgttcttctgagagcatcagattccttccaagagtcaggaggaacccacaggcaggttacagtgggaacttccccctaagtaaagttaaggtcatttcaaattacagcctgtagactttctcatgtcagagagagtttgcataagaataaactgaagagacacacaaaaacaaagggtttccaactaggttttattttagtgtccaatattatcagcactgatacaggagtaattcaggcaaatttatcaccttaaatacatcagagaaaaaactcactgtgtcaagcacatctcgcactccagcaaatgaacataaagacagaacaaagttagcagcattaaattaaagtgctttttgccacaattctttcagagtctcaccctcagtggtataaactcaattttatttgttgtgtaagaagctcaaaatcccaggggatacattaaaaaaaaaaattcatgtttagttattttaaataatttccccccacaaagcacaaaattcattggaattgtgcaacgctgatttctctggacatactgtgaggtgaccaccatccgggtctggcaaaaagcttggccatcctctgctgcacaacaaccttggctaagtccatcactttgttccacacaccagagtagactgagggtttgaaggaccagtgggcacctggagagcatgccaattgcatgatacccaccagcgagcagaggccactgagctgtttccctgaagtcagaggcggactcagaagggcaggacaggccccacctctctgcctgagcttgcctctttctgggagagcagtactgctggcttctaggaagctctctgacctgcccggcaaaggctgtcacctgaaggctgcctgccccagacagttaacaccatggagacaggaacctgcccccactgtgaccggtaacaatccccacactcaacataggaaacacttttcaagatcaactcgaggccccatgtgccacctggaggctctggggtcaggaagggtgggaggctgggcgctgggttccctgtgctgtctgctggccgtgtgcagcatggctggcacaagagacttcatccagaggtctggtggccaagggcggcttgagccaaggaggggtgaggggtgggaacacatttcttgtggaaccttaagctggtagggtgggctctcggaccccatgagcccctcccagagtgaggtcaaacagaaggccctgttttgtgcccactactgatccttcagccgtcctgggtggggtccactcccctcagcctgccgccaaggtccccatcttccgccatctttccttctactacatcctttaacgatctggaccaaaccatctttcaccaataagaagccagactacgaggctaacaaccgaaagcagaacaagggacacgagaagggaggcaagtctctctccatcatggcactggccgcccaagacagcacagacaggacacagcttccgcacaccacctccctcccggccacgcgctccagctgcctctgcgctatcttcctgcccctcatggcagaaagcctgcctccgcctaaaacccaagccacactcagcccactgccaatgcggaaaggctggtctggaaggctctgcaaacagactgaagcatgaaagccaaagaaccacactgacacaaaagccacaagcctcctgggactctctgaatcattcctggtgcaaactgggaagaaaatgcagcctccccacaaaggcggcctttctctgcaggggagctggggtgcatggtgggcaagtgtgtgggagctggggtgcatggggggcaagtgtgccggggggtttggcgttaagcgtttgccaggggcagggggcggtacctgcctgata

SEQ ID NO: 48601 - DNA, 1311 bp, Bovine  19866880835225
cggctcagtcacgtgagcatctgagtctatgttgtgggtttgtacgtacaacgtagtgtttgtatccatgtatgtgtatgtgtgtgtgaggcgtattcatgcagacatatgtgtgtgtgcgtaattacaagtataaacacaccgtacatgtccacaaatgtgactccatgaagcagcgctctgcgtgtgcatagataacatttgaatgtatgaagatgccagcacgtgtgcacatgtgtgtcatgcttgagtagaaagcagtgctcagtgtcgtgtgtgagcacatgtatgtgtgcacgctgcatgtacatgtgggcgggcctgtgaatgtggccaccggggctgtgcaggggttggtgggcctgttggttggggtccggggggtctaggttccccagctgaggagggacttctgctcctctctggtctcacaggtgtgtactgttaccgtgtcaaccggcgcttatttctggtgcctgcggatcctggcaccccttgccgcctgtgcaggaagccacgggaccagcggggtgcggggaccctggcagagccagcgcaggtcaggtgagtggcctgagtgggcaggacacccaggggagtcgcaggggcagcagcagaggggagcagcctgggacccgtggtcttgagggggcaggtcaggctattgaagcctggagagacctgcaggagtgcccccactgtcgccaccccccagggtgagcatcccactgtccgtcctggatcccccacaccggcaccgcatccaccggcggaagagcttcgacgcctccgacacgctggcgctgccccgggtgaggatgggggtagggctgccccctgtctggcccagtcctcagatgtgtcctgaggcccagagagggccagggactgtcccagagccacacagcgacactgggctcaaggaccccagtctctggagttgagactgggccactcacgtcacctgtgctgcacctgttccctgatggaggccaggctccccacccacccgctgtctgcccatgagctggcataatgcagaagggtctgatttctcatgcttttgtgtgctgtgtgcacagtcctcagggggtttatcttgtggggtcaagcaacagagagtgcagtggtggtggtatagtcactaagtcgtgtccgacacttgtgaccccatggactgtagcccgccgggctcctctgtccatgggattctccaggcaagaatactggagtgggttgccatttccttctccagagagtgcaggtcctgctgttattcaagtttacagatgaggagactgaggcagaggg

SEQ ID NO: 48602 - DNA, 2502 bp, Bovine  19866880857545
tctttttacttcagtgaaatgcagtccaaagagttttagcatccacattcactgataaattaaaaaacttctacaaatggttttaatgggacatgatgccacaataataagttattatacaagacacagtcactggggaaaggaattcatattagctgagcaactattattttgccaggcagagagttaagagttttacattaattatctcatttattaaagaaccatgccactgtggtaggtaacaatacaaataaatcaatctaacttctcagaggagtatgatatactccctctggaaatgaaagaaaaacttcttagacatctttagggaccatttttctcaactctggttgaacattaaaatcactttggataattaaaaaaaaaaaaaagaacacaacactaccacagaccagaatacttgggggcagagatgaatatccatacattctgacagctctccaaaaggctgaaaaaccaccttttaaaatttctgttttctgagaaaactattctttaataactacataggcctaaaaatgccttctaaattctaaaactgaatacagattgtatttatactggaagaagtgcctaatgcaatttaaaacccattatcttcaacaactttctcaggctgaaatcatcccagatcattcagagctaaatggaaattgatctaacacagtctcctcactatttcaatagaaaaacggatacaaggagattaagtgacttgttcaagtcacacaacacattgctgtgaaaccagactataatgataaccacaattatttcaaccataccccctttatttcttaaagcctgagtagcccacttcaatgcagatccatttgaatataaatcaagattcctcacaactagatcaaattgattctacataagaggctatgtttttttaaaacttttcctcattgcttagccgacaagaatttgaaacaggaaaccatcatgatggaaaagcttgatgtttttacttgaaagtctggaagatgagggcttcttctccacttgtagtgaaccgttctcggtagaactctccatgcgaggtaaggtcacttagagataggctcccaatgcttccctgtaaggccaggtctccctctaggaagattaaaaatcagaatgcattcttatggtcttttttctgtcacacaccctaactctgcctgaaacaaaaattgatatacacatgcctcagactttacatcatttaataaaacgaaatgtcaaaagtgaatattcatattttaacacacccagaacgatattttatgcactatttccaacagcctcaatgcagaagtccaaagggattgaaataataccacagtatcacactttaacacttataagggggaagaaattaagggtaaacataaattaaaggataaaatatttacaaatatagatagaaacatgctctattctgagatcagaccactaattagaattagcaaaacagcataaggtctattttatactatagataaaagaataaaggaaaaaatctcagagatgtattaatcaggcagtattaaatgggttttagtgatatttaattaaaaggcgacattaataaaataagacactgaagacacagatttgaaactactccaatattacacaagtgaagctcctggaaggtgggcataagaaagaggaaatgttaaaacatgcacccctgggctatgaacctatatgaatcattcttaacatggggtagatactgaaaaggaatattctgaactgttgcttatgtaaaacaaattttgtcatcataattaacaacaaaacaatgactgaggtgtatgtatttggcaggctagttctgctcccaatgaagacacatacttatttttggttctgaatgtcctctaacaaaaatacccacccgccccccaaaaaaagtgaagtcactcagaaaagtgaagttgtgtccaactctttgcgactccatggactgtagcctaccaggcttctccatccatgggattttccaggcaagagtagcagagtgggttgccatttccttctccaggggatcttcccatcccagggatcaaacctaggtctcctacattgcaggcagacgctttaccctctgagccaccagggaaacttatcctacccaagcttctcccaattcaaaggactcatctcttctaggaaccttttataaattaatttataccaggaatgaaaccaattttagttcatcatttccccaaaagacattcttattttactacagagtcaacatttgagctttgtagtcttcttattttatcaccagttgcttaaggaaggagcagtattttatgctcactttgtaaattcctccactttagagcttaatgtagctcttcacttgtgttctactaaggattacagcctattgcatcccattaggaagaatgccagctttgctacaatatctccctgcttaaaccacccactctcagtaaaggaaagtcg

SEQ ID NO: 48603 - DNA, 796 bp, Bovine  19866880929376
acagggcacatgctgtgtgttttgcatagagtgcttctcagcaaccaaaggaccaagggaggtcctctaatcctcacttgtacaggtaaggaagcactggaacagagagctcagacttgcccaggtcactaacaaggagccagtagggacagcgcaaggatctgaagccaggcagtcggctccagagcccacatttacatccaccataaaatactgcatcccattattactggcccaagattatactcagcccacagaaaaccacagagggctttcaaaacacactccagctcactaaggcatccatgggagtaggggaggaaatggaaagataaacattatcaaacattattgtttatcaagataatagataaaggaaaaagccttattcaaattaccttgacacaccaagagagctttgcggcagtcatccgtgctaaaccccagctcctgcagtctagccagctgtaattctacggggggaaatggtatatatatttttataagtaatttaatgtaaattaacccacagactaactgaagcaaaaaaagaaatcagaaactggtgactcagtcatttctcttctataggcaaaaataagctcctaattggaagttatcaagtataccctgaagtttttaagtcttttccctatattggctgtgttttaaaagcctaaaactgaaactcagtattatccatatacttttggaagaaaacaaagtttaaaactaaatcttagcattatccgtatctctagaagaaatggtaaaaggaaaaatactgtaggttaga

SEQ ID NO: 48604 - DNA, 2864 bp, Bovine  19866880940081
tacaagaatgtgagtcattaagtggcaggtgctctgggcagaggctccccatatttcctgttggctatggatggagtcaccgagagacagggattcagcccatgctggtctgagtcagggcccctcagccacttgagccccaggcttcactccacctgcctaccactgtcacctgctgggcctgggctggccagcctctgtctgcctcaccctgggctccctggagggaacactggcggaaggtgccgcttccttttccctctcttctggctgcaggagctgcaccgccacatagaggaaggactgggccgaaacatgtcagaccgctgctccacggccatcaccagctccctgcagaccatgcagcaggagatgattggtcagtgccacagggctcaggaccggggctctgggctgcccgagatcagtttcaggccagcctgcagaactaatgacctttccttatctcccctcttttatgatgagtcagctccataccttgaggttctggacatgtgttgtgagttcattccacgcatagactaggggtgagcaggggaggggggcgtcttgtgttaccacatgggactagcagaggctgagagcttggcctgctccttaaatccacatagtaacgggtatggagcctcagtctgcgtaccccacccataggccggctcatcccggcctggtttctcggtcgcactgccggcatccttgccagcagcaggtgtggtgaggctcagcactggcgaggcacagggctgagctgctctgctttctccccactttctttgttcccaacagacggcttgaaacccctccttcctgtgtctgtgcggagtcagatggacatgctggtccctcggcagtgtttctccctcagctacgacctcaactgtgacaagctatgtgccgactttcaggaggacattgaatttcacttttcccttgggtggaccatgctggtgaaccggttcctgggccccaagaacagccgccgggccttgatgggctacagtgaccaggcaagcggagtccctcccccttgggcattgagggcggctactctgtgccctgggcacccaagccattctaaatggggctcccggaggtcatgtctgtggcatgtgggccaccaacacggtcaggtttctgccacagatcaacctacttttattgtaggcactaatatttgtgaaattacaaaagcaagctgtattttttttattaagcttataggtatgtaattattaaatctagatgacctgtctgtccagataccaccgttttcacgtttagatgttaacccccatctctgtacctctagaggtgtcacctgggctgctcttgggccacgtcccaggcttggggacctaagctgaggccttccagggtggccacagctcatgatctgtggtatccatggtgtttacctttgggctggcaggtctgtcaggaagccgaaatccttgtctgctacacgtggagctcattttctattttagaagttgaagtaatggcccatgtccctgttctggactcttggccctgagggttcctgagggtttcacggaatgagggatttgctgccttcttcttcttagcaccaccctgtttctctccacaggtgcagcggcccatgcccctgaccccagccaaccccagcatgcccccactgccccagggctccctcacccaagaggagctcatggtttccatggtaactggcctcgcctctctgacgtccaggacctccatgggcattctcgttgttggaggagtggtcagtgacaagcccagcacaggaagggtgggggcaggtgggtgggaccgaggggcaatctggcggtggtccctgcgtcagccctgcactttacatccattatgactttttgctgtgatctcaggaaccatgcaaccttagccctgaaatgtacatttctgggcggaagtctcattcaacataaggtgacattgaggttcccattttacagaagaaaatctgcagttggcttgccaaggatacacagcttggatttgagctctggccccatctgactccaaggccatgttctttcccctgtaggcctagtcctgtgggtagggaagtaacctgagaaattgacaaacccgggttctagagaggtgggcatgaccaggagtttctcatttatacgtgaggaaacagagcagaacttgcaagggcttgagccagaaagaggccaggctgggctgtgaaccctcatcttgccagctgtggttttatggcccttctcttctgccccgaggcctgaggtcacaggctgccttcttgataactggggtattctccatgtcttgacccaagacacactgcagccagagtgccttgtgccttgaattttcctgatgatgtgggcacatgctctctgcgacgttcatttgagttgtagaatggtggcagaatgtagctgacaaagctgctgggagttggcttctcagcttggaaggccagggtaggctggagctgaggccccgccctcccggcctgtagacagtacctactttggttctttttttggtagatggtaacctggtagaaggtcattagcttagaagctgacacttgacagttatgtaacccttttacaattggtgtctcattttacccaaaccaccctgggaattgggtggaagccatcattcctatttcaagaggaaacgggtgtaaatagacttgccgtgggtcacacagccaggatggcaggcagcactggagcctctgtttctggctccacgtccccagctctttgactctgactgtgctgccttgcgccaaagtgttacaaagcagctcaaaaggagctatctgctgagcacca

SEQ ID NO: 48605 - DNA, 862 bp, Bovine  19866880993563
tattgtatggctgagagatttgcctttgttgtattgacctagattaaaccaccagtaattagtatcttgacatttactcttaagccaaaagataacatgttccagttgccaagtcgttgctgacactttgcagccccatggtttgtagcctgccaggctcctctgtccgtgcgattttccaggcaagaagactggagtgggttgccatttccttctccagggtcttcccaacccagggatcgaactgtgtctcctgcattggcaggcagattctttacctctgagccaccagggaagcccaaaagataaaatatattcctgcaaaattggcagagttttcagcaggtactgaattatatgtaatgtctctgcagagaattacacatagaggaaagaatcatgaccctgtggcccttttgtttatgggatctggggtacttgggaaataccatgtggcatagagtctttgaagagtccaggactgggaaggaacttccaggatagtagatagagttaccacccccattcctgctgctagttttcttttctttcctcccaggagtctgtgccttcatcttccccaactggtactcccaagcgcagtgtgaggaaaatgacaagcatggaggacctgaaggggacccactccgaggggctgatcatgatgcctcctgctggaatgagtcgaggcagcttgaagagtggagtctgtgcccagcacctcgaccaagcagcaagggcagccagccacaacctctgtcggccgagcttccagcagtccaggtaaaggaggagagaggagctgcatgaggaaggaggggaaattcacgagaccgttgcaggatcctaaggggcgctgcat

SEQ ID NO: 48606 - DNA, 2812 bp, Bovine  19866881076870
ttggcctgttgttgttcagtcactaagtcttatctgactcctttgcaaccccatggactgtagccttccaggctcctctgtccatgagattttctaggctggaaagaatactggagtggttaccatttccttctccaggggatcttcccaacctagggattgaacccacttctcctgcattgcaggcagattctttacctctgagtccttgcaaatgccccttctggtgttgaggtgtagtttatactggatggagttaaagtgcgagcacagtctcatttaatccttacgacagccctgtagaatctgattatacccattttgcataggaagaaattgaagttcagataactcagtactgtttttattgagtgttccatgtattaggctctgtgctaagtgctttacatgttttatctaatccttgctgtatcctcgtagatggctattctcattcccatttgaagatgaggagacagagaggctcacagaggtgaagttactcatccatggtctcacagctattgaatgtcacagaattcaaactcaggtgtgaatgtcctgtctttatgccatatacctgcctccttggagttttcctttgtccgagtatctgccaccaagacttcatttccatttgaagcatcatcaatgaaaaagtttcaacgtgaattcaattttcaatgtgtctggcttttctttttaaaatgtggaggcagagctggggcgggcagtgaaagatttcctacaccagtcactcctacgttatgttgtagctctcatgggcatctctgctctgtttgaatggtcattttcaaagtcaaggacatggatgaaacagtacttcccagcctcagaaaagaccagttccagagggcacccataaagagtgcccactgcaattacctccctctccagcccatgtgtcctcaccctgtcttttagggagaaatgagatatagggtgtgatttactttcccaccgaggtggggaatgagagatggaattaagggtgactcagtgctcccacagtgggagaaggccgcaagctttgtggtgccgtggattcgactctcagaagaccagtggactggcccaaagcccagcctttgatctttcatctggctggcttcagtttagttcctataaatgtttctccctgcaaaatcttattaagctctcatcagtatgggtttggtcagatcatggattcctacaatggcacaagttttctgagttctcaacatcatatttctaggggtgaagactttggtagtcatttcctgttaataaaatctctttgtatcctttctgtccattcacaagtgacaaaggacaagcccagctggcctgcacagtggttttttaatagagagatggacattcagatggaagccctggagtgtgcagagtataggcacctttccacggcagtggtaaggctcctgagaagcacagggaagaatccaacatttagagggaggaaagggatctcttaggtcatcttgtcccacccttctggggtcaatgtggtgtttctgtacagagaacaccccaggccagttggtgctagggttgccaaggctgctgcaacagaatcaattggcagttaagctttgacatagcctccctcataaatcttggctattatacttgttttattggaggatgggggacagttaagggaaaggggttggtattgggctatttgcctagattattaccccacattctcttaggggggaaagtattatggggtttttaacttctaagtcagctgccagaaatatgtagacaggaccttaacttactatctcttccaggaagatctctctttttaggaaagtcagagttgaaccattctttccttcttctgtgacatcagggagagacatttttgtccagaccctgagtgaagaccactggcaacctctgtaattccagaagatagcaagaatgcgctccaaaacaagggtcacatttctctctcctctctcaattcccaagtgcaaagagtttttgttccaggttcttgttgctggccgtgtcacgtgtggaattgttgtcttcctaatgagactgtcacttttgagagtaggtccaaggccgctattcgcttgcctccttagcaggacctaaatctgtgctgggcccagagtaagtgcttaataaagacatcctaacttggatcatagatcacagactgtcagagctggaaaggattttggaaaccaccaagtccaacactctaattttatagatggtaccactccaaaaattcactttggaggctggtgtttatctgctgggaagagagtttcggttttttcctttcaatgttaaattctcgcgcaagtgaccatcattctaaatgtttgaaaggctttctttagacagtgtgggatgttcctccttggactagtagctgactaataataacctgataacagtaagagtgctgaccagattccataccctgagcaactgtcactgatcctgtcagccacaggacagcatcaggactatctccctcctacagatcctgggagggaggcacagcggtcaggcccctggctcagggtcacgtggctaccagaatggttgagactagaatctggtttggccagacccccgagcttatggctcacagtggttctaagtggggtcgctggagaaaatccccacttaataagaaatcccacagtgtctctgtcctaaaggaaagtgtaaaattacttttcattaacttcagctctctaattagacagggagtgacagggaaggtgaggcagaaatcagtcatgacagaggt

SEQ ID NO: 48607 - DNA, 3762 bp, Bovine  19866881140037
ctaagatatgagggaaatgctaagaaacatacctggttacatgttacacagagctggtgagagggaggtaagacccaagcccagccagtctggcccccagacatcccgaatccttgctctgttgtatctaaagctttctccccccaaccaaattgtgctctgagcccacctcttctaagaagccgtctccacgcaccaggcactttctctctagggttctctggcactggcataccctgactggccactctgtgagctgcttactcccgtcagccctggccctggccctcccctggcccaagatgccccctgctcacctcataatccactccaacccggttcagggcgatgttgatggtgaaggtggaggcgtcgtggtgtggcaccagtgagggctgctcatcgggcttgtagcggacgacaaaggccaggtcgaattgggcctgcgccaaggacgtgggacaagagaactggagttagagagaggcccccaaatgctgggagaggcaggggtgcacagaagggacccctcatccaatcgctgcaaagtcgaccaagacagcagatctgcttatgctgtgttctccagcgtctggcacagacaagtttctcaattaaaacatggggtggaagggaaggaaaagtaaagaaagggaggacgtggagggaggaaaggaagagcaggagaagaagatgaagagaagagaggaaataaacgtaaccctcacgactttctggctggtgattccttgggggcaaggccctggcacactcaaagcaggtgtttggagaaaaccagggtaaacaaggaggaggtgactgagtgaaggagggcaaaagtcaaaagaggcagccagacacacgagggagggagctaaaggaatgagcatgccagccagctaacacgggcttatatgagcctctagagcaagatttaagtacacagaggaggatgcaaagaagtgagtcctggctggaggcagagtggcctccccttaccaactagatgactcccgaggccccgcccacagtatccgcctcctgaggccccaccttccgggggcctagcctcacccctgaagggaggagacgccactcctagagactaaatattcagtaaactctcccccaagcctggaacgccttcctcccctcccccaaccactccaccccacaccctcatcccggttgcaccccagtcgcgcccaccctggtgtagtagcccgggtagagtttctccgtcatgggggcgatgtactccaccaggaacttgtgccactcccgctcaaagttgatctggttcatgtggatgtcgatggttggcacgttttcgtagccaccctggatgcggttgtcctagacgtgaccaaggagaatttggtaagcagaattctaagatctaaccccctaacacacaccatgaaattccagctccctggtgtagtgcgtgttgtttcagtcgtgtctgactctgtgcgaccccatggactgtagcctaccaggctcctctgtccatgggattttccaggcaagaatactgaagtgggctgcatgccctcctccaagggatcttcccgacccagggatagaacccttgacgtctcctgtgtcttcagcatggcaggtggattctttacccctgagccacccaggaagcccccctggtgtacatgctctgtctaaattccctccctttgacctgtgaacctgatggggtaaggttaggttacaggacaaaagtgaagggattcaggagatgtaattaatgtaatgtctactgcctttgggttcatccagagggagatcatctcaggtgggccttcaaggagggtttggaagacagagattttgtgtcctgctggcccagaaaaagcaagctgcttgaaatgatgcagctgcaaggatgtgagttctgtcacatgagcttggaaaaggaccccaagcttcagatgggagcccagtcccggatgacaccagggctgcagccttgtgagacactgagccggactcccaacccacagagactgggagataataaacgggtattgttttaagctgataagctttgtggtgatttgttacacagcacagaaaaccagcgcagaggccacaggttagttggggtactagagccccagtgctggctgggtcactggagcacaagagttcaccagaccccacatgtgggctatttgagttactgggttctggagatgagctctggcaccaagtatgtcagttgggcagacccatgaaccatgcttagtccagctgctagcccagatgttagctggtcccagcggcatataggcccaggggttcatgtgcctttaaaaatggctcctgaactttctaagaggcttgcaggtatgaattcctcgtacagggaaggcacagcctgtcacatgccccatgccccttgcttcttaacactggtgtgtggtgatcttaacactgctgtcgcttccaaatccttctgcatcccacattatctcattcctccccatctccatgcccaatctggggaaggaagagaaatcattctaatgacacaccaggaactggaaacctagcaattcaagacaaaggcagctctaagtcacccagcagcaatggcaacttgaagaccaacattccatcccatttctcactccctctactcctaagtgtctgcaggcacccctgccaatgcccccatctctaggagtcccagacaggttggctagcttgtcaagaaaagagccccgagggcaggcatggggaaggggcagcatcccaccatcgcagtccaggcatctggacccccaccttgttatctcccagggaccactggccgtagtgctccatctcttccaccagctcatcacaggccgtctccgtgaagatggggaaccagtagacgtccggggcaaggctgaggagggcggggattcagtcacagggtccagagaagcatcactttgtcctcccgctgcccccacggccctctgcagaccccgctgcaggcaaggcccctcatgtggcctatgtcagtcccaaaccccagtctgtgagccctccgtgtctccacaagtgtccccagggaacaggagctcagcaggctgctgaagggaggaggaaccagagctcagagctggcccttctcagccaaggtcacagagttgcctaagcctggaaaggaatatgcagatccagggagcagaggcccacagactccaggagaagcagagaaggaagcatctgtttctcattctaggcccacagtccacagctgagaccacaattggggacattttcttctttcctgctctggccagggaagatgcctcaggcccctccacccccgaagactccagctgcaaagtgccatcaagatgcaggggcaccccactgcatgttcccttgccccatgcagcaccagagcacaggaagggggctcctgctcctcccccaggtcagctggtcttgttgctctgccgtctgtcccctgcagccgctgcagggtgtaaatccagcagctttgttcacagagggcgctggggccttaccatctccaccatcttccccgccaaggccttggtgtagttctcatggatgtatttctccttccagtcctgtggggagagggggggctgggtcctcgggccagcctgggccagctgggactcacctgcatgggctgttccaagagggagttctgccccccaggcccggtggggtgtgggagcattgggggtggagtgggggagcctgtatgcgcct

SEQ ID NO: 48608 - DNA, 1858 bp, Bovine  19866881273237
aaatttctgagaaaagtggacacatcttggttacatagccccagcttccagaaccaggatcgatgggcaaacactttgaagagatagacttcagcttatcctagagaacttctcgatgccagagtgacccggggtggcataaggtgcctggggaggaaggaagggagcaccctgtccccagaggcctatgagaagctgagtgattactgggaacagcctgggacaaaagccctggagccaggcctggcaccaagcagctgctcctttaagatttttctgaatgagtgaatacttggatgggcctgaagggttaggcacttattgggtagttggactgattggcatattaaagaccctctccaccagcaaggccactgagaatgcctaggttctcgaccctaggcagcgaagactctagaacgaagctcctcccctcatcccaacagcccctggcaggaaggggaagagagagcgaagttggaggaccagctttgcctggagctgcctttttggatcgtctgtccatagcgtctggggctctggtcctactttgacttgaccagtcctgaaactgtgggcaagaccctcccctgcctctgagcctccacatccttgtttggaaaatggggaccgtggtcccagacaagccaccagcagggtcagggcacccaggaccaaagaagaccacatgtggtccaagctggacttaactaaccaaccgtgccaaggaccctcaagcctcccggggctcccctaagacatcccttggcttcattttccttctaataatgttcctggaggtgaagggagggttgaggaagatgtgtataagtctaagcatgaatcacaactcaagaaacgagacaaggtcagatatgagtgggagcagaagcagaaacttacagtaaacgctctctttctcccagcactgacggctctcgagctgagtaaagctcccccaccatctcctgtcagcccaggcctccttctgaggaagaccagctggcatctccttccactttttcacatcaggggccccctctccggctcccctcctcctggtagagagtggatttctgccccccaggcagaactggtacagcccttgccaagacaaaaccagaaagtctgtcctgcatccacctcctgctggtacacctgggtcagcaccccctctatggggtccgaactgaactctggaaaccccaatgggaggcgtgagaacctgcctcagcaggatggctaagtcagcgcagaggtccgaaggagctggaatggtgaagtacgggtctgggagggaggctggctgtagcctcagcgctggcctggaggaggatggggggaaggcagagctcctgaaaaggccttggacctccctgcccctggcccccctcccctgacacctcgatgaaaggatagagaagttggggaggctttccgggtaatgaattgtactctcaccagaataatcctggatcacattacaaaatcgcatgtggggaggccttagggtgaagcatcagaggctaaatctttttctcagaaggtaacacacagcaagaaagccttcttgcctcagagatccaaccacaaaatgatggggtctcataaaaccagagggcaaagaaaaaaaggactttaatgtttgagccctgattcaagcccttttaaataatgaactttccaagtttttattggggcaacagaggtggaaggaaggctagaaggtgggggggagtactgagatgggcaggcagccctgcccccactggcaccccaaatcctgcccagaaatgacccatgtctgagtgcccgacagaccagggacactcagcctcctgggtcggcgggaaatgca

SEQ ID NO: 48609 - DNA, 762 bp, Bovine  19866881286650
cctgtgacttcccccgcgtctgacccctgacccccagcctatgactccacaccattgcctgtgaccccctccatcttcccctctctcccttaggggtgtctggaatgtaccctacatctcaaacatctacctgatcaagggaagcgccctgcgggctgagttgcaggagacagacctgttccaccacagcaagctggaccccgacatggccttctgtgccaacatccggcagcaggttagctgggctgggcagtcagaagaggccccgttgatggggaagacgagttaccttgttcccgtgggccctgtggcttctgagatcccagcaggactgcttacaggctgccaggccctggtgggggcacttggagccccaggcatgagggctgcccctcgggatctgtaggatcattttagcagacccagttatcacactatctttatctttttaaaaatttgtgtttatttatttgtggctgtgctgggtcttcattgctgtgcgggctttcctctagatgcagtgagcaggagccgctctctagttgcagtgcctggtcttctcattgcaatggcctctcttcttgtggctcccgggctctggagcacaggctcaatagttgtggcgcacaggcttcgttgctccatggcctgtgggattttcctggaccagggattgaacccacatctcctgcagtggcaggtggattctttaccactgagccaccaggggaagccctacacaatctcttttatgtacatttt

SEQ ID NO: 48610 - DNA, 966 bp, Bovine  19866881395674
agattttatttatcctggcatactttacccagagaactgtctcacccatcaaagctggataaaaaggacataaaactctgttttgtcacaagacaatctgaaaaggtttaaagtgacagttaataaaccacagggtacttatcctcatcattcaggcataaaaaaggaaggatatcaaatatataatgaagcttcacgggaaggatctaccaaaacaagtggtttaagtgccaatgacccaggactaaccttttagaaaactcacaggaatgttatttagatataaagctcagaggaaaggctcgaggcaaacagcctgacatgaggacgcagtacactggcctcctggccaccacaaggccactgcattctggtttggcgaggtggggcacacagatctgccctggaagccatcaatcctgaggcttctgacactgagaaatgagggaaggtgagttctgggcacaggagagaccagaggaagaagcagcgattccacgtaaagcaatggttcctggagcaagatctgactgctctttctccttgtactcttttgtttttgaatttttacaatgttgtgtttgtttctgcagtaccacaacatgaatcagccagaattatacatatatcgccccgctcctctcccaacgtcctacccctccaggtcatcacgagcgcaccaggctgggctccccgtgttacagagcaacctctcaccaactacccatttcacacaagacagcgcatacatgttgatactaccttctccatttgtccattctctcccttccacactgtgtccacaagcccgttctctacatctatgtctccattcatcccctgcaaacaggttcatgtatggaatggagaaacggtatggatgaactccttgcactcttgaccaaaagcttttatgacctcatggacttttccagagatgcaacctctgtcatgactgatttctgc

SEQ ID NO: 48611 - DNA, 1326 bp, Bovine  19866881505767
tctctccttccacatccctccgcccgccacctctgcccctgggactgactgccctgtctttccccaggtgcctgaagacccctctggagaccctgtggatcaccaactgcctgatttcggagtcagatctggcgtacctgtcacagtgcccgagcgtcagccagctgaaggacctgggcctcagcggggtcaacctgaccagcctcagcttggagcccctgaaggtcctgattgagtggacttcagccaccctgcaggacctggacctggatgagtgtggcatcatggactcccagttcagtgccctcctgccagccctgagttgctgctcccagctcaccaccttcagcttctgcggcaaccccatctccatggcagtgctggagagcctgctgcaccacaccatggggctgagcaagctgagccacgtgctgtacccctcacccctggagagctatgaggatgtgcgtggcaccctgcacctgggtctcctggctcagctgcatgcccggctcaagcggctgctgtgtgagtctgggcggtccagcatggtctgggtcagtgccagcccctgtccacactgcggtgagcagatcttctatgacaccgagcccatcctgtgtccctgctacatgcccgcctagcccagctcatgagttgcaggctttgtccccagcactgggacaatgccacccagacctcagtacatctagaaggaacacaaaccacagtttcagacaatagttaagtgcatgctggaaaaggaaaggtgatttagagtgtgcaggaggggagggcttggtgggatttttggagagatgtgttcctacaaagttagaaatatgaatctgaattttggagagggaattttgggcttgggaggttaatggggttgttacctctccattgaattgttaaaaagaaataaagggaacttcagtgtcaatcattgggtgtcctctgtgatctctgaccatgattctcccctttaaattcatgactctcctgttagtgtttaaataaaagggcctgaacgtgagcgggacctagatgctctctggtaggcaaggatcagctacaggagttcagggcaccatttacccactccctgtggttctcatttccaaggcattcatctcctcacttatctctgaggctgttcaacctgtcctcttatacaaggtgcgttctcagggcctggaacaaattaaggatccaggagtgagcatggctctagggaaccttcttccaaggggccctcactgctaaccccaccaaggccctggactggagcattttccccagtagatccagcagatgcaaagc

SEQ ID NO: 48612 - DNA, 965 bp, Bovine  19866880783025
atttcaaaggcttttaagatagtgaagaacactttaaataagttttttgaggtatcatcctgaatacaaaaatctgatacatccttactacaaaactgaactttctaaaaggaaccaactcaagttgtcttggaggattctcaacttatgagcattttaattcaaaggaggtagcatctgacaataaagtgatataagtaagaattttaaaaccaaataatttctattatttaacgtcaagagcaaaaaattcagctctagagtaagtaccatatcaagattaatttatgtcggttatggttatgtagcacaggtgatattcagccaccaggacaatgaatgtgtcaaaatattttgaatgacttcaccttaaaaggagacaaagacaagcatctattaacacacagttcgcagtagaatattatctctttaaaagcaccacaatggaacgctttccagagcacaatctttgaataatgttttaaaatattattttaaacacactgaagaatatttcggattaagttggtgagcatttttactaaaatacagagcaaatcttccattaccgtttctgcccctcccccaacatctgcctaaactgccactaggggtcagtatgaagacacagttctccaccgtcggaggaaaatgggctgcggaaaacctttccccgtgaaaagccctaacaaagaccataactgcacagctttagcattaccaagtccagcccgtacatcaggtctggaacatgagtttgcattttttcctgagactgcattttaatgttgtaaatcacagtggattatttctatggtcaatatttctttgattaaaaaaaaaaaaagtgttgtaaatgacaagattacttattcctaagtgaatctgtgtggattggtcaagaatatgatctagaacagatgttaaagtttatttgaaagggtgttggtatgcatctctagcca

SEQ ID NO: 48613 - DNA, 3843 bp, Bovine  19866880792668
ttgccgcatgtgggatctagttccctgaccaggatcaaatccaggccccctgcattgggaacgtgaagtcttagctgctggaccatcagggaaatcccactggagaggatttgcaggagaaggcaacggcaccccactccagtactcttgcctggaaaatcccatggatagaggagcctggtgggctgcagtccatggggtcactaagagtcggacgagactgagcgacttcactttcacttttcactttcatgcattggagaaggaaatgagcaacccactccagtgttcttgcctggagaatcccagggacgggggagcctggtgggctgccatctatggggtcgcacagagtcagacgcaactgaagtgacttagcagcagcagcagcagcatgtagctagtagggaaaggggtcaggattctggctctgggcagtgattctcaatcttgactgcacagtggatttgcctagagacctttttaaactctcacgcctgggtctcagctgcaatgcccacgtgccatgtccagccccaattccagattctaatttaattggtcagggaattaaatatatgtatattctttgggcaattctagtgagtggccatggttgggcctccagtcccttagcatccttctatgtagcccacaagaagctcttgaacagtgtatctcagttcctgtggttttccccactgggcaccaactggttaaagtcagtggaagaacaagtcttgtgaatgaaatgatgacagcacatgggtatcagccagccaaaggttttaggaaagtgccttaggacttagtttattcatctgcaaagcaaagggtttgacttgaataatttcctgcttccttccagtcctatgagtctatgaatgaaatcaatatattaaacacttgattatccatgagtgaatgatccacagaaagtgtttaatctgaggactagcttccttcagtcagcctccttatcaattggtgtacgcccaggaatgcacatcaattttgatttttggcctaagcagaacataatgaggaaggaaagaatcatggtgtgtttgcatgtgtgtacatgtgaaaatcattcaaaagataaattaaatgatttggagggattatctgctgttttggattatccacatcactgccccctccaagagcgttgataattgaaagttgcctgtagactgattgctgacagctgaaggatccatattgccaaggaagctatggcgggaagccaagtagcgacctgattaattatccttttatttgtgatgtcccagttctccgtcctcttccctcaccagggtggtatctagtttcaggagcttgtaagagaacagtaaccccctccaaatgaaaagcccatctttcctgaggcagaaagctctatagagagatttctcatccttcctcaggtcctttgctcactgccctgcttctgactctacctaagagtcattaaatcagggaggctgggtccattcatactggctttccacatggaagctttcagcaaaatgctctctgttcttcaatctgatgcatgcgaggttgcccaaaatagtatgacagaggtttccaagataagaacaaactgccatggctaagaggctaaaccttatctccagtggttctatgctgactgggcttaaaggagtgatgatcctcagtgtttcagtttggagtggcatctagaattctgacagtcttttctaaaaccagttttaaatggctgactttcacaagggcattaaataggcattgatggcaggaaggtgtagtttctggtctgtaacacctgccaggaatggcctggcaacagtgaagagcccacatgcatttctccttggcttgggctaacatcagggccaatggatgctttgtaccatggcaatttgtggattccaaagactttccctgactatgactcagtcagtggcctcagcacagagtccccaccagtgagaggccacattctgatttctacaaggtgtgcctgccaggagccagtcctgtgctggtctgcgggagttttccagtgctagccctcttgggctggccttggatgggtcaccttaactctgggaaataagccctggaaagagggaggttctactcagcaccagagcctttcctggctggctttccgtgtgatggagtcaggtatctgcgccatctgaggctcagtggtggtgattattccactgaggaccagtctgattttgcagagatttcaaacaaatcttttaagagtaaggtcctatcctgggggcagctggagggggacagatttcctcttagaatgtgggctttgaagtggactctgccagctctcttgctctgagcttttcatgaacacagttgtaaatcgatttgtgaacttgtcctaatgggctggaaaacacagctttcctgtgtggggtggctcagtgaagcatctattttaaaacccgtggaggatgacacaaagctcccttccaatgagatcatttcagacaatccttgaggtcaatgaaaaagagttgagtctgtttctgctagtaaaatagacaagttctcagatacttggacactgatttaggcatagatttgtgcttaaaccacataaacagattactctggtatctaagccatatagataacttgatttcactatctatacttgtctatggatgtaatttattagcttgtcttaatgcctttcttccaaagaataacttatttagcttttagataacacgttgatttttaaaataataatatagttttataaaataactttagcttagtctaaaattgtttgcttctttgtacattccatagatttactgggataaattgatattctttttatctgttcactaaattactttatgactttacctattgccctaagaatatttgctgataaatatggagacctattacatttttctagccatcaaaggaatgtaaactaaaacttgaagataatgattttcccccatcaaagagtcatagtagcaaaggaactaatattgccacatattgccagtgtgacatctaggaatgtatgctgacacagaattacttttaaataggaggaaaagttttaggtacaaaacttagcactactctactttaaaataataaaaaaaaggttaaaaataatctaactatttgaattaaaggggaataatggaatgactggctctaatggatggtatcactgactcagtggacatgggtttgagcaaactctgggagatgaaggacagggaagcctggtatgctgcagtccatggggtcacacagagttggacaagactgagcaactgaacagcaacaaaattgcaatgaaaagtggctgtaataaagaacattaaaaatgtttatggagacttccctgatggtctagtggccaagactccatgctcccaatgtggcgggggtgggaagggcagtgttcaatccctggtcagggaactggattccacatattgcagctaggagtttgcatgccacaactgaaaatcctacatgccacagctaaaagatcccacacgcaactgagacctggagcagctgcataagtaaataaatgaaagtgtagttagtctctcagttgtgtccaactcgttgcaaccccatggactatagcccgccaggctcctctatccatggaattttccaggcaagaatactggagtgggttgccattcccatcttcaggagatcttcccaacccagagatcaaacccaggtctctacattacagataaattctttactgtctgtctgagctacagggttggcacctaggtaaataaatatttttaacaaagaaaa

SEQ ID NO: 48614 - DNA, 1659 bp, Bovine  19866880826370
tttttgaacagaggagcccccacttttgtttgccactgggccctacaaaatcacaaagctgatcctgggagtgcagccgacctaggaggccagctgctaggaccccaggagtccctaccatccaggagagtcagaaggcaaaccctggcatgaccccacattcgtgtacttctggtactttgggcaaggataccgcatttggaacaaagcagaagatgggaacattttgtcctaaacctgcagcgtttcatagcaagctcccagagatttgtttaaaaagaaagaaatgcaagctcagagcttcagagtgggcagaagggtccttctccactccctatgttcccctcctcctggagagagcacaatgagcaacctccttcggccccttccttcccccatcccaaggaggtgagcattctggtaataaatgtagtacatttgggagcaagaaactgggcttcctgggaggggttggtggtgtctgtctgggattatccagccacaacaaagccagcaaggctgtctaattctgggagttcagcattaaggaagccatctggctctcacctgagccacacccttcaaccagcctcatcagcaacaacagtgacttagggctttcgttcattattattctactcctcacactgttcagttcttgggtgggaagaggttgctatctaatggtcaccctcaatgaccccaggagccacaggaacccccaccattcatcttgtgacttaggattaattaaaacgctttattaaaagcctcacttcctcagaggaagcggtatggtcaccggggagaatctgagattcattgcctctccaaggtgaaatctctccaaggcactgaaatcgtctacagacggtccccaatttacaacagtttgaattaagatttttcgatggtgtgaaggcaatatgcattccttagaaactgtattttgaatttggggttttgaacttttcctgagctggtaataagctgtaagacgctctctcaggatgcgcggcaagttcccagtcagccaggcagtgacaagagagaacagcctgcacatttacagccactctgggccagaaaccgctctgtttttcacttgcagcacaatatctcataaacatgaggaattcaatactttattataaactaggctttgggttagatgattttgcccaactgtaggctaacgtcaagtgttctcagcctgtttaaggttggctgggctgagcaaggatgttctgtaggttaggtggattaatgcattttcagtttacaacatgatcaacctacgcatgatgggttgactgggacctaacccatcccaagttgaggaagatctgtattccagaccccttggttcaaggagaaaaatccaaagagcctaaaatcctggccccttggttctcaaacttaagtgtgcatcagaatcgtctggagggctcattcaaacacagatttctcagctccatcccagttttggattcagtggatcttggggtaaggcccaagaatgtgcatttccaccaagttccctggtgatggtccaggaaccccactttgagaatcactgacctggcacaaaacgcgttggccagttattacagagcagggtctggaacccgggggtcctgtgttccaggtaaacgaacg

SEQ ID NO: 48615 - DNA, 1366 bp, Bovine  19866880863533
atgcctttagtgggcttcccaggcggtgctagtggtaaagaccctgtcttccaatgcaggagacacaggagactcaggttcgatccctgggttgggaagatcccctggaggagagcatggcaacccactcttgtattcttgcctggagaatcccatggacggaggagtctggtggactatggtccatagggtctcaaagagttggacaagactgaagcaacttagcaatgcctgtagtaataagccatttaccaaacttagaaaatatttttaaatactcgtctggttttccattttggaatttctatataaatgttcacactgtatgcaaatagcaatggctttacattatcttttataccttttcccatatcttaaacttcttgagagaaaggattgtaattaataaatgttagtgatggatgataaacaccaaagttatattcatagaggactcagaaagatgaatttgatactcaccaaatttcatgcttcaaatgaaacaaaattttgcaatactgtaggatgtatccaacagtcccattaaatttgccttaaagacatattttattggagtgtataacagcgtactttgtattaagactgagtttttaataccattttaatgctctaaactcagagtatatttatagagaacattcaacagttttcattccagaaattattcaagaaactttgtatttggcctagattcttgtgccaaaaatagattaccaaaatgggaagaaaacttcctaatgaaagagtcttgagatcataaatcaataattaggttaaaaagcctcactggagacttctagttaaaaaacaaaggaaaaaaaaaaggacagtttatttggcatatattttctactattacagcattttataaaataagggatcagatttttataggccatctgaaaactacacgttttaggaatctcagtaggcaatctgccttattctttaatgtctttgaattctaatgtaaggtgttgtaggacaacagaaaaaatagacagttcaagttatttcttagttaactgcctttgttggaactgaaacaagtttttggaaaacaaaatcctacagagctcaaaggaaccgtcaagtctgcagaacattatagttgatggccctgggaacaccacccctgattcttaattatccaaataaccaagaattctggggatgtttttagtaaagtctttttgttttaataatctaagacacctacatgcaatttagaagtgcctagaatattatgattatagctgttagttaaattaaaatgaaagatgaaagtcgcttggtcgactctttgcaaccaggccagagtcctggagtgggtagcctttccctt

SEQ ID NO: 48616 - DNA, 1549 bp, Bovine  19866880935316
tgaatctgccgcaggtatacatgtgtcccccccccaccctgagggaggtcattgtgattttacacagggcagagatggggcaaagaacctggcctccttcccctaaagtgcagtgtccattcgctctgctcctcaccactgctggtgcatttggccctgtggtggacagaaccatgggctcccagagatgcccttgtaccctggagggttctggcagatgtggttaagttaggggtttgaagatgggaagattgtcctggattatcaagtggacccaattacaagggtttttataagaagagggagataagagtgtgaggagtaggcaaaggaaatttgtagaaacaggtattgcagtaatctgcttggaagacagaggaaggggccacagccaagaaatgcaggtggatggtcaaagctagaaagggttaggaaacagtcccatcgagtctccagaaggatcacagctctgttaatattctaacattaacccataagacccattttcagacttctgacctcccaactgtgagataacagaatcatatctggccgcctgataggaacagccgactcattggaaaagaccccaatgctgggaaaaatcgaaggcaaaaggagaagaagacagcagaggatgagatggttagatagcatcatggttagatagcatcactgactcaatggacatgaattcgagcaaactccgggagataatgaaatacaggggagcctggcatgctgcagtccacagggtcgcaaagagtcagacacgacttagcgaatgaccaacaaaaacaattgctttaagccactgagttgtggtcatttgttacggcagcagtagaaaacagacatggtctccaaagctgggcaggagtaaccgatgcagggaagtggcacccgtcaccagacactgtgaccaacccagccgtgtggccaaggcaatgctgaagcagttctccagaggaagatccattttatcattcatatttcttcaaggagtgaaaaagaaaaagaacaagtagagaattggagagaactacactaattacactattaaaagaaatcactcatgtataaaattattcaaatcggggggagaagaaaagatttgacagagtgcctgtctccctgtctgaaatgtaatactgtgctatctaagcctggaggacaaaggaatattctacaggtgtctctgtgtagtatttgaaaacaggagcccttatgagacatgatccacttccaaccatgttctcaaacacaggggccctgatggagattacacaccagcacaactaacttgggcagctttgaaaagtttacttgaagcatctcatgcttagtaagccaaacttctgaacatctttatttctgagtataatacaagatagaaatctgattccatgtgctcttttggcaaataactaactcgtttattaattcctccactcattcctccattcatttattcatccactcattcattcaacactgcttattaagcctatactgggtgccagatatgtatcaatgacatgaacacagg

SEQ ID NO: 48617 - DNA, 2796 bp, Bovine  19866880972220
gcatcgccgtacctcataactttaagttttaccttcccaggcagattgcttcgttcacttaaagtttttcatttcaaattcctgacaaggagagaatttaagtggtccgctcaccctttcaagcctagtcatgccgtgtcacgcctgtgaatttactgtcctttcagctggggccaggacgggagttgaagggggtcatgtgatccgtgtacctcaaatctgccctcttaggaggtgtggggggtgatccatcttccttagaagtaactggtttcagcaggcaatgtgtttgacattcctaggatattctcatcagcaaaagaaaagcctttgcgatgcaagtaatcagcagaaaacatacaaagtcatctttctttttttccacctgatgttaaaatatagatatgtaatgatagtagacattttaaaaaaatacattctttaaaaaaagaaaagctctggtttggaatgcttatttgatccagctgtggagcattatcctgctgattcaagaaattaataatattctttagaagtattagtattatgatagtctactcctgcaagcaataaaaaccagaatacaatggttgatgtcaggatttagttttgtgtacctggacctcaatggggtaaaaaactttgatgatgagatggctttggagagaatgtgtatgttccagctacaagatccataatagatgttaggaatttccaacccttttctgcattatttaacatgagtttaacccaattttcccttaggctcaatggaaaacaggtgtcaggagaacaacaggaagatgtttttatccaaaaaaaaaaaaagatgtttttatcttccttagctatttctgcagtgatgggagaaagaattttcccatgttctgaatgaaaataagattttacatttccatctgtcatatctagacaaaaggtagacatcgtcctagatttcttccatcccttaccatccctttccagccaacccatcatcaagtcctcgtggttctgctttcaaaatatattctgagtctgaatgcttctctctgctttcacacctatcactcctgtgtctgcctggaatactgtaataggttctgtcttaggaatgcattcagtagcaaacaacagaaaactcatctatgataactttgacaaagagagctttatacttgtctctcataaaagtagtccaagggtaggcaatccaggtctggtgcaacaatgccattgaagacccagctctatcttccttttctatcatccttaatattttagctttcattctcatgctcgttatcccatgttctccagatggctgctacattgccagccattgcatctgtgtttcagataagaagaaaggtatgggtggagaatgatttccttcacaagttttgtcttttgttcagaaaaggaagccccttggacctagaggttatctattaagtgaagtcagaaagagaaagacaaatatcatataatatcactcgtatgtgaaatataattttaaaaagttatacaagtgaacttatttatagaaacagacatcaaaaacaaacttatgggtaccagaggggaaatgtagggtggaggaataaatgaggagtttgggattaaaatacacatactactatatataaaatagataaccaacaagaacctgctaaatagcacagggaactcttctcaatattctgttataacctctatgagaaaagagtctgaaaaagaatggatatatgtaaatctatgcaatgtaaactgaatatattaatgtaaaactgagtcactgtgccttacacctgaaatagaatgttgtaaatcacagcactgtaataatacaatgttttttaaaaagaaaaagggaagcccttgtcagaaaaatagccatcaccatttcatcagtgagaacaggattccatgcctattcttagactaatcagtatccagaggattaaaattgctgaggtagatattgtgaacttatttacacagtatgacttctaacctccttccactgtgtcttcccgtacagctgagactgggaggctaaaaactgcagttcccagattctgtggcagctaggaaaatggagtgaagtgaggagaggcagatacaagctggccattttgctggtggccattagcagaggtagggtggagctggagtcattaaataggaactttcttgattgccccttctttataaaatgtcttaaatcattattaactccacttgagtttgtccctttttggtttttgtctctagctatttcagtacaaaatattaccaagttaggtaacccacaataaactactttatagtctatttggtttcctcacagttgatgagctgtacttagaggatgataaatttctttggtctcacaaccacaaattgctaggcttctccaaaggcaggctgctgctgctgatggtgattttgctggtgatgtgatctttctaaatcatctatgctgtgcatgcttagtcactcagtcacgtccaactctttgcgactccatggattgtagtccaccaggctcctctgtccatgggattctccaggcaagaatactggagtaggttgccattcccttctccaggggatcttcccaactcagggatcaaacccaagtctcctgtatttgccagcagatactgtatcactgagattctgggaatggcgaccagtggtgttggtttttccctcttgactattaaaattaaaaactttaaggcagagcttccctggggtccagggttaagataggctgcaatgcaagggaca

SEQ ID NO: 48618 - DNA, 1381 bp, Bovine  19866881024605
aagctgatggatgacactgacagagaggatgcagaaatgaaaaccaagaaggtcataaaagggaatttttttttttttttttttgcaagaggcaaaaatagcatgggatggaagcggaagcaaggagccaggaggactgctactgtaccccagaggaagaatgccttaaaaatcataagaaaaagaaaagaatagctgcaaatctctaccagtgttaagccaattcaaaccaggaaaagaagggggcccaccccatgtaggcctctcaccaccaccctccccagtcccaagaaaggagggctttcagattagagaaaagtgtgcctgaactacggtttggactccatttgagacagttctctgaatagttaaccccaaatattcatattacagctaaaacagtgtgtttactccctagtgaaactaaagaacagccgaattttatatatatatgaaggacaccaatcagtcaagttacctcttgactttctcttctggaccatctcagaccctgttttgcatagctcttactttctaatcctggctgaatttagggatagaatcttccccaagttcttagagtccttctaactacagaactcaggaatggaccctgtgctccaggaaagtttgagaaaaacaagcataaagggaggggacctcaccgcccctccaggctcttgttttcacatcctaacaccaccacccagttttgaaaaagctgttgttatgactgactccagcttatctattttcattgctggctcctgtttagacatccttgcctgtaaccagtcacttttcctctcctttttgcagagttcatttccctgtcctgaagggacaccctgcatttatcttcagcgaacttaaaaaagaattctgaccacttcaccaatttagttaggttattttaaattttgctcttcatcagcgggcttgtgttggccttcctactcctgggtgaggaagtgactcatgcgttctgagtttccttcatgacagcgctgtattctagagtatctgtttgcaaacattttcagccttcgttgttgtctacatctcctgtgtcaggccttgatcatctttattctgccctttagcagcattaagaaaattacttctctagtgtttcaaagcttaggttaaatttttgtagatactaatgtcgaagagaggtatttctaagttaatatatgcaacaaaaaattaaacttttagattaaaaatcaacaccttgattagcatgtttttgttttttaaagttcttgcaggacttccctggtggctcagatgataaagaatctgcctgcaatgcaggagacccaggttgatcccagggtcaggaagatccctgaaggaggaaaggcaacccactcca

SEQ ID NO: 48619 - DNA, 4051 bp, Bovine  19866881076937
tagcagcagcggcagactatcaacatccaggccacagaatctcccaatcagatggaaacacatcagttctgtaaggcttgcacgtgcttcatctgtcacatcacagctcacagaggaaagccaaaccatcaccatgccacttaaatggcccttctgagaagtctgacagtattaggaaaggagtaagtttcactttcttaatatcagcttttagggaaaataaataaccaacagctgggtcctgccagtcttaacagttttaaattgtagaattacgacagggcttatctggttttgtgcttcctagttgcagtgctatttctccaagtatgttgaggtatattctctttctacatttacacaaagaagtccaaaacaaaaattatgtgagactttcatatccagattctggtcacaaatatatacattctcaacgtggaaacagctagttattgacatgttggatcatttcccaagctatgaacttgtgtagacgttccgcttatgtttttaaaggttatatgtactttcttgtgagaaaacacctgttatctttactacttgtttgaactttacgcatattcactaatttgcttttgcatgtatcaaatttgtgacttggatgttttgagaagcagaactgattttattataaaatctttaatctctcttactacccccaaattgataccacatatgtgatgttattcaggcaaattatctttatcccagctccaatataaggattatctaaaaagtctctcccttacagaaatatttctggagtatatcttcagccctacagactctgattcttatgccgttactttggcaagcctgatgaaagggggtttattctttctttgcaagtttactttcatttagatgagcttggactaacaagtaaatcagaagcatcagcagtccctaacttgagacagtaactagtacatattttttatgttgtgcattcagttccaagtgtaatatggctcatcaaagggacaccggacagcaattttagacaccaaggcttacaattagactttttaaaaacaggttgccaaatgagcacgttgaacaaaaattcatttctttctgaaatacaagtcctttaatcagagagtgccatgctatgcatcattcttttcattgaaaccttctggtgccagaatcctgtttgcagtaaacactcgagtgtgatagaagtacattccatcttcctgttaaggtttccatcctcaaatgtgactgtatatatacttttggctctgaacatttgaagtacatgtatttttaaatttttctgttagtagcaatttaatagactctttgtaaaacttaattgtagaatgatgttaaaagccagtatattttcatttgaattctgtatttgaagtttttgtctgtaaatacagattttaaatatttgattttaaaaatgtttgagtcatccaaaagacattttagtgacattaaaaagctaatgaaaatttccatgtaatttctggctttactaataactcttaacatatccaatattattaaactccacacgaatgacagcaatcatgcaccaagttacagaatccaatgaaatataacttattactaacaggttaactctcaaatataaaatttaaatccttttagtaagcatatttttgtttttggagaatgtgcaaaattcagtaatttaaaattttaaagtttattaaaagtgctaaatatttttatattagaagcaaatgcaaagtgcaaatgccttgcattttctaaaactctttctaccatcctaatggaaggaagcagagccctctgctcccaggatccatgatttctctctggccaccgccttctgctaagctggctacagaggcacagttctaaaaacaatgctctggactttgtagctcttagttatgaatacttttccctttttcacctcaaactgctggccaaatgagtcctaagagatcatttacatcttttattggatcctagggaatacttacgtattcagaagtgtttatacatttagaatactgtccacacatcaattctctttaagccctgatgcacataaagcatctttgacaatgaccaatattgttaacagtgtgtttcttactatttaagagtatggacttgctgagtgacaacctataatactgtagtttgaaagaaaccaagaactggcactctccttgtggcccagttaagactcagggctttcactgccaagggcctgcatttgatccctggtcagagaactacaatcccacaagccgtctagcatggccaaaaataaataagagacttttcgcccaatagtgtagtcacaaaaagcaaggagggaatgtttatcaggaaacagttttctttctacagcccacagcaaaaaaacccactttagaaagtgttcccaaggagcttgctactctctagtttttggggggtgttttctggttactgagatttcaattagtgaatctttgctttaagtcagcaaaatcgcattcactaagttacccaatattatcatttactctctgagaaaaatgaaacccatgaaaaattaagacaaacttctgtctttagccatatatataactattttattccatattaataaataccgtaaaatatactttatcagtctaaaattttaacttacccagttactgtaaagcaacattttattctcacttggatttcagtgaagctttctggctagggagagcttttgcagtgaccagaggtctttctggctaggaggattcagtcccggtttggagagcagccaaggcaggggcgtgcacagcctctactgcaccttgtgtgactcagtgaagtgaaacagcctcgagacagtcacgggaggtgttcgtgcctaatgaggaaacctgaaaacgcaggcagttgtaaacatggcttactgatatcccaaatttaaagagcctatttcttctagaaaatcaggaaggatagacgcctatattcattagtaggaaacacttagtaacaccattggtcatggtcaaaactgatgggaaactaaggtgcaaactaatacccagtgagttctcactgccaagcactgtgtttcctggcttttcattcagtcactaaccctactggataagtgttgttaatatcccattatatagacgaggaaactgaagcttgaacggattgagcagctgggtctaaacaccccagctgttataaaagtgttaaatatgccaactttgtattttaaatcttgctctggatttatcgctgatgaacttttctctagattcacacaccatacttgagaatatgaccagcaaataacaagaatatgtatatgtaactccacgcggcaaggagagccctaagctttttaactgtacaaatgagtgtaatactcacaacagtgttgtctgctaatccccatttaaagatgaggaagccaagccacagagaaggtcaagtaactcgctcaagtcacacagctaactggaggagctgagatgcaacccaggtggcacagttccagcctatgctcaaaagcgcatgcttcagtctgtgtcccaagtagaaacctgggccatactgactctagctgcgggggatcacctggcaggaaagtaccaggaatagtcaccgtgccaattgcatccacccagcgaacacaggatagcctgcttgctgggagaccagtgtcgctctgcttatgccgttagctgtgtttgtacatttacacatcacatcagtagagatgaatgccattttgagtccagccaaccccagtagagtcacttcctgcaaaagggatgtaggtgtgagctgtgctggcctgggttttacacacctcactccctggccaggccgggcagaccaaggagggcagcgtaggaagggcagggcacctcgtcctccttggctttgccgcttctaagcaccatgtgaggtactggaggctcccagtctacacaacaccagctgggagaacgttaacgcagagttaataaatgaagacctaacctacaaccacttcaaaaaa

SEQ ID NO: 48620 - DNA, 1468 bp, Bovine  19866881219217
ctgggaaagcatgtaacataatgtgtacctatctgcccataatttgctatgtgcaactctaagtgcaaaatgcataaatgagattaaattttgatatggaaaatcaagctattagtcttactttaaaaaataatttcagttatagaaatggagtgcagactttgtatttaaaaaaaaaagaattgcattaattttgtgtcttttaaacccaagacactatgtcttatttcccgtgtgtctaacatatacacaagccaaatcctatcctgttctaaaacacatttgtagtttcctaggtggaacagcattattcaaatggacaggatataagtcaaactgctttgttacaaaatacagaattaccgggtcatatgtcattgcaacaatctgaacctattttctgatatttactatcattagtctccatccggttggactttaatcaagtaagagtttaaaatgtaaattgaaaagtttaaccaaactaaaaaccaaatatgggggatgtataaaaacatgtttatatatgtaaatagaagtgaagtttgacaggtcatggtctgtcaatttattacaacgtcctgactatttccctcctctgtatttctcaaatccctccctttcctccatctccatctctccctctgaatccaatccaatatcctttcttatgggttgatgtaagttctctcctaacacactttccccctcatccactccaaacttttctccatcttacagttaagtgatttaaaaataataataataatatatatatatatacacacacacacatatatttatacatatattatgtatatataccagagaaggcaatggcaccccactccagtactcttgcttggaaaatcccatggacggaggagcctggtgggctacagtccatggggttgcgaagagtcggacacgactgtgcaacttgactttcactcttcactttcatgcattggagaaggaaatggcaacccactccagtgttcttgcctggagaatcccagggacgggggagcctggtgggctgctgtctatggggtcacaaaagagtcagacacaattgactgagcctgcagccaagtgtatttatgtcaaacctcatctcccagtgcatcccaccctgcctaccccacctcgtgcccacacatctattctctgtgtctgcgtctctattccagccctggaactacgttcatttgtgccattttcctaaattgtgcatacatgtgttaatatataggtgtttttctctttcttagccataaaagggaatgaaattgagtcatttgaagagatttgggtggacctggagtctgtcaaaacagagtgaagtaaagttactttttaaataatataatcatatttctcctctacttaaagcttccaccattccctgttgctcaggataaagccccagatttctcatgtgtcctctgaggttaagcatgagttg

SEQ ID NO: 48621 - DNA, 797 bp, Bovine  19866881753992
ttaagctctactaaagcgtactcatcaaaagaagttgccctcaccttgttaaaacattgttctgtgtgaaagagacatctggctgggtttcacatccacagggtgaaaacatggttaagtatttaattgcttagaaggtaatcctattatttcagattttcttcataatgaattctttttttcccctaatttgaggatttatgaagggaaagtgaaattctctggtaaatttatttttgaaaaggtacttgaaagagttgtaatatctaagcagcctctgtctcaggaacaggctctgagcagcagggtgatgattgggtaccagagggtgaatgtatgagacccacgtgacagtcaaatgaggtgatgtctgcctttggttctgagcatgaaatcaccataaaaacaagacttttgagaagcggggcataaatgaacactttgtttcattaaagccttcatatgtctcgaagaaagtcatgcgtttgaggacaggtctcagtcctgagtgtttaacagtcaatttgtgcacctatgagaagtttggggaaaacaaattgtaaaattggctttattttacaatttctggcacaaatgactggaccagcaggtgaatggaaacagaggagaaggagaaaaggacaaatgggtcagtggaggtgttgggtggatcaaggaattatcggcaccccagagctcctggggcgtgatgcaggtatcagtagggatttgttttcctggatgggatggatggagtgaaagcttttgtgatcacaaagaaggtcaatcagtgctta

SEQ ID NO: 48622 - DNA, 964 bp, Bovine  19866880624445
gttcttcttattactctacagccctcaagtatttttcttggtcgaggccccttacttaacacgagggtttgaaaaaggacggtaatagggtcaggaagtaagagtctccagattttctgcttagctttgtaactggaaagaataataatctgtgaccaggctaacaccacctactattactcactttcacaaggtagaattgacagagagtgtaaccactactggaaaaataattttcaaaatgggtatcgtaggaccaatccatatactccctctcatcagtaactccacatgtccagctctttctccctctctaactccatcatcaccaccgtgcttgtcagccacttctccttctcccctagatggtctctaccagactacagtgggccataaagggtagaaagcctcttcatgcaacttttgaattttaattttatttcagtggagagaaaacactggaatttgatctcactgccccttcggctgcagatttatctaggggattactcagagaacatgtgttcacttcctctgaatactgtcaggtcagatgtgttaagccagatacaaattttgatactgctccaggaaaatagctgagtaattttttttttactatatatctcaagagaaaacacaaggaatgttaatttaaatagcagtgaattaatacagcaaagaacacatgcttattttaggctgctttctaaacttcaagtgtgtttttcagataaacatgtgcttatgatgctgattttatgtaaccttccagctaaccccatattgtagtcacattactagtaaaaataataaacattcttatttaattttattaacatgaacacgaaaggacttcaaaaaacactttctttaacaagaacaaacacaaatgtaagaaacttgcataaatatgccaaaaacgtagagcaaggcgactttcattacaatcatcataaactag

SEQ ID NO: 48623 - DNA, 1064 bp, Bovine  19866880809033
tctcccttatttcctggggtttgttttcccttgctatctcttcacacaggtgagtggaaagatgcagaaaggtcaaggggactgagtgatgatgattcctgttggactttagttctgctccaccccacctccctacccctcccatcaccacctaccatatatcctctggtcctccatttgaggagctgtttggggcaggggaggggaagggtagaaaagtaactttcctgattggcagagaaataaaggtcattcaagaataactgtttaatattctgattaggtagatatgccaggaattataggatagaaacaaatatatgtgggcattaggattccagtgacaatggtaaagaatcctgttttctgtgttatcttttctcagggtcccttctgaacagaggcagcttcaaatgagctgtgttttcctataaatatggttcctacattggtataaagcttagatttttttttccccctgtaagtgttaattttagggacttttatcccctgaaagattgtattatggaataatcaagaaagcgaaaggaatgtttctcaaggaatcactttttaaattgtaaatcattagaatgtgacttaattgataaagcacttttggcttacatggttattttctattttctttaaagagtgggcagtaatatgtaacattatttaaacatatgagtgttttatgatactatataacaactttctaagtagctagactgtccagaaatctttgtgaaattagtgtagcggtacctgttttcacagacaaaaaggatgtgtttaatgatagagttaagactggctctccagatctgttcctttgataggcagattgtgttggaatgagaaaaactttcattgtggcttttcccctttgattattctttaatctttggtgtctgagacatagtggttgctctgtggttgccccacaatcatggaggtgaaaattaagttcatttgttgttaatcttaactttctatacatatataactccaatattttatttggttcatagacatctactagcatcgtttcggagaaggca

SEQ ID NO: 48624 - DNA, 1566 bp, Bovine  19866880878401
ggaatatgaggagtaggttcaatagagatgtccactgaattacttagtgtcccaagaggaaacagttggtgggtcaaaatagagtaattcaatgaaggtttatttacaaagagacattttcaatgaagtggactagggtcaccatgcatccaagacttcataataatagcctaatacctaagctattaagaggggagggagtagtactggaaaccagggaaagagtcatgcctgctgccttgagagaatccatgactgctggagagacacagctggctggaggagaccttgcaggaagggtgccagggcctccctcccctttctctgcctccaatctactcccagcactttccattggaaagactcaaccagaaaccccgtgggaagcccctggtgtggtctgtatgagtctccctgtctgggcagaaggcaaggtacagaatagttgagagtgaggccagtgggggtcagtggaagagatctggcctgcctgtcttaaatacatgaaattaagaccagcaatatttagctctgtagaagtaccaatcaataaaggctgcatttaaaatctttgataaaatttcagagagactgaaaattctttgaaattgtaagtaaaacaactactccagtataattaggtgggtcatccaagcaagggacacagaaatcactagatgattcaacactgtacaaagaagtatgattgaaagagaagagaatctggaaagcatcaggaagcaacaatgagccatgtttcctttaagcacaactgcccacaaggtttaccagctccctactgagaagaattgaaagcaaatatcaaaatggtttggagacacaattttgcctgaattacccattggtaaactgcatagagttctcatacctttgtgtagatgcagtcctttccatttaatctttttgttgctgtataaagttcaaaagtcaaaacttctccaggtatgtaaatatgaatcgagtaaatgtcgtatttaaattacagtcaataggtttttttttttttaaaccccaaattgacaagtaaaggtaaaggactttaaaggacaggtaaaggactgttctcaaaaatgaagtcttaacaaggtttcttcctggctgactgtgccaaacgctcttttaaaaaaaatttttttttaatttggaagataattgcttgtgttagtttctgctgtacaataatgtgaatcagccatatgtatacttacatcccctccctcttgagcctccctcctaacctctgcccatctcacccctctaggtcatcacacaaaccttctgcatgtaaagtgcagacaggtgcagagaacgagaacagtttgcaatcaggttaagtctgtctcataggtttcctcatatttaaaaagcttttaatgcaaataagtcaaagaggaaaaaaaaattttctgataatagtaactttggcctttatggtcatcttaaaagagaatttacaatcattatatatctttttataatatttttattttcatagcaacactgtagaatactcagtctacactagcccaaatttatgtgaagaaa

SEQ ID NO: 48625 - DNA, 2579 bp, Bovine  19866880904308
taaatgctccatttcaactatgaccggctttctgttcctagtgcaatttaaatgacaagatgttgaaggaatttgagcctgtatttatattcactggactttttcaatacaatttgcatcatggctatccatttagatcttacatctttgctctgatgttgccatttttcagatcttttggtcacacacagttctacttccagtcttatcactttccatttatttgctgcacttacatctttgttggacagtcctcttttttgattaaccatctgtaaaatggcatgtgggtttatcgctggaagacaaagaagccatataatcaagtgctttgctgtctgtgcgtgaacccaatacaggtgtgtagttaccaatacccactaggctttaaaataagtggcacaactagtcattccctgatcgtggtgtgtatctggtgtttatgtagtgatttgtggactgaagagctagcagcaaatttgtactttatgcagttatatttaatatacaatggtaactgaaatatgatctgtgttactaggggactagtgtttcttaaaatgtgacaacaagtttgtacatactggggctatgcaaagcaaggactgcctgtagtaacaatgggtgtttgacaatttgttatatatcaggtcttattcagggcttccctgatggctcagatggtaaagaatctgcctgcaatgtgggagagctgggttcgatccctgggttgggaagatcccctggaggagggcatggcaacctactctagtgttcttgcctggagaatccccagggacagaggagcctggtaggctaatctcctaactcccactattagttcccactttacaaaggaggaaactgagtcacaaagagatttaataggaccaaggtcacacagctggcagtggtggagctgagcctgtgttttacgtttatatgctgtacttcctttggtagagataaggaagagtgatttgggctagggctgtcatgtggctcataaaaggggctgtgtgtaggctagtccatcacagctgcccctccctcccaatctacttgggaagattatcattccaacatgagtgcctttcaccacctaccctgctcaccgaggaagacacatgcacctttgtctcttcatttttctccatttcttttggaatcggtaatacattcacgtaagcacatattcaaaaggtacaaaggactgcatcatcctctctcatcctctccttcagccatgactttcctccccagagacaaccaaggataccagttccttctccctccactccaaaactatcccagaatgtctcacaccacctgcccctcatttcctgtatctactaagactaaagtttggacaggaccagaatcctgggttcagagaaggcgatgggaccccactccagtactcttgcctggaaaatcccatggacggaggagcctggtaggctgcagtccatggggtcacgaagagtcggacacaactgagcgacttcactttcactttttactttcatgcattggagaaggaaatggcaacccactccagtgttcttgcctggacaatcccaggaacgggggagcctggtgggctgccgtctatggggtcgtacagagtcggacacaaatgaagtgacttagcagcagcagcagcagcagcagaatcctgggttacagaaaatcttggaatacaaaaagtaataaaggcactaaaattctttaaaaattattttggatttgtgtgtttcccatggagttgagaaccatttggataccatgaataaagagtctgtctgctttggaatctgagaagggaggagcagagaaggaccgagaactcctggtaggatgaatgggcccacgggagtgctcagagaaggaccgagaactcctggtaggatgaatgggcccacgggagtggtcagagagggccctgactcccgaggggaggagggggaggcagggggggccctaccctacctcgaagtctgccaattgctcatgttccgagagggctccacatgcaggctgtgaatctcacacagtctatttttaaaaggatttaaagggcaaagaaaagaatatcttcatctactatgctggctttttcaggataatactgatttcaatggcttccctggtggctcagtggtaaagaatccacctgtcaatgcaggagacatgggttcgatccttgggtctggaagatcccctggagaaggaaatggcaacccactccagtattcttgcctggagaagtccatggacagaggagtctggcaggctacagtccatggcattgcaagtcagctcgacttagggactaaacaacaataaaattgattgcaaatattctatcgtgatgtccccttgaggtaccacaaatgttttagaaattccaactttgcagtctctaaaccataccttcaaaactgcctctctcctctaaatgtcttaccttctgcagcacagaagccattctttgaacatatatttcaaattttcagctcagataataaggtaatcatagaatattgaacagaaggaacggcaatttaaaggcaaaa

SEQ ID NO: 48626 - DNA, 1193 bp, Bovine  19866880937215
ttttcttaggaatctggcttttcaaaggtaatttttagccaaaaatcaggtatctacacaattgttaactggaaagcatcaaattaagaaagctttgaaggactcatcttagcatataataatgggcaatattaccattaaatttgaagtaaaatacttaaatgaaactcctaaactccttatcatatattttacaaaaatgttggaatccaatttcaaatggatgttttcctgccactttagtgtttttaagtgctttgtctttgagaaaatactgtaataaataaaagtgggcaggtgaagtggctgaataccctgtcaagatgccctgtccaacgagtgcacatgtgatgagtgaggaagggagaaaaggttaatgtaattagagaaatgaattctgggtagccccaaagagcatgtcttgtgagtcatctacattcacatttctttgaactttgtctatcctaagggagatgaagcaattacatagacataatgtgttaccctttcagtacaatgcaacccacattcctccatacattcatcatcatctgtggtatttgtgttcagtgctgtcacgcaagctagttgccaacaattattaaaaagaaaaccgaaaggttatgcatttaggagataaagcaaggttaacttttgaaacatgctctatgaagatgtcaatccattaaggggaaaaaaatcactaagaagctcctcaaagatactcctgcatcaagaactatctccagagacctacgaagtaaatgaagtgattatctggtcactcacaattctccgaaatggaatccacaatggctgtgatatagctgcatatgagcttcccctcgcatttttacctacattctcattcactgattgtgaaagtctttttctctggactttctctcattacctgctttttttttctttaacaacaaacaaaaatactctagatttcattaccagaaccacttatgtagggagcatcctgtctggcacggtgttaatactacctctctcaacttctcaggaaaaaaagaaactattttcaacacatatttttcctcctcttacctcctcccctccctttctcttctttcctccttttttctctctttccctccattcccttcctcttactcctcctcccactcttcctcctcttactctggaattcatgtttcccttaaaaa

SEQ ID NO: 48627 - DNA, 1011 bp, Bovine  19866881040031
aatcagcaaagttatagtagaggtgaaaacttcccaattagtaattttaccaggaaatgagttgactccctttgcctagaggattaatttagcttgcattcggaagtaaatctaggattatatgatttaataaaaatatatatcacatgtatgatggtttctttgtaacaataattataccccaagttaagattagcatcgtatttgtaatttgattttgaaggatcctctggtggatggtaagctggaacatttcccaacactttagccttaagatttgatagatgctcttctgattgtttatcctcaagcttacttacttttttccttttatttttttttacttttttccttttaaaaagagcaaaaggggaattaaacaggaaatgatgcttctcagggagcagaataagcttacattcattcagaatacactgatgtaataagtagcttgaggaaaagggcttttgtaaatcagatgaaatgttacttataacttttaagcaaactataaaacaataagccctttggaaaggggacttactgagtaggaggaaagacaggaagctggttccctcttagctgtgggcttatttattctgggagagaaacctatgaaggatttaaaatttgaggaagggctgtgtgttcagataccagcatatttctccaggaaagacgtcacttaggattttgaactgattaaaagcccaagtttcttagataaggagagagctaagcaaaatctgagcaagaaggaaactttcaaaccattgaagggattttaccacccaaatggggtggaggagaggtgaaatgtcagggcagagccctacatggaaaaagaagaccacaagtgtcgccttgggagtcttctgtccgcataccctcactttggagacacatgatttttaatacaaatcactaggaaaaaaagttatagctatgttttatcttatcctacttctctgttaactgttgtatacggaaatcataagtaactgcatttta

SEQ ID NO: 48628 - DNA, 3040 bp, Bovine  19866881046716
gaagagagctgtttctgaaatccatattcaagtgaaacagaaaagattctcatgattgagcaatttagagtatgtatgggaaggtatggggaccatggagggaggctgtgagctgatcaacagggagtgtgaattaattcttcagtaacaacaacttagaaaagatgactgtgggttaaaaatgtcctgacttggcactagcatggtgtgtaatcaagactgtctgcaattttgagccaacaattatgcaatgtctaaattatatttgtagtttgttacttcaagtgccacagaaataactcctaggcattttagttatgcacaaaagctatggaatcttcctgagtgaatatatgttacactgtagtacatattttgtactaaaatttagctaaagctaaaagtaaaacagaagcaagaaaacaaactcacttgtcaaactcatcaaagatatcacaattcggcagtttccaaagagccagtcgaaagtgtgtggctagaaaacaagtggactgttaggaataaaagcaatcatgacttcttaggtacatggtaaaccactttatcctctgccctcccccaaatccacttcaaactggtatgattacctatgatttattccctggtgaaaattcatgatataactgcaactagtcagcactacttaacaagggcacctaaaatataaacactctaaggacactttgcaaaaatctcagaaaaataatatgcttaatctgaaaacaatcataaccaaaaattaccatatcagatgattcagaaaatgatattgatatagaactcaatattctgcaagtttaaacttatcgaactctctacaatgtattctaaatacacacaggatcagctgaataaggaaaatctaactcaggaaactatagacttgtcacctaaaaggctttcaggatttctcaaaaatctagaatgtaaagcaaagcagtggtcagtaagcagagggaaaattgtttcatcattagtggatggagcaattctctctaaatttagcaaaaacaaaatatcctttgattaaattaaaagactgaccaaggacctagagcttgctgatgacataaaactcctaggtaaagaggcaaaatgggagacaggaggaagttaatccacagaattgtcttcttaattctcaactggaataaagtaaggcatcgaactcacgaattacggtggtaaaacaaaagcaggaaaaacagtttctcaacaacaacaacaaaaatctacctttcttcattcttttattctacactgactcaaaaggaatggggatttacatattaaaatataattcctttcacccaatctcaaaaatcacatccttaggaatcactatgaaacaaaaagattaaaagaccttaaaattatatacaaacatatggttcacatcaaacaccagtcacagtattagggcagggtaagagtaatattactgacctgatgctttcatcccatagggcaaatcaaacttatcgctaccatagaaggaagcagtatttttaaaattagctgcacacagaaaagggtgaaactgatgatacctggaagataaggatgaagaatgactttcccaaatgtgtataatatttgcaggtttttaaaatcacaactgtaaaaaactgtagtatgtcattcctatcattatattgactataaaatgagcatataattatttttaagattctttcaaaatcatcttaaacactatttaaatgttacatagaataggatgggcaatggaaccacacacccagaatggaaatgctttccaggcagtaaaaccaaaattatgtaacagcttgggggaggggacacagaatttaaatacaagtgaaccccaaagacagccatctacaggaagaaacaaaagaacaaaggagggaaaataaaagtataaatgctgacccactccccaaagaaaagataccatatatataaagctgttgtcagcagtgaaaattaaaatacactaaaagctagaggtaactagaactgaactctctcctgatgtcattaaattaaaatatactcaagaatgatgggtgtcttattgcttctctaccccgctgctatactcgggtactctctcagacaagaatgcttcatgaggcatctctgtttttttaatggtcccttctttccgcctttaccagttttgttcttcctaaataaactgcaggcagagaccagagtgcccctgggttttcagaggccacatgacaaatggaaataagaagcactagaataggaacgagggcttccccaatggctcagtggaaaagagtccaccttcaagtgcaggaggcatgggttggatccctgggttgggaagatcctccggaggagggcatggcaatccactccagtattcttgcctggagaatctcatggacagagaagcctggtgggttacagtccacaggggtcacaagagtccgacacaactgaagcgactgagcatgcacgcatgcacaaataaggatgaattagcttcagctttatcctggttttgcttctcaggaactactaacctgggcaagtcagaggagctcaagatctccagagctgaactgagaactgacaccatattcaaactaggcaaagagttgagagaccatcccttcctacctgagaagagtgtgtatgtcagattcagttgtgacaagtgttagcagcctggagagggggatcccagccaatttcaaaaggtcattatctgtatcagggttgatctctaagcttgggatctgctctgggaaaagtgtcaggtcttttgattttaaatttctaaatgaaataattgttcaacactgtgggcaaagaatgtggcctgccatttcagtaaacaaaggatgttgaagccttaaaggcttcagctactccatctgaactccaactgcactctatcgggaattgaggaagaaaaacaaaaacaggatactggccccagatagctatggtgccatatccaaggagtaacttcaataatccagtctcttgcatcttccca

SEQ ID NO: 48629 - DNA, 1672 bp, Bovine  19866881077326
taattagcctccaattaaaataaattttaaaaaaagacaaaaaattttaataaaataaatcttctcaaacttcaaaaaaaaaaaaaaagaaacaactatatgatggaaaagtatacagaatgataagggttttgagatcttaagtaaaatgtgagatcttaaaaaaattcacagcctttacttttaaattaatctgataaatgttagcagttaaaaaatcaaataggatggggaacacatgtatacctgtggcagattcatgttgatatatggcaaaaccaatacaatattgtaaagttaaaaaataaaataaaataaattttaaaaaatcaaataggaataaaggtttataatgaaatgtagcagttctctgtcccctggtcatctatccgtagtcctgatctacaaaagcaacttgttttaaaacttttagatctatcttctgttaacttctatattattaaatgatcagctcaatctcttttctgagaatattaattagagatgtctgttttctctgcttctctctcttatatttgggaagttttcctcaaatatctgatgatctatgatcttaaaaaggcaacaaaaaattggactgaaaacgctagatgtcgggcgtatgagggtgcaggataagaaaatagttgtgcatggtgaaaatgccaaagatccctcctaggggtaaagcttttttttttttttttttgtctagaactattctatgaaattgttttctagaaaagagctcttgaatttcctgcccagctgtaggtgaaattcccttgagggaaaagtcctcagtcaggaggtcacttttcaagaaaacccctattgcggtgccagcctgtcctgtatttttgaagattttaaataacagagggaagtgtttaagatataaagttaaggggggaaattagtatgcaaaattgtatatacagtatgacttgactaaattcaaatttacatgaggtagctagaaagaactacaccaaaatattaagtggttatggttatagttatttctgaacagtggtacaaaatgtgacgattatttccttttgatacagctgttttccaaaatttccataaagtattgacactgatttaaatattagggaaaaatacttgatttttaaagaaacacatatcaggatgccaaaaggaaaactcacagaagtagatacatgctggtatcaaagtaaaagaatctttctgccctagcttaaagggtataattaaacgtttactgttttttaatatttagaaaatatgaggatattaaggaaaatccccctggtatactgaaatggctgcttgcatacaagaatccagctaagaaatagaacactgctaattttgaagctcttggaagctttgcctcagtccttttccccactcaccagaaatgtatttgtccttggcttttccttagttttttcacctaaatacagtttatggcctagctttgcatcttctgaattttatacaaatggaatcaaactgcacgttttattctacaggttgcttttttcacctcatattatgtttgtgagttttatggataatcctagtttatatttttattccaatgaacatctctactacaacatctttatttaacatctacagtctccatttcttttagacagtatccatagtccctctaaaa

SEQ ID NO: 48630 - DNA, 1541 bp, Bovine  19866881186862
ttattgtgaatagctataagaaaagaaaattcatctaagaatgcttaaccaactatgagtttaccatatcactgaaatagacatctacctaataaccatccaggctggatgtaatcctgggctggatgaagcacaggctggaatcaagattgctgtgaaaaatatcagtaacctcagatatacagatgacaccacccttatagcagaaagtgaagaagaactaaagagtctcttgatgaaagtgaaagaggagagtgaaaaattggcttaaaactcaacattcagaaaacaaagatcatggcttctggtcccatcacttcatggcaaatagatggggaaacagtggaaacagtgacagactttattttcttaggctccaaaatgcagatggtgactgcagccatgaaaattaaaagtggcttgctccttggaagaaaagctatgaccaacctagacagcatattaaaaagcagagacattaatttaccaacaaaggtctgtctagtcaaagctatggtttttccagtagttgggtgtggatgtgagagttggactgtgaagaaagctgagtgccgaagaattgatacttttgaactgtggtgttggagaagactcttgcgagtcccttggactgcaaggagatccaaccagtcctatcctaaaggagatcagtcctgaatattcattggaagaactgatgttgaagctgaaactccaatactttggccacctgatgtgaagaactgactcatttgaaaaaaaccctgatgctgggaaagattgaaggtgggagaaggggatgacagaggatgagatggttggatggcatcaccaactcaatggacatgggtttgggtggactccggaagttggtgatggccaggggaggcctggcgtgccgtgattcatggggttgcagagtcggacacgactgagtgactgaactgaactgatgactctttgcaaatgcaaagttaatagtattttaaatgagaaaatacatttataggtaaagtaaatctataatcattctgttgaaaacaaaacatattgaagaaaaagcatatgcagaaaatagtcttataaccactttctttttctgataaccacagtgactaggcagaaaactctgagtgcttgagcaagtaaacaaaccaaagctttccctggaatgctttgttcagtgttttaggcagaaaataatccaagacactaccccacagaatttcaaatttcaaatttctctttagaatcgagcaattaggaggtactcccatgtaccagagtcaaggatggataaagtggacaacgaagcaaagtaataaaacaccaagtctttcaccctgaagtctttagacccataaacagtgtgaccatacacaatgatctatttacattaatggaaatgtttagttcaaggatattgtaacaaagtttattatccaggctaaactgaagtcaagtctacaaataagtgaagacttatcaatggcattcctctacctttaatatcactttatataaagaatctgagaaaacca

SEQ ID NO: 48631 - DNA, 1406 bp, Bovine  19866881197640
attacactgtgaatgaagaaactccaaatattagttccatttataagatacaaattttcctctttctgacaattgtcatatcaatgaagtttgcatataagcattctcagaccagctcagtgaccaaggcttctctattgtgactgttattcctccctatggtccattctgatggttggactttgaccagtcgtatgtcacattctagcagtagaggggacaaaggaggaagggcatgcccctagccattgagacttgcttccttctttaaggctattccccaaaaattacatataacccattattacatccagtgatgtgctggagccagttggtaccaacttgtgagagctgctgctcttcccaactctgtgttcagtgccatcaaggtggaagattgaagttagccatggtgggaatgtataccatggaaaatggcaatgctacgaaccaaggctccccatcatctccctgtctcccaagggggactaattgttaaaaaaaaaaaaaaagcttgctagcagccaccaattatatcccactggctagaggtataatcacagggccacacctcgctgggaggtggactggaaagtgtagcctctattctaggtggctatgtgcccgcctaatgaaacataattattgagtggcaagtaacagtctttgtcagtgttgtctaccatcttctgtttctgtgcctggaaatattcaagattctaaagtcagttatgtaacactataccaacctagctcacttgaagcagccaattgtggtttgtctcttggagatgaaagctgttgaaaaatgttggtgttgcagatcattcggaggtggagtttcttccagaggtcttttttatgccatctttgtaggtaacgtgagtaaagtaactcagtgaggcagatcagcctttttctaaagttagtaccatgaagaacttgggccagaattagaggggagggaacaggagtgtgtgtttggccataactctgtgtggaagagccttggagttgtaacaattccatgcttgttctttgttctacctccatgcttccctaacctctttgcccccaccaccaacactgctcccccaccaacccgttctgtttcagagtttttggtcacttagcaaaaattgtgataattggcctctcctcttataattacatctgttatatttttgttatatgaaaagtattcattttagaaaaaatgttcattctagaaaattgtctttctctgtgattttgtgacagttctcagttttttcctgtgaaaagatgagaacacacaataggccatttgcatcccccattcttattttatttgtttatctctttggtatgtggtttttttaatgaaatataattgctttacaatgttgtgtttctgctacacaata

SEQ ID NO: 48632 - DNA, 842 bp, Bovine  19866881217537
cccattttttccccttcggggaaagtgtaaatgcagtcccctctaccacaagttatgcagccgagtttcccatgtttggagaaatcagaggggtcagcacacccagagtgcaatgggtaagtctcacctggggcaaaccacattcgtgatcatggtaactcccctgccaggtaagtatcccatttttcaattttttaaaaaaatttctttttgtatgagctatttatatgcatttaatattaaccccttatttgtcatatcatttgcaaaaattttctcccataacccctcctattaagtagatggtctttctgttttgttaatggtctcctttgctgtgcaaaatctttgaatcttaattaggtcctatttgtttatttttgcttttatttcctttgctttaggagaaggatccaaaaaacgtattgctgtgatttatgtcaaagacataaatctgcctatgttttcctcaaggagtcttaacatgttaaaaaaaaaatgagtttttaatatgataaatgattgtttttcccccttgctttactataaaacacagagtgagacacaataagagaatcctcatggcctttaaaagtaatgtattcaaaattttcaatgtaaaaatctagttaaattcagatccaaattgttagatttattgtgccaaatttcaaatggaaatgtggttctctgcattttaaaatgtataacaactgtttataatattctgtataatacagacatatcactatgtgcatgacagagttaaaggcttatttatgcaatttttatagaatacaacataaacatttctgtcaaaaggacttgtaaaatcattctac

SEQ ID NO: 48633 - DNA, 1274 bp, Bovine  19866881471622
cctttcttccttactttgtaaggcttggaattctgtaaactagttttccaaggggctttattgtttccagaaattcaaccttagttcctttaacctatctgtacatatgtgattttatgcacatcatttacagagatgacattccagtcaaagtccaaagtcttgataacgtaatcagtgtttctaattgtgtcctgttataataaaacaggttcctattaaacttatgcaaataactatactaccctgaaaataagaatattcaataatttcctgaattctggagggatcaggaaggggggaaaaataaatgtttcaattctgttaacaaaagtatatgtgccaaactactataattcatagattgattaagagaagaggaatcattctctgccaggtcttgtccctgttgctgccttcaccacctgcactatggctttcataacctggcaattcatgcgttccatgtcctcctcctccaccgccatggcctcgacaaagaaaatcctcatcaagcacgtgacggtcatcagcggtgggctgatgggctccagaattgcccaggttgctgcagcaactgaccacacagtagtgctggtggaccaaacagaggacatcctggcaaaatctagaaagggtatcgaggaaagtcttcagaaagtggccaagaagaagtctgcagaaaacccaaagagtgctgataaatttgtggcaaagactctgagcagcatatcacccagcatgggtgcagcatccgtggtccacagcacagacctggtggaggaggccattgtagagaatctgcaggtgacaaacgagctcttcaaaaggctagacaagtttgctgtggaacacacaatctttgccagcaacacttcttcattgcagatcacaagcctagccaattacaccaagagacaggaccagttcactgggctccatttcttcaacccagtgcctttgatgaagtttgtggaggtcattaaaacaccaatgaccagccagaagacctttgaatctctgctagacctcagcaaagccctgggaaagcatcctgttgcttgcaaggacacacctggatttattatgaaccgtcttctggtgccatacctcatagaagcagtcaggctgtatgaatgaggtgacatgtccaaggaagacatcgatactgctaagaagccaggtgccaggtatcccatgggtccatttgagtgcctcgattatgttgggctgtacactacaaagttcatcctggatggttggcatgaaatgga

SEQ ID NO: 48634 - DNA, 903 bp, Bovine  19866881774739
ctgataactcggtggaaaaggcatagctgatcatcccctcataccacacagccaggggccacagctagactgtggatgctgcgtctggcttcagaaaggatggtgctggctacagaaaaaagtcaaacactaatggtggcattttcaaatgttactgtgaatactataacactggccataatatttctggctgatcttaaaattgaggaatctggtattttgtatagtacgggaattgttacaaacctcaaggtttaagaaaaaaaaaaaggaacaagacacatatatacaatttattaaaaacacatgaacacattaaaatctcactatttatacaatcaaattctagcaacatatacaaatattgagtgactacagtacatgccgaggtaagaaaagtacattctgggagaatatcactgacactcaaagccatttttatttccaatacgtatttcaatatatgttttgtttctacctttcccagtgccaaaaaagaagaggaggagatgagaagaagaaactagttacaagttggattatatgagaactggtgccacagttgacctaaaaatatccaactcttacttagatattgcaatttagggatttcaagttcagaaccaaaaggcaaagccagtaggtaatttttttctttaaataaacagaacttcactgatttctcttaagaagggttgaaaagcttttattgtcccacctaatctaagttgttctttctaatcctattatctgacatgggtgttttcccataaccctcttgctctccaggtaacaatttggagcccagggaaagaggttcaagctttattacattccacagaattatggccacatgtatatttaaataagctcattttctgctccctcttgtggatggggagg

SEQ ID NO: 48635 - DNA, 978 bp, Bovine  19866882007763
catttttgtaaaatgtcacatgggtttatcactggtagacaaagaagcaacatagctacacactttgctctctgtatgtaaactggcagcagatgtgcagtggccagtcaccacaaaccgttctttttttaatttttattttatattgaagtacaattgattgacaatgttgtgttagtttcaggtggacagcaaagtgattcagttacattgatatgtatacatctattatccccttaattttcaagttctcttcccatataggttattaaagaatattgagtagaattcccagagctgcacattaggtcctcattgattacctgtttttaaaaataatccatcttatttacttttggctgcactggatcttcattgccgcatgcaggctttctctagttgcagtgagcaggggctactcttcattgcaacacatgggcttcttattgtggtggcttctctcgttgcagagcacaagctctaggcacacagacttcagtagttgcaacactcgggctcagtagttttggtgcatgcgctcagttgctctgtgacacgtgggatcttcctggaccagggatcaaacctgtgtctcccgcattggcaggcagatctccatccattgtgccaccaggaaagtcctaattatttattttgtatatagtagtgtatatatgttaatcccaacctcctaatttatcccccaccccagccccatttcctctttggtaaccataagtttgtttttgaaatctgtgagtctgtttctattttgaaaataagttcatttgtatcattttataaattccacatataagtgatatcatatggcatttttctttgtctgacgtatttcacttagtatgataatctccaggtccacgcatgtcactgcaaatggcattatttcgtgttttatggctgagtaatattccactgtatatatgtactacatcttttttatccattcttctgtca

SEQ ID NO: 48636 - DNA, 1214 bp, Bovine  19866881037064
cttggtaatttagctgcctctgctctgccatatatcaccaggcttcatctagggtggagtggtggagatggtgagagtattaatagtatgttgtactaagtcacttcagtcgtgtccaactctgtgtgaccctaaggacttcagcctgccaggctcctctgtccgtggaattctccaggcaagaatactggaatgggttgctgtgccctcctccagggaatctacccgacctggggatagaacctgtgtctcttatgtctaacctgcattgacaggtgagttctttagcactagagccacctgggaagcactattaatagtatacctgataggatttgctgactattgatgtagggtgtgaacagaaggaagaatggtggtgctgttaacagaaatagtcaagtgtatttatatgttactctgtgtagacagtatcttaacagaagaaatttttaattgacaatttcattagtactttattttaaatttaccaatcctgagtcttctgaattcttatatttaaaggacaccatgtaatgttgttttaattgagagaaaaatgaaacttctattgtgctaagctactgagatcttgaggtttgttatagcagttagtgttacttaccctaactaatacagaaatgaatttttaatcaaagtaaaaaatactgttattagtatgtctggataaataaaactgtgtcacttttacaagttaaactgagtttgaattgagatctcaaaatccgttcttttcctaatactgtagcttataatccaaaccaattgaaaattcagttgatggttgtgtggtttgttaccgtgtctaagcactgattttccagatatttaaattaaattactgatatttaaactgaattttttcagtattttttttagtggagaaaatgtcaagtcttatttaatttatgcatctgaaaacttttaatctattatcaaccgcagtaaaattaaataattctttttccttttccttctgattatctgaaggcatttgaatattccatttaaagcaacagttttaaaaattgagatataattcagatactataaaatttaccctttaacacgtacaagtccagtggtttttaatacttaacaaagttgtacaatcatcaccactgtctggtgttctaatgtccagaacattttcatcaccccatactcactagccatcactcctcgttctctgt

SEQ ID NO: 48637 - DNA, 1339 bp, Bovine  19866880265033
aaatggtccgtgcattgtttgctgtagcaagatgtcagcaaccagctgtgatatttattgatgaaattgattccttgttatctcaacgcggaagatggtgagcacgaatcttctagaaggataaaaaccgaatttctagttcagttagatggggcagccacatcttctgaagaccgtattctagtggtgggagcgaccaaccggccacaagaaattgacgaggctgcccggagaaggctggtgaaaaggctgtatattcccctcccagaagcttcagccaggaaacagatagtagttaatctgatgtccaaggagcagtgctgcctcagtgaggaggagctcgagctggtggtgcagtattctgatgggttctctggggcagacatgactcagctgtgccgggaggcatctctgggtcctattcgcagtttgcaggctgttgacattgccaccataacacctgatcaagttcgcccaatagcttacagtgactttgaaaatgctttcagaactgtgcgacctagtgtatctcctgaagatttagagctttatgaaaactggaacaggacttttggttgtggaaaataaatgggacacttaggatggcatctttgtagtcttgtctttccactttttattatagcaaggaaattaatgaattgtttgtgaaatgtatattctgaatctgtaccttaaaataggataacaatatgttgacttttacaattgattgacttagactatattaatataagctcaattttcattccagttgtttcctgatatttaagcctatacatacaagataggaatgcacttttttgttttgttgctaagaggtcttttcacgatgtatactgtgatgaatagtaagctcaaacagaaacttaaaaaaaatgtgatttctgtatgagaatgtatctgacttacatgcatgttttattgaagaaggtttcttgtgaggatcacatcatgcttagtgttggctgctactgctaagtcgcttcagttgtgtccgactctgtgcaaccccatagatggtggcccaccaggctcccctgtccctgggattctccaggcaagaacactggagtgggttgccatttccttctccaatgcatgaaagggaaaagtgaaagtgaagtcgctcagtcgtgtccgactctttgtgaccctatggtctgcagcctaccaggctcctccatccatgggattttccaggcaagattactggagtggggtgccattgccttctccatagtgttggctggtgtagtggtttacattagaacctgttgtttactgttgtttaagatctcaaccaaagctagagtaaaag

SEQ ID NO: 48638 - DNA, 2434 bp, Bovine  19866880480823
atcaagtcctagattagggttatttgatcctgtgcttctcccatcccattgtcttctaactctcatcatgcaggttaaaaagttagctgtccttctcattgcttctttgaaaataatgagtctttctctggttgcttttacattttctctgtttctgttttgcatgatgttcctggctgattttgtttatttgttccttttgttttgctcttatcccgcacctagattctgtagcttggtgtatttttatttgtttggaaaattcttggccatcatcacaaacatactgccttttcatactgttcatggagttcttgagacaagaatgctgatttggtttgccactccctcctctggtggaccatgttttgtcagaactcttcattatgatccatctattttgggtagccctgcacagcgtggttcttagcttccctgagttacacaggccccttctccacaagactgtcacccaaggagatcaaacaaggtaatcctaaaagaaatcaaccctgaatattcattggaaggactggtgctgaagctccaattctttggcacctgatgcaaagaatcaactcattagaaaagaccatgatgctgggaaagattgaaggcaaaaggagaagggggtggcagaagattcaatggacatgaatttgcgcgaactccaggagatagtggaggatgggagcctgggagtcaccaagttggacatgacttagtgactaaactgcatctgaaacatttgttttgacctgctctctctcttcctgtctcactggggtgcgactgtatctacggtagaccttttcatcatgttccaaatatgttagctttagaagtgagtacttactgctggtccttgagctggaaatgagttcacatccgtgaagaacagtgaagaggaaaatgcagcccgctggattcctctttcctcttccttttttcttttctgtgtggtttgaaggtgtaactgaggaggcaggttgggacatcaggactattggaggctttgcaggacactcagtgcttactgactgaggaaataaagcccaagctgctgagctggttgggcagggaggctagtggttaagaagagcactggtttggaagcaggattgtccattcagaacctgaatccttactttaccatgaccttgagcaacttgcttcacttgtttgtgttctattgtttgtgaaatgaggataaactacatatttcataaaatagagaggattaaataaaagagcagcataaagcacttagagctttgcctagagcaacatttagtaaggctaattgttcttgctaggcattattatgttggtacttctttgaccacttcctgcccacccagcacccccagacagatagtggtaactgaccgtggagtgttggtggtggcaggccccagagacagggctctgttgggtgtttattcttaagttcacccagttgtcgcccattattctatatgagtgtggctcttgagtgccaagggtttgccccgtgtggggctttaggggctccagatgccctggtgactgactctggccctccttacctcttcagtatgggatgctcctttaccagaactacagaatcccacagcagaggaaggccatgctgtcccacttctcgactccagtggtaagtcaagctgcacctctgaagccacattcctcttcagctgctgcatcagcacgggctgtgggcatcttttctcagatgaggctgccccgaggagccagaatagccgaccagcatgcatttcccaggagatggactttgtcgtctcagcagtgtgactgctgggagcagatccctctctaccctctcccctttcccacgtctccctgcagcattgctttggtgaatggctcccactgagagctctattctagtgttcagaatgttgacagcgcccacatctactgaggagctgccttcaccaccttcgcttctgtccatttcagccggggggtccatggtgctgttgaccatgatgcttgagtcctagtgaaaattgagattgtaatgagtcttcctgtgatctcagggtggactttatgtctcagaggtgcagaaacagttcatcctccccaaatatgatcttaacacattattaactaggtgatgtattaacacattttttgttatccaaatatttattggccaggagtgtcagtacatttttagaaagtgatcaaattaacatcactgtgtgaagttgttagatcttaaaattgatcaaaggttcattatacagtttatgattattgttatcactcatgttttgctccattaggtttttgtagcaccttgtgtatatttgtgaaattttcaaaaatgacacatcgagaaatcttgagtgaaaaaatattcagtgaattttatgcagatatcctctctgagtgtccgagtgacata

SEQ ID NO: 48639 - DNA, 2221 bp, Bovine  19866880528728
caatgattgattctgatgcagaaagtgaaaatgaaactcatggtgctggagaaaactttacaggggtaactattgaatgtgataacctgcaaaatgttagtgaaataacagaattaattttttggccagccaaaataaaaagcatcaccaaccacaggtgttagtttctgcagaaatcccccagttgataaggagttaacaatctctcaatgtccattcctcagagatgtcaaagtacccacagaagcggtgcccgtgtttctgtgaactgacttacctgagaagggatttggctgctggtgagggctggctcacctttgacgttaccatttcttggatgagttttttgtgggttttttggtaatggaggagaaagaaagaatgattttattactttgccaggcaaagggagaccacagcaggctaggtcctcaagaactgtgctctcctttgatgagttttaattcacattagagaccctgtggacgaccacacaggtggacaccagtggcctcaccagcagcttctgaatatcttgagagaactggaaggtttctttcctcttcttgagaaaaaccaaagccatttttcttccaagggcccttcagacactaagtgttctgtctgatccttgacagcggggtccttgcccatcctttgctgcccctccctgggtctgcacagctatcccacgcagcagttcctacctgctgctctgcttgcttccctgtgtctcaagaatccacggcctctcctttgcagcgcagtgtctctgagaactcccttgtggcaatggatttctctgggcaaacgggaagagtaatcgagaatccagctgaggcccagagcgcagccctggaagaaggccacgcctggagggtaagactgtggcccagtcccacccctggtctgccccagagaaatggctctgtgctggcggcagggatgcggggcggggaagggggtggctgtgagttctcacctgcaggaagctgtggcttgcctgggcgcctccacacccccggtacctggccacccccacggcctgtctttgggctgccatggaggggaggggcaggagcagagccctgaggccccttggccctcagccctgtccctgctaatgtgtcatcagggcctctggggagagcgccgggccaggcgttcccatcgtggctcaaccgccgaccaacctcccagccttgaacagtctctttactctgagactcaagttcctaatttccagatggaagaatttcacccaacttccaagcttttctgagctttcaaggcaactctggctcagaaagcctccccatccttcagcttcacagtgttcagaaaaggagaatgtccccaaagctacagacctgagttccctgtggaagctcatagttttctcctaaggtgtgtcgggaactgtactgcgtgtcttctgtgtgacagacagcccggcttcagcactgggatcgttagcaatatcccgggatgggacgcttctggttttgcttttaacgactgcgacccataagctgtttgccctcctgctcacatgggaggggtccttgtgaccacatgggactaggcagctgtcatcccgccatcaagggcctttcacccagccagcctcctgccccgtgtgtcccaggtggcgcggtgattgtgttcgcggctcacttggcgctgacgcagggatttcttttgcagaaacgaagcacgcggatgaatatcctaggtagccaaagccccctccacccttccgccctcagtacaggtaaacacggcatgttggcttgatattgttgtacataaataacataaaagcgctcccagccctccccaagcctcacggcaggcctggagtacagcgcacgaaagctgggaccgcaggagtcggggccccatgtggtccccagcgcgcttagcaaggcggctaccgtgcacggagcccagcctaccctccttctctggtccccacagtgattcacaggacgcagcactggtttcacggcaggatctccagggaggagtcgcaccggatcattaaacagcaggggctcgtggatgggtaagggacgcgtcccgggcaggagtctgctgggctcagctcctcagagcatcttgctgtgtgtgcgtgtgggcagagggggcgagggtggtgcaacaacctcattttaagttggagcattgtgctcaggagtatgaaggtggtgcaggattt

SEQ ID NO: 48640 - DNA, 846 bp, Bovine  19866880759886
agctgctattaatacggaggaatcccttgcgtcattatctagtggaggggaataaggatttgggttttaagctggtagttcttagaattaatttcctattttcaaccaaaggtcaccttccccattttgttcgttctgtcatagattgtaacacttcctgcctgactcagtgtaaaaatggggagaagaggaaaagttcacttatttatttatttggccactcagcttgcaggatcttagttccctgaccagggattgaacccgcaccctgggcagtgaacctaaccactggaccaccagggaattctcaaatccgtgtggttaggtatgtaagcactgagcagtaagggtgagtttggaatacctacagtagcatcaagtcaacgcatctttcatgtctgtcttgctgcttgcctgaaataatccgattacaattcataaccagaagagcaagcatattcatgcacagcccactgtgtgcctggccctctccccaaaaagtaaggctgttgtgaatgttgccactgtcttgggctcactttccaaacagtttgaacctccctgcagggcctgctctccatcacatgtttgcttcagtaaataagagacaggtcgcaaacaccagagccagttctctttggtgagggctaattgttgaaggcttcttcaatttattcatatcaaagaagaaaataacaatacaccgcccacaaatccctcttttaatgtgtcacctcctcctcattcaatcttattcccagtgaagatccagaattgtactttactctgtttgtagtacaagagaacttcatccttatcttgttaaatacagttgtactgctgctg

SEQ ID NO: 48641 - DNA, 2171 bp, Bovine  19866880881612
ctgcaggtttgatagaacatgaggctttcagactaaacctgccagttccttaacgcttcactggttgggtcaatttgatctgaaaatctaatttttttcccctaaatcagaatggcacatcacaatgcaaattcaaactcatttaaataaagtgactgcaacattttgtgatgaagagccactcttcctgatcagcagttttggaataaaccaatatccaattttgcgtgttgtggcatttggtgggggttttaatgtggcttttttcaaagggtctttaaaatatgccactgaagcagcaaaataaaaaggaaactcattaaaaatgcatttcaggatcacaagttcatttcagcgttacattcttatatttaaatgaaaggcacttcattataacagttataataacttcttttcatttacattttccctgtattttccctttcaatttcttctccattacctgtctgtccctatgcaggcaaatcaggaaagagacagacagagtgtgagggtgggagggagagaaggagaaagactgaataaaatgagaagttgagaaactggagggacggtttccatcatccaaagagaagtccttaatctctgtcaaaatctgagctgcactcgagggttctggctttttcctttgcctcctaatcctgcagccttgaagccagtatgaagtctatctgtatctattgaagtcagttctattttcagtacagatattctaagagatgaaattcagttattattgggaactctttcgggagcagaaccgctggagtggtcacaaaaacaacagaacaaaacaaaaaacccactgagctctctgctgtgcgtcagctcatgtccccagactctgagtccaacaacgggatggacaggccgctgcggtcaagaaatatgctattgactagtcacaggtctcagaatctaaaatcagtgaatatttaactctcacttaaaacagggatacatttgtcatgtttaagtaaacatcaaaactctttaaaaagtgcttttttttttttagacaaaaggctttgtatgaccatgatatctggtattgagataccatgaaaatgcacttcctagtaacaactttaccttagggaagaagaatgtgttaaaatgtattttaacaattttcccaatcaatctgcatgattttggtgaacaagacggcacttatcaagagcgatcagaagtgcatctggtactaaatctacaccagattaaatttagaagcctgtgttggcatctgaatttcaagattatcatcattcttaagtgggagggatagatgtgctactggaaaaactgaagcgaacttacaatgatattcagttatagaccatttggaatcctaacaataacaatatattcgtaattttccaaagtctgtatctagattggatctgactgagcagaggaagtccagcaggtggaaaggtgatggtaaaagtaacacttcctcaatctctgagttacaagcccacactagatgaggaggttacaacagctagtagccagcagaaccaaggagcatctaatagacattgttaattttcgactagaaacacttcagggccttcccccacacgtgtgtgtgtgactgcggtctttagctccaagcagatggaagaaggaagaagagtcagggtgaccggcagggcggacccttagggtgagtgttctggagagctaggcggtccaatgccatgaacatgatcatgacaaggatgtggaccgttcctggtgaccaacgtgcctcggtgtgacccgtgcccatgtgacatgccccctctatgctgatgaggtgctgggcgcctggcttctcctgaggtctgaaaggatgcagggaacactgccatccagccagtgttgtcagcggagaaaggacagatggttacagtcatgaatccctccagcagaacagggcaggcaggaaagacaggggccatgacttcgagagtgaaatttgtcttctaatttgctctcatgtagcctgctgggcctggtgtcttaattccactggcaagctttcctggaaatctatttgtttctgactgttgtgccagcatgaatatgtaacatggggcctggggactggaagagagcattccctgaagccatgacacggaattcaactcaatgtggcttcc

SEQ ID NO: 48642 - DNA, 1166 bp, Bovine  19866881094503
caccagagaggagcggcgtggccatcagggaaagggggtgtgagctggagggaaccggcatgggcaccagggtaagggggcatgaactggagggaaggagcatggccaccagagaggagggcgtggccaccagggaaagggcgtgagctggagggaatgggcgtggccaccagggaaagggggtgtgagctggagggaggggcgtggccaccagggaaagggggcgtgagctggatggaaggggcgtggctgcactccattcctctgaggctgcaggttttccttggtcacagggaggtccacttcctcatttcccagctctgatgtgtggcttatgcgtcctcctcattgctgctgaggcccaggtcagttgtcgcctagaggaggaaatagatgcaggatggactgttaaggcacaggatgggacattttgtgagcagttggccactggttactcagcataacaaaggtggtgggggacttacatttgagtgtatgctcctaaccttgaccacggtttgcaaatgtcctggtttccactttgaatattaccttataaggcggaatatcagatacattgtatccatctgtctgaatattgggaggtggggtttttagcaccacccagcatcccaattggctgggggatatggttttaacttggcacttatgtgacaccatggttataacctgtagactgtcaaaggggagaggtgttgagagcatgcgtagactgccctctgctgacaaggacaggaaacacttgctcttggctgtactgagaagttccctcctataaacctgaccacttctctgcaggagcccagacacctgcagctgctggccgacctggaggacagcagcatcttctccctgattgctggcaggaagcagtacagtgcccccacagactatggcttctgcataaaggtactgcccaccccgagacggtgaactttgaaattaaaccagcgacctcctttcttgattgttgctttttaaaaataacaaacagtttcacattggatttatgcactggtataaaaatattccatgtgtgctttcaatgtgtcagtccttgagtagcacagatgctcagggaaaagcagaagccctgatgcacaatgccccaggtcttaggggcgatgggccccgggtttagggag

SEQ ID NO: 48643 - DNA, 1512 bp, Bovine  19866881414003
acttccagcttccagaactgcaggaaatgaacttctgttgttcacaagccacctggtatctggcgttttgtgacagcaaccggcagactgagatgcgggtcagtaaacatggacgggtgtaattgtctactgaagatgactgagatgattgtgtgcggagcacttgtgaggtgctgaccccagatctcaggtcctctgtgagcggttagtgaggggcagggcagcgtgggctgggcagagggattgagcggggaagctggggaggcactgggtgacgagaatgggtcagctgtgaagacaggtcacagtttgagagtcaggtggtcaagagcgagaaatcaggatggacccaggaggtgcccgagggcagagcgagcttggagggcggcagagctctgttcccacggagaagagggccatggtcccagacaggagggaagcccgcggagcccggcgcccaaactccctccacgaaggagaggccgaaaagcaggcccagtaaagcagctgagaccagaagcgggctgtgaagaagctgccagctgagcacccgggacactggccgtggcagttggcggggggcccggggagggagatgcaggaggcggggatgggctggggacccctgaggctgatgctggcaggaaggaaatggggaacttggtgcagcccggacctcaggcctcagctgggaccagatgcctcaaaacatgccaagttctgggctgtattttcctaaggaggaaggtgaaaacctcagtgtgaagtcccctcgctttttccgctttttggcaaagccaaggacaggaacaaggcatgatccctgtgtgatgtctcctccgggcaccccccaccctgctcccccagcataggccgcccgcgccccctccctggcagcggggtgctgcgccggcccagcaggtgtgttgtggctacggggatcacaggacgggaagcagatgcggcccccgcagtccccaggcacaactggaggctggccgcttggggaggagatttgcataacaaggataatttggtaccaaagctgtcccctgaagtgaactgcctggatctcggtgcagttgacaaatttcacttcttctttcccatgttttgtcaaaccaactagatgtgacgttgagtgtgtgaattgtccaaagatactttctttctccctgcatgattccggcctccctccctctgctctgcctgatccagggcctcccgtgcacactcccagggtctctggccctgaaggcagcgcagcagtgcctgccccactcaaagccttgctccctctcggagggacgccacggtgggactccaggcctctgggcaccttgcctctgctccccgcacctgccgctgtgtccccgtcagcttcctccctcctgcttcctgtgggcaagggcgggccgaggcgccaccgtgaggagggcgtgtggtctcgggcccttggtttattcccctttcagggccctcctccctcctgggcactacccttcacaaaac

SEQ ID NO: 48644 - DNA, 1387 bp, Bovine  19866881463643
tggaattttccaggcaagagtactggagtgggttgccattttcctctccgttgtcttaaaggggcagccaagggtccgtgaagctggaagcagaggctgcctggaccaggcaagagtgttgcttgagctttgacacatttgctggttcccattgaaacgaatgcctggtggttatcatccttcacatgtgtgactctgtgcccaatcctgagatgcagaccctgatgcctggatgtctcagggagcttgctgaccctggaagtctagccagtgctggagacctgaaaggcacgtgagcctttcctaagcccacgagccctgcccacctccttcatggttcacaaaggggctacagccccttcaaagtgtgacctgctgtggaaagtagggggcacatggggcagatctgagctggaagccctccaggcactcgccggtttcttcctcttggtggtttgctttcctgacctgataagatcaggcccaaggcagagggcagagcctagcgggcagtggtgagattgacagacgagggagaggggcagagtagggtagcaggacagccccaggctctcagaggtggggcgcccagcccgcctccccctttgcaaatgtgattaggtctctgcagagcagctgaaatcaggttagcatctctgagccgagcccagtaatcacagcccggagcagagcaggtgctggggttaaagcggcttctgagaatgaggacaagctgactcacagccctcaaaacacgaatacatgggccctgccgtcaccagcctggcacatcttcctgggaccctgggtcccatgctgcccacatgctgtgcagggagctgcccagggatgggcttggttggaagggcctccagcatggccagtgtgcggggttctttaactggcagaaccagagctaagcatacctgcgctctcttcttggtctggtcctgcctgtttatccccagaccccacgctgagtgtctcacttaagctaacagtaaagtagggggtcccaaagacacccaaatcaggagggtcctgatgagtgaatataatgtctgcaaagctgagacatgttctcagctgaggccactcccaggactgggcagtgttttcttgattttacaaaatgctccacggcagaatgaaaatatcaatactaacgtaagaatcacagaataaaagatgtaatattaaccaaatctcatcataagagacaaacagtactaatatttggtgaaattattctagactcactgccatatacacattaatagaaaataattttaacaagaggatattcaggttgcattttaaaaacagatggtatggcatttatttccattaggattttactgaggaacatgagataaagaaaggaatt

SEQ ID NO: 48645 - DNA, 886 bp, Bovine  19866881764726
ttctgtctcctgatttttatttaaaatattgagcattttgagcttacctggtctaaactcatagtttagggaatgtctgttcagtggaacaatgccatctgagtaccaatgctttacctcacctataaatatatagacacattctaaagggaaaggaaagtgatggggaaacagaatctatctgtgaggcgaggccgccagtgtgctatatccctttgcattaacacgttttaatctttcatgaggcatacaatggttggcaacaggtccaggcctcctggcccccgtgaccccgagttctctggattctctcagggctaaccttgtctgtgtgctaatgaccaggcacccagggtcactctaaggactgtcctgttgctaataacatagaaagcctctgagatgtgtaaaaacgagactttcatttccccaaattttaaattgcatcttggaaagaaagtggcttttggctcagggtttgaaggcacatccactctgcaggcagccatgcttattaaataatgacaccggggcctcgtccatcagctcctgggactctgtggaaaagttagctgcacggttaggcctgaaccaatgcgttccagggtcaagaaacacaaagtctccatttcatgttctatatttaatcagttccactcagcaccatactgagtttgacatttttctaagcggtggaaggacagagttacaaaatatttataagtataatccccatattcaaggagagtataacatttcatagaagcagtagtgcaactaagcagcttggggtccaaagaaccagagctgatggaatggtttaggaatttagagaggggatgaccacagagacagcatccatgggctggaccacggaacactaaat

SEQ ID NO: 48646 - DNA, 1233 bp, Bovine  19866880355300
ctgcatctgtagaaagctgggcagccacagttgtcccggagggagtggggcaggggtgagggtggggggtggggtgaggggaaagcccgtccagtcggctaaacagggggatcagatgagcattttatatactaataactgagtccacccactgccaaacggcttttccagctcagcttccaaacaaacggtaacccgtttttcaccatcaagagagaaggtcagaagatttttctctggagaaaaatctaaccagcccaagaggaaagtcttaacataccaacactaagtactccttggtgaaatgacccacaggcggcaggcctcaccatgcgatcagagcttcttatcagctttatggggcactgctcttaagtaagaccagacaaccaggatcaccagacagacgaggaacatctcagacccaaaagatagggaccgaaacaaacaaatgaaaagcaatctggagaaaaaacagtctctagagagagaaaaaggtgtttaaacatgtatcattaatatattctgagacagaagagaacacatgtctaaatcaataacaggtaaatataaaaatatattttaccccatgagttgaaaacttatgtccatacaaaaaaatctgcatatacatgtttctgacagctttattcataattcccaaaactggaaacaatcaagacttcaaagggtgaacagataaactgtggtatatccttacagtggaatatcattcactgataaaaaagaagtcattaagctacaacaagacacagaggaaatacaaacgtatattgttaagtgaaagaagacagcttaaaatggctacatatttatatgattccaactatattaacgttcaggaaaaaacaaaactacagagacagtgtaaagatcagcggttgccaggggcttgtggggaggaagagtgactaggcagaggacaggaaacttttagggcaatgaaactcttccgtatgataccgtaatggtagacacatgacattaaacctttgttaaaacccatagaggtgtacagtactaacagtgaagcctaatgtaaactaggaactttagttcgtaataaagtatcggtgttcattcatgaataactttcattcatcaaacaaatatactacactaatgcaagatattaagaacagggcaacttatgggggaggcagaactagagtgggtatccaggagccctctatacttttctgctccattttt

SEQ ID NO: 48647 - DNA, 1893 bp, Bovine  19866880615033
cgaggcctctgaggaagacagaaacagtgacggtggcagaactgacgcagaggagaaaggccatcgcctcactgaggacggtgcttttccttcctgggttcctgctactcagcactttgggaaaggtaaactgaaccccgggggcccaaacagggcaacaccatttcactggtcagatcaagcctgagtaagtgaccacaggggaaactgaggcccgtttttcaccgtcagtttttcacaagctggctgaacagtgtacaaattaatgtaacaagggcaattataacagtttttctttttatccaataaaagcacttttattgggatgcccccacccgccctgccttcagttccccactgcgactgcttagttttccttttcatgtctcagtcattttgaaacaagtgaaacaattttcctttgaatccagaaaataagttaaatgcaaagtcactattctctcattctgtatctccatttactctgagaatttagagacaatcatttggataattttaagtaaccttataaggagaatcctcgcttcagtattcctttaatcatgcagaacttgtactataattttatcatttaatatatgaaacataatagtttgacttgcacctttcatatgatgcatgacctttctgggtacctgtgtcaactcactgtaaaaatcatgataaactgaaagacagctgaccataaggaagtatatcttttgaggtctaatgtttataaactgtgagagaaaatgcaatgaaaacaaaaaataacaggagatgcttaaaggactttctcccttagatgcagaaggcaaattatatatgaattacatggatttgatgtttcaattgaaaggaaaacaaaaaatacacagcttcaaacactgttttgtagagtttttttgttgtagttgttctggtacgtttagagtctaattacactctagcaaagaaactatgaaattaaaaagtaattcattagaacctccaactagcttgaaaagctcactaagatctcatggccaaaatattttagctaacagaacacagggggtttcttagttaatacaaaagaatcctccgttcgatagcttttcgacagatgggacattcactcatccggtctccgcagagctggcacgtcccatggccacaaaggaagatcatgttcttcagacgatccaaacacacagggcacattgtctgtaatatgagataataaacaaagtaataaatgctgagctattttctagtttgaaagtataatctgacaactctgcaatgtcattaatttttttgttgttgtagtcaaataatctttggctgctggacacttttaaatttttgaatctttaaggtatcatccttataaaaacagaaatactggctgtactgtcaggtcagtataaaatggtacaatataaaataaatagtacataaaattaaaaatgcaaatgccaaaatctaatacgaaaaggatgaaaatagccccttcagtctgactcagattgttcaactctaggtaccaggttgttcttgtatgaaaattacacagtgtattgcaggaagcagtgggggatagtgctaagaacatacacacatgccaagcacgatgctagatgtgatccaggcccaaagcttgtatcactctcacttcaagagaggaaactgaggcttagggatgctaaagacgagccagaatgtgagctcgggtgcgtgtggccccagagctcctgcttttagacgtgaagctgcactgcactgccttcagtatagaccctctggttaaaaacaattaaccttagctattgctaaatgtaacttcatcaacttagaagaattcaggagtatatttctataaattttctagaaaaaaaatcacacact

SEQ ID NO: 48648 - DNA, 3192 bp, Bovine  19866880629203
aggagcctggcgggctacagtccctggggttgcaaaagagtcagacatgacttagcagctaaacaccaccacaacaaacaacaaaacttacaattactaacatcagctaatatgtaatgttcagtttaaagatatttttccccatgccatctagtagccgatttttatttaaaaccttggcgcagctaccatttgatacaattagtaagtaaacatttatatgtgcatgtgtatgcctgtgtgtatgtgtgtgtaattctgtgtgtgtgtgtgtctacacagtaaggcctccttctagacatcagacttctgggaatcctccaccacccagcctagaaccagtcaagcacccagaaataagagaaaaataaaactttacagcagtgtaatgaaaggaatgtaactggcttgtattataggtagaggttaccctcaggtataaagcaaaatagcagtttaccaggcatgtgacacacagattccaaggagaagtggtaatttatctgaagggaagagactcaatatctatgaaaaacagacagtaaaaataaaaatatggcagctcagaccatttagcgcggaggcaaacaactctacgaaatacttcagtggtcgctgagaaaatcactacatttcagggtggcagaacagtgggactttataattaggaccctgagtaagtgaatgcccatcatttaagaatattttaaaagatagtattaagtgatatattttaggaagttctttcactaaaacttttttttttttttactttcaaggcttcagttatctggaaaataaagtaatctgaaacaacttttgtattgttttacttcatgcagtgtattttgtctctaactttcaaaggtttttctgaatactgatttgtcatgctcagagaggtttcaaggaaaggagatatcttacacagtatcattattcacatgcagattaaattacacaatagagttgattttgtaaggataccttttcagattatagtattatttgccctattaaaaactgtatttattaatctgttgtacaagttttacattataccacagggtttccttctctgcattactataaaaaggtgccattcttagcttgtaataagttatccctcatactattgttatgtaattttaaaatctgatgcacaaatgggtattaaggcctccaaagagatctgcataaggaatgggaggaagagtggcttgaaacaaaaattcctgattcattaattacttgttgagcatcacaatatcatggatgtaatccaacggttctggaatatgcttagaagacaacagaataagaagattttggagtagctgaaatctttaactctcttgctttgaaaatcttctgtcacaagtcagaaggataatgtctcttttcacccaatgagaaagctgttctcacacgagcataattaatcttctgacacgacgacaaagaaattccttaaaaggatttctctgatttcctctcaagacagaagactgtctttatccatcatctgttcttcctgatcccttctttttgaatatccccatcagcagaattgtccatcagaaaggacagcaggagggaagtctctgcatgatggatagggctcaatgctccgcaggcctatttaagtgtgagcatctattgttgcaaacttactttacagcagttaaacaaatataatagtcaccaattcaaccattgtgcagcttagacttgactaaaactagtaagtgaagttggctaatgacaaggcactgagtttgaagccagataaaattttgcagttagcctaatgtctactcagaaaaaaagaaaattctccaagttatgcaattaattacatgcatagattagaaagtgttatacactattctgtatgtagatggccattcccatcaaaaactaagaaaactcagggacttccctggtgggtccagtggctgagactctgctcccaatgcagggggcacaggttcgatccctggtcaaggaactagatcccacatgccacagctaagatctggcacagccaaataaattaattaatttttaaaatacatataaaaaacccaagaaaactctgatacttgttgtcctaacagtcactcggtacttcttaacctgcatcatggttatctggaaagaactccccccaaactacctgtgctgttacccaaaaactcaggtgtggcaaaggaaaaagggctacaaacatgcctctaagaatttctcttcagactcatcctaggaaagttgtttgaagaagagatgcaggtgtgtctgtgtgttcttactcccatctgtgaaagaaaaccaaaaccttttgaggccccttgtgagcaccccttgtgagcacttccttggcagaacgaacgaaccattgttgtggggagtgccacgggtcagttccaaggagaggagcgaagcattctgggcaaaggagaccccaccaaggacaatgcaggcctggccccacttagaaagcaacctgaacaaaatggaaacacgtctagaaatctcactaagctgtaagaggacactcgatatcaacagcagaggttacagcatgctctgtgttctttatcgatgctgccaagaaaggccacttaagcccagacaccaggacacactgacaccatatgtctgtttgcaccacgatgaccttgactactcagttctgagtgcaccctatgaaaatatttgtttatccttccaattcccaaacactgaggccagtccataggccggggcctggctcactggtggtctcctggcactgttagaaggacactgtccaatccactgtggggcttcttctccagctgagctgcctcctccagtgaaggagagcaactgacagctgattcaaagccaggacccacatgttctgcaaagagtggcttgatttcagtttttcttaaattttaggttacattcaggaccagttatcctttggaagatctaagaaaaatatcttctatccaaggacaaagactgaggaaaaaccttacagataaagacgctaagaaatctgaatagagaatatggcccagagtctgaatgtagagaagctggaagccaacagaggtagagaaagtcaccccgagagagggacagatggggaaggcaggcaaacagcccagagggactctaaatgtcccctcaccagccgag

SEQ ID NO: 48649 - DNA, 875 bp, Bovine  19866880690095
aatcgtctggagatagctgctatttaacattttggcagtttttccttttagttgttttcccatatacagtagtttggattctgttttgaattttatctcttcctgcagtagattatcaaggcatatctagtcattacagaaaatgtgaaaagtatagaaaaatgagaatagggataaagtcatcattagtcagtatacctaaaggcaatcacagtaccatgttggcacaattctttttgtaggtatcatttctacgtagtctttagaattactttttaaacaaacaaatttttaaataaccttatgtcctagaattggtatgtttacatttgtctgcgttttatatagcaaggtagatgggcatttgaacattttaactgtaggcatcaaatggccacagttgggtattataagggagaaagaatcagttggatttcaggattctagtcacagactgaaccattcaattcagaaatagtaagtacaggtcatgtaaggaaccagatcacaggagaagacatctaacaccactattcgcagtgcaagtccagtcatgctctgggatggtgggctggtagcatcatgccctctgtaaagaatggcttatggatactgtgggatacaacaaagccagatggtgactcaagatctctcatgatggctcatgtgcttgttcggatggcagatacgatggggacaaaacatcagctgctagaatgctggacgcaattgttggtaaaggaaatgtatcttcaagggttcatggaaaggacaagattaggagatacctctgctaatttaaggaaacttaaaacccatcttctgttgaaatcttacctgttcttgaaagagggcgaactgtaggaataggaaca

SEQ ID NO: 48650 - DNA, 728 bp, Bovine  19866880713227
tggtgtggccaaaaaaaaagattcaagtttaagtggaccctggcagtgcaaatctatgatgttcaagggtcaactgtacagaaggttgaaggtaaataacttacttttcatctttccactattcactgggttacacttccatttatctatactctgtcacaaatgatgactatttcataaaataattaaacacactaggtaaacttattacataaaggaataaggttaatacatgtgtaaactggaaaaataatttttaatatgatgtcctcctgccctgagacacaataaatttcatcttaaaaagagttaaagtatctttaagaacacaacaatactttgttataaaacacacatggatacttccttaaaaagactaatgcttaaagctccaaaatattacaagttagaaaaatacaatttccggtttcctaagtgcacctgttccttgtagattcgagtcacacaccttgtgttacaagcaaacagtacagcgtgctaggagaaggtgtgtctgtgaaagtcccagcaaagtaagaaacccactcacagatatcgtccgtggcgtcctctgcacttttccctccacagcacatgatgaagggcactcttcgctcaactactgcccgacattgcacacacttcttcatcaggctggcacagtctgcaaagagcaacacaacgcatctcacagaaagaaaacgtcaacaggggtgcctccctccact

SEQ ID NO: 48651 - DNA, 1599 bp, Bovine  19866880720706
tatttgtgtgctttagcaaatactttgctaaaatgtgtgctacatttctggctaagaaatgctgattacaggcagtcattgattacagattaagaaggcaatctcctacagagggtaaatctctatcagctaaggagatgctgcatatgcttaatgtttgaaatgataatataggctggtataaaattcttacagtctattactttcaaaatacatggaaaaaaataattgttgaagactccataaatattatttgtcaagaagaaagttttagacacaaagttttactcttaaaggcaccatcttctattaaattctctggattgcacctaaaattaatagctaatttcatggtcaaattactattctcccctcaacaagggatacacaagaatattgacatagcacttggtcacttgtgttcactgtaagtcagttgtgacaactgaaggagcctttgctaaataaagcctgaatcttgaattcctctatttggaacaattttcattttcaaaatatatttctgcataattaaaatgttaattatcatttcactatttattattaacatttcagtatcttttcattattttcaggtatgactagttatttatatatattcacctctcccttatgaaaggtaacatgttttattgcttttatcccttatttgagtgatttttaaatcactggagccaacaatcaagtactggaaccctgacttatagcatctgacaagggtctgggaataaaaacacacggtaagtttctgttggaatgaagtaagtattcactactaatgctgtagttttaaaattgcatttcattagacccaagttctaatggcagaaaatatactgcagaatcaaattattaaaattgtaggaggagacatcattgtaacgaaagctagtatttcagcgccaagagccaaatgccaacttttttcttacttgaatacctagtgacatgatgttctctcatttattctaaatgagaatttagaatattctcttctctctcaaatgacaggctttatataaatctcttggacagtttaaaggctagacttaaaatccaggatgaaatggtttttgctgagtccagacacatagccagaaatgtccccaaataaagtcaacttcattatcactgcagttgttactaatatagtctaataatcacttccatcttgaaaataagtggaaaccatttaccagctcatcaaaattccatatacatttggaagagaaatgtcaagtagtgcgatgaagaaagacagtcttttttccaatttgttgtggttgagtgaactctggcagaacacatatgctatgaggtttgtgggtaaaataatactttccaagatacaagtgaactgaaaaaaaaattcactcatacttttgaaatacttttcttcttgcctaagatacaacctaggctggttctgaaaatttttctcaaacactatctgcagggatctcttcagtcacagccctcagcccttcggccacctagacacattaagtcctgctggagtattatcctgaccagagtgcaggcctcctcactagaggaattctcagaagttttagacta

SEQ ID NO: 48652 - DNA, 1671 bp, Bovine  19866880723215
agcagccttgctcatctagcattctctgtttacacggaaaactacttcttaaggaaattattttaggaaatgcaaagcacatgatagagactttattcaaaatctcccaacactcatttaaacatctaacagctgagaaactctcaaggcttagtctattttcccttttaatcactgtgtacaagaagcacagtgatagagcttttacatttaaaacaaaatatccagagaaaaacatctttcgtccttgattcagctatctttcacagtattttggtcaggcacaccatgtttctaaactaaagatcttgttggtatatatgcagacacactttcacaaattgttgaatcattcctcctaatgctgaaggtgttatatgctactaatacatgatataaaatacaccacaaaacaatcattagtattttgatcatgtattcccaggtgacgcagtggtaaagaattcacctgccaaagcaggagacgcaggttccatccctgggttggaaaggtcccctggagaaggaactggcaacccactccagtattcttgcctggaaaattccatggccagaggagcctggagggctacagtccatgagatcataaacagtcagtcagacataactaagcacacacacactctctctcacacacacacacacacacacttattatcaaaaaaggccaggctacaaaatgttaaatgaccttccactattaactatttatgtatccatttaaaaaaaagtttacctcctctccatcccccagagcatcctctcaccccactttttgcaggaaaagaacgaacataatcacaaagattaatggagcatcaataaagtattttaggtacaaatgacccacttttatgtactgccagaaaaactcagcaagagtttaagaagaagaaaacctgaagttcttttccactgaattcatgtagctggtggtgatgaattgattgttctcttttaatggcagggtcagaaagacagagaggaaacatagctggctatattttttattaattagtaaactgttttttttcttcaaatattctatgtcattgagatgaattatctccagtccctctcaaagggtaactcatctttctagaagagagggcaagaggggcataacagaatgatttttctttcaggaagacaaaacataaaacgttctctctttataaaggaaagaggaaaggtattatatctacgcccctccccgagatttttattccttggaattgtttcttaaacatatgtgctaaagaaaatcatcactttaccttcaaaactcaaactgaaaatagactggtaactaatcaaatattagatcctgcctgaaagtcgagaatctcaaattgtgaacttatacctatttatctaagtatcactatcaagtgtaaattaaagtcacttactcagtcttggctacgaattctcacaaagatctgaatctggtcctgttataatacaattactagttacttccctggtgactcagtggtaaagaatctgcctgccaatgcaggaggctcagggttcgatccctgggtagggaagatcctctggagaaggaaatggcaacccactccagtattcttgcccaggaaattggacagaggagcctggcgggctacagtccctgggggttgcaaa

SEQ ID NO: 48653 - DNA, 1284 bp, Bovine  19866880802278
cgctgccaggcaggctctttaccactgagccactgagggctgacccctttaaaggcagagaaggaaatcccgggcccattttcaaggagagtaatgaacagggagttaccaaagcgaggcagccagaggttagaagcacacagggtactcttcccggtcttggtaattatggtatgataaaggaatatttctcaatgtccctggcttcaaatccaccagggaaatgagggcataggatcacatgtctgagctggaagggccttgagaccatgtggcacagtgtttcactggggctgtgaacatctggggctcatttactgcataggatgtctccaggtttagcatttcatggtcctcatagatcccctcaccactgcgccaggaggagaaccatgcattttggcccagccataattttataggggatggaattgagacagagatggaataactttcccttttcatccagacaggaagcagagctggggctaaaaaccattccgattcagaagccagtggtctttctacataaaccacagtgtttttcaacagacttagagcagaccaaagctgcgataacacaaacagtccagaaatttaatggcataccaagtgtctagattaaaaaatccctaagtcaccacagaacatgctggtgagagtaagtggtcttggatggtggctctgctctgggaagctgtgcccttgtttactgtactgtgccatgatggccgaggagaggacctgcttggtggcacatgtcacattcctagaactgcacagaaccgcccctacctggtctgctcctgaacactgtgaatgttccacaggacacatgagtcatccatcacgacaatgaaaggccagacacactggcgtttaactcccagctcttccaggcggtttctctccagctccaggttgtggtaagacaactccttaatgaggaacctggcagcacctggaaggcaacacaaagacggcttggacgttcccctcttgggcttggtggaggccccacagacgcatcccattctctccgtatgcgtgcgtgtttgcctggtgactgtgcacatgggggttgaccagacatccagggctgcgattcccacacatcagtgcaggcaagaatcatccaggaagttgtttaaaatgcagattcctggagcccaccaccagaggctcacactagtggtgtctgatgaggggccagagaccttttcacaggtgattggtgagctgcactttgaggagtgctgctaggattcctgtgcttaggcttcc

SEQ ID NO: 48654 - DNA, 1383 bp, Bovine  19866880803868
tttaaataattcttagtccaaaagggtccaaaattcacaataaacaaaaaacagcattgggcaacacattacactacaatacaagaccagctatttctgccacgtaaaaatgacctagcaagctttgaaatttgaattggacacatcttaagcagcatgcattgcaatttgctaaatgctcttacaggctaaagccatcaaagacataaatttaagaaagttattttcaacattatcaattaatttcgtgcctcagtagccagatagtcaatctgcaatgtttaaatttacaatcaagcataatttggccagctaaactaaaacacttatgtaatataatattccaatactaatacaaaatgaccttctcttgaaaaacttccttgctcccaacaaaatgaaatatgtttatagtttaaacagcaatgttaaattatgggaagaaaaactattagaatagcaccatctggttaagttgtgtgtatgttttgggtcacaaagctgacaatattagaataaaagaaaaaatatggtagaggtgagagggtacagagagggaaccctaatgacagctcttccaaaacattaggaagaaatgctatcagtatcttttagatcccttctttttgaaaagaatacttcaaatacgcaatggctgcatgataaattctgtatgtgcttagaagatgacaattttttcaccgtgtgtatcttgctcctgaagcccagtaaatacgtttttgagtgaatgcatgacagttttggtgggtggtgtttttttttctttcctaacgattctaggaaaagcaaaagctccttcgaggcacaagataaaaagatgatcatgacaagggcacgtcctaactgggagtactgctgagacatatgataagaggtagccatttcatagaattagaggaaagtcacttaaaaaatgatgctcttaaacttattctctctcacaaaccaaaaataaatttaaaattatttttcaggtgcttaaaaacacgaatgaaaaaacattttcttttcactagacaaatttcaaagtggtacaaatggagaaaatccacaagtgtacaccactacagttacagtgactttgtgccttttataatagtttacagggtattatatttttaatatggacgaaataagctagtctggaagatgaaactgccttttagggatgtaagcttaagcactgtagctcagaagacctataacaataagtgaagtaaagctccagactatacaattctctggttggtcacgctaagcacgagtcagccagtgctccctccttacagtcggccttgtggaaaagagatgggcagcacacggaggaaaaccctgactgacactgtttacagatctgaagaa

SEQ ID NO: 48655 - DNA, 1381 bp, Bovine  19866880805915
cgtcatgtgggatcttagttccctgactagggatcagacctgtgaccctagtaggtggaggtgtggagtcttaaccagtggaccaccagggaagtccctagagtttcagttttgcaaaataaaagtaattgtgtggattggttgcacaacagtgtgagtgtacttaatactactgaaatgtacacttaaaaatggttaacatggtaaatacaatgttttgtatcttaaccataattcaagcaattttttttaactccctgaattttcaggtagtattttgtcaatagtttcagtctttagaatgagcttccctttagttttataggcaatctttcatttaccatttggtttctttttgctctgtggccctagctgtaaggcactaggatatagttgtcttagattctgtttgtttttttcagtaattagttgaaatttcccaatttcagagcagcaagaaaagaggaattgtgcttttaaaattaatattaaagttaggtcatattgctgttatttgtctttttaaatgaggataagtatagaaaaccttttgtaaccagttactgtgctacagcacaagtatgaattactggagtacaggtgattatagtcagtctttcatacttatttgatataaagaaaatagagaatgtttaattttacctttgctcaagagtttctggtgacatcaaaatactcttttttttttttttttaatataactagaacaaaactattaaagagaaaagacttaagacattataaaaaaaagtctgaagtatttcttctaaacttcaatggtagaattatcacaggtacaaaatacatactagttctcatttataagtatttgccatttgaggctttagaactgagtgtagtgttaaagatactttctcagttcttttcagttgttattaaatgctgtggagtgaatgattactaaaatggaaagcaattcttaataaaattacatacagatttcgaaagttagcatcttcatttttgtcatcaacatggaatgttgttttaaacacttctcactctatgttcacattataactttagagactgatattctcaaattattctttcgtgggggaaaaaaaaacccttctgtttgttttttataaataggatgcaggacaaaaaagatttggagcagtttcctgtaatgtttgtggcatgctttacactgcttcaaatccagaggatgaaacacagcatctgctcttccacaatcagtttataagtgctgtaaaatacgtggtaagtggaattcatgacttctaaaatgcagaatcagatcattagagatgaattgtcagattcaagtcatgaaaaaattttgtctttagaaaatagcaccatatacaaagcc

SEQ ID NO: 48656 - DNA, 823 bp, Bovine  19866880902127
ttaaacagatcatttcaagtatttgatctggaatcaccagattagtaatataaaattacatatgccagcttctttgaaatgtttggcaaatgtctagccaaaggctttaattacagttcactctcaattataaaaattaaaaggaagtatacttttaaaaaaatgtatatgttactttgaaattctctgatttaatattccaggaatttacaaatcctgacaacaaaaattataaaaactttgaatataagagttaagatttttcctattagaaattaaaactctttatcaaactgattaaaataccagcctaaaatcataattttacctctaactacgccttcggagaagcctaacaacatataatttaaaggggtaagattcactttagtagacacgttaccctcacaatctgggtgtgctgccgctccacggcaaggtggagggccgtctgctggttcacgttctggatgtccaggtttgcgtttccctgaaagaagaacaaggcttacagttaaatgtgacaagagggaagcacataatctagctctctatgaggaagccataacactggatgctgctgagcacgccccctccaagggctagaccttgtaatatatggtaacagatgtgaatagcaggaagaagtggtgggacagccaactttctgaaatagaacggcaaatttaaaactatttttactgtggtgattccacctaaggacagttacaggacaaaggacaatacagagtcaaacacggctcccttttaatctccattacagagccacagacataatcagctcattttaagtaagtacttc

SEQ ID NO: 48657 - DNA, 1101 bp, Bovine  19866881016481
cacagaaacgccaaacttccggcgacgacggcgacgcctagcccgtcagatgggagttacctgggaccgtcttgggcgcgcttgcgcaacgctcttcttctgcccgaacccgctccgttgacgtgcccagagcctgaagatggccgccacgctggctgcgtgtcacgccgtttttcaccccggccgggacggcggggcttcggggagaggcgagcccgcgtccggccgcagcgcaggcgcggttggaggcctcgcgtgcgcgcctccacgggtgggcgccttgtaccctaccggcggccgcttcccttgtttcccccctgtcgtctcggaataaagccacccacgcgcccagcggtggaggtttgtcttgaagatccgtcgccaacggttcttctgttggttgcaggtactgctctctgcgacttccagttcagatacctctcatcttccacacgagccagtgtacaaaaaaggggaggcgattgatccgttctccctccttcccggcattgcactccagcgtctccccaaaatccagggcttccccgtctccttgcacactttgctccttgggcatcagagcacaagagtcgacaagaaattgtaggaagttccaccaagtttagtaacggcgtgtgttaagacaaacctttggctcttagaagcctccaaagattgaacctaggatcctaggattcttgattctacactgcttttgaacacgccctctgtgcttctctttgcttatttgtaggactgtgaggatgggtaaatgagtcctcttgcctttgagaatctgaagaggtgatcataagtggattctcccccatggttcttactgccctccttttttgaagccaagtccaccccaatataccctcttaagttgctgaagcctgatgtttttttttgcatcatcttccataaaactttatagagctgcctgtcagtttagtctggagaggtgctatggtttaaaaaccaaaatgagaggccttggtgggtgaagccattggccacgacaccatatcttgtgataattggcaaaaacctgtctgccgcccctcacccccacatcccaaaaccttgacacgttcattt

SEQ ID NO: 48658 - DNA, 1422 bp, Bovine  19866881031740
catgtctccaagtgttttgaatgcaataagttcttaaaggctaggtctttgcacgggcacttttaagataaaactcaaagtgtatatacaccacattcttacccccgtgtgcagttactgttgtttactagacttgcatagaaactgccagataatctcagatttacattaaaaatagaaaaagaagttcccaaatggaaagttactggtagatttgttttttttttttaattctgaaatgtatctggggaaaaaaattcttagaagggctaaactcctaaccataaatataatatttttcagagattttctaattggttttgaaagtatccctaaaggataggttagctgttaatgatgagctttcttcacttactgattcaaaggtgtgatgttagttttcccctgtaggctgttactctgcttctttgcacttcaaacagatctaaggtcactgatgatgactttgccacttcctgccctattgatcttacaaaggggttttgtggggttagaccttactgtaaagaaatcagcccaagtaaaaattcttgatatttgcatgtctattaaattcaacatgttggctttttatatgagcctgttttattttataatttataatgtgatacttactgggtcacaaagagttggacgacagagcgcacgcgcgcgcgcgcgcgcgcgcacacacacacacacacacacacacacacacacactgccccagccctggctgtctgcaaggagaggaccccgaggacttaggagggaaatgagacagtccctccagggggcttgacactgcagagtcttgagagggaaaggagggtaccctaagggtccgggaaaaaaccgaggttctccccgagttacgaaagaaaaggggaaccccacgacgattgcagtgtccctcggggtgcgcgttggtgaaacggtccccatctgaagcccggggtgcagatggggtctcacggggggttaggattagaatggcgcccccttggagacctggataaagaattggtgccctcagaaatccaagaaggacggggggtgggtctctccaccctcgggctgggacgcagaaaagaccttgcgggaggcggggacgcggatggagaaggggtcccggggctgggtacgggtctctctcggagtccagatcgggcagtatctcacctgcggagagttggggaggcgggcgtgggggtcggaagtctgctccaggcccacggggagaatcgagctgggcgctggactggaaaccggcgaggcaggggtcccggggacgccccagacccgcaccacgcaggtggcgcaggcagcggcaagcagcagcagcgcggcgctcagagcccagggcagcgggttgcagacgcgacccgggggcgcgggcgaccgctgggcctcggggtccgg

SEQ ID NO: 48659 - DNA, 2692 bp, Bovine  19866881079319
tataaggttttgatacatagtgatcgtatctaaggaagcataattttgctgttaaaattctgtgattttaaacaatgatttagtctgctctagccactccagtgtttttgcctggagaatcccagggacgggggagtttggtgggctgccgcctatggggttgcacagagtcagacacgactgaagcaacttagcagcagcagcagcagctcagttaataaaaaatccgcctgcaatgcgggagaccctggttcgattcctgggttgggaagatcccccggagaagggaaaggctacctactccagtattctggcctggagaattccatgaactggatagtctatgggggtttcagagtcagacaggactgagcgactttcactttcacttctgagctttgtgttacatgtggtagagggggctgagtgttcttcctgctttttacgaattcaaaatacaatgatggaagacaaaagtagtacagtgcaagatttgcctcacagatagtaggcacttaataaaaatttagtaaattgggggagcaaaatctagtaaaaatccaattctctcccctcacggacaaccagtgttacatttcttatatcctggctatatattttagtcctaacagtagggatgatcataccatctaccatagggacattgaggattaaactaaaatgccttagcgtaccatttctggaacatagagctcgtaaatctaatatagtaccaactgtggcctgatagataaattggttgccttcctttttatgctaataattgccctcttttttccctccaggtgtagatgtcagtatgaacacacatcttaaagcagtgaaaatgaccctgaagaacagagaacctgtacagctggaaacactgagtattcgaggaaataacattcggtattttattctgccagacagcttacctctggatacgctactcgtggatgtggaaccaaaggtgaagtctaagaaaagggaagctggtaagtttgaaggattataaacatttttgtgtatggtatatttataccctaatccactattcaaaatatgtttatatctgcagacaacacagattggttggttgcttttaattgcctatgctcgccatgagtacacctggagtttcttacggttcctggtattgctgttcaaaagaccagtgttgtttggtcttacctgctgggcctttttgcacggcctggtcccgcattccctgcacactttggaacatctggggatgaaccctttattcctgctattctgaaatttcttaatgacttagctttttgtccatttcattgttttgggtacttggcggaccctttccgtatggatattcttgtattttagagctaagaaatttacttgtgtacctttataaatttcttctgttttgcttattctgttctttcttcctggaattcttaataattgagttttctgactgagtcttttctcttatttttctctctgtcttttattctgaacttggtggttgttttctctggtttctctttttatttaacctcttaatatgctctttatgttgaaggctttactgtagtatcttgcactttggccatccattgtttaagaaggaacctgaaaagagaacttctggaaagggaggctggactgcttcgctggtggattcaaagtaaatttgcttctcccccaaggcaaccccacattttaggatgtggaaatcttttctggaactggttttctcagaaaaagattctagtcacatgggagacgtgtctggcaaccagcatcataggagcaggacaggagaaagggactgatactaaacttaccacaatgatttttagacttttcctctcacccacactaagaaatatacttttttgcattatgacctattcattcaaaatttcacaaagaactgtttagtcttaatacatgcagatgcccttaagtttcctgtcctattctctttcagttaaaaaaaaatgttcaggctataccacatagctggaaaaacactgacttgatccctctcttcgtccctctggctctgtgacttttgctgccatccactttgcaactgtgttcaaatccaaaccctttctgcttcaaggtcttaaggttaattttctctttcctttcctgcctacctgtcagggaaataggcttcagcgttgcaggatggggaagagggctagccagtctgctgccccacatgagggctggcagcctctttcccccctgttttcagcctcctgcctcaccttacccctggcttccaaggtcctaggtctttttgaggctactcttcctttactaaacatttgttgttctcagtttgttttctgacttagaaatttgttgagatgtttaaactactgcgttttttctgtgccctcgctccatggatatttgctatttttctttcttttctatcgtgaatagtacctcagagcgaattgaagataagtgtggttaatctgccttgtttcaagagaagtgctagatttactctattgctttgaatgataagactccgaacgatgagtagaaatgtcagggttttaaaaacattcatagatacctgaaaataggaagctcagagctaggatgaccaggtaacagggatattgttacggattaaagtaacaatagattgggtcaaagacttaagattcggaagaat

SEQ ID NO: 48660 - DNA, 1280 bp, Bovine  19866881169863
gagaaggaagaagtggataaaggtgagaaagtgggtaagaaaggaaaaaagtatgttacaaaacagaataaaaatcgtcaccatcaaatgattattgaaaatagcttacccagccgtacgagatactgtattgtcagaagaatcatgttttccacgctcaggagttggctgccagtcaaccctaattgttccaaatccttgttttccaactgtggaatcttgtagcagttcaccagcagaggactgacaacaatgtcaccaacatttccatagaaatagggtaaagtgccatagcctgccccaacagaagcaggtcaatacagttcaacatttcctcctgaggtccaaccaggtatatttgctcaactaggatccacgatgcctaccaaagttccctgacctctgaatggctaccaaacaaatgactcaaatgtatcaatcctagagaattcactccaacgctctaaacgctacccttttattaaattagatgaacaggaaacaaaatactcaaattatattatatagggacatgctaattaatatctctgccagagaggattgatgaaagtttgcaaaaacatctctgtatcctttgtaaacctgcaggaataaaatattttcagataaaattcctgatcagataagaagtcagagaatagacagactactataacatgcttacttcacttcttcaggttttcttttaaaaagtttaagctaaactcatagatcaacagcaatattctgccagtcacaagtattaatacttggagggtcttactctttttgctatcttagctattgttgttatgttctcttcctgaatgtcaataaaagtctcaaatcatcttaggagtagatagtacaaaatgtgttgaaaatacacactgtgttgatggtctggtggagagaacagtccctccatgagtctttctaaaaggcagacaccaaaggataagttttacttatccttccaaggcttagctgcaccatgcatgtaactcgaatgctcagtaagcacttcctgactatatggaatttaaacaactggatttcccccagtgcctgtaggttcagggagcagcctgataaagaatagggctcaaagcaaaactatccatgtcagtaggctcaagccaactgcaagaaacagataacacctcacatagacataccattaaagatccactgggcttaaacaccctatctgtttagtacccgggggtaaagtcagcagtcttctgctggcctcggctagccactggacctcccccgcc

SEQ ID NO: 48661 - DNA, 1031 bp, Bovine  19866881202700
cctttttggggatcttattcatttcactgtaatatcattaggtgtaacatcttcagaattaacttctttcatttcttcctgctggcaagctttatttttatcaccatatggttttgaccctaaaaatgtactttgcgtcacttgctgatgcgtttctaacgcaggtagtgaaaaactggttcgtaataagcccgatttaggggaaaattgagagtctaatttattttgctgcacagagttaaattttgagagtttaattttagtccagttggagttctttttagttgagttgtttattccatttagtatacatttcacaggctttgtttttctactggggaagaaacgattacactgaacgtcctgattcgcttccttctgatgaagtatttgtctttcagtctctgtctcttccaattttatttctgtaggcttctcctcctttacactttccatttgtgaagattccttttttacctctacagtatctgactcaatttcaccagcaatttcttcacagagctggagaatgctcccgcgtttgcttgttcctgcttgctccagcccattgtctccagtttgttcaggcactgatggctgtggacttttttgggattttgcactattattcacttgtgtgtgaactgacttcttcatctcgttctttttagagaccactgaagtagccactttggatctttttatctcagaagaagattttgtttcttcttttctagtattctccagacacttttcagatccttttatgcactgagaaccagaagtataagccgtctgatgctccactttgcgcttttttcctttgggggaattgatcgcttcattagtgacagaattttcttcctctttagaatcagactttatttccaatacttttcttttcacatgtttctgatttgttttagctttattagatttactctgagtattgttacagtgctctttttttgttggcggcaaactctgtttaactgcttgagcctgacccgaatttctctactacgcagaga

SEQ ID NO: 48662 - DNA, 1280 bp, Bovine  19866881270991
cagttttataagcgtctagtatctaagggttctaatttctctttttggcttctggtctttttctttcagcagaatttgaacgtggtcaagagccctattttcaccccctccaccggtcgccacgagcacggactcctaaacctctttcacgccatggagggcatcagccacttgcacctgctggtggtcaaagagtatgagatgccgctgtaccgcaaatactggcccaaccacatcatgctggtgcttcctggcatgttcaacaacgcaggcgtgggtaagggggcgcgcgggatgccgggcaagggctgggaagagagataccaagccaagctccattcctcaggcttccagagggtcccatgaccctggaaagtgtcttgttctgtggaccaaacgacttttgactctttaaaaaaaaattatttttggctgggcttgctcttcattgctgcagacttttctctagttgtggtgagccgtggctactctctcgttgcggcatgtagacttgagtggttgcggcacgtgggctcagtagttgagtcccagcctctagagcacaggctcagttgttgcggcacacaggcttagttgctcctcagcatgtgggatcttcccccgtcaggaatcaaacccgtgtctcttgtgtcggcaggtagactcttcaccactgagccactaaggaagcccttgactcctctttaaatgagttttcatttctctttatcttcagtcttgcagaattttttaacttctgaggactagcatccaaagaagtcactgatacactgagcaccctgggagggcttgggactccggccagcacaggctgcaggtgttgctcgctaccagctggcagcagggacctcacagagaggacagtcagaggaggaggggggttagcagttcggacccaggtctggtgggatcgttgggggtcatcgctgatcttaaaggcacacagcaagttctcgggggttctgtacagctggggactgaagcaccatcactgccgatggcagtcatcttaaaagtgcctggaagtccttcctgcttttcccctcgggatttaaggtcagtgggctgattttcaaggggacacctggctgttgagtgtactgacagagcgggaggaggaactagagacagaggtccagagctgcttcgtttacccctgaaggcaggagacctccaaccggatccagcgtcctagagctctgctctctgcccactccctgcatttcactcactccccatcggacttcaggggaatttcg

SEQ ID NO: 48663 - DNA, 1116 bp, Bovine  19866881277978
gggtcgcaaagagtcggacacgactgagcaactgaactgaactgaactgaactgaaaaggtagttaatatacaagtgaggtaatgtgatctgagagaaaattaagattacataaaacattatctgtgtaccagaactggggaatgaggaaaggctctaacgtaaaccacattgcttttaaagaaacacaaaacagaacataccaccagacgcgttgctgatggctgatcccgcggacgccaccttggacaccgccgctggattatacgtccaagatgttccacatacttccacctttaaatcactgtctgaataaatctgctgtactcggccaactttacctaaagtcttaacaacaagattagatttatgtttccaagtttacattatagaaatcaatcatcagtttttacatgtttgaagtattcgttttacttgattcctaattttaaaaacttttaaagaacaatcgtattcaaatgggttatttactagccacaaactttatagagtatctttaaaaaatattttaataaaactattacctttccacaagattataaaaataatcatgacaatcttattcaaaaaagtaaccttttaagatacctctagaaaacttgtaactaaagaaaatctgatttctaaaaaaaaaaaaaaacttaaaccaaaaagggctcaaagcttacatctatgtttaaatcctttttggaatcaagcctaatttcaagacagaagtatgaaagtcactgtcattctggggtgaaggatcaggaagcctctttgtctcaccttaacattacattctccactaaaggctctatcaaattagatttatctatcatgtattaactatagccctttaaggatcttcccaggctaatctaagggcttccctggtggcttagcagcaacaactacacctgccaatgcaggagacccgaattcaacccctgggtcagggaagatcccctggagaagggaaaggctacccatatttttccctggagaatcccacggacagagaagcctggtgggctacagtccatggggtcacaaagagttggatacaacctaccaactaaacagacatagagaatggacttatggacgtggg

SEQ ID NO: 48664 - DNA, 1020 bp, Bovine  19866881295537
ctgagggatggctggatgaataattaggtttaaagagtcatgggcagagtaggcctgcctgaggtagtggtctttcccagaggtgtagctccccacagcttctgcttatatacccagatttgggctcccatccatcctatttcaagaagtggaccaagtaagggttggaagtgggtcttgagcacaaaattcttatacataatgcttttctgtgttttgggcatcctagcggacagtactcaggaggctagagatcccagggccctttaccatcttgcctttgtcccctaaaatcccccaggtctaggtgatcaagcttctgacaggtgtcgcctgccaacagagcacttgcctgcactgctggaaggctgagggcgggcttcctggtgtgtcagctgcccccagcgcttcctggaaggcagtgggtgagcatcagtgcacttgaccaagaacaagtccctgtctgctctcagccgtagccagtggggccggccaaccggaggcttccttgaaggtgaggaggaaagaaaacagtggccccattgaggacctaccaagccagctcccgctttggcacctaaaatggtcagttttacctgatcagcttcatttcgcaactcggttatgtgattcccaagcactgcctcttatctctagagagaggtgtgaaaacagagcctgcttggcacagactggctgcctacaggaggggctttgtgttaggcccaaggctggtggggtggaaggggacacgggaggccacccccctaggcttcctgcttgcactctaacatttttgcttcctttcattcacatcagatcagacacaagttcacttgcattaaagagtagacccttggaggagaagatggcaacccactccagtattcttgcctgggaaatcccatggactgaggagcctggtgggatacagtcggaccaggcaaagagtcggacacgattgagcacgcacgcactcaagagacacaatattactaaaggacagtgtacaaaaacaga

SEQ ID NO: 48665 - DNA, 1502 bp, Bovine  19866881311291
cattgcctgcatatccatccaagcggtttgcataattacactacctaccatcacaatgaccctgtcatttagatatttttaatccccatttttacaaatgatgacattagggctcagggaatttgtttcaaattccaggattcttccccgatctctccgtagcccagcccaccatttttttccccaagacaccacagtcaaagctttcttccttcccatttttttcattgccacaggcaacgtttgggaactggcactgtgttttctcctgccgggtttacccgtcagaacacacagaacctctttagactgtcccctgagttattcccaaggagaactattactacttttaccgcaactactactaaacatggcttttattcactgagcatctactatgagttcagcacatgagtttatatatatataatcttatttatttctacattgttgttgtttcgttatttcagctaagtcagtccaaccccgttgtgacctcacagactgtagcccactgggcttctctgtccatgggattcccaggcaagaataatggagtgggctgccatttctttctccaggggatcttcccaacctaagaattgaaccgacatctcctgcttggcaggcagattctttaccactgagccacctgggaagccccatttatttctataattatacttgttttatatgttagaatactgaagcacagaaagataaatccatttgctcaacatcacaggggtagtaagtgttgaaagtgggctttgaactttgaatccagagtatgcaattttcagcactggacttgaaatacacaggtacacaccccaatctgttctccctatttccttaatcattttgcaaatactcactaataaaagaagcctgacattttggaagcaatcaaaacagggagaaacacatgacaaacttttcccaggacccttctgtgggaaatggtgtcaccatctacccagttgctccagccacatatccgagtcctccatattcagtgtattttcatatatccgtatatattctgatcatgaagaagcagggtcttatttaaactaattggcaattcttctgtgcaacagaatttgagtccattaaaatggtgattattcttcctgagctgtgaactatcgacgttagttgtattcagttttcagccatgaaactcattatatacatcacgagaaatcttaactatctgctgacaagggccatccctcctctgaacaagtgagctacccagcctaaaataaatagaaacttttatgactggccacattgttttcacttctaaacaaacctccaggaaagaacgcccattaccgacatgtttgtccattgtaaagggccatcattaaaaccaacaaagtttaaacctttccagtgtttggagttcagaatctggggagctgggctgggggttgaaggaggaggtggcatcttttaaaacagtaacttttaagtttaaaggcgaaacttcc

SEQ ID NO: 48666 - DNA, 1573 bp, Bovine  19866881677332
cagaatctcatggacaatctcttctggaaacagaaagccacgatccagtactctcttctttaaatctgttctgctttggcttctatggcgccgacactcctgggtcttctctcacctccctggttactcctcagcctctctagtgctgttttccttctgttgtagcttaaaggctgattttctctggggtcccctgttcatcttcttattccccatgctcccttgaggtcattttattgacttgtggtttgaattatcacctgcagtccaaattgctttcccaaggctcagagcactgtggccactgcctctggaaagcctctacatatttggattttgctgccccaactctagcaacttgattcttttctgtgtttcacttttcagtgaatgtcagcacgatcttagttgtccaggacagtcatccttgactatccctattgttttatttcccatgtgaaattgatcactaaatcctaattctatatcccaaattgctttattttttttaaagtgtttaagttataatttactcaaatttatttaccttctgtctttgctgattcttctacctccctgtgttccccaaatagaagcagcctcagggactccatggctccctttttcctctcctttctactgtctatctgagtcactttcactttttcagcttttcttccttttccatcatggtttgttataggattttcaatatagttccttgtgctatgcagtaggatcttgttgtttatccattctttatataacagtttgcaagtgctaatcccagctccccagtccatccctcctcattcccttattttggcaaccacaagtctgttctctttatctctacttcataaataacttcatttgtgtcatactttagattccacatgtaagtagatatcacatatgctatgtttggtatttctctttctctttcttacttcacttagtgtgatattctctgggtccattcatgttgctaaaaaagataactttatttcattctttgttatgctgagtagtattccattatatatatgccacattttcttttattcatctgttgatggacatttagtttgcttctatgtctttgttattgtaaatagtctgctatgaacatcggggtgtatgttatctttttgaattatggttttgtctggatatatgaccagaagtgggattgctggatcatatagcaactccagttttagtttttttgagggaccttcatactgttttccatagaggctgcaccaacttacatcaccaccaacagtgtaggagggttcccttctacacactctcagcatttgttatttgtagcctttttaaaaaaatatttctgtcctttttatgtattaagtatgctaacgacatgcaaggccaccagtaactttgtgtttctttaattcgggttttcttgaaactgtatcatctgtggagaaagaggatttctatgtcacaaaattttccagccacttaaacttggagctcatcacccagccaaagaagtagaagcacttgtagtactacccagtcacaagctcccagggcgtactgt

SEQ ID NO: 48667 - DNA, 2046 bp, Bovine  19866880476253
tgcacatgccgtggggcaactgtgcgccaggactactgagcccaacgtgccacaatggcctcagttcgccccaactagaagaaagccagtgtgcagcaacagagaccaagcacaaacaaaattaaatgaaaaagaaaatcattttttttaaaagctgaatataatatagaccttatgcttacagagcttacattctatgctaattttaaaacaaaagcttgtatatgtacctctaattttttctggtatttttcacattccaactgacactgtgtgagatttcttgcagtctcctcttgtagaagttgagcacgctcactttcaaaagattttattttactttgatggagatattctgttactttgctttctgcactaagttgtagttctctgtacctgaagaaagaaaacaattatgaaacaataaagaaatctcaatttatagaaacataagcagtacttctgcctgttcaatatccctatattattattcagttaataacttttatttattcagcaaagcttttgtaaataatttagatggtcgtgtgtatggaaatatgctaagtctggggaaacaaaacatgttgattaaacttcctctactgctccctttattttcattcttcccattccaaaatagttattacctattattattattttgcaagataagcatttaaaataaaaatggtaagaacaaggttcagttattacttaaaatgacttaatttccatatatttcataggctttcttaaatctatagcattgtttccaaccttgctatttcattctaagtctaaataatattaaatggagaagaatggcatgaaatatatgcattaacttgcaattcctgagacatatataaaataaattttaagctagtaaatatagatttgatttgtataagaaaacataatgtacaaattacaaaggtaaatatataacaataagcagtctattacaacacagataagaaacattctcttcattccataggtataactagtaataaaaacatttccatttaagatataaatcactgcatattatagatctgaaaatgcttcaagttgactatgttctaacagaaagcaaaacaaagacatagtatgctttttcagggagttattatgaacccggtataatgctagatgttcctaaaattcgattttttcaaatatttattgagctagtcaccatgccaggcaaatatgtatacagtggaagacaattttttttccccctttaaagaacttattttgggggagttccctcatggtctagtggttaggattcggcattttcattgccagggctggtcttcagtccctggtccaggaactgagaccctggctggggaactgagatcccacaagctgcatggtgtgccaaaaaaaaaaaaaaaaaagaacttagttttctggggaagagatgtaaaatatgaaaattcaatagaacaagataagtgcttcaataaggtaaaccctaggtttgatgtgtacatacaggaagaagaattaactcagtttgtgtagatgtgtgtttgagtacacagcaggaagaagtccaaggtggaagtgctctagaagtacaaacaagagtacacgcaggccagagaaacagagtatagtctgtttcatccatggcatctcatttaatcccacaactctattaggtattttgcagatgagaaaccagagattcagagattaattcatttcttcaagaggaagaacttcctggtagatttcagagggggtctcaagtccagctatgtttgacttcacagtaatgatctttccactgctacataagaaccttagctgatatttctgaagtcagttaaactttcaaacgtgttttaaaggaggtcgcttcacttcttgtgacaacaacatttaaaatataatgagagaagtaccttatcacatatatgaaaggtacttgtaaccagaatctctaaatcaaaatcaaaatcccagaaaatggggtttttgtagaaattgacaagctgattctaaataaacatcttctgaaaa

SEQ ID NO: 48668 - DNA, 872 bp, Bovine  19866880589541
tcatttgttgacactttaaaaataaattgcactttctattaacaaaacaaattaaatgtatcatcttattcagtcctcacaaatccatgatttaggaataagatttctgttgtacacatgaggaaactaaagtttgtggaaaataaagtcacttgctcaaagtcatatcactaggaagtggactcagagatgttgaaactataagctcttttccttaatgccccatttaccaaaaaatgagttaaacacacacacatatatataacccaggaagaactaatgcttatttcacaaaggtctgttgcaagatggtggaaaataaaatatttaaagtttgtgtatcctactcaagtcaaaattttaaaaactgcttacctaagacgtttattttgacaccataaattacctttaatactacccttgccctgatatacttgacctctagtcatagaaaatgaaacgcagcttgtacagattgatttttagatctctttattcaaagtaaaggataagccagaatcaaattttggtatgtctaatatttatgcttgcaaagacagtctggcaagtgtcaacgttgggtgtaaattagcattatgggaagatcagcaggtattggtgaaaaagctatcatcaataagaaagttctgcatgcatgcttagtcgcttagtgtctgactctttgggatgccatggactgtagccagccaggctcctctgtccatggggattctccaggcaagaatactgcagtgggttgccatgcccccctccagaggatcttcctgacccagggatcaaacctgcatctcctgcattgtgggaggatcctttactgctgagccaccagggaagccctaagaaagtcctat

SEQ ID NO: 48669 - DNA, 1831 bp, Bovine  19866880608644
atttagtatatggcttccctggtgactcagaggggtaaagcatctgcctacaatgtgggaaacctgggttcaatccctgggtccggaagatcccctgagaaggaaatgccaacccattccagactcttgcctggaaaatcccatggactgagaaacctggtaggctacagtccatggggttgcaaagagttggacatgcctgagagacttcactttcactttctttcactttcaaattataaaatatactttcagttttaaggataaacgttataatttgactttcagtgtctcaaattttaatatggtgccatatgtactttctttttaccttttatataagtcccacttcatctttttacatttcaggagtaaccagtcatctttaaaaaaaacactaattgtatgcccccactaggaagaaaagtattctatgaaaatgtctcagtcacgttgtcagattgaaaaaatattcttataaaataggtaggccaatgattgaatcaaacattgaagtcactgatctgatatctttatgaagtataaatttaatttttctttaattcaaatcatcaaatgtgtctttaatcttctacaatttcttatttgttaaatttgcactagtatgacagttttttaaacttggtgtattttttccccctagcaatttaaataaagaaaagtcagctttgcagcaaatgaaggatcagatggcattagatttggaacaacttctaaatcatcgtgaggtacttttccattttgtcttgctttttaacactttaggctttttgagaatcaaattgggttgagattattggatcccagtctcccatattcattatgagttaattcttattcctggaattcctaattcttgatgctcccttactgccttattcatatctccatcattgaatttccatgttatttaataatcatgtgtgttacacctttctccctacagacagtaaatttctttagtgtacctcttgtcttgtttgtcattctgtagccggtgcctagtgtacaatatttgtgttgaactttaaaatccataagttttctttaatttcttcctcatgaaaaatcttttagacttaatacaatccccatcttataaaagaagtaaatgagttttagggggtttgcctagagccagatggtcactggggtaacttcagtgttctttctcatttttaaagtcagatttattgagatataatatacaataaaatttaccctttctagcatacaattctgtgatttttggctaatgcacacaattctgtgatttttggctaatgcgcacagttctgtaaccatcaccacaagcaatatataagatagtttcatcatcacagaaaattccctcttgaacccttttccccaactctagtctgagcaaccactgatctgttttctatccctgtagttttgccttttccaacaaaaggtattatcctttcacagaatgtcaaataaataaaattatcagggaattctttgacagtccagtggggtaggactctgctctttcactgacaatgggacaggttccattcctggtctgggaattaagatcccacaagccaagtagtacagccaaaaaaggaaataataataataataataataatgaaattattggtcttttcaatctgggttttgttcagttgccataaaaaagattcattcatgttattataaatattagtaacttgtcctttttattgctgagtagtattccattgtatggatataccacagtttgttaatccatttcgcagttgagggtcatctgcgtcgtttccatttgggaacccttaaa

SEQ ID NO: 48670 - DNA, 754 bp, Bovine  19866880621978
cccacttgacttcacattccaggatgtctggctctaggtgagtgatcacaccatcgtgattatccaggtcatgaagatcctttttgtatagttcttctgtgtattcttgccacttcttcttaatatcttctgcttctgttaggtccctaccatttctgtcctttattgagaccatctttgcatgaaatgatcccttggtatctcacaaaataagagtaagaggtgatgatatatttgctcaccaaattgtgaacatcacttctttttagtaagaaattttccactttgagtaaaaatatagattaggagttgattgtgcctcttagtacctatatttaaaattcttcagctatttttcatgtgagataatactctgtatttatgtaacacctttcttcttaggacctcaaagcattttaccaaaatgcattaccttatccatcctcataacatctcctttcaagaaaggcagtgtcaagtctaatgactacaattttacagatgagaaccctaagacaaatggagctagtgacttgccaagatcagagaaaaacctgtagcaaacctaggtgtagaacttgggcttttatgaattcaaaattctttccaatctcttctttttcacatctcattttccaatctcttcttaataatatgtctcaaatttgtcttaactttggcattcctttatctgtaaattagcatgtagagagtcatgctaatgattgtaatctaattttatctgtaaagtgtg

SEQ ID NO: 48671 - DNA, 807 bp, Bovine  19866880626817
agtgaatttgtcttctctactggattcaagcctgtaccttgatgcaaaattccctaaaagtaaagccaaggggaatttctatccatgatgttaatggaacagacaatgttggttctgtagattggccaagacaacatcacaattagagctgtaaaacggcgtaggacattaaggaagcaaggaggaatgcatagtcatccttaatacttcatgtttactaatagtaatctggtgccctccccagtattcatactgaattcaaggaagagagaactgtcaagcgtgctccctccttggttcctggaaagcgagtgtgtgttaatcagctgtgggcggggtgggtcctggagagaacctcttctggcctgtgggaactcatctagaaagtgagccccagcagttccagcctgattccttttaatgtcacagttcatttgcagaaccataactggaatcaagaattaaaaagccttgtataaaagtcagtaacattaaacctttaagactcatgtttcatgtgtcataaaaagtctatgaaaggattttatatttctgtacagtgttttagcactttcaatcacttttttttcaacataacttttgtgaacacttttatagcctctaaatgaaaaactaaactatgtgtcattcaaaaaaaaaaaaaaccttttatggatcacagaatttaataaaagttctgcaccataacaagcgcctgataaacctttattaaaattcattaaaaatactgaaaaatattttaacagaaattagacctcacattttggtaaacatggcaaatcactc

SEQ ID NO: 48672 - DNA, 919 bp, Bovine  19866880653648
gaaatagtatactgacatttgatagctcgagttggtagacttagaaggaatatgcagtcatatctgggtcttgtctttcattctcttgatggcccttgtcatgtattgtgagtttatcgtagataatttacaggcatcatgtatttaataactgcattaatcatatgatcacaagttatctaatcatacaattggtagcttttaggaatttctgttaatctacagtttgaatgaaatctcattatcagacctgtaaaatattagtatagtttttttttttttcccaacaaactgttactttttttttaatgtcccaacctatagtataaattctgatcttgattttttcttttggtgagatgaatttattttagcccttttattattccattaataatatgattttcttctttccaaggaaattgttgtcttaaaaacatcactagaaggatcttatttatttcctctgtgaggtataaatgtgaatacattcaggggaaaagatatactattgatttttaagttcagtgatcattaagcatttatgtccaaagactttttacgtgtgcttgattctgttgatttccatttcttatctttctcttttccccttttcattacacttagagaaacttacgtagaacaattacagggagaaaattctaatgacaggaatgatagagccatccgagtagctgcaaaatggtacaatgaacatttgaagaatatgtcagcagagaatcggctgcaagttatcttcataaccaatgacaggaaaaacaaagagaaagccatagaagaagggataccagcgttcacttgtaagtctccatgtaaccagactgttcatgtttgtaaatgcatgcaaaaattatcatcaggcccatggtcagatgttcatttgactgtttttgactgg

SEQ ID NO: 48673 - DNA, 2247 bp, Bovine  19866880761218
aaggacacggtaaatgtttggctgatgactgtgctggctactagcagcctctccacccacggccctttagcaccactctaccaaaggaatggttttcccctaggtaattaaagatctgttttagatagggatatgaataggaacatttcattatcatattaaccaattacagaatctgctgattaaaatcaacatttagatcaaactggtggagaagttggttggttctctcagtggatagtatgttttgctcaaaacatagtatttaagtttccattgaactgtaaactggaaaaggcacttaaatagccaaagaatatgttttatattagctatttcagcaatatctacccaagcaaaaaaaaagagagaaattttgcaatattaaccttaaccataaaggtttactgaggttttttttcccttttcaaccactggatttacctatatgacatgaataagatagagataatttggccttattacaatactgtattttcagttgtaatggagcagagaatcctgcttatatatgagtgatgataaaatatactttattattgcatcagaaaggaatattttttctctttgcttcctttttcttcttgatttgtctctttcagtttttgtctggggttgactgggtgcgattctaccaaacacttgttatacacattttcgtaaggtttttggtgacccatttgttacacagttgacaaacctgataggtgtataagcaacacttagaggagtttgccttggtacttttcatagaattgttgggaatttttagtaagcagtttgttcttcccgagatgatgaattgggcggattatacatatttctatctcttcttttttagacaagatgtgaaatggagaagtacctgacacctcagcttcctccagtttctataattccagaacataaaaagtatagacgagacagtgcctcagtcgtagaccagttcttcactgacagtgaagggttaccttacagtatcaacatgaacgtcttcctccctgacatcactcacctgagaactggcctctacaaatcccagagaccgtgtgtaacacacatcaagacagaacctgttaccattttcagccaccagagtgagacgacagcccctcctccggccccaacccaggccctccctgagttcaccagcatattcagctcccaccagaccgcagctccagaggtgaacaatattttcatcaaacaagaacttcctacaccagaccttcatctttctgtccctccccagcagggccatctgtaccagctcctgaatacaccggatctagatatgcccagttctaccaaccagacagcagtaatggacactcttaacgtttcaatgtcggccgccatggcaggccttaacactcacacctccgccgtcccgccgaccgccatgaagcaattccagagcatgcccccttgcacatacaccatgccaagtcagtttcttccccagcaggccacttacttccccccgtcaccaccaagctcagagcctggaagtccagatagacaagcagagatgcttcagaatttaaccccacctccatcctatgctgctaccattgcttctaaactggcaattcataatccaaatttacctgccaccctgccagttacttcgcaaaacatccagcctgtcagatacaatagaaggagtaaccccgatttggagaaacggcgcatccactactgcgattacccaggtatgtgatcctgcctggttgaagaatctgtgtgtgtttagtgtgttcatgtgtgccattttccacctcacattccagctgtacatgggagaggagtggttgacatttaaaaaaattcacctgctctgctcttgtcgcatcccagtctccagtgccttacccaagtaactgtttagttactttgtgcttatttgatatagtaaaaaaaaaaaatttggaatattatggggaaaaaaagttactggactctcttctttttaatgttaaatacgtgagagtcttgctacacttacgttgttactgtagcaatctaaattggagttcttaattctaaatgaagtaacctggaaaggaattacttaagtaacataggggaaaagaaggggtggcaatgaagagtggggttggtgcaagacaagaccatctatagaatagatttcaaggttggttctgatagcatgtgagcatatgctctttcttgaatgagatatgtggtccaaaatataaattg

SEQ ID NO: 48674 - DNA, 2020 bp, Bovine  19866880767359
atgggggaggagttatgtaaagacagagagcaggcaattgatacttgttagtaaaccagcaatgtacaccacaactaccctcccagggtttttctgtttgttttttttaattgcaggttgctcttctgcattccatgatgtcttcttcctctgcccagcccttctatgtggacagtccccagagtctcactcttgctttcttcccaccattctgttatcccccaagacaatttgttcacttaaaaaaaaacaaaacaaaaaacttttcattttgtattggagtaaggctgattaacaatgttgtggtagtttcaggtgagcagcgaagaagctcagctatacacacacatatattcccctcccgttcaggctgccacataacacagagcagagttccaattggtttacttttgaggctgtatataccaacttccaaatctacaactccagttctctgagttctccaaactgtagacttgcatatcgttgtgtattggatgtagatacagacgtgtttcaaactgagttagtcaacatgacccaaagatcagcacatccttctgtattcctcacctcagtgagtgacttcattaaacattatttcctaagttcttttagacccctttcacttcccagcattggagtaatcacaaaaccctgttgatctagccaccaaaagttaacagggccacatgctcagaaatcttttctgtattaccctttctctccaatctgttatttgctcttgtcatatgtaatccatggcactgcatatgaaactgtataaaagaacctccattgactagcctcttgactgcagttgccacatcttactagtttttaatatccctgttctcagcaaacaacttgaacactgttggtgttcaggaaatgttagatgattgtagaatgactttagtctttagacacttactgggtcactgtgatttctagacattctcccaagctctgaatgtttgatgttcttccttgacagacttggtcctgccttcaagtgggtggagtaatgggaaaatgccagaagctgtgtcccaaggctgtgagtgtcaggtcatggccagggtaaacaatttgaaactaggtcagggatccaaattgggctgctgaatctaggagctaaagcatgaaaccagttgtgttggtatctgggtttttgaagaggctggcgggaagaaaatcccaggtccatgtgagacagctatggcagcttttcatgaagtttgagatgctcagactgttatggaccctgtaatacaaagatgaataggggatgatccctaatctagtaggaactcagagtcatgtgggaaaatagatatgcaacaaaaacttagacttcaccgtaagaagtgaaatagtgaaacatgcctatagcactaagggatccagacatggaagctgatgcctgtgcttaggagaaattgtggtgaccttgagaggatgcttgttaagaaaagtttctctctctcttttttaagattatatctcagatttggcatttaactccatagatgtcctcaggacaaaccactttctttaatacataggcaaaagttgttttcttccactgaatctatgtcacaattttttttcccgggctcatagggcctgttccctggtagaaattttttcaatagctttgtattcaagttataaatatgagagcatttttaagggtagtttttatgcataaaaatgattattcatagtttagtatataaaaattaatattcatcatattaaaattaaatatactatacatttatgtgataaatatttggttcttaagtttagcttgtaaatattatcctaattaaaagtctactaaatttggacattacttgtatggaactttaaaaacgtttttaaaataaacacccttaagcctttaaaaagcatttatacatttaacacatgtgattttcctattaaatgctgtatcaaacacttgtgtgatttaataaagaaaattcttcccagattcttaacgttctaagta

SEQ ID NO: 48675 - DNA, 1548 bp, Bovine  19866880780790
atgttaagtcaaaaagaattcttcgaagaattgtgactatattatacatttgtgtttatggtccatgttcttgcaaactcaagctggtctgataaaacactagatggattgattcctgtcacagctaagatcgtaactgccatgtaactaataaactatccacttgaaaacgttaaatgtatcagaaaatgtaaaagaaatacaattacagaacaaatagcaggaactcaaatgttcttcaaaaggcaaatttgaaaaattaagagcatgaacaagctaatagagttaaaattttcaaagttcaaactgagtatatataatcaaatataataacagagaaagatgttggaaggtggccaacattatagcaaatgttttaaattatacaaattcaaatattttacccttagaaatgctttttagaaagctagcatttgattcttaaactgtttttcttaactgattcctaaattctaattctttcatgttgcttcctactaactccatcttccatacacatatgcttatctcttcccatcattttatatttgcatgtgggaggtcgagtaagaggaaaggtagtagaaaagggaaaagaaatcttatcaattccatgtaaaatgcaaaaaaacaaaagtgagtatcctagtattatcactgacattcattgaagtcgctcagtcgtgtccgactctttgcgaccccacagactgtagcctaccaggctcctctgtccgtgaaatttttcaggcaagagtactggagtgggttgccacttccttctccaagtattatcattagtgtgcaagtaatatacatttcaacttaggtgctttttgagtaaaagagggtgctgttaataattatgccagggacttccccgatagtcctgtggttaagaatctgcctgccaatgcacgggatgtgggttcgatccctggttgaggaactaagatcccatatgccacagagcaactaagtccatgtgccacaacaactgtgtctgcatgctctggaatctgagtgccacaacaagagaagccttggcagcacagcgaagacccagcacagccaaaaacaacaacaacaaatatgattatgccagagaaataggcataaaccaggacttctatggaaaaacaactggaagatataaattatatcattaaattataacattcaaacaataaaccttaagagttaagttcttaactatttctccaacaaaagaatttaactgttacaacaaaatagacatatttcatatgcaacctagtatatttgtgcagagatgacttcgaacatgtaagtttatccaaaagtatgagcttctgtggcttctatggctcagtggtaaagaaccctcctgccaatgcaagagacatgggtttgatccctggtcttggaagatttcctggaaaaggaaatggcaacccactttagggttcttttttttaattattatttttaattggaagataattgctttacaatactttgttgtggttctgccacacatcaacatgaatcagccataggcatacatat

SEQ ID NO: 48676 - DNA, 815 bp, Bovine  19866880789492
ccaatttttgaagattaaaagaagcagtgtgcaaagcaaatcaggctgatgctaggctcctttagctgtgactttaggattctgctttcttggactccttgtattattttaattgaatttgttcttcctcttcccaccctctactttgatagttaattttttttctattttatctccccttctctttgcccttggtactggtgggcctgacaaaatctttttactgtagttttagggagtttcaggagagagagcaacagtgtttagtccatccaccatctttaactacaaaccctccctacttgattttttcactagatatttctgactgttgtccccagagtccttgaaaatatagttcacagtacacgattgatgggactttgtttcccagctgaaagtgacttgcttgcctttccaggtttgggtaacctgggctcatacatttctatcttcaactctccctatgcaaatgaaacaagtgtcatattttattgaccaatttccagcatttcctctagtctggggcttgttaggaccattcttttttttttcccacatctgggagcatctgtaagggaatcattttaattaataagaggttcccacttgtcttagaactgatttatttatagctgaagagaaagctgattttttattaccctctggaactctaatttggttctacttggttttttctactgtctttccagataagtatacagataaagggggtatcacaaagaggtcatctgtgataatctgcatgtcttttctcctttttctttttcttccctgctacactccccaacagg

SEQ ID NO: 48677 - DNA, 3789 bp, Bovine  19866880793656
tgattaaagatatttttcctgctcttgaaagcttagattctaaggacatatgatgaaataagaaaagtcattctaaggaatcatatttcttatactcaaaactgaatgttgaatttgaagccctgatactgttaactaaaagtgaggtcatgttagtcggtcttttcctttatatttttaaaaacctaattatttaagatttatattttatatttttaatacataaaagatcttagtataaatggaggcactgaagggtaaaaaagatttcattccacttgaaagataaagagaaagctactttgaagcatcataagtgaaagaaaagaaaaagattacaacacctggataagatatttagctctgagttttctgtcaactaagacaaaaaggaaacacgttaaattatacagttctcattttctggaaaaaaaaaaaaagcatatagcttcatctactgtggcaaaaattttcctggaactcacgcaaacaataattcatcatgagatttttgtctaaatgagactaagaaggatcataagcttctgtttcagaaaaaaaaaaagttttaacagtaagtatgtaatcatggttgagttacttaaccatgagttactcagcatcagtttcatctgtaaaagtagggacaacgatacttatctcaggggacagcagcgaacactaaattatataatataaatggaagcatttagtaggtccctaaagtttcacaaaacaaagagaaatggcaccagattttgttctgatcttctataaaggcagggatcatgacattaaattgtgtcttttttaataagagtgattgatttttggctcttctgggtcatcactgccatgggtgggttttctccagtggtggggagtgggggttactcttcactgtggtgctcaggcttctcttactgcacagtactggctctagggtgcagaggcttttgtagttgcagcacatgggctcattagttgaggttcacgggctctagagcacaggctcagtagggcttccctggtggcgcagtggaaaagaatttgccagctacgcaggagacgcaggtttgacccccaagtcaggaagatcccctggaggaagaaatggcaaccctttccagcatttttgcctgggaaatcccatgaacaaaggagcccagtgggctacagtcctggggtcacaaagagacaccactgagtgactaaacaacaatcctttcttaacatttttttattaggttaatatactttctctaaagaaaagatgagaataaaagtcacccaatacactttccaaatacatacaatggttttgaatgtatcaattctaaaaactgatagaataagagagcactattgattttatccttcctggaaattcttaagaccacaactgaactattaatgtgaatgaggttttaagctgccgttttgagctaagaccaatacagaaaagaaaaaccctgtggccatgcctcacctatcctagcatcgtcaacccaggactatcccatccattttctttttttcatgtaacacatatttgataactatgtaaatgaagtggggatctcattttgtattaccaccacacacacacagtcttaccagaactaagtaacatcacttataaaattaaagcaagacatgtccaatgcaaaaaagaatatgaaacactttaaatgttcatttggtctctttatgaatcacttatttaaactaagaaaatttggctgattgaatcaatgactcatgctagatcatttccacagggtcctgacaagggtgaggcaagttctcagctgcccgccctgcactgggcacgcccctgagagggggcacctccactattttgtgccctcggtgactgcttgccctccccttagtctcagtcttgatgttcactttcaataaatttgacttaccagagtcattcttattcaactgttatctactaggtgttctggacatgtcaccctcagagtcataaaatgaataaatcaatcttgcagattctgtctcatcaggcaaatgttcaaaggaatggtcaagcatattcctgggttacaggctattttctttccatagaagccttctgtatttgcatttgggtctgcacacatgttaagggtttcccaggtaatgcagtggtagagaatctgcctgccaacttgggagatgcaagagatgtgggtttgaattctgggttgggaaggctccctggagtaggaaatggcaatccattccagtattcttgcctggaaaatcccatggacagagaagcctagggagacacagtccatagtgttgcaaagagtcacacgtggctgagcatgcacgctgtacatgtgatgcaagttggtgctaaactgtttctttctttcttctttttttttggccaggaggcttgtgggatcttagttcccggactgcagatcaaactcagacccctggtaatgaaaatgcggagtcctaaacactagaccatcagggaattccttaaaccatttcttagaaaagattacaagcttatatcagatttgtttcattaaacttgaatttttactttgctttggggaaaaagaaaagctacttttctttgactggcataaagaaaagttataatgttggattatttatataccaaaatgaagaaatctcaaatgcatgccaattaattgataattatttaattagatgtatatccttgcaaaatttattgatgccatgcggtagctgtcaacttaattcaccttgctagtagttaatttttatgttaagacatattttcctttaaacctactcaagtctcaacccactattaaaacttatagtttttatttggactcatgaataatgtgattccaagtgtgacatacaaaatatataaatgaaggctttcatatatttttcagagttaagcataattctctaaattcaaataagacttgccattctaaatacgttatctattatgcagctttttttggggaaaaaaagctttttggtatgtatgacttaatggatctctgtagctactacttcttatatattcagttttaaaaacttttgttatgatacacatactgaatgaatctggcttccacagtgaggcaacaactatttgaaatggaaatcctaggacacaagtaatagtagatgaggcctggaatgcttgaagtcggaaaaaagaataaatatcttcagaaatttctctactctgtaacttgttgtcaggtctacttatctacctaaaaatcacctctaaaatttagcccagggacactttcttatccttttcacccatcacataaaatacacctttaagagaactcactccaaaggccatttctaagataaagacagtctcccaattcccttgacattatttctaggatatgtatctttaagttgtttctaggaatattccttgcttcatctctctcaataatttccttccagtaatttcttcccaaatacctgatatatcttttccagatatggaaatatatttccagacatatatgtcttcaggatacttataaaccaatgacctgctttgagcatttctttctctgttaggactgcaaaacagtaaaaacgtggctaagacaaggcagtgatagtacagtggaaaaaattcatggattaaaaaactaagcttaatgataccaactgttagtgagaatgcagagcaactggaactcgcacttgttgctggtgggaatgcaaaagacatagtcacttggaaaatagtcggcagtttcttacaatgttaaa

SEQ ID NO: 48678 - DNA, 2055 bp, Bovine  19866880847735
tacacatgggatcttgcaggaaatggcaacccactccagtatgcttgctcggaaaattccatgggcagaggagcctggggggctgcagtccattgggtcgcaaaacagctggacatgactgagctactgaacaacaacaatctgtggaagacacacaaaaaaatgatacaaatgaacttatttacaaaatagaaacagactcacagacatagaaaacagagctaccaaaaggaaaccatggagatgggagaaattaggagtgtgatattaacagagtcacagtactgcgtattacttaaaagagataaccaacagggacctactgtatagcagagggaactatatgcaatattttgtaacaagatataaaggaaaaaatctggaaaagaatatgtgtatatatatatatatatgtgtgtgtgtgtgtgtgtgtataattgaattactttgccatacacctgaaattaacacaatgtggtaaatcaactatacctcaatttaaaaacaaaaatcccctgagatctggaagagaacatgaaaacaagctgagttcatcaagagatgactttcttcatctagtaagtcttcgatttttagaaattgtcaaagcattctgcacactaaaattggcaaacatttgactgttcctcacccagtatttctgccctggccccattccatgggtcagagagggagtatctagtagggtctcctcaggtcataggcagaaggcatatttctatttaggggatcggccctggccacagaaataggtgttagaaccagaacgacatgtttgccttaattagttcttttctttggaatgtaacacacactgtatgtaagctactctgttcttccataccccagaccgccactgctaattatcattataatgttttaatagcaatttccccagcagagaattcaaaattctttagtatattatctcctttctcttcaaaatacctttatgaaataactggaggaaagctattactatctcattctaacaaaatttgtttgactgagaaggcaaaaacctggacctttgaatagagcatggccagaaactaatcaaactaatttttaggtgaagcttgtgaaatcagcttcattacatctgtagtaatacctgctacctccctcaccatcaagttttcgatcatttacccaagactaactgccctggcctgaaacacagacgtgactgaatagaaacatcatccattctaagaaaggttacctgccaccaaaaagtacctattaataggcagatggtgtgcctctttaaaaaagtcagtcagaacacatctaattgtctaatacagggttaattaacagcactccaagtgtttttctgttggctgcttagcatgtggaatcttagttccctgaccagggatcgaatccatgccccctgtattggatgcacggagccactggactgccaaggaagccccagtactgacactttcgataatcttttgacgtagggggttgtccagtgcattttagatgttgagcagcacctctggctccacctactagaagccagcagcatcttccccagttgagataactgaaaatatcctgacgttccccaacgttccttcaggagggaagaaggggagacaaaaccatccaccattgagaaatgctgccctaatcaaccaaaagcaagtaacaatggagcactagcctcagcctgacattatagtaaccagatgctggaggctaataaataacatgttcttgttttcatgggactgaacgtaaagacagagcttaccaccagtatactggaggttgagaactgagagtctatgcaaaggagggaaggtgggagggacaaattaggggtatgggattaacaggtacagactaccatgtgtgaaatagataggcaatgaggacacactgcatagcacaggaattagagccattaacttaaaacaacctataatagagtataattgcaaaaatgctgaattactatgctatacacctcaaactaatataatattataaatcaactatacttcaacaaataat

SEQ ID NO: 48679 - DNA, 808 bp, Bovine  19866880867595
aaaagagctgagaaatgtgtgaaagcatcttctcttttccacacattgttttccctagggactcccttgttaaccagatttactgctaaatcccaacacacattctaaaacctctccgaactgatgaaagtgacagtggagaagtcataataatccatcacaacagctctcttcctttctaagtcatgctcatggctgctcccttgaaaggtcaagtccacaccagtttttcctaaggctacggaagccccacggtctttgcgcaatagcattggaaggtaagaacaggttacagagtgccattgttgtgaaatggaagcacttttgtctctgttccacacaaaatgcttttttctcactctttctgaacctggccttttccatttctatcaggtaaagacaggtaaaagcaggaactgtttatccaaggctgaaatgaaactttacagacctccctctccccgacaattttctattagcagacttccagggaagctcctatctagccagctattcgctcctgttttacatgatgattgtcagtgttcaccaggaacaaagatcactgatattcccactgggtttttcagaagcaactgaacgttgagctctttttatgttgaaaatagagatttaaacgttagtcatacactttctcccaacacattctcatcctcgtgggcttctttcactaattagctatgcaagtctttgcactaaaatttagctacctattaatccttgattttccttgctatgcaaacacagtatatgtttacatacaaaaacattttgtctatgtttccaa

SEQ ID NO: 48680 - DNA, 1515 bp, Bovine  19866880867983
gttggacttataaagaagacacacacccataggagaaaatcatttcaagaatgtaatcttctgctagaaacagactgtgataaaagaactcaggcacaaaatattagttttgtttttacctaaaaattaataatgatcagctttatttgcaaggctttatagcaaaggttaaaataaatgttgataaattaagactattaacacagactggtaatagtctaaatagcaatttactaactgtgccatcttacactttaatgaaatgaaaatgtgaattgattggataaggaaagaatctcttgtttattctaatcttaatattatggttgataatttcgccagccgtcctgatgaaaatatacctgatataacaacgccgcaggaaactaatgatcataatgaatcgacttgtcgctgaagtacaaagatagagactcataaatctcttaaaaattactaaaagcaaacaagtgatcaggataaacaaatgattgttttatcatcatttatttgttttctactttatagctattatcttctttcctggggaaaatgtcaaaatatcttttaaatatttgcactttactttaacctttactatctttacaccacagaagcttctaaagactgggacttctgttaaacctttgtctaattattagtattatgagagggttgtttaatcttttcttcttcataagataatcagtagtcaactaacaaataatattagtatatacctcttaatacaacattttgcctatttttaggactttataacttgattataaattatcttcaaacttgaagtatacatgggtggcacactttttaaaataatttttccaaaactgtgtctaaaaatcacaaaatatattttatttattatttactacttgaagttagcattccataaataaaatgaaaaatgcaataaattactcagaaagttctattgctcctctctccactgaagaaaccaaagtaaccaaaataaaacaaaacttttgctcaaagataattgcaatcatttagataactgcctgcttcataaactttctacttttattaatggatagtctaaatatgaccaatttgtcataagcaaaaactaaatccatgcatgttaagttcagatgaataggaggaagaagtcatcaatctacttttaaatgaaaatcaggatatctgattatttgactgcaatattcactcttgttatagatttgaacttctcccataatcttagacactgtcatgtttacgatcattacttacatgataacaacatatctaatcactcacaagattattgggatgatgtcccaaacttttgattacaaaagtctcttgaaaatatagaattctgcaaatattactattttatgaggaattttgatattagccaggagtgattttatttatttatcaaaaaatgtatcaattcttattagtgtatgcatgctcagtcatgtcagactctttgtgaccccatggactgtagcccaccagggt

SEQ ID NO: 48681 - DNA, 1503 bp, Bovine  19866880929970
aatgttccctttttcttctctccctctgagatctctcctaaatctgtgtgagaagtgtaatattttagaaactttcctgacttatatgcccttagtaataaatcaatttccctctatcagtgctgggtccacgtaagagggaaaagaagagatgatcattttggtaaagacaaagatatgctccaagagaatattcttttcccttgggcagagaaagtggaccccccacctttccttgacaaatcccttgatcatcagacagggggtttggtggggaaatgatgagagggctaaggaaagaaagttgtcaaaaatgtctctcagcattccctctttatggtcccccgctctaagatatgagtggggaagaggtgaattagccagcctaagatgcaaagaaaaagtagaaagtgcttgttttttgatttggttatatctctgaagagccactgagcagggtatccaggcactcatatggggcagaaaaccagagggttcaagcagatagaggttttagtttgtactcttgaacttccatggttacaatgtgatgtgaataaagagatgagagccagagggcaaccctggagcttgacatgccaggggctgagaagaatactggaagactggagttggacagagtatgatagagactcagaggggtgtagtaccagtaagaatggaggagtagaatagaggtcaagtccgcagggtgagccactaagcaatggccaagccaagaagaaatgaaaaactgctttgtcagccaatattattaactgtagtgtataaagaatgcccgtatgtgaggatgaaccagcccttccacagaagatgccagaaagtaatgcatgtccaagagccagggcaatgtcaagagatctcattaatccccaaaccttcaagttctgtgtgtctcacaaagacaacattttgcatggcagaagacagggaacaatcaaatgatgaacatcttccagagactgatttaaaccaagagaaagacttttgattactggctcccatacatcttaattcagaatggactcaatttaattttccttccactacttgattggttggggcctttatgagaatgatcaaatcagttataaaggagccatgttttccttgcatatttgagttgtaatatgataaacacatgtaatggggcagaaaatttaatcatatcaatagctgttagctctctatgggttgaaactaggaggaactgctcttccttgagcctgaagaaagctggagagaccagtgggatggagtctctacaatgaggtcattaggctgggggccaactgagtgtgctgcccagacaaggccttgaggtcccataaaggaacacatatgtctagcttgcaaagtatatgcaacaacataattattaagccactggtggaaaatttcaatctgaaaatgagagcatctgggatgaatgacttctctgtaaatgtcggcttgtgtctgaatgatctgtttctccaccat

SEQ ID NO: 48682 - DNA, 1153 bp, Bovine  19866881015458
taatgtctctgcttttgaatatgctatataggttggtcataaaatcttattaggtttatactattataatccctcccacattatgaatgaggaagttgatgcagagaaattaaatgatttgcctaaggtaattgtctgtgttgggattgaaaccaagcattctgaatcaaaatctgtgcttttaagcaccacactgaaactcttgtcagaaaagccattaaagacaattttaaagagtagtatcttgataaaatattatgttgataaaaacaccaagtaaaaagagtaacttccaatagacccagagaggattacatattaatttttaatatgttttttaaaatccttggaaagatgataacttctgtttatgtgttattatggccctaataataatcactaataatattgtaaatttcttgctgtagtcaaaatgattaaaaagtctctcctgaatggtttatacatatgtatcacttataacttactagatgttcattcatctcaatttgatctggagtaatggaaactgcttactaaaaatattatccatctaactcttacaaaactcttacacaaaatatttgcataagatatatttcaactggtatcaattcagttcagttcagtagctcagtcatgtctgactcttttcgacctcatgaactgcagcatgccagcctccctgtccattaccaactcacagagtccacccaaacccatgtctattgagtcggtgatgccatccaaccatctcatcctctgtcgtccccttctcctcctgccctcaatggttctcagcatcagggtttttcaaatgagtcagctattctcatcaggcggtcgaagtactggagtttcaacttcaacatcagtccttccaatgaaaacctaggactgatctcctttaggatggactggttggatcttcttgcggtccaagggactctcaagagtcttctcaaacaccacatttcaaaagcatcaattcttcggcactcagctttcttttgtagcccaactctcacatccatacatgaccactggaaaaactatagccttgactagacggacctttgttgacaaagtaatgtgtctgcttttgagtatgctatctcgtttggtcataactttccttccaaggagtaagcgt

SEQ ID NO: 48683 - DNA, 991 bp, Bovine  19866881052532
ctaccttcaccctgcaatctcaagtgactgttgctcagttatgtttgactatgtgaccccatggactgcagcccaccaggctcctctgttcatgggatttcccaggcaagaatactggagtgggttgccatttcctcctccaggggatcttcccaacctagggatcagacctgggtctgctgcattgcaggtgattctttaccacttgagctaccagggaatccaccttcaccctactgcccatttaacaggggctctgtgtgttttcttcatattttcagtgtatatatataaacatgcacctatccatcccattaaatattgaatttgtattagggaaaaatacaaacagcaaataatttcagctaaaggatctggaaataaattagaaatgttccattttagctatagaaccataaaattatgtaatggttagatcttactttcaaatattagcaccataaattcctattaaacaagatcagagaaaacataagaaaagcattgctatggaaaattgaaaatactcagtaactgtagaaattatgatgctttaagataatcatggatgctagtataaaagaagtccaggccttatatcatgtaatcttgctccttattttacagataagaaccagttcagggccttttagtgacttgccccaggtgacccggtcagttctcattccaaattctacattattagcaacatagtcttgatttgactggtatatagcgtgggctctcagttttcattaggatgtagctgagattatacctcttttgaaacattttctctagtatataagaaaaagattattgtagaaaaaaagaaaatacagataagcataaaggaggaaataaaaactactcaattaagactttatatttaaaatcttatctgtcttctctttgcaaaaccttatcttgacatcctggagaaatctgttacttttgtatgggtgacagtcaggatttcaggatatcagaa

SEQ ID NO: 48684 - DNA, 1539 bp, Bovine  19866881079420
caacaccatattggacagcacagctccccctgatcagccacaacactctgtcatcatgggcttggtgactataccaaagaggctatgtgtggtatttctagcatcttcctgattcacatcactttaaaacaggatactttaagtataaaatgtttaaaaataagatcacataagaaggttgattcacctgttcaaaaatccaacattaaaaaattgggggcagggaacctagtatctatgaagatgttaccttggatacagaatttctgagctgggagggatgttaacatataaccatcttgtttaactccttgattttagaaataaaaaactgaggccaaaggcactgagaaagttgatcaagatcactccttccagcttataatacagaagggctacaacccaggtccactggctattgcacaccacctttactttgtaacgaatctgaactgagtacagaatctgaactaagaaatgcttcactttaaagccaggttctgacaccttatttctgtaaccctggacaggtgctctaacctttcaaaaactagtttttctcacttataaaatgaggtcaataacagcacctatttcatacaagctgttgcaagaatactgaaagcactgaacactgggcacatgaaaagtgatcgacccatctttccatctttccaaaacacaaaaaactgttgtgttttgataaagaacaggactaatattccctcttatactatgtcctattaatgtgtgttattctgaagagtagcaattccaatgagagatgtgtatatagaagtaatatttgaacactgctcacaactcaggacagtaagtaaccatttcctggaggtagaaaaacatttgaaagattgttggcttgaccttcagtttccttattaactttgcagataattggccgtattacactaccccagaggtcatataaatgcccattcctcctctactactataagaaaccagcaaactagcaaaaaacaaagcaatttaaggatttcattaaaaaaactaaccttcaaaatcactgcaaaaatcattaacaactcagatctatatccaatactatttctgtgtctatgggtctctataaccatcattataacttgatattcacaatgatcatgaagaaaaaattaaattcagaaaagaatggctaaaaaaaaagaactttgtaaattttagtcaagttttgaatccttacttttaaatagttaaacctggtatcccagaaatttaattttatagcaagcttcctcccaaagcagataaactgatacttcactatatatgttgttttacaatcactgctttctatttttatgagttttattcatacaatttttaatacactcacatttactggaatgatactctgaaagctgtttcccttcatgatcagtccaaggagagggtacgatgacatccttagtgaaaaactaggagaattaaaagtccttcaattaggcatagaaataggaaaaggtagttgtgctaaataaccatcaaacatgctacaca

SEQ ID NO: 48685 - DNA, 986 bp, Bovine  19866881218910
aaaactttagattctctttagagtcagcaggtgacccaactattttcataggtttagataaaaacagcatttcctttgcattgtttgaactctaaatttataaaacacacacatattataatatatattattattattatttttatttgcatgtgctctcagtcatgtctgactctttgcaaccccatggactgtagcctgccaggctcctttgtccatggaattttccaggcaagaatactggagtgggttgccattttacaagtattataatgttagcttccaatttatagtgttgctgctaagtcgcttcagtcgtgtccgactctgtgcgaccccatagacggcagcccaccaggctccaccgtccctgggattctccaggcaagaacactggagcgggttgccatttccttctccagtgcatgaaagtgaaaagtgaaagtgaagtcgctcagtcgtgttctgacctctcagcgaccccatggactgcagcctaccaggctcttccatccatgggattttccaggcaagagtactggagtggggtgccattgccttctccgatttatagtgttacctttggataacttagctatattaatatctatgtatattcactataagaactttaacaattccattggtttgaatcttttatttactcataaacttggattgcttccccaaatttcagatttgttatttatatagcagatattgctatacattaaatttggaatactaactatgcttaattcattgtgctatttgacaataacgtagtgaaagtgaaagtgaaagtaaaagtcgctcagtcgtatccgactctgtgggtccagggaattctccaggccagaatactggagtgggtagcctttcctttctccagggcatcttcccaacccagggatggaacccagttctcccgcattgcaggctgattctttaccagcgattctgagccacaagggaagcccaagaat

SEQ ID NO: 48686 - DNA, 1902 bp, Bovine  19866881415608
ggagagggtatatgtatacctgtggctgattgatgttgcggtttgacagaaaacaacaaaattctgtgaagcaattatccttcaattaaacaattaattttaaaaaatagatactttctagtcctttctggaagcctgtgagcctgccttctaggtaactgtgcacctgtctgctctaattcagatttgactttcactccagaggactgtttcatccttacgtgacacaatacctctgcgctccaccccagctatacaagttgtattttcctttgtttccagcactgctactgtcacgtgattttctaaaaaattttattggaatatagctgctttacaaagttgtgttaatttctactgtacaataaagtgaatcagcagtccatatatatatatcccctcttttgggatttcctttccatttaggtcaccacagagcatggagtagaattccttgtgctatacagtaggttctctagggccatatacttattatttattttattttacttgtttacttgactgcagccagtcttagtcgtggcacatgggttgccctgaggcacgtggaatcttcccagaccagggatcccttgctaggtggattcttaaccattgaaccatcagggaagtcccctatacttaagtcttcctttctctgccctttccccctcactccctctccctctttgtctttctttttttctttcccttcattagtacattggtacatgaatcagaataatgaacttttttttttgtatcttctttgatttgatactttttattatgtatttattgaatatgtattttctatatctaatgatgttttattctctctttaataacagtaggacaattaaaacttttactgagaatctaaaattaattcctattccctaaaccttcatagttcataaagtgaagtcactcagttgtgtccgactctttgtgaccccatggactgtagcctaccaggctcttccgtccatgggattttccaggcaagaacactggagtgggttgccatttccttctccagaagatcttccctgacccagggattgaacccgggtctcccacattgtaggcagacactttaccatctgagccagcagggaagtcatagttcatagcatatgtaaccccctaaatccatctataagtgctttactaagcaagttgttatatagcaaaaatgtcactaacattcaaaactgtgctctaaaatacgtgtagactttctaaactgctgatgacttctctctcattactctgctcacttatttgtaatactgcagagtcataaatctgcctcttttactttcacttccttccatttatttttggtacaatcatcttgatttactattattagcaagactagatcattatcattactggatactaagttccagggacacactacctattctataaaatgttacctcacttttattttcttctagtgtaggttaacattatctatttaaaatactttcaccaggatctagaacaaattcacaggatctatgacctagggacctagaacaaataaaacatttctctaattcctgttacattttgggaagcctgttgagctgccgtctgtggggtcgcacagagtcggacacgactgaagtgacttagcagtagcagttggtgactaaaggataaaacacagtaggcactggagaaggaaatggtaacccactccagtgttcttgcctggaaaattccatggacagaggagcctggtgggctacagtccatgaggtcacgaagaggcagacaggactgagtgactgagtactaaggcaaactttaggaggacaaagatctttggaaggggtatgtcctctgctgagggcttcccttatgactcagctggtaaagagtcca

SEQ ID NO: 48687 - DNA, 1578 bp, Bovine  19866881427350
ctgggagggattgggggcaggaggagaaggggatgacagaggatgagatggctaaatggcatcaccgactcaatggacatgggtttgggtggactccaggagttggcaagggacagggaggcctggtgtgctgcgattcatggggtcgcaaagagttagacacgattcagtgactgaactgaactgaaacacttataagtagtagtgtgtgaaaacacttataaggggatgttaaacaaagttcttatactaaaaagtttcattagattgaaataaaatggaaatggcaaatgaaatacaattagtaactctgtgtggttcagagagaaagtctgtgcttccatgttgagcatttgcaaacagaaagactgagacctcttcaatgttaacatgtcagcatcaaggtggacatgtgagctgtccagcatgagatgaagaacggacacttttttgtcatttaatacagtgatgagtgtcaatgatcaaaagctagaggtaaaagttatgatgacaagattgagtaaaaccatgtaagcaatcagtactgacagtcttagttacagagatatatttggatatagcctcagctacacaggagaaaaagggatggttggaggacatggaggaggaatggaggtgatggaaaccaaaagaatcccttttcttaccacctttgttatccacaagctttctcaagggaagtctttaaaaatggaagaagggggatccaaagaaaaatatcctcttcctctctcttaaacctttggtttgcctccttccattcagtaaaggactttttcatcagtacttcatttgatccatacaacaatccaaaaacagagacttaagagagttttgatttcatgggacagttgaagtaactaagcctcagcaaaattcagtgatttaccctgaggttgatcttagattgtaagttgggtgttccatctcccaatatgtttctgttttcactaaggcattttattctcatgcattatttgatgttgaactagtctttttgctacataacaaaaagtgtactatagtatgatatagtatactgctgctgctgctgctaagtcgcttcagtcgtgtccgactctgtgtgaccccatagacggcagcccaccaggcttccccccattcccctggattctccaggcaagaacactggagtgggttgccatttccttctccaatgcatgaaagggaaaaggaaagtgacacgactcttagcgaccccatggactgcagcctaccaggctcctccatccatgggattttccaggcaagagtactggagtggggtgccggtgccttctcaaatagtatactagactatactatacatagtatactaggctatactatacacgtctagtataatgtctattatttgacattaatagatatttgctagtaatgtctattaaaaggaaatttggaatctgggcagtggagcagtattggattagaaatcaaacaatatatgtctaattaattcaatgaatacttgattaatatttggcagttgcattttcattacaatgtaattaattagaatttctagataaacaa

SEQ ID NO: 48688 - DNA, 966 bp, Bovine  19866881641060
ctgacgtgcggccgcaacgccgtgcgcgcgacaaactacgcaggaacggagagacgactctcaaaggatgggaccatcagctctggagctctggacggtcccttgggaggatctccaaaagatgccgaccggggcaggaagtggacctgaagtcctcgtgggcccagccccgccccagggccttggctctggggaacagaggcaaggtaaagggggcgaaacggacactcactgtccatggtctccctcaccgcattcagattcgctgccgctgccgccgacccggcgccactgctgctagccatggcggaggccgagggaggcgggcgaagggcctgacccggaactggagcgccttcctttctcctgggcaatcacaccgcgcgttcccggctcacgccgggcaggctccgcctctcgcgctgatcgccagcgtgaggctgcgttgatttgaatttggagccgcggtactctgggcggaacgcgaagcgaggagttgccattcgaatttactacgcggcctcgctatgattggctggttcgcggacagcggtacgacgtgattggccagtcgcgcacaaggcccgtgccctggttggcctgagacagcgcggaagcggggagttaaagagtctgtgcctgtcgtgggagcttacccggcaccgtcgggagcgccctggagtcgctttggggggggcttcctttttatacacacaactaggtatgttctttgtgattcctggcctttcctcctgtctcgagttggagaactccctttgcccggctctggaccagctgcacgctcgcctcgggatgaatgagagctaccggggagtgggtgcggaagaggggggcccaggaaagagtgaccgagtagggatgggaaggacactggcgtcagtgtcctcctttgcccgtcacccgaggaggctagctacacatcagccttccgtgagtggttctttt

SEQ ID NO: 48689 - DNA, 1246 bp, Bovine  19866880454972
ctcagctgtcatgccctctccacacacttcaggtaagctggcccaaccccaggcttccctggtggcttagctggtaaagaatctgcctgcaatgcgggagacctgggttcgatccctgggttgggaagatccccagctctggagattgcatcttgattagttccaaccagtcaaggaggtcacgtggctcttgccagttattgattgaaagatgggtatgacccaattcaatgagcagaaggatgctgggggcttctgggagagttctctcattgctcagggagaaatgtggggtgtatagggtgtcaagtctggatgcggtgcctggatcagctctaaccatcccagggggatgagagacaccagactgagggcaaaggaaagtttttagagacaacagatgggaaagaagtaaagaactttggtcttagatgagatttgtccatcatgttgaccaaatgacaacctgccttacaaccaaatattctgaaaaagaatgaaatacccagcaggtggaaattcatcacaatgggcaaaagaaatgtcctttgttcaaatggctgcgatggaatagatgcaggtagatctttacttcccacaggttggaagcagagactatgccagttggatgcagcagaaacacggtcaaatagctggacatttttttttaaatcctcaggctctgtcttttactgttgccaatttttcttttcctactacaggcacagataatataaagaccttagaggtttgttgtaaagatgcaatgaggtgttttatataaaggccctcaacagtgcaatcaaccagcatctcctttcccctgtcatttcttcacaatgacaaaaaagtaccttttttctgtcatagaaaactgactgtatgtaggaatattataggaaagatgctgactttacctgattttaccacatttaataggaaataaagtactttccagtcatgagattctatgactttgggatgactttaactgcaatcaaggcatgtgttcagttgtctgagatctttctctatttatattgtagaacgtttgccctacatgaagattaatagacagaccataaggagtacagtatgtctactcatgcgatcctagagttaacaattagttatcttcttccatcaaaattataatttgaagacttgtaccaggctatgtcaacagggcatgaatgattcacatgaaacacactgatatgtcttagcttgagcaatttaaaggttt

SEQ ID NO: 48690 - DNA, 2685 bp, Bovine  19866880589874
gcatgtgggttattttgagctaaaagcaatcaagaccttgtgcggtcaagagaaaaatatcagttcagttgctcagtcgtgtccgactccttgcgaccccatggactgcagcactccaggcctccctgtccatcaccaactcctggagtttactcaaactcaggtccatggagtcagtgatgccatccagccatctcctcctctgtcgtccccttctcctcaccttcagtctttcccagcatcaggggcttttccaaggagtcagtttttcacatcaggtggccaagggattggagtttcagcttcagcttcctcctcccttaacgatacagaagaatttaaattgggggcttttctgggccaatccccagaagaattatgagcagaggtaagttttacctgtatggcagggcaaacatctgattacccagcctctgctcttcttcttgtcccctgaattatgacccccgccccgtcacatcccttagctcaggatggcatatgtatcttattttacctttctgtttttgaacctcatgtgtgtgggcttgtgtacatgcaaaattaagcttgtctttctcctgtttttctatcctctgtcaatatgattattagatcagttgagtaagctttgaaggtataagaaacacctttctcctcaacactatcttaccataggtgactgttaacctctgttcttgagttttcttaggtttgctcttaattattataaagtgtaggaactgccccatgcagaaaacaaataaaagaaatgctttatctgatgttttcagggaagtaactgtattcagattagcattcataagtgatgaataattcagaaataatcaccgtttccattcatattaatgcaaattagccccaaagattaataagccccatgggttcaggatccaaaagaaattggttacacataaaataaactgcactctgagagtagaggcatattagtgataattaaaattatgacccaaaagcaataatattgttattctctgggttcttaatattcacttccacaggatatatcataactaggataagctaggaaaatgtgggaagtctagtgaaaaaatcacacactggttaaattatgttgtaggacaatggattttaaattttatttgcaaatttgtgtttgctttcatgaactagaatctcataaactcaactttatgaatgtgaaaggcctactccgattagcaaaaacacgtatactttaaagatttttaaatgaggacccaagtatatgtagtaactacaaccagaataacaatgagctgtcttttagaaggccagagggaaacctatttttaatgactaggagagaaggattttcaattagcatattcattacttgtatgtaaattgatgattccaacagctgcttaacggtgttaaaaaacaatttgttctattaagcagtttaaacattcttcttaaaaatcgtgtttacctgtttgatttgctgaacaatgtctttcttccttcggagcactgggcaaggaaggctcagatggctcatcagtctcccattttcccactggtgagatccttgaacaaacagggagacagaggccacagctcaacattaatatttgggttacttccggtgttcttttgttaaggattgcaacattctttggtttgggcaaggagatattttgcagcaacaaaggtgttctagacagcatcagaacttttctagtcctgaatcctctagtgagctcagaggaaaacggtggagacttcaagagaatggactttttttcttcaaggactatttgtgaatagtcagctgtggcctccacccaggtcctgatgatctgcattcccaggtggctcagtgggtaaagaatctgccggcaatgcaggagacccaggttcaattcccaggttgggaagatcccctgggggaaggcatgacaacccactccagtattcttgcctggagaattccatggacagaagcaattgagcacacacacatgcagatggatgtgtggataataaggggtggagagctgtccctgctggaggattccaatcatgagagcctttcatttcattcctaagaagacttgagactcttgaagagaaaaccaccctgtgggctgctaggatttgctctgggatcgctcatcatctctccgttcctctccctgcaggaaaccatggcaaaccatcccttgccaatttctgttggcctggaagatgaatcagtattaggtcaggacaggatttaaatcctctaaccaccacccacacctctgccctttcctctgcttgtccagtgatctagaccagggctttgcaaacttcactgtgtacaggaagctgccggagcaccatgttaaagcagattctgggacttctctggtgatccagtggctaagactccaagctccctgtagaggttcccaggtttgatccctggtcagggaacatgggcttccctggtggctcagacggtaaagcatctgcctgtaatgtgggagacccaggttcgattcctgggtcaggaagatcccctggagaaggaaatggcaatccactgcagcactcttgcctggaaaatcccatggacggaggagcctgataggctacagtccatgggaaagcaaagagtcagacaggactgagcgacttcactttcactttcac

SEQ ID NO: 48691 - DNA, 931 bp, Bovine  19866880675158
tagacacgtttaggtcgtttcatctgcatgcctcccttggagggagcacgtgcctggattattaatgaattctgggttacattggagcagcatctaattcccttcagcgtgtgcagggggacaacaggagcaaagaggagcctggggagatgtgtgccatgtggagtcctaaatgctctttgttgtgagcctgggatttaaagagaaagtggggagccctcctcactccccgggagagcctgcctccttgcaggatcagtatgaagactcttttgtgtcctgcagaggcaggaagggcagtctgatcccagaccactgctcacagcagcgacttccccataacaaccgaaatactggctacaatgcatgcccccttgagggttcagtgcctcctgacagtaaaaccgaaaagggtccccttcctgtttcctgacctttatttccaaacagaggtatataagaatcttgtgttgcctctcatggtgcctgctgtataattaatgtcccaataatggatgtatggatgtccagatgtattcatgaataaatggaaatatgaataaatgaatgaaaaactaagctctcttcatcaagtcatacataaggcacagtcagatacctgggcctagagtctagcctctgagcagctcggaaaggcttctggaatattttagttgacttgaacaaactcagaatggcaatgcttgtcatgcttcaagcagcagcataaaacttgattaaacagccggagctaccaaggaaaatgtcagtccacataggaggaaggtcttagatgtttgcttatgactctccaaatgtgaagcaattgattgtggtcgctctgccattttccctaactcatgtgcccatctgtatccctttgaacaagtccaaggactcctactggtaaggaattagcatgctgatcaat

SEQ ID NO: 48692 - DNA, 1759 bp, Bovine  19866880871218
actgtgaaaacagctgacatggcctcaagtctgataccgttcagaaaacaccaggtctacacgatggagaaatactgctgctgctgccgctaagtcgctcagtcgtgtccgaccctgtgcgaccccacagacggcagcccaccaggctccccatccctgggattctccaggcaagaacactggagtgggttgccatttccttctccaatgcatgaaagtgaaaagtgaaagtgaattcactcagtcgtgtccgactcttagtgagcccatggacggcagcctaccaggcttcctctgtccatgggatttttccaggcaagacgactggagtggggtgccattgccttctccgggaggaacagtgtctgaaagcaaatccacaatggccgcctggccccctttagggtgtctgaacaacagttactccattttgattttttaattgatcttaaatatgtcatcactatagatttttcagtcccccaagccttaattttagatgccctaatgccatttcctatcatctaaactacaataggactggcataatatcaacattaataacagctgaataaatgcttgatacaaaatgttgcaaggcatccctagaggctcagatggtaaagaatctgcctgcactacaggagactcaagttcaatccctgggtcaggaagatcccctggaggaggaaatggcaacccactccagtattcttgcctggagaattccatggacagaggagcctggtgggctaaagtccatggggtcccaaagagtcagacacaactgagtgactaacttttacttttcaactttctttcagaaaatgttcaatttttatttcctcttcacaattgatcagtagaatacagcagaaatggtgctgtgccaattctgagctcagcccttcactggcctgaaagctcccactttcttcttggaatgtcctttgttggaagtcagatgacatgcccctggagaagaaccagggccccccccggtcactggaactctgagttcccagtccagccgccagatgactcgagcctcctaggacctaatctaatgtcacatctgataccatgtaaagcaaaagaaccactcagttatcctacattgtgatgcaataaattatagttttaagctaccaatttgtggggcagcttgtttcacagcaatcaatagctgaaatagttactgcaaatatacccattttacagatctagaaactgaagcttatgagaatttaattgtgggtcacatatcaaggaaatggtggaataaatatctgaacagagttctaccaaattacaggatccacagctgaaaacgctatgccagcttgtgtctcatcttaaagccaagtcatcagcgtatgtttctgcaacatttgaatttggatagcattttctcctatgaagagaaccgctaagcttacacaggcattacaaaagtctgttctctttaattaattctacaattcctagaagtatttgacaaataatgtgtgctaaatgtactcagatacttcacatggattacaaacaaaaagccagaaacctagaggaatgttcttctcttctcgtctcgctggagctctttaattttctaaagcctaaggcagtgacgtgcagcctttaaattcccttgtccaccttgtcagcagtgcctcagacacctgtgcattaaattagtgagatattgctttcaatctacacttagcgtttccaagtttttatcatctagaaaaaggcaccg

SEQ ID NO: 48693 - DNA, 1880 bp, Bovine  19866880948361
ttttggcccctgatacaaagagctgactcatttgaaaagatcctgatgctgggaaagattgaaggtgggaggagaaggggactacagaggatgagatggttggatggcatcaccaacacaatggacatgagtttgggtaaactctgggagttggtgatagaccgggaggcctggcgtgctgtagtccatggggttgcaaagagtcagacatgactgagggactgaactgaactgactgaactgagacagaacaaagtttacataaagaaaataatactgtaattcaagtcataaaacttttgtttagtaagctaatttcctaataaaagaagcagagagcttttatttacctttttactaattcctgccttgtttgcatggacacctcttatctgtttgatgctagggacttaaacatctgacacatggctccagccttgagatgatcacgtgtgtgctctccatgaccatgctagtttgttgatcacccaccttgaaagagtttccatggagcactgacaatgggggagccaaaataacccttaggtcttcctgtgagttaggaaagacaatttggggagggtgttggtgacagaaacctacaagcaaggagaccctggctacagagatggagatgcccggcaggacctcactgagggccaccagtgggtaaggaatttgacggaaccctgagcagctaagcatgaccgaaccagaagaagggggtgtggcagagggcgagactaatgacacaggcaggagaaatgataatgaacttggaggctgtacagggaagtcaagatttttaatcctgaaccactgaagaattctgagcacgtatgtctcacatttgcaggttctagggtcatttccagctgctgtgctgagaagagaggaattagagagtgagcctttcaacagaagtccagggttcaggtgagaaatgaccgtgttccgaaatcaagccagcagtggagggggcctgttagtgtggtggggactgttaagagagccacagggaggtacacttggttcaatcaggtgattcacatgcaagagaagaatatgcctttcaggttctttcattttgaaaagatctccctcgctggaatcgctgcccggcttctcgtgtacaaaggtgtgtgccaggcataccccgcagcccacagcttaactcaggcttgattgctggtcaaactccctagcaaatgcttctccacgtttgactctgaaggaattgaataccatcgctcacagaagcagaacactggccacgtgtgaatattgcactcttcctcctgggtacgatctctatttttattgaacaactgtcagtagaccatgcagcattgccaacaacacgctgaaaatagaatgaaggcaattacctcagcaaagattaacgcagaaagtaaaattgcacttatgtaacgctcatcttccaggcacggagaccagcccgcctctggtttctccgtctgtctccgcatgggcatcgtagtccaacggcaccaccccggaccacaccggaagaaacaactgtctccgcccttccctcttcctgtgttcgctgagccttttctcagagcggcccgcggaacacggtggtgctctcggggatggtcccctcaagacgccgccagcagatgagagagaatattagccaagaaggcaatggcaccccactccagtactcttgcctggaaaatcccatggatggaggagcctggtaggctgcagtccatggggtcgctaagaggcagacacgactgagtgacttcactttcagcttctaacaccatttccgcactcttctgctgcttggcaattactcgtcagtgaacttcaggaaaatacttgtgttttggagaatgtcaggt

SEQ ID NO: 48694 - DNA, 914 bp, Bovine  19866881023876
cctggggactcagcaatagctctggggacaagtgggaaggattttttagggaaagagggcgattccttaaatacaatgagtttaaaggtctgccatccaaaagactaggaacccagaatagtcgagtggtagaaatattaaggatatatgtttgttttcatacctgagcttgtgacctgaaaaaatcaggacctcttattaactcaaaactgaggttccaagacaaagtgaattgccaaagatcttcaaaacagttacttgcaaaagcaggactcacactcaggcttttggacatcaaccccagtgttctttaacttaacactttctccctgcaccctgttaggaaactcagctaacactgtgcagtgtttggcacacagcaggtgctagataaatgcatgctagtgaatgctaattgactcatttattgcatccctgaaggtccaattagctgcacacacaaggctgaaaggctttaatgctgggttttaattagcaaaccaggatgcgccgaagtgccttagagaaagggagagaggcagctgacaccaggattttaaatgatcagaaccactgatctgtttacacacatgatgccagaatctcactggtgagtgtttacagaaacattgttaacagccaaagtgctgggcatagagctggaaccttgaaacggcagtgctgaatgtccatctctttcctgtgaggacacccccacctctgagctcagacacgggactgctcagtttcgaggctattttgacattagcatccctccaactgtttacctccaagccttgaagtctgggaaccagaccaacttattttatatttcaaatgcgaagtgtttagcataactacattgattcccaaagtcaattctactttaactcacacacacaaacacacacaaa

SEQ ID NO: 48695 - DNA, 1061 bp, Bovine  19866881077556
tgcaggaagaatattggagcaggttgccatttcctcctccaggggatcttcccgacccaagggaatctaacccatgtctcttctgtctcattcattggcaggcagattctttaccactgtgccacctgagaagccctagagaagtcactaaaataaaaggcaacttcccttccatgaaaaaaaaaaattaagaaatgaaagaagtatttagaggacaagtaaaggaaatactaaattatattgaaaaaagaaagtaagaacttaacaaattcattaccagaaatttggcttgaactaaaaacaaagaagctcagaaaagttcttggataggagacccataggaatcatcattaagacttccctgatagctcagacgacaaagcgtctgcctacaatgcaggagacctgggttcgatccctgggtcgggaagatcctctggagaaggaaacggcaccccactccagtagtcttgcctggaaaatcccatggacagaagagcctggtaggctacagttcgtggggtcgcaaagagtcagacacgactgagcaacttcaccttcaccttcaggaatcatcaacctcagaggtcttctaaatgttcacaaaatctgaaatacatgttagggacatcaagcacaccaaaaggtcccctggtgacaccgtcagaaaagcagtgtatcacagactgatccctgcactgcattcatagtttcttggacacagaaaagaataagcgagaaaaaaaagacagatttttgatgttttatgtaaagcataattgctttcaacatcatggtgtttatcttggcttatctgaatgaaatttgcctttgttcaggcttcgtgatcactgcaagctttatgattaaaaccagaagcaagtgaagcatgagaatcatattgtgatgtacagctggcacttgctcacacaaagcaggacatgactgctggccttcagggatcttctctggttcactctgcagatgaaaagctgaaaacagagctgtctagaagacttagaacacagacttatggttaccaaagggaacatgtaggggag

SEQ ID NO: 48696 - DNA, 3956 bp, Bovine  19866881078244
ttgggagctgttttttttaaactactaaggtcagaaatcctcccagaggttctaattgagtagacatgggggaagggcccaagaatctagattttaaaacagaaagttccttaggtgattgaggtgtgcactaacatttgagaagcaagtgcgtggtccctaagctccccttcagtttcatgattccaagaagataagggccacggagggaaggtctccacaatgcctcagtgaacttgacctcccctccatctccttgtgtttcttcaaggtctatcaaagtcaggcaccgtggagagacctttacagaggttatctcacttaattctcaccacaaacaaatagagaaggcctatcctgaggtgcctgctggacttgtggaaactgaggttcagagaaggtagatgacaacttagaagcagaaggaagattcaatttcagattgtctgatggcaaagttggttctgtccaccaattctctcttctgtcttccacatactgttctgcaaacaaaagagcatcgggttctaagatacataaaagaatgtatcctggaaaaggtagaaagatgataaatcttgtttttcccttcttatcggccccctcctcagacccatggagttctgcaggtttatcctgccttctgacacattagtgacacatatgtttttttcaccctttctactctttgtattttgttttttaaaatctattggattacagttgatttacagtgttgcattaatttcaggtgtgcagtatggtgattccattatacacacatacacacactcacacacacactcattctttttcagattcttttcctatttaggttattacagaatattgagcagagtcccttgtgctgtacagtaggtccttgttggttaactatcttattaatgtatatatagtagagtgtgcatgttaaccccaaggttctaatttattcctccctgcatgttttccctttggtaattgtaagtctgttttccaaaactgtgagtctgtttccattttgtaaataagttaatttatttcatttgttaaaaattagattccacgtatgagtgatatcacatgatatttgtctagttcctttagttcttaaattgtcaaaaccttcctggatctttgccttttttccaaatcaagactaacactatttctgtggtcccttgagagctagtttgtttgtgtagaagttacctgaatggattgaaggggagaatttgtttcaaggaatagtcccagtagacagagcccccacgcctttgtcctcacaagcatcctgttcagagaagaatccataataagatgcatgccacataagtgcggttaggaatatataggaaacacatatgaaaaacctgcccagctagtcatatcataatgtgaacaatgcttctgaaaattctgctacagattgagcacagtgggcctggttgcatatcctctctttgaggttagaataacacaccatcaggcaattttctgggcatcatcaagcaattgcccagaaaatcatgtttttcagctataactataccacgtctgtctgtccgtctatctatctatctctcatttctatggacttgaaaacacttgagctggaattctaatttcttcagtatatctggagatattctgaaaatacctataatcaccgtggttttaaagcagatattctggaactatctacaatcaccaggtttttaaataaagcttcattgatggagagagccagacagagagtgacagtcctgtgacacagctgatggggaaaccaaggctcagagaggctgcagagagtagcagaagtcacacagcagcagcagcccgtggctggggtggcccagggccaggctctgttcttcattcctgtatgtatctattttaaaatgtatgttctcagatgggatttaatcaagacactgtgtaaaaaccacaaaacataaataaggaagtaaataaataaacaaagcttcactgaacacggagggaaacctctcctattgtttgtcagctcttaacccctctcatcccagggcctggagaccaagtttcatagagctgatgaccttggaaacacaaatcatacaaatcgaatggctccttcattccaagtgcaggctgagttttatttttttcaaagcttcttgaaaacacattaaatttaaataaaatctccaggcaggctgttcggttatgtctgaccttttggtaaacatgatgaatggagttccagtacaaacgctgccctcggtacagagttctgctagctgcaacggtgggcctccgggcagaggcgaagtggtcttcactgaactgtttcactgggggtgcaggtaggctgtcagtcaggagcagccttgccagggttttcaataaaccatgattaggctgtagagttcttttcaggctttcggctctgctcgcatttaaccgatcacattccctcttcacagctgcttctcacagaacatctttaagctcttgcgggagacagagggaggtttgaatgtgatccaagcattgggtttccattaaattcatcgaggaacaaaagaccggaggggggaggtatatttggtggagactgggtgcactgtctgatttccgtgttctctgggaaatcctgcttctttctggtcacttaataagcaagtggggagctgtgtcttggggaggagcctggcacagctcagaggcttgggaggttagcctcaaggcttctgaggaaagggaggggcagaccttctgtttctctgggcattggtttctttatctttataatcagggtggtggagagaaaattctggctgctttggcttccatgattctagtatagaggttgacagattattttcctatggagggtgaggtagtaaatattgggttggccacagcgttcgttcagattttctgttccatcttatggaaaaacccaagcgatcattttggccaacccgatatttttgacttgtgtaggccaagaggcacaatcaaggatcttgcataggtattatagaacaagagggcaaagaaatgcccatcaattttaactgagacattgtaaaatataccactagttatcaagtataattttctttcttttttcttttttgtaatggaggtcttctaatgaggagaacagaattctggtatttatttttttgttgggagtggataacatcttgcttcagtgggattcaaacttagtcttctctgtcgtcagagagattgcaaatattgatctgtagaaaccgttcttgggtcatgcatgcgtgctaagttacttcagtcatatccaactctttgagaccccatggactataacccaccaggctcctttgtccgtgggattttccaggcaagaatactggagtggtttgccatccctcctccaggggatcttcccgacccagggaccaaacccgagggtttcttgtgtctcctgcattgacaactgagttctttaccactagcgccaccgggaagcctgcttggcttctgggccgtgtggaaacaggagtgggcctcgttggggccacaggaagtaatgtgtcggtgtgtctggtggtgcagaaatgcccctgaaggagttgacaaaggaactgagttaaaaagaggcatcagacaacacaaaaaggaaaggtgttccaggcagacgggaacacgtggaccaaaacatgggagcagttgatggcttatatctcaggtcaggacggcagtgggagctcaggatggggagggcatgggctctcagtgaacacgtcctgcggcagaagccacaccagaaacaaaatgcagcttccaataccagccaattaaaaattatttttgtctgctgctgctgctgctaagtcgcttcagttgtgtccaactctgtgcgaccccatggatggcagcccaccaggctccccagtccctggattctccaggcaaggaca

SEQ ID NO: 48697 - DNA, 1870 bp, Bovine  19866881080756
acactgcccaggtgacaggtgacacagtccaggtgacgggtgatgcaggtctgactgtgacccactgtggagacatggaggagagacatcactgatgaaatattcagggaacagagatcatacttgagactgacttcaaaaatagaatctaaaatgccttccaaaggttcaacttggggatttccctggtggtcctgtggttagactcacacttccaacacaggccgtgtgggttcgatccttggttggggaactaagattctgcatgccatacatcagggtcaaaaaacaaagcattaagaaagaaaggttcagcttgagtaagaggaaaaacaatggcaccacagagacagaaatctccaggtgatgtttccacttctctcctctgagcatgtctaggcctcctctcctaggctcctcctctgatactgaggtttctctgaccttcaggatgcccccacaaggccggggaagagttcatgatccaaacccctcaccctgccctggaaggtcccacactaccactggactgctctctgcccacttcacggctactgaacagctgagaaccggccagagggaaacctacccaggaggaaagcaccttcacaattcatccagagaatcccaggaatccaggcagggcttttaggagctcgtcaattctctttttctagctggtagctaaagggtgtagacagagaagctaagggcatgcctttccatttcaaatcatttctttttaaaattatttatttatttttggctgtgctggggcttcattgcgtcacccgcgctttctctagctgaggccagcggacgctactctctacttgtggctcacgggcttctcattgttgcagagcatgggctctagggtgcacgggcttcagtacttaaggctcccaggctctggagcgcaggctcagtagttgtcatccataggcttagttgctccatggtacgtgggagcttcttggactagggatcaaacccctgtcccttgcgttggcatgcagattctttaccacaaagccatcaaggaaggccttaggtcatttcttagtgctgtgggaggagcattttccttgaccttaggctgtactacttcactgctgcttcagacccaagtctttaattgctacagagggatccctacccttgtcccaaggggttggtggtcttcacagcaatttgctatcccagaagtgactctatccatcttactctctctgatccaaatgaacatcacagctggcagccacagcagaaagtggctaatgaactagctcacaccacggtgtaaatggctttgaataggtttagctgtctcacatgaagcaaaaaaattaatccaaagaaatgaatatattatgcggagtttcagatccacaggactttagtttgaaatggaaaatacatctttttcttttctgtgtgtgtgtgtgtgctcagttgcttcagtcgtgttcaattttgtgaccccatggattatagctcctctgtccatgaaatttcccaggcaagaacaggagtggttgccatgccttcccccaggagatctttcctgcccagggatcaaacccatgtcttctgagtctaccgcattgctggtgggttctttaccacgagtcactggggaagcccttcctttctgtttgtgtgtgctaaatcacttcagtagtgtccgactctgtgtgaccctatggacttcggcctgccaggttcctctgtccataggattttccaggtaaaaatactgaagtgggttgccatgccctcctccacgggattttccagactcagggattgaacctgtgtctcttatgtttcctgtattggcaggagggttctttaccaggagcaccac

SEQ ID NO: 48698 - DNA, 770 bp, Bovine  19866881125871
tagtgaaagttgtcagcccgtgatccatccctttttggtaggcctgcctcctcacgaagctgaatgcatgaaaatcctcccattaagctcacccccacacacacacacacacaattctcccatctcttaaaatagctgtaaaagtcctctgtatgcttttctcctaccacaaaaatgagactaacacccacgaatcttaaagaaatatttctaaagtaccatgagtcagaggagtgagaaattatgtatacatgttattacagaaatgtctaaaatgattaagaagggattcatttcagcatcaaaaatctttacagctttccaacatcatggaaaagttagcagatataaaatacattatgacatttctcagaaaataaaagagaggaatataaatttcaaacaaatacgaaagtgtcaccaagaaaaatgtagagcaaaagatttaaaatagaactcctgaaactgaaaaacaaatcctttgtgggccttggtaacagtaatgatgatattcaagatgattaataatagagtcagcactcagagagcgtgcttaccaagcaaggtattcagggattatgccacctattagcggaggcagaatttgaatacttcttttaaagaggaaaaccatataggaaaatcaatcctgtgtcttgtcaagacaattgtcctctcttttcattcatagctttgtttattgtaaacaatgcagaaatgaagcagctcactgttaaattgggtttttgtttttctttgttatactgact

SEQ ID NO: 48699 - DNA, 1081 bp, Bovine  19866881286419
tggcagctgattgttgaaatcaggggtggggtggggtttatgctctctttggaggatgtttctcttaatcgggcactttaaattgccagcctcttagaaacgcatgccaagccctgtcaatcatcaaatagtttttgcccatatcagcttccctgctgaagcagccaccttgactggttaagatcccaaatgggaccaacctttccctccaactcttcccaagaacagtctttccatgagccaggcacttgtccacacagaggaaatccacttgtcaatagtgccatgaaaatcttagatgagcttcattgctatgatgtgcagatctaatatcaaaggcagtcattcctatgcctctcgggttcctatatttagccagcaccagtctggggagacaacagacaacactcagagcccagcttatctgatagaacaacataacctttaggtctgataatcatgccaaatattgaatgcttaaaagcaaatgttattctaattaactgcattcacaaatgacagcagcttctctttctaaagccggcttgaagattttccctcaagactcaaataataataataataataacatataagcatagagccagttcacaccagatgccgggaagctacccaagaccttcaaagttcagcagatattgttgtctggtttatttggtagatcatggtgagagtgtagacaagccacagagcccatgaccaccgtgatcctgcctgggcagattcccaggaaaggattgttaaccaaactcaggtttagctgctctccactcaaaaatcaaccaccaagaggcaagtgttggtagaaaggaaaatgctgcttttaagtagaaaaccagccattgggaagaaggcagactcagtgtcctccaaaaccaactctgaagattcagttcagccgtgaacgtttctaaaggaaaaagagaagtaatttcatttaattgctgagatggggtgggggtggtcagagtcatcaccaccagaggtttgtgatctttctttagactccgttttgttcacacagtttattcacaagattactgaaggggaagctggggaa

SEQ ID NO: 48700 - DNA, 759 bp, Bovine  19866881368215
agagctgagctcaactgtacagcgctactttaatcatcgggaaaggggtttcttctttcctccttccttccttttttttcaaggttataccgaatacaatctcactggcaaataaccatgccaggcaggcaatgtaaaaagagtatatacttctgtttgaagtaagctataggaagtgagacaggcaattaaatacaaatcctggcatccagcttgtttcaacacttttcgtattttgcatagaagctgccacgtgttgagaatttattaaatgtgaaggcttagcagcccttttatgcacatgtctttacctgaggttcaggttaccatctgaccattctctttgacaaaaatctgcctctgtaaccaaaccattcacgatcacataaaagtgagggctggtcacccaccccatctcatcgtatcggagactattgttcaggccttccagctggctttcggggtttgtttccctactggtccttgtgttaaaaattgttgagctttcccctgaagaaagaatttgccatttttcaccctagaatcacacatctttccaaatgaatgagttgtgaaaatgcatactttccagaaagaccctgaacacgtggtttcagtgtcttttttttatgatctcacaacctattaatcattatatgttatttgtaaccaaaatatatatgtaatggaatcgttatatattatttgtcatgaagaatgtttctgactgcatctgaacgcaagtctacatcttcccta

SEQ ID NO: 48701 - DNA, 1419 bp, Bovine  19866881402778
tcagcatagaattttgcaccaaggaggaaagcatcttgcctttacaccagcaggaacttttcattgtgacactgttgccatgggaatgccacgctggattgtgacacttatcatctctctctcactttctattataaagtgagtacttgggattccaagccatgaatatgtgtccaccaattgttaatctgtaaactaacctgccaaccagcttcagagcagaactggtactctggccagcggaactgttgttccctttgtttttgaaaatacaaagggaaggaagtgatgagacagtcatcgatgattaaaagaggtcatttactttccatgccttgtggctttggtccaaaggcagaaagtgaaaaggaatgggatctgcccttgcaagggatgaaatctactaatgatctcccatgtttcccagtctcatccagcatttttcagctaatcctttgaaaatattttctgaagccagtctgagtttttacctgtgggagagaaatatcctgtcggtaaataccaacattatggccactgcatgtatttaaagacagagtgcagggtgcctcatggagttccgtcaattgcgtgtaacggttttcagaagtcctcattcttctggaagctaccaacagacatgcacattcaggccttcagtggaactaaaggggaattcatagaaaccagaactgcacgaaggcaactgaaaaattgagcttcccaggtagctctgggataaaaattctgcctgccaatgcaggagactctgggtcaatgcctgtgtcgggaagatcccctggagaaggaagtggcaacccactccagtattgttgcctgggaaatcccatggacagaggagcctagcgggctgcagtccctggggtcgcaaagcatcggacatgactgaaacgactgaacaggagcacaaacaggaacagcaaattttaaacaaacttgtttgtgcaaattggcccaccctggctgcagacctgtcccttcatgacaactcaatttcaggaagcagctgcccatgcaaactatgttactgaattggatgaacatctattttctattaactttaatgaaaagattacctttaattgcaatgtgccaatgtgttactatccatcaaggctctagtttaatagacttgttctgctgtgatcatgtgtgagcatcttctttcaaggaaggagccacatctcagtgactgtttttaaagagcatctggaacaataccctgagaaaatcatacgctaacaatccttatgaaaggtaatgtttctacaatctgctttgttcagaaaaaagtaaacccaagagtaaagtactgttaccaatatcttgatatcatgggttctgtgattattccatatatccagtatttttcccctgtagaggattatatatccttgc

SEQ ID NO: 48702 - DNA, 1693 bp, Bovine  19866881583782
tctttgtgaccccatggagccgccagggatttcccaggcgagaatgctggagtgggttgccacttcctactcgaggggatcttctggacccagggactgaacccatgtctcctgcattgcaggcagatcctttgctgagccaccagggaagcccccaaaatacacagacactgctatatgcgaaatagataactaaaaaggacctgctgtgtagcacagggaactctaatcaatgctctataatggcctacacggagaaagaagctaaaaaagagtggatatatgcataaccgattcactctgctgtacacctgaaaccaacacaacactgcaagtcaaagtgaaattggaagttgctcagtcttgtcacactctttaaacccccatggactatacagtccatagacttctccaggccagaatcctgggaggggtagcctttcccttctccagtggatcttcccaacccaggggttgaaaccaggtcttctgcattgcaggtggattctttaccaactgagctaccagggaaggccgttataagtcaactcgactccaataaaaattaaacaaaacaaagcaaagtccgactgtacagtgcagagaacaatatccagtattctatgataaaccataatggaaaagaatatttttttaaagaacatatataattgagtcactttactgtacatcagaaattatcacaacactgtaaatcaactacatttcaataataaaaagaaacaatgagtagggaatttgtcaacaatgaactgacactacaagaaatattcaattaatttcttcaggctgaagggaaatgaaaatagatggataggcttttttgtttgtttgcttattttagagatactcttccatagaatttgaagttagatgaaagaaatttttttaaagcatgattcttcagcttaaaaagtacctagaatgtgctgaaaaaaagttgtctttttttttttttttgtggtaataattcccccaatgcaaaacaaacaagtaaactcagcaaatggaaaagcttatataacagcctttcagttaggaagatgtgaataatttccaacatttgtaacacttccaagaattcatgaaataatgctttaacattctgactcaaaagatagtagcaaaagataccaaacactgactaagccaaatgataaattttattttgagaaatatggaaaaatcacatggccataatgaaaaataatgacttaatcagacactgtcttgaaaagattcagagaaagaattctatgggaaaaaatgttttgggagaaaaattaatctgaagacacaaacaggctgctccttactcctaaaatagatctcaatttcaagaagaaaatagcctatttttctagtgttgtatctaagatattcagggcacacactagaaggctgaaaatatgagaaaggaacgtgtccggtgaccttttatactttccccaggaatttttttttctgctggcagaaaaacaaataaaagccacttgtataccaaggatgcaatcaacgacaagagataaatgtgtgcatatgtgctgaaaacaacatcactctcagctaaaaattaggtatgtcttacctatgcgtgggcttccctcatagttcagttggtaaagaatccgcctgcaatgcaggagaccctggttcgatttctgggtcggga

SEQ ID NO: 48703 - DNA, 1062 bp, Bovine  19866881662088
catataaagccccgtgggaattccgtatcccagtttctggatcctgactgtgctctgtcttagacacaggccttttgctggcccacagaggaccactcagtagcctccatcagatgaaacggagcacagttcaaagagcttacaagccttcctgccccttggggtcggggcagcgataggaaaaggcggagttctctctcctcctccggtcctctcctgccaacaagaacagtcacaggagcggcaggagaataaacagacttagtgctgtctacagacagctgctggagcactccgtcatctgaaaagaagcaagctgaaaatatgaatggctttgctgccgttcaaactaacgcagacgctgccccctcctcccttctccactcctttccccatttattttcctggtgacagtttccagagcttttctctttgattttcttataatgaaattcatgaaggagtgaacagagagattttcgaggagaattataagcttgacagacgatggctatttaggctattttaattaagtcctaaatgcttcaagagaacacaggacgtcaaccgccaccacaaagaaacacgggaagggtgtcagctttactgctagtgaaacagataaaacgcagtaacgccatcctgcccagcacgaatcttctgtcctttattcctcaggctgtgctcatcttgggtccgtcctgttccattgctgttgtcgcgtggctcgaggcagagctgtctaagaagcagcctccgattctgttctcatccctgggatctgaggtctttgcaggccgataggcgtctctggctttcctttgttggaacagataactgcatttccgagatggagggaaatctgactttgcaggccacacggaaagcttcctgggcccctctgatttcccccacagggcctgctgacagaggcctgctctttgacatcaaatttaaccatcgtttcactgaagaagccattattaaaacgatgttccctttctgaaattaaaaagtaaaagaaggaactggattttatttctcagtgaacttgccacatct

SEQ ID NO: 48704 - DNA, 2611 bp, Bovine  19866880362655
atataaatgatattacattgcatttttcttctctgtctgacttatttcacttaggataatgcctgccaaatccatccatgttgctgcaaatggcaaaacgtcattcttttttatggctgagtagtattccattgtgtgtatataccatatcttatttatccattcatctgttgttggatacttggattgcttccataccttggcaattataattaatgctgctatgaatattggggtacatgtatatttttgaattaatgtttttgcttttggatatatatccaggagtggaattgctgggtcatatggtagttcttgggagaaggcaatggcaccccactccagtactcttgcctggaaaatcccatggatggaggagcctggtaggctgcagtccatggggtctctaagagtcagacttgactgagtgacttcactttcacttttcactttcatgcattggagaaggaaatggcaacccattccagtgttcttgcctggagaatcccagggacgggggagcctggtgggctgccgtctatggggttgcacagagttggacatgactgaagtgacttagcagcagcagcggcagatagaggtttgtgtttcattaatcttttcaagagacctcttctcacttctgtgtctattttctacttaattgatttctactttgcttttattttattgttttgttccttttactttaatttcctcttcttttactagctccttaagatgaaagctcagatcattgcttttaaatcttttgtcctttctaggtatttccttttaagcattgctttagctgcattcctataaatcttgttgtattttgcttccattgtcattcagttcaaaatattttctaatttccttggggatttcttttttgattcatgagttatttagaactttgttgcttagcttccaaatgtttaaggatatctttttgctattgacttcttgtatcaaagatcatacttttattgtttttagagaatatgctttgtatgcagagaaggaaatggcaacccactccagtcctcttgcctggaaaatcccatgggtggaggagcctggtaggctacagtccatggggttgggaagagtcgaacacgactgagtgacttcactttcccttttcactttcatccattggagaaggcaatggcaacccactccagtgttcttgcctggagaatcccagggacgggggagcctggtgggctgccgtctatggggtcacacagagtccgacacgactgaagtgacttagcagcagcagcagggttaatcacaagagtccttaaatgaaagaagagggaaaaagaagactcagagagggagaggtgaccattgaagcaaggttgaaatgatgcagtgtgtgaaggattcaacctgctgttggaggctttgaagatggacagaagccccgagtcaaggatgttagaacaagcaaagaaatgacttctctagaatctccagaaggaatgccaatgccttgattttagcccagtgagacctgttttgaatttgttatgtggagagctacaaggtaatgaatttgtgtttcttcaggtggcttggtgataaagaatctgcctgccaatacaggagatgcaggagacgtggggttgatccccaagttgggaagatttcctggagaagtaaatggcaaccccctgtagtatccttggctgtaaagtcccatggatagaggaccctggagtgctatagtccaggggcttgcaaagagttgcacataattgagcaaccgaacacagaagaaggaagttactagatgtttggtaatttgttacagtagcaatagtaaactaataaagatccctttcagcaacagctgtccatgaaattatatacatatgcagtgtatggagggtcattggaaaattcccagttaggtagtgatgtgtgctgaaaggtggctactaatgatgatttgaatatgaaatctagagcctgctagagagaagacctgtaggagcagatccagtaaggaggggagacaggatactgaagcccatggaggaaaaggacagtggaaaagatgtggaggaagaagtatacttcatcatttgcttaagcttgaggtatttgaaacagccctaagtactttttctttgattggcagaatggagaatgttgacagatatggctttagaaggaacagaatcttagaattagaaagggccattgaggctgatcttgtaatgaatgtcagaaggcattctactgcatccctgaaaaatattagaatagcactagaggaaaggtcctcaccgcttcctggaacagcccttctattattggaggccttacttcttaaataattttacctgtataaaacaaattcagtcttctcataatgtgcattctttgatcttggtttcctttttaatggatttttgatgctcagaagacctcaagaccaacatctgttaatgaaggggatatgggcatgggatctggggcaaagttcagaactagagagagagagatcaaaaactccaaatcatttgcatatagacagaggcattcggattggggttggggggatttaaagttactataaagactgaaatgt

SEQ ID NO: 48705 - DNA, 1457 bp, Bovine  19866880395408
ttgtgccaaacagagagtgagaagatgtttgtgaaaatgcttaaaaaccaccaagtatatacagatgatcacctaatgcatggtgataatgggaacaggtgaagtgctggtgatacttgtcctcaggctgtgactatcattttccttaagttaggcaggagaggtgttaactcaaatattctctgttggaaggagaaaaaggggagacctctatcgggcacctactccacaccaggccctatgacaggtgcttacatactttgcctcatggaatcctcaccccggccctatggggggattgtctctgctatagattaaacgtttatgtctccccaaactcataggttgaaatcctaacccccaaggtgatggtatcaagaggtgggggacctttgggaggtgacaaggtcatgagggtggggtcatcatgatggaatcagtgccctcaaagaagagatctcacagagctcccttgatttttctatcatgggaggttacagagaaaagataccaagtatgacccaggaataaggctcccaccagacactgaatctgctggcaccctgatcttagacttccagccttcatgaacgtgagacataaatttctgttcatagattatcactcaggcactagtattttgttatagcagcccaaatggattaatataacctctgtccttagatttcagacccagaaactcaactcggtagaggttacaaggactctacagccgctcaaccagaggcagacttgaagtttaagcctctaactccaaatataagtctatcagcccctgtctccagccatgatgccatgaagaaaagcaaatgcagcagaacagtttacatgtggcaaaacaattagaaaaacaagggcagagtacagtagattgattgtttttgtcacctaatatccatttaccactcttccagttgaacagaagccatgcccagtgggcatattcagccctgctgttttcacttcccagatttgaggggtagaaaatgaagatcccgcctggccatcagcaccctgacctccaccacccacagggccagcttcaagaacagctgagtccacctgttcaaatgaaacatgtctgttctgcgctgcgttggcttctaaggcacacagctgtccccacatggtaccaaggctggcccccagcagttgcaagcatgtatccttccagccaagcaatcccaacagatactttattcttttcctcaatctccactttaaagtcctaggctgatttcaatttatctgctttggacaaacattctctttagaaccaataaggctgccagacaaaacacagaatttctgattctttaaagttcaacttcaggtaagtcattttttagcatggcaatattcaagacatacttgtattaaaaaataataacttttttatccgaagtgcaacttttcttgggcaccctattttgttt

SEQ ID NO: 48706 - DNA, 820 bp, Bovine  19866880448452
taaatttgctgaattgaatgtcccatgaaatctatgtatcatgtggggataaaatgccagtagtttagtattatctagcaaaatgtagataagtacatttgctgtaaaactacgttttattcattgtaccaaatgaaatgaggctaatttataaagaaaaaattgaaatcacaaactgatttgatagatattcttttcaacctgattgtgataacttttctttagctttctctcagctttttgttatctggtttcacagcttcaaagtcccacttgttaaatacattttttaatattatttacaaagttattataaatcctatatgattgaaatcgctacagttgaatctttcattattctcatagcaggtagtatctgttcatctttatcattctgaaagtatctctttttactaacatcaatagatacttctcttgctctgcatgctgttttagtgaatgtgtcagatgtcattctgttcatttttttttcaactttccttcctgcaccattgtcccagagtctctcttgtttatagtcttgttttagatttgaagtgtaatctgcatatacttaatttatttaaattatttaaaatcataatatgttaatacatagatttttattatagaaagaaggaaaatttcttgataatcaatcgtgtttggacttatggaaagagaaaaagaaagaacgtgaaagtgtaggaatttattagttggctttcattcaatggttaagatttttcttcaagcactatttgaaagatagatgttttatcccagggtatcataaaagtatgatttatgatttagaaag

SEQ ID NO: 48707 - DNA, 2169 bp, Bovine  19866880457942
cagtagtcatgtactgatgggagagttggaccataaataagactgagtagcaaagaattaatgattttgaactgtggtgctagagaagactcttaagagtccctcagactgcaaggagatcaaaccagtcaattctaaaggaaatcaatcctgaatattcattggaaggactgacgctgaagctccaaaactttggtcacctgatgcatagagtcgattcattagaaaagactctgatggtaggaaagattgaaggcagaaggagaaggggatggaagagaacgagatggttggatggcatcaccaactcaatggacatgagtttgagcaaactcccaggagacagtaaaggacagggaagcctggttgtagtttatgagtctcaaatagttggacatgacttagtgactgaactacagcaaagcactgaaataaataagccataatgccttggttgagtttgggaagatgatgatggatagttgcctcttctgagtataaaaatgttatcacttatcaagaaatcaatgaataatctaggcaaaccacctctgcagtcctttccctgcaaatgaaatttaggaagcaggtggacatcggaacaaagaagctctaatatcaaggtcaaataggttctagagagctcttccgtccatttgccctgcccaccttgttccttttcacacaaaagaatgacacttttcattgatccaagaatattcagttttgagggtgttatttatccctgaattttgagtatatgctgttctggaatgcccgatttcctccttcttcctaatctagctttgcttttcccatgaaacccaaaatcatatcacgaataaaagatggtgagagcagaagaggaaaggggtaaaggaaaaaggatgtagggagaagtgatcaacaatgagagattccagcctggaaacttttgtcttgggaaaacttttccatatgttcaagaataaaattacactcatttatttatctaggtcttattttaaagaaaagtgagtgtctatcctccaacaactggaatgagccagctcattttccagctgcatttttttaattaaaaattattattagaatcacttgatttacttttagtattcataaccaacatcataaaaaggctcagatttgaacagttaatggaaataattagagaacaacttccagatttcttttaattgcttgcatcctattaatcaagcagcaatattgtgaaatattggtgtctaccactactgtttgtttaaaaacccatgtcaccattttgttttattgtttatgcggaacattttgactttcagagagaagagattttcacaaatgccagcaaaaatgctttgtgaggcaagattatttggagctgaaagactaaaagtgtggcttagagagacagttaagtatgccttaaagaaactaaaataagtattccatcaccccaagcatggcaacagtctctggatgatatctctcaaaaaggtggattttaaaataattaagcctgcatgtgtaatggaaaccaagttctcagacatgtgggatccagggttttgttagagcggtggccttgtaatgaacagatgtcatgtggttttcacagtttcatacagaaagaaagactatgatgcctcttaagaggagttcatcagccattaatccctgactacatatgcccccctccctttcaagcacccaccataatattcaaacacattgcatagcaagtttcacaatatggatcacttctttccaaagcacaaatgcatgctaacaaatatccatttgtatcttcacatatttctacataatgttttcttcagtataaagatgtggaatttcagagcacctaggaatttctttccatattcttatgtaaagccaagaagtaaatattatgaccacatgatgaaatcttgaggtcaactgactgtttctacatctcatagcaaaaccaagacagaactaaatttgactcaagtcccagttttcttctgcaaactcttgtgctacccatgggggcccacaatacaagcttagattatgtaagtgatgggttacatttctcttatttattgaccactgattccctcaccaccctttacccattctcatgcctgcaataagtgataactgacagtatcatctccccattgt

SEQ ID NO: 48708 - DNA, 1384 bp, Bovine  19866880466404
tggggaggggtcctccctggaaggactccaggagtctaatgtacaaatctatggagaacatttgcatattctttctctttttgagacactgatgatgtccaagcacatagcatcagtggcatggactgcgtttttcaagttgaaaaagtcgacttcatgatcatactgtcccccgcagagagacactgcactacatttctgtcataagagcttagctgcgttccgggaagtttgtggtggtgaagtgctgaagtgctgaagtgaagattcatgatgcctaacctggatgtgattttatttttaactctaaaaatctaagccctgtttgatccctaggaactgaggcccaggtagcctaagaagggaggtgttattctgaattgcttctgctgctgctgctgctaagtcgcttcagtcatgtccgactctgtgcaaccccatagacggccacccaccaggctctgccgtccctgggattctccaggcaaaaacaatggagtgggttgccatttccttctccaatgcatgaaaatgaaaagtgaaagtgaagtcgctcagtcgtgtccaactcttggcaaccccgtggactgcagcctaccaggctcctccattcatggcattttccaggcaagagtactggagtgggttgccattgccttctccgaattgcttctgcaaccagagctaatacagaatgatgaggcttctgtggtttggagtcagagagctcagattcagtaactgggtatctgagccctcagggacacacagtcttctcattctgtggctgataatgacccccctggaaaatagtaaggttattttctaaaaatattcctccctctgccaataacaaaagaaaaaccagggccccttacagagcttaaggtttgttgactcatgctaagaaggaaacgagaaaaggggaggaaaaggcctggttataattatcagcaacagcatctggggtaacagcagtcattatgctggcagcactggcccctactagggctaaagcaggaagtgtatggtaaagatttgagctcttttcgcctcactttggcctctaattttagagtttagttgagattttaatataaggtgatgtgagaaaccattttcatgctgtttgtacttaaaatttcttcccctcccccagctttattgaaatctaattgacacataacattgtgtaagtttaaggtttacaacaagtagatttgatgcatgtataaattgtaaaatgattaccatcatagtgttaggtaccacctccatctggtcatgtagttaccatgtcttttttgtggtgagagtatttgagatctactgtcttagagcattcatatatatgatacagtattatttgtattattataatatg

SEQ ID NO: 48709 - DNA, 938 bp, Bovine  19866880566993
tggctgtaaaattgtgcttgttattaaatgaaatcttaaggctaacttagccacagaggaaattaagctgctaattatgtgtgtctaaaccactaaaaatgggtccagttgttgctcaagatttcagaaaccccccccccctcttctccttggttttgaaatatgcaattatgtctggaaatagtacctgttaatgattttatacaattaaaagaaatattttcagagttgtctattctcacagcctgtcgctttccaaataagcaaaagatttgtagaactggttaattaatggatttttgtttgtttatttttccaaatcatctatgtcaatgtctttataaaatctgagtcatcgtgtttatgccacatataacagagttctaaggattcaggcaggatgaccacactatttttatagcactttcttaaaaaacaggtttcttcaaaggcaaaaattgcaaagatttggcagatttggagagaagcaattctgatttgggatagaaaaggagtgatgatttcacaaatgttcatatgcatttagaaaggtgaatttattgtgagtttatctgcatgacaaggaaataaaaaatgtatctcaaagtaagtcagaggccagtaactggccaatattattttaggttcttcctgctgtgtcaggcagcctgtagctgtccataaatgatcagataagcaaaagaaaaagaaatttaataccagattttgacaaaaatgagaatgcaagttaatagtaaatgtctgtgttacagtgaataacttgaataatttgcatggctcaggcccttcagtttgcaaatagtgttttaattagatctcttgtagtttctgtagctcaacagcatcacctaggagtttgttagatatgccgaatctcaatctattaagtcagaatctacatgttaaccagttggcag

SEQ ID NO: 48710 - DNA, 1480 bp, Bovine  19866880595160
tgctctggactttgcctcatctgtcttgcaacatgagggaagcaaacacatacatccttggggccaacctgaggaacagggatggctgttttctggagatatggataaagcttggccatgcaggacagagtgtccacacgtgtgtgcaaacccctctgcagagcaggacaaggcaagatggggagtgaagaagggctggtgtgtacagggctgtttctctgtcacagcgctgtattgtgcacacaagtccaagaattctcaattcaaagttggtcttctagggtgttaggaaagtaaatgtgccaaagtagatgagagataaaaggatataaaaacattttacttatcaatttatgagcctgatataaaactttaaattacttatgtagacctatggtatatgggccgccgcttggactctcactttagaatctttgaaggtttagatggacctgaggcaaaaccacacaaaggatgagctgatctgtgcccagagttgccatgaacatatgaatatatgagtctcattctattttaccttttttccttcagttgaaatcatatgcgtatactctataacgataattgcccagaagcatacctgtcatcttatttcacttttatcagtttctagttcctctgtatctttcttttcctgctattttttttaaacaaaatttaattaccatcagaatactataaagtgattatccttcattcacatttctatttatccctcccatactctctctggttcattctgaaattctaagattctttaaaatttttccaatggtattattctatttccacaagtcataattaaatttttcatatatcaaaatgaaaactaaccataagcacatatactaacatgaagcctttaagaggcttttgttttttaactctttttccttgctggcccatttccaaatgcagggttttgccaagttattttagtttcaggctattgagcttttaattattgtatgtcctttccaatccaagaatgcttacttacagaatcgcatctagaagacaaatatctagcttcctaacctctccacacacaaaatcagatttcacttggattaaaaattaagcatattgtgaatcctgtttataacatcctgacaaagcctttgaaacactttgtcaggtgaaactatagaccctgagagaaaggaaagagagcgatggctggaatgaggggacacaggatggaggccaaaaacacactacagggcaggacaagcagagagcgggggctcagggcacacacagaagccaaacacagcaggaggggaggtgtccatccgcagcttgggggtcataccaaaaccagatgtaagggaaatgcagccaaacaaagctagaccagtgggaggacagcgaatcagtcaggtgaacctacacacttctatatggaagccaggaagaaagcagtaccctcagtttccaccactgggacatccctgga

SEQ ID NO: 48711 - DNA, 1409 bp, Bovine  19866880672927
ctttagcactctcacatttgtcccagtgtgtttttctctttctgcatctatgcctctgtccctgtgctgtagtcgatggtgtccttctgaaacatcaggtccttttgtcagccgatcctgtccttgaactgaacaaacccctcacaagagggccatgagttgagtcacttacctctgtctccagaggagttgatctcccctgacaaggttttgtctggttttcgtggcacagttagtgacagcccatgcatgtagcagtgtgtgacccgactccttgcctcaaactgtgtagtcgtcagaactgtcacagcgtcaaaacaagttaattccacgccagcagaagggcaggctgtaataatatagagcctcgggagatggggctgtcaggtggtgtgtgagctgcggccgccctagctgctcacgtctgtgggcagagatgcacgctgacaggcggcctgctatttcccaaggagccggctgggagcaggcttggtgatttcctgtcggttccttgctgctccgggtcctgccagctgtaatctggaaatgacagtttcaacagggaccattttcagctctaaaaaacctgtcttttcctggcagaggctgaaaagtgctgttgacccttctatcttagttcttccttttgacattatggctaatgagaatgatgatggggtaggtgtgtatttgtgagtttcccaggagacgattgctcattaacgagcattttcctctccctgtctttaagaaatccttggtttctgatacttaggggttggggaatgagcctgtttcttggagataggacggttaagagttcacccaggatatgaagggagaacatgtgttgcgggtatttatccataatggaagtttgagggtgtgaagaagtgctgatgagtatacagcccggggactgtagaggttcatggccactcagacacaaagcacaggcattcagtcagctgaagttggaaggcccgtattcctgctcaaggcaggaagtcatagttacatcttagattaagggttaccaataaatgtggtttttctttttcttttagaaagaggggatgagtaaggtgaaacacagcagattttgcttgcaattaaagagtagtgaaaatcagaatcacttttttttaccccctaatgttatatatgatacctggggttgtgtgattcctgttagaacacttgcttcttttgagctgctgtagtttctcctgaagtgattataggaattggtgagcaaagggcagtctttcctcatatataaagagttgtcttgttgaagacctggtgccagatttactgactcaacccagcgcccactagaccagctcagttcagagaccaatctggtgtaaagaaacaagcgtgcgatacatgatatcctgttgttt

SEQ ID NO: 48712 - DNA, 1246 bp, Bovine  19866880672952
ccactccagggtgttattttaaaattatgctaattaaacatattccttggtcatatatcttctgcagcatctaacaatgcaggttatcctcaagtaagaaaaatatttttaaaaaatgcaattttttttttcttgcattaaattctgtttagttttgtctcctttgtaatggccagacctagcctttgaacttggcattaatcaaggcagtaattacaactacagacactgaggaaaaagtgagtcccctttccagttagattaataggagaaagcttaaacctctgacagaaaaattctggaagcgtacgtgaaaatccctcttactgggtcaccattactcaaagagggtcctgttgaaaataagaaattcacagctgtcctgctgacatggagagaaagaaaacatcaaaataaaccttgaagaagtgatttttaaagcagcagagttgaggcttgacccagtaatagattttgaaagggtgtttggtatctctgcggtaagtcggggtgtccaacagacaaggctccgcacccgaatacaaccaggctggaggcaccttaatagtgatattgattgactataaacaaagacaggaaaaagtaaccaggatagcagagaaaaatgtatttgggggaaaaaggttattatcctccttcaggatgactaataccacagccaaagaaattcattttacaacaaatattttttgagattctacaacgtgccaggcactggataagagacacatttctaaccctcaaggcattttcaggctcgtttatgtgttttagggaggtcggtagaaggagggaagaatccatggcttatacacaaaaatcaaacctgccactttagcattatcagtaacctacactctactgaattgctctggaaaaaggaaaaaacaaaactataccatacagaatgcctctcattttgtttctgtcacaaaatagctgggtaacttcaagcagtcacttcattttcctgggtcttaatttcttcttggccaaatacaaggagcaatagggagaggagaaaacagtaaacaaaagttgtttctttccctctttctaattccagcatgcaaatttggtccataattgatatgcatctcaatattagaatgtgacctctaatgatctctgtgaacagaatacaaactctctttgtaagaatcaatctgtagcaaacctgtgggtggactttttgaggacaagtgggggttttaccacagtgcca

SEQ ID NO: 48713 - DNA, 1018 bp, Bovine  19866880681539
gggagaaaagagatgatgtatgatgtaaggtaaggtattaatcatgtctgacacctctggataatcagctggagttatccttgggaacaactgcttttcaaggatggaatgagagaataagtggggagggacttatcaaatgagatggcctaacccgataagatactgaactctatagctcagcatccttcctggaaatctggctggcaattaaattcaagagttggaaggttgtcaaatggttgttaatgttttgtttaacattcgtctcatctgcaccagagtcatcccagtagaagctcaaagtctgagttcaggagacctaccatcagtcaaaattattatcctcaagatctgtagctttgtgaagcatttcctgtgtttcctagaaaaggctgccatcgtgggcacatctccaagccagctcaggcagcggtggagcttatttctgcctgggtagagattaccacactgaagaatgcctgacaaatgatgaaacacgagctcccagatggcaacctggtgccacacaaaggacacaacaaaacgtgatccatgaagagtgtagtcaaactgcagctacatctatcacttagaattaatgccaaagtccacctatactcacacatctgaaaaccttacttaccctaccctcttgaacttgaaaggattaaaatatatttaaagtgcagtcatgtctttcacggaattcttcatttccttcgctacgaatcagttgtgatttttatttttaataaaaagtgatttagaactatgtagtcctctacgtttcatcaagagtttttgtaatttcaattttcacaacaatgcattttatttcaacaagcactgactgatcacctgctttgtgtcagtctctcttccaggcaccaggaaatgcaaagataaggaagttaagaaagctgtcttgaaatacccagagtttaagaagaaagacaaatgcataaatggtttattatgttataagggctgtgacaaagatatgggcataataata

SEQ ID NO: 48714 - DNA, 2748 bp, Bovine  19866880696598
ggtacttttttggtgatttcactgtttaaaatgtcccaaaagcatgatgttgaagtgttttctagtatttctaagggcataaaggctgtgatatgccttcagagataatatgttttttatagacattccattcaagcatgagttatggtgccattggtcatgagctcaatgttaatcaattaacactatgtattaaataatgtgtctttaaacagaaacccacacaaaacaaatgaattgatcggttgacagaaatgtgaaccaggagctcacaggcacctaactctatttcctttaggagcagcagttcagactttgctaattcagcatttgatgtcactttacagaaagcacctgccaagaacaatgagaatcaatatatatcctttcttcatttaatttccacatccatcctgtgaggcaaaggggtaatcagaaggttcactaaatgcatcaagacaaaggaacaactttgagtattgaaggatcttagagcacaaaggaccttgggagagaggggaggtgggtgggcaatggaatagacaacatctgttgattgcaaagggcttcactagatcagaggacaaggtggtaggtactagggctttgtggcacatttatacctctatgagggggtctatattaataataaatcatttgggatgactggatagatgacatgcattcttctttcccttgactctctctaatgagcttaagcatttgtatggcatttgtctacaattagcatgatagtaggtgatacgctaaatctggggtaaatttctaaaaccaaaatctgatgatatatcagaaacatcagaagagttttttcagtcaacctctcagctaactcaggcaagaaagatgaaaagattcaatatgtctctatctggaaatcatctcttccttgctttcatttcctgccctaaacacactctctcttggacagcacagggatttaaagaactctaaataaaacgcttctttcaaggaagtttagaattactgtttagggacaggaagggagcttgatagccatctgtttcaattccctctatttcaaacaagaactctgaagttatgggagttactgtgacagactgggaaccataacctatttccaacccataaccaaagcccagttaagtggactttccatatctataattatgacacatatgcagattttccaggagagctttggttttgaggacatttggtcccttcattgctctaagagtacttgtatctgttagtttctgggtcagataatatggtcactacaaatattatgctacattttctctaactgatagctagactttaagttctatcctcctgtggctattcatccaagaccgtggcttctcttgtcacatctgtatgaatgatcgccaagtcaagaaagaaattcatagaattttacaagagatagactaattggtcatttactcagtcccttcgttttactgataacggtgaaactgagtctccaggaggctaaatcgtgaccaaaacacagctagcaaaagagagattccgaaagtaaaataagcctcctataaatattttaaaagtataaagagattggttaacatacttgctatttcaacattatgatggacctaagggttgcaagaacatcagaagaagcattacaaaacatacacaatacaacggcaatgacaaagactttcattcgtctcccaggtgagaggctgcaagccggtttcctcagtacataaggcaatactgactgggttatatcaacatgaaaaacaagtgccctgaatagctacctgcaaaaataaccatgaaaacatttaccaggggtttacataatagaaggaataccttgaacaaaatacaaatacctggtctacattttaatagtgcttaaaagtcaattatcatttcacaccagaagtgacagcagggacactgtcaggctcttagtgataaatagacacaataagactaagcttttaggtcatttagaatcttctcaaactgctaaaggccagcagatcacatgagatgaatagttgttctaaatgattaagaaggcaaacaataatttggactccctaaatctttgccattaaggaaaagccttgtttaaaaggcacactgggttataaattagggggtatctggcaatggaagtgcatggatactctcatcacactgccctccctccacaaaggacatgctgataactgggctttacatctgcttatacaaaaagctgagtcactgccaccacctcttccttggtctcagtgactcacaagtcttgcccttctaatccatcctacattctttggtccaggcatttctgcatgaaacatcatgttactcattccagtccctgctcaaaatcctcagttactcagaggaaagccaaagttaggaagtaccatctgggacagaattccttcattctgtctggagtgatgtcccaagatctggggtcaaaggaagacaaaaaacaacctggaagacattactatcctagtgcagcccaaaagccacctgggctacagataggtggcccttatgcttcagtttgcctggcacatcacagtttgtgcctattattccagctggtagcatcccctccagctctaaaacgggctctagtttagatgtttagaaatgtcatgataaccctagttctgactattatgatgcctcgtgccctccaccaacagaaacatttttttttaccataagttacagaac

SEQ ID NO: 48715 - DNA, 728 bp, Bovine  19866880795525
tgagaaactgaggcaaagctccacagaaagtggatgctggatttaaactctgagctctgagattttcctggtagtccagtggctaagactaggtgctcccagtgcaaggagcctgggtcaatccctggccagatctagatcctacatgctgcaactaaagatcttaaatgctgcaactaagcccaagtacaaccaaataaataaatacatatgtttaaacgtttttaaaaaatatctgaactctgtctaacattcactccatcatccccacaatgccacttattcaaccatgaaatcctttttaatcagtctcagatcccctcctcccatttagtctctagaaacatctacagtttcccaatacccctatgcattagagatatttccttctccaaattggcacaccctcacaaactctaaccttctaaaatcactctcctcagaaagcacaggaagagtccaaaagtaggagttaaaagaacaatttccttttagtaatgtctctcctcccagacaagagcaacaaaggcagcagtctgaatgatcggctctcctggactccttattagctgtctacggcgatctgcggcccaggttggccgcacgctgccaccgtcactatagaagcactcatttccccattatgcggctgagcaggtgccggatgcagagctggacggtgacccaatttaccacgcagcaacaacagaaccgcaccccagctggag

SEQ ID NO: 48716 - DNA, 1348 bp, Bovine  19866880821562
actgaagtgacttagcagcagcagcagagaagtataagagaactgacccagttctttaaaattgtggctaatcctgagtgcctgaacacctaaagccactgacagcacatcagtaagaacgatgctttggcctctagtttaagtcaccctattatgcttggagcaatggcaaggctaccaagccacaggggtaagaactgtaccaagagggatggaatttgttcaaaagggaaacaaaatgagaagaggagcacatgctcattgtgcaaaaccatgtctaattcaacattttgtgtgacaccttgcatattatcgctttaaattgttgaactttaataatatccttgaacctgattcttcaacaggcacatcataaaagccatcttcaaaagtgatgctagaaaaattacacttacggcttagtgttatttccaacaagtattgaacactacttgtaatgtgtaaaaagtacccatttaatttgccttttcaatatcacagtgaaaaaaataaaagaataagaatgcatttttgaagcctgtaataaggcctgaccattcagagtatctatgtagcatctctgcatccacctccagaaaccagcaaactctctggaacacactcagcacgacttgacttgagtcctctttattcacagcattgaaaatatccacacactcttcttattacacgcactgacaattctcccaaagtctccttgtgtgggacagaaaacactttaatcagaactcaatatatcatagagaataatgaaggctttaaaaaaaaaaaaagcacagataaagatagctttacaaataagccaggactttcataaattgctacctgctgaaagcacacaatgagggccctgtcataaaatcacagtgagataataaccgttttatttaataaaacccggtgaccaactgaacacatgtattaagagttatgcagtaagaatgcctttttgtaatttcttacctgccgcgatgtcagaaatcgagacagtattcccggtgagcccagctggaacacgcatagccaacagcaggccatcttgatgtctgtattctgaagtctaatctgcctgtttggtcactctcagtgtatgacttacacaggcaagacatctgaagtttccaaagtttggttcataataaacatccctatgacaactgccaagaagaaaatggctttctattaattcttttaaaattggaatcctaacatgtattctaatatgatctaagaaataaaaacaatgggacaaaatatggattgtacttccactgtgaagtttccatgggaggaccatgaaaacctctattactaatatcatgaaaag

SEQ ID NO: 48717 - DNA, 1481 bp, Bovine  19866880942264
ctggaccccttacctgcctcctgataaatctgtatgcagatcaagaagcaacagttagaaccagacagggaacaacagactggttccaaatagggaaaggagtctgtcaaggctatatattgtcaccctgcttagccaggctggatgatgcgcaagctacaatcaagattgccgggagaaatatcaataacttcagatatgcagatgacaccacccttatggcagaaagtgaagaggaactcaaaagcctcttgatgaaagtgaaagaggagagtgaaaaagttggcttaaagctcaacattcagaaaactaagatcatggcatccagccccatcacttcatgggaaatagatgtggaaacaatggaaacagtgagagagtttatttttgggggctccaaaatcactgcagatggtgactgcagctatgaaattaaaagacacttcgtccttggaaagaaagttatgaccaacctagacagcatattaaagagcagagacattactttgccaataaaggtccatctaatcaaagctatggtttttccagtaatcatgtatggatgtgagagttggactgtgaagaaagctgagtgccaaagaattgatgcttttgaactgtggtgttggagaagactcctgagtgtcgcttggacttcaaggagatccaaccagtcaatcctaaaggaaaacagtcctgaatatttattggaaggactgatgctgaagctgaagctccaatccttggctgcctgatgcaaagaggtgactcattggaaaagaccctgattgtcagggggtcgttcaactttaagggatccaatatgttttcttcctttgtgtgccatttctcaaggactctctgttccttatcagttcctagaaaatgggaacgaacagagctgcatgtagttctcaggactgagatcatgggaaaggacacctgcttggattcccttcagtgactctcttcagtgaccttgtacttaaaggactatccattttgttgcaactgctgaaatttcattcttcttaatggctgaataatcattttattgaagatatattagcatgcatttctgtaaataaagtacccttgtttcactcaagacttaggtcccctacatccttattcttgttgactccagtccccaagtcctggtctacgaagaccatgacacctgatgctggggaaaagtgaaggcggaaagagaaggggatgagaaaggatgagatggttggatggcatcactgacttgatggatttagtttgagcaagctccaggtgttggtgacagacaaggaggcctggcgtgctgctgtccatgaggtcgcaaagagtcggacacgactaagtgactgaactgataactgatcatatgtcagctcagtgggacattatcgaggcattataaaggataaataataaaaccatgcagcaatagggcaaaatgcctctcaagtaaaagatgtttataaaat

SEQ ID NO: 48718 - DNA, 1807 bp, Bovine  19866880968421
agccctgtggcttaaacttgggcaatctgatgcactccacttctctccgcttctatccaggcccatccgaagatactttccagtagggatattgtgagatttaatcaattattattaaagggctgaaagatccttggatgaaaggcatgaagataaaagcaaagtctggccctattattatcactttcctctgctcttcattcatctgttagtgaccatgggaatacgctcaagtgtgctttggtgcattttgtaaaatagagaaaacataagtaggtaaattatattttccaaacaaagtgccctttcttgtttgtaactcatatgcagtagattggctggcattgcctgtctcatttatctctctatgttgggttgccctctgtgtctaattttcccttattaatgaatctccccttttgttccacacaaatctaggagggtgacatttatacaaggtaatcatttccatgcattaccaaaaggattatttattggtggttatccagtgaaagtaagcacatctgtcacccaaatctgacctagaatgggctgctcttttcttagtggaatattagaatctgcctgcaatgcaggagacacaggggatgtgagttcaatccctgggtcaggatgctacattccatgccaacatccattctgaggtagtaaatgtcagtgtcaaggattaacttgagttacatagtgagtgtaagttcactgtatagtttttgtaaaggtctgatgatagaaacagtgtcttcacataaatgaaatacttttctatctttctatcatgtgtctattaatatctttgatgttataggtgaatggtgactctgaaaaggccagtctctataggtcccctccatgtcgattgctttcgagtgataaataatattggcaggatcacattccattgagataagtttacacttattagatttgtcttgatttggtattacctcataatttagagaaaaatacagatttcacacacctacattttagaacaagtcatttctttggttgctttgcggacgagattgggctcattcagggtggtatggctgtagactttgttgcttttcagattaattttgtattagctttgagagagaatgaatgatgatttgactatttgccagtgataactgaagcatatcctgtgtactccagtgcagataaaatgttatggggattttttttttttttgctttaatataatacgagaaaaattaccttctccttaaataagacttaagtggattgatggatgtctacctaaattatttaaattatcaaaaaagatacctgaataagtaaatgagaattctcatttagagacagagcaaccgtttcaggactgaattcaaatttgtttaaaaggaggaacctgggcatggagttaaacctgagctgatatctgtagatcctgtgctggttgttcacaaatgacatcttttctgactggttgctgtatctgctttgattcatcagtatccatgccgtgctgctgctgctgctgctgctgctaagtcgcttcagtcgtgtccgactctgtgcaaccccatagacagcagcctaccaggctcccccgtccctgggattctccaggcaagaacactggagtgtgttgccatttccttctccaatgtatgaaagtgaaaagtgaaagtgaatttgctcagtcatgtccgactcttagtgaccccatggactacagcccaccaggctcctccatccatgggattttccaggcaagagtactggaacagggtgccattgccttctccaatccatgcca

SEQ ID NO: 48719 - DNA, 857 bp, Bovine  19866880988791
gggagaggcttgaagggtatacctttaattgtagttttgaaggtataactttgctgaatcctggaataattaaaatctaaatcctgatgttcaaatgccccatgtattcctactgaagttcttctaacaagaaaggaattttaagagcatagctcggaaataaatatttataatcctttgattacacagctattaactttttgtatattccctcctaattttatagtctccattacaccatacatttaattttatatgatgcttggatcaaaactacttttccaagttgtaacatagagttaccaagtgtaattgcaggagcttcacaaaggtttttttgaattgatatattataatttaataatttctctggttttaatattttgctaagctctgagaataataaggttaaaaaataaaaataaatgctttttactgagtaaaatatttttgactctttttgaagatcaaacttcaactgttgaaataaatttaaatagctctagtacctttttcatacattcatcacaaacttgaagaaaataaagaaaatggcaaatgagagagaaaagaccagaaaaggaaggggggaggggcatggaggagaaaagagaacaggaagataagcagagggaaggacttataattacaaggataaattgaaggtcttacttctgttctgacatttgcttcatgtaaatgatgaaaataccatacaaattcatttgaatacatgtcaagtctttccatgaattataataaatgtcagcctcattctaatatttaaaaacaaaagctatctataactcagacatgaccctttcccctattgtctactccatcatgtaaaatatcca

SEQ ID NO: 48720 - DNA, 823 bp, Bovine  19866881038377
aaacatatactaacttggataaccaggaataaatgagcaatataaaatctcgggggaacacatgtatacctgtggcagattcattttgatatatggcaaaaccaatacaatattgtaaagttaaaaaataaaataaattaaaaaaaaaaatctcaactactgccaatactcatgcaatggttggggatagaataggctggtctttgcagggtttttagagagtaagatgggctcaatacagactgtgagggacaggctttctgggagaggtggggagtgaactatagcagtagagagatgtgcgctgatgcaacaaagtgtaacatagtttgacttacattaggcagaatcatatttcaaaacttgaacataaataaatgcaggcacaaatgaaattaccaaaatcccagtattcatcacacattttcattgaacccgtacctttagtaccactagcactaaatatggacatattttgggtttacataaacaaatctaatcccacaaactggatctatagtcaactctatttttgatggcttcagacttcatgatgaaaattgtacactacttactctaagacaaatgctaaaattaagtttcactaaactgaaatggtagggtttatataaacttaaggtccctagattcactcttagcattgtttcatgaggtgctaggtaagaatggaaaaagagtaactttagtcttgcaatatatgttgccaaaggagttgtcacattatctggtagctgaaactcaaaaaagaaacactttccacatcataaatattagctatagaacagaagggtccttcttataa

SEQ ID NO: 48721 - DNA, 1705 bp, Bovine  19866881056698
ggaacttagggggaagaggatcctggatttaggaaaagtggattttagaaattaggggcaaaccatgaacaagatgaagttctgaaaactagattcttatcatcccatgagggaatttgacaacacaatgtgtatttcaatcattttcactttgaaaaagaagtaagataaataacatattttgatgtaaaatttgtatttcaggtaaatggattcccatttaccttgatattgattaacactgtgtggctataaaaatttgtatttgattgactttatctccctaaacaagcaaaagcagatgcatcagccattagtgaactgctactgttcagagttcatctgagggggaaatgggccaatagaaggctctccttctatatcttatgcagcagtcttgcggacaattttctggtaggatctggccctgctctgatgcacaggagcaggattggaaagtgaacactgaaataagcatacaacccagccaagagcagggctgcattcaaattctagattcatcatgtttgagtaatgtattgacattcaaagtgatttctctcacttgctccaaactgggactagcaactctctgaagggagaaaatgctcattgtgtaagaatttttttgatttggaaccagagatggagaaataggagggaaaggatcagggatacatccttcattgcccactgtatcagtaaagttgcccctcttccttttttttaagagtctgatagtacatgggctcaaatgggttgattcctattgataaaatggactgtttaaaattcttcataaactatacccaactctgtaaaattgtaaaatggaggataaggatgacataggtgatggaaggaaggccgttcagccaatgctggccgagaagaagaacaggaatctgtgagaataatttcaagagagaaatgactagaattagttgagactgacagaaaaataggaaggtccctaacaaagaaaatattgaaaattttacttgatgcatagattatttctgtcaagataggaaaagctggttatctctgggtcagggagctgaggaattggaggacattggtgacaggggaacttattttctgctatagattcttgtactttttggagtttttatcatacgcacttgctagtttttcaaatagttaaacagaatttaaaaagacatgggcatgtggtagacactgctcatagtctcctgatcccgacttcttacacagggatcaggtcctactaataatatgtgaccagaaagaagttatacttcctgatttcattattcaagggaggaagccctccccttcacctctttccctttcctactggctgcagcatgagttgtcttggaccatcttgtgtcagtacttcaggaatggtagaatggtaagatagaaggatcctgggctgctcttgactttgtgaatcagcactgtcataccagtaggacgtttatgtaacagcaagaatcactatcttatttaatctgctgttatatcatgtgtctgccatgactgtcaaaggtatattttaaaaaggtgactacttttgattattcatggtagccaagatatagaaacagcctaagtgtctaacaatggataaatggataaaagtgtgtgtgtgtatgtgtgtgtgtataatgaaaaaatagtcttgacaaaaaaataaatcttgctattgcagcaa

SEQ ID NO: 48722 - DNA, 904 bp, Bovine  19866881064288
tttaggagcttttagacaatctggaggtagtggaaaattagatgcagtgttgcattagacatgtttttagtattttcttctttttgtaaaagctgtaattttcagagtttagaaccaatttaatgtccctggagttacagcttttttgtatccattgtccattaggtgaattactaagccaagaatggaatccatttataatgtataaaatactgtgaaatgtcttaaaaacagtctttgcagggggagaaaaaagcactgggagtccattaaatttgaagacagtgagttctgaggttcttcttataatcatataatggttttttggtactttgataatacgatgcattagatattggaagatttatttaaaagtttgaattcaatgaaaatttatgtaaaactaatgcaaaatgcattatgtttgacattccagacagctttcaaaactgagtgtattgttaaaaaaaaaaaaaactttgataaaatttattatttttgacacaaatgagtaaataaccaatacaattctactacctgtcttatcaaagatgatgtcactgttactggcatttaataaacttagaatgcttggctttaaacgtctttttttaacagaaaaattaattgctttttaatagattttggaaatgtattgaaactcattgatgtatttcttggttgtccacttgctcagtcatgtctgactctgtgacctcatggaccccggcgtgtcaggcttccctgtccttcactacttcctggagtttgctcaacttttaagatataaaattagccaataaagaaaatcttaaaaataatttgaaatttataatccatgtcttatagactcataaagattgacaattctatagtctcatatatttctgtttattattttata

SEQ ID NO: 48723 - DNA, 868 bp, Bovine  19866881066267
gtttccagctcatcctttctgtgttctcctttgtccctatctcccccatttcacatctgtcttcccttcctgatattttttacctgataacttgaaggccaacatcgggatatagaagcaacagcacttcagaaattacactaagtcaatcctcctcgataaagcccatattcttatcatttctaagattctatttctttgatcaaacccatgtgtttaccatacacatgtgcctattatctatagaaaaggcatactgctaattgttttctaggatttatctcattcactcctcatagcaaccatggaatgcgtactattactactactatccccattagagatgaagaactgggctcaccaggaccaagtgacccttcccatatcacattcctaaaggagtaatgaagctggaactcaaaccctgcgaacatgataaagagagtccagaaggttatatgctgtatgtactgcatctttagttatgctccttggggcagttctgtaaggtttagacacttattaagtgcttttttcatcagggatttttgctcagaagtctttgggttcatgactaagaaagtgcaattgattgaggaatagaatttttgagatagaaagaagtttaaacatcactgagaccaagtatatgtaaaagaaaataaatcttacagaagagattgtgcaagttaaacaaagtctcttgatgaggggtttctgcctaaattctgtgcccttctgtcacaacatactccaaatgcgagcaaactgaggttcaccttcaatagtcaatgatgcagggatctgggacataccatggagcatctcctgagccaggtttaggactttgagatttgttcatgtgtgt

SEQ ID NO: 48724 - DNA, 927 bp, Bovine  19866881071593
ctcagtactctggaagaggtgtttgctcctgttcctttcactaaaagtcatggtgaggtctcaatccactgaataaacagaagcagaaatccagtttgtcacaggaaggggaaggcatgagtgtgagataaaacctctggaatctgtcactgagaagagggggaaaaaaagcaaggcaactatagaaacacatgtgctgatccagatccatgttttcttctcactgataccccaggaagttcaattcattactactatgaactaaagggcaaggcgagctggctaaaaacaccagtacatcttgtgcttggaagaaggcacaagcagtatgatttcagctccttttcagaggcacggatggaatatttcagaaggctgtgttgcctttgttattaagaagctgtatattatcaaaggaggcagtgaaaggccatattcccacagggtctcaccctcctttctatgcaatgcctaaacaggctcgtttattcccatcttattcgtttccctctagctgataccagtgacccccaaaatgttcagctcccaagttaatgcacatttacagccagggagtattttcctggcactgaatttgggaatgaggagtggggagggagaaaggaggtaatttaagttgctcttttgttggaagggaggggagtaattcttgcttctatcagcagcttgctgagtctcgccatcattcctacccccttttattttatttatctctttatggcctatctgataatgctataaccatttcctgttgtatcctagctgaggaagctttctccaggcccaagagcaaatcaataaaagcaagctatagcgattcataaaaataaaattgtcatcattattgttcaattattgctgtgtctgggaaagaatctcaagaccgaaggtttctcagctaatatt

SEQ ID NO: 48725 - DNA, 1623 bp, Bovine  19866881081569
cacgtggggccttagttccccaaccgggatcgaactgacatcccctgcattgcaaggcgaattcttaactgctggaccaccagagaagtctcaagagtgtagctgttaagtgtgcagcactgagacttgcctgtgatgatgcactgagctctgctgcttagtgtgccatcctggctcacttgcttaagttctctgagtttctttgtcattaaaatgggtatattaattcataggattgttgtaaggattatataatctaatagaatatctggaatagtcatagtttctgacacaaaaagcactcactcactgttaatgacaaaaattatcatcttgtgactttttaatgatagaaattatcatagttgggacctccccgctcagagatgtcatctatacagaacataggcagtttggaagtgactactagtgcccatcagatttttgccccccaaaacctctttttccatgtgctttctccttcatttcttgactatgccctgtgcccaggtctagcaccattgtatccccaactgtgaatctttgctaaagtcttaaatctctcagggcctcagtttactcatttgtaaaatttactcagtgcccattctatcttaacaaattaaaaataggcttacatcttatgttgctctgagtctaactcaattttgtcttttaaaaaagtaacaagttggcagtctctgatgtgaaagaataccatcaaagagtcactctgcttccctagaccacacctcagcctgaaggctgggaaaggggttccgaggactgtcctgcgcaaaggcattttcaatgtatttcatgctatcaatgaagtatgcagtgcacacctgcctcttaggattatttctcaggttacagggaagctcagaaaattgctatttcttgacctaaaaggaggttaaaacgctttcagtggaaatcgattcactttaaggtatttaacactgttcatattttgtacaagtctctgtgacagggttggtttcaattggcactttttgctgcagttgtaggaagactatcacagagagagtggaatctgaatgagtgtttaacaagatgggctatttcctttgtttcacttccaagatagaaagggaacatgccctagacccccagactggctggagatcctgtgaactttatacacgtctgctccataaaatgtggcaaagtgatttctggaaaaataaaattaatttttcctgctgcctttatttttcctttgctaggggaatttatgttacacgtggtcaaatagcattatgtacaatgaaggaaatgaagcgtgagagaatcattcaataaaaaatgataaatcataaaagatcatttagagaaaaatgctgttagcaagagtttgagaagtttaaagatcttttttcataggtttttaggaagtgctatcacaggaaattgcaccatttatacagttgttcttctcttccttgaaaagatagtgtgatacatttcaaatggaattaaataagaaatgaggcagtctgtcagtcaccacctgagactggttgggggacactgctttctgaggagacaaagtaggtcatagtcatgaccaacaactcagaaaacaaaaccccaatt

SEQ ID NO: 48726 - DNA, 1446 bp, Bovine  19866881114591
acatcatgctcataggctgaaatggagcatgctgagaatatttacaccatagacagcagaagacactataaatcaagcttcagtttgttttgctgattgtctagacttaactaagtcatagggaaaatattagcaaagcaaattgaacttaaaaaatgtattgtttaggtagccatcatattgttaaaagcacaaaaaaattgaagaaatagttttctagtgttcaaaactgttatctctttgaacaaaaatttttgctcagcatattctgacatatcaatttattgtttctctttcgtcttgctcatgaaaagctaaaatataaaccaatatttattttagagccatgcttgttcagtatttgcagccataggttaactatagatctaagactttgccaaaaattaaagtattttgtgaggattaattgactatatgaaatttgtaatggagtgttgtatattttattattatttgttgtgtatttaagataaacttatgtttgtacatacatgcatgtatttttttttttttttttttgcctctcagaggtttgttgaaagttcacattacatgttatgcacgatttctgattatttacacagcgtaattagaattgcattccattctctaccttatgagattatttcctcaaagcatactatagtggtgccttattctaagcattgagtattttttgtacattgtcttggagatttcagaggaaacagtcaaaacactgagaagtccttcagtgggaagccgtttagctttatgttggtacagtgttttcaaaacattttaatcactgtttcttttctctctctctgtaaatactgatttcacagtttggaaaatgctgttttagagattgattaacgaggctcatttgatgctagatctttaatgatcaggtcccatggcttcaaatatggtctgctattcaccttgatcttatgattagtggttaaaatgtatatttttcagtaagtgctcttatttttttacatagaagaaaatgtataataatgggttacaggtaagtcagttcaatgactttattcattggaagggcttagattccccttgggaattctattgccaacatcctaaatttggcttgttctagtggttccagtgctttggatcttgaaatcttggtgttaattcattccattccaggaagttttaggcttgtgctgaggagtggaacatctttatgaaagagcaatgcacacactcattgcttgggttttagtaacatcacctatgtgacttttattaatatggagatatttaaataatttctcaaagacgtaaggaaatattaatgaaaggtatgttcataaatgatttttgtgatgtaactggaattgtctatctctaccttctaccataaatatttagaaaatggtatcttgaggaactttttcttaacattaccag

SEQ ID NO: 48727 - DNA, 1189 bp, Bovine  19866881125890
tttacagaaaggggattctaagcagggactggccgatctggtctgcaggccaaatctggctcattagcttgctttttattttaaagttttatttggacacagccatgccattcatttatgtatcaccagtggctgcttttgtgctgtaagagtgaaattgagtatttgtgacacagtatggcccacaaagtatcaactatttactatctgattcttgaagaaaaagcttgctgacccctgatggagagcaaagaagggttaagtgacttgcctaaggtcacaaaaatttctgagtggcaatgctttatcttataattctccacttttggggagtggtttgttcattttttttccccaccatgacctactttatttcagatattgtataggaaacggagcctcctgcactactttccactcccacccccaatcccagtggacaaggagagtttgagaaaaacttctgcaccataaaaatgcaggtaagctccaatattgttaaggtgtgtgaaagccggaaactccagggaaggtaagtaaataataataataatgatataagtgaagaatatatattacatcccctaggtacctaagccacaaatgataacttttgagagtttacaacataggttactgtggttttgtgattttgaattgtggggttttagtgttatatcttttgctctggggcacaattaatcctatttcatgaaaaaaaaaaaaaaaaatccttgcttttttgtagaacttctcctgtccatttctcaagaagctcaaggtcatcagaaaattagagattttaggttttacaaatacctacaatgaaatcacatgtatttacaattgaaggttaagacatcaaacctcaggaggtagcatggattttgaaagagacatgtatgcctcccagatctgcttggattgctttccagaagcatattgagggacttaattccagtatatttataggttcttgcacaggcagagattgctttatttcattgcatgagtaacaaagatcttttgtacgttgctttacgctttgaacaacaagaattgcagcagatctgagatttgtgggcatctactcgatataaacgtgtaccgaagatggggaaaaataaggactaacttttatagacctctctcattaaaactcaccttcaaaaaacactcctgctccttc

SEQ ID NO: 48728 - DNA, 1700 bp, Bovine  19866881311925
cccccgtccctgggattctccggcaagaacactggagtgggttgccatttccttctccaatgcatgaaagtgaaaagtgaaagtgaagtcgctcagttgtgtctgactcttcgcaaccccatggactgtagcccaccaggctcctccatccatgggattttccaggcaagagtactggagtggggtgccattgccttctccggaaagtagctttagatgattcataaacaagggaacccagctgtagttccaataaaactttatttacaaaaacaacccacagcaagatctggcccttgggatgctgacctctgatccagaccatgaaccctgtgggcactcatgtgttatttaaagtagcagagaggttctcatacttgtaaagattcagacatgagcagaatttaattatctgaaataatcacagaacacaagaagtcacaggtatgacaccgaggacaaggatttcaatacccataaaagttcagacactggaacctcactcatttggggctggcaaaggagactaacctaaatcctcccgggggacatgtttccagtcctcttaattaaggccattcacaaatggcttggaaaatgtttgggaaatgaagcggttgggaaaacctatgaaatggaacattggctattagcatctgctcctccccacttgccccacccacaccaccaccccgcaggcgaacacacacactggaaaataaaagcatgcacaagcgtattttcaatgattaatctcactgtttcactttgaaatctaaaagggaaaaaaatggaagcattcctatttcccgttgaaagtaatcacagctttatatccctgggtgtttacataaagagagctgtttatttagaatccttgctgataagaacaccacacgctcataacttattatatattccctttccattttgtctcttttttggaggggggggagaactatgtatattttatgataacccaaaatgacttatacataaaaaatacagactttaaagataaaaaggattagtcgcaggtaatgcattttccatgagtggctatagggctctcggttccaagaggtaccgactgcatacaaatgaattgataaaagtctgacgccgtggatgggtagcaaggctcatgctttgctggagatgattcttaaagttacaataaatcagacagacagtgtcggcctttgaggataaacctgtgatggcttgttgtgcctctctgaatcgcctcagaggcccagggactcaaaagtgcctagatgtcacattaaatctaccgggagaatggagcacttcaaagacgaacgcaatcagatctgatggaaaatacattttctgaaagctactgacaaaaaagtaatctttgatgtggatgttgaataacaattgatattgtcttccctgacatttttcattattgccgtcttatacagcctacttcatgtattaaagcaatattaactgtttgacagggacaaatcctccaactatcacataagcaattgtttctgaattgtcctagcccactgcctgtaaaacctgtcccaataaccgcttttaaatacgacagtaggctctttctcctgactagctagacagtgtctgagctccagtatagctcagtggggtctggggaatattaaaaatggttaggtgggttatgaggtgtcatttgattataa

SEQ ID NO: 48729 - DNA, 1271 bp, Bovine  19866881352522
acctttccgagtctattttctcatgaaaaaaaaaaaaaaaatgaaatagccatatctgcctttgagtgttggtgaaagcatttaacaagatgctattcctaaatcaccaaaacaaatctgggtacaagataagtgctcagtcaagggcgataagagatggggagggttcatttaatcacagcctcagaaacagaaagccacttaaagtagaatcaagaaagggagcactttcaaaaggatatacaaatatctcataggaagcaggcaaagaaattatagcaggacttcacaagagctactaacgaggaaagttagaagacgactgaatgatctctttctgaccatgttatttccagtccacctgtctgtgtatctcctggctcctcctcggtctgcaaactgacctctcctgcttcactgagcatgtggcagaagtgaccatcccaggcccaggtttacattaccacatcttccaacactgaacaggctttgaactggtccaaacctgggtccagtgtcaatccaccatccaatccactgggtctgccctcctgccccattacccactcatttctgagaaagggatccactaggaacaaggtacgacaatgggaaggaagaaattgtcatgccgaggacaatcaacagaaagaaaagccccaatgccttctctttaatatcctccacatgaagcaaagcaaacagtggactgccttatcacttgaagaattctacttcaaaggcagagaagctaagagtttctaaccacgacctctgccaagtcctccgcttccaccccagctcctctcctcactgctctaatatattcaggtctcttccattatggctgggtgtgtatttcagcttggcatctccttccgtcgcaaagcggaggtgatcatatttcaggaggtgctagttcctgcttgcagagttgcctctgtgttataattgctttccaccatgcagctgccacacatgagctcatctacatgctggatggctgcgtttacagcaagccagcctcacactgagtttagaaagaggcaggctctgccggcaaatcttgcttcctgaggcatgtcatttctttggacgatttgtagtctgataacgaccgtgtcatgattgtgcggtgatgactccaaatgccccaacacacttgatggatcttagcataaattggccattaatcagtgtgtaggacattcagaatttccatattcaagctgctatgccataacgctgattaattgttcaatgcccaatgt

SEQ ID NO: 48730 - DNA, 805 bp, Bovine  19866881422569
atgcataaacagataacttggcagcaagggtgttgggaagaaactcagagtagggctgtgaacccaaaaggctggtttggggcttctttgtctagaattttgcatcttgttctgttctccttagaggcagcacataattgctttttattctctgtgtgacccactgggtgcacttgagacttttgttcctctaccctcagcccttcctgactaccaaattaaccctctttggacttccctcatgggtctcagtccaaccctttagtcaccgcagtttgtacttttctggatcctctccaaatatctctcaaagatggctcgtaaaacaagggcttcccccaagagtcacaggcagcctgacagctcagcaagagaaagaagagtacagagcagagcaaacaaaggcccacaggctgcctgaggctccggcctcctatggacatctgacctctcatggcactcccttggtgtggcttggctgttaggccaactgggactctgtccagagctctctccaggtaaagaagcaagccctgcttcaggctggggaggtgccattaagtcattttcttagtgcctttcagatcagctttgaactataaataaaccaagtgtccaggagtagccacagtgcctgctgtaaggttatttgcatcctttctctctctgaatcccccttatgccaactatgccttttagaaaccccaccaaggttggcaggtccaccactcctcctgccaatgtcagtgcattagcacttagcttaagtgacacatatgccaggcaggctcttggcttccccctc

SEQ ID NO: 48731 - DNA, 1793 bp, Bovine  19866881683796
tgtagttgccgctaatgattttttgtaaagatttaattaattcatgagtttgtttttggctgtgcagggtgtcttctttgctgcatgtgggctgtctctggttgtggcaaacagagggctactctctaggtgtggtgtgcacgctttctcattacagtgacttctcttcttgtggagcatgggctctaggggtgcatgtgcttcagtggtcacagcacaagggcttcagtagttgcggatcatgggcttacctgctccaaggcatgtgggattttccctgactagggatcaaacttgtgtccccagcactggcaggtggtttcttaaccactggaccaccagggaagtcccattaatgaggtttttgttgcagtcgtgatgacatagctaaaagtttgaggagaaagagtctgtgatccatatttacccacttatccttatatgaaaatatcaggtcctataactttaaaaattctcctccaaatcatcaaacatcattatgacctaataattaatgaaatgctatccattcaataaattctagctatttagtgagcttttcattttggtgactttagtttgcacattaaccctagaaagcagctgctgttatcatcctaccattttgcagatgaaacacttagcaacaatatggcttatttaccttcccaaggttaatctgttatgtaaggtgaggccaggatttgatcctatgcattctgaaatgtgtgcatgaaaccttaagcactgtgttgttttccttcaaaaattcagaaggatgaaagaatcagctgtgttccatcaaatattgccattgccaagtgtgcatctttgtgtcagaacccagttttatccaaatttggctcatgtactacctatttttcactttaagtgctcagaagttgcataaagggtagatttatacatgagatggcagcatcattctagagactttcaatacctaagtcatggtggagtgagacatacttctaggtctttgtaggcctgcactgataataggcagtgtcttctgttcttaaaaaaaatgctatgcactcctgtcaccctctgtatgaaaataatcattatttgtttggactttcaaggctttctctatctagttgctttggagaataagtatcttatcgtccttagtgcattgcgtttcacattctgttttcccacatgcaacacagatgcctcattctgttggattcctgcatatgggtcaggaatgagttattctttggtgagtaaatgaaagaagaaagatagaaccgacagcagtgagcagagataacttgtgtctgttggcctcagtggccttcttaggatatcatttcagaactttggcgagagcagtggaaaaaataaatgaaaacatgagtgagcgtttgagtcattcttctaaaaaaataattgttcccattccttctcccaaccaatatgtcagcataaagtctcccttgacccaggaacaaagaattatattagtgatcagtaaatgcatcacactcagaagaaaaataaatgacataatgtaccagagagaacaaacgtcatctgagaattgggtgggagggtggtcaagggactgcctgattacaaatggccgacatctcattccatgggtgattcacactctctactggtgtcagtgctagaagacttttattagttaacatatttcagagctcagtgtaggaacaagccaagatgttgttctatagtgcaggtcctgaatgaattttgaaatggttgtttaatactatttaatgaagagtgaaatcaaa

SEQ ID NO: 48732 - DNA, 1533 bp, Bovine  19866880254460
tattggcatttcagcttcaacatcagcccttccattgaacacccaggactgatctccttcaggatggactggttggattgccttgcagtccaagggactctcaagagtcttctgcaacaccacagttcaaaagcatcaattctttggcactcagctttctttatagtccaactctcacatccatacatgaccactggaaaaaccatagccttgatgagatagacctttgcaaagtaatgtctctgcttttgaatatgctgtctaggttggtcataactttccttccaaggagtaagtatcttttaatttcattgctgcaatcaccatctgcagtgattttggagcccagaaaaataaagtctgccactgtttccccatctatttgccatgaagtgatgggaccggatgccatgatcttgcatacatatatataaaacatggtggacttgaattgtatagactggatttaactccaagcttacacttctctgcagtgcaggagacctgggttcaatccctgagtcaggaagatccccctggagaagggcacagcaacccattccaatcttcttgcctggagaattccatggacagaggagcctggagggctacagtctatggggtcacaaagagttggacacgactgagtgatgaacacacacttcatagcagccttcagacgtaaccagtatcacttagctgctgggataacagatacagctgaaatgtattcaatgtgtctgcgtgccaagcaccacacacagggttttctcaggcatcatcccatcggatccttccagattctccttcccttgggtaaacacatcgcctagtgggtgcagaaacaggcttaatactggatgcagatctaaacagcagacatgctggacttgcaccagatctgattgatgcctgtgactgtgttttgctcacctctgaagtggggttgattaaaatatcgcccttcctgggcagtttgaagatccgatgagcagcttatgtaacggaagatctgaacgctgagtaggtaaggtgattcattatttggtttctgccagcacttgttggaaagaatgtgcatgttttctctgggtttgtccctggcacctcatttaccaaccttgaaatccccgacttgttttctttttcaagtggtaaatgtttcatcattatttttgtctcctcttggagctgaccctctctctccctctctgtctctcatgacatttggcttcatccttcagcctttctctctctcttttttatggttccatgttgctgtgagcagaactcatttttcaaaagacagatggtggcaaccctattctctctaaataaaaaagcaaaacagctgttaaggtgcaaacagagttgcggccagcaaatcgtatctgcttcaagtgttggcgaagtctccctttagggaagaggagctagctaaacaaaatgtgcagccttggctgggctctgccaaggtccaagtatagaatgatggcaaagaaggaaatttatagcccgcgatagatccagcac

SEQ ID NO: 48733 - DNA, 1285 bp, Bovine  19866880370171
cctacctgcctatgcttgtctggaacacatggacattcatacacattggtcaaatgaattcatctgagccgttgaagatgactcagaaaatgaggcaaagaaaacatgtgcaaaaataaaggcagtgaatagccagcatatgactattcttttaaaagagaaaaaaataatgcaattccaaatattctttcttcacttacctcagcaatatagcttgttctatcaggcacccttgtggttttaactcatacatttacagtcaatgagcaaaaaccaattccactgctcaaattctgctcacttactattcagctgtctcaattcattaatttgcttaatcagccctcatcaataacacttctctccactgcattcctctaactgaaaggaaaagcaagctctgaatactcaaaaatgtgaatctataaagcaacaaaaatggtagttaaaaaaatacttgtataatgtctttggggggattgaaataacttcatattaacatgtctgctattatcagaggtcaaggctggaagacgctttctcattttactgatgctgtagtcacttttgaaatttgaatgaaatggttacaacagttagagactagaaaatgacaattctatggaggttaggtatcaacacagaaggatcatcccccccaccttggaagatgtctgaaatgtatctgacaaagtggagctcattttaattcatatttttacaggcagcacggaaaaagacttacatttgggaaatttgccggtctattgccattagatctacacacctgcataagaacgaacagccattgttagaatcatccagttttctgccgaacagatggctgacacgtacaagaaattatgatcttagggttatcgtaaaccccaaggatgggctaaagggtcataaaatataagttccctcatttgtttgaggaggggaggagagaattgtgtatggaatccttgaccctttattataaaaagataacaggtaacagaccaatggatgagatgagcacaaattaaatgcagaagatggcatttttatgaagaataaatagcatcttctcatcagatagaggaaatcatctgtattcctaccatttttaaagaatgatctgctagcattggtggtattaaggatacataatctatttccttctcccaacctcatttgtgaccccatgcataaatggatgtacatcattgtgactcagttaaactgtcaggaatgaatgtgtttttacccactttgacgataagggaaaaaaaaaagtctt

SEQ ID NO: 48734 - DNA, 1794 bp, Bovine  19866880468544
atttgttacaggtattttttaaaatttgtttcaccaaatattatgtaattttaaaacgaaaaaaaaaaaagacagcaagaggaccatgtattgaagcaaatatatgctatacaaagctgaggcctagaaatctagcaacttgagatgagagagaacacccagaatatccagtaggaatggtacaatgcttacatagattgagataaccatgaactctttaaacccaaatgtttcaactgcttaattttctcttcgatagtttgcatattacaagaagaaatgtgtgctttctaatatcccagtgaacagccgcttaattaaaaagaagagagtttgcaaaaaacacaggctgtgtgtctcacagctaattgaaatagctacagaggcccccaaaaagacaagttcaatattgtggaaatatcagcaggtctggcatttcagtgttctcagatatcctccttgtctgtctgattaaaatttcacttggcctttctgtccataataaaagaaacctatttgtgcccagagctgttcggcagacccagacgcatgttaaatttcagggcgtttattgagtctgtggatggttgagcagcattgctgctgagaacacttcatcaggctttgtggtgggaccgaggcagtggggctgatggtggtgtgtggggtaatcattttcagacagaggcagctgtgttggaaatgatagatacacctccccctttattcctcaaaaaatagtgtgctctatcttacacggtcttcaataatgaacactttatgggcaggtggctcctcagggcaattttcagagttagacaggaacagctggggaaattgagcattgagccttctggtataccctgtcaaggtatgtccacgtgtgtgtctctaattgagagcaactgaaggggcaaagcaaacagattgctactactactactaccaacaatgataagaagattgtaatcatgatatctcctttaagtattagcctttaaagataacacactgctctatataaaatggacatccaacaaggacctactgtataggacatggaactacgttcaatgttatgtggcagcctaggtgggaagggaagtttgggggatacatggatatgtatggctgagtccctttgctcttcatctgaaactaccacaacattgttaattggctataccccaatacaaaataaaaatgttaaaaaagagagataattaatatttagtgagattatgcaatgccaaattcactgatctgcatagtatttaattaaaactattattcttcccaattttctatgaggcaagtgaggcttagagagattgaatgacttatccaagattatacaaatcacccccagtaaaagctctgacccaggcagtctgagcctggtgtttgaattctgaagccttttgatactgcctcttaaggggtgctgcagtccatggggtcgcaaagagtcagacacaactgaccaactgaaccaaactgaagatgtggttattttggcacacatgcctactgttccctcatagccagttttcctatcatccctggtcatttaaaagactctagcactggggtgaagcagggtgactcattctggcaaggaggccatgcacggacaccccctccattgcagacaatctgagagcagccctctgacacactctccccatgcaaactcaccttgggtgatgcagctacagaagcagcctggatcttgacatacatcacagaagagacctgcaccacacctatgcgagctcaggatacactcgaaag

SEQ ID NO: 48735 - DNA, 595 bp, Bovine  19866880496958
cgcctgcaatgtgggagacccaggtttgacccttggatcaggaagatcccctggagaagagaatggcaacccactccagtattcttgcctggagaattccgtggacagaggagcctggtgcactgcactccatgggtagcaaagagtcaggcacgaccgagtgactaacactttcactttctttctttcctgttgaactgacctgtgtcagtgttattttgcaagctgcaatgagttttacaagagtttccttgagaaaaataaaatgagaattttaggtgcatggaggctaataaagtcagtgcatttagtaccattgaggatgcaaagtctcaacagttacctaatctgtgaataactgcgctgtttgtaacatcatcaacagggaccaatgggaacacactgcttaggattgcaagtatttgcaacctggtcatcctattagtacaaggatcgaatttgctactcagttcctcagcaaatactcggtatcatgtttgcgtcttcttgttataatttgtaccatattagtagcatctcaccatattagtgacattaaaatgtttttaaaattatgtctcttgggtggatggaa

SEQ ID NO: 48736 - DNA, 1068 bp, Bovine  19866880563862
gccccttgtgtctaagtctgctctgagtctccacatcttcctccagcccatcctcctcccttagcaccagtgactgcggcgtttcctaatataaatgcaggcaaaataaaattagcagtgtgctagtagggaagccagctacccacgggcgccgtaaatggccttcccctctcacccctcctcccttctgcccaccccctctcacccccatccagccaccccgaataacccgccctgccggctgagtcactgtttctagaaaaacaaggccaggggtccagacaagtcaagggaatggtgattagctgatgatcagccatgaaaagacagtgtccccagaaaaagacagtatgatgacctggtgtgggtgacttgtccaggagagctgctgcaagccacagcacttgtcgtttaggatcagggagaggaaccaagagtgagaaaagctgctgagtcgtgtcctcacatctgccgccttggcatatggtccctttgcttgcgcctcctctgtggttgtttagttgctaagtcatgtctgactctttgtgactctgtggactgtagcacgccaggctcctgtgtccttcactatcttctggagtttgctctgattcatgtccgttgattcagtgatgctacctaactgtcttatcctctgccgtccccttctccttttgccttcaatcattcccagcatcagggtcttgtcaagtgaggtggttctttgcatcaggcggccaaaggattggagcttcggctttagcctcagtccttccaatgaatattcaggactgatttcctttaggattgactggtttgatctccttgctgtccaaggggctctcaagagtcttctccagcaccacaattcaaaagcatcaattcttcagtactcaaccttctttatgatcctactctcacatccatacatgactactggaaaaaccatagcattgactgtatgcacctttgttggcaaagggatgtctctgctttttaatataccatctagggtatgccatagctttccctccaaggagcaagcatcttttaatttcacggctgcag

SEQ ID NO: 48737 - DNA, 781 bp, Bovine  19866880566377
cggtgttagcgacacacattctctgtcaaacacgtcagtccctccgggggccagggacagcttgcgagcggcgtctcctattgttattgtgctggtgtgttatttctcccttcaacagctctgcatttgttctggcgagaggcgcgaacactgaggtgcctgctcactgggcaattttgacaggagatgtgaaattgacagggaccgtccaccgaccgtcttaataaggcgactcctcccgctttgtagagactggccacgcaggcagccctgcctttgcctggagcccttactggggatttgggtgggagcgtaaggactctaaagagctggagcttgtttcacacctggcgcgttggcaggcgtctccggttgtgatttagcccagggactgggtactgcctgccagagggtctaagatctgtgcggggcactgagcaggtgttgcacgcattcacgcagcatacggtccgcctgtcatcggccgctgagtcccggtctggtctccattgtagggacccaagctcccacctgctgcatggtgatggggtggcctggggatggatgaaaagcctccgattgctgagggtaacgcggaacatatgggattcttctctgtctaaacagtggtggggtttgagtgtgcgatgctgtctgcatgtatattttctttagtgtctgattcttgcaaggtcagagcctcgctaaggataccactctgtagagtcctctcctggggggatgctcaaggtgtgtgtccaaagtcatctctgcttcctgg

SEQ ID NO: 48738 - DNA, 2612 bp, Bovine  19866880594182
atgcctaaaatcccccctgcacttaaagttaattccaaccaccttcatataaaaccctcaaagtctggctactgccaacctccctaaattaatctctttttttcctcattctcatcctgttggtggtgactgtcccaagctggccacggtccagctgtaagtcacctctccaaagatctcctctacagctgaataatattccattgtatagatgtaccacattctctttatgcgttcatctatcagtgaacatttgcttccatgtaaacagtgctgtgatgaatatcagggtacatctgtctttttgaattatgatcatctgagtatatgcctagtaaataaaaattttaaagaaaaaggaacttttggaaatagaaaaaattagtccttctctaaccacccttttcaagctagtgactacaacttctgtattgtttgccagggcaccctgtttattgcttcaaaacttttcttaccacttgtaatttaaaaaaaaaaaagacttttatattgaactatagccaattaacaatggtgtgatagattcaggtgaacagcaaagagactcagccttgcatatacatgtatccattctcccccaaactcccctcccgtccaggctgccacattgagcagaattccatgttctatacaatagatctttgttggttatctgttttaaatatagcagtgtgtacatgaccatcccaaactcccttcctaactatcccttcctcctgtccttcccccctggcaactataagtttgttctctaactgatttattattttttctttgtcttattcatgaatacagctctgctgactaacacagtgcttgatatagagtaagcccccccatcagagcttggtaaatgagatccatgtgtagaaattatcattattatagtcctgaaatttgctacaaactctgctttgcctttaagtatgcactggtggaatgcttaaaggtatacacatatgctttgccttttggatatccctctttttctccaggctgtgtcttttcaacagggagtgactttagcacaaggtgacagcctgatgaactttgaacccttcttttacttattatgtatgtctcaggcagacttggcaatatttgagaatttattaaatgacagtttccccttccacttcttattctagtttattttgcccaacacaatcctattaagggaaaagctaattgaccacaagcttcctttctgctgagcttagccaaaaagtcaatcactgctcaacgggagctctcctgactgtttagccaatggacaaatttccatcttgactggcttggctggtcctaagagaatagatgggaacgtgctgaattctattttgatacattccagtttcagcaaaactgagacctacccccaaggaggcagaggatcatgaagaaaggagcagtgtggaaattagtccatgaggatgcttattctgtttccatggcattcagctctgttcagaagaggattttctgttgccttatacccttgttgggctttcctagtggctcagatggtgaagaatctgcctgccaatgcaggagacctgggtccgatcccccaggtcgggaagatcccctggagaagggactggcaacccactccagtattcttgccaggaaaatcccatggacagaggagcctggtggactatagtcccatggagtcacaaagagtcaaacgtgactgagtggctaaaagctatacatactcttgtcagatatgtgggtcatggtaatgaagttgtgacatgccacaagttttcctatgctgaaggaaagccttcccagatcaataaaagatgacccttctgaaggggggggggactaactccttgatggtttagcttctagcaagctaaactacatataacatatgtgtgtatatatatatataaaacatggtacatatagcatggaagtgtaagagtgaactaggacgggaaattcacttgcttttggttctacccatttgccagcaaaaccacaagacgagaaagactagctatcttcggatagtgaaaggtagagctagtactaagtccaatccccagaaaagaagggggatggcctcaagcttgccccttcccagacggcgcaggggtaaagaatccacgtgccaatgatgccagagacacaagagactcggaatcaatccctgggtcaggaagatcccctggagaagggaatggctacccactccggtattcttgcctggaaaattccacagacagaggcgcctggccggctacaatccatagagtcacaaagagtcagacaggactgagcacacacacacagcctcaagcctttgttctcaacctgatatataaacatcatgttctgggtcatagtcagcacttaaaatgaagttttctggatgcatattgtaaaataataataataataatgcagaaagaaaaacagcaaacttgctatctcaccaaaccctgccaaataccttgacctgaatggagaaatcagaagccagtaatagactgcattcaaaggcattttcaatttccaaaaaaaaaaagcaaggcacccaattttggtacatggatgttttttagcatttaata

SEQ ID NO: 48739 - DNA, 738 bp, Bovine  19866880610147
cttttatagctatagcttggatcccaagaaatttatttctcccgctgcagtctgaaaaagggaatgtctaatgagtttttgctaggcaagtcaaagtgtcagggtggaattcttcttcacaagacatgcttcactggaaggaagaatgtaaagcaggaaaggttctttaagaggcatataaatctacacatcggtagcagtcacactaataataaacattcatttggcgtcatatattttcaaagtgctttacagtgttggcattccttaggagaggagagttctgggatacacattttcatttcccatttaaaagatgggcgatacaggaagtcagcaacttgttcaagttcagcaaaggcgaggaaccagcctgaccgtcctcggtggaatttctggctcttggcttagatcaggctttgcacccaagaggccaagggaacagcttctggcagagtgagctgaaaggagaggatagaaagatgcaggagcaacccgtttcggttggaagatcttcatttctgaaatgcagacattgtgaactaacaaggagaagcttgtcatttgcaacactctttgaacttttgtagctttgcacttatgtattaggaatggaaacgtgcatagtaagggtggggactgcctactagactgcctttcactcattgagctgatgaacaaaccttttttgaaatgaatacgatgcggcccctttgtgggcattaagatgccaatatc

SEQ ID NO: 48740 - DNA, 1103 bp, Bovine  19866880648445
ctgagtcctggggcctcaggctatttggagtgaactctgtacctggctcccgcagggccctgcagtgcatgcatgtgtgcgcgcatacacacacacacaaacacacacaaccgaagatgctgggagggcaggaagcacaatctagccgagcggctgattattcattcccctatccccgagagaccccagggagtatttgtttgcggagaacaaggtcaatacgttctcaaacccagttgccattcatccccagacaggtcaggggttggttcctgaagcattgttgatctcagcagagatggtgtgcgaggttgatattcttagatttgctcattcagccggtcagtctggctttcagaggagaatcaggtcaagaagtgcttaatgatccgagaggaggcgctgcctccaccgctgggggctggggtttctaatgctgatcagcagcttcctcactcataagacctactggaattttctttgtgtgtgttcataaccaattttattgagaggggggtgtgtgatgttactgggtgggggtgacccagtgtcctggattttttgccttattcttgtttcagaggcacttcctcatccccataaatccccaggtgaatttgaaattttcgtattttgttttccaaactggtcttccatggacagtagcaatgcccacatattcattagactctctgtcttaatttttcggtttagagcctggaagaagaaggtaagttcttccaacagaaatgcacctccctgctggcatctgtaaaaactatctgaccagttcgcatttgaagggagggagggttttgatactcctggtttgtgttagtcgctcagtcgtgtctgactctgtgcgaccccgtggactataacccgccagactcctctctgtccatgggattctccaggcaagaagactggagtgggttgcatttcccttctccaggggaatcttcccgacccagggatcgaacctgggtgttgtactggtttgatccttgcaactagatgctgctaatgcctcattcctatgacaactgtgcacccactatcagctctgagccagggcctcagctaaccgtgtctgtatgtga

SEQ ID NO: 48741 - DNA, 1883 bp, Bovine  19866880660821
gctcgtctgtccctgggattctctaggccagaatactggagtgggttgccattcccttctccatgggatcttcccaacccagaaatcaaacctgggtctcctgcattgcaggcagattctttactgtctgagctactatatgcatatatatatacacacatatgcatatacatacatatttatatttgttgagtatatggagggatgaaagggtggaaaaacaaatagatttcaaacattatcctgatctctagaaaaagaaaacagaataagacagttctttcccttgcagatcctctctgatgtgtgggaggggaaatctgactggtaataaggtcaggataaagcaggaggaactgataagggagagctccaagtcaggagaagatgaaaaaggctgaatctgagaaaggttctgagccctgttgactagatgaagataggagatggggggaagatgaatcctcactattaaacatcttgttcaaccaggagagcatagggtctcatgctggagtttattgcttcagtttctaacctttcataagtgcttacttggcagccctatcaaaaatggtatttgcttctctggaagcatcttaaaggaacagtaccagacctcccacttttttttttttttccatttaggctataaactatattggttttgtgcattagtcccatgggaggaaaaaaaaaatcacatgctagtttccagatgaaatggcatttagtaaagtgtacatttaaggtatttttcagggctggcttttaaaaagtgcatgggaagggtatttcttcataactgatgataaagtgttataatacaggtgtctcttctcctgaacctctccccataatggtgtttgagaatttttttttgagaacctcattagatatgaaagagaaagtctctcagtcgtgtccaactgtttgcgaccccatggactatacacagtccatgaaattctccatgctagaatactggagtgggtagcctttcccttctccaggggatcttcccaacccaaggatcgaactcaggtctcctgcattgcaggtggattctttaccaactgagcaatagtgataacttattaatgcttcagagcatcatcacactctgcttcgagttctgtgtgatgaccaccgctgcagcagaaacacagacctgtgatgggactcagaccgtcaactggcaatttgcacttgatgacctctaggtgacaaacaggaggtcacctgccaccagagccagaagatgtgggtgttaccaagttgatttctaaacaaagagctgatggcaggtgtaggttctattaggcaacagtagaatgtatggtgggcttcccaggtggcgctggtggtaaagaacctccctgccaattcaggagacataagaaacacaggtttgatccctgggtcaggaagatcccctggaggagggcatagcaaccctctccagcattcttgcctggagaatcccatggtcagaggagcctggcgggctgcagtccatggggtcgtgaagaatcagacacgactgaagcgacttagcacagcacagaggtgtttggtggagatgacatccaactcacaaagaatttatggcatgggcaggaacgccaccaaaggagaagctggttattgttactagaatatgaggaatgttactagaatgtagatgctgcccaggaaaaagtaataccatcactctttaattgcatctcccgtttagtttatgttttacatgtagataaatatgtgatccattttgagttaattttttgtataacgtgtgaggtttaaatcaaggtgtttcatttgtttttgcttttttgttttttgctttgcatacagacattcagttactctaacaccat

SEQ ID NO: 48742 - DNA, 1076 bp, Bovine  19866880663615
atcacaagagacccattgctcctgatatgagtcaccagggagagtcaagtgttggttatctgattaaaggggtgtcagaggtcaggatgcctgcagaacttgagagagcctcaaataacaggttttaaagagctgttttctttggaggaaatgctttttgcacttggtgtgccatgaacccacttgttaaataccccattagcaacagaacaagttccccagatctgggatgaggctgtgcaggcagacagattcgacagacaagcacccagcaagaggtggcagtcacaagcggcccctggcacggatcccattctgcttcctgcagccaccccgcttcctgcaaagatgcgacctcttggagctgttgatttcaggcttgatgctggtcttgaagtgagagggcggcccctggccatcaagagccaggctggcctgacacatgtacgcacggttaccagcgaaaccagaaaagtgtcttcgcatctgataacttgcaaggtggggggagacctggtgcctattatttattctaataataaaccattaccccaggcatattcttattctccagatttaataaggtattttgtgaaccaaggcagaggacggtgagagaaaacaattgtggttattatgaagatgatttctatttgtttcagatgcagaagcaatcaccacttttcccttcataatcaagggttataattgctcccccaactccaccccaatcccttgctcggtccaagaaaatctgaacactcaccgaaatgtcctgaggagctaaaagggcttggcatatggccctgaactggtcccctgggaccatcattaccttatagccagagaactctgattatatagcacagggctctcaactcagattttccaatcatccccctctccacatccagaggtgagaaagagtggggagggccaggtgggtgatttacatactatttgcatacctctgcttagatgaaatacagttttcaagacatttttaaactgagatgttttaactagacttttttttttcccccttctggttaaatgttgcaaaatgtgatgatgat

SEQ ID NO: 48743 - DNA, 1242 bp, Bovine  19866880664540
cctggtgggctgcagtccatggggtcgctaagagtcagacaggattgagcaacttcactttcactttcactttcatacttaccagctgtgtgaccacagataagttacttaaactctctgattctctagcttcccaccttgtcagataaagtagaaatgatctcattccatacatttataggaatatccatggagattaaataagataacgtatgtagagagctcagttcagtgtctagcacgtgactagacactggtcacccatttactagggtgactagacacccaatagtaaccgttcagtttggaaaacttggagtccaaagtaaccggtaacagccagacaggtagacacaagaccgggatgcaggtgacattcttgggggcattcatcctttgtctctttgcttcatgaaatgtccatcccccagatgtgacaaagctccccctttctccctttgttttctcttccatgagctcccacctggagttaagaattgaacgtcttaaacagattcctattttgttttagtggtcagttcctggccagctctaactgtgagcatctggttccttaaggccaatctgtagatattctcagtgacccctacatctcctgacatcactgtattcatagatggcttctctaggaaaaccattattaatgctgtaattaatatgaatgactatggtatatatcaagtgggtcgttaaggcagaggtggagatgcagccatttatattaaagatacatttacattttatgttctgaagccaaaacatagaaagcacttaggttagaaatctcactttgctacactttggaattattttaagttgctggagacccttttcatgcttgcttaatgctccactgtcaaagcctctgggaatctgaatgagttaatagggtaggtttttaatagaagtatataatcagctaaatcacagcctttaatgtcacaaatttcaaagaccaactgatttaattatgtgttacttcatagacatgggaaaaaagttttatttgatttcactggtctctctcccacagacattcagctgcaagaagatttacttataatttattgtgtggaagaatcttcctcaagcagacaccatatgtaactctgcagcttacctttaagggaaaatattgaagtaacaccctcgagctgttctgttctgtgttgagaactcggagctagatttctatctttgtagtgagtatcgaaaccttgc

SEQ ID NO: 48744 - DNA, 1264 bp, Bovine  19866880718239
agatggttggatggcatccctggcttaatggatatgagtttgagcaaactctgggagatagtgaagcacagggaagcctggcgtgctgccgcccatggggtcgcagagagtgggacaggactgagttgctgaacaacagtctatcatctgtcagcaataggtcggggtatcattgtctacgaacagagagacagagggagtaaggagaccgtgtaaaggtcagataggggttccaacaagtgatgtatttgagctgggacggtagccctggagttgtgtgggagccattaggaaggagactagaaacacgacccaggtgaaggaccccaccacctgtgtgtgtccctgctgggctctgtttcatccgcagccccatttgccctccctgcccctgctcagcgcagatcactgttgaccaaagagcaaagcatttgcccaggaatcctgtgtctctttccaagggctggggccaagacgtaggacacagtagatttttggttacaacgggccttctgaaatagtctgtgcccgtctgcccggagagctgtgagtccccggggagtggtgagcggcagcaggtgactgaactgtgaaactcagaattgaaggagagagcgattagactccatccggcacactttctgaggaacggggctgtcagtctgaaaaaagacaccgcttctcactgcttcgattcctcccaccaactgttcagctgcccccgggtgctagaaggaggaacgtgctctaggagggaggcagagagggttcggctgatgacagcacaaagtcacagcttctgctctgggaaggaagaagcgcaggctcccagggctcggggaggtgggggggggcacgaccctgggattcttgaaagagccattgctgcaagatcccttcctctgtgcttgctggcctgcacgccccgactcatgaagggccgcctgcctcggccttggggtcggaacctctgcttcggctcctcttttcgttctgagtgactgacagcctctgctccaggaagcctttaactcagccaagccccccaggcgggctgtcactcggagagaggaacgttgcaaagctacctggtgaaattagcagtgatgccaacgacgagatctctcattgcttttctttctctttatatgtttatatgttccgccttcatcaggcatctaacttttttttggcctgctcccatctcatgcagctggaagctgggaggacctctggccatcccaatcctaactgaggactcaag

SEQ ID NO: 48745 - DNA, 1508 bp, Bovine  19866880743938
gcatgtgaatgaatggatctcttatattatcaggggccttggtgctggaggtttcactggaaagaatgtggattctggccctgctaccttcctcttaaacatgtcagaggtcgcaaagagcgtgtttcctttccatttgaattctccatgggcccatgcaaacattgtatggattgccatcaaattagtcacaatgtcttggtcttgaataaaaagctcagttgaacctaacatttaaaagtaagcatttgtgaagtgagagagatagttatgggcttcccaggtagctcagtgggtcacgaatctgctggcaatgcaggagacataggagatgcgagttcgatccctgggttgggaagatcccctggaggagggtgtggcaacccattctagtattcttgactggagaatcccatggacaagaggagcctggagggctataatccatggggtcacaaagagtcagacatgattgaagcgattgagcacgcttgcttgtacacagaggtagttctagatttagaccactgagacaagccattgtatcctagagttgtcttcagtaacagctactcagggagtactgggtccagattttgcctcatgcttgtccatgtgacagccatgcttttcttatcaaactacaggccttctgggcatgaatatgacccaccgaagtctctattgtcaccaaagacagattacatggctttcagaacatgcagaagaaactttcattaaaagtagaagaagaaggggctttcatgatgactttttaaatgacaaaacagagatattttcagacatggcagggtgcctcctcctgttcccacatctgaaacgtgaaaacagccctaagaaaactaggatgttgccttttcttagcttccatgaacattctgtgaactaagcttactttcctgttttatactgtatccattgaacacctttcagaggttttcagagaaatattatttgatctgagccggtctaaacatgggcggtacctcttggcccgagtgtgtgcctataagctccaggattttaactttgtcgcatctgtcgagacccctccagtggaaactgagactgttgaacaagggtgaatgccgatgttgggcaaatagatcctagttatgtctgcgaatgagtcgtgtctatttaacttgaaaatgtgccagctgtgtttacatcattagtaccaaacttcccaattaaactgttgatactataaatatagtacacaactgccttagaaaggggacttacatcagcattcttcttacggcttgtttcactggctttgagaaacttccaccccatggcaactgccaaagaaacaaacaatggagaccatttcagggcatgtggtgccattgctccatttagggaatgagacatgcgaagattactttttgattggtgctgtctcaaccggcagcttcccaggtggctcagtgttaaagaatctgcctgccagcatgggagacacaggagacttgggttca

SEQ ID NO: 48746 - DNA, 930 bp, Bovine  19866880789900
tggcttttctagtttaaagccctgctctggttaaccaacccacaagtttggtttgaataaatgctagggctgggagcctaccggggcgctgttagagagcatctccagaaatcaggcacacttggtatcccatgtcacatttccaccggtctggaggtggccttcattcgccaaagggcagccctacaaatcacagctgagtaggctgtctggatggttccttcggagtctctgaatctggaccgttgtgtcgtgctgcggtcagcacttctctgagaagcaaaaagatgatggggtgctgaattctgctttttaagggcatgcaaatagagtgttgatttttttttttttaagtgttctttttctaaggagctgtcagtgcttaagaggcgtttttcaggtagggtgcacgcacacattattttgtctcctgtccagtccctaaagccattttctgtcccattttattcagagggagaaaatagaataaaaaccttcagagcatctgcgtgataaaggagtcacactctgggttattatgctgtaggtgatgaagctggggacttaaagagacagagattgagttggtttgggcagagtctgggactccggaccccatcaggtcagggtgtgtatgtgtgtgtgtgtgtgaagtgctttgataaaaatgcctctcccaccaacaggctgttaggcgcggcgctcagaaacagcagtattgtcttagattccctttcagatcatgtaggtgtctataccatgccacccacacaggagagcaagtgagctgtgaaatatattcattgttagagtcccggggaaatggtggcaagcaatcggaggtaataacgtccgacaggcaggggaggccgccgacattacctgcattatttcggttgcctttttcattataggttcgggaaataggca

SEQ ID NO: 48747 - DNA, 2065 bp, Bovine  19866880800356
caggactagacatcttttctaaatgtttggagtctttaccaggttggaaaacagctcttttcaaccttattcttggggcttaacgccttcattattttcatacatctggagaagtttggtaacggaataaactagagggatccatgtgatctgagatgaaatattctgaaacttggagaaaaaaagagattgccagaaatgagtggatatgtgaaactaaaatgtgattcattcagatagcaatgttaaagtccttcgaagaaggggtccaatcctttgcaatttcccaagtagaaacatgttttgaggaagcttcctgaaactggattcactggcaggctgctgtcaagaaaggcagggggaacgagaaatggggagggtggggggacagatgggggatggggtgaaaagccaggccatctattactcatcatgtattactcttcccctcagagatttctgaaaagtcatagtgaaaggaaaactaaaccccactcattaaacatgcgttgtgtgaatctgcatgttccaaatgaagcatgaacctctgttggggtggcagcttgtgtttcaaaccataattttcaaaattttctcttaattgtccagatgaaatgatatcctacccagacaagcctttcccagaccaaaaacaaaaaaaaatcagcatttaccataaacaatacactaattttaaaaaaagttcccttgtgtatttcaaaataatcagaacgggagagttatatctctgtcaagtatcatgcacccaaacttataaacatcccatctgctttggagtataatttatctgagttcatctccaaatttcacctctcaatggacacggtcaaaataatacctgtcattccctgagaaaggaaaccgaagacaaattcatcagggcttcaacgtgataatctgggtggtggctccagctgacactattttcggcttatccgtttacctgcttgtttgtttctgattggctacaaatggtcagacttaagatattccttaagatactccttccctatggagttctgagttctttctgatgctgtgtgccctgccacagactagatatacactcaggtggtcaaccgaagcttgtgggtggggaaatgagttgaacatacaggtcttaacagcgatcttaaattggatcaaacagaagtgagtgtacattcagcactgtttcaaaacactgtgataaaccccgtccctgaaactgaagtcattaaaacactgcatccttctttttaaccgaaattcactacttaaaaagctccagatgcttaaaaagagagaggggaaaaaaaaaaaaaaaaaagactcagaataaaccaaaggaataatcagcttggaggatttttcctgcctcgtgcttaagttatataaataaagagaacaattaatgtcaactgccttttattctccattctattagctttggggagcttcaagctaatctctccacaaagaggggacatcctgggattaaaacacaaggttttctgcagaaaaatgggcccgccagtcaagacagctcagggaaataagacatagcgcttcctccactcttctgcgactgaatcaaatggatttccaggagggcagaaattcagagagaaggaaagagatcccccaagcaggtgaggagagatctgggcagaacctcgggacgtggaatgcggaaggccgcccctttctgctccttttataccaaccaggcacatgagtaggtcagcgaatcaaaacccagaaagtccccccaaatcacaggcacaggatcaaccccccccacccccaaatcacagctgcaaactctcctgggttcacaatcagcaggaagcactccttcccaagggggtgaaggtctaggcagcaaaccaggggtctagactgtgatgggagcttgggtgcaagtctccccgatgcacaacctaccccccgcccccagcaatctcccaactccccccttgactccattccagagttctgccatcagataaaagcttcattctcaataccttttagcacgagagcctgcatcacctgtcattat

SEQ ID NO: 48748 - DNA, 2536 bp, Bovine  19866880837495
cacccccttcccgtaggcctagccctgtgcaactcgtctatcaggctgttcctgagtcaccttttgcaataaaccggtgatagagtagttaatgtgtctgagttctgggagctagcaaactaattgaacccaaggaggagctcgtcagaacctcccttctacaatcagtgggtcggatgcacaggtgacaatcacaggtgacttgggacggggggaggggagagtcttatgggactgagcccttaacctgtggcatctgatgctgcctctgagtcagaactgccatgaactgtgggacaaccaggggtgtcagaaaaagacaaatgcactttgtactttattatcactaagtcactaagttgtgtcccactctctgtgaccccaggctcctgcagtccgccaggctcctctgtccatgagatttcccaggcaagaatgctggagtgagtagccatttcctaccccaggggatcttccagacccgggaatcgaacccgccatctccagcattggcaggcagagtcacttggttggtggtggtgttcagtcgctcagttgtatttgactctctgtgaccccatggactgcagcacaccaggtttccctgtccttcaccatctcccggagtttgctcaaactcatgtccattgagtcagtgatgccatccaaccatctcatcctctgctatccccttctcctcctgtcctcaatccttcccagcatcagggtcttggtactggaatcattttaaagaaaaagagagagacggggaaggagggcagagtggtaagaaggcaggaagggagaaagaagtgggtctcccctgcagacaagagtcctaagtttggatggagctggaaaagacccagaggaaggaggtggcatttgaggagctgctaaagccctgggtctgatgttcctggaattagtgagagagaaagaaaccatgctctagagatcagtctagaaatgggattttattctgacttctgtgctcatctctgccgtgataagtttcagagataattcttagaaactcgaaatgtgctttgctgaaaatctattcaaatatgacagttatcagatgtattgaaaacaatagtttctgagagattaaaaacaaagtaagtttaatatacccaagttccttcccctcctcataaacacggcagctgctcatgaagtctgccggtcccccgagctcagcaagcagagacacttttaaaatacaatgtgaaaccgagtgactatttcacagaaggaacggcatgtgccttcccgtccacaggtttctgaaaaggtggattttaatttccgaaaagacaaagccaagagaaaaagaaaatgcctatctccatgcacttaagaactatgatattacttagctggggacattttattctggaaaaaaaaatgactgtcaatggtgattaatattctccttataattaattcaaaatcttattaaaatcaaacttttataactatacatataaccaggctgtctatgtcaggatggaggataagtcttgccattaattttacctgtatcatttctctcgttctccaaaaaggcaataaaagatacctccttgaaagtcagtaatgccgggccaccctcatctccataatgacacaatttccaattcacgcctcattttcattaatgtttctggccataaatttttaagcatatgataaaaaatttctgaagcggcataaaactaacatgaagagggagttcattagcatgtgaccctaattagaaattccatattaacttcccatttctacttgtgcatttccaagaacgtcacatctctattcttgatgtgcattcacatcattgggaggaaatatcccttttggctgttttcatcccttggctttattttttaaacgatccatgtgtttcctctgttatgtgaataagccaacagacaattgtatcacaggacgcctttcatgttgcaaattatctggaagaattgtgagaaggtccttacccaatgctttattaatgataccagatcataaaagggggggaggaaatatgctgactctgtctcttttctaatgttgggtgataaaaatgctacttcaggattcagaaggttaagttctaatgtgtattttgaatagagtgtgttggaataattgcctcataaagcaaagcattggccgcctgctaatggctgcatagtgcagggctcagcaaagacggccaagcttactggaaaaagtgctgtgcctcaacttttggagcctccaagatgaagttaactttcccctccccttgctttgcagaaaaggtataaaatctcatcacctggttggttttgcagctcagaggagctgctgctgctcacgtcactgagagctggtctccaaagatgccccttccatggactgtgcctccatctgtcttcacccctgctttggcccccttcccgtattgtgcaaccaatggaatgtgctggaagggatgctacatgacttcagagtctaggtcttcagtaagaagtctctcagcttc

SEQ ID NO: 48749 - DNA, 777 bp, Bovine  19866880885209
tggggaagaaaaggcattctgcttggagggtgttcagttgacttatcctctccatgttccagtgtttcctagttaagcctgtctctttgaagctaagaagatgcttgtgaacattcccacaaaggatggagatcagacatgacgaagcacatgcagataagaatggggatggtggggcagaatgttcaagggcctccctccccatttaggtgaaaagcacactcggaatatgggcttgaatcttatatttagcctccactcatgatccttcaaaaatgtgcacaatgtaatgctctctatttcaggtcttctttggaactatgatgcaatgcagcgaaataaggcaagcttaaattaccttgctgcttcagcagggctaataaagacacaggccatgactcacaaacatctatgtcttccgaatggcctagggcctagccccaccaggaccctcaagcttctgctacctaacaggatagggaggggcttcccagatgtggagttaattttagttaaaaaaataataatgatgatggtattgaaaggaaggttttagagaacaggcccaggaggaggagaaagtgaagtggttgacaaggagggagaaagaagtccagcaacttcacagtagatgcaaactcaagcatcctttgggatccaccaggatctgaaaattattgaaaatgacagcagtgaatgtttccagagcttctgtttataaagagatggtggaacccagatatttgtgtaatggcaacagattcagcatttcaagaa

SEQ ID NO: 48750 - DNA, 2576 bp, Bovine  19866880887480
tgaatatagactgggtatctgacaataaggtttccctggtgactcagtggtaaagaatttgcctgacaaataggagatgcaggttccatccctgggtcaggaagatcccctgaagcaggaaatggcaacccactccagtattcttgcctgggaaatcccatggacacaggagcctggagggctacagtccatgggtttgcaaagagctggacacgatttagggactaaacaacaccaatctgatgactggattaaggttaatgctcttagttgcaataatgtcatcaaggtttttcacagaatggaatttctttcatatttatttcttttgtatttagaggcaagtttcactgtgtggaaatatcctttcaagtggttctgcatgtcaggtcaattcttaaatcccagtgttagtatacaaggcccactgtatttctctttctcctattctacacatctgacgttttttgtaacaaaaaatactctttaaaaagaaaccagaacatttttctcagtggaaatggaaatacacagtggagtccaggtggttcaagcatgaaaacactaccaaaaaattggaagcaacagaatctctggttttgatataccatgatgctactcgggagtctgtctgctgacaggcagtgacataaatagcctaaagggtattctgtgaaacagcagcacttgcgtttcccacaggtaccagagatccctaactctctggcccccttgatctatactagcacacactaacaaaccatgggggttcccagccgataagtacttgagaggagcagcatcaagggtcacaaagcaagtctccactgggcatttgcatctgtgcctgagaatggattaagtttgttagcacctagggatgcaatgccatgaaccatgagtcgctgttcctcaccatgtacctgtgagccttgccgatgctcagatctttacaagccaaggtagagactttacaatctaaaaagtaatccaatcgcttgacatttgtgatcatcatttaacactttcagtcagaggagaagaaaagaaaagaaaaaagtgtatgtgaaggtaaactgcctaactaggactatctctgagaactacattgatttatgattctgacacacacttatcagcccagatgtttctcaagatataataacagtggcaggcgtctcttgcaaactggtgtctcccatctggccaagaatgtgtgtgtccacagattgatccatattatcatggggattactaggatgcaatatcatcggagccagtagacccagatagtgcaaatctagcctcatcgcttgcagacaaaagcatggcatacaatggacttccacgtaatccgtctctgtcaaatgcattaaggaaattacccatcagaagcatcatggctgagatgctgtgattaagcacaaacatggaaatgctcaagggtaggggggaatcattaggggaaaacattacacacaaacaccgccttcaatttactttctttagaattagttctgtggtcatagatatttgaaatctgcagagacccataacatgaaagttgtcaagcatccactctagctgaagctatgctaggtgttcccaccagctaccccacaatatcgcagttaggtggatgcagtcagattaactccacagacattcctccactgactgtacaatctcaaatgagttacttaatctaaggctcatccccttatctcagcagtggtgcattaatatgcatattaggtggtcattgtaacgcttcaaagaaataatgtttatgaagttttaagcatacatttactgcaacatgaccatttttatacatagcactaattgacaattatgagtaagcattattgctgttgttcattagtatccccttgaacacacacacatgcttgtgggtcaataatcttgtagaaggtttcaagctgataagcagaggtaccggaatttagaatgaaggttgctctgtctgtaaaagttcaagcactgtctacagctccgtattgctcatgttcttaaaaaaaaaaaaaaaaaaagtttcacaagagttcacaaagagctcaggtatgggagtgcatatgtctttatgcacatccaagggattacaaccttatattttgaatcccttgtgattctgagttatcctgctgttgctcacccagcaaggattgccttcacaggcattctagagaaaccaaacttaaataactaagtgaatttttgaccataagggtgtgtctgtgggtaactataaagaggtcaaaaacctacacacatggtgatgaattaacgccctgtgtcatgtggtgagtttgtggatgtatcataaccaccatcatctctcccctccacttctgctaacacctcctagctctcccctctgcttccactgttcccatctctggcccacaaaattcctgcaaattgtaatgtagatgatgtcccctctctcaggtaaaagacttccattgctccgcctgaaattccagctccttgccacaaacaataaagattttctcaatctacttctccaattctcctttctcctctttccctgt

SEQ ID NO: 48751 - DNA, 1498 bp, Bovine  19866880889082
aatagaacaggaaagtagtgtttaccctcccactgcctccatttcagctcagccccaaacgccctgttacataaaggaagagaaataatgacccagactgggcacaattcctcccttgctgaacttaccagcaagttattaaccaggcttccaccaacactctcaacttggcaccaacaatagctgaagttcagttcagtgatctagatgaagggaaattagattcaggcggggataacaacttgtcctggagtgaagagcgaatgcataattcctctcatttgtccccactttatttaatagcccacatagggagcttatttaaaactacaaaacaacaccacaccaaaccagccaatatcaggagacagtctcattgaatcatcaatattacaatagtaattattattattttcttctgtgatatagtaacaaaggggaaggcagggagcagatatctaagagagagtcagaaatacccttttgtgctgtttaaactgaaggcaaggaagcgaattaagacagagctcatgcactaatcctaaatgtttttttattttttaatgaagtataattgctttatcatgttgtattaatttcagctgtacagtggagtggctcagtcatatgcagacatatatcccctctctcttggatctccctcccaccacccccatcccagccctctaggtcatcacagagcaccaggctgtgttcccttcacttcttttctatgtcattgttttccatccattcattgaatcagtaaccactggatacctactatgtgtcattcattgaataactaaccattgaatacctaccaggtgtcaggcctgatgccaggtcctaggagcaaattagaccaggtctccagtttcacagagcttagagtttaaccaggggtggagagacagacataaatcaaagaaatcaaaaattacaatgctgtgaagggaagttatactggggccacaagagtagaaaatggagatcatggatgtaaatccagagaggcttcttcaaagtgacgtttgagaagatgcttgaagcatgggtggcattcaccaggctgaattgggaggagagagagcaacggagaaggtctagggaacttgagggagtgaagtgcaaagtccttaagaatgcaacacatgaggatggatggggctggaggcgaggctggagaagagagacgtgctagccactgcaggaccatgtccggttcacaggctgtgccctatgaacagggaatccactgaaagacatgatgtaaataaatgctgtgatctgtctgtatttttcagctgttattcaggcatcctccctggcagacattgcacactgtctatctacacagtatctcatggaatcaatcctcctacaggggagtaaactaaatattggagacagtatgtgacttgcctgagattgcccacttgtcatttgccagagccaggattcaaactcaggtctgcctaactccagagcacttcct

SEQ ID NO: 48752 - DNA, 1445 bp, Bovine  19866880926393
ccttcaattagccttcatccgtaaaacagcatcctcctggtggctcagaggtttgattatcccacccagggaaggggaagctttcaggagagatttctgaaaggagagaccatcagagagcaaaccagtagggattgtctctgagtaactatatatgcattgcagttgaatatcatcatattttgcttcttaataatccatcctcatctttgttaataaccaacagataccattcctcaggatgaataacttgcaaaaaaaaatcattaaataaaagtcagttaattgcatttcttaagaaatccaactttttaatgtttcttctgagagcagagctgtagtatagtcaaaggatcaattatctttttttttcctcctttttaaaaaaaacttgcagaatacaacattttctttccttaaagggctgcagacacattcccatttctttccataagaataacttgaaaaggatgcaaagttatacagtcgacaattcactgcacacaggctgcttttgattatattgcctcacaaactagatactttgctgggaagcataaaaactgtttatcactaaacatttgagattccactcagataatttacacataattagacagaagcccacacttccgagcggcggcatcacctcctctttcacagactattctttaagaacatttttggtagcataatgagtattttatgaggatttgtaatcagtcgcaacgtaggtgggaacaaaggtgaattactcctcaacacgatcaaatcattacataactcagtgtggaataatgatgagctgaggttggcagaggtaacctgcccaggtatttggaggtattagtaaattccagtcttttccagaagcatagaatcaattaagtgatcccttgcatgctcagtcacttcagccatgtctgatgctttgcaaccctatggactatagcccgccaggctcctctgtccacgggattctctaggtaagaatattggagtgggttgccatgccctcctccaggggacctttcggacccagggatcaaacctgtctcttctgtctcctgcgctggcaggcagcttctttaccactagcaccaccttggaagcctaacagttctctttcgctcctttaactactgctctttactctaggaagtcaagaaacgcctggagtaacaggcaaatttggccctggaatacggaatgaagtggggcaaagactaatagagttttgccaagaaaatgcgctggtcataacaaacaccctcttccaaccacacaagagaagactctatacatggacatcaccagatggtcaacactgaaatcagattgattatattctttgcagccaaagatggagaagctctataagtcagcaaaaacaagaccaggagctgactgtggctcagaccatgaactccttattgccaaattca

SEQ ID NO: 48753 - DNA, 1409 bp, Bovine  19866880950191
aatgatggggtggacacgtcgcagtctccagtgcccatctcaagatccttccaaaattcagttgaggaaccgacattattttagaaccagttggtgtcagctcttttgcaaagcctactttgaaagaactggtgtctccggagctgtatgtaggacagaagtggtgagcggaaggcttatcccagctctgttactcaattagctgatccaactggatcgagcaagttgcttaacgtgattcaggggctttaattgccttctgtgaaaaaaaataggggtaagaataactatttcatactgctctttgcaagattaaatcgaatccttagcacagcatctgggacagggtgagcggccaatggctgtttattaaaaagtgaatgaaagaatgaatgaatacctgtgttaaaagaagtagcatctgtttatccaacatcattttttgttttccatttctcccacgtcaacatgatacatgccccagtggcttgacaaggacgcacacgaggcatgtagggagtaggggtctctctcgggtcccttggttcctcctacctgtcctggctttcttccacttttttctcccgacccctggaagtcctgctggtggtaccgccttgtaaagtggctgcacaactcaattaatgctctgtgacaggaggaggggaaataaacatcgtcttgctcctgtcggtagcaaagctatttactttcaaaaactgacagaatcgcactgcaggggcttcacttatttctattcagaatgtccttgttctggatgcaggaaacctgagccactctttcaagttaattcccataagcttcccttgggtgggagctggctaaagtgaagatggtccctgggagagtccagggagtccctccggggcttggtgatggccgggtccttgactgatgcctgggcaaatgtcccagtctggggatggacggtccagctgacatgtgcatttttagatcctggatctgtcctgccagagggcatatgtgtcatcgtgtcctctttgctgttgttcagttgctaagtcttgcccgactctttgtgaccctgtagacggcaacacaccagcttccctgtcctcccctgtctcctggagtttgctcacactcgtgtccattgagtcagtgatgctgtcttgactatctgaggatagatatccaactatctcatcctctgtcaccctcttctcctcctgccttcgatcttttccaacatcagggtcttctctaatgagttaactcttcgcatcaggtggccagaggatcggagcttcagcttcagcatcagtccttccaatgaatatccagggttgatttcctttacgattggctggttctccttgcagtccaagggactctaagagccttctccaacacaattgaaagtataa

SEQ ID NO: 48754 - DNA, 747 bp, Bovine  19866880976307
tcaacatcataattaatcaattgcaaagcaatggcctaaaaacaacactgatgaagctcctggtgacctatctgtttctaatctgctacagaaatagaatatcgctgtgaaagattagataatataggacaggcagcactggactttcagctttatgaaagcaagtcttcattaaaaagctgagttactaaacactaaactgaatgtgaaaaatgacttgagaaacccaacctaattagtgctgggacctttattttatatgatattactgtgccctcgcttgacactattatctgtaagaatagaagtcttgagtaggttgatccattttgagccagaagtcttcatttttgtaatagctacaatatccagccataaagccactgttccactcagacagtccacacggcacaaagacgccagtgggtgacctccagtaagggtcttcagcattccatagagacagttaaccacagtctctattagccaggtagcatgggaaaatctaataatttcttcttccccttaaaaccacatagctgtccatgtccagtttttctctctctggcagtagaagttgcagcaaatccaaccacattatcctgaacgctagtgtcttcaaagaatatttaggccaccaaaaagactgacttggacagggagatgcttagatttatatgaattaatcaataagggccattcaattgctgcattgttcaggcaggtattgctaaaatcgtccatgtt

SEQ ID NO: 48755 - DNA, 1600 bp, Bovine  19866880978763
tgtaggctcacgccttggcttttctgcacttcctgggtttgtcttggggacacttgatactgccctcttccgggcctgaaatgcacgtggccatgggtgcagctgaaattgcaggagccggggaatgtgcttttccagactgtgggagccacctgtttctgggagtgccatggaaacgcacattccgtcccttgatcttgagacccaggcaggaaatgttcagctgtcagcagctgtcccttctgatccactgccgaggagtttccagtcccataaaaagctcatcgtgaccctcactagtgattttgtcacctctctctggcgctgagcaggaaacaggggttccttccaagtgatgtgtgggcataggtttttaattggggtgcctgaaaaatctcccctccaactgtgtgtcagactaggagcatatggtcttgccatggagggattttaaacatctaattggttgtcataataccccatgacggaatcatccttaagaatctctgcagcagagatagccatggctctgtggctttgtggcttctgggggggaaagtcatccagtctttcagaggcggtcaactggatactgcaataccgtgttacctaaatctttcacctgtccccaaacagagcagagaggactggcccctcactctggggctgtgtaggaggagcctgagcttgcctcatcccatcctggatgtggttgtgtgtcctctttaggaatagctggccattctctttcacaagagactgtcagctgttgagcagtagtgttgctgaaacttggcccctgttcaccggtgccgaaatgcagagacagtgttttggatcaagtagaaaagagtaacttttattgctctgcaggctaaaggggccacagtgggctaattctcttaagactgtgtgacccaccctggaggtagtagtgaggagttgtatcttgttcattgagcagggcgtgatcagcctgtggacattccttggattggttggcatcaaggtgaagtttcaagcatcatcagccttctgcttgcaaccagtctagggtctgtgttcttgtggtcagcagtttccatctggaggggatctgcttcctacaaaacaactcagaaatgcgtgccaggtctttatctgtagctttcagggaactgggagttcagtgattctgctaaggggcagaattatagtttaaattgttaccagttccttagctcaacagctagtcttcatttttgcatcttcacgtttcccatcattggctcttgtttagtcactaagtcatgtctaattctttgggatcccctggactgtagccctccaggcttctctaatccatgggatttcccaggcaagaatactggaatgggttgccattttcttgccgacccagggatcaaacccatgtctcctgcattggcaggcagattccttaccactgagccattaatccttgagtcagcattttaattcaaaagatcaggacacagagtctcgtacacatcagctggggaacagtaaaatggacagagatccatcttcccaccaagttttgcttcagattctccacctctgttgtctggtctgttctgct

SEQ ID NO: 48756 - DNA, 1347 bp, Bovine  19866881010844
gaaatcccatggacagaggagcctggcgggctacagttcctggggtcactaagtcggccatgacttagcaactaaagagcaacaacaacaaacccagtcctggcactgacatgtgtctggagtttggagctaagctacctgagccccggcggtttgtgttgactcggattccaaatggctctgtcagcccccatccaaagccaaggtaccaacatcccaaagcggaattgcatctcactgctggcaaaacagctcttttgattccatggcaaccctgcatcctaactgcattttgcataggcatttaccctacattcatttccaaaatgaaatggtatcttgtactacacgtgtttcttgtgatagtttgtcctgtgaattcatttaataatgaagcatatggtctgtcttcccattttaagaaccggggtcgtgttcacaacagccaactgccaagcgttgcacatacgcaaggaggagcttttcagcgtacgattttgaggatgaaaagaggctcaggtgagcttgcttctattaacctgtgccaatgagaaaatgattgtattctcccacactcaatggcacggaagttggtgaatatttagtagcataatcaaggataacaagtgcagaatgggagcactctgttcaaacttcctccagcttttcacagtctgacagcagaggatgtgtgtttattataaggaaaatgttgtttaaagggccctttgtgtgtgtgtgtgtgtgtgtgtgtgtgtggagaaaacaggttaccacatacgctgtagggatgtaaatgaatgaattctttcgggaggcaaattttagcaacatttatgaaaagtgaattgatccagcccttgccggactaagaaattatcctataaatatacatgcacaagagacagatgtataaataaatgcaatgcttgaaataggaaaaaaaaaaaaagaaacttaagccaaactatttctattggcattaataaggaatctattaaataaataccacttcattcataaaacaggatacaatgaaactattaaaaataaattagttgtatacatccagtatgaaattattatacgtggcatattcatttataaatattagcactagccagttggttaatttctttctttctttctttggtggctagctgatgaatctttcatggaccaattctgagaatattgctacgtctcttatctatggttctttattttgtttcaactggaataaggttgcattacaatgttgtgatagtttctgttgtacaacaaaatgaatcagctatatgcgtacatatatcccctccctcttagatttcccagcccacccccatc

SEQ ID NO: 48757 - DNA, 855 bp, Bovine  19866881048229
catgtggccacagccttctggggacagactcttggggaccacctacacccctgttccatgcggctcctggcacactgtgggcgcttaataaatgctaaataataagaatagctcccatctgtcggtgcccggtggtggagaagatgtttgagcacaggacggccgactggcaccgggcagcttgtgagaagccttcagggaaagacgcagctctgagtcactcagagggcttcttgtacccaggggtcagctgaccctgtgactcatcagaagctgggcaagttcattaagcatgcaagtgtccactctgaaccccagatcgtctccatcagaaggcagggagcagaacccagtgaactgtgtgcctcccaggcaatctcgggtttccacgtgtggctggatgcaggaactggtgtcgaccgacaaggcagggactttgttagggtttaaaaggggccctggatctgccctctgaacagacggcgtcataaattcatacttccgtcattttcttggaagaaaatgcctactgggctttgcgcatttagttacaataaaaacaacagcagctgcttgttttcaggcatttactacataccaggccatgtgtaaggcatttcacctacagcatctgactgaagcattgtggtttggagaggaaaaagcaggtggacagggtgctgtcaggatgtggaatctgtggcaggtgacctggttcatctccttccttcagctgtgtgaccttgggcattacttactccctgtgtgacctcaggcagggatcatcacgtctctgggcagcagtcacctcgttggacggcagtgaaaggaaccaaagcgtataaagttcataac

SEQ ID NO: 48758 - DNA, 780 bp, Bovine  19866881052200
ccactttgagaaccatggctttcaagtgatggggttcttgagttgtctgaagggtgactgtctcttggagcctgtgtaaatcaattgcaagttggccctggattagcgcctaaaataaaattcaacctattctgagaaaacaatatatctgagtagggactaattacctcttttttatttcaagtgacaaaagccaatatatcacacttagccactatgaagactccatttcagtaaactaattaaactaatcctatctcaactcattattctcagttccactaaatattttaacactcaagatttatttcattccataaattatatcatacttaaagctccgcacagccctcgagagtttattttggactttttaaatgcaactcaaagctttatctagaatgtatatttttcataatctctcctagctaatcattcaccttaattatgactaattattaaaaatgatatattactttaattaaacgaaagtgctcttcttcttgttagcccttattaaacgctgagaaccttaaaacgatcacacagcacaggaaacggcataactcgcagaattgattctattttcttgctacaagctgacagagatgcacatttcaggaggctgattaatgcacaagatcgccagaagagtgtttttcatagttagaaggaattaaagcccgtgtccatcccagattcgttttctaacagaggatcgccgcataattaaagcgttaatacacatcctcctatccgtacttaggttccaaagccagc

SEQ ID NO: 48759 - DNA, 2452 bp, Bovine  19866881082224
ctctccttttgccttaagcaatctgctgtactgacaggggttggtcctgcctgtctttttttttttttaatcccttgctggcactggaaaaacctgcaaaggccccaagaagaggacagaatttccccctcagctcattttcataagaaacacgataaataatacatggcactttaataagaccttatctgaatggtttaatgaaaaacaaatacattatgtaaggaaccaataactgctctcagctgcactgagccaacactggtttgcccgtccgtttttctcccgaaagttgaaaactctccgtggtgattggattcctacagaccctttttgcaataatggctcccagtttcccccttagacttaggtctcgcagccgggggaactggaagccggcaaagggaaaccgtagaatccagaccatataaacgcgtctcaagatgatccggggccaggctgcattccctggataaccaagtcagaacgttcctgcgcaagtgcatgcaaacaaattcatgcaaacctgactacgcacacagccaagtacacagcccatcaacacagatacaagacagggcaggaaagattttgcagtgaccgagaaacgcacacagcatcgggtgaccccaaatcaaacggtaactccccagctgcaactatggctcagtggaaaaaaactctgctagccttttaagcagtgtctggggatgctgaatttgaattccatctcaacagagactgagagagagccacatcaatgctactagctcccaaatgattcttctattatacatgaataaatgggagacgcgggggaaagaaaatactcttctctctccctacaaagaatgtccgggcactcagtgtcacttgggtgtatattctgagttacattcaagggccgccctcctgctttctcaactacaaggagccgtcatggaatgcttaccccgtaggaagcagagagtgtgcaggaagataatgaataatgccgtcttcagatggaacttgacccacacaacagtgctggaactttttccttcgctcaaatttgccatctcttcagaataaaaaaagaaacattttttttttctttactctctttcataatcccttattctaactttctaagactgtcaaaaagcaggtattcagctaaagaaagattttctatggaggttgccctgcctcaaagcaaaaaaaaaaaaaaaaaaacttcagttagacagaaggaaggccttcttgatcttaaatgcaattttctgttcgaaggctaggcataaagtgactgagaaagtattttattctcacttccaaattttgatacagcaacaacaatcttcaggagagtgagagtgaagtctctgtagggaactggttgttgctatctctatcacaagcaggttaagtcacctacttgtgcaaacatttgaacgctatttagtgggcgttggttacactcaggcactgatcttagtccctaaggctgcatcagtgggagaaagcaaagatccctgacatcgcatggtttacattctggtgggagtgtcatcaagcacagaacaaagattagagtatgtcgattgtacagaatacagaaggtgacgagtgctgtgcaaaaaaataaaagaacaggatcacagcatcagggacaccaaagataaggaagtttgggcaggtggcagtaaatactgtataaattggtgctcactctgcaaatgcagtttcagcttgacaggtacacactgctatgtttaaaatggataactgacaaggacctcctgtacagcacaggggactctgctcaatattctgtaacaacccaaaagggaaaagcatttgaaaaagaacagatacatgtataactgaatcactttgctgtgcacttgaaactaacagaacattgttaatcaagtatgctccgatgtacaatacgaagttaaaaagaaaaaaagaaaaaccttgcatcctcaccctttccactctgattgccaagccccaagtttgctaaaatatcagttctggagttctcatgggtcagtccaccgagagtggcggtgggagagtttgaccctatcaatgcataaacatggggaagattcccacctgcagtgttgtccatttgaagtgcagggtttaatacagtgtctgatatattgtagggactcagaaaatactgcattaggggataggtggatggatgtatgggtagactgatggatggatggatgaatgaatgaccacaacagcaatttggagcaaatgacctctagctatctctttcttttcaagaaacacacagattctaagttttatttactttttagctctctctatattaagctggcttcttggcctctagaatgaggtctcagcccctgatggtccctcggggctaccctggtgaagccctactccccagacagctctttggaaaaatgtccccact

SEQ ID NO: 48760 - DNA, 1606 bp, Bovine  19866881082383
ttcccatttacagtggtccagtcccttaagttgtgtccgaccctttgcaaccccacagactgtagcctgcaaggctcctctgtcccccactatcttctggagtttgctcaaattcatgtccagtgagttggtgatgctacctaaccacctcatcctctgccaaccctgctccttttgccttcaatctttcccagcatcagggtcttttccaatgagtcagctcttcacatcaggtgaccaaaggctcagcctcagcatccgtccttccaatgaatattcagggttgatttcctttaggcttgagtggtttgatttcccatgctttctcccaaatagtcttggtacactaatcattgcatctttattttaatttcatttttacagtcatcttttattattggagtataattgcttcacagtattctgttagtttctactgtacaacaaagtgaatcagctgtatgtgtatactgcccatttattctttaatgggtttactttctttatccatgaccactggctttttggtgtgctttagagctgtgcttttcagccctttggagatcatattgaagggaagagcttttgaagaaaacgggattttttaaaaaatcaacaaactgacatctactttaattagcctctaacaagggaattcattaattcaaaaatgtaaaaagaaaaaaaaaacagagcagcctctttagaagaatatgatatcttctaataactggtgttaaactggaggtaactaagagccttaataaacacatacacaaaaaccttcacatttcatctattcaacttcgtgcctacacttccttctccccaaactgaaaagttagtttagagcatggctaatctattgcgatgcaatcatattttcaccttatcaaatatccccacgtattccttctacccgctcaaaaatggaacagcagtgatttagattttatttggaaaattctttattcatcatacggaaacacattcaattgcattcgaggaattcaatttcaaactaatttatcttacgttaatgtttaaattcatgagattttgcttagactcatccttgtagtataataaattcagagtcaatatgataattattaaaatagaaatgagcatgagaaaaataaatcgggtggtctgagggtgaattctctcacacctgagctgtgaggcttgtagcaaagaaggtgagagagaagaaaaaagagaaaaaaatagttgagggagagatgaaaggagaggaggagatagaatgtgcataagagcacctgtgctaacacttatctgatacacactgtgttccagtcaatttcaggatttcttcaaattcttgcatcccttggacagcaaggagatcaaatcagtcaattctaaaggagccaaccctgaatatccattggaaggactgatgctgaagtgccaatactctggccacctgatgtgaaaagtccactcattggaaaagaccctgacaggggggaaagacagaaggccaaagaagaagtgggagatgagatggttggatggcatcaccgactcaatggacatgagctggaccaaacttggggagatagagaaggacagggggaag

SEQ ID NO: 48761 - DNA, 1426 bp, Bovine  19866881201213
tgcaccataaatggaatgctcttgaatatcccaaaaccatacccctctccctccctggtccctggaaaaattgtctttcatgaaaccagtccttggtgaggactgcagtcttacaggaaaacccaaatgaagtttttggccaacccaatatatgtaatgtaaaaatacacataatgtcaaaatcaaagtgtacatcatgtcagactttgaccaggattttaaaggacaagtcagggtcctctaagaccctgtggatgcagtgagcaagataagaaagcccctgttcttaagtgcccgagactgttggctgggaacttcacttgctcgaggctaataattgtttttgtttgtttttgacacaagcacatttctctttggaaataccacctcataagccaccatgtcaaggctactgattaacaccaagtgccataaatatctgattgtccctaacttttaaggagttgagaaaaacagcctctccgttgccttctgtggctccacatggaacgtcaggatggaacatttcataagcgtgacacctcactgtcgcaaatccaccccgcctcccctgcttcatgtttctggggctggggttttcagccacggcaaggtggctcctggcctctctctcctctgtgcctccctgcggaggctgggaaagtgaaatgaaacaaattgctttttctccaatctgtgacatggattcctgttatcgtggttgtttgttggttttttgtgaattatggtcccagagcaattgcagagctctttgttccagagattttttttttttttttttttagtaagctcatgtagttaggaaaccaaggtttgtatactcaccttaccaactacaagatcagtttgtaagctgacctggaggtcagctttgaacccatctccaggtgtttaaggatgtggggcttggggcttaggagtctgatggatttggttaactagttttttctagttgtgtgaatggcaggaagtactggattgaccagaaggttcatttgggttcttctgtaaggtgttatgaaaaacctgaatgaaccttatggcccacccgataactccacctagcttaaaaagagaatgatggtaggtgctacactgggttcttatcaaatatgataatataggcaaagctgctttgttgaattttgtatctttggtgcttagaacagtgactagtacatagttagtactcgagaaaagttttcttatcatcaccatcatcttcatcaccaccgtcatctccatctttatcattttcatcatcatcactatatcaccatcagcttcatccccaccatcatcatctccatcctctttatcatcaatatcatctccatcttcgtcttagcatggattcagtgacaggaactcttcaataacaccacatcaggttcaagttctgggt

SEQ ID NO: 48762 - DNA, 1222 bp, Bovine  19866881212787
aataagcaaaggtcactttaaagcccctcccttcttcttctttcttatcttcctccttatcttcctccttcttcctccccctcctctttctttcttattaagcaatcatagactggaaaactggatggacagctggtgagaagttggtgtgcagcacagggagccagtctggctctctgtgacgacctggatggatgggaccgggggaggggagagggaggatccagggcgaggggatgtgtgaatagttatggctggttcatgctgttgaatggtgggaaccagcagagcattacaaaagttaaagtatacatatatttaaatgcaaactgaacgaataatgtaaagtattctctagtccttcccctcaaaaggcaggttgaaatggagacaattttggtcgccagctggcattacggtcttggatagatgacctagggtctttacttttctgttacattgtatgtgaatgcaggctttttttatattgcgcgtaagtcctcacagaacgcgttaggtccgtcttatttatctgccaagcagagtggcgcccgtatgaataactcccaaactagtgaaagcatctgcaacttgagactcttaaattttaattttcttattttaataccagtcagtagagctttggaaaggttttgacttgcctgagttgaagcacaaggaatctactggccaatttcctttgagtattaccttgtttgaattggatggaagggcagggaattgtataaatgtcaccacagagagcccttgtcccctggtaattagtaaccttatcaattcagagcaaaggcgcatgttcagggattttgctttggacgatggcacacggatgagggaattttatgactatgtatgaagtgcctgctctggtgatgttttgctttggcaaatgggtaactggcatcattcacaatctgacctgttcctgtcaccccctggttcttctgttccctttattatccctagaagctcagtcttcctcccctttcccccactcagagtctaaataaactccctcatgatctcaggttgtaagcagcaaaacagtttgaggagtttttgggtttgtttttaagtttatttttattgagtgtttttctcccctccatggcagaaataatccatgtctgttgcaaaaatccaaagcacaaaagaagaagaacacatgaaatataggaaattccccttccaaatcctacac

SEQ ID NO: 48763 - DNA, 2287 bp, Bovine  19866881217287
cttttgccttccatctttcccagcctcagggtattttctaatgagttagttcttcgcatcaggtggccaaagtattggagcttcggttcggcatcagtccttccaatgaatatttagggttgatttcctttaggatggactggtttgatctccttgcagtccaagggactctcaagagtcttatccaacaccacaattagaaaggatcaattcttcagtgctcagccttctttatggtccatctctcacatccacacatgactactggaaaaaactatagctttgactacgtagggttacagatattaaataaaataaaaaaatcaaaacatgcagcacctacatagaacaggaactgtgttaaatgctacaaaagagagaggtggtgctgtaattcacacataacaaggggatccaacttagtcagatgggtagggtgggaggatgactgaaaggacaccgggagggtctgggattcaggatgcttgggctgcaagtaggtgataaactgcagggctaagtcccattaagcatttgttcattttcgtaaatgcattgagaagccacatcatgttttcgtctgtgttcagggacaagacccaatcaatacaaatgttctctactctagcttagtggaagaagtgggcttttggaaagagccaacctgggttcaaatttccactgtactgcatatcagccgtgtgggcctgggggagctatctttcagcttcggtttccttttatgtcaaataggaatagtttccactctctcttccttatttggtgctgccagcaagcagaaagcaagcgcacagaaggaacacggtactccacactctacactgctgctgccattgctacggccaccgttatcagggtgattccctctagatggctgtcagctgctctcctgttgtagcacccttccctcacttccttaactggatacatttctgaaaatgtaggctaaagtctcttctcatttctcactactcattacctctattcgccaggcccttttctaacatggccatggcaatagcaagttacgcagtgtcgcttatctccaagcattgctctaagtgctttagatacaccatctcaaaacgacatggaggaaaagcactaggatgatcttcattttgctgatgagaaagaatgctgatcccaggagataacgcacaccagccaaagtcatacatctaggaaggggcagatgagacgtcaacctgtacttgaacttgaaacttcatggaactagaagtgccataatgctcaccgtgagaactgtacaggagggctctcaatagcactcaccctcctttgcactgtgcatgttctcacgggtcttctttaaccatcttttatttccttgatcaattctacctttcgtctccttgccaccaagcattggtactcggggatctacaactctggatctttgtcatattctcttccttgttcttctgtaagcttttctgaacatagatccctccccttatcaatctcatacagatgcctcataaaagccatcagaggaatgggcagttgagttttatgaactcttgtttatctggcagggagacagacatttagatcaactaatagtagaggccaagaaacagggtagaccagttggcccttccactccctgaatctttttccatacttattaaaccaagatattgagggggggaggaagcctggttctgtattttctttacagctaccaggagattctggtaattaggaaccactgggatatataatctcaaaggtttggacttgttctttgatttctataacattataaaagtagaaagtttcactaacgtattttatatactttgatatgggtgaaagaactagagtttttttaattttaattaattgattactttgttaatgacttaggttataaactataggggcttttgttgttgttttttatattactgatagccaaaatttaaagatggtgaaaagtctgaaataaatgaatatttttaagtggtcattttcaaggtctttttttgttctggaagggtatatatgttgcaaattctagatggaaaacatttggaaacactgagacatttaattttagctgagcaagccacatgttacttatgaaacatctattttgagaactgcagcagagaattaaacctgacacttcttattctggtctactaccttcactgataaacaaaataaaattacaaacacacagggaaaatggctttaaaggatactagaggaaaaaatgaggtaaagggagattcat

SEQ ID NO: 48764 - DNA, 710 bp, Bovine  19866881221304
tttcactcaaatgcatcaactgggtgtctccttgcaaatatttgactttctttaaatgtttgcagtggaacgaacagcacagaggatgtgtaaacagttctaaatgccacttttccactaccaaccaaatacatacttgtaatagtttgtacatattcaggatttacagctgtaaatccctgtttcaatgtcatggtttacaagcccactcatatacttctcatgagaccctgggatagtgatgtaggtcattctacagcagtgtcacctctcttgagaccacaaaacaggtttcttctggttgttatcttacacactttctaacaattttctaacattgcatttctagaacagcttggaagtatgtgctattagtaggttgggtgggtggggtgggcgagacagcagtctgatttcttggaacagggccattttcatggattagatcccagagattttcctcatccagacttctggtatacctataatttcctgctcagaaatctcttcaagtcttaaccctgggggaatgataactctgaggaagcagcttatcagcaacacatcaggctgctatcaggctagtcctctttcagacaatccgtgaggggggaatctcgtcattggagcaccaaggtaccatcaagtcaatgtggcttagaaggtaaagaatccgcctgcaatggggggagacccaggtttgacccttg

SEQ ID NO: 48765 - DNA, 1290 bp, Bovine  19866881247003
ggtttctgaagtgattaaacttgtaattaaattgtataacagaggaggaggtgagggcggagaaggctgcccggaagaattccactttcctgctgatctgttggtggtgctagttcagggagcccctgggtgatttttttttttttttttaattcccagcttcccagggttggaaagaaaatctggataaacagtatttgtgccattcttacagtcctatttccaatcacagtctggggatgtgattattaattaattaattaatgcaggatgaaattaagcagctctctcaggttccttgggattccctggtagctcagttggtaaagaatccaatctgcaatgtaggagatccaggttcgattcctgggtcgggaagatatgctggagaagggataggctacccactccagtattcttgggcttccctggtggctcagctggtaacgaatccatctgcaatgcaggagaccaatgttcaatccctgggtcgggaagatcccctggagaagggaaaggctacccactccagtattctggtctggagaattccatggactagacagtccattgggtcgcaaagagttggacacgactgagcacctttcactttcactcaggttccttaaagagatgcgtctgctcccctctcaaaatcgcatcaccagaggaccagagcccctcctcaaaggactcgctcaacaggtgggctcagcagtcattcttacgagccacaagctccttgtccaactaataactgaagagctaaacttcagttcttcaatcaaaggggtcttgcttttctcctataaagcaaaaagtatgagaccaagacagaaagattccctggtgttctggggagtgacagataaaatgcaaaaacccaaaacacaaaaaagtcaaaacacccaatagcggagaatgtttcaggtggagacaatcagagtgaggtaataggacattactctttatcccacaggccatcgggtcacctatgggtggtcctacagagccagatgctagaactccaccccagacccaccggcttaaaatctctgagggtgggtgggatccagcctcggatgctgtgtaaaggtgtctcagactattcttatacacaattttggggtgaaatgtattgttttcaaattacaggtgtgatcccttgggatgtaaaactctggtggcgggttattgcatcaacattctctaaatgaaataaactataccgcactgggaaagaatagaatagagtaagagaaatgtttcatgaaacttttatgcgggtga

SEQ ID NO: 48766 - DNA, 1251 bp, Bovine  19866881266522
cctgtgattctccaggcaagaacactggagtgggttgccatttccttctccaatgcatggaagtgaaaagtgaaagtgaagtcgctcagtcgtgtctgactcttcgagaccccatgggctgccatcatgctggtttaaacacagctcgttattcagctcatgcaatggacaggaatttggacaaactccaggagatggtgagggacagagaagtctggcatgaggcagtcttatggggtctcgaagtgctgcacacaaccaggcgactgaacaacagcaacagttactcatcaccagtggaccaacctgcacaacacatttgcccaggagcattttgtcctcatatatgaaaaggtaacctaaagtagcagttctcaaccaagggcaactttacggcccaggggacatctagcaccgtccaaagatattttggtcatcaccagtgggttcagagttcctgctggcatctggtgggcagaggccagggatgctgctaaaaagttcctataaagcataacaatctggccaaaatgacaaagtgccaaagtggagggactcccctggtggtccagtggttaagaatccctcttgcagtgcttgggacgcaggttcgatccctagttggggaactaagatcccacaagcggcagggcaactgagcctgagcactgcaacgataaagtccatgtcacccaacaaaagatcccgcatgacacaaggaagacccgatgcagccaaataatttgttttctttaaacagtgccaagattaaccatgcttagcgtaatttaaaagggtggattctaggatgaagaagatctcagagagtctatggctctgagagtagtagcatttgcccctgaacttctgcgagcctcggtttctgcctccagaaagtggaaatcatactttctaccttgcacggcagtgacgggaatttgaaacaacgggacagaaagcacctgtgacagaatcaagtggcgctctcatcatcaccgcggctattgtcagtagtgattattaacgtattttgcaaacccgtcaccaaatagaaaccaaaacaaacttcttggagaatcctgctattgctcattgggcaccagggcaaacatccacccccatcctccgaggaataaactagtctcacttcaaacaattgttacagtttgaatccaattgactccagacaaaagtattgagataatcagcatattaaagccaacactataaccatatattaattatgtaaat

SEQ ID NO: 48767 - DNA, 1034 bp, Bovine  19866881340273
agaaagagagacaaagagaagcagacagacagacagaaagagaggcagagagaaaagagacaaaggtggtaatgtatcaaacccccattcagcctttacccaacccagatcccaggggggaaaaatcactgagcccctggagaagggtgggaacattaaacgacccaagaaaatgggaaatggtgtggggtgtgagatttctttattagtcaatttaaaacaaaatgtggctcagtaatttagaatgtgtctggagtcaagcagaaaattagccgtattcacataggttccctcctcccctgaaggcaggagaggcaccaataaaaataaaaataacaataccttgtatttatggggtaactttctcccagggcttctcctcactcaccctttttatcttttctgtgtccttggaggccagcaaggacccagagcctgggaagtcagctccagagatacttctttaccatgaaggcttcttagaagcgcttcattgggcctcacattcactcattcattcactcgtttatttgtgtttattaagcaacagggttttattcatgaatattaaccaacagggtttattgagcgtctgttgtgtgtcaaaccctgtgaaaagcgtggaagagagcagtgcattctgtcctttgtgtgttagtgaaagccccttgactccagatcttacagaagaatgtgtgttcatagatgtgggaaggatcatgactcctgaaaccctggcagcccaggggttaagactttgtgcttccactacagagggtgcaaggttcaacccctggttggggaactaacatcccacatgccaaaagagagaaaaaaaaaaaaaaaaaaaaacccttggtattgtcttcagaacattcttattctggttcctgggtgtccttgaatgttttaaagtctgagttcagggttgacgtgtctgtaagctttctcctttggggaaacaggtctgcataagattcaccccagtgggaggtacagaagatctctgtggtttgctaagatgataatttaag

SEQ ID NO: 48768 - DNA, 1199 bp, Bovine  19866881375938
atcttattgatggggaaaaggataagtagaagaaacctccaactgcaaccatgggcagaagctccttcctcagatcccctgggtccccctgctaggacaggtgttctgacaactcatcctgacaccccatctcaaggtctaagccagtgctgagggctcagcggtacctctatgatttctcactcttcctgggcacagacaaggtctgactcatctctgtttcccatcaaggacctggcacacagtaggtgttgataaatgttttctgcactaaatgcaattgggatcaatgcccgaaaggcagattctctcatttccattgtttaaaaatatcacagattccccctcatgcattatgtagcacagaaattaatttatccggaactgttttccaatgcagtttccaaaggctctagtctgcattcagctggaaatctgcactggggtgggggcttgtctggctggtctctgacaccctctgtcagtttcaaacactattccttaggtaagtacaacgataaggatctgggtgaaagagtcaggtgagaactgatgtttcctgactcccacctcccttggcaaggtaaagatggatggatctcccaggaccaggtacatcttttacgagtatctgcatcccaaatccagtgggtgtggcttctctactcttccttccttagggagagggctgcagaaaagttgttgttattagcacaggttgtagctacaaatgtgccacgttctagtgacgtgaccttgggataaccatcaagtcatgtcaactctccaagccttcatttcctcatctgtaaaaagagcatcgttacatttacacttgatggtcaatctgacgatgaaatgacaagggactatagcactccaaactagtaacggacattctgttgtttttgtttagtcgttaagtcatgtctgactctgcaactccatggggactgtcccttgcccaggcttccctctgtccatggaattctccaggcaagaatactagaagtgggttgccattttcgtctccaggggatcttcctgacccaagggatcttcctgtctcctgcttttcaggcagattcttttccactgagccaccagggaagcccaacagaacttcacacctgtgcacactgcatattacacagagttttagcagattcttcagtcatttgagaattactccagctctg

SEQ ID NO: 48769 - DNA, 1802 bp, Bovine  19866881385475
tccaggtgcccacaactcctgaaacctgcgcacttctagagcctgttctctgcaacaagaggtgagaggcccatgctctctgcaagtagggaaaaccccaggtacagcaaatgaagacccaacacagcttagaattaaaaataaacacattaaaaaaaaaatgacaagggctggagtccttttcctattctgatcttgtcttctccaatgaaggggaaactgccctctgtaaagtcaggcagagggtgagcttgagtcccagacctgctccttggccctttgactttgaataagcctgtaacttcctgcagtgagttgaagagtgtgcctgagtgctaagtctcttcagtcgtgtccggctctttgcaaccctatgaactgtagccaccaggctcctctgcccatgggattctccaggcaagaatactgcagtgggttgccatgccctcctccagatcttcccaacccagggatcagacccatatctccctcactgcaggcagattctttaccgctgagctaccagggaagcccctagtgacccttagttaagctcatttggaggtcgggcttccaaacagcaggctggttgatgggatttagacttgtggataaggaaaccaaggcgtatcaaatgtttttctgcagatacacagctaagggttagagctgtgattgtactggtactagaacccgctctcattagcctctgccatatggctttctttgttaatggcaaactttggtatagtctaagtgttctgtgatggcatcaccaagccccacactcctctcagattttctaggtagaccaagtgctctgatgtttcacagatggttcacattttcaaaaaaaacacaggagcacaaaacatccttagggagtctttgatgaatagaagtcataaggatgtttggttgaattttctaaaaggtgggagctccttattgtgattaaatgaagagcttaagatgatcaagcagcagtgagaaagattccaccccatccaatgccagccgaacaccataggcagagcaattttacagcagtccatttccacccagagagagcgcagaccgtgcgccaatttgattagagaatggctaagacgcagggccagccctgtctattagacggagagctggactaatgaatctcggaaatggaaaaatctgtctatccttcttcaaatctgtaagccaattattatattggatcttgacttccaatatttctgcaggcttcaaggcagtgaaaccatgccaagcaacaggcaaatgagaagtcagggctgtgaacaccgtttttgtgctggagattaaataaagtttgttttttttccccttccttgcttcctccctccagcccttcctctttcccgccctctctttccttcctttctctttctcctctccctccttctctctttttcctttcctcctttattttcttcttcttctgcaactttaacaccccaaacacaattataggttacagatatgaaaggaaaggaatctattcattttcctggtaaaatcaaataatttcactactcttttttcatccagaaacctgcctgccatgtcctttgaaagctaaattctgcaaggtgggcttcagggattaaattctatgcatgcttgttccctccctgggtttaatataagtacattagtcttggtcagaggagaaaaagactaaggataagaggaagttgagtggagacatttatagaagaaagaagaaaacaaaactctggagtcacactgcttgggtttaaacccacttactcattatctca

SEQ ID NO: 48770 - DNA, 865 bp, Bovine  19866881397251
gagtgcaaaagtgggatctgaatctttcacgagggtggatggttgtccatcttgtcaaccggaacaggaaagacctggttgctagtagaaaccatggtctcaagccctcccatcgtcacccaccagatcggctcacttggtccaggtggctgggtaattttttttttttttttcccctgattcaagacctggtccatggcctccaaaaagaattcatcttccaactccatcaaggagatgacttgactcattgcctgtttctgatgaatgatctgtagtgaaactcaagtcacatttctcccaggatgtactgggaagaaagttccatcaaagaccctaatcagcattttttttcttggggaggaggcaacccctttcctctcaaaatcacaagcctcacccttctagtgcatgaggaaaccctgatcaaggataaaatatcatttttgattcatagggggatgctactaatgtttctaatatttgtcaattctgggattgagtggtatagatttcatatacaaccacatttttttttttaaatatgagaagctgccaacaaatatatttctctggtttgattcatcctccaagaggcaattttcttggtggcttaggaggttacaaaagatgcttaatcagcattctttgctgggctgagtgaacaagtgtctctcctcctcctgctcacactctctttcgcattaatcatgtaattgatttaataagctctggctttaagagcttttttttttttttttttttttaactccgctctttcccttctccccataaggtttcagtttcacaactgactggaaggctgaggctcttggattttgccaggcatgaaatccagcaactg

SEQ ID NO: 48771 - DNA, 1014 bp, Bovine  19866881446003
ctcttgaaaaatacaggataaacaatgctggaaggaaagtatggaaaatcacctccggcctgtggaaatgtggctttattttgaaataatttgaaatattggcacgcgcatgaaaaaaaccaagtcagcttacctgctgctgctgctaagtcgcttcagttgtgtccgactctgtgtgaccccatagacggcagcccaccaggctcccccgtccctgggattctccaggcaagaacactggagtgggttgccatttccttctccaatgcatgaaagtgaaagtgaagtcactcagtcgtgtcggactcttagcgaccccatggactgcagcccatcaggctcctccgtccatgggattttccaggcaagagtactggagtggggtgccattgccttctctgaataagtagttaaggggtgtataaaaaaacaatgcaaaatatgatgtcaaaaccaataaatgttgggggagggcaaggaataatgcagggttgttaaaatatgtttgaatttaagagatcagcaacttaaaatatatatatatatttatatattgaaatatataaacaaaaatgaagaagaatgatagaacagtgattctcaaagtatggatccttgggtcatttcagggatccatgaagtcaaaactattttcataatattattaagatttgatttacctttttcactaggttgacactgcactaatggtggaaaagctaaaaccactagtgcttaagcatgagttaaggcagttgtattcattgtcttagtggtcacttattttttactgccatgttcaaaaagaaaaaaaatcacaagtttcacttaaggatgtctttgctgaagtagtaaaaagtattaattttattaaatcaacccttgaataagtgtctttattatattctgtgtgatgaaatggaaagtctgcaccaggcatttctgctacactctgaactatgatggctgtctccaggaaaagcgattgtgcaattatttgagtggagagctgaa

SEQ ID NO: 48772 - DNA, 581 bp, Bovine  19866881630920
cccctgccttcatcacccccaggcggtcagtgtgttcagcacagtctgatctctggggtgtgggcgggcagagggactgtccccagcttcacaaaagtgcctttcctgctgatggtcacaaaaggagaggcgaaaagggcttcggggctggacaaagccagtctatgcaactgaaggtggccttgaccatcagcagcagccttcgtgattctcctcatcacagcctctcaggctggctttttgtcagccccgtttggaaaaggcttgttaattcacccccgtgaaaatggaagtttcatacgcattgacataattaatgaaaaggcaggcagcatgctccaccaattaacactgcagggaaaagtaaaatgggcttactttgggcgtcttgtgccaaagttaaagactggaacacacagcaaataaatagagatgcttttaatgagccacaagatcgagccgagtaagtcagaaagaatggtaggtaaacactgccaactctttgcattgttacgagtaattgatgagcatagttaaaaagtttgagcatcggatgctgcaaccaggttcatttataaatg

SEQ ID NO: 48773 - DNA, 1417 bp, Bovine  19866881725834
ctgtagcattagggaatttgaagttcactgggcaggttatgcattccagtttctacatgcagttgtttaattaaagcctttgtttcattccagatgactaacatatttttgagcaggatgtttcaaaagttagtacaatttcatagcaaaaacttgtatgccagggatcttgatggatttggtttgggttggggcattgcaagagggttctttacaatgttttgttgtatctggaagttatagtaaagaaaatgtatgtctgttctttacttccatcatgtcttcagaaagactgcattatgaataaatccacacctggaaaacagtacaaatgggtagactgaattgtatgtacacctacacacaaacacacatacaccatacatttatatatagagagagaatattctatgaacagaggagtctggcaggctacagactatgggatcacaaagagtcacagacgtgactgagcatgcgcgcgcacacacacacacacgtttatgagcatccctggtgactcggtactataaaatctgcctgcaatgcaggagacatgggttcagtctttgggtcaggaagatcccctggagaaggaaatggcaactcactccagtattcttgcctgggaaatcccatggacagaggagcctggtgggctataaagtccatggggttgcaaaacttggacacaacttagcagctaaacaacaacgatatatatttatacacactatgcatgcctatgttcatctccacattcctcctctctctctcctaatatggacagatagatatggatattgagatattgatagacaatacatgtgtacataaaatacatatatataatgtacacagttatattggtgggttgtatgtatataaaatatatgtgatgtgtaactctacaaacacacaagtatatgtatacaaaaatgtgtatctctctctgtgtatatatacatatatatatttagaattcctcaacctttgcactattgatactttgtattgagaactcttttttgagcagagtctgtcttgcacattgtagaatgtttagcaacatgcctggcctctacccattgtatgctattattattatcacatataacccagtcataacaatagaaaagtccctccaggcactgccaaatgtcaggggaaggaatcccctgccccagcaacatgagaaccactgttccttcactgctacccacatacaaacacactcatgtacatgtatattatatatatatatatatatactctaacagagaaactgtggttttataagtagtttatcaattgtttggttgctaagttgtgtctgactctttgcattcccatggagtgcagcacaccaggcttccctgtccttcaccatctccccgagtttactcaaactcatgtc

SEQ ID NO: 48774 - DNA, 1707 bp, Bovine  19866881937114
atgggcatgattcggatccggaatcctgcctcccacctccccagggtgtgggaagactcacgtggtctggtcgctttaatcactctcctgagcagaaacgaggccagagcagctgcagaggagacagtcccctctgtcacccgcttcccttagactcacctggtctcccttggacagagtccatttcaaggagcatgaaggtgccaagcagaggatggagtgagtctcagttgagccaaaggaacgattctttcctgctttgggacagtgccactgccttgttctttgatgcaaaatggttttcatctttcccaagagtaaacatctgcttaatgcaaagctttctaagtcaatttaggccccccgtaagtgctgcctagaagctctgctgctattacgggcaggcccaatgagatgggactgcagtaaaatgtgcagtgacacaaatgggtctttcaggcccagaacctgcatgaaacagaagtggtctcactgcgcaggctcatggtgggcagcttagagagacaaggagagagggcatccgggggaggaacgagagctttctccatccgtgagcatgtcacccttctccacgtggtcgaggacccccagcaggtggacagcctgcaaatgtggctgcagactcattttcattgtttgcttttggttccttctccggatggctcactgggactggggactgaggtcgcccttggaaggagggaagagaaattcacatcccgtggatgtgacgctctgcagatgaagataaattaagggactgtaaatatctacacaaagacttcaaggtgacctgggtgacatctctgggaggcgaggcaggaacctggaagcctaattaatggtctgaaggaaggccacattaaaagaagggacttggccaacgtagggaggaaaaaaggaagccccagagtgtcagacattggcagcgtggccacagcagcatccaaaaaagatttacaatagatcccggggacaccagcgtttcaaataatagagaagctgatggtgtcgtgggaggagagctcctctagcctcatggtggcctcatgaaaagtccttcagaaaaacccatgtccctgtgaagagggcctatgctggctcctgcagctgggtttccttcaaacacacacacaactcacactctaaaccacttcattcatttcagccacacgagagctaacagagccactgttttcagatctttccagatcagttaactgatggcagttttgctacgatcggcagcatttcctctttcttccaacaactccgggtcttcttattttaactgcatcagtctaagaaaccctcatcagcaacacaggctaacatttgtaggttcatgacacagagtgtccagcagaacaccacactatatagtgtgaagcatctaacaggtggaatatacttagtgctttagataatatataaagttatgtccctctgtctattggcctgattaccttgtcatcatatttggaggaactatctaagatagctcaatcctatcaagatgaaaagaaaaacagattttccagagtggctgaactggaggttcaccataaagttcttgagattgctgatggagaggcaggtcacatacggtgaagcaccgtggacacggacaacacagatggttccacatctgagccccgaatcaagacaaggggacagagacttcaa

SEQ ID NO: 48775 - DNA, 733 bp, Bovine  19866881944447
ttagcgaggagatgctgcagagtttgagctgatggttgacgcatggggaagttaccccatgtggcgacagtttgatttttcacagaagccagggatatggatttgaagtgagagctctattatttcagtattggtagccaagaacagaaaaaaagcaaaaacaactctatgggtgaaagaaaagtacagagttcaggttcacaacacctgaccggagaaagatgttgaatgaggaggggcgtgggtaccagccttaccgcacctggtgacgacggcaatacatcagtggacccctactggttcctcttcacaagtctataaagtgaggggccagcagatgccatgtctcaggcccaaattctacggctctaatacttttacaagaaactttattaggtagggcttatagagtccaaaagcatttaaccatctcaaatggaactaatatgctaacagccccaccactgccaaagccattgacgctgactgttcttaaaaacatagattattagcctaatagagctttcagaattgccaagtcatgtgcatacagcatcgattctctaaccgcaatgggcttcaatagaactagagagattggtttcagggggccagtggtagaggtggagagtctgggtgtagccgaatctcctgacctgccagggggtcacgtccccctcccaagctctcccataagatcacgtagcttaacttgggtaggagtggcagacca

SEQ ID NO: 48776 - DNA, 2726 bp, Bovine  19866880185888
actccttggaaggaaagttatgaccacctagatagcatattcaaaagcagagacgttactttgccaacaaaggttcgtctagtcaaggctatggtttttcctgtggtcatgtatggatgtgagagttggactgtgaagaaggctgagcgccaaagaattgatgcttttgaactgtggttttggttaagactcttgcgagtcccttggactgcaaggagatccaaccagtccattctgaaggagatcagtcctgggatttctttggaaggaatgatgctaaagctgaaactccagtactttgggcacctcatgcgaagagttgactcattggaaaagactctgatgctgggagggattgggggcaggaggagaaggggacgacagagggtgagatggctggatggcatcactgactcgatggacgtgagtctgagtgaactctgggagttggtgatggacagggaggcctggcgtgctgtgattcatggggtcgcaaagggtcggacatgactgagcaactgatctgatctgatctgaaggtgctagaaccattcttttccctgtgttatttaacccatctttttattcattgcagtaaaaatcaccctaagtaatccattgcccagtgcttagatttcccctgattttaggacatataaatctctacctgagcttggtgacacagctcataatattatctccccttttttatgatcccttctttgtgacctcttcaccaggacaaatcccagtggttcttcatcattcaattctgaagcctcaaatcccaagtcagtatcttttgtgtttttttttttttttccaggactgctaaagtccctgcaatctggagcttgtgaagctctgagtgaccaaggaatagctgtatatcacacccagggctttcacatcaaagtactcagtggagacttcatcctgctcaaaatgacaaattaaaacgaatcccagagctttattcttaaagaacataagacatgttttctttttgaacatttcattgcactgtcttcagaatcaagctctctaaagaacattattataccttgagattcttgacacatttcctaataatttgaagcttctgacattaatacaataaaagattgcacttctggaaaaaaaaaatcaatgaatctttttggcaatcgtcctaaatctgtagagattaaattcacttcccagacattgctatttcatatcaaatacagagtcccacagtataattaagatagttgtagaaccatatatttcataccctagctgtctgctttaaactatcttgggaagttcaaaaataataaggaagctacatcttaaccagagtaattacatttgctaagcagaatgggatgagcaagagctatgtaaaggaataaaataaatccaccagaaaatcaagaacttctacattcattctgatatataaaccttgctgataaaagaaaaaaggctcacctccagttacaactcccaggagaatggcagctattatcccctattgagttggtacttaccatatacagcctgagcaattcatacagaaaaataaaccgtaacattcctgtttattattactttagctgagaggtggtgacattaaacagttctgcactgctgctatcaatcagcaggctggtgatgttctcagcatgggactaagattccttggaaaccatgctcatcaaagcaagcagctgtcagaattcttcaaattaaactgttattatggtagtattcattagtcagttactgactattaagatattttttatattggcaccattgacattggctgttgctttttaatatgcaagttacatataaacatgattcagtggctcgtgtgaggatgacagactctattagagcttggtgtccactgtctaaaggctgcagcaaagggctcctgtctcatccatgcacacttgaatttccctgagaagttggatgtttgttctggtggttagactagggagaagggtagtaataatacatttcaacactagtatttgcccggcaaagtgatagctcaacatcagaaattacaactctgaaagctgtttctgagcccctgatgacagtggtttatgcttctccagcttgatggtttggatttcctttttgtctgagttgctaggcacgtgtttaacttttgcttgaaatccagaatcaaacaaaggatgtcaaatagggtgtgtagagaagtaaaaaggaaaatcagatgcaagctctgataggagaaaaaataggaaaatacttgggttcttattgatttaaatagtatccttggcatttaaaagttcttaagctttagtttttagtttcaaggcaaatttgacctaagtaattttacttcaactagaaaagaatgtgtattaaatacttactagcctagaaagagcgatgtattatttacacacggagcacaaactccttcatacatagaaaccaagatcttctaggtttccccttccctcatgctaatactcatatggcatatggaacaacagtctgttttgttgaaatggagaatatttagtccaaattgtttatgttgtagatgaagagagattcaatgcattaggtcactggtgtcagccttaattttgtttttctcctctattttcaaaatcatcttggatctcccattccacccagaagtcaagccatttccaggtcctcacatgcatgacgatgccgacaga

SEQ ID NO: 48777 - DNA, 2781 bp, Bovine  19866880506022
ccatgcacggcagcccatgaggctcccccatccctggggattctccaggcaagaacactggagtgggttgccatttccttctccaatgtaggaaagttaaaagtgaaagtgaagtcgctcagtcgtatccaacttagcgaccccatggactgcagcctaccagactcctctgtccatgggattctccaggcaagagtactggagtggggtgccattgccttctcctagaacagttcaaaaccagtaattcctattactggggggggggggggacacaaaaaacaaaacacattcctttagaataggaccactggtactgtgaacagagaagtgagaatttattcatgttcgacaaatatccaatcaatgcttagatcaataacagccataatggaaggtgtcagcaatacttggcataatctcccaaactttagtacccatttttttttttttttggaccacaagaacataagtaggctgattttgggtctcacctagggtcagtcagacctaatagttgggcaatatttgttgaagtctaacaggcaatagaatgagagcaacgtaagtaaaaaattcacacgagaaattatctcatcctcactgaggtttgcatttggttccttcccaactgcagggcaatggaacacctggggagatgatctggtaatatattctgacattctacagctgaatactaagggaatgtacttcaaactgtgtgtaaaagagcgaaaaaagttcaattctattcactgtaaaaaacgggaaaacatttcatctcagtgtctatttcgtgtgtatgtgtatgtgatacgctagtatctatccttagacttcccaggtggtggtaaagaatctgcctcccgtgcaagagactccggtccaatccctgggtcaggaagatctcctggagtaggaaatggcaacccgctctagtatttctgcctggaaacttccatggacatggaggagcttggtgggctacagcccatggaattgcaaagagtcagacatgactgaacaactgagtgtacacacacttgatatgaatgacataaattagtataggcataaatgaatactaatgcctatactagatagagaaaatgaatgatttgacttgctttattgattggtttacaaattatgtttactgtcatatagaaattgtgacgaccatgaacatggctagttgatttgctacattaatctgatagcctcagagcttaatttctctgagtcctatccaaagtgataggatgcctggcttctccaccactatagtagtcctgaaatactgccacttcagcaaaactattaatatctacttccctaaaacataattattgcaataactccccaccaggaaatttaattaatattcccaggtagagaacataactttaagtataactgaaacccttcaacatggcataaaaatctcaaaaatcactgatttaagaaaatatgtaattcaaaagtacctgttcaggatgttgctataaataaatattccatgtctgtcttatcatcagatggagttaggacagaggcatgacactggggaggtacggtataaaatgactgtagcctatgaaaggcaacttttattaaaagttggagagaacctctgaaaatctttacttataagcaatctgaaagctctgcctttcccattgaatacttctgtcatatacgcaccatacaatgcatgcagtgatcaaaaactaaagcgtgtgagctttactcaggaagcatagaaaatgcaatccaacttcttctggctgatgttttattgataaaaatcagaaagtaaaccttccatgaacttgtaattagtttaccatgcaaaatgttgacaaaagctttagttcaacaccctggattttccccatgcttggctgaatgagaacagttcttagcggcaatcatgctgggtcatgaaactaattgtgctttgtgagggtgaaaattctcaatttccgagcaggggacactgccacatgacggatgaatgttagaaatgtggtgtgctgtgctctttcatctctgtcactggatatttattctgactaggcctctaaattattcattttctttaagcaatcaatattaataatctgatttgctccctggcattttttagtcacacttctgtttaactgactgtaaataaaggtcactcagaggcttcctgctgctgttcggaaggtccttgcctaattaattcccaacactttttttccctatgactgtgattagcagttgcaatcaagttcggcaattagctgcctccttgcgctgtgacttgctcagtgcaagcccccaggatgaggctcctttaggtcattcagtcatcattctaaaaagagacctgaggagggaggatttatttttcaattcaaggtttacaaatttgcagataattatagaggagattattaagcccatctgccagttgcttcagtaatctccttgtttagggtcctcaaatcctgagcatctagggaagaagtatagcttgctagtactctgcaatcagaagggttggggtggcaatctagggttcaccatgaataggttctttgacctatggccaattattcactatttcttttaatgaagagtggcactttctcagagtttatagtgaagatttaatgacagtaagttcataaatggattctacagacgtttaagaaatggaaaagttgtaggtataggctgtttgaattaaaacagatcaggtgaagaaagaagagaatctgtaagtaaacc

SEQ ID NO: 48778 - DNA, 1489 bp, Bovine  19866880648263
aggccttcttatagagcagataatatcattcagtctcagccattcacccaaacctgctgtgggagacacagcatgttaaattttaatcaaggggcctgtgaagagcagcagggtttagtccacatctacagcaaggcactgtcatcggttccatgtcctcttctcatcctcccaaagcactcattgagaatgccttccgtcagccctcaacaccattagaagagtaagtgccagatacatgcaggagaaatgttgccttgctggcccttgcttttgtgttgaaaatacagcacagccattgaaatgactaggatatttaatcaaacgtgtaaaacaagaggtgccatgggtgctctatggttttaggttctttagtgaatctaccaagacttcttaaccctagctcagagtctataaagatcagttaccaaacaacctataaatgccacgtggtagaatgataaaaagaatgaagccaaaaaaaaaagcactcacaagcaaggatgaattcacaaggctggcaaagggcacaggtttggcctttgccacagcttccaggcattttctaggactggaggttaggaatctcactggcccttaaaaagaaaagatcccttgggtttagtgcagaaaagacatagagatacccacccatgaggttgttttaacttgaaggatcacattattcatcatgaacagtctctaaactcagtcagcagaagcctttctggcacttttcttgtgtatacttggctccattttatgaagacagaacagactatgtttggcatttttgccttgagttattgacatgttttaaattatgctgttttatgtccattcttaatagaacagaaatctgctacaaacgatctttattaacagaccgcctcaggtgctgagactctcgatttaacaacgtctccaaacagacagacagggagcttgttaataggcttttccaaccctttggcttctgtgagacgtaagtggattatggaggtttgtttgtcaggctatcctttttacatcactgtctgaataattgccacaaaggcctattgctttggcctaattaacaaaatgtacaaaatcccgaacatagaacttttattgactaaccatctccatgggaagcatatgaaccctcatcactcctggccccagacagacgctcttagtgatgttacacactgaactacagcttgttactataccaagaacttgtcttaggatttttgagccactcagaaagtgtcacaaaaaaacacatttattggttttagtttaaaactcagtatccttgggatgagaccaattcttatgcaaatttcaccctatgttcactgtaaaactttatactatcagttctgctttgttttttattcacagaaactgatccttgaggaggtggattcatagtataaaagacttgatggaaaagttagaaatatggagaaaaagtaagggttagtaagcttccttggtg

SEQ ID NO: 48779 - DNA, 854 bp, Bovine  19866880884752
atacagaaaccatgtatttgctaatagttagaatatctttaaaaaatagtcatctttcattggaaaaacatctatgttcacaaaagttatggtacatagaatgctcattttctgctgcagttaacattaataataagagtaattacccaataaatatggataaatatggatcttacccataagatgctggatgaatgttgtaaccttgggctgtgatttgattgagaatagaagacgtagaatgtgaaaggttgtttttcctaaaagatggtgattttgttagaggcaagtagattacacgctgtttaaccatgtaacatgattcttgaaatcgtattcggataatggaggacaaagtgacttttttggcatttaatctaccacttttcagcctcatttggcatattcagattcagtctgtattaataattaaagacttattttttttgaataagttacaacttaggacactaattgttaaacatgtaccgcaatgaaaccatacaacttgcaaaaacaacaatggaagaattttacttcaaatatttagttataattattatgaccatattctgcttccattttcagatttatctgctaatgtttcatgatttcagctagaaatataaatctgaatagcacatttgcctagcactgccaatatttttcttggtaaagagccactaaatgttttctttcattttcattctccatatataaaattagttcttaaacattaaaaacattatcttaaaaaagtttccattataatctaaccctgaaaatgataagaaacaaagacacaccatgctacaaacgggggaaatactataaattccattatataagcatat

SEQ ID NO: 48780 - DNA, 2131 bp, Bovine  19866880887358
acactttggaagatggcaaaaaataatttttgcgtgagcatttaagtgaccactaaacgatagtgatttagattcatttattgcaaattcacgtttaagtgttccatatttacagttttatattaattttttgcactttcaacatgactatattccaaaggactatgtcaattttatttgggtaaataaataaataataattcactatgttttcaaaggaattagtgttacatgaaatgtcctggttaactgaaaacgatcattgactttgcatgcatgcgtactcagtcgcacagtcctgtcctgcaatcctaaggactgtagccccccaggctcttctgttcatgggattctccaggaaagcatattggagttggttgccatttcttcctccagggtatcttccaaacccagggatcaaacccgtgtctcctgcattggcatgaggattctttaccactgaaccacctgggaagcattattgactttaagctaattaaattgtgatatgattatatttcaatgtaaaatcagtcagcttaaaatacacatgaaggaaaaatctcatagatctcttttctttgtatatatcaaaacaccaatgatatttttcaatgttttctgcttattgggtattatacaggcacaggcactcatataatgaaaaaataaagccatttgttattaaatgatgggataaactcaaagggaaatgatgaaaatacattgaaaaacatgctgtaagctatgtttgttttgctgtctttgcagattgacatttcaaattatgactagagaaaatacgaaataattgcattcagtcttttacaactatatgtgctggtgtttcatagggtgacaagttggatgatacattagtatggatccatttgaatggattcttctttccctttttaatggcatcagtcaatggcaattttcagatctactatctatagcccaagcccaggacaagatcttactgtggaacaatgactttttttttatttccttgcattttcattagtcttttaaattggtctaatgcgactagtttatgtcaagctagcattgtcttaaactaacattactttgccagaattttccaagcagtctagcaattttccagtgttgcttttcataaaaattgaaaggttatatgtattattcagctgaaagtttcaggaaaaaaagaaaagtatggaatggaaactgtaagtttctgttagcatagtaattttaaccttgctaacattttcaggatgctgatacagggtgaaataattaaagtaaaactggagagctggaaactagcaatcattttcctttttgaatactttacattttattacttgagattaatctcttttatgtgagaaattaattcctgcacacctgtcattcataaacataatatgcacacaagcatgtgtatgcactcacacgtttgccccaactgaagcttttcttcttttcttgttctctgatgactccaaatgctcatactctcttaagtacagcataagggacaattcagttatcatggtgcttcatggtaattaatagctgtgctgaataatctatttactcaaatagcaactgaccctatattgactagttctgatggagttacacaattatattctaatagaatataaaatggctaagatgatgccccaaattctacaagctcaacttatacagagatagaatgttactatctatagaactatttagatatgtgctttgggaaaagtagcaaaatgtctgttttgaatagacagccattattcaccaatttgaagcttttgtggccaacacatattgtactctcatcactagacagatgctaaatgttcacataaagggagtatctgttctgagaaacagtgtggccaatctgtattcatatatggaaagccaagatggagcacttataaaatactaagaaatcaagttcaaacaggaatctattaaataaactcaaggttcaaaatcttttcaaaggcagagggatagaggttatatagatggagaaagaagaacacatttttatcaaactgtaagtagaatcttgtttcagttcagtcagttcacttcagtcgctcagtcgtgtccaactctttgcgac

SEQ ID NO: 48781 - DNA, 1730 bp, Bovine  19866880896109
tgagtaacttgggtgagcaaaagttttatctgaagtattcaaaaaatgtgggcaaaagcagatgtttggtttaaaattaagtgcctaagaggctcagttccttgtcttgtttttgttgatagggttgggatggtcaactcagaaagaagggaacaagtacatcctatttgagactctttttacaatatttgcagagatttactacgatttccaaaggtcatgtagggagctattagatataggatatataatctctcaaactgtactctaaacttctgtcatttagcgattatcatatttcttatccattctgcaccatgttttttaacccgtttctcatgcattctacagaacacacaggggccaatctaggaatgaatgtgaaatataattattgaacagccttctttactaatgctatcttcttttgctacagaatatgttaattacttcttgtctgcacaaaaaatgctgttttttttttcttttctgttatatagaattgccagttaaaaacaaaagtttgaaaggagtcaaaacactaaagtaaattttaaaaagagccaacaagagacgttgagtaattttgaaagaaaccataaagttgaaatgaaataacaatggaaaatgggacaaataatccatttcttcaccaataaatgtagatgcctttgacatggtcaaaataaatcacatcgatgacagtgatatacataattatctcagcattttgatttttatttcaatgatatttcagtgaatcatactgtcttgggacagctcaatgcctatgacattttcctgaccatataaaactttaagctttacctagcagccagagaacaaagagaaatgcaaaggcacagatttaacactgaaagtaagaactacctctaggaaaatactgggcctttttgaaaggcacactttttgaaaggcacactttttgaaaggcacactctctctaacacacacacaagcgtacatatatatattcacatacacatacatacacacatatgtgtgtgtatatacggtgtgtgttagtcactcagtcatgtccaactctttgcgaccccatggactgtagcctgccagactctctatccatggaattctccaggtaagaatactggagtgggtagtcatctcttctccaggtgatcttcctgacccagggatcaaacccaggtctcctgcattacaggcaaattctttgctatctgagccaccagggaaacccatatatgtatatgtgaagtgaaagtcactcagtcatgtcagactctttgcgacctcatgcactatagagtccatggaattctccagaccagaatactggagtgggtagccttttccttttccaggggatcttcccaacccagggatcgaactcaggtcccctgcattgtaggcagatttttttttaaccagctgagccacaagggaagcccatatatgtgtatatgtctgtataaataaagatgtcatacttttaatttaaaatatataacttaatgactttatgaaagtcagtatcacacactaatctggttttgccacagttttagggaatgataactcttacatatgcataattgatttagaatgtttaatacaatgttatatgagattgaaccagatgggccttttctttataaattaggtccttggaaaatatgaatacttttttggagagactcctgaatattccctccaacacatctgca

SEQ ID NO: 48782 - DNA, 1210 bp, Bovine  19866880934155
cttgtgttattattcacagacttataactctcagtttccattccgaattagatctaggttttatctttatataaacaaaattccattggagggttttttttttttttttcttttctctccagtgtttattttaaaaataagcatcttactaagcagagttcaattttccctcttcagtaattcaaatttagcaattgcagcttcctctctgcctctacctccacagcccctggtgtttcatttatcaggcagggttcaagttcaaggttttggacttctttagctctatatggagaaagcaatggcaccccactccagtactcttgcctggaaaatcccatggactgaggagcctggtgggctgcagtccatgaggtcgttaagagtcggacacgactgagcgacttctctttcacttttcactttcatgcattggagaaggaaatggaaacccactccagtattcttgcctggagaatcccagggatgggggagcctagtgggctgccatctctggggtcgcacagagtcggacacgactgaagtgacttagcagcagcagcagcaggataataatgctatgtcaggattgggttttaaacttatttttaatctgcatatagtctcagttaagaaaagctacttgtaaatttcaaaattttgagaaaattaaatattaaagtgtttcctgattctgttatcacatagtgggttcagattatctgaagtcctaaatcattaaagaaatcctgcaattgctttatatttatttaaataaaagtaaaatattgacctccctacctattctatagaccagtggtaaccttgcctgaaaaaaagtgatgatttttagagttatgattgttaatggcccttgaatgtatcctttaactccccagtgtaagtaaggttcagccctttccagatgggaaaatgataaggacgctaggaagatagcaggtcattcttgggcagctgccagaaacttacagcaaaatgaatcatgtagggctgtgctgctttagccagcatttttccattttaatttatcaagccaaagcttgttgacatgaaagtgaatgaaattgttatacagtgggctctaaaaagccagctcaagggtttagtgcagaagaactctgactataaataacaaagaaaatacagggaaatgttcattcttctagcacctgctctgttatttgagatg

SEQ ID NO: 48783 - DNA, 1083 bp, Bovine  19866880950033
attcttgcctggaaagacggaggagcctggtgggctggagtccatggggtcgctaagagtcagacacaactgagcgatttccctttcacttttcactttcatgcattggagaaggaaatggcaactcactccagtgttcttgcctggagaatcccagggatggtggagtcggacacgactgaagcgacttagcagcagcagcagcagccatgcccttctccagtggatcttcctgacccagggattgaacccacgtctcttacgtcttctgctttggtaggcaggctcttttcaatcatggcaaaaatatttcattttctacagtcttagaacagaatccaagtgtatttttataagtaacagaatgccaaagccagcttaatctcaaagttagatttattggctagatactagggtagctcacagagccgaaagaaacaccagaaacaacaaaggattatgggaagatgacagagcagggaacaccaggaatctgtctccccacctggacaataattttactggtagaatcgatctgatgtaaatatttttggaactctggagtctactgaaggcttgcaactgtcaggggaagtttggatggtaaaattatggtcaatttcagatctcagcacactggcagttccagttccaggcaggcagctgttcatgtgttcttggagctgtttgcacacagctttgggagccaatgtgggcaaaaggaccttgtcctccaaatatcaaggacctgtgctctgattgctgctgctcctccttatcgcagagtggtcagtggccattgttgctgaaccgcttcccattgtttccctctctgccaactgaaggcttctagggaacttaaagggctggtatccttcccccttcattgttctcttttccctctttaggagccagatactaaaagctaggacattcagaagcaactgcttttttgtttttaattttatatttttggttatactctgtggcatgtgggcttccctggtggctcagtggtaaagaatctccctgccaagaaggagcagcaggagacgtgggttctatccagggggcaggaagatt

SEQ ID NO: 48784 - DNA, 947 bp, Bovine  19866880969401
aaatgtgagttaagaaaatgtatacattttatttgtgctctcatgtcccattatgtaccccttcatataatctatccgaattataggcaaaatgctgaaattcatttgcaagtagtaatatcaaagaccaaatagaatagcaaattaatgcatatgtaaaatagtaaaaatgtgaagaagagctatatagtgcttctaaggagaataactagcaggatgtatttgtttgcaaatgatggagtgatttgtaggcagatagtgaagcaactaaaaaagagagaggacgaaattttacatcataaagatatatgtgaaagaataatatttaaggcgatgcaaatgcaactggaagcctgattatgggagtagcatcctattagaggtcactcaggtacaacatgtgaagagactgccggtcaggaaagcttacgggtgctgccctgcagtatatccagcccacgtcagaattgatagaacacacggtgctttatactcttagctaagctacatcacacctcattaatggtatatctattccctttcttccctcagcaaaacattaaaaacttgagatgaaagcatgtcattctaaaacatatttgactcaaagaaaaagatgcttcccagaactacaaaagatatttctgtaatgaaactttaattaaactttgctttaatttggatcacaacgcagaaaataaggggcttttcatcttgccccaagtggaaagtgtcagtgtgtgtcatgaataaaacgctggcatggaaatctcttacaatcttttcgtgttgtgagccttgttgataactaactatgacaacaaaccaattatttgcaatttcatctacaaatagatatatctttaggatgaataaactaccagaaatatatttttgcctgccctctaacatgctaataagaacaatggtaattagaaggaacaaag

SEQ ID NO: 48785 - DNA, 1098 bp, Bovine  19866881008221
cttgagatctgttctcaaatttaacctgctgtaaatccgacatgtgttagagaaactcacagagtatgataagaggcaaacagtgaagggagaattttagaaatatcgtctatgggctggcctgaatttctagtcacaaatataagtgcaaaattgcaccttttgaaatgtctctaatttagtttagctctgaggtcatttcagctaattgtcagagtaagcttaaactcattcgagctcagttaagcccacatttaaatgttgttaattcagaattttaaaaagcttttcagggcttacattcagcaacatcgtcattcttcccccctgccttccttctgtctgtgatcatcactaagttcataggggagagtagacagtgctcatgcgtatcactgcttccaagtgagggtctgctccaggtcactctctgaagccctggacattattgagatgtaattctacttttttggtcctcattttcatgctataattcccacttctcaagtcgcaggtccacacattctgcatttttcttataaatatctcaaaataatatcctattaaaaaggaatataaacataaattaacttgccattgtgagaaccctttgttttagggttctctcactcctttatgagctctaggcatcttgagaggcatcacccacaaggcgtgagacgttcattcctgactacacctctgatgcttcaatgccctctctttgccatacccagaagctatatgtatgtaggccaggaatctactgctcctacctttaagattgtgaaagagtagaaagcattctaagtgaagaccgtggttagggtattctggaaacacaggctggagtataaagaacagctcctgaattctaagtgaaagcactctaaccttgcctgactttgtgctcttatattagaaagttctttttctccattgatgctcaacacattacttagtgcataggagaatactaactgtggctaccattagagttaatagaatatgtggaaaatgaatagcgtggtgacagtatagtgattttttgctaatctcgtgacaagttataattatttattcagcatatatatgtaa

SEQ ID NO: 48786 - DNA, 1131 bp, Bovine  19866881014767
atagtgaatgaaaagcctcccccaccccacaaaagccaacaaccaatcttggctaaaaaacaaacaacaaacctattagctattaggggatttctagaactaagaatgttttcatttctctttggtttctagctttaacaaatcagtatcaattagtggagtatatacctgaagtaaaaaagtcaaagaatatgcttgtattatgtacagaaaaagagatattcggctgttttagcttagtaaagttcacaattcagacatgcatgataagagactaaatcacttccatgctaatgctgatacttcagcactattttgtgacatcttcatggatttaatcgtatgaaacagcaagtcagctaagacttcgagaaaaatcacctatagatttttaggtactttttctcaacactgactcatccccattttttcaatgatacattatgaaaaatttcacattagcagctaaggtaaaagaatattacattgaacatctgtaaactcattacctggattctaccattaacatttcactatactggtgaagagttgactcgttggaaaagactctgatgctgggagggattgggggcaagaggagaaggggacgacagaggatgagatggctggatggcatcactgactcgatggacatgagtctcagtgaactctgggagttggtgatggacagggaggcctggcgtgctgcgattcatggggttgcaaagagtcggacatgactgagcgactgatctgatctgatctgatccttgctttaccttctacccatccctctagacaatcaacccatcttagtttttgatgcatctgcaaatcagcatgatggattacattaacaatctgaagaataaaagtaacataatcatttcaatagatgcagaataacttttcacaaaattcaacatccacttatgattctattaactaatagagtctttgcacatgtaatcagttaaggactaagatgagaccattctggattggggctggtcctaaatcccatgactagtatattaataagaagagaacaggacacacagagatattaagaaaggccaggttttggtggaggcagactgcagcaatcaggagatgctgtgaagagaaaag

SEQ ID NO: 48787 - DNA, 1045 bp, Bovine  19866881076251
ttgttaaaataatattttctttattaggaattcacgtgtaataaagaaaagcatattcactcctaaactttgtgtggtactatatttgttgtatctttgtggtgtatctacagataggcttaacttccatatgagcgtccatttatataagtgtgttaaactatctcataaaatgtcatgttgtgtgtattaccttctatgcaatgaagatgaaatatatgaaaatcatgtgtcaaaggtcacttagtgggtagcaatataatcaatgtgaataaaatttagtaaagaactgtttatttgttactagactaacatagcctgtgggatgagcagaatgtcaaaaaagaaatatggggatatgaaatttttgtgcttgtcttcaagacagccatatgtttataatggcatgcaagcaaaactcagttcacaatatatattcaaattgtaatatctaaagaatatttcaaatcactagtaaacaaacataagactgatgccccccttttatgtaatagaatacttatatataaaagcattttaaatgtcaatttattttgtgaaatatatactggaatagagatgaggcagaacaggctataaatcattttgaaacatggcaaagtcaggttcctttctttactaagatcctctagcagatgcctctgttgctccatatcacatcataacccctcttgaacctctgattttaggcagatctctgctgaattcgtcagagctctgacagagtcccaccaagtatttatcctctgttctctgatttctgactatgagcttcaatgtagttgtccaagtgtaccagcatagccctgaggtgcagggagttagttcctccctgacagccctctaccaagggaaaggtcagctgaagacaaagcctcaagtccctacactttggactgacagttctgaaaagtatgtggtttactttcggaagagctgctagaactgagccttcattgcccacacggttaatctcggtggtgcgtgctaatggtaacttctcttttctctaccctccccccat

SEQ ID NO: 48788 - DNA, 3535 bp, Bovine  19866881082533
tctattggagtttctagtttaactgaaactttatgcattttatctgttctgagataagatttatacatattcactataagaagaggcatagtcttgagaatataaatacagcagatagcagtacagttcgtaataaaattgttatcctaatgatgcttacttccattcctcttgtgttataaagctataagcagagtttctcagaggcatttgaagttcccttcataggccatgagaattggggatgcatatgagaagcaaaaattggtgagtggaggggtagaaccaaagagccttgtagaagctctatctcagacattagtattgggagaggatagaaaaacaaggcgcaacagtaattaatttgtagaggttaagttccaagtacatcgcttacagttatgacacactggtctggaatgtgcacagaacacattgcacactctaaccaggttctctggagtgaaatgtaggaggaaaaaaatttttttaatgctcagctgatctaaagtgagtgcagctaagatacactattccagggtcttctgagatacagcagggaacaagcaagaggactataaattaaaaacacacagagacatttgaacatacagttatatttgaggaatgcattcatatagccagatgcacaattgcattagcttattctttggtcataatgcaccagaagtcctcaagatttctgaaagagttgattctatgtccctcaacatacccttgtaagtaaatgggagacaagtaggacaacttgtactaaacacttttaaacacgcatggttagtgtatgtttccaaattaacatccaaccatgtagatacataaatccaacatgtctctctaagcaatagggaaacctccttgctttgaggcttctgtcctcccctttgctatggctcctggaattcttggactcagctacacagctgatagggggataggaaagggaggttgaggtttggattccactgtgtagtaacagaagaaagaataatcaccctgtggtttagcctcaatgctgtgtgatttcaggacaataagaacctcagatcttaaaaaaagatttattccctttagcctctctatgtgtcctgggttctatctgtgccagatctgaagagtcaaagagtgtgaagtcttaaagtagtcactccccttagatgtgtaatagtgcattcagattctgcccttttcactagtttgtgagctcatgaaaggaaagactattatttgttttaccactggacccttaggttgtgaaaaacattggcagatactagatcctcaacaaataattgctgaatgaatagatgaagaaatgataccaaatggttgggtttcatttaaagacgcacatattagaaagtaccagcaaaccacatgataattcaaaccaaatatatgctgtttggtctgtacattgacacaaaagctgcactttcaacttttttaacctatactatcaatttgatgatcttttaatacaaatccaatttttctatattttcagcacacatttaaaatatttggttaatttttgcttctggtacatcagagtatgacacttttaaataaatatgtgttatagcaaaataaacaacaatagaatatacatcaaaattctaaaaataagataattttaaaattttcatatttaaatcactcctcccaaaaaggagttcttaataacaaggggaaaaataaactattattttaaaaggtgttgttggtactatagctaataagctaatatagctaataagctaccatgttataagaaataggatgccaaaatcagtcattttaaataagctaataacatatctaaatgacatcaggcagttaaaatatcagataaaaggatattctgaaaataactatgttgaaaatgaagtctgctctgcaaaccatttgacaataatggattgtgtgcctgatgaaaatgcagttaaaaataacaaaaggaaaaggaaaaataattcatttgctaagatataagcagattttttccctatagacattcctggatgcaaataattatgtgacttctctcatattaagtagactaaagaccattggcttctaagaagacatgaaaataaagggttagaaaattataaaatctctactgctggaaacattttcacaagttaaaaatttttatttaaaaacccacatattcttaggaaaggtaggtagaatgaccaaaaaggaaacaaacaaacagactttctctcagtatttcctagataggaaaaatacctcttgaaatattcatgaaatacattttaccccatcaaccatcaactggaagaaattataatagaagttttagcgcaggaattctttcagaaccaatctgtacagaatgaggattggcaacttgcaacataatattgcaaagttaatacccactgattttcttggtctggctacagtccccatgttcctcacttaaacagaccacaaattacctaaaatgttgtcaactggtacactcactgagttggagtaattccttatatccaaactcctgggaatcatggatcattattttcttaacatccctgtgcctgatccacaaagaaaaacaaagcccttgatacacctccctggaaaaatgaccatcccttgacaatgatacttttcttttacagacccagccaaaattactttacatgaatgaatataataattgatgctatgtctgtctctccctctagactgtaaactgcatgaaggtaggtgttgtgttcaatattgcatactactacatacaagtgtcttgtgcagtgcttaacttaaagtagtcactctattagtgattgttgaataagcaaaagaatgaaaaaggggaacactgtggtcccacaaggaatggtgccaaggtacattacacgtaggatatttgtaactgccatgaaagaagggatgtccagagaaactcacatttttgacggaaccatctgggtagtgagttgttttatcatacaaaacaaattatgagaaaatagtgtaactttatgagaggggtctaaataaatggcattatggctttgaagtgggtaagaaagaggaaaggcatctatagggaaacaataataggctgctgctgctgctgctgctaagtcacttcagtcgtgtccaactctgtgcgaccccagagacggcagcccaccaggttcccccatccctgggattctccaggcaagaacactggagtgagtgggttgctatttccttctccaatgcatgaaagtgaaaagtgaaagtgaagttgctcagttgtgtctaactcctcgcgaccccatggactgcggcctaccaggctcctccatccatgggattttccaggcaagagtactggagtggggtgccattgtacacattctcaattaaatcagcaaatgaactatttattaaggactgttgcataaagacatcagagcaataggacatgggcagtaatcatgtcaaaggatgttgggctaattcataaattttacttcattaagag

SEQ ID NO: 48789 - DNA, 1053 bp, Bovine  19866881143774
actgtaagttgttttgatgacagatgcttcaagtatggtctttgggtttttttcaacatgcaatacttttttcaaaaacaaaatttatttcatgggaattacacaggcagtgtttttctcagaacatttttattaataattttcaattttctaaatgctattccattgttctgtagatcagcaagactcacttcaaaaaagcaattctagaggaaatcagatacagttttgcttcttgagactggcctagtgttattccaatattttttatgtataacacacctggcacttctcatcataccaatctttctgagaaaataagttcaccacttcagtctaggctttttttctgttgtcttcccataagatgctttttcttccccaactgtgatggtgcctctcagagactcaaagggcagcaattgtattttaaaattattccaaatacctttacccaccacagacactgtatccaaagaaataaaatgtgcttggaaaaaaaaaaaaagtttaaaatcgtctcctgaagttgtggcacttcagtttaaacaggattttttttttcccctttcttaatctccctttaaactgttatccttttcaaatttgattcatgtagctgctggataaagaagttcttttaaataattgccaggagaacaaaataggaatcaaagtgtcaaattccctaacattattttgtaggtagccttaaatacttctttaatgcctacgagaaatcaaatattggtaatctgtcgctgtccatttctctcttcccagatagctaatgacatgcattatacttccctgactatgtgtacctttcatttcgtgcaaagcctttaatccttctctttttagataaaatgccataactatagtgtagtaggttaagattgattgacaagtgcatataattatggcttcagtcgtggagtgtgttttacagttgaaaaaaaatgcacaaccttgaaaataaagaagtgccctttctctgggataaaaggatcatatcaaatggttcatttcttgctagaataaataaaagat

SEQ ID NO: 48790 - DNA, 705 bp, Bovine  19866881265112
acattcatgtacacatgacatcacattgaaaaagcattttttgcaaatttgaacaaaagttttaaaagtgttcctaaaaggaatttgtttttgtcctagtttttagtttgcagctctaagtgccaaggtgaaatactctgagtttccatttatctgaaccactattattcaggtttctttttactttttctcacaggacactacttagaattcttcaatcatttcagtgtctcagacttcatctttcccaatttttaagcattttacttagaacaatggtgggaaataaaaatgaaagaaaaacagttcagtcctaggctcctaaaagttattgagctaccagtgtccctcatctgctttagttgtgcttgctaccattgttatgactgccctgtcttgtgtaccttgaatggttcttgcttttaaaatgtttatccagtgtttcacatacttcccttgacttcccgctgataaaacttcagtgtaattaaagtatttatatgaacactgctgaattcaacttgcattatttagacacacaaaggaaaattcctggcatttccaagtcacagttgtataatcagatgacatagtgtcagttggtttaaggatacctttatgcccagttttgggtttttttttttaaatgtgaagttgctattccctttctattctatgcatttttcagtaaattaattttaccag

SEQ ID NO: 48791 - DNA, 2180 bp, Bovine  19866881276311
attgatggagtgattctgtgttttatcaaatcacttaaatcaaaatggagtgtaagttaattggctatttcaaagcactgtaaagacagtttcatggtttaaaaagcatccgtttccattaccatcaatgcaataagtgtaaaaccattttatgctatttctacatgcttttattgtatagaaaggaaaatgcattatattatgttaaggtacatggatttttttcaacatttcttctttgtgaaaacttataacttatggtaaatatcctcccccccaaatagctctaatgaatcagataaaatgctgctgctctactttaataatagggaaaatttatatgaaaaatacaaaatgtcaaaattgcgcttgtgcatatacaacaaaaacataaagaaaaatcatttaacgtatgtaagagagaaggcaaagtgatttcttttattatcattatttttagaattcatcaaataagtaatatcaataagaaaaaaaaaaggtatagcacaaaagggcttacggtgagagttaattctctttcccacactttcccaggtactcggcctttctcactacagtcaactatctcatgagctgttttatgtttataaatatatatatgtacatacataaacatgggcatgtgtatttttccaagttaaaaaataataagcagctttttatatttttatctttttactaaaaaatatatctaggggattatgcttctagcatgaacatatatgcacacagacacacatagacacacatcatttttaatattaatatctgcataatatcccctctgggagtgcaccactatttagccgtcttttgctgacaggcatttaaattgttttcagtgtgttcttcttataaacagttactgcaataagtccaagtaactatgtcaaatccacatgtagaaataagttcagtcctagatgtagaattgcagaatcaaaagtttatgggcattagttatttttacaaaaattaaaaatttccacactgctgagggaatttcggggcacatatgaaccatttactacctagttaggttgcaccagtttatactccttccaacagtgaacgagaagaccagtctgtactctgttctccaaagctgtgcagctactgtgcattcatttattcagggatacagagcacctgctctgccagggtgctggagctatttaaaaaatatgatagggataacgtccctgatactctggagtttatgcgttcctcatattatgtgaaaaaagctaacaatttcattgataaaatattttaggtagtaaaaagtaaaacaaaattaaagtagacaagaggacagagtgtgggttgggagaacttagtttctcctctctcttagcagggtggctaaggaagatatttggagaaggtgacaatggagtaaagtctaaatgagacgaggagacagaaagattcagaaagggccagctgaaagagggaaaacaagtagaaaggtctggaagctccttactggatgtgttcaatggggagcaggaaaactagccagtctacagtagaggaggggagcagagggcggagatttcacagctacttaggacttcaaataaattcagttaaaaagcagctgtcttaaactatattttcattccatttatataaatctaattctttagacaagcatcccgattttgtttttactgtgatatcattgttatcatttttgatagatggtcttgccaggggtgagaaggaatacataatcgtttttatctgagcatagagagacaatttaaaagtgttgctcctattataattaatgagaattaaagatctaaacagccctgactaaagtacagacagtatccctgtatttctgaactcaatatgacatatatatatacatatatatacatgtactgacaccatataattatgataaacaacgtcattataatacaagggaaactaactgggatgctgcctttattttttagcaactctctctccaatttcaagtgaaaaaaaggtcttgcttcaactaaattattaatgttgtaataatctgtcattagaatcaatacctgctttattattcatagtgcatagagagctaaaatggacctttcctgaaataaatttagtgccttgtcacaatacaatatgattttacaatactgcta

SEQ ID NO: 48792 - DNA, 809 bp, Bovine  19866881323457
tttctaaaaacatgtatatagtagccaaagccctttctttactgttctgtttgtacttatgtagcaagtttaaacatatataatacattcccaacagggaagctaaatggtcctgctgatttctcacccctcatatggcaaattaatttgaaaattctaactgggaagaaagtatttcatacaggagaagaatggagagtataaattcattggaaaataaggcttaaaaataaaattccaaattaaatacccattttataatgacaccaggtaactctggggcatgctttactgggttattaatacatgtctccagcagctgaaggcacccaaggcacgcattcatagacactaaaacacaccctgtcatgctttaatactaaattaattaagcagtagcatgacctgtgtgaaggtctttcctggtccagtaattactgaatggaagacataaaggcattttcagacatttcttgaccaaacaatcattagtttatataaacaaacaaaaaatttgtataaactacagtttgattttcctttgtcccaaagttaatttcaaagttaagtttaggacaaagaaaactaattgtttttagcacttttaggccaaagctctatcattgtttaaaatatatcccatatatccccttttgagcttacaaatataaacacaaatctgaggactttgatttcacacatttttcatttgaatataattaggctgatcagtgggccataaaagttgacacttgctataggaagcaagtttgcactcaactgagtttctcaatatccttacaatttct

SEQ ID NO: 48793 - DNA, 987 bp, Bovine  19866881368076
cacctttggcattttaaaatatgcttttaaggaaatcaacatgattaacatggtggtatgttcggggaggggaagtgttgtagcattattatcccagttcattttttaaaccattgagctacctttcatatagttttgtttctgtaggtgacgattaaacaaatttagttctcccatattgttcttggttctgatgctggtttcaactgttgtgaaattagtgttgattgtgaataagttattcataatacagcttctcatgaagtgtggacgtgacatgaataacaaatatcctagctctttaataaggttatctcagactcatcataaaaccctacattgtctctataatcctgcagaggtttactgaagtcaaattaagacacataaaaacacattcttcaagtgtgattcacaatccttaggaaacgactataattgatttacaacaaaccagctgtactgagaactcagcagccccaggtgattctgacagttgtgcttgagtaaatctgtgtgcaaaacacactattctggaattgtttactgccagattgttaaatccaaagatgaaacacgtggttaatggggaacgtttagcaaaaaggactggagaatgatgttgcttaggtaaacattcatttaaacacattagtaaaaatgtcaggtgcattaaaaacttatataaagaatttataaagctactgtgtgtttctaaaatgaatcttttccctctcctttggtaggtcctgctttgtttaagctttcttgtttttataaaatcctggcatacacagtgtactgtatctgaaaatgataaagtgtgcctctttggtacgcccttgtcaattacatgtgccttgtttcattagctacagctaattattagccctagtgttcgaggctatgaatttaaattgaggaaaatgagtggtcattttttatgatttccttctagtcatttcagattcatcagactatttttat

SEQ ID NO: 48794 - DNA, 1187 bp, Bovine  19866881414440
tgttcagggcacaccaaggaagccagtgtatcttcagtgctgtgagcaagtggttagtggtcttggaaggaatcgccaggtcaaatcataaggagctgtggtaatgactttgggttttattctaagtgtgataaaagccaatggagaggtgaaaacagaggagtgacacgatttgatttcaatttcaagttgtcactttggctggcactggagaacagaggtcaagagtgaaagccgtaaaagttgttgtatagcaaatataagctcaggcaaagataagctcggatgatagtagttaaaaacagtgatcaggtttaagatgtattttgaagattttgctgaactgtcctgctaatggaatggatgtggaaaatgaggaaaagagagaagggtgagagcccatcgttggccagtataaggtaactgtcagttacatcctcaagcataaactaaaccttctctttagggagaaggcattgctagttttcttcattgtctgttcccttgggaggacttactaatgtctatatgtgaggacataataatgggtaactggagaaacagttaactactcctgtgctgtgcaagcccaaggcataccagcaacatggagaagaaaagatcatgacccagtatatgcccatgggggctacactggaggaaagaggccaacattaaagcatacattctgaccttctcatggcagtacagcaaggcaaacgtagtcagcaaggacagataatcctctttaaactgtaagagacaacagtgtcagtttctaaccaaaatggtatttggaaaaggagaatggaataacttttaataaagttttcaggtgtattaagaacacacctttattaaaaggtaaaacattttccccaaagactccttttagatcaagagttgaagatttttctctctccttaatcttcacacctgctcaaactttagtaccaaatatatattacataagcccagtgaatatgttgtatactttgtaacccaggaataatcagctatgtaaagtcccttgatttttttttcagatttatactaaaacccagtatcaagtattttatttagatacaattaatttaaaacatcagtatttagttactgagatctcactatagattctgagaatgtaaatgtgaccactacatggtctcatcctagtaaaaaagaga

SEQ ID NO: 48795 - DNA, 651 bp, Bovine  19866881773699
atgagaagcttggacacccaagtgatgtattatatagcccattatttgcttctgggtttcctttttcatctgaccaaggaaatggagggatcaaaaaatcctcccctcaatccaaattcattttggaatccatattggaatacttaagaagagatgaaaaatcactgagtgatatttgcctgtttaaggtttaaacacggagaaggcaatggcaacccactccagtactcttggctgcggtccatggggtcgctgagagttggacacgactgagcgacttcactttcacttttcactttcatgcattggagaaggcagtggcaacccactccagtgttctggcctggagaatcccagggacggtggagcctggtgggctaccatctatggggtcgcacagagtcggacatgactgacacaacttagcagcagcagcagcaagatttaaacaaatcctagtacaaaaattttttttaattcagatttttacatttatcttgacgctcactttgtcatatgatgcctaaactctaaaggcacgtttccatcgaagatcatgattttgtcattaaaacaaaggcaccaaagctagtctgcatttcccattcattgaaagagggaaatctgcatgcttctcactgttggaacaac

SEQ ID NO: 48796 - DNA, 1493 bp, Bovine  19866882034783
tattactctcatctatcttcttaacaagaaaaaaatatatgtccaaatacatatatatacatatatgcacatatatatatatatatgtcctagaaaacctctgaagatacaaagttttccccttaattgttcttttatattgtttacctaaatatggctgactaagttgcataatactctcagagatacaaagacatgaagagggaacaaatattccatcctggttaagaagaaaactatactccttaatcaccagttatccaggcaagaaacaaacaaacatccacataggcataagaaaggattctcactcttgtgacaaaacagaacaaacaaaactgaaaaaactgtacacaaaatttggttcaagttttggttcaagttttctaaactctactcatacttagagtgaacacgtagcgtctcaacatagttattagcaacattaccttccaccttcaaaatttccctggtttggttgataaattcatggtatccatgtatcaaccttaatgcgatttattacagtatgtataataaatggaaatagaactacagatattgcagttagggagttttactcttcttcataatagtgtgctacagaatcctgggggattcagagaggaaaatggtaggtacacaaaatgagtcattaattgccctgtaatctagatccattatagtcattaactttctgttttagtttagtcatctgtaaactagagataacatataattttagtaacttcataaccattcctctaagacttggataatatgacatgggaccattttgcatatcataatgctttaagcatttaaaatatatttttattgataatctaaactatttatttagagtacttagcactgtctctttttctctttggcagctgtgtgtgtagatttaagatcataaagtcttgaaataatgacataataaactttttgagtatatattatctttaaatctaagttttgagtttaattaattttaacagtaggaaaactcatatggcattacttcattcctattactttcatagatttccttcttaaggtacaacctggagaaaagtaaaaaagaccactttactctcttgaagttaatttctcctaacatggaaataggcccaaatttctcaaagtttagctgcaagcagaagacattcacagtagtttctctaattttcctggaaatgaatggtgtgtgttacttggtgtgttcttattatgatgaaagaaaccttcttcattagtgacttttaaattaatgacttaaagaaagatgtaataagtagcaatgagaatcaggttttagtttttatctcccttctatgactaatctcaaaagtcctaaattaattgtcaaaattcttacagcctagctttccacctaccaaaatagtatgagtctctatatttaatggatagcttgtttcaacaaaacttttaaattatttcttaaactcagaacactcacatttgag

SEQ ID NO: 48797 - DNA, 984 bp, Bovine  19866882127905
tggaagaatgagaagtattaactatatgtataacatagccttaaggatgtattgtataacatgagacatgcagccaatattttgtaataactgtaagtggaaagtaacctttaaaaattataaaataaaatgaattgccctctttttctcctatgccttatcagtttctatggggtctacatatatttctaattcttggatcctttatattcttctgctctataaactgaattttaatttgagccagtgtacctaggctctgttccttaaaaaccaatgacactgtgtccatgaatggggagatggagtgtagtctgtcctcattttactggtaacagagcaaactctatgcacaaccaacatgaggaagaaacaggtaatactcctttgccaggtaccagagactttctggactcttgatggctatgttctctccaaattaacccctacttgacagccataaataacagttgtacagcttccacctccaagttcttcttttatgtggagctaggtcagaagttttatgtggtctacctggaagtattataccatctgtactttatccaagaagatcaaatctgtggattgtccccaaaaattctgcagtaagttgtggcacgtataccagaagtttcagaagtgaccataaagtattttcaaatgaaaagacctaccataaatgagacagtaataatcaccagtttgaatttgggtcacttgatctatggctaaaagattttatatatactccagctttggaggaatgacaaaagccaaatttatcttttcatataaataactaaaataacagaccaaatatacaaactagtaaattttgtataatgaatcctaggacacacaaattagagatctttgagaaaaagaagacaaaaggtgatccctgcaattgcttcagcttaaagtgcctcaagtgactaaaaaagtatctcagtcctggtgaaggaagctataatccaaaca

SEQ ID NO: 48798 - DNA, 2571 bp, Bovine  19866880271135
caacaggcttttgagttcctcttcactttctgccataagggtggtgtcatctgcatatctgaggtcattgatatttctcccggcaatcttgattccagcttgtgcttcttccaacccagcgtttctcatgatgtactctgcatagaagttaaataagcagggtgacaatatacagccttgacgtcctccttttcctatttggaaccagtctgttgttccatgtccagttctaactgttgcttcctgacctccatatagatttctcaagaggcaggtcaggtggtctggtattcctatctctttcagaattttccacagtttattgtgatccacacagtcaaaagctttggcatagtcaataaagcagaaatagatgtttttctggaactctcttgctttttcaatgatccagaggtacatctgcccacctctaatacagcacctcaatgacaccatcaaaacgaaatcacctctgcttttcccccagaagtaaaagaggaataaaaggttagttgaacagagacttgaagtaaatctatcctttcaaaagataaatgtctcccttcctccttacccgggtgcatttaaattctcctatacctttgatcaaatcaatattctgtttaagaacctgaatgactctctaatgtcatccaaataaatgtccaagcatctttagctgacacttaagtaaccttggtaaaaatgcttcaaatctaccctggaggtacttctcatgttacctctactcacaacgtagggacgtgaatctggagccccaacacatgctgactcttctcagaacacacacgacacttctgagcctcttgctttcactcttgccctcctctccagtcatcagtcttattcgattacagtcaccagccttccacacatccttggagtccagcagttgcacacactggaggcccgcctcccacgacaaagccagtaaccgcaggcacctccagatttttatgccactcactctcaagagattggcttctcactcaatagtgcagcagctgcccaggttctgttcatattttatctcccctccaaactggtaagtgcccagagggtgggaatcaggtttcactgttgtttcccacacagcagctagcagtgtccttggcatttccaaggaacttaatatatatttgatgagtaaatgaattactgtgttccaactacaactctacgtttttgcttttctaaaactcagtctattgcctgccccatgaatacatttatttcaaagggagaattgcaaaaagacaagaacagagatatgacatgggatgggtagtgccatttccctgcatagtttcatcgcaaatctgcccacctagctaattttcatctccaaacccaatcattaacttcatttgattggactgcctgcaggtctttcttataaaagggagtcttagatgatgaagtctgtggctatctggaaggtatactgtgataagaactttttaaatgtccttccttctctaatccattcttcaaaaagccatacttcattgatttcttaaatttttcctgttgagagcctatatttagttttctaggtaactatctttaggagtgcttagctgctcagttgtgtccaattctttgtgaccccctggactgcagtccgtcaggcttttctgtccatggggactctccaggcaaaatactggagtgggttgccatgccctcctccaggggatcttcccaacccagggattgaacccaggtctcccacattgcaggcggattttttaccgacttagccaccctggtggctttagggagaggcttcacctatgatgtgattgttattaactacagtaagaagactctgggactagggaagtgcaaaagaaggggtaagagagaggtcagtaaaaatggggagtgttaaaaagactctgcaaaccacagtttggagaatttgctgaagtttggtcctatccctagtagaattttacatggcaactcttcatggatcagaaaatctctctgctgatgaataaccacaatcctggcatttttttaagcccacccaccctcagctctaatataattgcctatgacagacagccagctctatccctgtgatgtaattattttctctctgggtccttcttatgggttcgtgcacacgagagcctgtgcatacatgcacacgcgtgctgtgtaggcacggagacagctcactgatcctttccaccccattcatttccctactaatacgatacatctgaagcacacgtggaatttccgagtgtgtagtaaaacatgaatctgtggaaaataaattaacctagtaaaatccattcaaatgatcaaatgtcttgtaatttgagaggaaaaaataactactggttttgatggcagcttaaaatatcttgtatttctcataacaggctagttaaaatgcctattttacttaaagcatggtaacaaattctacatgacattcctaagttctcatccttctcttgttaagccctcccaatagtaataatgataataacaataacaacaatggtcatatacaacaaagagcaaagatca

SEQ ID NO: 48799 - DNA, 1769 bp, Bovine  19866880390040
ttttaaatttttaacagtttatgtgagtagaaattgattcaaatcaagcagtgtcaaaccaaaagtgattcagagcactgcaccaacaggatctcaaagagagacttttatagggaagaaacggaaacaaagcaaggccatgatttgattggctatagctggagcacttgccttatctgggaaagcctagttgactgctatggttggtggtccttacatcatgacttcttaactttgaagcatttcaggcttaggatttggtttgcttattatgtaggcaactaaggtattaaagccacctcagtttattggcctctttatctaattattttaacaattatatgggtataaagtctcagtgagaattcacagacctccaaaaacctggtcctgaaatgttgtgtggccttcgtcagggaccatgtacgttcatcaggggtctaatggaaattttgccctatgcatttgcctctctcctgcatttttgcctatcaggattaaatccaggtatacttccaggaaagtcatgcaggatactgctttcagggaaatgatgatgctaaagatcacatgctcttcccctaaaagagcagcttgagaaggtccaaagagtattaactttggagttcagtagaccaggctcctgtgtctggatccagttgctctctgcttcaacttcaggcaaaatgtttgagatgtcagagaaatgggggtaataatgcacacctcaagatatgaaaaagaaagcaaaaataaatccccaaaccccttagttgtcttttcttccagccaaaggctaggttctgactgcactataagccagaaatagcagaccccaaatcctggcagggtttgatggctagcattgcggcagccaggtgggaggaggaagccaggcctacctcccctccttggattgggtttgcaacttaggtagctttacagcagctctgacagcagagctataaagagaggctgcagaacagctagtgtctccttgtctatggggtaggatgtggggcctcactcgagagcccatttctgtaaatgagaaaacagaggaggctgggaggtgatgtccaccttgcgctttggggtaacactccttttaatgaagactccttagaagtcatgttctcataaaggaggatgcaggaagagctgtttcctcccggttgccaactgtacctactgggcaccagaaggggtttcactttcagcactgggccctgcagccaacctcacaaaatgctttcttgcatttgccaacaaggaaactcagtctgcagctgcagcagcaggtgctggctgccaggttcccccggcaacccaggtgtactccaggttagcagctctgccttggagcagtggccttcgtctctgatgcatgtggctcgaagcacagagtggagctgtgtccccccacggtgggaagataatgattttgctgggttttatggggcataatataacctcagtgggtggttcagtagtagtggtggtttttagaggatatgagagattgtaacatgcttgtcgatgtttcttgtttgaaggatttggggacggggggaatggggattgttgccatcattcaatccaattcattatcattcatgcgtttgctcaggcccttggctgatatgtttatgactcaagagggcactgcttccagccacatgataattcaagtttgcatttgtgtgttttgcacagatgtttacatctaggatcttacttggggctccctgtgaaaatcgtgagtgagg

SEQ ID NO: 48800 - DNA, 4154 bp, Bovine  19866880390049
atgttaaattataccacaaaggtataatcagcaaaatctagactctggggaaactccatggacggtagcacgccatgtgtctcagtttgggccaatgagatgtaactggaaagtgtatggggagcttcttgaaagagtccttaaaagagggagacttccctgcccgctgaatggaacgcaaaatgacagcctaagcagccgtcttgaaccacatgcgatgtctgacgttagaacactgagacagaaagacagagggagcaggggtccctgaaggctttcaggtcataaagctactgctctgaactgcttgcctccagacttctttgacataaacaaaacaagcccctatcttatttgcgccctcactgtttttggagtttctctcattcatagcgtaacctaaccctaagtagtagacaagttaacaatgaattcctaaaaaataaatagcagttctcactgagggatacactatatgaatgttaacacttaatggctctgattcacactcactcattcattcacccattgcttcactcattcaaacggtctgcactcactcatacaactcacccaacaaaggatcagtgaagtccagctgaactgatgaactgcagggtgcagaatgggactcaagcttggcctgtgtccacagaccaacggtttcctgaaactcgtaatggacgcgctccatgttcaaatactccatccacaggtcctaaaacggaaccataagactttaactttcagggatgaatcatatattcacatataaaactatatatttaactctaaagtgaatccataagtttcaacatgaggtggtccattccaggttctccaagcattaggatgaatcacatttaaaatgggcattctggagaattccctggcatggcagtccagtggtgaggacttatgctttcactgccaagggcctgggttcactccccggtcgaggaactaagatgccagaagccaagtaatgcagtcaaataaataaataaaatggacactctaacagtctaaggaatctcaaaactttttgattatataccacacttagaaaaagtaatttcaacagccccgctaaacatttactgttgatagaggctgacaattagagaagaatactgagaattaacaatgggttaattctgcactcaaaagatttcaggacaccatgatcacttacgtatttttcctatttctctggccctacaatctcagccttgtttctccatgtcttaaatgttccttttcagaattccatgctgagttctcttcttaatccaaatactctattaccattacacccacgtctcctactgccccactcctgaactacagacaactttatatcccgtccccaccaattcctgaatatgagttctccttgaagcccctcaggcactttctcttccagttttgtaaagagcatctttagctgcccaagctacatatttggaagtccgtgtataccttatctaccctacaagtatatcaatcctaaccagagaatcctattgattctactaatgaattgttctatatatttttaattcatccacttatttaaccactccagctatttcaacatctctccaaacaaagacttcctgctgaaaactttctgccactccacatcaccatgctatcctttcaacttgacaaactcccatttgtcctttagggctcagttcaaggtcacactccagtctcagtctgaatcaggtaccattcctccacctttgcatatgaaacagcaccctgcacatttcactcccacagtctttatcaccagatgtaataattatttagtcccccatttgacagtaagaatcttgaaggcagagactgcatcacttttctttttatatttttggtataggtgactgacgcctcaaaggtatccaatagatactcatggaagtaagagaaggaaagaagaaagaagagagaggaaggaaagaaagaaaacagaagaaagccagacacctagtggagatgaaatagtacatacaatgtggaaacagctaggtttaaagacacagtctatcaagtctctcaagtcttaggggatcctaaatcctatccaaggttggggatcaagggccagtagagttcagtccctagaaaaaataaactggaacaggagagatacatctctacacacacacacacacaaacatatacacgtagagctacagaagctcagaaaaaaatcagaagttttgacctaggaaagacaacagacctctttgtttgagaaaagattagaacatgtggagacgagaattgaccacatccaaaagggcagccaaaactgacagctacaagtcagcctcttcaagggtgagcgcctcgctttctccatgctattaactttctatatgcatgagtcttaacaaatccttacactgaactttttatgggagtagagatgactgcttaaaagtgttcagatgctgacaatttaaaacaaggaagaatatagtcagaaaaaggctgtgtttatgaggctgcagacggtccaagaatgagcttcagtccttcacatgatgccagagcagggccggatattcaaaaggggatatcccagggacttccctagtgctgcagtggctgaactgcattggaagaatccaccttccaacgcaggggatacaggttcaatgcctacgtggggaagtaggattccacatgccatgggccaactaagtctgagcgccacaactactaagcccacatgctctggagcacccatgtcacagctagagagaagctcatgagccacaaggaaagatccagcatgacgcaagtgagattctgtgtgccgcaactaagacccaacacagccaaaaatgaaacaaataaaatataaaggaaagaaagattgatgtcaagcttctgacttctgggcatctctctgccatctttttggggcacctgtgccatttggtttttgatttctgggcatctctttgcagtttgctctatttaaaatgtgactgccagctggtgaggttttggtttggcttggttactttagtttgagcatgcagacatctggtactaactgctggagctaaaatggacagcatttcctctaaggttccaccctgggtgggagctccttgggagattttaaatgactggtcgacctatatctatgatccaatgacaaagaaatatggcctaaaaacaggtctctcacagtttgatcttcattaccacaggatgagaaaatggagtagggttcccacatgtccaggactttctcctataatccaaaagcctggactgatcaaaataagaccccatctcctcagagggacaatccctgatgacacattttatcagccaatgtgtgaccccatagacggcagcccaccaggctcccccgtccctgggattctccaggcaagaacactggagtgggttgccatttccttctctaacgcatgaaagtgaagtcactcagtcgtgtcagacacctagcgaccccatggactgcagcctatcagggcaaatttgaccactacctggtctaaattttaggtatgaccacagacaaagaaaagtgactttttgaccgtgtgcccacaatatcctttagactttggacacaactggttaaaatttgttttccaattgcaaaatttgctatttctgcatgtgcaattagagaaagctagtttgttaaagtactttccccccacccccagaattctgaccctgaaggagtaagtcctactaggagaacatgagtttctttctcttccctgtgccttgagaccatggctctcagggacacttacctagaccacctctaattcctgaaactgaatttaaaaaaaaaaaaaaaagaatcctttaaaattttttcttactccaactgtcatttataaactagtgagttttctattgtgatacctgattcatgactaagtttagaaaacaaagctatgagatctctcattgtgtctgtgtgaatatatgtacgtctcagatgtgtttttgtctttggatattgttgctgaggttaatttgtaaattaactggatatttaattggcttaaagaaaagcagatacttaaaaatcaaacaattctaagcacaagagaaatttaaaggatttcagattcatgtaa

SEQ ID NO: 48801 - DNA, 738 bp, Bovine  19866880401055
gggaagtgagggtagggcgagtgcattgtagacacactggcactcagtgcaccgtggcttaggggcttaatctctgcagctataaaccaaatgggtgcaaatgaagacaggccctcctccttctgcagcgtggcgtgtggggggcattaaggaaatcaccacagaaatgactgtcttaacattttgtcttgatacattaaagaggaaatcctaagaagaaatgtaaattgcccagaatgcttaatgtcttaatttatttgcaaacactactaaaaagcgctggaacagcacttaaactaaattaaactaacgggttttagtaactcctgactttgaaaccagagaaagatgttaaaaatcagatggcatgtcggagagttgtagagctcagggactaggggacacaggctcccctgaggctctcagtcactgcgtagcagtgggtgtgggcgtgggcggcagtggtgtgtgacccccggcagtgggcgtgacccccggcagtgggtgtgacccacggcagtgggtgtgatgctacagacaccgcaggttcaagtgaactgggtatcatgtgtgtaaaaggcctatttgttcccaacacccttcatcttgacttttttattttgaaaaatgaggcgatcgcatagcaagacctcaactgatgcttcttgttcaaagattctatgctttaaacagagacattttgtcccaagcaagctctctgattctgttagaagtgaa

SEQ ID NO: 48802 - DNA, 1916 bp, Bovine  19866880420576
tcctttggactgcaagggagatccaacccagtccattctaaaggagatcagccctgggtgttctttggaaggaatgatgctaaagctgaaactccagtactttggccacctcatgcaaagagttgactcattggaaaagactctgatgctgggaggaattgggggcaggaggagaaggggacgacagaggatgagatggctggatggcatcacgaacttgatggacgtgagtctgagtgaactctgggagttggtgatgaacagggaggcctggcatgctgcaattcatggggtcgcaaagagtcggacatggactgaactgaactgaactgaatggcttattcatatgccagttaggcaggactgaaggtaatctcagtttcaatgggttctttaattagttaataatcagagcagggctggaagagagacttttcccaaggaaagactgatgtttcctagaggctctgaaaaatattaatattttatttatcctaatggactctctccctgacttcaaaggaaaggaagtgtcaagtcctctttagatttcagctggtaaagaatccgcctgcagtgtggaagacctgggttcgattcctgggttgggaagatcccctggagaaaggaacggctacccatgccagtattctggtctggagaattccatggactgtttagtgcagggggttgcaaagagtcagacatgacggagtgactttcagtttcactttttttcaagtattaatgagaacctcatgctaacggagggggctgggagtaggcatcttctcacttctggtgtaaaattgatgattttcttctggttggtgtaggaggctatgggcagaagatggagaaaacacactagggagactgctgaatgctcaagccctctcctcctaaacctccccaagagatgctctttgaatttatctctttttagtctccaccttggagtgtctttggggttgccaaagtcttcctttaaagtacaaatacctggaagactccttaatggagagaggggaaggataacaggagagtgggaaagggaggtaagaaggatggagataagaaggactctgaggtgtggggtatcttggggagggagatctgggagggtgtctgcagggagatactggggtgtggcagtagaaaagtactgagtgttgggcaaaggcattgacaaggagctgggagggcactagacacaaactttgcctaatgtacagtctgattataaaacaaaaaagcgttatgtaccaactgtgaggagaggagcttcccagtggtaaagaatctgtttgccaatgcaggagacacaagagatgcaggttcgatcctaagttggaaagattccctggaataggaaatggcatcccactccagtattcttgcctggaaaattcgatggacagaggagcctagcaggctacagtccatgaggtcacaaagagttggacatggctaagcaactgagcacacatgaggaggtagctttttcagacctcatgagggtttcccagctttctgttgctgttgaacaagctacaacaaaactcagtggcttaaatcaataaccacttctacctgatgattttgtgggtcagaaatggggttggggctctgctgggtgattcttctgttccgtgcagagtccatgaaggtcacttggtggtacttgctacctttttaagaggaagaaataaaaaggaaaagtcagccaataaacatttattgaggatctccttagcacgaggctgagagcacagactgaaatgaaaatggccccatctcttcccaatcacatcgtcttgctaagtaacagcctctctgagtgtcatttgccatatctgtaggtggggttgttatgagattcaaagagatcacagagaggctcaataaaatctaag

SEQ ID NO: 48803 - DNA, 1531 bp, Bovine  19866880430233
attagtcaatgaacttatactttcagtaaacaagctatttattaatatatatgtaatctcaaagttagacattatggaataattcaataaacatgtatagactatctactagtacttgaaagatagcaaagaactttattgtgaattatttcctttaatctccagaatgtggaaaataccactattattataacttccattttagacattagggaattgaagtttaaacaggttgaataatattccataaatcatataaggaggaaatggatgaattggaatttgaaatttaatgttctgctctcaaacctcatgttgcttttagtatagtattgtaatccaggtaataaggagttgattttcaagtgatcttacaattttgctgaagagacaagatatatttatcagaatgtatgaagagacagataaacaagcaaggaaagtttgaatgtattgaatattcactagaggttaaacattgtgctaatgaattttcttgcattgtctgatttgaacctcacctctaaggtaggaactatttcccccattttacatgtgaaaaaactaaggcttggagaagtcaaataataaatcaattaaagaactaagattcagccccagacagttgaactacaaaatcattatggtgaataattatgatccaaatacaatgaatcttcttcactgaacaacttgaagttctgtttgagccgttgaatctaatgtatttcccaatgctgggagtggtggaaagaagcttcaaaggctgttgataatcaaggagggacttaaactggactttgacattgagtagcaaaagtggatgaagtgacagtaagaacagaactcttgccactgcaaatgtggataagagcaaaagaaaggtagaaacaagaaagaatatgacacctgagggaatagtaaggcaaccccaacagttagaagcctaagccacagcttgaataagtgttttgagccatattaggaagggcgaggagtgtctggatgaaaagtttgggctatgccattaaagacctgagagccacaggaaatttttaagtgtgaaagtctgacaatggtgtgccattggggaggtatgtctggaagggaaggatgtctaggttggtataattggcattgaacaggagcagctgtcaggggcttcagcttaaaagttcatctttggttttgcctacagaggtaaggaaagaatcattgctgtccatggttctgttgcggctgcagcctggggcaagactggaaaaaaataaatgtcagcctgatttcttcagttgagaagcaaaaaagagcataaactctgctctgctttagcagtgtgagttttagtattcacatttcaatagttctcaaacctgaatacgtctcagagttacctggggcacttttcaacagcataaatgctccagatacaccccctggaaactctgactttagttttttagtggggagcccaaacaatgggaaattttgaaagtgccccagactattctaatgtatagcaatgggatag

SEQ ID NO: 48804 - DNA, 1763 bp, Bovine  19866880464313
ctcattttcctcatctgtcaaatgggatttaaataattgccctagctttcacatacgattgcagtgaagatctggaatgatatgaacgaatgagcactgaccaagtatacagcagcatactcaggaaaaagttcacccttttttagcaagtctatctgaattgaagtccattcagtccattgaagaaccccaccctcctaagagggactccaggaaggagggattatatgtaaatcactcagttactgcacctgcattacttctagaagatgtgtcaattcaacacaagaaacactcgaccgagaattaaagttggaaggtagacatttacaaggaaaacttacacacagccagttccttgggatagcatgtatcttagcagtattatatccaattcaaataaaacaacacttttcaagggcacagtgtcacttcttcggattgttggatagaaatgatccatgtttaagaagctataaaacggcaaccatacaccataactctaaaataaaaaaccagctttgcagaattgttagaaattgtacactatattggaagtgtggagaaaagatggtgctaacatgattataaagcagaaaatagcactaactgtaggcgccacattctcgcaggaaagaaaaatccctgagggctggagaaggagctttccctataggctggaggttatgggtgtcccagggcacctaccacctaagctggtcctgaaccatgaatataattttaaaggcagaggttttccaagatgacacggtgagtctgggtaggcaggtgagcaaaagggaatagcagatttgatgacaaaatggaccaatccctgagcttgcatttacaaaagacttactgccccaagaccaaagaagaaaaggtaagcaaaactcccacttgggttgtatttaataaataagacatatagcaattcagcttctcttaattcattcaggatgataactggtggttcctgatgaatactggttcatcactggccatgaacaagtgatgagtggtggtccttgatgagcttccccaatttgtctctgactgttggttcttgatttggggggaaagatggatatctgttgctttcatgggaggaatctatgctcttttcccataagcactgatgctaccctctcacaagtgcctgatgagagaaggatgcatcactggacagagacaagagaaaaagtccagtgaccaaaggcaaaatttactcttttgcatatgtggagaaacactggccctccagatgtaatggaggacaaggaaaacaaggacaaagatgttagagttctcagttttttgacatgaaaggatgttcacaatatatcattaaaaattatcttataaaacaaggaagtaagtttccacttttttgcaaaaaagaaaaatgcttatgggatgaataagtataattacattctaaagaataaatccatcagatcaggagtctgcgggaagcccacactcttattaagagcctgcctatgatgacaagctagccagggccaggcatggcaagccactgtgcagtgtggcttgagaggcatggacctagctgagcagaagcatgctggaggacttggagaggaccatgtagcactgggaaagcctggaggggaggaaggaaacctagccaccactctctttcctcttgtcaaatttctgtgatatgagcagccaggagctcgaaaataggtctagagctgacggtctgccagtcatccacccctcagtgcccagga

SEQ ID NO: 48805 - DNA, 672 bp, Bovine  19866880477595
tttgagtatttgttcttagtcactatttgtttttattctgagcagtcattaacctcctactatgtctccatcttttataataaaaatagcagtgttaaaagggataacaatactcccctccctgcgccctccccaggcagtgctctgcaaggcaagagaggaataaaaatgacagatgctcctgtgccaaatgataaagccacaggggcaggcgggacccggtgatggtttaaaagaagcttctggagtagctttctggaaatggttgttatgaaaccctcctccagagaaagtaggtagaagaatgaaggttgattagctatcaagtggccccaaacagtccctgattagaccctcactcaaggtacacagacttttgcaacccagggagtcagctggggacatggatcctcgccctgaggtctgactctgtgttggaaaatagcctatgtgacccaggggaggcagagcccggggggatcaccagctctagtttctctgccatgcccccaacacccacaccctgacatttgatcctggatttgtctttgtgaatcaacttcaatgtgatctgcccactgtttcctgcaaaggcctggattgcatctccccgcattttaatctccccaggacagggtcctgggaccccagggagagcctagtagaaggtgt

SEQ ID NO: 48806 - DNA, 1491 bp, Bovine  19866880487226
cccatggattgtagcctgccagggctcctctgtccatgaaattctcccaggcaagaatattggagttgggtagccattcccttctccaggggatcttcccagattcagagattgaacccagtctcttacattgcaggcagattctttactgtctgagccaccagggaagcccatctaagaagataatattcttcccatctcttcaagaacatttgttaactgtgtatcagataaacctatctcatgtccttttaaaaacttcatttcaatattcatgcttatcaatgaatttacttgtaaagcaagcaccaaatatatgcattgagtaaagaaaacagtcagattcaaaggtatccattatttacaactgaacatcttctctgggctagatctgcaaaacgagcatttaatgactctcagaagatagacagtaagcaaacattatgggaagcagaagaacacaagggtaacaagagagtgcctcaaatcagaaggactgagattcgtatccaggttctgcctatatatgtaattatagataagtcctttgacctagctaagcctcattttgtttctctgaaaaggattaaataatgtcactatttattcgttcaataaattgtacaagggttaagttgttttagtatagttttagtgcttaatagatattggttattattattatcattaatagttgagactaacatagagtgtgaccaggtaggataagtgtgaaaagagccttaggacaggagccactaattacagttgaacatcacaacagggtttccctggtggctcagtcggtaaagagtctgcctgcaatgtgggagacttgtgcttgatccctgggttaggaagatcccctggaggagggtatggcaacccacgccagttttcttgtctggagaatccccatagtcagaggagcctggcaggctacagtccatgaggtcacaaagaatcagatacgagcgactaagcacacatcacatcagagaggtgtaacctgcagttatctcacaagtactctaagacttggagacatgggtgagacgtggaatacgaaagtcctcgatgtatctggagaatgggagagaggctagctttgtgaacccaagtggacaggtggaattatggttgtaaaggaagattgggtcatccttggttgtggaaacatgtaggagaggtatttcggggctacgagataaaaaaattggaactagcaatgagaaaatgggtgtctaactgcccaaactgaatgcagagtccctttacctttgtgggtgttgttttgctttggggacgacagcttattccgtcagcccatctctctggcctgtcctcccccacccagccactggcagtcatttctcactcccacgctgacatttccctgagactcatttcatgctatttcttcatgggggcatctgggctgacaatgcaaagagccttttcccacagaattgagaggaatttctgattatg

SEQ ID NO: 48807 - DNA, 1523 bp, Bovine  19866880517849
ccttagaaatccttggtcctatccccatcctgcccaatgcaagaactcactccaaatcctgcctgacatgtggcccaccacgttaataatggctggattgattaatggtgataaatccagccattattggattaatggtgataaatcatccaactaatgattgattagtttggtgattaactgaatcttggcaaatatttccatgagattacagaaactcttgcttgttccaatatccttccactcctttgtcccccaggaaggatcattcctttcattctagcatattatcttacatacttttaacttgtgttgaattagggatgctggaagctatgggtgaataagccaccccttgcaatggcctgggaaatgcattagcttttcaaatctgaagcacttgaggtctgtttttacctaagggcttgaatggtactgaaggaagggagagtagcgtagtgggagtaactcttgggaagttgttagcaagtatggactctgggtttacatctacccctaatggatgcctttcagtgcatcactttctctgctcttagaactccaacagtaaaacgagaaggatgtcatggagctctccagaaccccttctagctctgacagcctgagtctggcctggagctcggaaaggattaatattacaggtctcaaaatgtggtccccagaggaatagcatcagcaccgcctggcaccttgttaaaaatgcaagctcctcccctgcctccccggccggctctaacagacaatgagtccgggacaggggctaggccccagaaatctgggttttaacaaggcttccaagagattctgatgtttgctcccgtttgagagcagccatattaatgtgattctctaaggacccgttaataccaccagacttgccaggagaactggctgtatttagcttgtttcctttcagtttcttgggtcaaacaattagtatgaagaacatagagaagttgtttgtatcccccaccaaatacatattgtaaaatggttaatatgacccagcaggctctccagtcttcaacatgagcaatgaggtaggcagagcagacctgggtcctccctgagaggggaggcccattgccctggtgacacacttagcaggtatcaggggctcacactagaactccagctgtagtttctcacacagttctttcttattgtttgttctggattttgataccacagtcacgagcaacttttcccacgttcagggaatactcaccacaggcaagagccaggaggtgggtttgccaggtgagtgccatgaacgttcctccaattgcaatgcaagctagagagctgttgaagccccagagtccagcgtagatgtcctcaaatggagctgaaagactgagtcctattagggaagacaggaggggtcagagctttggactaaaggcaggatgttctggaaggagcctgggggtggggaaggcatctgagaactcccattggtcccttggaagcaggccttcaagaaaggtctggaatgtaga

SEQ ID NO: 48808 - DNA, 1427 bp, Bovine  19866880518394
gaggtggggctgcaggccctccccactcctttggccgatcagctgcatttttagcaagaaagatttcaactggttgagaaaaattaagtctagacacatatagattcatgcagacggagaaatgagacagcagaaggggttggatgtgaacagcaggtgaatctgggtgaagaatttgtgggtgtctctcagactatttttaattttgtaagttttcttaagtttgaaattatttccaaataacttttttaaaagttgtgcttccaagaaatttttgaaaaatattgggataagtcaacaggctcctattcccaaagcacccaaggtccatttctgactctactctctttgtttacatatgtgaatgtgtgtatagacacctacgtagaaattaaatcacatttgtcaaatgacaatccaattcttgggaaaatttttcctgttagcttagtcaaaatttcaaagtgctaggtcgtttataccccactgggtctgctagtgctccccacccacaccggattcccctctgcctcccacccctcagctcccaggggctacaggccagtaggtctcagcccttttgcatctccccatacaacctgctcagatggtaaagtgtctgtctgcaatgcggaagacccaggttcaatccctgggttgggaagaccccctggagaaggaaatggcaacccactccagtactcttgcctggaaaattctatgcacggaggagcctggtaggctaccatccatggggtcacaaagagttggacacgattgagcgacttcactttatacaacctgctatcttttggagactcaagaaaggaaaaaatgagtcacaagccctgacagtgtctaaaaacttcagagaagatagtaagcctagactctttactgtgtgctgggagaaatgacctcaggaaaatgacccctgctgagccaggggcgccctggcctacctgccagcagccccacgattgagccaatggctgcatgcaagcaaatgagtggtgagcagatgaacagggccaccaggaacacaccacctgtccaggggttgtcgcagccgtacacctgcccgaccccgacagggatggcttgtagcagctgcaaagtcaacaaaatccaggtcagtggagtgtgggctgataatacaaggaccaagcctcagggtgaggactgagcctttccccgggggggggtcatggtgtggaatgggaggattgctgtgcccgcgagcgtgtgggagaatgtggaagggaaggcacgagctggaacaaatcgctcttcactccaccacttggcaggcatctgagcatccctcatgcaaaactgggcaggtccccagcacagaggctggaagccaggtggttctgagggacatgtggcttttgctttgggggtctacagggtgcctccctgga

SEQ ID NO: 48809 - DNA, 2286 bp, Bovine  19866880603579
ctacagtttctccagtagtcaagtacagatgtgagagctggtccacaaagaagactgagcactgaagaatttatactttcacactgtggtgctggagaagactcttgagagtcccttggactacaaggagatcaaactagtcaatgttagaggaaatcaatcctgaatattcattggaaggattgttgatgaagctgaagctccactgtttggccacctgatgtaaagagccaactcactgcaaaagaccctggtgatgggaaggattgaaggcaaaaggagaagggacagcagaggatgagatggttagatagcatcaccaactcaatggatttgaatctgagcaaactctgggagatagtggaggtgtgctgcagtccattatgtcacatagagtctgacatgacttagcgactgaataacaaaataccctatttggtagaaactattattatctctgttttaaacttgagaggcagagattgcttaagtcacttgcccaagatctcttggtttgctctctctggtcagcttctcttttcccccagttccttccagtgatcgttccctgccctaaatgagagggtgtctgtcgcttttgggcctgccttggtaagcaaatccatgcgggctgcttgctgaggaagtaatatgagctctcagcttatgaggctataatgaatgtacttggcaaaacagaagtcactatccccaagtgtgcagaataactagatttggggataggattccctgactctgaggcagcagcagcttcggggcatttgtttgtgtctttgaccccgagtggacattatctgggatttctcttggtgcagctatacctgagatcactagctgatcagctgctatagcaaagtcaaaggggagtcctgtacacagggcagagtcaggcggtcaaggggaaacagaagaggaggaagtacaaggcctgctgaggtgatcttcagagtaactttatcttccaatcaggagggtaatttcagttcagtaagatttcttctgggcacagggctactaaatcaaagcttcacaaagcaggtagctggtgtaggagggacaaagaagattttacaaataaagaccaacccaggccctagccagctaaagtgtgcctgcttttcttgggaccacctctctagtgtgcagccagcagaaacaacgcccaaggacccaacctaatgtctgtactttatgtgaataagactgtctctaaatgctgacatttataacttcacaggaaaggttagggaggagggagaaagcgtaaaagaacattctgtgtagtgccatgatgcgtgccaacagtttgtgggttggatggggccctgcattcctaaagattagacaaaactgaaggtttcttcttctttaaagtgaggaaatacaaaccctctcctcatgtcagtctcaactcttcagactttttgtacaattttccccattcaggagtaatatttaactgaagggaaatcagaaaagctgtagcttctttttttttctagaaaccaaaagaatttaaagatatcaagtttagctttctaattcaatttctgaactttctattttttaatgagagaaagaatgttagtggatataaggagaaagcacatgtttttgtgattactagactttcagtggttggtattttatgaacatgccacagggctgaattacgaggaccagagagcgattggaacgacccccaatccctgagccctaccaaagagaaatgtcaacaagaagtccaagcaagggagttcttttcctttccacattggataaaacagattctaaactgtgaaaagaaattaaggctgagaagtattttgacttaatacatgttccaagttacctcctcctagcatgtgagctacacctgaattgtagactgagatttggtggttggttagctttcagggtgagcttagagcaagtcattataactcaatcgctcagacggggattaaaggaaaagccactattgcctgctcatgaagaaagggttcattaagccattcagacatgtcacagaattacaagatgacccagaactagataaacaatccaggtaagtagtatcatggccaaaccactctggggaagatgcagtgatcaccatggcatttctttgacctcagtggtcccctcttgctggtagaacccgactgaaatccaccattcaacacaatgctctctgacaaggccgcttctctagtcctccacacagacagccagtcaagcaggtcatgccccttctagtcacat

SEQ ID NO: 48810 - DNA, 1704 bp, Bovine  19866880607563
agatacaggttcgacccttgggtcaggaagactccaggagaaggaaatggtaacccgctccagtattcttgcctggagaattccatggatagaggaggctggtgggccacagtccataaggttgcaagacttagcaactaaaacaataccttgatgcaaaaagcacgaggaactaaatgggaactcaacctgaatgagactggagtcccatccttgtccacaatctccagccctccctgcaccttgattgcagtctcatgagaccttaagcgtctgagcttcctggacctctgacctacagaaaccatgtgataataaacgttctctgtctcaagcctctaaatctgcaataaatctttacagcaacaatagaaaatgaatacaaatttcactactcctcttatcactgcattttaatgacaggggttagtagataaactggtttctgagacaggtgccattaactagggctcacagactctggctgcagcagaccaaatgtcataaggttgaaactgcttcccttttcaagagaacttccaagccctgcagatgatgccaaaacggtgaacctgcagttatctttgggtgaaatgtgtgttttgtcacttatccaccatcactgtctaatcctgacaccttatctttgtcatcaaatacgattgtaggccagcagatgtctacccttccatgcgcatatgtgtgttcgaagggagatttaacttcaccccagtatgagcataattgggacagaaagcctgctgttcaaagaagacttctgtagaaatctgctgtgttgtattttctgcgcttgaatgtattatccaaagtggaagtgaaaggaaatgaacattattaatgaccatgtggtaagctgtgccctggatgctctcgtgtatactctactttcctttggctctcataaaactctgccaggtaggttttaatagcctcgtttttcagatgaggaaaacgaggatcaatgaggctcagttgcccaaggtcatgctactagtaagtggggatttagtatccaaatctgcatccaggagactttaactccctagcattttaatgctctagtatgctgccttagccgttgctggatttattcccaagctagtgagttgtgctctgtacaactcagattttatctgagtgagtcaagatattcttacctaaaataaacaatacaaggccataaataaataagcactgaaatgaaagttaagatattacttatatcagagaagcaggagatgccagaatggttaaggaaacaagtaagatttggaagccagattgaaaagaagagttctatgtgaaggaggcaatggggtgactggagattcagatccaggctaattatggtattttctgtaggataaggtagagatttagcaaaactcacagcaagtcactaagatgaaaatgatctggaaacaaggtgagataatggagggtctgttaagccagataaagaattttgggctttatgcaagagaaacggttatttctacatctggcatcaattactcattttgttatggttcccttcgtggatgctccacgaaaagttatttcattcttctttttccatttcagtaattaatatatttatttagttagagctataaggggtgtggggtaggccaggaaacaaaggagctttgctctgggctatatttccaaaaggattcccca

SEQ ID NO: 48811 - DNA, 2269 bp, Bovine  19866880633328
tgcaggtcaggaagcaacagttagaactggacatggaacaacagactggttccaaatagaaaaaggaatatagggctgtatactgtcaccctgcttatttaacttctatgcagagtacatcatgagaaatgctgggctggaagaagcacaagctggaatcaagattgctgggagaaatatcaataacctcagatatgcagatgacaccctttatggcagaaagtggagaggaactaaaaagcctcttgatgaaagtgaaagtggagagtgaaaaatttggcttaaagctcaacattcagaaaactaagatcatggcatgtggtcccatcacttcatgggaaatagatggggaaacagtggaaacagagtcagactttattttttttggctcctaaatcactacagatggtgactgcagccatgaaattaaaagacgcttactccttggaaggaaagttatgaccaacctagatagcatattaaaaagcagagacattactttgctaaaaaaggttcatatagtcaaggctatggtttttccagtggtcatgtatggatttgaaagttggactgtgaagaaagctgagcaccaaagaattaatgcttttgaactgtggtgttggagaagactcttgagggtcccttggactgcaaggagatccaacagtccatctaaaggagatcggtcctggtttttcattggaaggactgatgctaaaggtgaaattccaatagtttggccccctcacacaaagagttgactcattggaaaagactctgaagctgggagggattgggggcaggaggagaaggggacgacagaggatgagatggctggatggcatcaccgactggatggacatgagtctgggtgaactccgggagttggtgatggacaggggaggcctggcgtgctgtgattcatgaggtcgcaaagaatcggacacgactgagcgactgaactgaactgaactgatctgactgaagttctagcacagtctcaggcaaaaatggaggccagtgaatattatcatacataagtaagtctgtgcaccttcgtgcaaaccagtaagctctggtctccctggaactagcacgtggaatcaggctgcagggctcacatgcaaaatggagctaaaaaataacagactttatcatggcatggctgacaacatgcacagctagtgccaagttctggctcacaatgaagggctcaataaatgctagtcattcttcttgttgatagatctcaggtatctagaaagctaggagaatgctcttcttcccatttcctatccaatcgaggtctctgatatctacagtctgacattaatttccacttcctgccttcccacacatctacctgcctcgagggtgccctctgaatggctgcttctcagtcagccaagcagccaacttctcccctgtgggagcccaccccttgtcttggttccttcagcttctgggccagaggaagtgggaagggcaagggcaaatgaggtccaccatggaagctctaccagtcacttcccctgcctgcgcccgggagagatgggacaaaaccagaatgcaaagcaagctggtgacttgcattaaattcctttcacgacctgggctgccaagaatgaggcccgaggaggaagtgcagcaagtttgggggctttctcctattttcccctcctcacatatatacggttggctctggggcctccactcctctcgctgaaccccaaacaacgcccaaggctaatgatgtgatggtgctctgagacagagctcgctctcttcttctttgtgtgtgtctgcggttctctctcggtctttgtctctcccctacctgtcttactctatgaatctgtatttttttctttactctctagctcatatctctgtgatcctagctcttgcttttctgttggttctctagctctcctttcattgtctgtttctgcccatctccctcatcctgactctcctgtctgcccgcctccccacgtgcatctcagctttccagctctcctccctgccacaatgctgcagtggtgagaaggggcccatcgatctgtcagagacaggatctgccaacctcgactacctctctcccgctgctggcaattatctggaggttggcacagggcccggaaactgccgcttgcaccgccccacggctcaggacctgttctaccatgccagcccccttggaggactgcttggtgccgtgcccaggatgtgacaacctgcaaaggtcacacacacactccaaagaaga

SEQ ID NO: 48812 - DNA, 1004 bp, Bovine  19866880664176
tgagattcaaggaaagactgaaggactgctccagactgagggaaaatagagacatgtgacaactgggtagaacccaacatccggatgggtctcttttgctgtaaaggacatcattggagactttggtgtaacttgattggggaggttctggatatctccttgtactattcttgcaacattttttttgtaagtttgaacttgttgcaaataatattacattaaaaaaaactgagaactaaaaactcgcatactttcactatagcgagtgacaagctccttacaagacaaattgcaactgactgtgataacatccaggaatagtgacaagagtcagtggcctcaggtctccaggactgttgagggaacagccaactctgatgaggatgaggagcaagaaaggaaggaagagggtgttgatggagtggctttgccgtttgtttcttgtcatcagctcccatctgcaaattcctctgcaggagtagtagcataaccagagccctttaactctaaacataatctcaccagttgtcttcctgcatggttgggagtgtgtgggtggcagcaaatagaagaaagatcggaaaaaatagaagaaaaatagatgcaaatggggaaaatgtcccatcataacatatattctttcttccctccccaacaactatatcaaacagaataatgaaagaaaaactaaaaacaaaagtcagccaccatcaggaaacctcccaagttcttctgtgccaaaacccagcagaagccaaggaagtggcatttcacccacacggccttcctgacgacggaccccagctgggtctcccacgtctaggttatttatgaggctctgggaaggcattcagaactggagagaaactccaaaccctgcctctcagagaaatgtggtgacttcaaggactgtgtgggctcaggaggacacgccttcctcctgggagacctcagctccagtccagggatgctcagactgactgggttcaaatcctgactctagt

SEQ ID NO: 48813 - DNA, 2785 bp, Bovine  19866880701036
gcgacctgccttggcggggtcaggcaagatgcctcatttaagcctgtttctaaaggcaggaaggatttgcgggaggaggatggtagccgccaagggctgtggtgctgccctgagtgacctgtctttgtgatgtttcccaggcaagcagggagtctgggctgggttatccagacccagcatagtactagagactacagcaactttcttggcattctccccctttatttttttagtctcttcttcaaactgagaatcagatgcaatcctcccaagtttggaaagtggagacccctaagctcctactactttactggctggtgtagaccacagcctgctacaaataacccatgggatcctgataagacacttgaactgctccagacttgaactctaaattgatcagttttaggggctgcacatgtgcaaagccatggtatgttctgcattggaagctagcagagttaggaatcccaagcaatctagattgtttaaaggaggtgtccttaaaaatatcccctgacttccattccccaaggcagtgggatgttgcctgttgggcaatatgattttccaagcatgtcagtgtgaattgggaaattagatgagtggccgaggaaggcaagcaagcaaggcaaacaaaaatcctcatgcagcaaacaacatcaactttttaaaaagcctaccaaaaaaaatcaataaatatttgtgatctagaatgaatgaatgaatgcatgaatggaatttcctgaagaaagtcctattaccaaaaccatcagcttctttcagaggacaatggagagctaggcctgtttcccaggaactgtcagggcagaattaagtgtgctccgtggcccttccattcccgttagtgagttatgtagggctgttcccgcccagagctggagctgggggctgagtagagcagaacgaggggcagggactgaaggatgctgccgggaaactgctgccctgagaatggcagggttaaagctcaccctggtctgaaatgttaagggcgagcctgccagagctaccttcttgagtttgtcactgcaagctagacagtttcttgggggcttacggcgtttatgcttctagggcttagctgctctggatatcacggtgaatggtaagaaatgctttcttttcacaaacatcacacccgcagcacaatacccctagttatggcactttatattttggaaggtactttagcattcatgctcccatttgaaatccacaataactcagttgcgggtgtgtggggggcggtttagctcctgtaataagatgtgcaaacttaaggtaagaagtggtacatgactgctttaacagtactcaggggaaaatagtcaaggcaggattagaacccatgtctcctgactcccagcccagcattctttcttccctacaaggtctggtgttgctctcttcccttcgttacctgcttctgcatccttaaatcacttggcaatttgtacaagttgggggccagccacagagactactgatttggtggccaacaccagagactgattccatagaagtctgcatttttgacatgttcaccaaatgattacgatgtatgttgatctctgcaatttgctagtatagggaaatcagtgaattttgaaccagacatcgtctctaattaaactggtttgcttgaaaggtaagtttaaaaaattaaaagaaataggaaaggaaaaaaagaaacaggcttcctccttggtggttgtttccaaatttacacttcctgcatcagctgtctctcttctttcctgcttctcccaaccttccaagcttctctgagcctctcccttcctgttctatattctatattcttgagctgtatcacactttccttcctcactgtgcagtcactacgagtctgcctttgtgtgtgtgttttttttttttgaccctaaccctggggtactttccgagggccttgtacaactcagtgaagctatgagccatgccatgcagggccactcaagatggacaggtcatagtgaagacttctgataaaatgtgatccactgcaggagggaatgggaaacaattccaatattcttgctgctagaacctcatgaacagtgtgaaaaggcaaacagacatgacagaggaaggtgagcctcccaagttggaaggtgtctaattgctactggggaagagcagagggcaattactaatagctagagaaagaatgaagtggccaaagtggaaacgatgtgcagttgtgcatgtgtctggtggtgaaagtaaagtccgctgctttaaagaatattgcataggatcctggaatgttaggcccatgaatcaagttaaattggacatcgtatgagattgctaggtagcatcactgactcaatgaacatgaatctgagcaaactctgggagacagtgaaggacaggggagccctggcgtgcggtagtccatgagtctcaagagtcagaatcaactgatcgactgaacagcaataaaaagagtccttggcacagtgctggaggctaaaaggatggtttagccatactgttgcaatgagccactcaagtctgttggactgcctggcaccactccccagatccactgtgtggctaattgagacattgttactgcagaagcaaagcccatcaccaagtagccattgagaccctcctgatgtaaagtacaaactaaaatgccaaaaactcccttcacaaatatggggtcttagaaataacaaatgttgatgaggatgtggagaaaagggaactcttgcgagctgttggtaggaatgca

SEQ ID NO: 48814 - DNA, 1896 bp, Bovine  19866880709663
cctccccctcaaacccctagcagcctcaggggttctcatgggcttcctagctcatagcactgtgcaaaacttagctttcctccagggcccaggctttacacagagagttagaaattctaggtgtaggtcccaattctgttcttttctagctcttgggagctcatcgccttggagtaaccatattcatcttacatagaaaatggtcactacaaacacgtcttacttcatgtgccgaacagtgcacatccctgctcttgtggatcttaaaggacaccaaacacaaaatggaagatgtgaccgtgaatcttcttggtcttaatggtcttcattattcagaaaagacacggaggatctgagacattgagcatcgggcccaggtcccctgtagttcctatctcagtggtcttcctccatctcacatggtgacactcccggtgaagaggagatatctgtcctttggtggttatggtctctagagccagaaggctaaggttcaagtcatagctccctcacctgacttctaataagcactagacacatttgctattattattactcttacttttattgctgcttttaatggtttttccaagactgtgaatggactctctcttatgcatgctgtacacatgaattgtccaattagccagtttagggctacaaatagaactagattatcccataagcagaaaaagtgtatgcactcaagcaaaacaaatgtaccaaaaaaaaaaaaaaaaatgcctacttcattaaacttagttttgtgatcagaaaattccaccaaaacaggggtagagaatcataactatatcatttagtgtttcctttccaaaggacttaccatgaagcagagtgtgccctggaggagacagcagagcacagctgcctcctttgtcaggagtctgaaccgggacctgggcttcctcagccgagcccctctggcttcctgcactcagtagccgtggcagtcaccacagtcacattgtcgtttctgggcttagtcttcccagggaccactctcctgacctccttccgcatttgttctcctccccttcatcaggcatgttgaggagtgggaagcggggatgggggttagctgctgaaaaggtttgtgatgaggccagactcagctctgtccatccaggtactaccaggtgaggaagccacttttgatcatcatagggacaaggcattcatgtaactcatgccaaggacccctccaacaccacgccttcgacagcaaagacagctgacatatacaagaaggatatcagcaagctatgagctagggcgctgtctgtcactcttctacctttttcttcaggatcgtttttcttcctatagcaccttcctctcgccttctccccagcagttgcccatgagctggcctctggctgtccagggtaactagctggctgcagccttatgcccaggacacatctccacttcacagaaactgagcctgaatcttcatctcctactttcccgcctccaccacacatacatacctggtgtgtctccctcattattgagaaaattggctcagctggtacctagtggaatatttatcaatacaaaagcatttgtggctactgagagcttccatctgcttcatcagaggggtctatgcacttcagaatgggaagagtggaacagagatcacttgcaaaggtagaaggtcaggccaagtgcctgggcagtgggagggcaattgaaggacaaaggctgggacttgatgagagcctttctaatcacatagcacgatgaggccttgagtggggagaaggagtaaaacctgtcagaatcacagttccatttggcagaggggcagggaacgggtcacccagctgcatgtaaacaataaaagatatttctttggaaatttttagcttg

SEQ ID NO: 48815 - DNA, 1308 bp, Bovine  19866880785848
cctgatgctctggagtcagaaagatgccgaagcaaacatctcctggctaaagactctaggaatttcatctaaaggttcagagaaagcccaccatgctgttgctcagggaccacctgggagcaggggcctatggtctgaaagcctcacagctgtgagaacacactgagtgctgccctaaggcgagcagagccagaggcaggtggagtcctgagctgggaactaacactctggtgccaccaggcgcctggcagtggcatcaagttactcccccagatctttgcatatgcgggtagaagctggcagccactgcccccttcacacactggaaaccacacctgtggcatgcttagagcgctttgggccaatgtgcatgctgcttgtgcatctgtacgtatgtgtgtatacatgtatgtatgcacatgtgtatacacacatatatatgtgcgtacatgtgtgtgttcaagatatatatgtatgcatatgttacgcatatgtatgccaacgtgtatacatactacttggattaagcacctaggggttagaaaccatagtcgtgaggttgatggagactatacgatgctttaaccgtaatcttggattgagccattcaaccctgctaggctccaccaggcgattctcttgccatcagtgtggataatagaaacgtgggtatccagaagaaaagcccatcatcaagtaggcattgggtccctaagaggtgaaaactgcaactgaaatctcaaaaactccatccaaaaaacgaacatgctacagtgatcgttgccagatcactcagtagggaactggggggacgtgtggttcaggtcatgggtcggagggcgtcactcgaccgtacccttgtgtgccacccagtgcctgccatagtgcttttccatagtattgcggaggtacagtccctggggtcacagaagtcggacacgacttagccaccaaacaacagagaagcaaggactatgttaatacctttggaatgattgactaaatgtacttaaaattgcacttctttctattctttttgattataatttatggaataaactcttcatgagtgaaatgggtgaaggtggtcaaaaggcgcaaacttccaagctgtaaaataaataagtcatgaggatggaacatgctgctgctgctgctgctaagtcgcttcagtcgtgtccaactctgtgcgaccccagagacggcagcccaccaggctcccccgtccctgggattctccaggcaagaacactggagtgggttgccattgccttctccaatgcacgaaagtaaaaataaagtaagccg

SEQ ID NO: 48816 - DNA, 1569 bp, Bovine  19866880800003
ttgtatttctttaagtactagttcaattgcatgatttttcaatgatttaataattttttgtgatttttctggtttttgttttttgcacgttttctgctgggaagtttcttgttttttgattgctttgaagagctcctcaggctgttaacctggtgtctggaatgtgttataatttttctacttcgtcgtttttctataattttatgattctttttgccatatagaagtcaaagtttttatatattcacatgtatcagtcttatcctttattatttctgtctcatcaaatttatcaaagcttttgtaactctgagattaaatatcagcttataatactcttaaacattagaacaaattaaaacaaggtgtatattaattatgaaagttagctttttaaaagtatttaaagcgtatctcaataaaatctacaacctagaatcttttgtttttctttttcttgacgtaatgcagaatcactttagatttttagtaatcatggtaggtacactgcgaatttctggattcagattatcccagtattttaatcttttaaacatttgctttgacttgtccaaaccaaatgaatggattagccagaatttttaatacaaattacattgaaagtgatagatttatctgtgtcaattttagatttcttttgattgtttcatattttcatttagaaaaaattctgttagctgtatatactattccttaaaacttggttgctcaaagaaaagttggggaggggagaatttgatgacattttcccttttcaattgtttttaggtatttatcagtggcactaaatcagaatgcagaaaagtccttgagaccattctgaagaacagaaggctttgctccctcttgtctcctttcttcactcccagtgctgcgcccgcggagttcatccagctctatgagaaggtggtgaagtttctgcgcgaggacaacagtgatatgattttcatgctgctgaccaaggtgacgtgtgactcagtcctgacgttgtcattgagctgtgggtactgctgctgtttccctgtgcctcagaaatgcagggcccttggagctctgtctccagggggactggaggcagacaggccctcttcacgtttgatgtcatcttcaagtagtccgatcccttagctgctgcttctggatgcattgattacatcatgtaggacagtctcaccacatgtagtataaaaaagaccagctcccaagctctttagaaacttcctacagttttgaaatattcataataataatttggtacatccttcttttgaatgtgtcctgaatttataccttaattgtgtttgataattgagttgttaatgtgtcagatgtcaccagttgagaaattcagagccttagctatcttgcttttaatacttctctgacatctataagtcataaaacctggacattttttaggacctggagactgatcgcaatttttagtagggaaaagcatgttttatagtttggaattctggaaggtgagatcagcaccctgacttttcattaaccaatgccgatttagaaacatggccaccagaagga

SEQ ID NO: 48817 - DNA, 898 bp, Bovine  19866880800718
tctgctctctgtatccgtggatgcagatgccacggtatggagagccaactgtaatttcagagtccaggtgtcagcagacatggttttaacaaaaccaggtattgtagagagacatcttgcttagagaatcagagagtattcactctcaaagatattcatacagaattaaatgacccactttggtctgattcaaattttccactagtcagatttttctcctggtcatagacattgctgcaatgggaataagctgattatttattgctggtcacataccacctacaattcacttttccaattttcctgtgctgcctatacagtgccactttgtcagtccctgcagtttattgactgttttctgatggctggggtaaacaaattacttcaacaatggctgtggttcaaaaagggcattgcttgctgggttctaaatgatggacaggtgtgtgagatccaattggtcctaatgtcaggaagcaatccaccatcacagcgggcagggtacagtaacccatcctatcagggacatgattttgaatggtacataatatctacctttttttaaatttgagcatcagacaatatccagatcaaatgatttcgcagataaaatattccaaattttcaagtctacttttttagcatacactgagaatatactgcacagtaacaactccactttataaatgcaataaaatcaccaataaccaagaagttcacattatttcattaagccagagttcatttattggatctagggcagattcttagagcatctagacctaagtctatgtgtaactcagtggtctctgaatttctttactatgcaattataccagaaaatatttttgagcaggcactccaatacggttgtttaattataatttatattcattca

SEQ ID NO: 48818 - DNA, 1232 bp, Bovine  19866880824668
actcctccccctctctcttaactcacaattaactgaaaaatattaacagcacttaatgagcatgagcatttaccatgtgccagacattatgctaaatatggtgtatgcattattttatttgttcctcacaacaatcccatacattgggtactgcagttaaataattcctcagggtcatggctaacatagctggtgtggacttatgctggagtctgaagtcaagactataatatattttttagctttatagctaaaaattgttttaccactttattcaggtatagtttacatatataaagctgtatacattaagtgtatataacttgtgtttaggaataagtatatacctgtgaaaccactaccatcatgaagaccttagatacattccctcccctcccaaattcttctccaaaccccccaacttattattattttttgttgttgtaagaacacttaccataagatctaacttcttagagccttgccaacaatactggattgtatacttaaaattttctaatatcagaaagcaaatgttagttttataactgcttgctgatagaattacacatgatatttagtaagaaaatataatgcatataatcaagtcaaaccaaacaatctcccagcttggatgctgtggggatgccatggaaatatgcagcacagttctagaattaaagattctacaacctgttaggctgcagatataaacacgtgatataaacataacccatgagtgatgatttttatttgattgagacaagcctgtgttagacttttagggtgggagagacttgcactccaggtaagcatgataaatgaaatgttatgacactagcgtgcaccacagtgccaggcatctgataaagattcagtcaatattaaatgaataaaccagcatccagaccagtctctccagtgaaggactctccaaagcggcaactccagtgccttaaagagtgtggggcagcgtacacgattttatagcagacactacattcaaagtgccgatcctgagagccagataaggaaatggtgcctttgtggggatcacctaactgcttctgtcatccacaaagacttacttagagaaacagataaatagctgaaccataaagtatgatcagtgctttagctggtttacatataggtgcaatctctctctctctctcaggagacgcaaatcgtctgggaccaacagtaggcttgcagaccacgtcacacctttc

SEQ ID NO: 48819 - DNA, 865 bp, Bovine  19866880850041
tggggtcgcacagagtcggacatgactgaagcgacttagcagcagcagcaacaccgttatatagagctattgaacaatcagcaactatttatcaagccagttttataattaagtgttgagtgtctcatgtaatttattgaatactgtactgagagtgaagaacagaatggctgtctgggtgcagggtgactgtaagtgtactggttgtttacgcttgtgttcgcatggctggaagctgaggcccatgactgctgcccagcatcatgacagagtcctgcaccacgtatgagtagccaagaaaagatcagtcaattttctactgagtgtgtatcacttttataccatcagaaagtcagaaagtcgtgagtcaaaccattgtatgtcaaggacaatctgtatacttattgactgctcattgtataccaaaaaaagatcctgtccttatgagccttatatatgtcaggtgttggtgagggtcatgaagaaaagtaaaacaaggggaggaggtggaggatggagcggggatactgttctaggcggttgttcagggaaacccgtaggtcacctagagtgacacgtgagcagccctgaaggaagtgagggaggggccgcgcgggtatctggggagaaggaacaccaaaagaagaggtccttggcacacacaagcaagcacgcaggaatgctagtgaggctggggcagtgagtggagaggagagtggcaggagataaagccagagcccagactcttagggtttcagcagctaaggtagcctgtctgggttttgttctaagtgagctgggaagctgttgaagaattaggaacagggaatgatctttactgaagggtcacaggctgactgtgtag

SEQ ID NO: 48820 - DNA, 1800 bp, Bovine  19866880854694
atgtcatccaaaaatgtaaaaataatacaagcatgcaggagtttagaattactaatcttcacccaaaatgctcaatgaataatgccctaaaggttgctatctgtaaaaattgtctgttgtcaggttgggccctaattgggcagccacctcatgcgaagagttgactcattggaaaagactgatgctgggagggattgggggcaggaggagaaggggatgacagaggatgcgatggttggatggcatcactgactcgatggacgtgagtctgagtgaactccgggagttggtgatggacagggaggcctggcgtgctgcgattcatggggttgcaaagagtcagacatgactgagcgactgaactgaactcttagacattggagtccacagtcctgtgcgcagccctttactttgatttcgcagctgtcttgactgacgtgggcctgcttattctgatgactatagatttgggaatagaagaaaatttctcctttacaatgtgcttaatataccagttggtttctttctagtgtcaaaatggtagatacatttagggttccctctccctaattttttgactcttgtattttgcaaatgaattttatcccagtataatgatacactgtttttatattatccaagagaaggaacaacattaaatttcccaaattcccactgttttatccccctcctgcagttttccatcagagtgttggagaaataaagagtgcaggctttttaatttttgaaatttcactcggcaggaattttattgaaatttgaaaaatgagatagtatttattcatgtaagcttcatactgtttattgatgtaatggaaaactaaattttgcattatgtcaaatctttgtgttactttacggaaatagttttatgaattagctaatgatcttatgtattggactacttgaagaatgtatagtctaattttcaaagcccttcaaagagttcaatgtttcctatagcggcaggttgcaaagtgggtggggagtggtggtacagaagtgcacttgtataatttttaatgcttatttacatagctaagttttactcctaagttttcaaaatttgattaaacatatattatggatttttcccctgaaaccttttattttatttttttaaatatttatttatttggctgtgtcaggcctcagctatggcatgcaggatcttccttgggtcttgcaggctttctagttatggctcactaacccagttgccctgcggtatgtagggtctcgtaccctcaccagggattgaacccgcatcccctgcactgcacggtagactcttaacaaagcactggataccagggaagcttccttccccgaaaccttttaaagagattctaaattgtttatacaggcaaccactgacttggattgagcagaaaagttttaattcgcaggaaaagtagttcagttacaggcttaaggccaacagtgccacctctgtcagactccgtgacctccagcctcctggtgttccatccctccctggccatcatggcagtgttcccagggctttacccattgctaatctgtcttcatttgccctgggtgagcccactgcaatttcccctggcttcactgccatcttcttggtgtgcgtgactccatccagacctgcccttctgagccactgtagtctccttgatccaggccacttcccagtggtaagggcatgagggccgtaggttcctgtcctctggggaagtgagttttgcaggtagctgagtgctggtttggtagtctctacttttgcatactgtctctgtg

SEQ ID NO: 48821 - DNA, 1351 bp, Bovine  19866880860322
agagaaggattttgtgtggatacccccagggtaaaaatatagtcagattcccttagaatcaaaagcccagacttttgtgggccttgatcaaggatgtggagttaattgacccaacacattagactctagagtctgagtcttctagaacactcaggctgatgctgctctgtccctctatacctaagacggctggagaaatctcaactagaggagcccaagagcaagcactctgtctctacatgacttgtgcattgcgtgaagaggtcctctgagttcccatagactctaacgtggggtgaatatgaagataatgagccctacaatactaggttagatgagaaggattaaaaaaaaaaaagtacagaaacttctccatggttatattagtaacaatatattttgatgatgtaagtgaagcacaggatccaccaaaacaaacaaacaaaaaatgaaacaaaacccaggtgggattagccatagtgggcagacaccagtacaatgtgttcaggaaccagaacagaccagcctcactctgtgatcagcagggaagatagcaagcaggtcagttcccactccctccacatggcatgtaaaccctccatgaacacatccaaccatcttgggaaaggaacatagaggtgcttcttgtgaaaaggaatatccctgattgaacatttatgcttcacattcactgaatatctgtccaaattacacctcagatgctattctaaaatgaaaaaggttgaactgtatttaattagaaaatttaaatccaattaccacttgatcggattaaggagaacagtcatagaaaagaactctattcctagagtatgtaaatatccatcctttctcccctgtttaacccaggaggtcagggcaatgttacactatgtatgccataggggtcccctacgtaaacaccacatgaagaaatgaaaggaagaaaatatggatttcatttctttctttcctcttgttccaccaaagccaaaataagtcataagacagatttttttcaaaaataacataattcacagagagcattctggaaagagaactggcattaggaaagtcacagggcttagtccctcgaatattggtactgccggctatggacagttttcctgccaggctttctgtcaataagtcgaagtaaatatctagttgaactagtaagtcccacaaaagtaataagcaaagttttcaatcttcaaaaatgtctgaccgtctctttcttattgaagaaaagccctacaatggctcataaatggatatttcccctggggaactaatatcttttccaaggtcaaaccttgagttttcttaaagattagcacagcaacattta

SEQ ID NO: 48822 - DNA, 1148 bp, Bovine  19866880919372
catggtgtaaaataactagcaccatgttagcagtcccctcttaacttggaatgatgtagaaaagtgtgaaagcaaggccattcaactaagcattggaaggccagggttggaatacagaccctgccattggctgtgcctctgggttcatcacatcactctttaatcctcaggtcctctacaggacaattaaagggctggtctaaagttgcggtggaaatcactgtgagtttcaaagtgtgttctaagaagtatttgtatctggggtctcatccctactcattgattcagactctgtatgtgtggatggaggggaggagtagcaagaagttggagaatgaggagggcaatgcatatataggttttggagacaattcccctgacaaatccctggttagcataaactgatcaaaattatagatgaggtcactttcagttctaatattcctaagattttattttaaaaaataggaagactgaaaacccatgcagactattatacatggctattacaaggatcaaatgagaaaatgatgcatatggatatcccagaatacagtgctcttaagcaattattaggactcccataattctatgtgctatccaagtggttcatcaaatattaaccaaatcctcttagaatagaaattctgcaatggtaagtctggagaacaggatctacacttggcacttttccttgcgtttctcctaatgagagcatttagtagtgtaataatatccttatttgttttctggtaatgtgaatgcatataggtcagaagagaaaaaactagacatgtacatatttcccagcaaaagtgagccatggaaagcctggatttatctgaaatctacccattttcccaagctcagaagctgcatatcctgaaaatttctgtcttatcaaaaaggtgtatcattttattgtttccaccctgtacccagaagctgatattcatccctgtgctttgacttctaggatgacctttgaggtggagtttgttagctcagtacaaaggagggaagtctctgcctagaaactttcattttcattgagctaacgagagggctgtcacctaaattttcattgttttaagagcaagtggaggctgacagtttcctttcaagctgaatgagaagagaaaacatcc

SEQ ID NO: 48823 - DNA, 1189 bp, Bovine  19866880933481
cacactgataatctctcatcttaaattcaataggaaaaaagacatgtatcaaggttgctgtcaccaaatctcacctgttcaaggtatagacttgttagagatgacagaggggcaatggagggagcatagctcttagtttatagtttgtatctgttttgtatcaaggctaataaactactctctcaaactgcatgatatgtcttgtttagaactatcagagtaagtgaaaatatttaaatttcataagtctatcaaatgtttagacattttgcttctaaaagcaaaaggatgaaataatatccaggtgcaaatgcaagaagcaatgaacaggaacttcagaattgtaaagtaatgtatttgttttttgtcatatggggaatcatgatctggagctcctgatcaaaataacaggtcaattcagccaaaagtcttgtccttcaaaaagaaccaaaatagagcaaatatatgtgcaagttgataggatttggaacatctaagagccataagtatacaaaccaaagaagtcatcaaattgtaaaataaatttctctaagtccagattaatcacttaaaatatacaggagaaaaagttcaaaaagatctagagaaaataaagctttatttaaaaaacatatcactcaaatgttctaaagggctacctacccactgatgtttgaagtagctcagaatgagctcagtagctcagtagcaaacagactctgcctagcaagctctactgaacactgaagtcctaaaagagccccttccctttggctcaaaactggacatcctagaaaagctgagttcttgctatggccaaagctgtccaactcaatagacacaagtttgagcaaactctaggaaatagggaaggacagggatgcctggaatgctgcagtctatggggtcacaaagagtcggacacagcttagcgattgaacaacacggctgtaaacatccccaagaagcagcatattctccagaatctagcccctgccttctgctccaaccccatttgcctgaaaacgtcaccagccccaaactcctttggaatccccactgtcagagtgtacttttcaaaaaactaaaaactcatgtcaaagattcattcagctctttaatgaggaaaccaacatggtgataaaactggtccagaaagaattagaaatagaaaatggcattgcaggaa

SEQ ID NO: 48824 - DNA, 1858 bp, Bovine  19866880959359
ccaccctcacccccaccacatacatgtggaatctagaacgatgatactgatgaacctatttgcagggcagcaacagagacgcaggcatagtgaacagacttgtggacatagtcggggaaggcgagggatggaccaatgaattgagtgagtagcatggaaacatatacattcccatatgtaaatccaatagccagtgggaatttgctgtatgccgcagggagcccaaacccagtactcctcattcaacgttgaaaccccagtatctagctctgaggtggcatgggcaaacaatagctaatcattaaatactagtcaaaatgaactggacaactgtctcctgcacaagaccatctgttgcacaaaaacacatactctagcatgatatttactagagttaagaggcattgatttgcttttattttccatgtcagccccagaaacagcaaatcatcctgagactgttctgcaaaaggagcaacctgagagggacctctggggcctctagaatcttctgttcagtagtagcagaccagcttctggctagtccaccaggatatcctccaaaggaagattgttttcaagttaaagataaaaaacagcctaaatggcatggtctatttggtaaatgggtatgtgcttatacagaggaggaggaacttgtacacataaatgttttcctttactcagaaatcctttggggttttcagggtgaacttctcagtggaaagctggagtttacactggcctatgctgatgcgtacttaattattttatatataccattcttgaattctgcccaaagtattgatttctggagggcagcaaccatttcctgtttaagatttgttccattcaatgagtattgagtaacccatgaatttccagaaccttgggctaaatgggatgaaaacaagagaaaaaagattcaggaacactgctattaagcaacatttaatcatatttgggtgtcaagaacctcctgcagagctgggttacatagtagatactcagtaaacatgcctggactggatttaactaattttgctctctccagagctgaaattttaggaaagacagagggtttaatgtcaggttggaaagtgctatgcctgtgagaagtttaactcaatttatcttctccgaatgctttgtacagattacactcccaaccacctcttgctacaatcagaccctcttaaaaacagaataatgataataatacaatttatcatcttcctagtgatagtatcattcacaccttcatcgaagcccagtgggaggtttggctgtgaggcatcacacaccaggggagtcaggtgcgatcattgtaataatgatcccacgctcagaaatgcgggaaagaaaacctcccacacatgaagtgatttctattaagatactcattttatatcaaatattcaaactcctctttataaacaggagagaatgaaaggacagtctttcagggcagattttatgtggccgagaacaaaagggcacaaatattttacgatcagttttgagatgaaagtgacatgcctgccttattcagtggctctttccatttccagaagtctaattagattgttagtttaatggtagtgagataatttagtggccactgaaagcaattgtgttaatgagaagggggggacagtgcttttggtttcctgtaattaatggagagtttttgaaaaacttcttggttccagtgaagttggcatactgagcccagctgtgaagggggacaaggtctttcctgcttattgctgcggaaatggcctcaggcagcgtggaagaactgtgtaatgactgtcattaagaatgatctttagtggtccaggcagactgtaagtca

SEQ ID NO: 48825 - DNA, 885 bp, Bovine  19866880967175
ccgtggccctgcattggcaggcagattctttaccctgtgcccctgggttcccagggcctacacaaaacaggcacttatttgtggagtgaatcagtagcattgaaacgcagaggcctcgtcttgacagtagtcttacctctttgacagacgttactaggtgcatctatcctaagggcttgttagatgaaacagaaaaagatctttcggttttgggtcccctgggcatcaacagtcagaaagcctagcttaagttttcagctttcttgcctgaaatagcctctaggactattgcaaaggtgtatttcttaataataactttctaatctctgtgggctcagaattcccagagggcatgactgagaactgcagttagtggctttggaagtcccagtacagcccagaatagatgatcagggccaagatattgtcactaagaactgcttgtccttcaggcaagggggaaacagcatcaggctgactcagcaaagctcatgtctcaagagtaaaagatacttactcactgtactgcccacagggagtagacgtggcctctgacttctggattgttattcatttaatattatttaatatttataatttaatatttatctttaaattgacctacttttcaaaattagatttgtactaataatacctatattggtagggctttaagaagatgatagctagctagacacatgatatctataatatattataaaatattatcattaactttatattatataattacatataaataaatatataaatgttaaaatatgaaatattattatagacagtctaaaatccgttgtgcatgccactagtgacatatgcttgccatttggaaaatactagactaaatggctaacttttatgatc

SEQ ID NO: 48826 - DNA, 1163 bp, Bovine  19866880985175
attcaaaagcagagacattactttgccaacgaaggtccgtctagtcaagactatggtttgtccagtagtcatgtatggatgtgagagttggactgtgaagaaagctgagcaccaaagaattgatgcttttgaactgtggtgttggagaagactcttgagagtcctttggactgcaaaggagatccaaccagtccattctgaaggagatcagccctgggatttctttggagggaatgatactaaagctgaaactccagtactttggccacctcgtgtgaagagttgactcattggaaaagactctgatgctgggaggggttgggggcaggaggagaaggggacgacagaggatgagatggctggatggcgttgccgactcaatggacgtgtttgagtgaactccgggagttggtgatggacagggaggtctggcgtgctgcgattcatggggttgcaaagagtcagacacgactgagcgactgaactgaactgataatgttcaaggatcttcttttgtagtttcaattttagtcactatgtcatgaattctttttaatctgtttactttatctctttgattttaaaatttttctttcatttaatcttctatttcacttcaagtattttctgttgtgtttattcactcttgtattccttctggtttcatcttcattttttatattgtattttcatttcttttaatttttttctgacttctctcacttcattattgaggttttcttactctaatttatgttcttttttcatgtctttcagcattttttcatatcttttagttcatttttaaacagtaagttagcatttttatttgttttgtggatatgttttactcgtatatttttattctgcctcttatttctctttttcttttaataactttcatgagagatgtttgaaagttgatcattttctgtctctaatctttatctgaaattaattttcctgaagttttgaagagactagactgtggatagtcctaattttgcagccttccatttccctgcagtgttaaaatgttgacttgttttctaagatttcctgacactgtttcccttcccatttttatctgaatcttctctttccaacctaatatcactgttctctctagtgtcattttaagtgacacaggaattgaccaccaa

SEQ ID NO: 48827 - DNA, 1104 bp, Bovine  19866881006531
gagccgggcgttgcctgagggtctgactgaggggatgaggacagctgctcaactgcagtaattgagcatcaagatactggaaggaccagtctggggcaagccctgtgattttgaggggcaggttctaagaaagcatagctgctcttctgcacgtcctcactgttctctcctaaagaccctggcacgtgtttgttattcacgaattatttgtgcttgcctagtttatttatttattttttattattaacatttttttaaaaacagatctccttttgaagtaactggccactttgactttgaacccagcaactctccaatgaaatggctggcaaaagtggaggcccagaaggtgggcagcttgctcagggcagggcagcgaaagcccaggggtcctgcctccccgcatgccctgcgtctacacaattgcccagctaaaccccagacagctcaggttttttaaaagtagagttgaaataagtcaaatttctggatataagggacactctgacccctgcccaagttttcaggcatcctaggtttttaataaaacagagaagctgccctctgctcaaggataacccctcaaaaccagcagagagatccgggatctccagccagcttgctctctgtcagtcagggtccctttaagatgcaagaacttggaggtaggggaggtcaaatgcaggccagtggaagtttccacactccgtgtgtcccggccagcttctctgtctatctctgctgggaagggtgggccctgttcccacaggcctgagatttatgacttcagtctgggagggggcgttggtcttgacttcttggcgtgaacaatggtaaacagagttatgaagaaagtttggaactggtatccttcagcctgtgtcaggctaattctctggttctttctctccttgtgagttgtgtacacacacacatggtgtgaacatataccggctgtaaaatgagatagagcaatagtgtagttggcctctagatcttgtcaaatatgcaccccaaactaatcaccagacttccatcgaccactaaaggctgcaactttagtgtcacttaaaatccctgaaggtacacacacacatacacatt

SEQ ID NO: 48828 - DNA, 1195 bp, Bovine  19866881009413
tgattgtaattgtgcagtagtttgagtcattcttaggctttgcctttctttgggattggaaggaaaactgaccttttttgtattccggtatagtcaattggtgcctttgaattgtggtgctggagaagactactgaaagtccctgggacagcaaggaggtctaataagccaatcttaagggagatcaaccctgaatattcactggaaggacttatgctgaagctgaagctccagtattttggtcatctgacgcacacagatgactcattggaaaagtcattgatgctgggtaagactgacggcagaaggagaagaaaacgtcagaggataagatggctgaatggcatcactaataccatgaccatgaacttgggcaaactctgggagatggtgaggacagggaggcctgccatgctatagtccatggggtcacagagtctgacaccactgggcaaacgagcaacaatagcatagtcaattaacaatgctgtgatagtttaggtgggcagcaaagggattcagccatacatatacgtatatcccttctcccccaaactccctcccatctacacttccatataacattgagcagagtaccctgtgtaatacagtatgtccttgttgcttatccattttaaatacgacagggtgtacctgtccatcccaaacttcataaatgtcccttccctccattcttcccatggaaaccataaatttgttctctaagtctgtgagtctgtttctgttttgtaaataagtccatttgcatcatgtcttttgattgctgggtgataagtcatggggcatgaactcctcctctgttgggagaagatatcagctccactcctctggatcaggcccagtgagttggggctcagagcaccctcaggttattcatattcatgcttctccactgttctgcaaaggtagcagtttgttttaagagatattgctcaaaattaccttaagattgacaaactcaaagcaaattttgacttagagggagaatctaaaggactattagcaacagctgtaaaacctccccttattgagtagtgtctcctgcacttcagagaattgcagctttagagagtgaaggtccttcagttcaggagctttaaagttcttttaactgttatcggtaagaagacttccatctcacattgcaaaatagtgcatacacatgattcaatga

SEQ ID NO: 48829 - DNA, 1291 bp, Bovine  19866881032072
ttattattctaattaacacatccactggtcataaccgaaaataaagtaagctaaagacctgccctaggtgaccctggagctatgattgcggatcagtctttcagatgctaactcgctgcctctggagtgtgcattactgattaaggaaatgcaaatgttacaattctcctctagggcatagattaaaattaacacccacttaccccatatgttttctatgctaataaattttgaagtaaattacagataatttaaatagatggaaaagaatatggcatggattgtggacagggaaggattatcagctgaccaatagatgttgaggaaaaagggagaaagcaagttgtataggaaggtttttggcagattggtgaatcattgcattgcaggttgagtaggtttgatgggatagcctatggatagggtgaccatatcatttattgtccaaagagggggccctttggagagtaaaaagggacactgttaatgataatgctaggacaagagaggtaaactgtcctaggcacaccgaggcataaggccgactcagctacggtcattgaattaaagcgtgaaggagacagggtaaacgctgccttgggtgaagactcatctgtcagacacctctgctttggctcacctgagcacagcagagtttccttggagtgacttgggaggggagaggggctacctgggaaaggactccccctgcctatacttggtcaatcatctcagatttatttatcttcagctaatgttgtgccctactttctcagagcagcatttcaggaacatgttctatttcttcgattttttttttattttgtccagagcaattaaacagtagtaaggaaactacctccctcactatttttcttatctgaccttgggcagttacgtcttggccctgagactcagattagcaggtattttttgagaaactactctgtgctggtgaagggcttttccacgtgctatctgaagtcctagctgctctcagaagtgtgtgggagagaacaggacctgtttcatccataaatgaaggtacaagtatctactctatttttatcccagagtttgtaaaggtaaaatgaggtaagaattccctgaaagtcagagaactggctatcctggttatgaggatagactattttcaccaaagttcaaatgagagtcctcaagattcagcttagaatgactgatgaaagtactaccaaaggaggtaattcaaggtatttgcgagctgctgggtcttaaagcaactaggtagtaaaaatcagaatacaatttt

SEQ ID NO: 48830 - DNA, 731 bp, Bovine  19866881062437
aatgaaatgacaaaggaagtatctttctaacagtaaaactgggatcattattagagtcttcattcatcactctgcattctcaactaggcaggaagctttctgcttcataagaaatacaggattgaaatatcattgcctatattatatttgaaaaaccagaggacacagtcattttatatttgctgtgctgttctccacttactgctcattctttagaaggtaatactggcaagggtagaacaaaggcagaatcttatccaggacatggaccactgttctcaaatgcctcgactggaccagaattcccaagagtgggatgccttctgcacagaacttctcaatgctatggaaaaagaaaaaagcaatgagcatataaggtaatcagttcacaaaatgatatccttttaatgcattatcagcctacaagctacccggattatctcaggtctccaacacatttatacagagccaaatttcacacacaaatgctacaatcataaccccaggaggaagcagcttggggtggagaaacgtatgagagaggttaagaggtacaaacttcaaattgcaaaataaatgagttatgggtatgaaatgtacagtgtgggaaatatagtcaataactatgtaatattttttaatggtaacatatcataaccagacttaccagggggatcagttataaatgtatagaaatactgaatccctatgttgtataataggagctaaca

SEQ ID NO: 48831 - DNA, 2065 bp, Bovine  19866881067518
gcaccgccactttgggcatgtaacttaaattgctccttgcctgtatttcttcatctgaaaaatacagacaaaaaagaatatccacctttcggtgttgtggtgaggataaaataagttatataaagtgtttagatggtaccttgcataattaagtggtatgacatgttggctaaagctaaccttccatttgaagtctttacaatgtcacagacccaactttggtctgttgacaagctctgcccaagtgatctgctttccacgcggccctcctacctctgtcttcagtgactccccactatctgcagcaaacatctttacttgggaagatcccaggtgatgatcctttccaatgtgagctccaaccttcccaacgtgaattcctatcactactccccaagacaactgaaacagacggatcgagccactgacccctagatagtgactccattcccacattcttctcactgaatccaaactatcatcaccaaaatcttttaaaatccagctggagcccctctctcttagaatcatctcaacgattccacttttcttttcatttctgtctgtctgtcctggaagactcatcagcacttatggaagtaagtgatcagctttgtgtgtagcttggtgctgtactaaatcgcttcagtcatgtccaactctttgtgatcacacagactgtggcccgccaggctcctctgtccaagagattctctaggcaagaatactagagtgggttgccatgctcttctccaggggacattccgatatgggcagcttcactctccccaaaactattaaatgtgggacatggatgatgtactaaatatttctttcagtctttttcaatgatatgccaatattaggaactcaaatgaaattctctgaactatgaggaaactcaatcttacttgaactgttacaactgctgctccttggcactttttaccactactgcctctgcactccaaatgtagtgtggtctgttcttctcgattaacatactgcttgggcattgtgtccaacagttcactatccagcgcaacctgctgagattcccgaagagctgcagttctgaaagacatcatcaggagaagttattttaaaagtcttaggaaaaactttatgatgaatgataaaggcttccagtcactcccagcctgcatcggtgaacaataacacaagaatctcacagtaacaagagaccaaaagtgtgtgctaagacttacccaaaccttctccctggcagtcactggtcaacaagaaagttaagaaaggaaagaaaagtataacaactttttggcaagaaacaaagctccatttaaaatttgtgttatatcaacaatgtgtttttttttaaatgaacccttaagtacacaagaacaaatgagaatttcatgctaatttaatcatcctaagggggaaccttttttctaagtaccagtgacttcttaggggcttccctggaaggtcagtggtaaagaatccacctgccaatgcaagagatacaggttcaagccctgggtcaggaagatcccctagagaaagaaatggcaacccactccagtattctcccctgggacatcacatggacagagagccatggggtcgcaagagagccagacacaattcagtgactgggcacacacatagcgacttcttaggcatcagggactcaaaccgacgtgtggagaccagataagctagttcaacactgtcctaactgtattatctcagtaatctgcaaggagcctgtgcggtgtggtgccaacaacacacacgacacgaataaaccaaaaacaggcccagtaatagatggatgcctatgagttttgcaaagacaaactctttcactttgtaagtaaaacacacacaatcctcctcacatgatcacaagctagaatcaaaacaaacagctcatcattctgtagccaccatgacctcagaatattaaatgagtatttcctgcccttccatcaagtatctatgtaatttttaaaagaattcggacatttagagagcaaagcagtgacaaaagaaaataaatctcattctgttccctttg

SEQ ID NO: 48832 - DNA, 1794 bp, Bovine  19866881082595
ttcttgcattgggggtcttgcgtggaaagagcattgtcacggcccctttcagagatgttcctttgcattcagggacactggagagtatgaggatgaatctgagggaccaggtcatctcccagacccacccagcttgggtgcaattgagagcctgattaacgagaattgcatttctcttagtttcttctccactaggagcagcattctgagccatcccttggaagcatcagactaatctttttatagaatctactctgatttatttttggccctgagacctaccccctcaactcaggaagcttcacacagatatttgagatcaaagtgtccagaataattttggctctgtagtgaggtggttctgaagtgaaatccctgtttgtagtcagagccagcctcatgttcgggcagaacccaccattgcttatgcgatggaacatgaagggcagtgaaaagaactttaaattccactggaatgtatttctctcataagtgcttaaaagttacatcagttgagagtaagagtatagttggatgaggtagcatgacttatcttcagcttttttaagacaaaaatccaaaaggaattttttcataattgctatggattagtgctaggttgttttcctcccagggaaagtctgaggtgaaatggacactgggatcaatgcagggcgggagattgaaaaggaaacatgggtggggttatgatatatacacggctatagagaaaatagctaactgacaaggtcctactgtatagcacaggggcctatacccagtattttgtaataatttatgatggaaaagaatctgaaaaaatagatatatgtatgtgtaactgaaccactttgctgtatacctgaagctaacccaacattgtaaatcaactataatttaattaaaaatataattcaataagaaaaaaaaaggaacatggagcaggagggatacaagggggtggaggagaaaatgtaagaagcaaacgtgcgttttcccagtcgccagtcttacctgcaagaaactcggtcctctcaaatcacccaaaacatcaagctatcattaagagtgacaaaccccaagcaaaacaaatcaatgtttctgttttcataaattcagagaaagtgatatttctttttccctcttcagtagtttcaaacacagggcaaatattttcctactactccgtaaatctggagtctgctgaactgtagggaattttctcttcaaccatactccataacagcatcgaaagagaaaataaaacctccgtaccaaaggcatagaattttagagccagctgactggctggagccagccctggtttccagtgagtctcagccagcatcctccattccgcgtgggcgagggcctggtgtgctgtctagcaggctccgtaaatccctcggttttagggccccctcgtgaagctgccaggcaggtatatattgtccactggagcctgagggctctgagatatacgatctgaaatggagactaggaagagtatatagtcagggagatttttctgcttcggtgactgttccaggtaattgaaatgtacccctttaaggacgagggccattctgaagttttaattatttagtaggaaaggtttctgaatggtagtgtgtgcctccttgagagcagtgtggtggaaaactttggaagcaggcagcttgacatttgaatcccagccctacacttaaagggcttccccagtggctcagaggtaaagaatctgcccgtcaatgaaggagactcggggtttgatctctcgatgaggaagatccc

SEQ ID NO: 48833 - DNA, 887 bp, Bovine  19866881102134
ccatagggcaaatggctgggcagctgaggggtggacagagcacctcgtgggggcaattgggcccataccacccagcagagggcagcagtgcctaagagtcgatcctaaatccatccatttactcagacacaggccaaggcaggttgggggtgactttggaacatccttggcagccccatgcgagtaggggatatttcctttgtgaagcctgttggctgattccatactgaggagcatagaaatcctagagccacaaagccctctagagagcaaggtttgtttctgaatttccaggctgatcctggaagggtccacagtgcttttcgtattgaagatgaaatcagctgctggaggtagggtcagtatgtctcagtcagcagagaaggtctacaaggctccttcaagatatgactcctctcttgtgcggtgggtcaaggcccagtggtttaagaggcaaaggcttcgggtctcagccttctcgttttcaaacaaatgtaatttgcatccaatctccacctctctatgtaatgcctatgctagcatgtcttgtagatagattcttttccacctctactcaacccagaaagtctctctaaatttgttcattttctgggaatttacccttaatattggtccttgtcttcatatccaccctgcagaagaatctcagattaaactcattcacccttctcacctcacctcactgtaagatgccccttggggttgcagggaagaggtgggccctgaagtggagaaaataagcccaggaaagcagagcctagggcagccagccaaaaatatttttcagattggtcttctctagactccagcaaggatagtgatttaaaaaggtttggattatgggacaacttgggataagattaagc

SEQ ID NO: 48834 - DNA, 1392 bp, Bovine  19866881129018
atgatgtaacaaaaataacatttttattgactttggcacagaagtacattattttccaaatccatctatttcttaattcactttattctataacgtgtatccccttatttaccatgagtgaagttcatttgcaaacaagaataaaagagaaatgggagaattcatacagacaaccagcatatgagaaaaggaattaaaatcaagttatcaggatgagtttcctcttgtgaaaaatacatactggttgacccaaaagtcaatgtgttagggaacagaaaagaactttgaagtgagtcaagaggcctggatttcagctccgctttttcctacacatgtgatatgtgagcttgggcactcacctggtcatctttgccttggttttcttatttgtgaatctggagtttcaccctctgactcttggcatccatacatagggatgctgcaaggggcaaatggcataatgcatatcattgctccttgcaagattaaaagccactgactgttcaacaaaacatgcatctcagtccatgccaagtcctacattctactgtgaaaggatcaaaaagatgatggaaggaactaaccaccccagtggtgtcagcctttctcactatgccattctgagttttgtctacaggaaacatctgggcatttgcaaatcttagaattaaaaaattaattaagtctatattaatcacatgctgttttacagatatattgctttctgtagtagatattacaaaatgaattacgtatgatccctggatgatgattctatcagcacttttaaagaaagtatgaaatgaggactcagccaggagttaagatctaatttttactacttcttaccagcagtgtgtttttagatgagttgtctcacctccttgaacctccattttctcttctagaaaacaggagtaaacagtaactgtcccacaaagatttgtttgtttctccataaagaacatgagatgagtagataactaactttataaacctgagcgacatacaaattactctgtggtttggctggtttttattatccaaggtcacaaagctcattacagggatcctgggaaaatcagccactgttagaccctgcttttcctgcatgacccctgtaaccttgagcaacctggggaagaggtaattgaacagcaactactacttcggaagaaacagaatcaagatatcgaagctattgattcaatattgactcacccttaaggcagtaaacaatgctttggtctctgaccttttcgcatcctggggcagtcaataacctggcctctagaagcagcgtctgccactgattctgatttgggagtactttaaccttgaactgagctccaagtaaccaaggcaacaggaagtcagcttctgcatcagagg

SEQ ID NO: 48835 - DNA, 920 bp, Bovine  19866881149094
taaataaggtaatgaaatcattcttaatattttaatagttgcgagacaatctttaatattaggtgtagctttcaattgccaagaagtttgaattcaaagatttgtaccctttgacctttgaacaatattcttttcccaaggtggggaaagcattcccatgtgtcctgatcacatgattcacagaacataagctaattcacacagagtgataagaaagaaaaccccaaggggcttattctccaaagacatgactccctggtggagaaatttcccacagtcatggtggtctgtattttttggcaagagtgtcttcctatttccctgtcagtcacagaccggggctcctgatctcctgcagtgcatcaggtttaccctgacttgcagtccaatgaccctagcactggatctttcaagcccggcagaaatcatgggaggggtcaaagctgagaagttctgggctttcagtttagtcacaattaaagacacagcgtaagtacttgtagcaaggtcacatcaattaccatcataaagtaggaaagggtgtctggtttgttacactacttctgaaacacaaggcttagtgaggtgccatgactggcccgagtaaccaccagaattcagtggtcaggacatatggctacagccacccctcactgtcagacagaacgctgccttcttatccaaaagtgcctttggggcttggacttcagcagcgtctgcataaatgttgtgtcaccagtgttcatgggcttggagtggaaaccatgtaatttcatacggagagcacggtgggcaagaagatagtgaactagggctctagctgcagccttagagaatgccttccagactgtgggtctcattttcctcgtctttacataaaagaattatttgtagacacttctcttttttttatcatttag

SEQ ID NO: 48836 - DNA, 1399 bp, Bovine  19866881216033
agggctgccccttgccctttcctttgcccgccgctgctctgaacgcgctttgctttctcccgggtcctccttcggccgccgcccgcagccgccccgcggatcgtcaacatctctgtgctgccaggcccggggcacgccttccacgcactctgcacagctgaaggggagccaccgcccgccctagcctggtccggcccggccctgggcaacggctcggccgccacgcggagcccaggtcatgatcacggccaccaggtgactgccgagctgcccgcgctggcccacgacggccgctacacgtgtacggcctccaacagcctgggccgcgccgaagccagcgtctacttgtttcgtttccatggcgcctccatggcctcggcgaccgccctcctgctcggagcgctcggcctcaaggcgctgctgctgcttggcgttctgggcgtttgggccactgcccagcatcgcctaggtgggtgcgaccctaggccaggatgggtgctcagggcaagtggggctctcctccaggctgaccacctggcctgacacaactggaatttcattaatgcacctgtggtctccttctccttcctggtcaagcccaggaggtaccagccagagtgagccaattttaccatcaggaagctgaggccggagaggttagggaacttgcctccagcctagagtcacagagatacagactcaccctattgccaagtgccccatcatccagaagggccctgaccacacacaggctttcccaaatagcaccatttcattcattaggttgcagcagcatcccaagcaccacctacatgctgcataggtgctgggaatacacagaaatgaatataacatggtgccctgcccttgaatgggatgctgagaagtaagcagataaatgcagtctgcagagagaagtgcagtcaacccaggtactgcagaggcccagaggcctctctctgatggggcattgggacaggagccaggcggcaaggctgtgcacagtaaagggaggctaaaccgaaagctgtaagcagctgggagctgggagaacaaggagctagcagtgttcctagcagagggaacagcatctatccaagcgtggaagcttgaactagcaagctatcttcagagagctgtagtcacccctccctactctcactaagctggatgggagatttgttctgtgccccagagaaggggcttcctgagcctctcagctcacctaagtgagtagcaccagcctcagactctcctgggatgaaatccaaaatttgccacagttgccttggctgccatctttgctggggccacactggccttcttgcagggtcttcaaacccaccaagaattctgtgcttcaggggcctcaaaaaagcaggtctccctgctaggtgtg

SEQ ID NO: 48837 - DNA, 1255 bp, Bovine  19866881275270
aaactgtgcatgactgttctgtctttccctctgctgtaaaagaattatggcttagggtttatgggatttaaaaaaaaatgtgttcaatcaccaggatgggagaaatgaggctaaaccacctctggaccctctaatggttttatcatagaattatagctggaatgggctggcaggaactttgagaggtcgtgcagtccatcccccgggctccacactgctttatctccagcactgaggtccgtgggtagccgcctctcctcagggatcacccagagaggagtttgtgtaacactctctggaaactgagccacatccctaagcttacagtacaggaagtgtttcacaggtcctatgaaagtcacatgacctaaggccatttctcttcatcgcatccttaggaagtggaagacttttccatgtcatttttgggaagacttcatttgggagaatgcctccagccaagagggtaggagcaactcctaggggtttcaaagagaggaaacccaatgccaagttccctttgcacagaactgctgaatatcaggcttcaaaggaaattcaggggccatccagtccaagtgtgcctgaagatctggggtcttcttggtggtgcccaggcccttctagcaactggaagcccactgtcccctcagccagtttcttctcctttgtgacagttctcatgatcagatagctgtctctcctattgagcccagattcatattttctttctttgcctttgctgggcttcattctgttctctgaagctacatggaagaattcaaattcctctgaatgacagtcatattcctatcatatcattatcatattcatatcatgtcattaccatattcatattatattattatcatatttacatcataacatattcatcccaacttttccctttccaagaactaagaaaggaccaactcagctttttcagttactctgcccctctcccacctccccaatttaatgtatagtctataccactcagcagaatctcggtcttcgtttattctacctacaaaatcggggtaattctgtcatttgttcctactgcctagaatggctgtgaggttgccttgagatggaatatggtttctgttgcacttttcttcagcgctaacacagttggcggtgagagtgagccgttttctcctcaccattttcagttgtctttcctagctgtgtggctctgggccagccgctctacctctctgggggttagtttcttcctctggaaaatcaa

SEQ ID NO: 48838 - DNA, 1708 bp, Bovine  19866881319447
ctctgtttgtgcaccatgcagtgttggaaacaacacaggcattatacaaacaaaatgtatttggggctactctggggtctagcaatggtgaaatttccttagaggatggttgaaaaaagatgcactgcatcccatttattgaatagagcttgcataatcaaccaagtagaaagaaatgttgagatgcatttaacctcattagtttcagtaggactgactctctccaatccatcagagttgagctacattagtgaaactcaactatttccaaatctcatttacataatggatgagaagtgaaatgagcccaatgcaaggggagccgcccggcggcactaaagtttatcacaatatgtaagatttcttttagatcattgcattaaatttccactaacaagataacaaattaattgtattacctgtactagcccaaagtctattgagtggcgagtaccagtgaaggcggcagctgggatttcaagggctgtggttggggaaggatgctcagagggatatggtgacttttaccttagctttcttctgcccctttaagaaattctaggcacctctgtaatctgatggtagactttggctttattagtgaggtaagtaaggatgagtaaatcaactgtatcagacaagcctcaggacatctagaaaattgatcattctgccgaaataagcactctgtgtttattagctgggagttcatcactatcacttctccctcatccaattcctaagagatttcaaagccatcatcatggtattagctcgtctgactgaactagcagagataaagattaggagatctatctaatgatgggtctgagtttctgtgatttttttcctcttctattgcaaaaaagagagcttttctggtacacattctgtgtctatatgtgtgtgcctacacacagtcacagtggtttccattttataggatgatttcaaacagtggaacaaagtaggtggtttgaagaaagccacactcaaaccgttaaagcaatgcaactttctcacacataaagctaagactacttaagggggctatatgctgaactgacttctctagtgacacagtgtgtccatccagtgggtgatatcacactgagagtaattagattctgcaaccacgtttataatcctaacatccatacatggccagactcctacagataggttcttgagagatgagtacatattcgactgatctttcacaaaccagcaagtatgcatttatctatttatacatatatttatagacacacatgcgtttaagctcctgatatcaagctcttttctcagtgtggcttctaaataagcagtaatcaaaatgcacatcaggtgacccagttagcatcgagatctgtgttgccacgcagatgtgctctgcgtctctgtgttctacaggtaaaaaggaagacactacaaaagatgctcatattaacaacttcacatggaggggaatagggaagaacccctcagagccagtggccttatagcttgtatcacaactgccatttttggcttggtctgtttgaaagctgccctgtagagtgtagaataataagtatgtaccaggagagcaagaagactgcttctgtgaagcctcagattgcaaccccgtgtaacagaaagccaacacactcgcctgagacagtcaaaaaataaagctggggtcagagtaatggccctcccatcctcc

SEQ ID NO: 48839 - DNA, 742 bp, Bovine  19866881583880
ctaagtagacagaaacacctgtggggagagagttggggatcaaaaataagaggaccattgtactcatgcggaaggtgaaaccaagaccctcccccccgcacccaacctaaggccgggttactactcctcacaaaccctcctaccaggacatggatgctcacagccatcagagggcgcctgggcaggccaggctgaaggagtagtgaggcagagagctcggtgagcctccacacaggtggaaacagcagtggtctcagagctgaggatcagatcacatccagaccctgcccctaaccccaggacagccaggcctgctggagcagggccaggcagccccatagatcccagaccagacccagagcctttgaaatacagctgcctcttcctgggcctgctccccgcgcccctgtggtgtcatttccaaatccattacattccaatggctttgggatcttttaattacatgtgacgaagcctcgccattgctggaattagacggcctgtgttgacgatttataggcctcagctttcacacaagcagggtaataaataacatgaaatgggcccttcagtattaaaaacttcagagctacccactaagccatgacagaaagaaggaaaaaaaaatgaaagggtaaaaaaattaaaaaacagtaatgtctgtgtttcatgtttaaaatactgtatgtgaaacaggggaatgtcaaaaatacaggggtgctgagcaatacgcaactcataa

SEQ ID NO: 48840 - DNA, 1709 bp, Bovine  19866880376932
tcacttttcactttcatgaattggagaaggaaatggcaacccactccagtgttcttgcctggagaatcccagggacgggggagtctggtgggctgccgtctatggggtcgcacagagtcagacacgactgaagcgacttagcagcagcagcagtgtgttcctggcccctggatgaaatctcctgcaggactcagcacctctccaggtcctcttaaataacaaaaagattttggtccacttttgttagaggaacagtcttcaaatatcaagttaaaggtcaaaatcctggccaaacctcagacccagacataccctctgtcctatgaacagaaaacccctaggggatcgaagtctgtccccaggacctcatcccctttctggcccattccagagagcacagctaactgccacatcttgggttcaaatgaaatttctgactcaaccagaattcaggagaactagacccagttccctggaccctgaagaagtccatccgcctgactgcatgtcgggtgcctcccctgggaaccagcctccaacaagccacgatcagggtttaccaacaggcagacatcagcagaagctcatgcagaagttctatacttaaccagagatctcatgtattgatagaggctgccccctcattgcccaggccctggccaaaaaccattaagaattcaggaaagtgcataaagctaattgctaagcagcactccagagctgggctctccatgtgaatcattttacagcacaaatagcatggtctgggattgtgcagtgtgtacgccatagggctgactaatgggctgaccacactcccttccttccttcttttcccacccactcactacttctctgtagctgtttcaatggctgggacaaccaactctgacatctttagaaaagatctggatattttcctggggagtggtggttcccaccttgtgccacacttgcttagcacactccattccacagatgctctctctctctttgatgaattttccgacttagctgatacctctttttttccctcctccagccacctccaaagtttctccaagtttcagttctcagccgtcttctatctaccatctatctatcatctatctacctatcatctatttatcatctattttctatcatccatctatctagttatctatcatctatctatttatctatcatatatctatctcagttcagttcagtcactcagtcgtgtccgattctttgtgaccccatggactgcagcacgccaggcctccctgtccatcaccaactcccagagtttacttaaactcaggtccattgagtcagtgatgccatccaaccatctcatcctctgtcatccccttctcctcctgccctcaatctttcccagcatcagggtcttttccaatgagtcagctctttgcatcaggtggccaaagtgttggagtttcagcttcagcatctgtccttccaatgaatgttcaggactccttgcagtccaagggatgctcaagagtcttctccaataccacagttcaaaagcatcaatttttccgtgctcagctttcttcctttcttctatctatctaatacatcatgcccaagatgctctactctggggaaaaactcagctctatatcactaaccctagcctctcccctgagctccagtccaaacttgttgaacccctaatagcaggggtcctcaacccccag

SEQ ID NO: 48841 - DNA, 777 bp, Bovine  19866880388371
tcactccagtattctttgacggggaagcctcatggacagaggagcctggagggctacagtccatggggtcgcaaagagctgggcacgaccgagcacagcacacatttatgcacatagagagagagagacacaagaaacagagagagagccggaggggcagggacagagaggagagacgctgccaatccggccagcagtggggcatgcgtgtgccacaaagatgaccctgaagggacgttcagaccaggcgctccgtggggcgtgcatgtgccacaaagacgaccctgaagggacgttcagaccaggcactccagcaatgttcctgggttgcagagaaaaccaagaaaccaaagacagatacataaatacatacataaataacaaaccccttgcaaacataacagatgtatgtcatgttcaagtacgcggccatccaggaaactttagttcagctcctccgaacataacaaatggcttttttgttttgctttgtcatttgtttctccctaatgcagacaagaaaaatattcttgaaaagcagctattaatggatagtgacaagtggtttcctgtggtctaagaaaaagccatcaattactgccttttacactcttaaattccagaggcagaggaagttcaataacgctgcactggcttcatggttattgactgaagaaaaggaatcgtaagataaaactttttttccgttttaaatgaagttataaataattttaaaacttgaagagtacaaaatttcagggaatctccaagcttcca

SEQ ID NO: 48842 - DNA, 1599 bp, Bovine  19866880455397
cgaggcctctagctcttcctgctctccctgaatgaggagccccgttcttggcatccccgggcacgaatggcagagagagaaaacaacactttaagaaaacagatagggtcagagctccagaaactctggatcagagcagaaatccattgagaatcctacatctggtaatggtcaccagcctggaaattttaacttatgcatctgcaagactctgcgggtgtgtgagacattgccgtccttctcaacaccaaagggagctgtatcctgacctttacaaaggtggtaccgggtctaatgggaatggtgccactcccattagaagttttgattggcagttagataaacctctgacacaagaatggggaaacaagttatttttaataatcctggtggggttttttttttgatagatgaaatttttccaaatataagattcatatggggaaatgtgaagaagctcctcaaggggaaatggctgaggacaaggaccctggaacaccccagtcctcagatttctccaggacagttcaccccaagaaaaggattttagctgcttataaaccaaaggagcagttatatagtgctttaacattttaatttttttaaataaaacttttagggagctgcactgtggctggtctctatatatatatgaccagggactagacttcatgtatttacttgtgattcgaaagttcatttgaggtagctgcatggaattcccgatccaagtgaatttgtaaatgtggtctgaatacttgagatagtttgctgcatgaagaggtttgctgaacccccccctttccatgagatggccaagcaaacaactggggaagaattaagcagggttttgcagtagctttctgtggagctgctgagcaaaatatcaaagtagtaatgttgtgactgtctttttcatgcttggaaggggaaaaaaagaaaaaaactgtcgaagtactgggacaagatgaagaggaagaaagatggacagagtgaaaagtagctttatttacagtttatctgtgagaccacgtaagcttggggatcagaagccctgaagtccatttcgtctccaaggcctacagtcatttatcttgtgttgggctctgggaaactccaggacctactccacttgtggtcagtttgatttagtagctggggttcaagatatttttttttataacactaaagagtatactgaacatcgattggctaaaaaaaaaaagtccaatcttgagttagttcccaaaaggcacagctagaataaggtattaatggggattaatgatggcattgtggttcgatattagcaaaagtccagggtcaaaaataaatgtgtacacctcaagggaagcaggcaagtccaggctggcaacagtgcaaagactggaatttaaaaatacctaactagtatattgatactttttcttctctctccttccagattttcctcttaatgtcacctttaaaaaaaaaaaaattgcaattgaatcaagtaagtccccagagaagaaagtttccttctgactacgttttcctgcagtgcttttggtgatggctatttgggtataattcccaccatgaaaaaagggtttttat

SEQ ID NO: 48843 - DNA, 1455 bp, Bovine  19866880473528
cactcaccatcacacatgggtgatcacactcgtctttcttctctaccagaaagtgacggtcccttccaccttactcctctctgttttgtccttatttgcatggcctcctggcattatctcaaaacaaactaaaatctcttccagttggatccccgaggaattccagaggggagggtttctttgtggcttctgtttgcttatggactctgcacggtgtttgcaaattctacagtgctggaaaacttccagacctatttaaatccgttttccaattacccagtgccatcgaagatgtcactgacttgcagtgaaaatccagaaagagtatgtgtgtttggagtatgtgtgtgaacgtccagaattttcagaaagcacgttgcttgcaggatccatctgctagaccaagtttctgacaatgaccttgtgctgttggctcctgtatccagaggctgttgggccctgacctgggtgagtggccagattcccagtgtgggaaagacttagaacttattttagaactgtgcctctcaccatcagtttgggggctttcaagatgcacaggtgagccatcactgcaaggaagttatgtctggtccctcccacctccggaaaggctccgaaatgtaagaaatctatagtctgattactttgggaccaggatttttttttcattttcattttgatgtattgcttaatattagacctgggagacttcgagaggtgatttcgttgcccgggacctttggggcttctatctggggagtgaaaagcgtgtgtgtggctgcttactgcccaggggcctttagatgccaactgaatttgtcgcacttggaaggggataaagccctggaacatctctccctaggatattccgctgtccccactggcagaaatgatgatcctatggcctaaaacaaagtcttatttagaaagaaatccagctacagcgtatggtcatgtgaccagcagtgtccccccgggggaaagatgctcatcagggactgtcttagttggttcaggctgctgtaccaaaagtaccttagaccaggtggctcagaaacagcagacacttctttatcatagttctgcaggcttgtccaagatcaaggagccgtcatggtctgctccttggctcactaatggctgtcttctcccatgtcctcccatggtagtgttaccaaaaggcgtggggtctgactactcgcagccacaaagccagtaagcagaccaggttggcagaaaggaaagttggctttatttccgatgccggcaactgagagcgggagggcagacatctctccaaagtcaactcctccgtgaacaggcaggggatgagagctccataggttgaggagggggctacatgcggaaacagcacactcggctctgacagtcatctttacactggccatcagtggtctgacttccgtcatcttgattgctttaggcacagta

SEQ ID NO: 48844 - DNA, 1430 bp, Bovine  19866880783198
tgagtttttgtcgttgtgtctgatgtttttctttctttaaaaaaaaaaaaatgactcaaaagtttccacttgagttccaatcaatatgctgcagatgggccaagtcatcctggcagagggaagagctgagattgtgttcctgcgggtggtgccaggaggcagggtgctccaagagagggcaggggtgaacgctgaagcttcagagacctggaggcagcagtgagacccacgcacgtggccagacctggggctgtgggccgctcccgggtgaatttcggcgggcacttggctcctcccctcgcaacatcactttgtgacttgaggactgactagctcatcacctcctttctccagcccctgaaagtgagagatggtgtggtgaagggtggtttacctttcctgcagaaatgtgtgcttgcatagctgaatagccctttagtaaattaaaatagagtccttcacggacataacattgtctacatttgttctcctccctgagtgatcttcagctggcagtggtcctgacatactcagttccagcgtctctgctctcggctcccttgacaaggagtgaatgattatttaatggggaatttaagaaagtgctctctgcttggagatatttatatatattcccaaatattacatatataatattaatatcaaagactttctcaagcacaaggcagtagccccacagccttggggctgacagctagggactggtggctagatcatgcacggtactccctcacccaagaacagcagccttcatccagagctcccctcgtggttacaggctccagttgggttccagagttctgaaactgtggactccaaatggtttcaccagtttgatggctgctttgttggagggagcaactccaagatcttcccactctacattttgcatgaagtcccttatatggatgtattgtgaaattcatgtaaatgttatctatctaaatctccatttcttactttttcatcaactgttttttaaaaattgtagtgaaatacacatggcacagtatttaccatcttaaccacttgtaagcatatagttcaaaggcgttaagtatatccacactgtccaactaacatcacctccatccactcgcagaactcttttcatcttgcaaaatactgaaactctgtacccactgaggaaagactcccctttccaccctccccacagaccctggtgacagccatccaactatttgtctctgtgaatctgaccactctaaattcttcattaagtggacctactgtttatccttttatgactgactcatttcacttagtacaatagcctccaggtacacccatgcatcagaatttccctctttttgaagactgaataatatttcattgaacaaaatacaccacaaattgcttatccatccatccatccagccacgaggaca

SEQ ID NO: 48845 - DNA, 3127 bp, Bovine  19866880787964
gaggataaattgcctatgaatgcaaagcaagctaaagacccccagccacacagcagaaccttcttgatcaatcagtgctgtacttgcctgcgtaattttcagcccggtgtcctaagtcaccttggacctcacttccactgcgcgtgtgtggtattggcagcatcttgcccacctggctttatttggacaacttctgacttcctcttgtgtaatcttttccagttgggcagtggtctctttctgaatctcctctgtagttgccagaccatatctccgtgagccccgtgttatcacgtgtgttatgttctgcgttagtgcacacgcaagcagaaccctggggactgtgaagctacagcgtatctggttgtgtgtggggttcattatacagcatccgagttggactgtgctttgggttctaggctggggaaaccacaggctgttaccgtcaaccttgaaccttgtctcatagataaggattagtgggtacaggaggacggaggtggcaggtggggagcataggattagctcgaatactggaataggtccttcagataaagggtcaggaggatccaggtttatgttaacccgagcagaaaaccttgttcactgattacctgtgtgtaagttcatatccaccctgaatcaagtgcaactcccacgttcaaaaccagcgctaatatagactcatttttggaagatattggagagcaatgtatatgggacaggacggtgtgagaaatctttgatcttatgtcagcttttatatgttccgttaccttacttcctaagatctaaaagtggactctcccccgagtgtcactgcaatgttcgcatctgcccctgaaacttaagaccagcctcacaccaagtatggaggcagaaataaggaagggcagagatggggacagggaaaaatactgtgtgtgatggagttcttaaattggattggtagagaaattcttggacttgactaagtttatttgaatataactagattaagcttctgcagcagccagaaggaaagactcaaaatagcagtagagattaagctgaattatattaaagttacatgtttgcatatccagcattatgatttataaagtttgcacccactgtgcatttaaacaaatttacagaattcattagacttatgctttctgtacttgaattaaggagataaaagttagtttcactatagacaaggtcaactttattttatttttctgaagccagattatgaatcttaatagttttttaatttaattatatttgctgtacaatattatataaattagaagtgtacatatatgatataatgattcatgatttttaaagattatactccatttatgctgctactgctactgctgctaagtcgcttccgtcgtgtcccactctgtgcgaccccatagatggcagcccagcaggctcccccgtccctgggattctccaggcgagaacactggagtgggttgccatttccttctccaacgcataaaagtgagaagtgaaagtgaagtcgctcagtcgtgtctgactcttagcaaccccatggactgtggcccaccagggtccttggtccataggattttccaggcaagagtactggagtggggtgccattgccttctccaactccatttatagttattataaaatattgcctatgttccttgtgctgcacaatacatcctgtagcttattatacctaattgtttgtacctcttaattcccgacccctattttgcccctccctattccctttccccactaggaatcattagtttgttctctgagagtctgcttgttttttgtatattcactagttagttatattttttagattccacatataagtgatatacaggatttgcctttttctttttgacttatttcatttggcataatgccttccaagtccatccatgtttctgcaagtggtaaaatcatgtttttttatggctgcacagtattccatcatatccacctggagaagggaatggatacccactccagtattcttgctagagaatttcatggacagaggagcctggtgggctacaaatccacagagtcacaaagaatcggacacaattgagtgactaacatctagtatatttatatgtcttatcttctggatcctatcaattttgaaagtcaaggcaaagaagcccattttgttaatagagcaataacatatacagaggtaataccatcagcatagtaacttcacaattaactaattgtgcaattttacacaatcttcaattatttcttgaagtaaatttatagcagcattaacttcaagttatagcctcatacactgaaagcaaattttgtgtcatcttctgtccttaaaacatggaaagtggatgtaggaaggaacacatcttctagcataatttttctattgacccaaaaagagatgcattagaaatatatgaactatttttgtagtgagataataaataccaggcccttaccttcacaccaagggttgaagagaatgtatgtgtccgtttcggggtttcggctggtgcggatgaccccatagggggtccagacagccacgtacatgcggaacttcccccccaatgcagtctgcagaagactggacagacagccgggacagacctgtcctctctcatgaccaccttcgccccccacttgccactctgcagctcagagaccaaagggactggaatgtaggttcccttattctcctgggggtagagacctacgggaagaaagaagaaacacagccttgagatttcacaagctacctttgttctctgtcaccttaatagctgaaggtggaaataattcattagacttgaaatagtaaaacttgggtttgaatttcacttttgctgccaacttgctgtctgatggcagttacttttcagaactttttgaaggtcatattcgtctggtctatattttttaaaaaagaatgacagtacttacaaagatttttgttggttggtcaatgcactcaaataaggtgtagaaatactaatcttggatgcaaaaacaaaacagagcttacagggtgatgtgaagtcatcagtaccataaattctgctctctaaagacttagaatggctttaaaaagccctaaaaaggga

SEQ ID NO: 48846 - DNA, 1563 bp, Bovine  19866881064966
ggcctccgtgaacacttattaagctggcatactgattcttgctttgtctactggcttaacaagacacagtttagattgaaggaaacttctcatcacctaggctccattcgccacaaacaggaaatgaatttgcttatccctggcccacttactggcagaatggagcaactcattgctaagccatgttttttgtcttttagagagatattgtagctggaaacgtggcagttttctctttcaaagtgacagctttcaaaaagtctacctaacacaatttagcctaattccaaaacatcagaaaatggactgctaaaaaaaaaaatctctcctcatgagccagctgcctccctgtcctcctaccctcctcctaataagaaaaaattggattaaaagtagattattttctccttagtttgtaaaaatattcttcagagaatgattatacctgtcacagatggaacccttaaataagttaagtgtttaggttcacattctaggaattccctagcgaactgagttctccatgcaatctctgataatataaacgataggtataaacactgtctatgaggaggtaggtctctttattgtgaaaacagcaggataaagttttctttctcatattccttttgaatacccagaattttaaaccatcattcattagaatcattaaaaacattttcttaaacagcttattttttttaactgtggctattaatattaaaatgtcctgtactctgagggacttccccagtggttaaaactgcatgcttccaatgtaggagacatgggttcaatccctggttggggaactaagatctcacatgccgtgtggcatggccaaaaaaaagaaaagaaagatgccctgtatcctgaatgtgtaagacatgctcagcagaaactagaatgagaaaactgagtctaatgctctctccagggactaaaacccctctggtctgtttctcctctggcctgaagtatctcagcagcccccaaatgtgcctccttctccccattttctcaatattagcatttttttttaataaacataattctgatcgtgtcacttgctaattagaatccttggcaagtgtcctgtgtctggaggaggaaaggtaaggtcttcaaagcctgttagaatatgattctggcttacttttcccaggcgcctcccccctctattgtcctcactacttaacatacactgttccctctgctagaaatgcccttccacgcactcgtctgcccggaacgctcttactcatctgctaagccccaactcaggtgtccgtccatcatgaagcgctcctcaacctcttccccagtccactgacaccactggtcactcctctcacctgtttgtttcaaccactaggtggacagttgcttgaggccaggggttgacttgttcatttttgtgtccccagagagatcttggcatagttcctgacacaatcattgaacattttcccacaaatcaagagaagtgtgaactggttctacacagcatcatctcttaatcatacactgaaggtcttttttattctttcagtaatcttgaac

SEQ ID NO: 48847 - DNA, 1072 bp, Bovine  19866881082602
ttcctggagcctcctatcctactgagggccgccttttgaatccatgaacttgccttgactttgaccctcgaattctgcctttttgggtgacacacacctattgcgttctttgcatctgagcatggaccctgcttcccccatggctcccagaccagtgacttgtccagaagactaaaactctgtccctcaactggagacaatctcagaggagcacgtgcgacctgtggccagatgggccagatggggcggcaaagtgagcggccttcaacatgcattttgcctctagcagcctcccgtaataacagtaataataatgcacatcctctggtatttctagagggccgtgtttgaccacggggatgtctaggctactgagatgtgcctgacaactttacagagacttgctctgccttgatcctgttggcctcgggtctctttattctctgaggtggaatatcctctaaatcttagcactgaagaaactgggctgtgtttctgagccccagagaccaggctcctaaaatagtacgttatgtaagtgctgtgttttgccactgcacaagaaattgttctagataaagtttattaaacgtggcaagagaaagaagaataggttttcattctgagtggtggagctgggatcctgccagcaccattgacggtgtctggggaaagccaagggagacacagacaggggctgccttgtctcttttcccaaaaatgcaaagaaaactaaatatagccgagtggaaggcatagcaccctggaagatactgaaaggtttaagttattcacatcttcccagctgattctagctcacagatcccctttaatcgtcaatctggaaaatatgctcctgattgacttggaaaactttctctgcaacagaccctccgacaatagaccctgacctgcttgatcaaggtctagaatcctgtgtttttttgcagtacactgcaatgtacgttcagctgcaatgggcagtttattgcatgcagttagtgccacctgcttgcagggtaaagcaaaaaacagtctccgactcccttcaggttattcaggacaagcctgg

SEQ ID NO: 48848 - DNA, 1138 bp, Bovine  19866881151642
tgtatatgcccatcccaacctcctgtttacccctccccccaccatccagcactttggacatggacactgtgcttgaacccctctctgtctggttcttaaagttacatctgattagttcaagtagcacacactaaagaaagcttgtgtttggtttgggactcacagagcctggattatctgcttaggtgactcaaatcaattagtcagatttcccctggcttcatcctgtgcactgttctgtagacgtcagagagagtcacacaaatgcacctttagcataaatttgaataccctttgtgaacctaaggcgttgggacacaaagcctggtcagcaagcatcgttaagacaagcagcatgtgaaaggcagttttcttgttgctagtataaagcagggaggaactgccagatgtgaagaatcactaacattagggtttatattctggtgttgatagtcacttggaggaaaagttacattaaccatttcaagggaggggttaacctagttgaatttgatccagtagagggcactgtatctctgtccttatgtatatacatgtacgtgaatattacatactattaaatatgccctgtattgcaacaatgtaagataatatggggcatatgtgtatattttacattttcctttaagaacctctttcccccaaggatgagaggctgctaggacatgaaaacatggcctgtagatgagtggtacatggtgaagcatttaaatgaaaagcgggcactgcagtgctgtatgtatatttaccatccttattaacgcacttctgcagtcagatatatattttttcttttcagaatcactgtttttcttgattctggcttttaagggaagggatgactacattttctttatcttcaaggagaaggttaatttcttgaaaacgacttcacggctcaacatgtcaggataactgctgattttaggctttgtttttcgcttgctgcggcccttggagcactgccggtcagcctgggcgcaggcgcgggaggtctgcggtgccccgctccccggcctgcgcgcagtgcaggcgcgctgacaggtgctggcgaggccccggaagacatcgcagggagatgctgcggcggaagaacgccccccgccccgctcaggct

SEQ ID NO: 48849 - DNA, 1554 bp, Bovine  19866881246961
tttgctaggtgaagggaaagagctgcatgaaaaattgccaaagaagctcatacacaggagtcgcacgctgacacctaaaaggcggaaacacggctccatcggtctgatttcccacatctgcatcgtgagccagatggaggaaaaaactgacttctgaaaggtcactgattttgaaattcctaggacagaaatgcttccaactgggagtaaatccaccagtcactgatgtgtggcaggctaatccactttatggccttcatcaaatatttagagctggtacggtactcagtggaaaaacatagaggataagcaaggaatatttagtgcctatggtttaaatatgcacaagctagacactttattaaaacatcagagccatttttctttgaaaacaagaacctcttagtggatgttagaaacagaattcatgagactatatatccatccatcctaaaggaagtcagttctgaatattcactggagggactgatgctgaagctgaagctccaatactttgggcacctgaggcaaggaactgactcagaaaagaccctgatgctgggaaagattgaaggcgggaggagaaagggatgacacaggatgagatggttggatggaatcaccgactcaatggacatgagtttgagcaagctccgggagttgatgatggacagggaagcctggcatgctgcagtccatggggtcacaaagagtcagacatgactgagcgactgaacaacaactctttttgagattcttttccagtaaaggtcatgacagtgtattgagtagaggtccttgtgctctgcagtcagttatctattttataaatagtagtgtggggataaattgggagactgacatacacgcaccttcctgattcttcaaggtttcttactctgaggtcacctgctatctggtggattcataaatggaataaaactgttaaatatttgtacaattttctggagagagagtctgactctaaaggggctgttgacacccctctgacctgcttgcccgcgcagagagagcagtccactgtgtggtttgcatactgaacctcttccacgcatgggtttatgaaggcatgtatatttaatgacacttttatgaaaataagacaaatgaataaacaggggtggcataaccacaaaattctgtgccatggcttcagagtgtgcccacgccttttccattcaccttgctagtacaggggggactgggcacaagatttgggaactttatagcaaacctttcaccttcatgagagaaaaaattaaacgcgtgtcttactttacctgggtcagtcaaggaagatggcagatttgaatttcacgtggagatggctaagtgaagagggtgtatgacttaaaacaaagcttggaagatacaaaatgtcaactgggaatttagctccttctgtcatgaaacacatcgggcttctgcataagatacgttttctacaagctgaaagaaagctctcttaatttttcagtgatggtggacacgatgccatctctgttcctccttcaacctttccttgctttttct

SEQ ID NO: 48850 - DNA, 1333 bp, Bovine  19866881286998
ctgcattgcaggcggactctttactttttgagccacctgggaaggccttagacactggtacccgccgacagtgagctgactgcctcgtggcagaggagcaagattagaattctgaggataccagtgttactgctgcctctcgagtccctgttggcactgtaaaacgttattgtgatgtccctggctgttttacactagaaagtagaatatatatatttttttaattatttatttggctgtgccgagcctcagatgtggcactcgggatcttcgatcttcgtggcgtgcaagatctctttttttttcttttcagctgtggcatgtgaagtcttagttgcagcatgtgggatccagttccctgagcagggatcaagtccaggccccctgccttgggagtgtggagtcttagccacagaaccaccagggaagccccaggaagtagaatatattatttacagaaattccagagaaacctgggccttacccttttccccagagatccagttattccacaccgaccagctggggacctatccatgagagtagacgggaactggctgtccgagggccacgcctgtggaccagatggagacctttagggacgctgcgtgtgcaaaatagtataaagtttcttttcataaataattacaaaattaaaatcatgctaaattgtaaaacaaaagtaaatacatatacaccaaattcaaagccttctatttttttaatcattttgagtgtaaaattctgagtagatttatggaaatagaactcttcgcagttaactgctgcccgtgtgcacacactctccgaagcccgtgcttcatctgtaccctgagtgtccagagcagctgcggacacagatggaattttattttgctttctcaaacaagcagcatattctttcctgggccaatagccacattttaaggtttcccaaactaggtgagttttgttgttgctattgtttgtttgtttgttttgctactgccagaagctcctgaccacttaggttagcaagcagtaatcaaatggcttggctcccgaaacctggacaggcaccttggctgaactcttaaagcatcggactcccagtctggaacagctatgcgctcatgtctccttttgtggttacagctgccctagaaaatagagggggaaacccagtgagaagaaacaagatttcactcggttctgcttcactagctcacccagagctcccagcttccaggggagcccagcgcctagcaggtgtccggaggaatgaaacacgtgaacctccaaactaacacaggttccgtcagcaaacacagctcagatctaaaccaaacatctc

SEQ ID NO: 48851 - DNA, 910 bp, Bovine  19866881342547
ccttgggacccttctctgctctctgagaccagggggaaagcccccggcacaatgctccaggtcccgcaccagcctccaccctgtgggccagctgaatccctgtgttgtcctctcctctcccccaaatagcccttcattaaccatcaagatcatcagggcttccctggtggctcagctggtagagaatctgcctgcaatgcgggagacctgggttcgatccctgggttgggaagatcccccagagaagggaaaggctacccactccagtgttctggcctggagaattccctggactgtatagtcagtccatagggtcacaaatagttggacacgactgagtgactttcacttcaaccatcaaaatgctgaagaatcttttcctgacttaaagcctcttacaacaatcaacacatgggaaggcagagaaaaattctacatctgattttaataaaatatatttttctcatcaaaatattttgatagcctgggaaaagagatatgtgctcattaaagtttaatgactctctcctgccgttttccatatgaggctcacacactgtgactcacgcgtggtgggtgcagggaacagttaactgggagcacaatttaacccagttcccatctctgtggtcacaggagacatgcgagatatggtcacatgcgagatggggttcttaggcggcaaggacgtgtccactggcctgagcactttggttgacttgatgtggatccagacaggtgggccccatcgtggtccaggttggtctctatttgctccagaaaggagggggaggccaagaacagctgcaaacttgcactcaggcagctccagccctgaggctgagccagggtgcccagaagacagagctctgggcacaggcttgaagggaaaagagaaaggcaggaggct

SEQ ID NO: 48852 - DNA, 1001 bp, Bovine  19866881376519
caagggcttagtaactggtggcgagaaagaagacctggtagatgggggcttccggaaagggtctctgggctgcatcggacgtgggtttagaaggttttaaggggacgtcaggggcagaaggaagaaaggagacgtgtgaggagctctgcaacttgggtcaaaccgggtggcatcagaccagcacgtggagacaaatggggaacagagagcaattccattcattccaaagggagaggaaagagccctgatttacaggccttttcacatgcgccgcatgcaaaagctgattattcatgtaagacctggcctgtcgatagtaccgcagggtcttctcggctgctccctcataccatgtttaattctgagtgtaatgatttcaatgacagcgctggggaagaattttccatgattgaaccgcgagcgaggaagttgtgacagagtagtatttcatttcgctaaatagccctctcacctccaggaggtagcacgtgtaagagaccacaatcagcctatgctcctgaacacccatccgtcaacacccctgactgcccaccagcctccctcggccaaatctcggtgcaaaattcgaccctccaaaggtgaccaccatgcacacgtttgctaaaagtgaataatgcctggacagatgttttgtttttacaaagctgtgtaacttttgtgttaaaaaagaatctaggcaagaaaaatagaagcaggaaatataataccccagaaaggattctcattttgtttttaataacacagtctttgcaattgaaccccttactaaccatgaaaaaaatataattaccaattgcattccttcacactcaactaaaattggtgtcaaattctcaagtcatgtaggaattaacatatggtcttagtctaaacgtttgtttacacctgtaaatcatttttgaggccacacgagtactacttgcaaggcaaagtggccagaactacatgcctgtactcacatataaccgactctctcttta

SEQ ID NO: 48853 - DNA, 762 bp, Bovine  19866881546382
ctgttttcctggggggtgctgtcccgacttgccacctccaacccaacgggaaggtccggcctcgtcatccaggcttcattccagcagtggtaattccttagaaaacaccaccccagtgagttaggcttcccgccacagtcagtgctccaggaaatcaaaaagggaccaaaattcctgtggatatgctatctataaaaaatcggaaaccccagcaagaatactgggatgggttgccatttctttctttctttctttttttaataatttttttttactgaaggataattgctgtactagttgccatttttcctccaggggatcttcccaacccagggatcaaacccgtgtctctttcgtctcctgcattgcaggcgggttctttaccactgagccaccagggaagcctataaattattggaatggcttaagctaaatggaagcctcccagagacatactgaggatctggatgcaagtttcctgggcaggtctgtttccactggtacccccgggggcacttgcatggtggcacatggctgtccccccagcttcaaggccacccagagagggtctaatcaatgccttaaacagtttcaatcttacccattgcctgctgcctagtgaaacagaatttactatggcctcaagagatatgggagagaagacaagttaattaaaatcgaaacacatatatctttgaattccatatacatatatataagacttataaaaagcacagccttttgtaacaattaagcaataaa

SEQ ID NO: 48854 - DNA, 1110 bp, Bovine  19866881822398
tctggagtccaagtgctccacagagagggtcagtccccggagcgctgatgacacccacccggcaggtcttacctctttatttagtggcactcagcttttgtataaaggggaggggagtaaaaagtgtcagtcactcagtcgtgtccaatccttttcaaccccgtggactacagcccgccagcctcctctgtctaagggattttccaggcaagaatactggaagggaattgctattcccttctccaggagatcattccaacccagggattgaacctgggtctcccgcattgaaggcagattctttaccatctgaaccactgggaaaaccccaaaagttgtttctaattcttcactcaaaatctctccttttaccaaaaaggtgagacatttcacctttttgaagaggtcaaatcaccattgcttctaaaggatctcaaacagaaccagactgtgacttaagctgttcaagagtctctttggagataaaatatgggagagcattctagctccacaattttctctgatcccttgccaggcttgactttaaggaccttagaaatggggcttgctttaactttaaaatcacatgaaaataaccaaaaggaaattttcagcccaggtggtgatgaatagccctccttcgccctctgaggttaaacagatactaaaatcaataggcttagcatttatttgtacatgtttgttataaattcttactttctctgggtggggaagccagtggtaatttccacaggggccagaaatcagccctagaagtgagtcctagcagttctcagctcacaatttgcttttcttagctgccccactcctcccactggaggaattataaaatcaaggaggccattcttctttaccccttgcctcccggtagtcacccaggaggagcggtggttcacaaggcatgctgaaggtctgctctgggtaaagtgcacggaggcgttaacacctcagcaatggcgctgtgtttcccttgggtttcactgatggttgctggttgttggccagaggtcgcttaggatcaggaggttgtcagcaggtctgtggtgccgccatcccaactctgcagccctcggacccggtttcttctat

SEQ ID NO: 48855 - DNA, 1103 bp, Bovine  19866881082777
cctctccagtggaggctgacacaggaattccttggatgtgtgtggtttcaagaccttccatacctaaccttctgtgcttcaccatctcctttccaaactaacaggcagaaaggactccttccctccccatcttgcctggctctgtgaactctgcccatggtccaggcgtgtgctgctcatctagactgtggtgtggagagctctgagctatggccagtcacctggagcctgcggagttagcaccgctggggagcaggactgacctgaggcttaggacttaggacttagtaggcttaggactccttcagatattccctgtccggccacctcgttacccctgcctgccaatcagttttgcatcaataaactttatgttccaggctttgtgagatgaatgaaaggcaagcagctgaagtgtgatctctgaccttggcacgtaaacagcctacagattggacttgacagttaataaaggaaaggccttgcgattctctgatgcctttttgccttgattagattaagcattcataagctttggggaaatcgtcaactggaagaggaagaccccatgagacagtaattcacatctctactcgtacaaccgttcagactgtcagcccttcagtcaataggcaccgacactggtgctgtcctattacctgagctcagctctgtgctaacctctctccagcacaggggcctcgaaaattcccgaagcccacactgtgccctcctggaagacagcgtccagtttggcagtcaggagcactcactttggttcagacaaatctgaacttgaaccctaattctgcctggtgacctttggcaaattatttaacctgtgtgccctcagtttcctcttggggttaataatacccactgccaagggttgtcatcaggactaagtaagaccatctgcacaaggcttgcagcccagggcctgatgctcagctgccagccagacgtgcaggtcccagcacagagcttacagtttgctgtgcaggctctcagaggctggaggctccttcccttcccgacgccctgccagccatgaggagctgatgatgatctccatggtctctgctttccacggtctgagagat

SEQ ID NO: 48856 - DNA, 1148 bp, Bovine  19866881942850
acctgagtccctgacagtagaagtgctgagttctaacccttggaccaccagggaatttcagattctgaaactctccttaagggccaatgcctgatgaatagtgagactttttaaattagtttaatgataataaattgtaggtgaaatcttccacatctggagagagagattttcctggagaattctgtgatctgtgtaatatgctgtagtgggagttgctttaaatcatgctttttcagtatgttttgttttcctacttatgaggtttctccttgcccttttggtcacttaccttcctcatttttttccagtcctcagatctgactcctcatcagaataaagactagaagtaaaggagtcaggaatgtaccattttaaacatacaagttggatttcacaggctcctagagttgttcctggttcttaccctaagagtaacaatgtttgctgtaatggcaagagctatctccctcagtgggaagcagcagggattatgtttaaagcaagatggtttttcttgaggctatatgaacattttctaacctctcttccatctgtctgcagacaaattcggcatatgacccttgtcggtgttttgcctttgttcatgatctatgtgatgaagataagagttacccaatgcctgagaatagtcttgatgtcatcatccttatatttgttctctcagcaatcgttccagacaagtaagttttaagtcccttaaccagtagcatagcaaaaacaaagctttgatcagggaccttgatctcagagttggaaccttaataaaaatgattttaatgttctgatagacaggaagaagctatttcattctaagcgatagaagcttgtcaaccacttttctaagtttgtcttggagtccacgttggactccaagcatctaaacctctgcctgttgactgcagtggttgattcttcttatgataatggtttaacatctccaaagaatgagggagtcatcttagtggggtatgtggagaaatttcctgttaatgatcacatagcatggtatcttagaactgtgaatgccacagctattcaagaacatctcattattggctttttaaataaaccaggcttattaacagcacaaaatatacagtgaaacttaactcatcaagtgtttt

SEQ ID NO: 48857 - DNA, 1532 bp, Bovine  19866881063071
aacgaccgaagccccattttcctcgacgaggaaaaccatcacaggagaactgcatgtcctgcaacgcagagtggccccaactggttggaactggagaaaatcccttacacagcaacgaagacccagggcagttaaaatgtaaaaaaaaaaaaatgtacatgacactgaatgtgggacccttgaatggggtggcggggggaagcattccttcattcatgcggatgtgaattccaatcacactgatggaatctgatgcattgggatttaatcacaagggactcatgtcactgcttacgctgaccctccaataccttggccagctgatgggaagagtcaactcatttggaaaagaccccgaaacactgaaggcaagaggagaaggcggtgacagaagatgaggcggttggatggcatcacgaactcagtgcacatgagtttgagctgactctgggagatagtgaaggacagggaggcctgctgtgctgcagtccgtgggatctcgaagagtcggacacgactgagcaactaactaccacctcgatagagactcaggtagcttctgggtttacagagagttttacttactaaaaccaactctccctgccctttttgcttctgctctcaaacagctagtcttcgggtatccaactgaaaactcctcacatattgcaacagatttagaatatgcttgtattttttctctgcggtggaaatgaaattgccagagggaaatcttcactgacagtctcattccagagctattttgcccctggcttttcatttttattacattctaatttccaacctgctttaaagtgtgtgcttcaagaaaactcaaaagcaaatgcaagtctctctgtaataagcattacgggatttggtttcccataaagaagctagtacttatgtaaaggtggcttaagaggagttgaataatacatatatatatatttaacatcactgaaggaagctgtttaagccccactaggatttccgttcaggattaagtaagagccgaaacagtcatacactctattgttctgaaattcggttccctcaactatgaaacagaaagtccaattttcagaagtaatgtcccaaagtaactgtccatctgtgcaattagtaaatatgattacttctgctctccatctttctacccttcactgattattagctatatacttcaataaaagaggaatgaaatgaagacgatattctaaaaaatatctcatttttcctaataaggcagttttaaatgccagttggacttttgaagtatcacagtaatttaaacttcaccctacagattatggatttcaattcttttcatacttggatttactgttggctcagtggtaaacaatccacctggcaatgtactagacacgggtttgatccctgggccagggaagatcccctggaggaggaaacggcaacccaccccagtattcttgcctggggaaaaccatggacagggaaggctggtgagctacagtccatggggtcgcaaagagtcagacgcaactgaa

SEQ ID NO: 48858 - DNA, 791 bp, Bovine  19866881082885
cttttaaaaattgaatattttccctgaatggaggggagagcatattggatttgactgtagtctatttttcttgagggtgaagtcatttttcttgagttgtgtaggagctgctgcagctttaaatcagagatttggtggcagagctgggcacatatgggccataaaatacccagattggagctgattgggatatcaaatggtgggaagacgacccggggtgacaagagaataggtttaccttgtctgaggaaaggagatgttgtttctcttccgtgtaggatgacttattaatgagaacacctgcaaatctgtggcttgtggaagacaatgactggaagaaaccttactttcaaggacaagtcagaagcttctttctttccttttttgtttttttaagagaaagcaggtaaattagaccttttgtagttgttcagtcataagtcacgtctgactgtttgcgacccccatggactgcagcacgccaggctcctctgtcttccaccgtctcctggagtttgttcagactcatgtccatcgagtcggtgatgccatccgaccatctcatcctctgtcgtccccttctcctcctgccttcaatctttcccagtgtcagggtcttttccagtgagtcggctgtttgcagcaggtggccaaaatattggagctttaacttcagtatcagcccttccaatgaacacccaggactgatctcctttaggatggactggttggatctccttgcagtccaagggaccctcaaaagtcttctccaacaccacagttcaaaagta

SEQ ID NO: 48859 - DNA, 1486 bp, Bovine  19866880599161
ttgcctggagaatcccatggagagtggagcctggcaagctatcatccatggggtcgcaaagagtcgaacaacaactgccacacatgagttgggtcccactaaaatttctcagaaacagtaccatcatctctgcatgacccctcttttcagtaggatacctttaaagttgcaaaacaattcatgttccttcaggcacctggaaccctggtgcgccgttgccagactcagttcagattgagaaacagtgggacctgggactgaaacgcctgctgcctgacctctggaggattttcctttttggagttttaataggtgtcatcagcccagtaggggagactcttggcaaactcgagattttctccttccagaagctcactggtcctgcctctgtgaaagggccaaatttgtcagtgggaaaagaattttaagaagtatcatgaagtaaacgattttgccatgctctggatattgacccttactaataaagcttcttacatttttaaacacggcactgaatcatctctttaaataattagtgagtagggagacaggagttcacttagctctttgaaagggaaaaatcgagtagacttaaggtatattgggaaaaagtgaatcaaatggaattgcattaatgtttgcagagttaaatactgggattatttttttcaaagatttttatatgtggctgtccacatagaggagatttattcttaggcctctttcaagttagatatttgttaccattagagagtaaacccactcttcaattattttctttctcagtctcttccctcatccacttcaaaaatgatccaaaccttccagtccctgagtgtgggacagcacggagcagaaggagggaaagaatgacagaaactcagtgaaggccaccagaaagttctgccaagaaacattttgaaaaggttaataatgcttagatgtcaataacgcttttaccttgaagtcatccagctactctgtggagtttaaattatctgtctgaaagtggtgattcagagtttaattatctacttgtaatacatagaaatatttgggtggaccaagttcattcgtggatgttggtcagttttctgagttctaaaaagtgttgctcattataccgtgtgcagcctgtgttcttcacccttgccagccagagttatatcggtttccaaattcagaactgtgacaacattccagcaaaagttgtttttacggtctttgaccaaggagaaaagaaaacgtattggataaagtatgggagaattcttctcctaaatttcctcccaccagaaagaaacaaaatgaaaaaaaaaaaaggaatcagaaaacaaatgggtgtctgggaatccaaaggatacatttcctcataatatacctgtctcagggaaagttcgcagcagaaatgttcgcctgttcctcaaatgtcatagctttcctttggtctctctcggtggatctgatttctcagccatacaaggta

SEQ ID NO: 48860 - DNA, 1459 bp, Bovine  19866880620497
tggctattttcaacatcccatctgtattagacattaactctccaagtaaaacgttgtctctctttttttaagctttatattttgtattggggtatcatattcaaagaaacaccttatttccaccatcaaacatcaaaaagggatgagaaacaaactttatactagagaataataataagcacaaacctcttaaagtgtttgcttctcagcatcaggataataagttttctgtaactacctgaaaaaaaaaacacaaaaacattatgaaacgaaataaagactttctattaaaatctgttacttcaggatggaaaaataacattttatcatttatctctaatccatgtatttaaatttttacatacatctacattttgaagttagcaattctttcttaaacttcaaattccatgaaactgtggattgaactgtcattactaaaataatagagtcgacacaactgagtgactgaatagcaataactaaaataaaaaatattaccagcttttagggaaaagtacaacttgaggatttttaattcaaataatgttttgtacaaaaagctcaagatgaattgataattctcttacatgcagatgctaatgtcaaaatttgaatctgaacttccggatacaaactgcaaaagaatgactagtgttttatctaatataaagtggaaaatacaaaatcaggactctcagtactctaaaagttataatgagttaccagttcacacagtagatttttatctgctaggactagatacaccattacttcacttgatgaattggtaagacctagtctcactaatatttccaaacatgatttattccaaggttccattcttacaatatccttgaaaatgctagttaaatataagaaaggaagaattattgtaatacaaagagaaagaaacaagagtatatttattaaatattatttgaaccaggctaacaacaataaatacctgcaatttaaatatatcctgaatcaattaaattctagaagtcactgattaacgatgaagcccagaagacaatgcaggcaaccgccacatcacaaacattccagatgcttcttgaagccatgattctctccccacttattaagcctgtgacaactaccactcagtcttttgtattgcctttcaaattgcacactacatatttatttttaaaaaacaaaagaagcaagtagagagacgaaaataaactcaaagacacacagtttgtctagatgaaaagaaaatatgcatttgttgagaaacataggaatgaatttccttacaatgatgcaacccctccaaaaaagtcacaggagtcatcaccctgggtggtaggacgctgagtttcccacaggaagcagctcaggtaattgcttggttgtgtttgtactgagaggcatgccatcatgtgcctacgggcttcttctaggagaaaatctgccgtgtgggtcattt

SEQ ID NO: 48861 - DNA, 1286 bp, Bovine  19866880753429
cggacctttgttggcaaagtaatgtctcggcttttcaatatgctatctaggttggtcataacttttcttccaaggagtaagcgtctttgaatttcatggctgcagtcaccatctgcagtgattttggattggggggttttaaatcataattgtagtcaataagacaaaaaataattaagcatgttgtatgtcaattagataactgatgaagatgaacataatagacatacaaattactatcctgattcttttttaaaaatacacctattttaaaagaatttaatggaatatttataaaattctgaccataaagcaaaccaaaaagaaatctagaaatagcacagaacacattatctgactgggacctccagtgatactataaataaagaggaagaagagaagagaaagaagagagggatagagagaagaatgaaaattaagaaatttacttgaatctatacttgggtcaaagaaaaaagcaaaactaaaattttgaaatatctacaaaataataatgaaatacattacatattaaaaaaaaatgtaacaacctaaaagagttagggcctaaaccacaatcataaacacactgttaattaagaaagaaggaaaataagcattcaagtcaacaccttagaaaaagaataacaaaataaaattaaggaagtataaaaaggaagaaaaaatggattacgaaaattaaattgcttaatattacaatactaaaagaaaaaagactattagttattggataaataaatccaataactgattctttgaaataatttatgaagtcacaaaccattagctggcctaacccaaaaaaaagaaagttaacaatattagaaagaagaaatagccacaaatatgggagaagtttaaaaccacattcagatgaaggaatatgtatttattcatactttctggagttggtctaaaacatttctcacatattgtatttctttttggtgttcctattatcaatgtcaaaaagtgtcacagcaaagcaaaagaattgttacgttattaaatcaagaaaatcttcaacttctgtggatttttggtttcctctgttgtcagtagcatttttttttttccccacagaccatttctcactgactcgactgattacttcacggtcatgacaatcattgggctacatttcttaaatgattttatcctaaatatagaattctctgatagaggctaaatcaacatcagcaggaaataatatgctaagtataatctcagcctccaccatccccaaactaccgggcaaataaatt

SEQ ID NO: 48862 - DNA, 1228 bp, Bovine  19866880848488
aagcccttttcttaacaaaattaacactcaaaaaactgacagaggaggcaacttaagtctcataaattccatgaaatgtaaggaacataccaaacaaaattacaattcatagttcataataaaagcctgattcaaacaggctgtaaaataaatgacaaattttgaaacaattgtggaaatttgaacactgactggatacttcctgatattaaggaactatttgctaattttgtccaggcttaaaaatagggatattttaagcaaccttacctgttaggtacaccctgaagcacttaccgatgaaatgatagagtgcttggactttgcttccaatgatctggatgtggaacctgggggggaagtgctaaacagaaccagttgtgacttgtttgttggagctggacaatgggtacacagaggctcattatgcttttctctctacctttgtatgtttgaaattttcgataattcaaaccttacatttttcattgtgtcagccaattataattcactgtcatataaaatgtgttaattacatatgaactagcagaaatatttaaccaatcctcatctgtgttgagaccatctatactccaatttgtaccccaaatcttggttaagctcactgtaacacaaacctccaatgtaggatgcttaaattctatatcaagtataacatttgtttccaaacaacaaatgaaaattttcatcttaattaaaatgtttctctgttaaaagaaaaaaaaaaatttagacatcacccttaatatgacaccagtagggggagatagatgctgcatttcctctgaaaaaaaattttttttttcaagaaataatctaaatttaatctacagtctaaatgatttgggcatggaggggaggacattctccagggttttcagtaaaatctcatctccaccctcaattctttagtccttcatttcaaagaaaggagttgttcactctgcattgttataatccattttctagcctaagcacatgttcaaattatggcaacaacactgtccaaattgttcttctgtcacttatatctctttaatggactttctaatattatttaagtatttttttaagtacctcttttgctctcccataggtaacacattttacatttggctaagcaagtactccagtaaacaatgtcactcatttataatacagctaattcttgaatatctactatgtacaaggtacttgtggtcagagc

SEQ ID NO: 48863 - DNA, 2762 bp, Bovine  19866881017082
gtctccacttacatattagaaaagtcagatttgggtggggtttttttgttttttgtttttttcagtaaatcactagtagagttagtaacagagtccctgtttctgcagaaacctctgcaaagataacaccagaatgacccaggtctgtccttagcaatcaggcttaccggtccttcacaacagatcctcaggagtttttggaaaggaaaggtaaatggagcctgctggaatgccatcttgaaaacagccttacagcaataaaaagcctcagaggttatgccaagaacaggcaattagtcactaaacacaattaatcacagttttgaaagtcacagaccccaattccctcacccaacagtcaaaggcttggctttcccaaccttctaaaagaaaatgtgaaattttctcaaaaactcagtttcatttctgagttgattaaaatttcatcatcaaaaatacaaaaggatgaacgctagaacagtataaatgagttgtacctctttcaataacccagattctatattcactcaccaggcatttacaactaataattttgtgccagatgatgcctttagaagaaaatagatgattatataaccatgaaacccttttcttcaacctagtataacatgttcaaccactttaagtttatttggggtgggctggggatattttcttggattgatatttgtttctgtatataatgttctctaagcagaacttcccatatattttatttctgaggtcctgaaaaaatagaaaataagatttggaaagggtatcacaggatacagctctcaggaatccaaaaatcactttgtccatgtgtagcagaatttttataagtgttcggtcatacagtctgggagttataagattatgtaaacacaatacaaccctctgagagttatctgctgttgtgtggtcttcatcacagctgtaataagttacatgtaggtattttttgtttgtttgttgatttgttcttttctatctcagctctaacttttcatttagagccaaataaggacatcaaattaaaacatgaactgaagagacagatcaggcaggaaattccaaagttaagtttctcattgtaattttaactttgccatgatagacagtttctgtacttactcacatcttgcacgtatatatatatatacagctttacataaagagtcagattctgacctcagtcacacttgttttatttttactgaaaatgtaagagggagcaatgaagaatcaaagaagggccagaggtcagtagactggaaagcaaatgctaaagaagaaggttatgggaggcaggcaaatatgggagattgaaaaagaaatacaaggcacagatggaactgtgttagtagatgcacaatggcatttcaagatttcttaatatgcatgtcttcacatagttcttttcaaatacctgttaaacaacaatttaaaccacattaattttttatttttttatttagagagagcttgagcgtttggttccctttgatttcacctcttgctttataaatcttccgaccagtcattaactgcttgtaaagccctggcacctcatatattgtcacttaattatgttatgctacagtgggcttcctaggaggcaaaaattctacacaaaaacacttataaagaaagccagggcagacagcctgactaagcccgtaagaataaaaattgttgctgacaagggaatagaatcgacaactaaagctttctgaaccaaaggggaaaatgaatagccaagacatttgaattgttgaaggaaaggatgcttcagatctaggcgaggggggaggaacagagcataaaactggaaataggagattaaccactaagcctgctcagaatgaatcataaagagagaaaagggattattagcccaaaggatctaggcaggaagggcccagggcaaagtctcctgatgtatcttgctttcaaatctaagatgttaaaaactgtaccctgttggaagaagggtttctttgctgtgagcctgcccaagacatgagggaataaaaaggactggagaaaaaaaaacagattcaaattgcagggcacaattaaaaaaataataactataagcatctccaggataatactcaatgatggtgaggatgtggtaaaattagcacccacatattactgggggcagcatcagttgggacaatccttttgaaaaataattaaataatatatatcaagaatcataaaactactactagctttaacagagaatttcctttcttggtcatgtatattaaagaaataccttagaattagaaaaatctctattcatagaaatagttaacacaatactataaagttcaaaatggaaacattaaatatgcaataataaaagacaacttaagtgtaatttattgtatatatactcaatggaaaaaagtgatcataaaatcatggttattaaagtatatagaatgatgaagtacttatgaagtaagtatgaaatactccttacccccaaccccaaattgttgaactttaatcaagtttttagacaagatttccaatttacaggaaatacccagctgagaaggcaaactgtccataagcaggtagttcaaaattactgacaactgacccagtttcttcagtaattcagtgatctgggggtaggtaggtggtggtggtttagctgctaagtcgtgttcaactcttgcaaccccatgcactgtaacccactagactcctctgtccacgagatttttcaggcaaaaata

SEQ ID NO: 48864 - DNA, 1153 bp, Bovine  19866881418648
gtatttttaccagcaagaagaagaaaatataggtaacagaattgagacagtactcaggataaaagggaaaattctcagtatttatttacataaccccccaactaatgagaaatcacagccctagaatgggtggaaatactggttgatgaacaaagatgccacagaagatatttctgctctctgtaactctgtggtagagaacctttaagaaaaaaatttgatgtaagttttcagtaagaaaaatctgcccttatccccagacaatcatgttctcagaaatattataaacattaaagtccactagagaatcttgctcttatgtgcatgttaaaaaaaaaaaggcagactgttccaacaggagtaggaagcaaggcagctgatggtcttagcagttttcctgaatgtagtggaattaacctctcttagagggagaccaggagtttaagaaatcattggaagttgcaaaaataaagtgaagttgctgggagacaaactcataaatagaaatgatgtgccagtaacaggagagcaaaatatatcacaaaaaatatattttctgtgtcacaaaaaatagacacagagcaagatatatcaccaaacttgacttctaccattttttaacccccatttcatgttacttacattctgccatacacatatacacacatatacacacagacccttagagggaaaggattatttcttatttacatttctatgtacaaaagacttagcactgttttgcacacagcagacatttaataagcatattagatgaatggggtgaacttagtttactagttttgaaaggtagaatttataacacaatggtttgaaagtattttaaatgattcatgcaattgatgctaataataataactaactgactgcagccatgaaattaaaagatgcttgctccttggaaagaaagctatgataagcctagacagtgtattaaaaagcacagacatctctttgccaacaaaggtccgtctagtcaaaactatggtttttccaatagttgtgagatttggaccataaagaaggcagagcactgaaaaactgatgcttttgaattatggtgcaggagaagactcttgacaatcccttgaacagcaaggagatcaaaccagtcaatcttaaaggaaatcaa

SEQ ID NO: 48865 - DNA, 800 bp, Bovine  19866881318175
ctttgcaggcctctgagtctcctatagatttctaatctgctttcttggtaaatcaagttataaaagacctttagagtaatgctcaacaatcaggactaaaatgagagaataaattcaaataccactagacgaatagggaatattgctgacataagttgttaataatgaaaatactgaccagcaaagaaactcactgatgtaggatctgtctgaaagcatattgattcttgagtacattaatcccttatagagaagaattaatgtcaaggagtgagtcatgggccaaaatataagatactttaaaatgtgttttcagagcttgcagtgtgctcatctgtggcaacccctggttgttaaacaattcagatgctttctataacctgatcctatgatgcatcagggaaaagaaaacacttccaaagaaactttgttcctcttcaccatctcaaggcagcaaagtaccaattagtactctgggaaggagtaatttatcattttctatcaggatgccttaaaaaaaaagaaaaaaaaaagagagagagagagaaaaagagaaacacatgtaccacgattataatagttcttatttattgtagcaggcactgtccatttatattgttatcttgaatgcattgttgcattgaacaaccaccaaattaaacagctattattatttctgttctgtaggtgtgaaaaattagtttcagagtgttaaataattttatgaatgccatacatcttttaagatacagatcaaggattcaaactcagagatccttgtctcaaaagcttgcacttca

SEQ ID NO: 48866 - DNA, 815 bp, Bovine  19866881349906
aattggactacatttgatcaaccctcatataacaaacagtatattcattgtatgaatgctgaaaagagaagacagctaaggttttcatgtctaatttctgctgatctacatcatgtagagtcggactgagacacacaggcctacgtagaagcttacatttttaaaaaatgcatctggggcacatttgctgtcatccttctgtctaaataaaataatgccttttttattatgaagaaggcagaacatagttttaaggaacaacttttggtaatctgcaatagcataaaatgctctcatctttcagagtggtacttatataatgagattacatctatttatttttgtatatatgaaagattcatagagcttttggcttttttcacataccttgctttggtgtataaatggcatcctgaagtacagtgatgaatttaaaaaaaatttttttttcaaaaatggcattatgtttatagtatatgcaccagagagagcaaactacttatttttgaaaaactaatattaaaaactcttgtgaaagctctataaaagcaatggattttatttcatgaatcaaatccactttagcttttctggtttagctgaactaagattaacatttcagatagaggaaaaatctgcctcgatgccttcattttattaaactagagttgacaacatagaatccatcgtgcaattataaaaggctgcctttagttttagtggtacgatattggatttcagtgtcattatagtttcagcttttatgtactagttaagccaagcaaaatcgctactaaaattaggctttttttttt

SEQ ID NO: 48867 - DNA, 988 bp, Bovine  19866880443289
cgcgaagcaccagcctcaatgacctgctgggccaggtggagtacatcttctccgacaagacgggcacgctcacccagaacatcatgaccttcaagaagtgctgcgtcaacggagttgtctacggtgggaccccgcccgcgccccgctccccgtgtccagggtctcacagcagtggcccggcatccagcattccacaccgattggtgccctaccactagtgccaaggggcttcctctcacttgggggttggttagctattcctataaaggacgcacgggtcaatatgtttggccactaaggccgctgggtctctggccccagaaagcagctgctgctctcacccggactccgaatttttaatttcatagcatttccacgtgtcacacaagataatattcttttcaggtttctcccaactctctagaaatgtgaaaaacatttatagccttgcaggtcacacagaaactagtcctgaggtggaggcatggttcaccagtctctggtctagttgataagcagcggccacagtttagaccaggagccgacagagggccccactgggcgatattgggcctcatgcgcagtcgcatgacagacctgggcccctgcccttgggttgatgccacctgaccgtcaggtagggcaccaggcccatgctgagtggcaccaatcccagccggtctctgatgtttctagaagtgctacggacccaggtttttgtgaaatcaccctatttttcaaagtaggtggccaagtccaaattttaaaaggacaccaggaggaggtcaaaccaaacatattctacagggctgaaccccattcccatacgccctccagcccaccgccctggagggggtccctgggacacatggctgcatcctattctccaggcagaagctgaggctggggtctttggtggcttgaggcgctgggtccagggtgcaggcctggctggtctagctgcagccggcagccccaggaagcctgg

SEQ ID NO: 48868 - DNA, 1499 bp, Bovine  19866880452798
ctcctgggtgtgggtgggtggtgggggctgccagaacctggcttctccctaggctcgggtacccatggggtcgtcagcaggcacggtcactacatcttcctgagtctttttattgcaacccgaccacacaggaccaagacagatctgaggtggcaccagggcccgtcccgggaaagcgcgcaggcacacagggggagaggaagggaaagggaggggggttgggggttgggcctgggcagcactgcctgaaggggagagcaggacactggacccagcagccacccccacccaagctgccaccagggggcaccagagctcacctcagccacgcactctgggccccccagctggtcaatgagctcatccagggtgttgactggcagctcccggcccagcgcctgcaccttggccagcaggtcctgcttcagccgctcaacccgctccaggactccggggccatgcaggtcccgctgtggggggcacaaggggcctgtggggccagagggtcagggggaactgggccaggctgcctgtccacagccctgctccccctccctgggccctcaagggtgagggagtccctgggtagtgggggtctagaatctttccccgaacccctggctgctcctgctcatgtgcccctgacttcctgctcagagcatgagaagcaaggatggggaaggcggcattgggcctcaccgcggtcatcggctgggagcccgatggcatccacgatgaccacatcgtcgtccaacagggactcgggggaggagtggaagtcactgtccaggccaccgtccgactctgtgctgctgtcgtcactaatgcggatcacacctgctgcctcatacaccaggcctgggtgccttggccccacggggccccgtggccgccctgcaggggagcagtcaagggtcactgcaggcctggtcccagggagactccccaagtggtccatggacaggctgcatgcctggatggttagggcttataggcccaagccctttccccctgtgcagctgtggcatgtctgggcgctgctggtggtggggacgtgttaccgaccctgccagacttccttgacatagcagtgtgtccttgggtggtgcccggggaggccacgtgccccaccctcacaaggtggcactgggtgggtaggccagaggacatgcccaaaccctggggggtggcagtccaggggcccaagtaacctggatactgtcccagacaccctgcagggtgttcccagccagaggggcaggactgggccccaaggctggctgtgtgctctcaggtgagttgcttggtctctctgagcctcacttccccctgatgagaggatgctcagcctttgcctgcaagaacagggtgcagtgtgtgcctgcaggtaggtgctcgggccactcccctatcctggggtgctttgtatgagccccatcctggtcccctgaaccagtgcagtttcagcctcaggctcacttttacctgggaatacgagg

SEQ ID NO: 48869 - DNA, 1919 bp, Bovine  19866880477136
tgaggagtcatactctgtgatgtcacccctgatttctggcatcccagggacacctacctgagaaactggcagaaggacacaacccacggtccccttgattatgggaatctatgccatgctcttacaacccagccactgtcagccagccctggagaagctccaccatggcagaggctgcctgatatctggcctcccccgcgtcctctccactcccatcactctccctaatggttccctctccactcatcaaacttctgttcatcctgtagggccctattccattggtccctcttctaggatgcctcacctggtctcctgggggtgaatgaacaagaggctcccatggaggcagggtgatcgtgggtggtccaggccaagtgtacagacaaaagcccactggtggtgcagaaaaagtggactccagggaggggtgaatgccagttcctgggtgccctgcagcggctggcagagctgacaagctgcccaggaggttctgatatgagcagtgtatccctctactgtgcttctcccctgtgcctgtccttccctctgcctgtctatcccctccctctatccctagctccctctcctccctccctctgtcccttggtcacccctggcctggccatacccccagccacagggggccatctccttggcaacagtggccatggggtcagtagctggatcaatctcctctcacccgggtagccccgaccctggacacggaaggtgacaaggaagtggggtcaggcctggggtctgggctggagggatgttgtggggttaggacaggggtccctcagccagggcagcggtggcgaggcgtggagagggagagagggtctctggtggtgtggtcagcagagtaagaggtcaagtgagccctgggcacatactgactccaagattttcccaggcctgttcttcccagcactagtcactacgtgcgaggacctggaggaaggctcagtcattgtcccagtttgcagctaataacaaggacacctgactgggccctggtcacagctggccctgaaaaccagggctgtgtccacagcacgccgggcaagtccacattcctgagttggctgccatcacagcttctggaagattccattactgctactgagcagtctgccatcactgcttctagaatattccccccatcaccacttctagaataccccccgtcacagcttctagaatatcccaccattactgtttctagaatattcctccatcaccacttctagaatagcgcactgtcacagcttctagaatagcccaccatcaatgcttctagaatatacccctctcatcaccacttctagaacattctaccatcactgctctgaagagtctacccccaggggcctttaggtttttcccctttgggatcaggccatggaagtttcccaaacacgacagaaggaatgggctctctcccttcctcagcggccgtggggacagcttagcagagcagccacaggggtgagggccacagggggccctgggcacaggtcgatggacctggcctgtgagaacattgatcgctaaatgcgtttgtatagatcctggcacaggtagccctggcccccgggggaagcgaggcagggccaagggagccgtgaggggtcagggagccctccgcaggctgactggggacgctaggggtgcagtacagcacagaagataacctcattcgtgttctcctcttttcgagcctcactttccccatccgggaggtgaagatgtggaggggcttttgcggtgggcctcctgggcccctctatccaaaggaaccacctccatctcagagaggtcaggctgctggcccagaaccacacagcctcagggggtgggggctctgcgacgcgctctgttgatgcaaaagactttctttacccaaggccttc

SEQ ID NO: 48870 - DNA, 1701 bp, Bovine  19866880538327
tgatgcactattatttttctgagtttgggtgctgctgctagttttctagagggagccacggaaggcgggaggttgtgggttgtgtagggcaccgggagtctccggaacactatgcggctccgccagcctggcgacgagcgttgcggccaccaatccaatttgcgtctgcgagctggggctggccgcaacgttcgctgtggttgacgttcacagcccggccggtgccagaccggagcctgcccctgctctttgctgctcctgttcagtccagggctggccatgattatcagtgtctaggttctgcccttgctcccccaagagttgaggacctttttgcttttcccgcctacaatacgggagacctggtttcgatccctgagttgggaagatcccctggagaagggaaaggcaacccactccagtattcttgcctggagaatcccttggacagaggagcctggcaggctacagtccatggggtcgcaaagagtcagacacactgaagcgacttcactttctttcactttggttttcccgaggcataccccctgcctggtgcaggccctttgccccctcctcgggcccctgatctccgcatttggcttcctctctggggttgatctccagagagcctgtgtcccacagagttgaccatgttcaggcgctctcaacgggcattttctgtcttcctcgaacactgctgtgggtgcacaacgcttgtctccatgtcagtgcacgctgtatccatcgtagaggcctcatatagagacctcgcggttttcctggtggtggtcaggagccagagcttctgtctgagacagctctccacttgatgtttctggcaaaccctaatactttctctgagactcagtcttcttatatgtatagtggataaaaaaacatcccccccaccccgcccccaccaagggtcctagctccggggcctgccaagggagatgtccatccaccttttgttattgacataagagcaattgataatcgttgtgaccattgtgagaagaaatgcaattaggccgggaaagtacactgcaaggctttgggaatcatggagaggaggattatgggaaaaggtgggaagctggacagggggtcagcagcttcacggagaggtcgtgagagagtcactgagtgagcctgggcctgctttcagattgaaaaagccacagcggaggagatacgggctcctggccaacaccgaggaccccaccgagatgacctcgatggacagtgacgaggagacagtctttgagacaaggaacctgagatggtagggtagcactctacacactttcaggggctccttgggtgggtggagggtgggatcagcaggaagagagtcaggtggaccacctgtgcctgtgctcagtgtagtcagcacccagcagcaggggtgggcctggagtgagcactgctttgccgtcacaggctgcgtggcctcatctgaggcccctgtctcaccgtttcagtttcccatttctttaacatgggaaccagctgcatggctggagtaggtgagcacttcctctgtgcctgacactgaaggccaagatcagtgtcagagatagaggatgcctgccaggtgctaccaaagctgggggatggggtctgagactgcctcttcaccgcccagccctaggaagagtgtcccaggcacagggagcagcagagacagaaaggggg

SEQ ID NO: 48871 - DNA, 1887 bp, Bovine  19866880588694
cagtagaatgggagggggtccctgcccctcctctcctgccagcccagcccagcccctggccgcacccttggcctgcccacacatgctgtgacttttaatcccactgatccagctggaatgtgggtggggttggcaagggtagactgatgggcaggctgattttggggaaggggttcccagaggtgctgacaacagtctggcccccttgctcctcataggtttccaagggaagagctgtgctggggggacacccatgagtaccgcctctgccagcagcccgtatgttctaccccacccatctcttaaactcagttctcccagaagccctcctgcttccctgctcaagcccccaaatatgcttagcaccataccaggtgctcttggggctgtcccagcctctgctgcacccatctctgtccccaggactgtcctccaggggccatgccctttcgagacctccaatgtgccctctacaatggccaccctgtcctaggcacccagaagacctaccagtgggtgcccttctatggtggtgagtagcccagcctcctgttagtccagaggaaacaactcaaaactggccaggaaaagttggcttctaaaaaggaagaggaacttggagggttgcaagaagggcgcattagcactggggctttgaaggatatgtaggagttggtgaagtgaagcagagaaagcatgtggagttgtgaagcaggggcaggaggaggaagggtctatcctgcatagggttgaacaccaagctgaggatttactgggagttgtatccagaggccaagagttctcaaacttataccagtagcaggaaatgttgttgagctgaaaatagcgagttatataactgtgtgcccagggcagcgtgcctccagatttaagggaaacaggcagcttcagacgccacggtgggggtagacacagataagaaaatcctggaatggagaaagttccaaccgtcaactcatgttttttttttttttttccttcaccctaagaattggaggaaatttgccatgatctcactcccacagaggcccgccagggccagcttaggctctattccagcagggtctgccagccagcctcaggaagttgggagatggagggagtttgagtgggggtggggtggagggaacaagaatcagggctgtgagcctgtgggtgtgatcagactatccattgtgccccgctgccaggcagagggggaaacagagtcccaaggagggacagcaacatattcaggatatgcagggctcagcactgaacaaatactttttattgagcacctgccgggtgtagggtccaactgctgagtaagttctgcccaccactctacccagagcctagaacattgtctgggaaatgtgcttgatgactgtttgtggaatgaacatatgaaagaatgagtgaagaataggtaatgacgttaatattgtgtgtgcatgctcagtcgtgtccaactctttgcaactccatggactgtagcccgccaggttcctctgtccatggaattttccaggcaagaatacttggagtgggttgccatttccttctccggatgacgttaataaatgggtcgcctagtattaagacttaacatgaatgaatgaatgaatgaacgaacgaatgaatacattctggcccagtatacgagtctgggacaatcccagggaacgggaagcagaaatgcctaagggtccagtccatgctctgcctcagcctccatgtgttggctttggctgaatctctgagcctcatatgcccaagggaatggctgcctggggaaagactggcaaggagggagctggaattcaaatataaatccccccacattccaccgacttctcccatccccagcacccaaccactgcg

SEQ ID NO: 48872 - DNA, 2057 bp, Bovine  19866880722476
cccagggagttgagcagagcactacccagacccaggcagagcagcacgaagagtccggagaagtggtagacgcccatctgcagggtctgtgggcaggatgcaggcacatagtccctccaggtcatagcagactccggggggagcccggaccttggaagggagcgggaacagaagttgggccagagagaagggcctggggctacattttcagaggtttcatggacaagagggcactagagctggggttttgtaggatgaatagaatgcacaaaagcaggcaaatacactggtcttgggaatgagcagaggttgactaccctggtgaaggaccacggaaggttcgggggcttccccacgccgaccccacccccacatgcgggggacctgccgcacctccgtcacggcgaagacccgcttcccacaaggcaccatcttgtaccacttgtcgtgcagtaagtcgatgaagccggaggacttgtagcggctgatgaattcggacaggttggaggtgagcggtgaatttctagggagtccgataccatagcctgggggaggccgggcagtgggttgggaccaggctggacgcagacccagaggagcggaaccctcctggagcccgcagatcactggttctggggactcctcaccctcgatgacaaagggtttgcccacggtcagcagcctgcagtccgcgtcgatggacacctcatagtccaggagcgacttgtccatgatgaaggcattgagcttggggggatcgctcctgaggagggcatggggacaggatgagcacccgcgcccgcccgcgtggccccgccccgcgccccgccccgcgcgccctcctcacgtaagcatggcgacgccgtggggagtggtaggtgcactatggcgccgcacgtgcgagtacatctccgggaagcttttcttgatgtaggcctcagcgctgctctcccacaccgtgccgaaacggaagccctgagacgggtggtgcagctgcgggccagtgcccagtcaacacagaagggcctcgacccctgcccccgctcccccctcgcaccccactttcgccgaagaattgatgcttttgaactgtggtgttggagttgagagtcccttggacagcaaggagatccaaccagtcaatcctaaagaaaatcagtcctgaatattcattggaaggacttaggctgaagctgaaactccaatactttggccacctgatgcaaagaactgactccttggaaaagaccctgatgctggggaaaattgaaggcaagaggagaaggggacaacaaaagatgacatggttggatggcatcaccgactcgatggacaggagtctgagcaagttccaggagttgatgatggacagggaaacctgtcatgctgcaatccatggggtaacaaagattctgacaggactgagcgactgaattgaactgaactgaggccacactgaccggggcctccttggtggggctatgaacctccaaaaagctggacctgaggtaagcagggctgtccacaattttctgtggaagaaaaggctctacaactgtgctgttctcaaatggctgttgcatgctttcaattaatcaatttaaaaagtagccacatgtggagagtggctggcccatctagatctccttaatggtttacagaggacactggggtggtggtggattgggcgggcagcatgtgtgctaagttgcttcagtcatgtccaactctttgcgacgctatggactgtatagcctgccatgctcctctgttcatgggattcttcaggcaagaatactggagtggattgccattgtctcctctagagaatcttcctgacccagggatcaaacccatgtctcctaatatgtcttctggattggcaggtggattctttaccattatcgctaactgggaagccctggattgggagtggacagaagaggctaaacaccactcagagacaagatcagccagatccaaacactgggagatactatggggcaaaacacaaaacaacttcaacaaacaaatcactagtaaaaagacaggagtgt

SEQ ID NO: 48873 - DNA, 1000 bp, Bovine  19866880735888
tacatttggagcacctgtcctgcccttgcttcaaagctcaaatttgccaaatatccctgaaaatgctcagcacagagctgggcacggaaccatcccccactttatgtagattctatacctctgttaatgcagccagatattgattgaaggctgttttgctctgtggcttcaggcatgctctgccccctgaggacctccgagtgggagcatgcctgctgccttcctggaggctgcgggaaggacacagcatccctcagaggggagggagttccctctggcgcacctgggcagtgaagccgctgtagaaggcgaaccagatctggaccatcatgccggccagcgtcttgtacaggaagtagcgcaggaacttgcagacgcgcatgtaggaccagcgtccgtgcaccagcaacagccgccgcaggaagcagaactgggccagcacgtagtcgctgttctgcaccgcctgcatgccctcctgacctgccacccctacgccgatgtctgcagctgcagaggcacacgcaagcctgtcagcccagggaccccagcctgctgctcccacctgctgccagcctcccctagccccgctgcccaccacccactcttgatcatgttgacatcgttggcgccatccccgatggccagggtcaccacattctggtatttcttgaccagcgccacgatcagggccttctgcttgggcgtcacgcggcagcagatgaccgcctggcatcgggaggccagctccacaaaggcccgctcccgccgctcctcagcactccggagggtcttggagtcttcgtgctggggcgccagccccgagctccgcagctggatccccagtgtccgccacatgagggacaggcgcctggcctgcaggaagtccaccctctcctctcccggctcctgccaggactccaacgggtccacgttcacgttctggacaggggcttgggggttccttgcgcagggacagcagtagctggtcctggctcacagg

SEQ ID NO: 48874 - DNA, 1096 bp, Bovine  19866880751437
tgcaggctctaaatctgtgccaggagtgatcactgggcacccagagcagcatgtgccatgttggaggccagatttaggggagactccagtactcttgcctggaaaatcccatggacggaggagcctggtaggctgcagtccatggggccgctaagagtcggacacgactgagcgacttcacttttcacttttcagtttcatgcattggagaaggaaatggcaacccactccagtgttcttgcctggagaatcccagggacagtggagcctggtgggctgctgtctatggggtcgcacagagtcaggcatgactgaagcgacttagcagcagcagcagtggttgtgtgcactgtatcattaaaactatttgcagttggttttagggcttttctgtttttctttttggtaacgtggctgctgggaagcatggacccactggccaaactcactttgccctcctggcgggcagtcctggactggggcagcatgctcaggctggtgaccagcatccagaatgtcttgggggtctggaggtcatgtagtcactgtgggctaagggatcatctttgaagaaaggctaggcatctggattttcctttgtgaaattgcccagtttctttaaacacagggggcccctcagtctgctcactggccacctaccctgccctgcagagctcgctgtggcccatgacctttggcctggcctgctgtgccgtggagatgatgcacatggcggcaccccgctatgacatggaccgctttggcgtggtcttccgtgccagcccgcgccagtccgacgtgatgattgtggctgggacgctcaccaacaagatggcccctgcgctccgcaaggtgggcccagccccaaggctcacccttactccctgtaccccaccccccagccttgagctgcacacagacccctgtctcttccaggtctacgaccagatgccggagccccgctatgtcgtatccatggggaggtgagtgcccagtggggcagggtcggatggcagacgcgccagtgacacactggcctctctcctgtctcctttctgtgctgccttctcactggggtcatccagaatgtcccctt

SEQ ID NO: 48875 - DNA, 1103 bp, Bovine  19866880756735
gccctcagtgggcagggcctcagcgggcagcggtgtgcccagcagccagcggggaccagggggtgcagcctgcagcacctgttgggagtgggccacatcgcagcctaggagtacggctgcggggaccggggccttccctccagctggtgcccccaggagtgccaggcgtgcgctcagccctgcatcacccagctcctgccggctcaggtccagcacaagcttcggggcccggcccgcccggcttgtccacaggaccaccaggctgccagggtcacgtacgcggcagagcaccaggccgatgtcctcccaggtgtgagcctgcagcacggataccagcacatccagcagtgtctcaagggggctggcccagtccagctgcaggtggaacgggttctggcagaggggttggtcaagttagggctggcgacctcacagtcccaccacactcttcccacccccatctgtacatgtccaataaacacatatcaccttgagccgatgtcgggagtgggccttatggcagcccaggagtacagctgcggggaccagggccttcccccagccccccgtccccgtctgctagtgcccccaggagtgccaggggtgcacacagcacctgctcctgacaggtgctacaggctgcgtccccgtcccctggctgccgctagctactcaaaggaccttgagtctacctcctcccaccccagcccctgctctatacccctctgtggctccccatcgccatcagcacaaagggtggccctgccttgacctgcagggcctgctcttttgactccagtcactctgaggctttttggattccccagctggaagacctttcctcatctaggtcagccaactcctacacatccttcaaaacccatctccataccatctctctattcagacgtacccaggccaaccaggcactgaagggccccactttgtgcccaggacaccccgaaagttctcctggatttgctttcagtgtgggatgagaactttaccagacacctaggataggcaggatgttgtctgggtggggacagggtgctgagtgcccggagaaaggctggagactactgctcagtccctggcgtggg

SEQ ID NO: 48876 - DNA, 1090 bp, Bovine  19866880813527
agtggggggcccgggctacggtttacactgaatccacgaaaatcaccgaagcttgaaaagtgctcaatacgccatcgatctctctcggctgatcggcgcggccgctgcagtgggctgggaacaggggcaaggcgcgcaccgcctcccagctcagagccccgcacaccgcccccacttgcccccagcctggggagaacagcccccccagagcacatgcacaccgccaagtctttccccggctgttgtgggtgacacggaattaagacagaaaacctggctggtccactgccgggctgtgggaccctcctgcctttctgaccagcctccctgggcctcagttatacagtctccgtaaagtgggttttgccacacttactccgacgggaattcctggcttcctcgcgtctatctatgggttctgcatctcttcccatctttgtagtgcgtctccattccttctgagctcaggggagaggaaacagtgagtgcaaaggcttggaggccggaggccatgtggggcattcagagaacgcaaggacaggcgaccgggacctgtctctggaagaacgatgggtgacgggtgtttgtggaagctttggtctttaatcttggaggatgtggtgtagcctgaatggttcagcatcttccccctcaaagctatgcctcggttctgacatggcctcccctgccccgcccccagggcccattggtcaccactgcctctcttgacccccccactggttccctggggacctttcaagctcagttccgaaccccccccctccccatcagcactcacataatcccaaagggcagtctgtgacctgtcccactcctcgtctagccccatgccagccagcctgcattgctagggtcacttatgccctctcatccctcctggactttgtcctcctgcctggaggtgtgtccccacccagtgcaccggctaaacctttccttaccctccaagacctcaccccagctctcccaggcagatcccccctgccaaccctggggcctcctttggactgtctggttctgtgtcccatggccatgattgtggggggttgctggggacatttgtagcaga

SEQ ID NO: 48877 - DNA, 2459 bp, Bovine  19866880824032
gcttacccacatttctcaccaccttctacccctcctttccagatgtttggttcaggaaggcagcatttccagtggccctgggggaaggacgaaaggcaggggccctcccagtgcttggaacaccccgcctggaccagagagcatgtgtgggccctcccggcccactggaagccaactcagccctccctgcagacagggctgcccaggttaccgggtggaagccagaggggcactggcagccctatgcaggactctgaggcccctggccatgatgtgacttataccagtcaccctccctggtgggaatgcggcagccccaggctgaggcctggaaggtgggcaggctgggtgtcctgtctgggggcaccggttcctctggggcggggacaataaaggcagcagtgcttttgtagccggtacccaattccacagcgggccagacccagtgcccctggctcacgggtggggcagggggcagcagatctgggtccatgtcagcctgttctcccacctgtgaccatctggatcatccctaactgtttagagggtcccatgcagaatcccacaaaggagggggaaagatggaggagacctgcccccacctgcctggaagaagaccctgccactagttatctctaggcttagtaaaggagaactcctattcgtccaccaaactgcttaagggctccccttccaggccagcttcagcccagggcccctcaagggcagtgttctctgcttcaccacacactactactccagggccatttctcacagagccccaggctgcagcatccaggtctggagccagccaaggctccccgtgcctactctgcctctctattttcagcctccagtgaaatcactggtgaacttgatcccccatcccaggcaatctgtgctggcactcaggcctctgtcctggcctcctgagtcccacggagacacttgaattccacagcgtgtggctcagtgcccatcctggccacctcagtcccatatttggatcttgaacccctttcaggcatctgagtcccatcagggcaactgatccccattctgggcacctgaaccccttaggggtacctcagtccccatcctgaccatctgggattcatcctggcacctgatctcatgggggtgtttcagtccccatcttggccatctgaggcccatactggtcacctgagtcccattggagtaccttggttcccatcttttgtgatgggcttgatgagttcctctgtgggccttgtttctaagcagagtctggctctggcctattcccccctggaccctataaatttggttgtgggaagcaggaccagtgtggctggcctgtagctctctgcccagcctgaagttaccctcaggcctctggctgaaagcatggaggccacgttgttagaaggagctgtcatcagagggggctgccaccaggtggcagccttgtgctgcacagtctacccaggtgtggcctgagccaaactgtacaggtggggaaataggttcggctgggggccctgtttctcacacctcaactccaccttgttgccatgtccaccatgggatggtctgagcttgctgcccattcaagcctcgtcagcccctctggccagtctccctcagacctgctgacccttcctgcccagcctgagcctgggttcctgaagaaacaccatctctgtcacagtcagctggtcccccctccctccagccggggtcctttgccttggcccccagttgactttcttctctgttggcaatatctcccatcatgccccaaggctgttcacagttcctcttccctttctgatgcgctgttgccacctccaggaggtcttccctgactgcctactaccattctttgggagagccctgtacagagtggccagcaggtccccagtagccagggaaggttgaggaactgaggccacagtccagggaggtactgagatgacatccccgaacccaacgcccctgcgctctccccatctgttcgccctgtgggtctttccacacatctctgcttttttgtctctgtgtctctgtctttatttgattctgaagccttgctcacctccctattggtgtctctcaccatctgcactgcctctcccttggcccccctccatttccgtctgtccctctctgtcactcgggctctctctgtgcctgactcactgggacacacttttaacaggcacgcagacaccgtccacggcccccccaccctgtgatctgcgcccctttcccacagctctgagcgatttctccagcttcaaaaggcacgttaattactctaatgaggtcaggagagaccccacgctctgccatccggagctgggaaacacccgcgtgcccccccagccccgtgcctcctgcccgtccccctcgggtgagaaggggagccccgcccgctacctggcccctgcgcctgttagcgcagtcagcgcccg

SEQ ID NO: 48878 - DNA, 718 bp, Bovine  19866880861922
cgatggcgcgggtgtgggtaagggccgcacggtggccggcgtcatcctggagaactatctgcggggcaggaagaaggccttgtggtgagctgcctcccctgggtgtggggcgggcccgcagcccgggagggggctcctgaagcctactggcccgcaaccccaggttcagcgtctccaatgatctcaagtacgacgcagagcgcgacctccgggacatcgccgcccccggcatcgcggtgcacgcactgagcaaggtggggtggccgcagccccaaacctggtgtgggtcggggtcacggagcccagctctggccaagccacctcatgcacagatgtccgccctctcccccagatcaagtacggcgacaacactacctcagagggcgtcctcttcgccacctactctgccctgattggtgagagccaggcgggtgggcagcaccgcacgcgcatccggcagatcctggagtggtgcggggaggccttcgatggcgtggtatcctcgatgggatgggggcggagccaagcgcagaggcggggctagaggggcagggtctaggacagggggctgggagaccctgacaagtcccatcctggcaggctctggagaggtgggaagtgcgggaggaattcccggcagggagggtctggtgttgcacgctcgccctcagtgatcgttgctacccgtccctggctggctgcctaggcctcctggctt

SEQ ID NO: 48879 - DNA, 1917 bp, Bovine  19866880897658
ttgtggtgctgaagcagtaatgtaaagaggaggaagattggcccctgtatgaacatggccaagaggttcttgccgaccaccttcccaacgcaggggcgactggaaatacccctctcctgtggggacacaaagagggatagggtcattttagggtcttggttactgggcctctccccattcaggtcaccttgggttcttaagggaaagcaccaagctgaatagacactcaactgaggtctaattggcatggaaaacagtggcattgccacctccttttatttagtgccttagacctcttgtgacatgaccaagatggagttaacttttatggctgctttgctgcacttttaactttgcctacccacccttccaggtcatctaagacctcaagttctcttcctaggggctgctgtttgtccctgcactgtaggattgactcttgtctggcacttcccctcctggagagaagttctcacccaagcgctcaaaggcatcagccatggcctggttccgcaccatgtcgatgaggccccggcccaagcagaagtgaggaaagataaggaagacctgtttcaggatccggctcaccttctgcaacttctgctcaggggcagattaagaaggaggtgggtcagaagccgaggctgaggcccagtctgaccccaacccaaggcccagccttgtgggtcccacctgatcagagaagagctcaagcacgaaggtggccatgctgccattgataccaatgaagagattgatgcaggtgagcacaacataggctgtgctgggcacggagaagaagaaggaggctgggtacatgagtggcgtgatcgaccagctgagggggaacaggagccactgttattgccagacaggctgagcagccctgagaagaatatagatctcccatcccaaactgtgttgtagacctctgtaacatggtcaggtcaagatgagcttttaaggcctccttggcatacccctgaataagatcacacttggagtcctctcagatctccatatcctctccttaggatctgctatagagtcccagctccctcagcagagttgagggagaacaagtcctggaggggctgggaacctcacccatacagtagtagcaacagcaggagggcaggcaggttggcaggggccacatacgccctctgctggaaggccaaaaagatgagcaccacgatgcaggctgacaccaagtagttacactacattggagatggtggttatacttcagtatgctgagctaccagggaagcccacaggcatccttggcattgtgtcccaccccaacctccctgtgctttggataataggacgaggtctccatcatccccaagacttcaggggtgccatcctagacaagttcctgaccagaaagggccagaagaggcagtggcaagtggtggcagggcccccaaccctccaggcggtctgcgtaccatgtcccagagaaagttgccaagccagtagagagtggggggcaggccccccatgcactgcaggtgtttggctcgggtgacacgctcgtcaatgaggacaaggatgaagctggccgggacaaaggacatggcgaagaccatgcagatggagacaagcacgtccaccgaggaggccatcctgggagtgaaggggcatgagctgctcagagaggagctgtgctcaccactgatgggactgaggtccccagggctagacacagctggtggggaatgtcctgagccattttgaactgttaggcagggagagatcgtccaggtctctagtaggatagaagtggatgtgacaaggacgtgcaggcagatgggggagactgcagcccatgaagcctgatgatgccccattaccctggcctaaggggtggagaggggaagttcttgttctctgtttacatagcaagag

SEQ ID NO: 48880 - DNA, 2312 bp, Bovine  19866880921699
acgccccgcgtgggctcgggcctcggtggccgcctgtgcgcctttgtcctgccgctggccgcgggagaaagttgggcgcggcccgcgctcctcccctcggcgctccggccccgctgccgcctttgtctgggcgcctccagcctggagagcgccctgcgtgcagctcactgcctgggccctgggctcccggaggttccatcccagggataaggaggttgggccgggcagtgccctctccacacccagaaatggcccggggcggttcgctcgcgtgtgaggggggctaggggccagggcattctggcagggtcaggagagagatttggtggcacaaagagggtacaccttaagacttgccagcctgggcaccctgctggggtgagggggagcaggacagggtgagcgaatatccctcccgctgtcagccccgtcagggatctagggtgtgcacaaggaccccctgtgaaagccacttggggggatccagcccgacagcccttctctggccagggtgtgggggtcccgaagcggcattgtcggaggtctttgcagccgccccattgttctctttgttagagagccaggctgggtgacatcaggccggcggccgctcattggccctggagctgcggggcgggcgggccggaggtggtgggcagtgcccggcccagcacacacccacccaccctgttagctgcttgcccaccagcctcaactttctcttgcccacacctctgggctccggcctctctgttggtcagccaggttctagaacttggggtggggcctgggcggagcttgagatggggctgggggaccctgcctctgggacctcggtcacgggagctagagaaaggtgtggggggcttgaattgcaagatgacctgtcaccctaactgccacgggcagaggaccacagggatacctcaacaccaccctctactagttcctggtgggtggggccttggggccagcaagcctgctgcctcggccacaggtacattcagtcattcatttgtccatccttcatgtggacacaaggagggccaggtgtggtgctaggtcgggggactgccataaaggggtccttggctatgggcaagcaccaagagaccccaattgaacacttcccctccctgccttgtcccctcccagcgctgtcccctccctgccctgtccccggtaaccgcactgggacctggaagaagacagctgccccacaccaaatgttcagaagcccgttgggggcagatgtggagactgaggccggggatgccacccaaggtcactaggctggtggatggtggagcatgagggcaagccccctgtggatgcacgtggcagcacctgggggtgtgggcagtaggcagagggccccaagccctggtctcgtctgagccatctggtggctgagtcgtcaggctccgccctgtctcttacttgtgcctctggtacccgtttaccaggtgtccgcctgggttcccactgatggcaggcagcaaggcagggacccccagagctctccccacatctagggtggttcctctctgtgacgggggttgggggagagcacctcaatggaggtttttgtaaaaattctcaagcaagatgctggttctccacccagtcccagccggcacacagttgccgtcccataattagtcaggtgcagggcctcgggggtggagcacacgtgccaggacaggtcagcagcttcagcagcccttgctccccactcttgaagtatctgtggctcccatcttccctcaccagtcctcaggcacagcctggaagacacactatgcccttcttccagtcacagtcccccacccctccccatctaccctgtgggtccctgaacatggagcctgtccctttttcctgctctgctggcccaagtgcaggggtcgtggcctgccctgaacttactcttctgtctgacccctggtctaaggccaccccttccctggagttcatggagggggtgtgcatctgtccagcctcctctggcaaccagagccacaaacctgggctctccctttcctggacaaccccatgttgctccgtgagcctcagtctcctccccactaggtctatgcaacttctgggcaaggggtagggaccatgacccctgtggtgctccctggtccctgaggctgagaggcctgagggactgagaggaccactgagtgggggcctcagcctgccccacggtatcccctagagaggacctgtcacctccaggccaggagggtaaagcggctgaggtggaagtgcagccatagccagctggtagggccggaatttgcact

SEQ ID NO: 48881 - DNA, 3459 bp, Bovine  19866880925806
cctatgacactgacccttgaggggatgggagtcagggctccactaccagcctgcctcgccctgcccttgcccttggcccccacagccctgcagacaccaatggccaaaaggctgatggcagtgacaccatttttttctcccctaggcttgggcgataaaatgtaaatatacacccaactgcttcttaaaccttggacggaggccagaccagcaacagaatcgttttacagtcttactacagataagtggaaaaaaaaaaaacccacacagaaagagaagcctcttgccctttcttgggggaggcgcaccccttctgagtgcactgcaggctgtggacggagccagcgggccctgatgctgctgtcactggccatccgggggcgggggcgggggcgtgggccaaggacaggacgggctcaagaagcagattctagaaggttagagacagcagctcctctagttcagggaaatcacgtttccttgaaggaaggggagagacagggaacggggtcactctgcatccagaaggccaagtctgttttctcccagaacaccctgtgctcttgccagacctcactgggacggaaaaacatgctctcacctaatgaggaggcgatgtctttcgatgtgcacctttctcaggaccttggcttccgcgctcttcaccttaatcctgcggggacagggacgcccattatgcgccaccagcaatgccaccgaaaccttcgcaaacatattttgctttagatgacaaaagaatcagattcgttttcttctttcgcacccttccactcaaaccaggagtcactgccaaccaggaattcaagcgcctgaggttagaggcagcgaggacccttgtgaatgtggctttttttttttttttcctttccccttttaagacagaaaaaggctggttggatttaagagtaaaaatgaattcaaattgtgacttttatgaggtacatcccactttcaactgcacaaataactcctttgttagatttccagagtggatgataatgtcactaaaagctgtttacagcccagcaggtgtgttttagtttaaaaggatgcgcttcccttttaaactcgagtattcaattactttcccagcctcagggaaagtgtgagctgcggactaagcaggcttaggatcggctctaaagaaagaagggtcgaaggatggggacccggagatgcaggagcaggggctgatcctgtttcattttctacttagaatcaggaattcgcccatcagaaatgcgcaacctgggccattttaatcgtccccagtcatctgtgtccttccaccatgggatgtaacatggtaccctgcgccctccatgcatctgccttctgaatgctaaacaacagtttcttactacaagcacaggctcaaacatcaaatatcccagaacgcagggggctgacacacgtttctgaaagtcacacaaacctatctgtaggaaagaaacaggcctacctgaaccccaacgagagtctaccagcatataatttacacccatcccatttttgtactgatctctctggatatcaataccacatagagattcttcaatttccaaacatacataaaataaaattggttgttttcctcttcgggttactgtgaccacattgataaacaaagaagtgagaagacttaagagcagacttcacttttttttggcggggggggtggggtatcacaaatcccatgcaggaggactacaaaaacacaacacttaactttttgtctaaggagagtatctgaacgtttagaaaatatccttttttcctcttatttttggctgacttttcagttccagccaggacctacattaaaaaaaaaaacacacaaccttgttacaagccaaaaaacacagctgaccctgacaagcagtagcgacatataaacacaaatgcagtgcatgattcttaaagaatataagataggactgcagacacagggaaactgaggcacaaagggacagcagcagaccgagaccaaaagcagggtcttgcctcaagatttggccctcttcccaccacactgctggaaagcgtccccaagacagtcctgttatttactatcagggctgcttgccaaaaatttccttgagttacagccttacatgcctttttatagctgacactgctaaattctttttttttttaaagcgtgagggaaaaaaaaaaaaaaagacacttccagaagtgtaaccttgtaagcactcgaccaaaactccattagaccaggagcaaggaccggtgccaacagatctgagcaccaactgttcaaactcaattattttgctgaagcgactccttaggtatctcctgataaagattttacttgtcacccgaaagtcatttctaattcctgaaattacagaataatggctgtcacctttgcgggccataatcgctttttccatctgcaaaggacatacttggcatccgtcatgatttagactcatgtggcaagtggtaatgatttggcacaaacaaagtacttgaaggtctgacgcgatgtgccctgcaacaaaatttgcacggtggtttataacatcatttgcttcccgcttcgacgcaaccacaattcttaagggcgaaggtgagcttggctgatcctcaagtagatggttcagttccatcatcctgtaccgaggggctccatgccaaaaagaaatgactggccttgatgcctggggaggcgcctggattattttaacaaataaaattcagtcaaattccctcccaaaggttccgcctagattatttttaaaaggctcctgaataaatcgtccccgtgctgagggcctgcctctgacctcggcacgagaggcgttttaaatggtcaaagcttacaaccctcccgtgtttggggagctaacaattgaccccggcgcaaaaaaataaaatcggagaaaaacgactgctcttaaaggacggggacagctgcaggccattcattacatcaaccaggaaggctgatctggctgctgacagaaaagaggagctggggggtgggggtgggggttcgtttgtgcaaagttggggggtgggtcaccacagcaggacactgggcccattagcaggggagggggattcaggcaatagaggtggggattcagacagcaaggaggcgattcagagagaggaagccaggttcacggagcagaagtacgagcgcagacagcagagggtgggttcagggcagggaggagggggctcaagaagcaaaggagaggcttcaaggcgcagaggaaggggttcaggcagaggaggagttcagtgagcaaaggttcagagagcagagagattcaatgaagagaaatgggagatccgctgcacggcggatcaccgccccggggagcctctttcggggttcgcccctccccccaggcccagccccgccgccacggccggcccgaggggcgcagcctgccgggctca

SEQ ID NO: 48882 - DNA, 1714 bp, Bovine  19866880936847
acttgggcttcggggactcctcgcaggcgtgcatacagctccaggtgctcacgaccggtcagcagctcgaagatggcatccgactgagggcagtagcccatgcggcggtgagctgcagccggttcctgggccacgctggggatgggggatgggggacagggaactcagggcactggctggccctggccatgcgaggggcaagcaggggccttggggctcacccaccctgataagggacaggaggtaactcagggccgggtccattgcagggggactcaaggccaggctgatcctgtccatatatgcgagagcaggggaaggtggggaggaacaagagcccaggagcccctcacctgtggccttccagaatggcctcacccccactgggcagcgtgtccccagtcaccatgcggaatgtggatgttttccctgctccgttcacgcccagcagcccgaaacactgcaggtatacccacagaaggcactcatagaagcccggacaattgtcccagcatctctgacttctgggacaggtttctcagcttccactgggagggctgtgggcaaggggatccctgggcagatactggggtgtgtgagtgggcacaagctgtcacatagcagaagtgctagatgacacacagcatgtatttaatcaatggacacagtagatgttctataaaggtcacttgcagtcagtgctccataaatattgaggcaagagttggctgaatgtttcctgccatgcagtgggtaccgacagcaagagcacctggtgagaattcatgctgggcacacagtcaacccaagatggagaggttgactgaacacagtaggcatttgctaaagagtgatggcaatttataccaacacaccacaggtgttcacaggtgtgtgctagcccctagtaggtggccaggaaatggaccacagcagacaagtttgcacaaagtagttgcttgaatgtgcattggtacagagcaggtgcctactaaatattggttgtgagcaagtgcttaatacagataaagtatggactcataaatgttggtgtttgataaaagttgatcatcacaaaggtggcattcaatacacttttggtacaccaatggtgggggggttcaacaagctttactgtatacagttggtactcaataaatgctaacatatagtaggtgcacatagtaactggcacatgtatgggaggccaggaggtgttcaataacaaatttatcctcactaagatcttgttaatcctattgcacacagtggggatcaataaatgtaaccatgcaataggagcttcatatttgttggctctaaataggagctcaaatactgacagccagtaggtactcagtataggacaacagacagagtaggtgttccatagggggaggtagacacaaacatggtaaagaccagtgggtgtacaatagggcagcctctcacccttgcaccacctggacttacctcaccaggggggatccccaggcacaggcggtcaacagctggtgtcctctgcccagggtacacctgggaggatgaagtccatgagaaaggtgggtgggccagtggaggcccccccaacccagcagtggaggccccccaacccacacccaccttggtcaggtccctcagtaccaacacatccccctgggtggccccttgtactacccgttcccgctcacgggccacatcctcatcctcctct

SEQ ID NO: 48883 - DNA, 764 bp, Bovine  19866881019691
cgatctcgcgttccacctgcaggcagggcaccatgtatatacacccggtaggcacccacacccgaggcattcatgccccacaggcgagctccacaccccaggccagggacctctctggggacccgcttcggttctggggctcctgggcactgacgcgcagagagtaccttgcagcgggcgcgtagccgcgcagccccgccccctccgcgaggcaccactttgagcgcgaacacagcgctggtggacatgtcggtcagcttgtagcagcggctgaaggcgccctgcagggcaggagagtcaagctgggtgcatacaggtgtgaggacagatggccaggcctcctcacacacacacacagctcacaccttcctacctggatccccaaagcaacacaacacagatgaacacgaaggcacacagatacatcacagacgcctccatacctggacacgctgagtccacagaaccccaacacagtacccagacacacgctacaacgcccgcacacagaaagcacagacctatgacaaacgcagacacacacgcacagggacaacaaaacagagtctgagtccgcaccaaggctcaaaaacacacaacacacccataccctggacataacccacgacacagcactgcacgcccaacaccggttcccgccacacaacgcgcgccgcacagcgagtacatcgcagacccgggcatccacccacgccagccccgcgccagcctccaaactcccgcagacacgcggacacgcagag

SEQ ID NO: 48884 - DNA, 688 bp, Bovine  19866881073706
cctggaacttgagcaccgcctcacacaccatcctttttgcttctctctcagttctcaccagcacccttggctgtgttgtcccagcttggggctgggctcagtatgagtttgagagaaggaacagctgccctctctggggtgaggatggggctggggggattagacttctcagctcggaccacaaacctctcgcagttgcccaccttggggtcgtggatcccagacagctcctcgaaagtcttgtccccaaccatgacggcagccaggttggctgtgtagctggacagcacgagcaggcagaagatggcccacaggttcatgaggaggcggcccgttgggcacttgggcgtcttgctggataccgtgcgtccaaagaggatggcatagcagaggttgagggcagaggagtaggagaacacggtgtcccggttgcgtccgcggggtgttaggccgaaggggctgcgccactcgtagagggtgaggaagagtgcggtcaggtgcagcgcagcgaagacgcccagccacatggaccagtgcagcggccacatgaaggcgccaatgggcgacgccgtgtcgcgtgcgcgcaccatgatgcccaggctggtggagaagaaagggctggtgaagtccaccacctgtgagcgggccgaattgatgctgaagctggtgacggccatgtgcgcccggc

SEQ ID NO: 48885 - DNA, 888 bp, Bovine  19866881084199
agttaactctatgctttgctgtctgacctcaggcaggaaccctagcccctgctagcctcagacttctgccctgtagaatgggaataacagtgtctccgcacaagtcatgaagaagtctgagcctcaagtttaccctgtgtaggctagaaggtgattatccagtattggagaggtgttaacctcctcagagcctttctccgaggattacagtctacaaatgagttgcctttttaactttcaattaatttctgcaccccatccccaccccagtcccgggagtgctatggacgctgagattttgccacactgacttttttaacatgacacccaagaagtgatcattaatatcagggtagacagcacataagcctcggctcccgccctgagagcccgtgcccaccaacctgcccttccccaggtgtttcctgttgaatgagattgagaaggaggaaaaggagaagctctggtattactcgcagttgcaggggctatctaagcgcttggatgaactcccgcacgtggagacggtgagctccctgggttgccccggggtcgacagggccccgcctatggcgggaggcatagagcggaggtggaggcctctccctctcccgggagccccctcaccggggcccgtccgctcctcccagcagttctcaatgcagatggatctgatccggcagcagctggaattcgaggcccaacacatccgctcgctgatggaggagcgcttcggcacctcggacgagatggtgcagcgggcgcaggtacggcgcgggcggggcagtgggcgaattagagcgcagatcttgtgggaggagtctgggttagagggcggggttatatgcctgagggcgaatcagagagcagaggctacttgtgggtggg

SEQ ID NO: 48886 - DNA, 1327 bp, Bovine  19866881318238
caatgcaagagaccccaatttcattcctgggtcaggaaaatcccctggagaagggaaaagctacccactgcagcactgcagtattctggcctggagaattccactgactgtatagaccatggggtcgcaaagagttggacatgactgagccactttcacttgttcagcgacatcctaggtttgatgcgaggaccccccaccctcacccccggcgtagccaccacgtaaccacccctgggagtggagggacaaactgccccttgttgagacgctctggttttaatctctaattagaatgaataactggatttgctcataaaattagcaagttttgcataggagtgtcaacagatcctcttcgtctactgcagggatgagaaaataaggccggggtcggctggggctccaaccagaactggaagccgaccttaaccaggtctgtggggtcaggatctctggagccacgtggcagcagcaaactgcactttgggagtgactgaagcacgtggcctgaacccctatgcctcagtatcttcactcagctgatttcccaaaagactcccagggtccaacttttcctgccgccctgctgggtctcgaacccttaacttagagctcgcctcactctcctgcgggtcacagcagccgcgctcaagaaaggggcggaatgagtcggtggtgcgcgcggccttgtggggattgtagtcccggcctcgcctccacctcgcgccgactccgcccctggaactacgctcccgtcgtgccccgaggctccaggcggtggcagaggcggagcaggcgggctggttgctaagacttggtgaagcgcagcgcttccgcctgtctcctcaggtaagcacacagccccggggtctcgggcttttacgacccaggctcccgcggaaggcgaggagggcgagggcagggggcgcgcctgcggaggggcgccagcggcgtggggagcaaggcgggggcgccaactggaccaggttcgtgcgcgcgcatcgggcgaacgcggggaggggcgcatgtgcgcgtgcgcgcggggcggccaggtttttgggacccctctttcggcgcccgtcgtccttctgcgcgtgcgctcgcccctgccgtccgttttggagaccccgtgccctaactgcttccactgtgttcaggcctttggtcgtcttggtcacccttgtacctccgtgctgtccgtttacaagctttccgcccgcttagggcgaaacccccagtcttttgtacgtcttgtttgtgcgcgcgctcagtctctcagttgtgtcccactctccgaaccccatggattgtggccctcaggttc

SEQ ID NO: 48887 - DNA, 681 bp, Bovine  19866881361428
caggctccacccctgcccagccctcccctgccccagcccacccctcctcccatccaccaccccagtcctctgccacttgctgggctcagggactcacccgcatcacactcctcaccgctggggggggcactctcactcgcctgtccatacaggttctccatggactatatcagaaggagacaggtgagtccagcctgggcttggccctgtgtgaggcccaccctgcaggagacagtcgccacccccctggacagagcgagtggccgtggtccacagagggaacaggggcactcacccgccctgccagcctgaccccaagcgatatgcaggccacccttgctcacctggcctgggtccccagggggcacggacaggaggatgctgctgtccacttcacccatgaggaactcggatacactgcagggtagaggggcaagtgtcaaggggcacatgggtccacatgggtccccacccttccccacccccactcgtccccacgcctaccccaaactcacgtgctgctaaaggagacagcaatggtctccaaggccttctcaaactcctgcttgtctgactcattgttgcactcataatggaaggctggggacagacaaggatgagagaggttggcccagtctgtttgggaggtgaccaaccgtgcaactaattgaggggggaaca

SEQ ID NO: 48888 - DNA, 1054 bp, Bovine  19866881362527
ttgtgcgcatgcgcacagctacaaccccccaccccgaagcagctgcccaccttcagctcggcgtgtgcgcgcagcgccttagccgctcgcaatcacaacaggcgcgcgactccttaccttcccccaaaagaccccagacccgcgcgtgcgcagaacaccttaacgggactacccactcctagcccggctcagggtccatgtagcctccaccgccctttcccccgacccctgagcgccgcgcagctcgccaacggcgcccgggaacatgccgtcgcaccttcctctgcagctcccaggcacagatgtagttcttgcccagctgtgcggccagcaggtactcgccattgagtagcgccaggccgcggggccctgcctggcctccgcggtacgtgagcaagttggcgccagagtgcagctcccacacaacgcagctccataactgggccgccgagtccgtacacacggctacctccatgggcgccgccatcttgccttctccaccgccccggacgtgcgtaatcatcagcgagacgcgggcgactgcgccgtgccggatagagcggcgcacaggttgcctggctcaaggctgccggctgtcctgcgcgcgcgcacacacctcagggcggggagcgggggactgccctatgaaccaggctgagttatcttcctgctctgcgaaaaataaggggtgcaccgcctggttagagctcttagaaggatacttcttccaaaaatagatggcgaaaccaaggcgtagagtctcctgagagcagttagtagcttcagagcctggaggtctggcttggccctttgcactgggcgctttggccaagcacgcaacttcgcagattcttcttcttcttctaattgtgcaaatactgagtaccgacctcacaggatcgagacattgcacgtaaaacaggctacgctcctaacgtaacaggtagtgatagtcgtgtccgactctttgcgaccccatgggctgtagaccaccaggttcttctgtccatgggatttccccggcaagaatactggagtgggttgctattccctc

SEQ ID NO: 48889 - DNA, 969 bp, Bovine  19866881425694
tctgaaatcccccttcataattaataaatgaagaatatggttgttaatcgatgcagctgtgaagagggtattgattccaacctctcgctattttgtgtgtgtgtgtgtgtgtgccgcttagatttttacacctcatttagaacaaggcttccctggggaactcttaaaaccaaaagatatttgcaaggctggtggagggggcacaaagttggggctgagctggaaaagtgggggtcgagggggtgggagtgggtaggagacaagtagcagtcggcaggatgggagagcggccaaggaaaaattctttatcatcaaagttgccgaatcactgtgtcttccctccaagcacctatttgaatatctgattgagaatcaatcactgcgggtattgggaaaggtcattgggaaaattcacaggagaccatgggggaagttcgtgggtagaaaaataaatcccattattattttttattacacaaacactgcaagtctgtgttggtgaaaatgtagtcaaataaagatcatccaccaccactaccaaaaatatccatctccccattccagagagaaacctttccagatttctcctatacagatgcatacactcctggaaactaatgatacataaatattaaagaattttgtaagaatggcttcgtacactatgaccggcactaaagattaggacctctttctgattgaaaaataataatatgttgccagggtgggaaagtaattagaaaatattgaaaagaacagagaaaagctaattattggtaatttcattccttagaactgaaacaactgttctctccctttaaaaaattttcccaggtttaagcaaacacaaagaatgagattttgtattgtaggatcattttagacatatagaaaagtttgttataaatgagaaattaatgctgatttataccttatagactggttggatttccccagttttctgtaata

SEQ ID NO: 48890 - DNA, 603 bp, Bovine  19866881700776
caatcaaggtgtgtgtgtgggctcacctgccggggctgctccacagccttctgggggtcgctcttcaccttgttgctggggtggttggtgatcttggtcactggctgcttaaagatggatgctgtttgcctgaccgggagggccgtgttcaggtcaggcttgccctgtggagacgggatggggcaggtcctcagagtgcatccctgtcagtgaggaagctgtgctccagggcttcagggtccccagcacaccccagcacccctggaccagaggcagtgctatgcccaggcctgggctgatgtgctgccctcggtgagcttggccaggggctgtggacacacacctgccccctcctgcctcgtggccccgtcctctgcagagcatgggccaggtgcccttagccacctctgtcctgcaatcagggcaggggacaaagtccctgaacacttgtttattggagacttgtagacactacaggcgccaggtgcccaagcacagaccgcagctgggcctctcctgggcaggtgacgggcaggtcccgatcttccttctgcttttccatagccgccgagtctcccccaaggagcagccaggcatctaact

SEQ ID NO: 48891 - DNA, 638 bp, Bovine  19866882051450
tgtctggagcctgtgggtgtgggggccccagcgggcctgcgccgtgtgtgtctgaatctgccatacatagggtgggcttgggggccatgcggcatcagtcggcatccagcttcaccaaggggtgctcaccaagtaggtgctggagaccagggtctgcgcccgtgagagcagctcgagtgggggcagggtggcatggggctctcttgtgctgaacagatgcccccccagcacccccatatctcaggttcttgtgccctcggggccttgcccggctgtggtcatgtgggttctcgcctcgcccagagcaggacaccacggtggtgggtgcagtgttgctgacccctagaggggatgtacgagcgactgagcaagcatgtgccccccagcccccctcctctgccaaggccgcccggggcagttaccctggtctcatctctcgccaggcctgggcacctcttctccagagccaccaggcttcggcccacactttgtttacactcttttggtcaggctgagcagtgatgtggcctaggtaggtggtgcctcctcctccatggtcccccctgtctgcgcccgggccacggacggcacctcctctgctgttctgggcgggggtggactcggcggtgccctcgggg

SEQ ID NO: 48892 - DNA, 1055 bp, Bovine  19866882151570
cttcttttgtagcgcataaatggaacttcaccaaggtaagggggttaggggccctggcggggtggacagacacagccaccagccacagatgtactgctttgagagtccagagccatggggacggcaggtaggggccactggctcacttcagccccacggtggcctccttgcagttcctcattgacaagaacggctgtgtggtgaagcggtatggtcccatggaagagcccctggtaggtgcctgtctggggagcccgctggggggactcgggaaaaggcatccctcacccccttctcccccgcaggtgatagagaaggacctgccgtgctacctctagctccacaaggtgctgcccctacccaagcctgttgcctgtgttccgagaagccttcccccggtgcctatgacggtctgtctgaaaaccagcccctggtggggcagacctgagaacctggcgtgcactccttccggaggaaggtcccttggcctggctgcggcttggcaacccccacctctggctgccttgtgggaataaaatgtacaacacagattggcttgctcctggcttttgctaacccagggctcaggggcaggtgtcatcaactccctaggctgaggggggtgggggcaagtgggaggtggagttccttcaggattcagagggctccacctgtcctgcctggggttgctaatctcctcagcccagcctagcccggcccagccgctgggggagataatgcctcttcattggctactgctctcagccttggtctcctccagtgtacccaggtgtggggacatcaggggacttgggctggtgaccctgctgttgggaggcccgctgcacccaggctgggcatcaggccaagctggtttgagcaccgagccatgcctggcagggcctgctcaccatgctggccttgtgaatgaagacacagagtccgggcatcaggcctgcccatgggctttaccttggtggatgcagccccactccccgggaagggctgtggggtgggtacagcctgcctgctgctcaaaggggccatcctgtgag

SEQ ID NO: 48893 - DNA, 1272 bp, Bovine  19866880370943
gtagttttcaaaagaagagtgatcctcgcctgaggcatctttcaggtccagaggtttggcttgtggggaaatggaccatgaggccacacccagcggttcttagcagctgagaagttgaccccatgtgggctctgggctgggaaagttcctagagggctgtgagcatgccacagcacatcccggcactgcactcccacgtagggtcactcccacaggcccctggcaagctcacatggtgagcgcagaggcagacataaacacgcacacagacagttggccccctggcccccctacctccattctcaagttacagggttaaagacgtcctattcacagccaagggggagggatgagagagggggtgctgaagcagggaaccatctggttcagatcaagattgctcattcaggaccccagtggaactcccagagcctgccttcgtgatggctcacagatttccctccctcccccaacttcccactgagaagctgaaaactgggctaggaagggatcgacccataggcaaatctgccaaaggaagataagaaaacaaaactaaaccaaaagaaaaaaaaccagatacaagcaagtctccaccacctctctgagccctggctccctctttccttcaaaccctgaacaccacgactaaacttgagatcaccacctacagtcactacgtcttcctccacaaagagctcagggggcacctggcagcatcattccctttgccgccaaccatctccaaagttagcagcagaagcaagataagggttaggggtgtggtctcccagacttctcttatgccgccatctccaccaatgtaggaggttccctccatctcggagggatggtggagtccaccacgcgtaatgagaggaagaaatgaccaaccagcttccagacaactgtcccaaagacaagatgggagtgtgcatcactggctaggactgacttactgagggactccagagtgccctgagccccctcggcagctttagctgaaagaggctgccactcccttcccaccaccagcacctctcccctttcccccaacaccaccttagactctgttcttcagcgttttactgtagctgaaagcaagaggcaagatgggagatggatgcagttggcaagaaatagaaatcaaaaggctaacttgagtaaatgagtgatgggtggggggactctacaggcaaaggaggccagaaattaaatacaggaaggaggagggggaaacagaagtgggaaaacgccaaaagggagactaaa

SEQ ID NO: 48894 - DNA, 2322 bp, Bovine  19866880404675
tataacttcccaagcagggggatgttaagaaaaaggaagctttctaatgtgcctcttttttgggaagaagaatctttccaagaaggccccagcagatacctccttatgtctcattggcccaagctggttcatcccgacaccagttcctggtaaaagggaacaggcttactgtggttgcctgtccaggcttgcctcatcttctgggactgggttctttgccgcctgagccaaatcaggactctgttggcaggaaagaagggggagtggctgctggtaggcaaccaacggtgtcggccacagatggcaaaacacacaaacagcgattctgtgtcgtttgtttttttaattttaaagaaggaaaactaaaattgttgaccacattagcaaggaagagtaaggtagagtaagaaagggaataccattcttaaatcacatcaggtttctgccttgttaaatagaacagtactactgaaaaccttagacctcattaggaaagtgtattatgccagcaatttaagatagccactaaaagaggaaagaagagggatataatttccaacccaggagggaaagaagtggtgggagtagggataatgtgtcaatccaacaaggcaggaaaaggaagaagaactaaaggaaaactagtaaagagaaaacaaagagtaacacgaccccagatgcatcagggtaaagggttatactcgtatgttaaacaactaccagataaaaggcaaataacgagtggtctgaagcctggagagactggtcagtgggcacaggggctgaacaggaaccaccctggccttcgccatagaagtggttctgttctttaaataacttgtttttcccttgtgctatattctggcctctcctcaattgtttctgtctgggtttgccttgctactgagatagtattgtttttccagaccgcttcctgccttctgtatatacgtataacaaaaccctggattctgtcctgccacaggacaccaacacaccatgcagggactcgtttaagggcaggtgtggtgcagcgccgagaccctgcaccccccgtccccctgccctgctgcttgcccatgccccaggactcagcatccctcccttggagcctgtttcttagggtgcaccatcgatcctctcgcaatgaagactgatggtttatttctcccgggcttattggaaagttagccaggctggaagagctgtattagctcttgctttctggtttcctggctgccaactctggacagcgtcagcagtcctggagctgagatctcagactgaacatccagtcagagtgaggtgtcctgcagtaagacgggctcctgaagcagacactgccggaggggttgtaactggggagcaagggggcctgagtcactaggataactgaggggtctgtgccagaggctggtgccagtgtgtggcaatggatgagttcaggcagccaggcatgcagaggtcaagccagccgttctcagatcaaggaggtgggctccagttcagtgagaaggggggttgtcgggtccctccctccgcatcttgactgattcccacccccaccccccaggcatctgctgttgccacacccaggaggcaggcaatttgctgggttgctcggtggccaggttctgggacacagggagcactttgattattgtaccccagtaagtgggaaaagcctctctgtaaggaaggcagtgagagcctgtggagggagccctggccttggagccatcagccctgggatggcattaaagctccgtccctcaccgcctggctgacctcgttcggctgtcttgggacttctgtgaataccgaatgagaggctgtgcctgtgaatgctcagaaacgcggaaagcatcacacatgtgagtactaatctgtggcttgatgcctttccgttgaggctctgagacacatccttaggccgcgtgtctgggtggaaagagcgagctttatcagagtctcgggctgggattttctttccttctgtccaacccctccagcttcaagcagccgccctccccccagcctctgctccttattttgacgtttcttttctctgcctgccaagaagattgtgttcagctgcgctggtctgaggctgtgctatcctgtgcttcattaggttaattcgatggcttgtctcctgggaacggaccagagactggctctaaaaccgcactcgcctccaaaacccagttcccactgttctcctttggggctggctttgctgctcagtcccatatgcctgcttttccttttcttccacctgcaagctggctagggcctcctttggcttcccttggttctttg

SEQ ID NO: 48895 - DNA, 1245 bp, Bovine  19866880410382
aggactcacaggactctgcatgtaactgtactcacagctgtgatttattgcaatgaaaagcaaaattagcaaaaggaaaaggccatgttgaaaaggccagaggaaaccagtctcaagcttgcaacaatcctctcctagaggagtcagaagctccattttattcctgcttaattcctctagccacagtcagtaacgacacacagaaagtgttgtcaaagaagctccttagagactatgctcagggtttttattggggtcctgccacatggtcattctttgcctcacaggtaccaaaattccagactcctggaaggaaagcagctgttatcataaacctcatatttttttagaaacatagttagtgaacccttcagcagttttgggaatggtgggaaccttctcatcatccaggctcccagaagcctgccagggttcagctttccaagctggctttctgaaggctagcagtcagacctgctgtgttaagtcctgtgtatacagtacccatgaagcatttggagatttggcactggagttcaggcagaatcagaacaggggtgtaaaactgacaagttaccacaaataaataaaaaagtattgtaaaggttatggtttgtactcgagtttaaaactagttttcagcatcaggtattccctaaagacagttactgagaattggtttcaaatctattttaacctacaaccctatgaataatacaaatatagacctaaacatactcgtatctggttttgtccattctgtttcttgagtggctggtgtaaataaatgttttaaaacactgcttcccaatggttgggtaagaccccttgtattttaccatttagacttaagtacattagcttgataaatgtaattgaccggtgaacaatttgggggttatgagcccccaacccacgctgcagttgaaagtccccaaataacattgcacctccatatatgtggccccacattcaaccagccatgggttgagtagtactgtagcatttatccttgaataagtgaacccttgaagttcaaacccgatgtttaacagtcaattgtaactcatggtattctgttatcaggtgtctctgctcttaagtgtttcttttcattcccattcagatgagtaatttgcagattaaggaagaaaaagtcaaaccagataccaatggtgagtcacaagtaactacgatctacatgtgtgcttccgctttgtactcttagctgcagcgggaaagcag

SEQ ID NO: 48896 - DNA, 798 bp, Bovine  19866880517312
tcctccctggtccctgtcactcttaccggcctccttggtgctgtgcaggggataccgcttggctcctctatgacacctacgggttccccgtggatctcactgcactgattgctgaagagaaggggctggtggtggacatggatggctttgacgaggagaggaaactggcccaggtaaagtgtttatggtgtgagcgggaaactcagcgccaagcaaggtaggacttggctgcaaagcacgagtttcctcccattaaagtttttaaaatttctgtttttcccaagaccagtgagtctcaagtgggggcggtttggcagtaatgtctaaagacatttctcgggtttctcagcttggggggcaggtgctgctgccatgtggtgggttgaggccaggcatgctgctcagcctccttcagtggacagcctcccagagcaagagttcccagctccaaatgtcatggtgctgagatcagaaaaactctgtttcacagctttacatggggcatggtttagtaattttgagtctttcagagttctttttctctgacattaaggtaacttgtgcttatttctcttgctggcagctgaaatcacagggcaagggagctggtggggaggacctcattatgctggacatttatgctattgaagagctccgggaaaagggtctggaggcaacagatgattccccgaagtacagttaccattcggattccagtggaacctacggtatgttcatttgttcatctagggtggttttcaagcaatgcgtctcaagattgggaacccaaaatatcca

SEQ ID NO: 48897 - DNA, 3703 bp, Bovine  19866880524733
cattgtaaattggcttattaaaactggttcacaagccctccttttttccttttgtgattgctttggtcttggattttcagtgtaggactaaaaattcaagtcagatttcagttactaggataattttctttgaattttaaatttttgtaagtaaatgcatagatttttaatgaactcggtattcagtggatttgctttcaatttagctggagagttaatttcatgattgatttattagccctttgaaagtataaaaagtggtatctgtagttcatgaagactgaaaaacatcatcacattttgtttagcatctttttaaaaccaattaaaagcttttctaaaatggattgaacaggagaaaataaaacatgttcccgaggtctttatttcaatcaagtttccctgtgttctgcaggagaagagatcgaggggggatagaaaaattgaaaagggctgtcccagcagggagccacgccggagaaaagggctgctctgagaactcagcagcagcagctaagaaagctcccagcctgcttcatctacatgcagagtcacacaaggcacgggggtgctcaccgtcaccacagaggtttcacatgtgcttccctgctgattcctgtgaaaagctaacaattggcttggaggggaaaagaccactgcagttcaccctccctgagctggacgtacaatttgtccagtgttaggaaatgtccggcttagcagtgagaggctcgaagacacccctccttccagtaagattcctaaagccggctcttttgctcgatgacactggggctcttttcaagttttgcagatttatggaagtcgaggggaatgtgcttttcaggatcaggaggatgaaagccttagtctcttcctgtcaagaaagaggcagtaaggccaggtaaaccttcttgcaaactgtaacacgaatggctttgttactttcctcctagatctcttctggcaccttctttttttttttttttttttccttccgggagacaaagtgcctgaaaaggaactcctcagctgtgaaatgacatgacttcctagtttcctcaacaagtgtgagagtagttaagcccattaacccgactgccttaatgtttacctgacagtttttgcaaatcagtttggaagacctcatacatatgtaccagagtaaccttgtaccttacagagaaccactgctttttcacttcagtgcttcccagcccttttcatatcacagcatatagaaaataataacatctgatgatatagttgggtaagtggatgaggccagtcacagctggccagaggtgcatccccaccaggtgctaacccccttcccaacggctaaatagtactgatactatagaacacttacagtttattcacagcattccagctggcagaatctttggaaactgtgaacttttacaaaagaagaccactccaatagcaatattactgaagtaggactcaaaagatctcacagttgttaagacttttagctaaaaaataaagttgttgagaaaaattccttcctcactgctctggcatttagaaatattaacctgagaagaaagaagtagggcttagagctgggaagggtgtaatatgtgaaccaataagacttagtaaattcctgatgggaactcaggcagacatgtttgtttctccatgggtttcatttaaggtcaccgatctctagacaagattgcttttcctgtaatccttatatgatctctcagtgcaatcttacttcagatatgttattaggaagtcttggtgatattaagcaactcctcaggctttgggttgctttagcgaaataagcaaataatggaagagactccaactcatgcaggcctaaacacgaatatctctctgtctatctgttcaaaattaactcgggctaatgactataatatgactcaataagatatataaccactttaggaaagaggtttagtcattttgccagacacattaattgtaatcactgatgtggtgacttttgcattagacttctttattgaaaaaaatctgggtgatgattgacagttcagtagcccagttttcccatttaactcagtgatattagatggctaccatagtttataaataaattctctaaaagtatacttcgcttagtagattatctcagacagttctgtgtaagttatatatatatatagagagagagagacagttttaagttcatcaaaatcagtgaaagaagtttggtgagtccttttataaaatattgctacaaatatctgctaaataaaaccatgttttcttttttttgctttttttttgtattttattttttaaattatttattttaattggaggctaattactttatagtactatggtggtttttgccatacatcaacatgaatcagccatgggtatacatgtttccccccgccccgtcccgaatccccctcaactttattgtattaataattgtttgtttcttctttcagtagttcatttctttatttcctatttaattgaagtattgttaaaatataaatataaatgtatccagccaaagatagaaaatataaaagaaacagaaaacatgattttctgaaatttttcatctatagttataattttcattcattaattatcaccatttaaccatattaatatggtaacatattaatatgttcatgttgcaaaaagtgttatctcccttggaagatgtgtctgggtgaatatgatagtcctaagaagcagcagcatatagtggaaggcatatagagctaatagtaaaaattgccatattttgaactctgcacagtatgccagagattttattaacaattttataagcattatgtcatttaccctcaccattgcctttcattgtttctgttctacagttgatgaaactgagacttaaataacttcctcaaggtcatgtagctagtatgtagtaagatcaggattaaaagcctcctttttagccattgtgctgtgttgccaccacagtcacttaaaatttagcagtgctaaaacaaaatttgaatgattcattttatcccagctatagcttccagatggttaggactatagttacagtatgaaattatgttagaaaactatttcctctacctatgagatttgtgttatgtaatttatagattttttatgaatttagaaaatagatctcaatttatattaggggattttgcttgaatacctatattatcccttccatttccttttgtaaacgtcatttattatggaggtgtaggatatatatttttactcctttagttgactatttggcatttatattgccatctgcttggtgaaattgaattagataaacttgagcaatactttcttttaaagaaagacatacctttgcaataataattcgttagaaatggaatgggaggtagaaggaaacaggaagatgagaggtaagtagaaaggaagaggggccaaaaggtgctagaggtgaaagggaggagaggaaacagataattgatcttccctcagtggaaagaaggcctaatgccagaattcatgttgtgccttgtgaccttagaaaaacaatcttgcttctacttggtggtttaacagtggccattggatccattttcttttagtttgttgatttttaagggaatagaagaatcctctcctttcacacctttagatttctccagaaaatatatatatactagat

SEQ ID NO: 48898 - DNA, 1592 bp, Bovine  19866880779537
tgctgcctaaggatttcatagtctttaactgttttacagactaccttttcttcaagttgactctaataatacagttcaaatctaaattctcattaactagcatcaagaaactgtttccaaggaagggagtgagggtcattttaaatttttcacactgaaccaacaggattctcttcaacaatgaagactttgggggtggactcctaagatagtacctactttctggtatctactgattaagaaaaatgattgtattattcatgattctattttattgaccatacacagaaatatctatatatatatatatgtgataatcagtagtagaataccaggcatattattttcggtacagctagagctcagttttggggtctttttggccatgatgcatggcctgtggaatcttaagttccctcacctgggactgaacttgtgcccccttgcaggggaaagtgcaagcacagtctgaaccactgaaccaacagggaagactctagagcttagttttcatatgggaacaaccaacactagagattgagagctgtggggctagatttgggtttaaaatccagctcacctctcagttgtgtggcctcaagtcactggtaaaatttggatatcctcgatttccatgtaaagaccctgcggaatcagaaatgtgtggaagtcatctaagatgctgcacggcagataggtggcacatacgtgagtgttacaactgtgtcctcacgttttgcctgaaatccaaccctagtctctcctgaatgcttcatataagaattgttttctaaaatgttacgtttgtgattaagctgactggccctgaaaatgcagttccaggcttcgcgtggtttaacttatagtttctctattttatgacagtggaagtgatatgcattcagtaaaaatcatacttttgaattttgatctttacctgggccagcgatatccagtacgatattcactactggggtgtaaccatctcataaatggaggaaaacctgcagagtatacagatatcttttaagctaattaatgttaggttacctatgttacctgcaattaccaatcatttagcagtctgtgtgggtgcttggtcccttaaatttacacaactgaaatcacaatcttccatctcaggttttcaggaatcaaccaggatttgtcaaatacttgccaaatactcagcatcaggaacagtgaattattaggactgaagatgaaacattagactcaaacactagcaacaagaatgggacttttctattagtaatcctcaattcatatgatagtgaaataactacaccctagaatgatgtctcatggtactgttagaaggctatcagtgtgttttaaaaggtaattgtaaaaatggcttatttaccttgttttattaagtcactagaacttcgatctcaatgcttaatttcccccaacagtttagctatttccaagaaaaacaaccatttgaagactgacattatagataacaaatactattaccttgaactggtttctctttatcagatggtttcagtaaaaacctgtctaccctcgttgccatatcatatctgttaacacagcaaaag

SEQ ID NO: 48899 - DNA, 872 bp, Bovine  19866880804495
ttggaactaactttcctgtcaggtagaaaataaacttgtaaaacattatatactatttgttcccatttttacttgtgagcacacaccaccccctatatacatctgtatgcaaatagagaaaagtcctgactggttagttatatgcaaaattccaaagaattgtgacttctgaaaaatgagtcaaagagtattttcactttctacctctatactgtttgaatactttgccacaataatatattactttaaaaatcttattattaaaccccatttcacaccaaagcagtctaaccaggctatgctcagcctttggagacacaggagtctatagtcaagtttgtgagaaaaggcttgccccttccaggaagatgaaccagcctgatgaagaaaggaacaaactggttcttaccaggaatggttttgctgtctcccaggctctgaattttcctgtccaggatgcgacgccctctgctgagagtcttgagaaactgcacttcttcttcattaatgatgtccttcaccatatctgggtccttcttcagctcaggaaacgcatctccctggcaaatgggaaacacagattttaggccaataaagacaaggattatatcacgactcctctaaaaattctcattaacagtgtgacatcgcccaccctaccccaattaaggtatgcactttagtacagaagaggtgagcaggaaatacacctaccagagactggacaacaacatctactaacgtagcaaagaaacccctgctggcgttgagcttctcgtgagagtatcgaacagcccggcggagaatccgtctcaacacatacctgtaagagagagaacctaagaccccgctagacagcattcccagtcaag

SEQ ID NO: 48900 - DNA, 2277 bp, Bovine  19866880806468
gagtaactgtccttacctcactgagttgggaaaagatctaatgagctactagatgaaaaggtgctaagtcaaagaagagaaaataatggcggttgggaggtttgctctaggtgctcgggactgggggtggggtgctggggggcaggtcccagccgtgttctgactgcagagctggaaatacggcagaagcgagagcagatccctgccggaacgctgctgctggctgtggaggaccctgaggttcacgtgggcagtggaggagccaccctcaatgccctgctggtggctgctgagcacctgagcgcccgcgcaggcttcaccgtgagtggtcctgatgtcccctcctcagcacggcagggcgggggcttcaagcagggctttccctggtccccgctcctcgggccccactgccctgccccattcaggatcagcatcatgtttgcatctgtagattgggcagactcacccaggtgagggcaaaacacagggccagcctttggtagtagttcagagccagtgtcggaactcttgaaaaatccgtcttgccaccctgggctctccttcccacgtggcagtggcttgctggagctgggatgcagcagcccccgagggtagggcaccagcccacgtcccgcacacacccagtcacttcagtcggtcaccctgctggcgtggtgccctggcacagggagggagggtagctgcagctgtggctgcagcctggcactgggagtggtgccagtgagccgggggaccactgtgtggctgccagccagccccatgctatcgtctgcaagcttccctacaagtggggcaggggtggccccaccgccaaggccgctttgtcccctcatctcggaggggccagggctgtcttgtgcctgcctctggccattggtcttacctgttattgctttgctacttgtgtggactggtgctggggtttctccctggaggggaggctgccatccttggctgccatctgtccagacctctgtcaacagggctctcccacttctgataggtggtcacgtcagatgttctgcactcggcctggatcctcatcctgcacatggttagtagaatgcccggcagggcccacgcaggagggagccattggttcttggggctggacgggaccttagagggcgccttcctctgtgcaaggtgtccactgtgcacgttcggaagcgtcaggatcagaattgatccaggtgttcaaaagggggaattggataaataaaagcagcatatcctctggaggaatgttagacagcgattaaaaggtccatttaactctctgcactcacctgtgcattgactgactctgtgacctggggcagtggtcacgtgatcatttctaggccttggttagcacttcctccttcatatggaagtgttgagatggcccattaaatgtttaaattggggctggacctggctcactgtgagtgtcagtgaatgtgttttcattatttagtgaaaaaggtgagtcacacaagtttgaatagaatgatctcggcttttttaattgaaagtttggttgagatcatcatagatgcacatataagaaatagtccagagagaaacctctgtaaaccttgcctagatccctgcaatggtcatattttccaaaactatagtatagtcacagccaggatattgattttgatgtggttcccaatcttacttctccagtttgacttacactcctatgtgtgtgtgtgaagttctattttctccaccttttaagtttttgtaaaaacatagtctgcatatgaggtatatgaaaggatatacctcaaaaatgagggcaatggttattatccctgagggggtctttttccttttgtgtatctgcattgtctaattttttaccatagtcatttcaaaaattacacggaaaagttatatgagaaaaacccttgtcaaagtccagagcctggtggctttccgctccggccctctgccccaggctcctctgcctgaccccgctcccccagggccgagacttccccttcgatgactgtggccgggccttcacctgcctccctgtggagaacccccaggcccccgtggaggccgtggtctgcaacctggactgcctgctggacatcatgagccatcgggtgaggccgggcccttgtcctgttccccactgtgccccagccatggtctttgctggctgagacaggggacgccagaacaatggctttgggagcccacgtttagttaccaacaaggctttgggtgccagcttttagggggcgcttcagg

SEQ ID NO: 48901 - DNA, 819 bp, Bovine  19866880861945
aaaccctgaaaactgagaggagagagttaaagatgacatgatatacaatgtacaagtcagatcaggcaggactgtacatattgcagcatctctcgggataaatttggttccctggaatttgtggagatctgacatggagcagaaaaaagcatgaagagcccggcctgtctcagaaattacctttgagggcagatggaaaccagaaacgtgcagaggcgtttccgggtgctgaatcgatgaactcactttaacctttaaaaagaaaaaggaacaagagacagcactaagcaaagaaatacaggctgaaaattcaacatggaagagtaattaaaaaaaaaaaaaaaacagaaaacaaaatacttccccctgggttattgaaataaaaaagatttattcaatgttttttaaagagtgagaaacataaaaatatatgtgaagaattattcagggagtccactaccaccaaataaccattttaggacattccttttttggccctggacataaagctctaatgcacatcattatgtataaaacttggaagtatctttggttacatccttaggataaatgcccaaaagtggaattgctgggtcaagagagaggagttttaaagcttctgatacaaaacaggttaactcctgcccaaaagactgcaggaaagggtggtttttaggaatctcaagttgacagatgccaaaacagaaacccggctcagccacaaagtcagcctttatgtaaaactattcccttgactcccatccccccaaaacattctggtgacacacggaagtctgtactttcggcatcgcttttaga

SEQ ID NO: 48902 - DNA, 606 bp, Bovine  19866880885557
cccattgaatttttgttcatgtatttaaagttgtaagggagaaattgtaacatttaccttactcagatctttttctgtatatctttatataactacaacactgaaaatatgtttctattaacggtttatacacatagactcctaatagcactgtggtgtatatattgatgaactatgatctgcataggtattcctctgttgagcatcaaggtcatgtaatcatcattctataacatttgagaaatattgatgctgtgagggattgtttttgaggtacagtgagaggacttggactagggaagaactgaaagtaagcatcagttttcatacctttgtgtatatagtaacataaaatgtttttatctgtggcttggtttcctcatttatttttttgctccccaggcctttacatttctagtgtctcatagaatttgaactgtctcagctcttgggtatgggatgtgattttgaatgacggccgctttgtgtctgataaaggtgctgttgtcaagaccaatgctaatgcagagaaggctgatgaagaggagaaaggtaacctagcctagagttatgtatacgtggagttctacagtctgagagaatgga

SEQ ID NO: 48903 - DNA, 1869 bp, Bovine  19866881084220
tctgaatcctggactataaaattttaatgttattctgaaggtaatggccacagaaggttttgaaccagtgatcaattcagagcaaagcccccttccctttaaacccctccacagtgattttttaaaaagtgacaaaatgacagtgatatttgaagacagctctgctcaaaacagtacagatcagagagaatgccagcaaagagacaattccaaggctgccttcaccttccaggtgggaggagaaggggaaaatcaagaatcagatagaagaaattgatctagaccggtggatccatacaatttttctgtaaacagccataaaaaaaatattttagactttatgggccgcctggtctctgttgtggctactcagctctgtcactgtagcacaaaagcagccacagtcaaaaccttgactaccgagtgtacatgtgttccaataaaactttaatttacaaaaccagatgggggccaatttggtccagaggccacagtttgcccatccccagatccaggcgaacattaaagtccctccagcttttagaatctgtcagataataaagatctgaaaaggtgaggtatgggagaggtcacagtgaccttcaggtctcaaggcaggataaatggacctggatggaaggaccggaagagaaatccagtctcagaaggaagatgggaaattcggttacagacacaggtactgagcccataaatacagaagctagacactgagtcactaagttagaaatgccagagttttgaggaatttcgctgtaatgagtaaaatctccagggcctgacatttctacccactgttttccctactcaaccgaacaggtggaaggagaatgtgtgaagctgcctgtttcatagcgccaggaggctcgccctccacctgtggccggcccccgcgtctcacctggtagaggaatctttggctgaagtgctgcatggcgccctggagctggttgcgttgggactgccactgctcgtagttccgcacgtactcggctgtggggcgctgccatgtggtggtccgggtattgtggtccacgtagtagaacctgcctcgggggtctgtgcgtttctcccagctgaaaacatcaagctccgagtgaacacggtgaccacctcacccctacgctcacatagagaaactgggcaggctggcaaggaggatggcgaggaaaggtctggtgtagggtctggcccaggggcttagctgctccagggaggcagaggcaggtggggcccagtcacggacgctctgggggccaggatgattctaacagacatctgtggttgcccctgcagcaaccgatctcaatctttttttttttttaacatttaaagatttttttttaatgtgaactatttctaaagtttttattgaatttgatacaagattgcttctgttgcttatgttctgggtttttgaccatgaggcctgtgggatcttagcttcctgaccaggaatcaaacccacatgccctgcactggaagatgaagtcttaaccactggaccaccagggaagccccaaccagtctcttctaccaacagcccctggatttcatgtcagagatccaagtggctctgcagcagctgactatactcctgaccctggagttgaatggctgactggaccaggaatgggcatgtgacctatgtcaaaccaatcagggtgaatctcataatttttagtacttacagtgggaaaaatgtagtcttccttgccagatgtgattgagaaagcatgcagtcctgggactggctaacatcctggacccaaacacaattatgaagttgacccagtggatggcagagcagaaaaatggggggaaaaagccagtcccctggggataccgttt

SEQ ID NO: 48904 - DNA, 1162 bp, Bovine  19866881198464
ccccgtcctctccccgccgggcccattacgttggcactggctgcttcgtgagtggcctggacgtggcccagtcccaggcgctgcacggcgtggagctgcgtgaccttgtcctgcggggacaccacgtgcagctgcacggtgcacctagccgggccttcaccctcgtgggccgcctggacagctgggaggtaggtgctcagcggcctcccctcacccccatttttaggccttgggcagccccagtgtcctcagcgcagcgcccactcccctgcggggctctgcgagcgctcacctggggaatacaggctgtgaggaggatgcgaccggtagggcctcagcaggcctttccctccctgctcctggctagctggggactcctacccccatttttcaggctgagactgaggttcagagaaggaagcgacccgccttggctgcagagccagttgcagtgggtcaggccggaggccagcattctgctccgggtcccaggcccccgggcaggcatctggaggtgccagggcttgtcgctggttcaggacctgtttgcccgtgtgcccccgtctctcttcctgcgaccccagtcccctggccttattttccctaaccccttcctgtggccccatcagtcctgactgcttccttctcttctcccagagacaggggacaggaacatatctcaacatgtcttggagtaaattcttccagaagacgggcatccggtaggggtggatggccccatggggctccgtgggtcttggcagccggggtggcagctgcctggaggctcagggcccacctccctcaatccctggggcctggggtagttttgagcagcctcatctgccctagcatcttccccctgggctattccaaattcttgaccgtgcccaggctctgggattttgttcagcggcctgggaaaggaggcagggcagctgggcctcccgccctgaatcgctcgcttgtgccgtctctggagggcttggtcctgtccccaggaaggagccaggcccccgctgacaggtggtcggggctggggggaccgtgctcccttcctgctgatgcggcttctccccacctcagggactgggacctgtgggaccccggacgtgccccccactgagcgctgcctcctcagtgcccgtctcttccccgtgct

SEQ ID NO: 48905 - DNA, 1068 bp, Bovine  19866881200829
cgcagctgtgggggctctgcaggtcaggggagcccgtttctgatgacccccgtcctgccccggggcagccccctacctgtggtgagcacctgctccaggtgcaggactgcgtggatcagggcctccgcgcccaccacgcggcctgcggcccgctgcaccgccgccagggcggcccccgccaggatgctgctggtgcctgcagggcgggagagagggccggcatgaagccgctccgccagcccgtcctgccccacccactcccgctccacgaggcagggcccggcgaggaggccagagcgaggctgaaggggtgaccgggccggtgtgcagcaaggggcggacccactcaccaaggccagacccgtggggcagctcagaccaggtgtgcagctcgaagccacccccgaaggcacgtagcagctgctccctcagcgagagctcggaggagacactgacgatgcccgcgcagacgaaggctgccttcagcagcgcccctgcgtagggagcagtccccagctgggcgtttggtctccagggcggaaacagcccccaacccgtctcagcgcggccaggggctcagcccagcagcagtgcacaccccctccccagtcacgacaggccctgcgggctctgggcaacagcccgcgggccgctctcccttctgcacccgtgtgggctgtgggggtgatggcagggcgcccctcaggcctggccgctgtggcctgaaggctctgaggctccgcccccacgccccgccgcgcacgtggcaggcgcgctgacctggggcctggggctggcagtaaccccgcatgtcgtccaggttgcaacacacgatcttcacggccatctggtcctgccggggccccaccgccagccgcagctcgggctccgggatgcggcgagccctggccccaatgggcccggcggctgtccactcgcacagccaggcccagcacggccccaccgagctcgtaggccaggggcggtgtgtcactccagccccctgtggcaacagaacgagacccagctggtctcgaggggctgccagctcagctctgggggtgccaa

SEQ ID NO: 48906 - DNA, 840 bp, Bovine  19866881246099
ttagttgctattataaatagcatctcttcgtaatatctgtatttataaaagctactgttttccatttatttattttgttgtcatttttaagttaatagtcttagtcatgcaagtttacaatcacatattctacaaaaagtgatcattttacttctttttaagttttaatgcctttattttctttcttacatctcattgtgtgtactaacttaatggtatattttaaattaggttaaggaagtcagaggtgacatcactctgaagtcaaccaacatttctagaaatttgaattttcttatgcactaaacttagaataaaaatccattaaacataaagaaacccaactatttacattttgatcacttaaataaggtctgatatttatattgtcccaccttttgaatggatttgatatttgcctttctgattacgataactgttttcttgtgtaggtgttatcaaaaccaatgccactccagagaaaacagatgaagaagagaaaggtaactaatctttgaaaccctgtcacctaggacttgcctctctggagccagaggcactgtgagttataagattgaggaaatgaaggggattcagccaaggagattgagaatagtcagtgagatagaaccaatagagggtggtgtcccagagaccagaagaaggaagtgtttcaaaggtagggagtcatgtataagtaataagttaacagaactaaaaattggctactcagttgatttagaacgtagaagtcattgatgagtttgacaaggggctattgaagtcaagtggggagatttaatgaaaaaacctctaagtgtgcactcggggagaacagga

SEQ ID NO: 48907 - DNA, 1276 bp, Bovine  19866881248099
atctagttcatagcagaagcttctggggctgggagtggctcccccaaatcccctcacaaccctgtcaggaagccagtcctctgtggaacagtccccacaggctgttctgaggtgatgggagctctgtcataatcccaggcaccttcttttctttcttttccttttgtctgttgtttttttaaatttccatcaagtaatggataccaggtaaggcagacagggaccaggacccttggttgatactgtgaacattgcaggctgctgctcaaggggtgggggctgggctccatagttctggatctttttcagcttttgggttccctgtagcttctggaactgattatttttatttctttaatttctccttgtcatcagtaaagagggagggccatgcacattgtttgttttcaggacagaaacagtgttgaaagctgagaaacttttaagttgggaaaggtgagcgctatcgtgcctgccatccacctggaaccagtgggtgcccccttcagtccctctcagaatcaccagctagagttgagcttgcccctgcagcccatactttctccctcaaacaactcagagtcatcgttagtacagcagtaaagggccagagagtaaatattgtccaaaggagaaagtatgtctgagctcaccagacactgcccctcttgaagcacacacgtaggaataataccaggatgcccacagccccaggtgtctgcatgtatgcacaacatagagattttgctgggatgtgggagtttgagaaccaaactttgcctttaagcaggagggtacagaggcccggtggtgctgagcagagaggtatgagggaaaaggcagcctccccccgtgcccccagtgaccctgcctatgggacagggatgcctaggttggctgcatccgaggaccagagagtagccgtgatggactggggtgggcgccagggtcgaggggaggctgggctgtgtctgcactttgcacacagctggatgcaattacgcctctggtttcagctggcctgctccccctctgtgttgccacaccgcccgcttccctccagcaaaccaaccgaagacggtgcttcatcttgagttgaaaacgtgtatacccctcccctgctccccagtagggaaagatcctctttgtcctttttttcgccagtgacagacacgagtgagccaggcttgcgctggttaaacttctctaacagggtggggacagaggcagagacgcagacctagcacccaggaggtgggagccagaggggagagga

SEQ ID NO: 48908 - DNA, 1010 bp, Bovine  19866881275611
acccttccccttctttctctccccctcaacccccaacttttagaggctgaaaaaaaaaaaaagaaatttaagtctctcattgtgctgggatggccgggtgttttcagagtgggagataaaagtcaatttaaaaactgagtcctatgaacccacctgactgttgtagagggaaaaaagcaaacttaaaaactattcttacagtttttctttttctttttaacctgtggactatacaagaatggagaaaggacacttaattgagtttttgctcttctattcatgagaccaaaagtttccgttgcaaaactgaaaattctcacatacaccacagaccgtttcctgactctaatagacttatgagaaatttttagtcaagttattaaaaatcaatcatatcaattggagtgcagggtatgctacataggaaataattttactcttgtgtggaatagtaatgccagcagccactggggcaatatttttaagctatttgagttggtttagtttctattatttacaaagatagttacaaatcataaaaaaattggcctgttatttatatatatatacatatatgtgtgtatacacatacatgcacacaggatttgtggaacctttcccccaagaatttgagcaattcatctggacttggagtggtggggataagggagaagccctaagcaaaggagacccctgtcaagtgtctctggggtgggacccctctgcaaagctttacctgcagaccaggaatttaaacttgtgtcaccagagtctacctatctttccatctttacatctgagtcaggttgcccaattctcttcactgccttctgtgtagtaatcaaccctgtgaacattctcttcctatcagaggtaagaaagcttttcagagccaccccaagatggcaaagcagaaccagaaattattctcaaaagtacatcaccgctgtacgctgttgtaacaagtcccaacggaagtcccttcaaaatgggccaaagtcccattcatt

SEQ ID NO: 48909 - DNA, 1081 bp, Bovine  19866881391081
taatataaaaaagtatctttatataaacattacattcaaatcctccattacttttgattaaatttaaaataagtgtaaggtcacacatgtttttaaatgtagggaaaaggttatagtaacatgctaccaaccaaaaaaacacttggtgcttgagtcctttttcagattacacgaaataaaacattttccccttggagcaaactttcaaaaataactgttttatagactcaaatgtaattttctatccacagcttgttatttaataactttattatgtgcagtcaaccaaagagctttaaactcactcccatagttgaagataagattcattctgggagatggatctaacagatgtgccaatatgaaattttaagaaataataaatgtataaaagtattttatagaaaaattttaatgttaaaagtatgtattttaaaacctcctgaaacaaaccctcaaatcacactctttaatacaaattttgccagcactgttcatgttgaccagataatgctttagttttctttaaaaagtaaaatgaaatgcataccagcagcaactacagctggaggaggcgagcctgcctcaccaccacttgtctgactcattgatgctacaggtgtttctctagatggaggtaactgtaactcctttgggagaagatcatagacagattctgttgggagaaagagaaaaaatttttatgagcacaaaattaatgtttttccactcacaagaattatattattcatacacacacacactaaacttcatgtaattactgttgtaaaaattattagcaaacatttttattttattataattttagtgaaaggcacaatgaactttccattcattctgactcccattttcttcttggcttttcctttcatgctgatgatatacagaaaaagttaccaaattttttaaaccatataaaactaggcagtagagacgccaaataacacaagatgctccaaaatctctgtttaaaaaaaaaaaaagtattatgtctcatcctttacatgtaagatggcatgtactggtgtatatcagctataaatggcttcttcaaacagac

SEQ ID NO: 48910 - DNA, 1262 bp, Bovine  19866881394651
gggttgcacagagtcggacacgactgaagcaacttagcagcaagaattaactaaaggaagtattctgaagtaatagtcttttattagatcaagcagttattgacattgtaagattgtgaaaagagtaaggaggtgaccttgacaattttcatatattcacacacagaaagtttctgtgatttaaaacccatttgtaattttttttttttacacatatttacttttaaccaacatagactcattctagaattctagtgtcttattgatagagccttcatcatctaacattataggtaagagagtttaaattgcagaataattattgtagggagttcagttagtatatatatttagagttgctttttaaaaatttggcatattaatatccttagcgatataaatgtcaaaaagagttttggagtaaattaccagttactcagtgttttctggccaaaagactagatatttagggaaagatacattaatttagacttttgtgatttattttttaatctatagcatttgctgttttaatatgaaatgcataaaaatgatgactcttgatgtagttaattcttcagagttttgaaggagctggattggctgctatcaggtatgagggcctggtgggaacagacttctagttctgccataaaggtttgtgtttcacaaattctgaatcaatttaaattttaaaatttagagactgggcatatagatattcatgtacatttaaaattatttaattattaaaaatgtgtttctcagattcgccaatctatatttttttccctttacgtattactgaaggattgagtaatcatgatgctgctaatccacaatccagaatattgggtaaaagaatgtctctgaaacctcctttcctgtctctacattatacacacttttaatactgtcatttataatatctttagtctggtaagaacctggactgggagtaggggaaagagggcttccttcctcacaatgtctctcctctctagagggccagtgtcacagtctggaggtgtagttgaatatcagcagtctgaaatttgtattttaaaccattttttaaaaacatatgtttttatcccactagaaagtttcttagtagtttgagattcaatatgtgaatgtataaaagttttaaggtacagacttcctgaagaatattgtaggtttttggtaattaagacagaggccatttttctaacataaagttatccacatgaacttattatattttttggcaaaataag

SEQ ID NO: 48911 - DNA, 1098 bp, Bovine  19866881556914
cctctccctcccgctccccattaatatttttctcaccctgcttgggctctgaaaccatttgccagacctccaccactcccacccataccactggattcccttctcattctttacttctgacactcagccctagtcctccttacccttcttgaactctgaactctacaattctttaaagctgatttgaaaaaatattcctataagatgtttggaaattataaatcgataaaggttttactcagtagtcaggtcataggtaagactttgaaagtgtttattctagaacagacttaaataacttcttttgaaaatagtataaataaattaagaaagtataatatataacaaaaatggttaaatagaataatccattctgtatcttataagtgttactaagttatgtagaaaataattgtgaaattttaaagtgaaaaataatacctattagaaaaaatagatctcaagttattcttcttatttcccaaattgttgcaatctgtgctgctgcatattgtttaaaattattgtagaccactagcttgaggaaaatggtaataaaatatattcaaaaaaaggtgatatgattaaataagtaacagcaaactagtaaatggatttaaacttaaatgagaaaattttattaaaacagagatcacatacaagttattcttggacttaataatcttttagaaaccaaatatccagtagacctgcagccagtacattttccagtggagatgccaagtatgatgactgtcaagcccaaagtgtttttaacagaatgaatgctgtctctcttcaatgcagaagtatgttggcacagtggaggtgccaggcattttgttttagaatgtctgatgtgaaaccatagccttgggattcaccagcttattgaggtagttaataaagacatggaagagtaaggcaattagtttgccaaaccatttgcaagaactcttcgtaagtcttttttaactcttctggatgctaaggtagctttgtatatagacttaaaaaacaaagtgaaatcccattttagaaacaagatacaaacatttataaatacatttccagtattagaatgtttgcatctagtat

SEQ ID NO: 48912 - DNA, 1059 bp, Bovine  19866882070176
gcttacctaataagaaatgttcctgacatccagaaatccctgtcagccaatattttattgaaagttctaagagcataaaagaaaagagactttcagctatgatgaataaatctgtggcattttaaattctctaaggaggaaaactgggttgccaagagacaagggtggagggagaccatcactttttcatacttttaaacttttgaatcatgtgaattattaactagtcaaagaaagtaaatatatattaagatctttttaaaaaggggaaaggaaaattcccacaaggtctctgagatactaagtcttacaaaagaagaactagcaaggatcagttgttcaaaggaacagatactcacagccgaagctcctcgaaggacttgactgagtagagcggggagttggggtcccgctgcagaacctccacttggttggtgttatcgacaaggttgcttctgatcagcttgttgagtaaggactgggcggctctgtcctctgtaggaaaacaccaacagatcttcctcgtactcatcaggcaaaccccgtgtctgcacccacccctggatagcccagcaaggtgggagaaaaatacaatcacaccaacaagcctcactttaactcctgatccctagatgcaagtgggctgagtcgctgggcaagtctttgtttctatacaccaccccccgttcacttgtctcctttcttcagtttctgaactctccactttctcactgccccgagaagtaaacctaatcagaagcaccgccacacactgtggtgactacccacacatccacctgtgtttgtgggcgtcctctaccttcgctgctattacctgtggatggacagttatgctcctgaccccatcccgtcctgtggacaaggacatttctcccagcagtgacctttctctcctgcattctgtttctccctctactacatcattccccccagcatgtgtacacgttttgccatctctcatcataaatcttcctcctttatcctacatgcccatccacttactgcccaaattctctgctcccctttatggagcattcc

SEQ ID NO: 48913 - DNA, 719 bp, Bovine  19866882132771
gtgcccgtgacctggccccgactcgtgggccctggctgtggacgagcaggaagcggctgccgagtcggtgagttggtttcagccgtgaaagggtcagggggccagttttggccggggatcggatcctggaaaaagtcactccctgggttggtccgaatcggggtggggtgcgtgtggggatagagcctggaccctgagctggctttgtttccccacccgccagcctcccccgggttacgtaagcagaggtgagcgcttccatcgggaaagagccagccgcccccctgtcttcctggagtcaggattgcacttaccgccttgaactgtagtaatcacctatttaggtgtcattttccacttccccattctgagctgcttgggtccaggaaccatagcttactcatgtttatgtgcttcctcagcttgctcattgatgatgaatgatccactctgtgggcccggcagtcagtaaatcctctcgtgatcagcttaactttgttgtgggcctgacacacagtaagcaagatatatgttaaacggtactgtgtagaattaatttttcccgcctaaacattcgcattatgatagtgctttgaacccgcttttttggtacctgagttcagttctgttgctcagtcgtgtccgactctttgcgaccccatgaattgcaacactccatcaccaattcccggagttcactcaaactcaggtccattgag

SEQ ID NO: 48914 - DNA, 826 bp, Bovine  19866880257484
ttaacaagtgttagagtggctacagaatagaaccaaaatgaaaattttctctttgatgcaatcagaattgaaagggagtggaaaagggaataatttttgctcattgctgactcaatattatataaagcagcatccagacagcttctcaaacactctcaaagcctgagccctactgcatcatcccacaactaggccctggcttttaagtttattgagaagagaagctgaaaccagaagctgagagagtttctgcttgggtagaggaaagtgatgtcaagtttccgtaagtatgtttttcctcaagaaatatgaaagaattttgtaaacattttaatgcaataagagaaggttgcaaacgctaaggaccagggcatctcctttcctagacaatgttaagaataggccagagatgtgatgtggaatcggagaaggcaatggcaccccactctagtactcttgcctggaaaatcccatggacggaggagcctggtaggctgcagtccatggggtcgctaagggtcggacacgactgaacgacttcacattcacttttcactttcatgcactggagaaggaaatggcaacccactccagtgttcttgcctggataatcccagggacaggggagcctggtggactgccgtctatggggtcacacagagtcagacacgactgaagcgacttagcagcagcagtggtgtggaatagtcctcagagataagaccttgggagtcatttaatgcagaatctcttcttcagccttccctgaatacatatagtcagacatacaggaatgtatgtgcccagggacacacacacgtgcatg

SEQ ID NO: 48915 - DNA, 1683 bp, Bovine  19866880387971
acttctttcctgtgatattctgggctgagaggatcacagacttacttcactgcctgttatttttgggaaaattcagagtccccagagaaggagctgaagcctaaaaaagccaaagtggcagataagaaagccagattaattattcgaaacctgagctttaaggtaagagagaggaaacagtgagtgttctgaaggctcttggggccagggcctgcttgttggttgaactccccgccagggtggcataattgggcttcattcctcctgggaatgacctttagcagtgttgaattcagaaaatgggcctgtataaacaagaatttattcaggatagacagcatgaagatgtcttccttttgtggaaaccactgctgagattgggagaggaggacaagctctctcacgtctgtcctttttaccatttaggtacaaagcaaggtgtcctctacttgggaatgtttgatgtcctagtctcaaaattttaaaaggagtaaaaatactcaagctcttcccagtgaactaatttaatagttgatgttttatatttatttgccgtgataacatctctttctttctcactttccggttcagtgctcagaagatgacttgaaaacagtattttctcagtttggaactatcctggaagtaaatatccccaggaaaccaggtacctgccaacctttattttgtgtggattaggttattttacataatggtgtttttccatgtcacctttcaactaagcactatttgaaatagaaatagaaggttggggtcatactctccaagcctcagatgatatggcatatataaagtatagtgcttgacacagaacaatgtttattccccagatggtgtttttagttagatcagaactccttttaggagacgagtaaaatgcattgctctcctgagcctgtgtcaggctaacgtcagcaggataaaggctcttactttgggcagggggctgactggctggcaggatttgagccttctcgccagtccaggttgctgtataatccatcttagtgtctgttggttccttctgctacctctgatttctttgttatgtttgcacacagatggaaagatgcgtggttttgcttttgttcagttcaaaaacctcctagaagcaggaaaggctctcaaaggcatgaacatgaaagagataaaaggtaagttttctgtgcccatcctattgactcagatatttctggtgttcatgcagattaacacagtaacccactttctacatttctgaaaggtgtttgccttgttgagagtctcactgctaatatagaagttgctttgatcttagggttaaactcgacaggacccttcccagccttctctttttcttttttcagtgatgagtgtcctttaaatctcttaatgagaaaccattgctgaaatgatcattgatatacaggcagattgctgtctaggggaatgtgagattagcggattcttctctcttgattatgatccctattaagcatatgtgggctcctaaactgaccttgaggttactctgggtattgatttaccaggtactctgcctaaagaagggattggcttggagacttcctaacttctgagtaatgtgcagattattccagaatgtctgttttccctcttgctaatctaactggaaacttgatctaactggaagcactgtactaa

SEQ ID NO: 48916 - DNA, 2892 bp, Bovine  19866880402750
gagtgggtgagtgaggtggaatctattaccaaccgggctcacagctggagctaggaggcaggaagggcttttacaacattgactatctgagtgttagaaacctgatgagccaagctacttctgaagatggactgagtgccgctgctgctgctaagtcgcttcagtcgtgtccgactctgtgcgaccccatagacggcagcccaccaggctcccccgtccctgggattctccaggcaagaacattggagtgggttaccatttccttctccaatgcatgaaagtgaaaagtgaaagtgaagtcactcagtcgtgtccgactcttagcgaccccatggactgcagcccaccaggctcctccgttcatgggattttccaggcaagagttctggagtggggtgccatcgccttttccgacggactcagtagatgagtgtttttcaacttttatcatttattatgattccctccccccactcacgtatggggatatacatatatacaacagtttccacaaaagagtggtcagttgtgactacatgtgatactctgtctcccttctctatttcattaatgaaaacagcatacagttatgacactgaattaactgaaacctcgggggtgaggtttgcaaggtcaagggcttggggaagactgaggtgtgaagacagaagggctgggtggcctgacggccctctttgagaggtcaaaggccacacccaaaggcttacgtatcagctttgggacttggcttttgtgtcccaagggatcaaggacaggacgagaaatatgcagcccactaacagagagtaagtcaaacaaggtaacgtcataaggtaggagagacaagacgcagctgctgaaggcaggggaaggacacgtgcagccagcgaggggagtcctgctatgccctcccctcctgagagcctggccagtagggaagcccgattgcactgtacctctgactcaaatgccccttgatgctgggctggcgtcccccgcgtgctgctttgttactgatgcaccagacttagagaaggttaaagaaaacatatcacaggaatgaaggccgggttctctaacagcgacccggaggctgcagtggccaagctgggccagcccacatgccacaaaggtgagcgccccagatggtgagaaggaagcgtgtgtcatcaggttccggaagccctcggtaggcaggccaggcagagctgcaattctggttggggctcaatcgccactatctgctgtctttcccactaaggccccagggctggcctgcctgctcacgaggacagttaattctgctgagcttccaatgccacacgtgcaggtcagccaccaagctgacccctgacacaggcaacactcgaatactgaaaacactgttgttgttgtttttaaatctcaaacattcttgaacatttccttccctataatggggagggcagaatggagaagaaagagacacccatggggccctcgcagctgacttctgccaagggcagacacaggagaggcaggccagacacatctgcttctgctccagaggctccctgacctctttaaagcccgacagacagacctgcctaagggaaaagccattatccctcacaccttctctatgctttctgggataggaaggccgaccaagattacttaaaaacagaaacagaagagaatttgcttgattcggtacaattgagaaagagaaaattcatcaccaggcatcggcacatcatttctggtttctattctgctgctgacaaagtatcacacatctccaagcctcaaggtctctggctgtaaaatgaaggtgctccaaaattctctcctggccaggaaatcctaccatctgcattatgcccttctgagatctcccatgtcaggttcaactctgggagtacagggtgcctcctttcaaatgtcaaattctggatatacataagcattctattaaaaagaaattatacatttagagacattgactaactaggtcaattaacacaaacactttggtcagtcagctctggagcaagaagtacaaattgttgtaaatgatacgataatggctacgtaagattctgttgatggccatatgagggagttgtgtattgcttgaatattttacattatatgttgagttttatgataattaagcctcaaagcatggtgccttttttctttattgaagtgagggaagtatcacaaattcgccttggctagaagtgacacctttccaatggcttagtccagcaaacaagaggccaggcatttgcggctggaaacagaactctagtggaaatagtaaccaataggagggattagttggtggtgtttattactcgtctactatgtgtttgttactgcattggacatcacggagggaaggatggagccttctgccaactttggatacttgcggagatcccctggcagaccttctctgcccctatttcacaaatacgcatcactgcctactctgggttaggcactgggttgggagatgaaaactcaataatgaaaaagacagactttgtcctaatgaagcctaattagcagcatgacaatatcatcttccccaccattgtatgaagtatgctgtcggtgatggaatttatcatcggtctgtagggtgctggatgttatgcagtaacatgccatatctggattatggcgggcaggtgcatccgtgtctaggagactattgggaggatgcactggacaagtcaatcacgagctcaccactgacccgtcccttgctaaggaggcagcctcaggcagctgctttcccgcacgtggccctggattctgtcctctccctggtcacaaattgggaatggatgtcagagcaggaggtgagaaatgagggagagagggcagagttgctcctgt

SEQ ID NO: 48917 - DNA, 5166 bp, Bovine  19866880434707
agatgggagatgattttcttctcccgagagaaaaaggcactatttaaaacagtaccacagccttgatggatgaccagatttctccagccccagtgtggaacccctagtccttcactttgggaaaactatttttggaggagggcagggcttatttttttttaagattttattattttggccactccatgcagcatgtgggatcttagttccccaacctgggatcaaacctgagccccctgcactggtgtagcacagaatctacagggattctggaccagggaaatccctgggaaacatttttggcctgcaaaacttttaccggtctgatgggtcagtaacaataagcattaaaagatagtgttcaagttgtgggtcttatttttattagccttttcactttccagaaagctttatttcttttagacctggataaatccctcggggtccacagacttgttctgatttgcatagctgtccttcgctctggggccgagttgtagcaatgatctctgtaacctacaaaaaagcaattggaatatgggcttccatctgccaccaatttgtgttttgggtaagcgatgccaagaggtatactctgcacctgatatctacctcctttcatcagaaataccccagtaggttcctgctaactttattccgtgcagtatcgcctaccttgggtagcacggagcccaatggagtgacagctagatgcctacctgtgtgcagttgccctatggaggtatgtgatggaagcgaaagcagaaacaccttctgcttttcaggtggggttacgtgtgctctgccccacaatctttgctgtaaaagaataacatttggtgatttcatatgagccaagcattttaaaacctcttgtaaaatctgaccgtagcttttacccttgccagactgaagatcagaaacggttgagtctgtcttgtcttttgagaaatcccaagcagtccttccgatgccgggcagccgtaggagctctggctggggagtgaagtataaaacctccttggcggctggtgaacagtaggctgcatgcagagtttctgtgcctgtgcccttcagagtatgcagcagccggctgcagacactgctctctcatttgatgtggtggctctgtctgcaagcggaagctgctggttttcagaccggctccctgtaggataatgaattgtcatgcctctgctgattatctaacaagtttgtacaacgtgtaacacaagctgacaagacaaacaattttattaatttaagcctgctgctaatgggattgcagcactatatgaatgtaggagtattagatacacatacaagagtatccaaccccacaaatagtcatactctgcgtttggtaatgggcagagtctattcattgaaaaataaagtttggtatttccatttgtccttaataaaatactattcatttgaatggtgaaatacttagggatgttcagggatttatagagctcaaatcaacggctcaaatgagccgttgtatcagcctttgaagtacgagagctaatagatgccggtgggcagtagataaacttctggtttttacaaaccaattacaagtagaggagcttttgtcgtaaatctgtctggagttttggtcttcagctgggagagtgctggagcctatggggagacaggctagactttcacagcctctgatctgaagtattttcatttcaaattctcatattcttatatataaacttgacaatttgaggccattgaaccttgggttgttggccagaattgattaaccgtgtttatgaaaggaatgcatcatccaagagagagggttagttcaggcagataagaaaagaggtttcctatgaactctgtgtaatgtgatttttggcttctgagagatgtgttcccagcatggaaaatgatctggcctacgaaccagggagtttcagactccgccagagtacacggatgtggggataatttcagcaagcatccttctgtttcagagacaataaacagggacctttgctttcaggaccctgggtaaggaatatagcagcagagtaggttcccgtcagcctcccaacatccagacgtttagagtgcaggctataaactgtgccaagttaatgcggcaggcagtcaagaatttagggcactggtatttaaaaaaaaaaaatcattaaaaaaatcatagtaaatctaaagcagcgagtgattgaggctttctgccctaattgtgtcaactttatgcatcattctgtttggggattatccagtgtttgcaccccaacaattgtggtgctgctgcctgttcatcctccttgcctctctccctggtgcctccctcacatccgctttccgaacagcttctgtacttcagacctgtgttgtcttaaagcatattgccacagggcagggggtggtagcaggcaagttctgtaagtgcattttgtagaatgtttaaaaaaaaaaataagggaacaaactagaaaatcctagtctatatttcccattttgtctttattcttctgaagcagaggctgtgttcccagagtgtcgagtctctgattcttccagtgtccttccctgtccctttgtatcttagacctgcatgtcttcaatttttcttaccaccactctctgctttagccattcctctcggtattcttcccctgcaaggcttatcgcctctcaggtacagaggcaacataaaatctgggctcctctaccttgtttacttgcccccaaacaaattagatacacagcttcattttctaagaggtagaattgccagctgctaccagaaataacaatatttgcataatggtacaaataccaagtagcttttggattctgctcctgttaccaagtccaaactcgtgctgctcgtcatatgacaggtcagtaaaccaagagatgagttgttggggcaagaaacggtgactcattggaaagccaggagacttagaaaggtgggtggattagtgtcccaaagaactagaattcagacttcttttatactagaattcagaggagaaagtcctggttccggccagactctggagggaatgtgtacatttctttcttcttggagccattattcataggtaggcatggtcaggatgtttcttgtgaactaaacaaaggcaagttagcttaacactcattacctaggaggcagggttcctagagatggccctacatataatttaagaataggcagcatcccatgagcaagtgattaacttgtagtagcatacaaaggttcttccctcttaacattcatagtactaatatggttttcttcattaagttgtaaatggtattactttgcctatctttgccattttctgaaagccgtgttctaaaaagaaacctttttgaggttaaacagtcatgtgtataaggtgtagtaagtgtacagcttgatgaattgttaggtatgtgtacacccgtttatctactactcagatcaacacagtaatttagcgtcccagaccgtgtgctccatgttaggtaactgctgttcttaaggacttccaggatagctcagtggtaaagagtctgcctgccagtgcaggagatgcaagacgcaacagtttttgatcgctggatggggaagatcccctggagaaatggctacccaccccggtattcttgcttgagaaatcccaaggacataggaacctggcgggctccatggggtcacaaaagggtcgaacacgactgagtgactaaacaacaacaacaaaccactgttctatcatcactgattagttgtgcctatctgttcttgaacttcactaaatggaatcatgcattaagtacccttttgggtttggcttattttatgcaacactgtgcctataagatttatgtgtataatactccattatatgaattagccatagtttgtttttcagttctattattggacagttagattatttccagcttggatgtattatgataaaatgctgatgaccattcttatatatgcctttggacatgcacatctgtttttcctgtgtacctaataatgcttttgtttgatcacagggatgaatgtggatggatctgaacttttttttttttactttacaacttcattaaccttccctgcttatttattccttgagagacttgatactggagggaagaagaatggacttgaaaggattaggctagttgaattaggctggtgtctgaaaccagcccaccactagttctgagactttaaatctgtttctgaacctgtgagatgggtggtacagtgtctagttactgtgtagtcgccagtcctgtccggctctctgccaccccgtggactgcagcactccaggcttccctctccttcactctctcccgctgttggctcaaattcattcattcagagataatgcataggggatatttatttaacacacattccccccttttttttttactttctagagaaatctgattgcctgctcatagctctaatgaagaggaaaatatttgtttgactttagcactattaattttgaactttcctagctttgtcttggataatcatctctgtgcaaacgtgacaataagaaaagttagtagagaggttaacgtataacttttatgtaagaaatctcaaaaggcacctttgccatgttttgtcatcccaccttttgctattaagggacaagcctctaaaattttaacctgattatctattcagtagttcttttaagtgctagctttatgtctaaagggcttccatggtgtctcagagggtaaaggaatctgcctgcaatggtggggagacccaggtttgatccgggtagcccaccaggctcctgggtccatgggattctctgggcaatagtactggagtgtgttgccattgccttctccaggggatcttcccaacccagggatcgaacccgggtctcccacattgtaggcagattctttattgtcagagccagcagagccaccaggagtgggacacgactgagcaactaatacttttacctttttgtctaatattttcctcttttggttgtttcttcctactttcaaacattgagactctgtgtctcaatgtgtactaataggtgattttgtaataatatggacttgatgaactacaaactgcattgtaatcataaacttctgaacaaatttgtacgtcat

SEQ ID NO: 48918 - DNA, 1965 bp, Bovine  19866880601900
ggtgggttccccagtggttcactggtaaagaatctgcctgccactgcagaaacacaagtgtgatccctgatctggaagatcccacatgacaaggaacagctcccatgtgccacagctattgagcctgtgctctagagcctgggagccgcaactgctgagaccggcgtgcccgagagcctgtgctccacagcaagagaagccaccacaatggaagcccgtgcactgcaactagagagtagccctccctcatcacaactagagaaaagcctgagcagcagcgaagacccagcacactcaaaaactaaatacaattttaaaaattaaaaaagtatttttggtatgctgcacaacacgtgggatcttagtgccctgtgtgcttgcatgtgtgtatgtgtgcacttagtcactcagctgtgtccgaccgtttgcggccccatggactgtagcccaccaggttcctctgtccatggggattctccaggcaagaatcctggtgtaggttgccatgccttcctccagaccagggatcaaacctgtatcctgtgcagtggaagcacactcttaaccactggacagctggagaattccctcagaatcataggaattcactccaaaagtccacagtggtccaagggccatttcttttcaaagcctaaaatctttatggatccagaatgaggagtagagaggtgaatgagaacctacctaataaggtttttgtccaaagtggtatcaaattatctaatttcagcactccatggctttcagagttaaagtactgacaccagagactcaggggaaggtactgatgaagacacttggatggataatcctggctatttccccgggtacatcaatgtgtggttggtttctgagatgtccggtaatgatgagacgtgtgcccctaagcagctctgggctcagctctggcactcatgtcttaattaggtgggttttgactcatcattatttagtaactcatttttccttaacacagtgctttagttgttttatgcaattagaaggaggaagctcccaaaagtcatcacattacagaagagatgtgacagaaaagatcattaactctatcttactgttcaaatcccagcagtaattaaggacttacgtaaatagcacagcttaaattatttagctgacaatccctaataacaacaccagcacttgattcttcagaaaagcgaaagtgattagtctgctatgtaacctcatcatcagaaaaaatgtatttcccttttgtaacatttgttatgacgtccttgtaaaagggcaaattaaagacaagagttttgacacatcaaattgtactgtagcatgaaagtcaaaataagtgtttcctccattagaaggctggcatccatgctgcattggggaattttttctcttgggtggcaggcaatgtggatgaagttgagtggaacctaattttcagcaagttcttatctttttcaccatctattctaggaatgatgctgcagaagttaattctttcaggaagactggttctagaaagatgattgaggttcatgcgggagattaggggggattttaaaactttcctttggcaaactaacatttatcagtcttcttgggtgtgtgaggatgtgggccaggcgctagatacaaaggtggtgaggcagtgatcctggcttctacgagcttcgttctaaccctgaaccatcagccaatgatgtttccagttctcagcacttggtcacctgctggaagataggggtggtcatgtccccttctttgatctataggaactcttgcatgattccttcactcccctatccccctcccaacaagtaagcaggaattttctctttaactacatcaaatccagcccaccttgaccattatagaaagttagacttcctactactcctggtagtagacaatcaatgagatgcagatgcaaaggctctgtggttggcacacagcagg

SEQ ID NO: 48919 - DNA, 863 bp, Bovine  19866880632018
acaactttggaattcttgaacgttaatttttgtgcctgcatcatcagccaaagcattatgttaaagtagattcaggagctgaattttaagcagtttttagggatatgggggtgttacagcaggttgatggtgataaactaccactgagaagtttatgtttttgtagaatcctttgtaacttctcaaggggtaatgggtggatttcccttagccgagtggacaacggaaaattgttggaatatatttcctagtttaggcagggtcctgtttgtaaaatttcttgctctttaccaaggtaggttatcagcttatttcaaactcttgttcattcctgagatcttcctccattttaagaaagctttaagtgaggctcagctctgagagtcaacatatggcttttgagtgaattgaggaaccccttattggttcgttaaattcctttggaagatcttagtgagggtcacataagagatgaatataaccctctttgagtacagtgatggaggtgctgtgcggagccctgttgtggtgggtgctggggaagtcttcttggaaacagctcactagcctcttgagcgctcatggatgagaagtaagcaggtgggagaaagggcctcctagaccagcactgtctaatagatgcataatgcaagccacagatgtgagctgtgtgttatttaaaattgtctagtagctttgttttaaagaacattaattttaatgcagcttatttgacctactatatccaaaacagtatcatttcaacatttaatgaatataaaaaattcatgagatatttaacttttatctttactgtgtcttagaaatctggtgtatattttatacttggatctcagtttatc

SEQ ID NO: 48920 - DNA, 1609 bp, Bovine  19866880673965
actgtgcgtgcccttgtgcatatttgcacaattacattgtaggttattacactgcagcctattgtgatgaaaacgattatccccaggtaaatgtataggaagcagttatatttaactaagctacaacagcatcgctgaccagtggatattatactattgctaatttaaagcagtattaccaatgctgccgggcttctcaggtggcgccagtggtaaagaacccgcctaccaatgcaggagacatgggttccatccctgggttggggagatcccctggaggagggcatggcaacccactctagtattcttgcctggagaatcccacaaacagaggagcctggtgggtgagagcccatggggtcacaaagagctggacacgattgaagtgacttagcacacacgcaccaacgccgccaccctgaggagggtgctgctccttcaaggttcgggaaaggagacacatgcaagttctccgctgctccgctgtctctgtgtgaaacctcagcactggctacagagtctagtctgatctcaagaagtggtgtgtttgcagagaggtcaggctcaaatcgctgaggtaatgagctgcagccagcatctcaaatacactctcaggcaaaaggcagccattgtcacccaggtccaggtgtgctgtgtgctctccatgtgcctgtccctcagcagctgagctgttgccttctttacctggccagaaactctgacttggtgccttgggtgcatcaggtgtataatgcagtgacccagaagttacttcacatggttaacatctgtatgtataatcagaagacagttcctctcaattgttcaaatgcacttttattgcatattttttttatgtgtgttttctctgaggatcagtacttgctatgggcaagtttctcccccaccctcaaatccctgcctcaagactgggctgttgtttactcccagggggtcctctcggccagggacagaacagttgtggtcacacagagctgtttctttcaggatcagttccttgtctgaccatcagcagaggtcagaggaccccaaattaaagttgcatctatttactatttgctgtttatgtattttttcttcatctctctccatcctttcgggatggtaaatcctggtccagggaacagaggagaccaggggaggatggagggacaagagctgagtttgccagtctgtcggaggtgtcctgtgtgacacatgctcctccctcttccttcctccacttgataaactttctccctgttcccctcaagctctggagggctgccgtaagaaacggtagagggctttggaaggacacttcaggcttagttgtgtctgtgcgcaggaagtgagtggagagactttaatttgtgcacaggtgtgtcgcttggagtgacattggctccccctggtttgatgttaatgaacccgagagcggtgggtttgtggtgaaatgaggctgcagtttctttctgaagggaaagaacaggccaggctggtgatcatttgtgatattgtgtcatgtgtgtgggttcctccctgtggtccagaagaagaaatgagtatatggccatttaaaaagtaatttagctcatagactcctgtc

SEQ ID NO: 48921 - DNA, 2924 bp, Bovine  19866880736659
taatagcacctaccgcataagaactgatgtcttatagcaagtgaatatatataaaggaatattccatatattccattatattataattgttgttactactactactactactattatgtgccaacaggtaatgctattctctattgactgagttcactagttccagtctaggacattcgtagccccacctttgctgccttaagtctccactcctatcatttctgtctctgcttcttcagctgaccctcgtgctctttaggctcactgagcctattatatgacattctttctctgatctagagtttccttatctggagatagttgggtggctatctttctgctgcttttgaaatatccaaacttctgcacttttgaaagggaagaggatgagaaacagaaatcattgaggatctcaggtctttgcctgtatgctttctgaaggttatggaatcctggctgtggtctctctatggagtgagcgggaactgaactattttaatgtaatctagtcagcagtgaaactatgtctgtaaacaggtcctacataggaaagctcagtgctccagcttgggtaactatccacagcttgctgctgctactgctgctgctaagttgcctcagttgtgtctgactttttgcgaccccatagacggcagcccaccaggctccaccatccctgggattctccaggcaagaacactggagtgggttgccatttccttctccaatgcatgaaagtgaaaagtgaaagtgaagtcgctcagtcgtgtccgactcttcgagaccccatggactgcagcccaccaggctcctccgtccatgggatttttccaggcaagagtactggaggtggggtgccattgccttagcaagactcaaaggcaatggggaataaagctccctccccgagcttaaggatcttacttccatcccaggaatccagagctctttcatctttactgtgtccaccgggcccccaaagcaacacctgctgagtccaacagaagtccccatactaccagagggtaaatcatctcattactgtccctggcttggcaccatcagacacaataaccagactttgaatggtccatgtcccaggtttcaccatcagcccagctggcatctctttcacctccacccctcagcttacccagttcctctttactggtcctcatgtccacttcttgccctgactctctcaaatctccactgcgggtgtgctcagtcactcagtcgtgtctgactctgtgtgaccccatgacctgtagcccaccaggctcctctgtccatgggattctacaggcaagaacgcattcccttctgcagaggacattcctgacccagggatcagccccaggtctcctgcattgcaggtgaattctttactgacagagccacctgatctcaactacctgaaatcaattattttagccttccctggactgctccacattcatctctctctttctttttgtggaagaaagtgcaacagtgatgtttcatggaaactcctgtttcctctctgattctctcttctctgttcaatgtttagactgttcaaacccctcattttctccacccactaggccggtttctctttctcctggtactttaagttctttctgttagtttctatatctcataatacaatatataataataatcatctccatcaaacagtgtctggagagaactctggctagagctgcttgacctcagtcaccagggatcagcccctctggagcctgcctgggatgtgcaggtgcccctcagggtctgcacatgggctccccctgcaggatgcccagtgctctgccgtttggtagggacacagactgattgtaattgttggtaacccagtcttccttcatcacatcccctctgagagtctgagccgtgtgattggcaggggactcagcatcaagtcagaagaggcaaaggagatgcagacttgggaaatatttggcagctgccagtgccctgaggcaccatttccccttctaaccccgtacccttcaatatccactccccacaccttgagtctgactttctccagagatggaattgaaaagacaggctcaggaactcaacagggtaaaatcctttggggttattgtcactgttaagaaagctgggtttaaaaagagaattctcctcttttctcaggagagaacaaggaatttattttaaaccaacaggtaaaaatatcagtcacactaacataattgcccaaatgtactaatcttagtaattcagaaaaaataagtctgctggattggtaataaagaatgctgatttgacctctgatattttcttttcatgttacagtgtgagaaaacatgcaccacataaccactttaagtgcacaattccatggcatcaagtccatgatatagccatcatcactatccatttccagaagttttcatcatcccaaattctgtacccattaaacaacaactctcctttcctcaccccctctaaacttggaccttaatgttactttctgtttctattgatttatctattctaggtaccatgtgtgagtgggatcatgtaatatttgttcttttgtgtatggcttatctcacttggcatggtgtctttgaaaagcaagttcttaggcatgcttcccttctcttgattatcctggtctcaaaaaaattaaagctacttttggagctattggtggagccttgggtaagaacagaggtggagtcctgggcaacattggagatgtcagtccatctgcctgcggggatgaagtgtcgaagcaaaggaactctgtaagagtagattccctttgagtttcaagttcacatgtcttgagtactgggagagccccagatgagagagaaaacaaagcaagataatgtcatcagccagtccacggagatactacgcaattcaaataggaaaac

SEQ ID NO: 48922 - DNA, 1659 bp, Bovine  19866880740834
tcaagttcctgtgcctctccgtctactcaggtggagatgaaagcagaaatagatccgcttttctcgctgcggcctgttcatcttctgaagccaacggggccggaagagaggggcccacagggcctttgcttctgtcacttccccttccccagccctacatgacaggatctggaccagtatcacagtcattggcacagataacctgtttttttccactttctaggatggatctccattatggattcccagtaagttgatggtatgggactgcccagttgagcatcattaaatgcccttagcagcattcctgcttccagccactgcaacagcagaagtgttcctcacatatgtcgcactccctttgggggctgatctgctcctgagtaaaaccactaatctctaacagaagaaagaaagaaaacattttattatagttatctagaaaatgaaagggtgtgcagaagttttgctgtgtagcgtagcttatttttttctttttgtgaagtttcaactgaggttaagtaaagatgaattaataacgaagtcaaatcagcctggttatatgacttattccatttagctatgttctacagccccaagggtatcagttgctgagaaaatagacactaaatctgatttcaccatgatccttctgtgttgatctgtgcagaaaaatggaccatgttgccatctatattcacatcttctctgagttatattttaggagggagattagggccagactctgagagcctttaagggattatatcagatgctgcagtgctacagtgaaattggaatgaaagctcaacttctgagaggttcaaaacccgcctgccagctgcctaggaacatcctgggatggagcttaggggaagctcaaggaaagttaggtcctgcagaagagttttctagagccagatgtgtcctttcttcccagatagactcgggaggtataggcagaggtggctcagaccataaaaagtcaattttacttcttcctggcaagagagaggacattgattaaatgcgtccttagccttcggaacttgtaaaccctctcacatgtgagcctctaggttttccacagccatagcattctatccagatagttactgaattcatgcataatgttgatgcatacctgtttttcagaattaaatcacctacttgggtaactagagagcatgaagttttaacatatcaccgaagtatcttaagtatatttctaaaatcttactgtagttaatcagtgtccatttttttcatgcagtatcttcaaagggtgtttccttacattttttgttttctttctttttaaacaaatcatgctacaaggtggtgaggtctggattcagacatcttcattttgagctacttgaacagccagctgaaacatgaaactagaagaagccttagaatgatagcaaaaacaaatgaaaattaagttctctgagtgcttgccactgtaccaaacacgtgcaaacaactctcctttgcgagaaagaaagacctaaaaccaacacaaccaaaatttaaataccacttttgccatgtgagattgtctaatcagcctcattttcctctattgacatcatcatcttctgtttgttctgatgcttcatttttagtatctttatgggcttcgaaagcagtaag

SEQ ID NO: 48923 - DNA, 3085 bp, Bovine  19866880781514
ccagctaaagccctgagtggagggttagagctgtgtgactttggccagcccagagctgttcctcacacatgcttcctatgggcacctcgctagtagcagtgagttcctgcattcttgctgctctgataggacctgggtttccatccatagggagaggctgagaccctggccaggaggcaggaaagttaccagcatcctgagcctctcaggaacccaggtattctaggagctgactatctctgatttcagatgctactgactgtcgggactctcaagctggggggatcatccctgcttcagctaatcccattatgcagatggagaaaatgaggctgggcacaaagagttgcttaaacaaatctaggcctcatgctaatgcagggaatggtgctgagtcagtccagcttcctgctgagtacctgacgggagtggtggggtgaaggcagggtggagggttgggaagtggaactgaagctcctctggccagtgatgacttggatcaggcaaggacaatctcagagacctgggctctccccctcacccagtgcaatgtcacatgcaggcttcctgtgggctgggaccactcaccttccctgcctctcctcccaggtccctattgtgcccacaagtggacatgccaggctcaggtccactgggcgaacatctatctgcctgacgttgggcagcattcccatgaggccacagccagatgttacctaactctgcagaaggaagctaggaagccagagcatcctggaaagtagccaggagtggggctaggcagatggtgacccagaggaccaagtttgagctgcagaaatcctggggtgaagggaagggggtactgtccttcagtggaagccatatacccttgcggtttgcacgtgttacccacactgccaccacccccaccacacaaagcttcatcatgaaaattaattcttttggaataacagcccttttctgattccccttgtgacctggggaaactcaggatgccataggagctgggcttgggcttctgccttgtgagaaggaagccactggactggggtcactgtccctccttccctgtccctagcctgggatttcttttctctcctctctctgatagctcggaagcaagcagaacaatgacgtcttcagagaaaaggccatttcctgctggcagtgtgcacacttcactccaagtcccagagcttctgtaaagaggcaccctcctccctgagcccagatctcctttagtgctataggctcagtaggacaaagacaacacctggatctgtccccgggtcagctctgacaagattagcctaatctctgctatctgagagaagaggatgtctagggaggaagaatgttctcatttccaggcagaggaagaggttcatggtccccagccttgccaagggtctctgaaatagggtggggtggggcaggatggacagaggtgactttttggcttccctcatccatctctgaatctgctcttcttggaggagttgggatgacagtaaggagacatctgagcaaatggaaagaggtgtctgagacaacattccagtactacttctggtgctttcatcagccaaagaaaaccaggagtggagagaaccacaggtagattggctgtatcctggattccacttgtagagtggtgtggaatgcgggctctcttggaggtctctatgtggccagtgcagcgagtgtgagctacacagagttctgcaaccactaaaattacttttggggcctccagggaagtccaggacacagctctggggagaactcatgcagacattgctccatctagagctccaaagccatgacattcagctgaacactgactgccgggggaggtagagaggcagacaggactcatcctcactgctcctccattagctgaggcccagatttagggaaacaggaatgggcagggctataaaaacgtctgggaaggaaaaacaaattaagtcacttctgtcatgtctgactctttgcaaccccgtggactgtagccctccaggctcctctgttcacagattctccaggcaagaataccagagtgggttaccacgccctcctccaggggatcttcccgacccagggatcgaactcaaatcttttatgtctcctgcattgacgggtgggttatttacccctagtgccacctgggaagccccaggaagggataacagagggccatgaactgtgttttgagaatccagaaaatcctaaaccctgacaatgtcttctgaaggctggtttgcctttgcagggaaggaatctggctttatttacttaattttaataaactgaggtgggaatggggaacttgcaacagggccttagcagcctctgttcagagtcactatcccttggaggaagttagacttcaacgcagagacacctagcagtctgctctggagatttcgccggctggttttacccctccaagcttccagacagagatctgggaaagggagccaagggccagacttgtgtgtgtgttgggggcagtggggtgggaagatctaggagttaagttagaagccagagaggcccaggcagggagtcttcattcccaggcccagcacctagttctgggagggaagaggcggtgccagtgcgggcgtggagctgtccggactctggtgctgaaaacgaggtctgccgccgagcggagcagttagcaagcctaagccttgtccgggtggggaggggtggatggaaatgaattcccccttctactcacgctccaaggagagaagggcacagtgagttcgagcaagaaggcaggttgagctttttttttttttttttaggaagtgtgattccagacgaagctacagccaggtcgggccaaagtgggccacagcctggctgggggtagggtgcgacctggccagccgtggcagatgagctggggggaaaagaccctggacccgggctggtccctcgctggccccccacactcctacactggtcaaggaggagctcctgaggtgttctcacacctatgccactgacacgctcgcccagcagacttccatgagagcaaccatacacacctcaggacacacga

SEQ ID NO: 48924 - DNA, 1124 bp, Bovine  19866880781556
ccattctacagattctagctctccaacagatgactattaacaatccttggttaaagaattcagtgtttctcaaatcacaaagtgtattcagtgtttctaaaatgatgactttttaaattccagctcttcctggagtgatgccgtcctcctactgacctctggcatgaacggtggcccgtggggcctgataccatagcagatgtcctgggctgaccttggaaattcccttcacatcctttcctaggctgtacttcctgaatccatgtcattctccttaaaaatcttcctcctgacaaccttttcctttaaaaaagaaatcctattcttcttttatggagcaaatgttttatcttaggtcaggtaagtaaatataggattgcttttgtagattttatttgggtaaaagactatcctatgcatgagaactttgaacatgagcacagcaatacactatgtttctgacaccactgggtgctttagttatgatatgaagaaagcattttattatgaaacaattatatttgctcaagaatatggacacaaaagatagtggtccaaaattatcaatttataacaaaaaaatgtttaaaggggaaagcatatcttcccattattttcaggctaattatttcacaaaaaacatttaatttagaaattgtagaaaaaccaatttatgtcaaatagatgattacagtgataatagttaaaaggtagtatttctattttaaattgttaaagataaacacaaccaacggggatatgagaaaagggccatttagatttttaacaatgctgctgttacttttctaagaaaaaaagaattatgagttattataggaatactacaataaccatcttgtacatttccagaaaaaggacatgagaatggtctaaaagcatagcgtatacatggtatgtgacactgtgagtgtggaacaaagcacagcaaccagtgtctgtaactctgaattatcaattacaaggctatgattaaaaagtaaaacacaggtctgaaacacaatttaaaagaaaaatttagatcaatttgtatcacttctgaagtctctatatgcaagaggtgagaatttattacagaaccacaaaatggcttgagagatataatt

SEQ ID NO: 48925 - DNA, 1413 bp, Bovine  19866880799440
cccgtaagtccactttccatgtttaattcagaaaattcccatttcatgaaacatcagggtctgaagtgcagaagtgggcacaattctccttgcattaaaactccccaaggcaagctaagaggctgcccagataaccggtggtaatgtgccccccaggaggacgtcacacaaggaatctgggtgttgagaaagtggatgattcaccctagaactttttaaagaacttttcgggcaactgaatgatgttttaaacataccgggttgctaaacccgtcaggagaaacatctggatctgagaaaatctggcaaagctatctgaatgaacaccaactgttctctatcctaaatgttaagattatttttaaaggttaatttatagatatttggacaacaggggaaaaactgtctggtgggcagagagttggagaagggaaaacagagcaaaggacagataggctgtggatattctatgcatcaatacacccttaataacatgtctgaccccatcctagggttgatgggctgccaagctgctgccaggactccccaggtcacacagtctcaaggtaactctggagacaagttctctccaaaagctttcagcattttcatggtctctcttttacccattattaagccagttaagagtatttctgagcattcacgggtttcccaagatacttcaatgaaatagtgatatccctaggtcagcaatggttctgaagaaagcatctctcatgatagcaccggactggactggagaactaagaattctatgctgtatttccaactctttctctggcctcctgctcactgctctctccactacccactacatctcttgagtccacaggaggtggtgctggaagacaggaaatgcaggctagcaccagccaggctggtgtctgtgggccactgcaaatgacttcaagttaactaccagctactccccacttacttggcagacgattatcaagcactgctcctggccaggccccatgccctcgattactttccaagtttctcccaacctcagagattaggttggaaatcatttttctctgctctttcttaattcctgcagtatgtaggcctacatgactgaatgagagttgggaatattaaagacatttataaattataataaaggagtcacatatattaaaaatgagagtctgttattcaaaaagccacaaattatctcacttagagaagacacttaacaaaatatacatcttaaaacttcggcagtcaagaatgctttttataattgtttccatttgagaaacacaattaaaatgggtaagaattaatagacacaacttcactcagaatatgtaaaaagcgtcccatgtttttctgatattcctctttgggttagctaaccacgcacaggaggaaccaaagtccaaa

SEQ ID NO: 48926 - DNA, 1335 bp, Bovine  19866880855753
aattctgaacttccggaatgttggaagaggaaaagaatataatacggtgaagagcacacttacacgtgagctgggtgtatgggtggagagagtagaaacgctaaagcagaacagtagcaggtctccaaagagtcttgatatcactgggtataatgtgtgtctaagagcgggttacaggagcttgggttagctcccaaactcagaaagcttcccagttcccattttttgccaggccacccgcatcgcataacctttttgtcctccctctcttgctttcttaaagttgaccctctgaccctgtggcttttctggatgcatctccacctgttcccttgttttttcagacagccgttgctgaggatcagctgcgccagcagtcgcagttggaagagcagagggtggcggccctggagaatcaaatatcccaggtgtcggaattgctgggcacctacgagaaggccaagcagaaggaccagctggccatccaaaagctgaaggagcgcattctgcagctggacctggagaacaaaaccctggcactagcagcctccagccggtcccctctggacagccatggagaggagtccagtctggatgtcaatgtcctgaaggacaagatggagaagctgaagaggctgctgcaggtggcggccaggaagagccaggtgaccctggacgtggagaagctctgcgacctggagataatgcccagctccgaggctgctgatggggagaaggccacggcgctctactaccagcaggagctgaaacagctgaaggaggaatttgagaggtacaagatgcgggcccaggtggtcctcaagagcaagaacgtcaaagacgggaacctgggcaaggagctggaggaagcccgggagcagctggccgagctgaaggagaagtacatctcgctgcggctgtcctgcgaggagctggagcgccagcaccagcaggaggccgagggctggaagcaggagctggcccggctgcagcatggccaccggcaggagctggagcggagccagctggacttccgggaccgcacactgaagctggaggaggagctgcacaagcagcgggatcgggcgctagctgtgctggccgagaaggacctggagctggagcagctgcggtccatggccttgtcctccgggctgccggggcgcagaagccccgtgggcggcgcaggccccagggaccaggcggacacctcccccccggacaacctgacccaagccctgcaactcgccgcggtcagcgagcccactttcttcctgtatgccgagcagctggcccgcaaggaggttggagatcacgtcgctgaggaagcagaag

SEQ ID NO: 48927 - DNA, 2080 bp, Bovine  19866880864156
ggaggcactggccagagaatggagggcgggaggagagggaggtaggctctctctcctatccaaacctgtctccttcaagcttccttctatactcagcttttcaggtgatagcgagtctggtcccctgtgtgatgggttatttttatccagtgattctctcagggttccattaactgcccctgccccttgtcctccaggttgtggttaacaactccccctctcttgccagtgctggggttccgcactatccattgttgatttccctaaactctgcctatacacctttgtgtatacacctttactgaacagaatgtgtcacctgcctcctggcagggtccatagaatgctgggttagactagatgatactgaaagacagtttcagcactctgcacttgtggacagcgaccaactcctctcagatgcctgtctcaatgccccggataaagacattgcctggactgggacctgtcctctaggacagaattatcttcataccttcagttgtctcacttgcccttctgtccagtggagatatcttgtcactgccatgccccaccctgccccaactcttcctttgtttacggccctagctttcacctccctgcctgaatcctgactgtcacaagactgtgagctctccaagtcaggtgcagggtcctaggcttttagcacagggccatagcagacgcttcattttcttggactccaaaatcactgcagatggtggctacagccatgaaattaaaagacgcttgctccttggaagaaaagctatgacaaacctggacagcatattaaaaaccagagacattactttgttgacaaaggtctgtatagtcaagctatggtttctccagcagtcatgtatggatgtgagggttggatcataaagaaagctgagtgtgggagaatgatgcttttgaactgtggtgttgaagaagactcttgagagtcctttggactgcaaggagatcaaaccagtccatcctaaaggaaatcaatcctgaatatttcattggaaggactgatgctgaagttgaagctccaatattttggccacgtgatgcaaagagtcgactcattagaaaagaccctgatgctgggggagattgaaggcaggaggagaaggggacgacagaggatgagatggttggatggcatcaccgacttgatggacatggtggaggacagggaagcctggtgtgctgcagcccatggggtcacagagtcagacacgactgagtgactgaaaaacaacaacacatcagaccctcggtgtctgtggagggattactggtcctgtggtgttttctctaagcactgggctcctttatggcccaatggagacaatgggcagcatctgttgggcccctccactcccctctcctggacccgtggcttgtctcatcttcgggaaggagtcaatgacagaagctggaaaatgttgttgggagatcatggtgggggcaaggaggtggagaggtgacactttaattgcataactatttccatcggtaccagtggtgctggggaagatgaggcctgctgcctgcaggatggatgatgtggggacgggtgagttatattttcccagataaaagcaccgattgcctataaactctgattctgcctgatgtaaaagccactttattgcacatccagaaattactacccgtataaaagcacattattgtgatgtaaaaatagatttttatataattttttcatgccaccaccttgtaattcctcatttccgagcaccctgagattgcatggaggtttatttttctcttttaattgtttgccatggcatgccaatttatgatgatatattctccctaagatcagagcaaggcctgggcataaataacagctatcactgcatggaggcaaggttctggggcaccccaaaatgccatcagacaacctcaggctccacgtgatgccacagttgggagtgtggcggggtgcaggttcatactcatttgaagccctccaggaaggcaggaagtagggaggggccgcatccctcccacctgatcagagggaaggtgcagcgtttcccctcctctcagcccg

SEQ ID NO: 48928 - DNA, 1979 bp, Bovine  19866880877132
attctatctttttacttgattgataacttgaatgaatccaaatacaaagcctttcttatatgtaaccctttgtatgttactttttttttttttcctttttgaaagtttcttggctcttctctttaatttgcctgggtatgggtttattttcatccaaccaacccttataatccagtaactcatatccttctgttctggaaaatttcctccaattagttcattgatgatttcctccctttcatttttctctttttagaatttatattatttctattatcctgaaagtgtcctttaaagttcttatcaataagaacgtaccgtatagcacagggaactctactcaacactctgtaatggcatatttgggaaaagaatcttaaaaagaatagacatatgtatatgtataactgattcactttgctgtacacctgaaactataataacacattgtaaatcaactatattccaatttttaaaacgctctcatctttcctctcctacattcctacattttctctctctctgtacgtttgttttactttccagggagattcaatcagctttacctgcctgtctttctgttgatgtttttgtttctgctgtcatgattttatttctcaaaacataattgttgcttttgctattctctggatgtttctttgtatagcacattgttcttgtttcatggatgcagatcttatccctctaaggatactgtggtctttttgaccctctcttctctctgggtaatctgtttccttgaagttactttttctgactgttttgttactctcttctgcatttgaaaattccctagatgtctggcaatctttggctatgattaagattgtggggatgggagggaggctagtcagaaactctgagctcagagagaggctgggtttgccactgcagcgtgggccagctgggctgtttcttatatcagtaactttaggtctttcctcttggtctggtgaaataccccagagtagcgtcatccagtttcctgtctaggtcctactcccagcacttggggagcctgatggtggcagaaagctcagcatctctgcatttcaccattccatgtggcaaggtcaactgatcctttggatttcagtatttttcagtgtggtatctccattgacaactgtgctccaacccaaacatcgtctatctcatcttcagaagaaaactccccagactctggctgggatatgaaaggggctgttgcccaggagtttggagctgggggagagatggagggatctaactgcccattctggtccttatcttagcaacctcttccacctttcacttctaggaatccataggtaccacggagaggttctctatgcctctgagaatcttgcaatgcagatccagttagttctcagctcccgtcagccgtgacagctgacatgactccttggcgccgataagtcagtgctggtctgccattctgcttcaaaaatgtggctgttgtctttttccatgttctctctatctttgtaagtttatctcttgatttaaaaaacctctttattgaagttttagtggggttttgggaaggagtgaaagtagatatacacattcaattaccatcttaacccagaaccctaacatcccttttcagtatgtttttaaaaatataattcctgggaatcaccttccttggtcatggagggctgttattttaatgtactggggtatgtttatttctgtctttccatttagaagtctttccgtgaacatgattagcaggaaatgagcctttctatgaggaagattaaaggaaaatgtctctagtgggataacttttattaagtatatgagagaagcccagaggctggatctcagtatgcagtctccaggcagcccctaaatgacaaggttgtggtgggggggaggtgggcgggcagagtttcactactagaggaaggaccctatagcaatccctgagggtgcatccagggaatgcc

SEQ ID NO: 48929 - DNA, 1592 bp, Bovine  19866880887591
tgtcaaagtcctgggatggcaggcaggagaggaggcagcccagcatcaggagcatccggaaaacccactctgtgctgaccccgggccccacagtgggattcagtaggtcagaaagcttttccagcactgagatgagcaagacaaggcttttctttttctttttttccccccatttttaaaaattatttgtttatttggctccacggggtcttggctgtggcactcaggatctcagatctctgttgcagcatgtggagtccttacttgcagcatgcagaatcttttcactgtggcatgcgaactcttatttgccagcatgtaggatccagttccttgacaagggagtgaacccaggctcctggcactgggagtgtgaagtcttaacctctggaccaccaggaaagtcccggacaaggctttacaaagcctgcataggccagaagaggagccagtcagctcaccctgcccctccacccccagcttgaaccaaaggcttccctgaaccatcagactgtgtgctggaggggaggtttctattccagaagtttccgtctcgcagcagagacatacagcagatgccaaaaactcatccatgtgaaagaatttgtttttcccccacaggagaaaaacccaatcacaccttctcccaactggaatatctgcaattacctacttcccgccccccaccccccatgagcgggaaaagaatgtcaggactaatcaaactacatcactctgggaacccagcctgtctcagcaccaatctttttgaaaggccccatatgggaagacaaattcaatttgtcttgtctaggggaaaaatgagttttaaatatgttgaaccaaaagtgatatcttatgtatcagacagggatccagaacaaatgccctgggagaaaaattaccctgaaaattttaagcagtcaggatgccagagaactaggagtttatgctgcaatctaagcacagaaaatccacatggggacaccctcatgtcccgggctgggccatggagtattgtgcctcagacagagcccacgttcccaagagctggcctgggcatcttccctcagggacacctcctgcctgcctcctagagacctgcagcctgggtgacctagggagccagcctggccagaacaagttggtggggacggctggggagtgagagaaagggtccagtttccactgtttccccaagcctagtggacactggttctattaaatagcggtttacaaaccctgaaagacactggttgttctctttcaagacaagctcgtggagcagcaagctccaggaccagaagtctggagattcaggttctaattctgactctgccaatagctggccagtccaagtctcttcacttgtctaaaccttaacttattaaataaagagcttaaataaagagcttaatttaagtgatccctgggatctctttcaattccatgaccaagatgttttgctttctttttcctctctttttctttcaagagtgtagagcatggtgagtaagagcagtctttcaaatcagtcttcgtggttctgaatcccatctctgatgctttttagctgtgtgtccttgagcaag

SEQ ID NO: 48930 - DNA, 1195 bp, Bovine  19866880898511
ctggggctgtgctgagcctgaggggctgtgggcagctgcgctctgggaacgccctcctctcagcaggctgggcagctcctggtgttacataagacgtgtgtgttctggcagggaagagctgcccgagtgagtggttagcaaaaatgatttgtgcagagttattttgagaccccacgggagggaacagcagcccaggccgacagtattttaaaccatatcacccatctacaaggattaatccattagaatctcagaacatgggtaacagggaaataagaacctttagggtcctagtagattagtagtgccagctcttctggtccacacaaggcgacttcagtggtttaggctgaactcggtgcctccagacttccaccatatgtattctttgatcctgtctgccctaagggctgcaagtggccgtgcaggcttctttccatggggttggcctgggtcactgaacagcagcagttggtttaggttctcattcaccctatgggataccaattggctttatgatagatagaggaaggaacgccctttttgtggtccccagagtcatcatttagtgattgagctccttgtggttccaggctggccaggagaaatcccttgttccccacccattttcctttctcctgactcaagcaggaacagctggctaagggtgggtgaaatacagaagatagaattttccagtttagtgacatgaggggagacagcctccatatgaaacacttctcttgtttttgtttttctctcggctgttatgctaggaaattggcctcctcacgcccccaccctcttaccaacagctgtcctctgccattcaggagtcagtgtctccctcaatcgctgccctaggaaggctttctccttttttgtccctgggtctgcaggtgtatagccggagagttccttgtgccagggcacctgattgccttctgaccccaaagagtccatctgggctggaggacttgctggagtatggagcaagggtccagaaaggaagaacccaatccaagactgtcattttgttttgttgcactttttttatttaagtttttttctttcttttttttatgttttgtttttttctggccagtaagcatgtggtgtcttagctccctgaccaggaatcgaacccataccccctgcatggaaggcagggccttaaccactgtaccatcagaga

SEQ ID NO: 48931 - DNA, 1419 bp, Bovine  19866880957003
ctgccataagtgtgtgacacagaacttggcacctacgtgctcaataatcactacttcacaccccttcccctcccccagctgtgaacagattatgatgaaacactgctgttttggaataagagactggcataatgaacaggcccttcattttgtgctttcttcaacactttattgacttacagctgaatcataggatgctggcagcagttcacatctggatcagattgctccagggcctgagtctccagtgacttgatgtctcactatgtaacaagggtctccatcagtcaaagtcaaacgcccggttgcaggtgatgggcaacactcacatgcatgacacgtgacaccctcccatgggcatccccatcagctcagggctacacgcgatccccggctggcagctgtaactccaccctttcttcttttagactgggaggcatatcagaacacaagtgagtgacagaagcatcatcacagggatatgttggatctgttctaattgtttaaaaagtgcatcaattgtctgaaaatcccaatagttaattgttaatagcgaattgcctatgacacacctcataactgctcaagatatgcagcgtgtcaggataccagtgtggatgaattactggtcaagatgatcccagaccaacctgttgtgaaatgaaaaattgtgtcaattaactggttgttttatctacatggtgccaaggaattgatgggagagaacattttgtccacgctaactaaattggctagtggccttggcattgtgtggacccagcctgagtattaagaatgtgagcataatatcaaatcatggaattagactgaaaggaatttccagagataattttcatctgttgcagatgaggaaactaaggaacaatcgggttaaagatttgctgagagacacacagtgcaattattaactactgttttagaagaggtagatgtgtgcacatcttcacccacaacatttttaacattttctgtagctatttcagaactgagaggctcaaccaaatggaattgcatactttctaaaagtagacaagaatttaagaaacaccccgtggtgcaattgtttcattgcttaaatttgctgctgactcatctgccttccacttctttaccaacatggtcgtggcatccgtcacttacgttggctcttttccccagcgggtcccatcctcctccactgggctgggaaacaggacgtagtcacatcacctctgtgattcctcattggtcggtgggcggggctcaaaggtgaggactccagtggaaatcccttgccaataggggtaggcctcctgtcctccagcatgaagaaagctacctgttgcccaggagagtgggctgcttaaggccaaaatcctggaatctctgaacaaggaagccaagggtttcaggcttcat

SEQ ID NO: 48932 - DNA, 1034 bp, Bovine  19866880966865
ccggcaggctccgaggcgccgtttgggtgggagaaggtggctgctctccctgactccatgctgctccctagcacacaggtccctggtctccacctgcagaccatctattgtaattgtctcccccattgtcctgagctcctcaagggcacggcccaggtctttcatctccactgttccctgtcacctggcacactgctggccgctggactgactctaagtgaaccacagaagggcttcagcagccagcgcccattagccgagggtcagaaacctaaagttcaaaacagcactttctccctcgtttaggcttctgaacctaaactgggtgctgacctggaactgtgtctgagtcggttagtagagcagcctatgaccagggaaggtgtctgttctcttcccactttccttcagaataaatgatactctcgctgtgcctctgtttctcccacttgatacccacgggcctctgagcagtctgtcctctctccccccttgccgggacctctgaggagggcagcatgtttgtaggagggtttccctgtgttttttggggggccatcggtcgagtgatatctggcccggtgttcttagaagttactctcctaacctgaatgaaacctccaggccgctggcttcacttaagcaaaaccacctacaagaggaaccctctggagtccgtgacaggactgacctgtctgagtgtgctctcaagatagagggctgtcagcccaggagtgctctcaaatcaccgggatgtatctttaaaatatcagagtcctgtctcctccatatcttatctagcggtggaacgttggatgttttttaaccgctctctccgtgcagataacatgtactggggactgactaccgctgtgttggagggtcttcaccagaaggagcccttgaacacccactgctggccctcccttccccacccccccggccacagggaaggtgaaggggagcttgccgcttctgggcacccccgtcaccttccttaaccggttccaagacaccgctattgtcccaaatgg

SEQ ID NO: 48933 - DNA, 968 bp, Bovine  19866880974838
tggaggtgttttctcccggtgtgtggttagctttcagttgtttttttaaaatcttagacccacaaagtcgtaccgtgagtgagcttttacagccagcacacagggctgctagtgagctgtgttgcaaattctcaaccttaattaccttgatttcttgttttcaggtcaatgtgactgtggactacattagaccagccagcccagccacagatacggtgcccgccttttcagagcgtacctgtgccaccgtcaccattggaggaatgtgagtgttctggctggtagcaacttgaccatggctgggagttttttctcttctcattgatatctctcccccctttcaccccgatttgctttctgtcactcctaacacagcagcttgtgattgttctgtcccggtgtagcactttgtttgcagcgtacttcataattgttcactagttaatcatatattttcattattgtcattatttaagatttattgggctctgtgtccttggcactatgtagcattcattattactgttaataatgccatttattgagtgtcaatcaggcccttaggtactatgcaaaattagaaagattctctgtgtattagtttaggaagtttaattgtaggccagaaaaagaagagaggttaattggacattttctttgaatagacgtatgtaatcagtagatgacagggtcttcctcttgtgttccactggctataccctggttatgttccagagtctcttgggagcttggttgacgagcagccttccaaggaggtatctgatgggggcaggaggaagcccgctgggccatgcttccacagtaaatattaaaacaatcagtcagtccccagtagcaattcttactctgcataaagtatacccacatgctaattgtctccttctctatttaacagtcttaaatggtgtttgttaccaaactggtattttgcttttgttttaaaagga

SEQ ID NO: 48934 - DNA, 3754 bp, Bovine  19866880975115
ctagaaaatgaaagtattctataatgagagaaagtagatcaaaggcttgtggggtacataggaagggataggaaggggcacaaggaaacttggggggttaaggggcaggtaagagttatgttcacaatcttgattgcagtgatgattccatgggtatatatgcatttctcaaagttttccaaatttcacacttttcctccatctccattatgtcccaataaagcggtttgtaaaaacagaaggaaaagagttgtttcatgaatagtaatgaatatcaaaatataaactaacatgtatacattggccacaactacaaatttagatctacagagataaagtttgtatagaggttttagttacatttgtgaaaagtttacacccactgagtttatctaaagagcgattcttattttccagaaacaagagctgggagatctgcccgtgatcatatgaaaaggtcatacaaaagaaacagaccacataactctgttctacactacacgtcacacacttagaatcccaagatgcttgggaaagagaaagctgcttcagaagtgttggaaacagggaaaccagagcaactgcagcagggcaaccacggtgctcccagggtgaggcatgaagggaacccctgtacacaggacggtgaccatgtccagaaattcgcccagtctcacgattcaaagcaacctttcaaaaatccaggttaacatgctttgacatacacgatgttcacttaaaagccaagtgtgtagtttttgttccaaaaaaaaaagggaaagtcattcttcatcacaagacataaaatgtttaaagaaagagtggggagacacaggtatgtattttctagggctaacaaaaattacccgacactgatggtgccaaccagcacgaactttttgtctcctggttcagagcccaaagttcaaagctcagagagttggcagggccatgctccctctaaaggctccagggcagcctcttctgcctctacccagcttctggtggcagccagcagtccctggcaatgctcggcttgcagctgcatcaccctctgctctgtcataaggctttcttgcatctgtttgcatctgaccctctcatggatctaggacccagcctcaccaggtatgaagacctgaaagtcaggtcttcacagatccaatgtcatagtcgttggttcttagtgtgctaacttcaacatatcttttgcgggagggtcacaacttaacccacaatagggaggcaaatatctaacatagtaaaattctcttcaagtagacaataacgaagaagtgagacttcagttaatgtagcaagtaatattttcacttctatatacatatctgtggccatttcacactgaatcaaaacacctcaaaatggctaacaaaatatttatactgattgataatttttaaattgatttcattttcttcaatggaaaatatttgcaacaaacatccctgattcataactccctcttattagtaagaatgttcattcacaaatatactgcttgaatttggggggacaggggggcggcactgagactatttttataactggaaatgaaataaatgaaacctttgtttttttctttgtaaagtcagacatcaatttgcttctaaaggggtcttgtcctttcaagccatcatcatcataaaggcgttttatgatctttaatataacgtgtgttggtacccttaattcacactttggcacaacactattgttacagtgtacacttacattctaatagaactaagagtaaaggattttactgcagttcaaacattcttttctgctcggtgtctaatgtgtacaaatcaaataagcttagcataattcagaacataataaaaatttgattcctatcctttagatttacaaatgaaaaccgtttcattgctaaacagtaaaatatatgcactaactgaaactgattaaactaatcataacactaaggaagatagtgaagattaagctataagttgtctgatattcaaacgacctctcggatggatgaccgagggttcattctgattttagaagcatatgtctctggttcatatgatttgcttgccagacagtgcctggagacgtctgtttagtatattacttcgtaattaaaaaaaaggaaaactacatgtttcataatttgcttatttttaggcagcatgtaaacagtatcaaaacagcctcttttccatacccttttaacatgcatcagcattgtggcaacacagaaacggggaatgtttgtgatgacctctaatattaagcaaaatacagtgaatgtttaaggaatggatctagatctggtataagcaggcactagatctaacacagtccatttcttcctatcctaaaaatcaccatcaataatggaaaatacctaaaaacataatatcatgttttaaagacacacattaaaaaaaaaaaaaaagcctctctagaactgagttcaaaggttttgcaagcataggaaggcggtcttacagaatgggtgatgaaataccaaacctctgtacacatggaaaaggaccctgtgcctgagctactcaaatctaattctgatgagtgagaaaagtcccctcaaggtctaagtctctaagattcaaggacacagctactattcttcctttctcttggtgaaggtaaacagcattaaatctaaatgagttttcactgaaatacatgctccactcccctcctctaatgtccctttgcattgactatatttgtgaagactatgcttctggtgcatttaaattagacaccatcttttccatcacctacaagcctcaaatgtcacatgaattctgaagtgctacgtgtattatccaatgggtaggagagcaccaatgatgaacaatgaataacacgtctttttaagcaaatggccaggccagacagaactagaactcgggggttctaaacaaacgaagcaatttatcaagtcaacagaaataggaaggacggtgggggttagaaccaaacaatggtgcatagtagaactaccacgtttaattcaatctcagatcctgcttattttaagacacattatttcatacaccattaaagacaaagccgtcagatataactagaagtttcttcctgaaaccagatgttaaaatttgcgaatggggagagagataccttttaagaattcaggaaatgcagtgtgttttcaataaggtcaagtattggcaaatgctagttcatagttattcctaccccgaacattcattatgtatcctcatatccattataatcactcaaacagcaaatagacctttaggagttaagacgatattgtggcaaccatatagaaaagaacgtaggaggcacttgactagcttagctgaacatcacccatccagatcacctacacccatttagggaaaataaacttatatttggccctctgggaaaccaagagcatgtgtatgccaagtattacccggtggcccccgagctgatcatttcctttgcattaagttggggtgaataatgatggaaaagcaattggcagaaacacacagcccccagctctgtttgatgcatgatctgtgacaacacgattagcaagaaccatttctcttacaccaaaatactgagtccagatgtcaacctggtgcctggaaaagacgctgcacagtgacagctgtttgatgcttccacactgaagagctgcattctgaccagacacatgcttgaccaggagacatcagagcattcacgaagacaa

SEQ ID NO: 48935 - DNA, 4316 bp, Bovine  19866880976584
tgggggcccagccgtggggacacgcatgtatccacagggttcagggagaggtcagtaacaggtgaccctgagaaggtcagagttggcaccacgacccgaagaccggagtagacggaggagggagacatggaaatgactcttgggaaaagtttgtttgagggggcagggagaacccaaaagaggactaagggtagtagggaattctgagatccccaagaggcaagagataaaagttgtgcagagatttctaaggaactgggtggtgccagaattcatagcatccagtattctggcctcagatgggaggcaggatgcggaacaggaaggaagaagaagaagcagggccaaagtgggggaagagcagaagggtataagggttctctctgtattatttgctacagctgtgtatgaatgtataattattgcaaaataaaatattttaaaaattaaatcaagactttcctgggggtccagtggttaagactccatgctgcccatgtaggaggcaaggtttctatccctggacaaggagctaagatctgctgttcagcatgaccaaagactaaaaaatagacaggtggattttaaaataattaaaaattaaattatatatattacaattaaataagttatagttttaaagataaatactataaactcatcacttcctaattatttcactctatttcaggagagaatctgccagcagtgcaggagatctaggttcgatccgtggttcaggaagatcctctggagaagggaatccagtattcttgcctggagggtcccatggccagaggagcctggtgggctatagcccatggggtcgcaaagagtaggacatgtctgagcgactaaacacacacatactcagctcttaaagatattacatctatggtaactgatatcatgtcagcagcttgaaataggccacaatgggagtatgtataccgtaggagtcaggaaacactacaaatcagggttttccccgccccctccagagccccttttcaaaaggctgctgacataccactgggctggccagcttgtcagagtctgagaaggtgaagtagtctttctggaggacagaagcaacagttgactggggacatgggctagtgagactgctgggccccgttgtggtgagaccaggtcttcacggcctgcctgccaagcgttatggaaagtcgttggctacctttgttgacggtttgagttttcccaggagcgttcaagggaaggacaagggagagagggagtctggcgcttggagctggagtgtggaatctgagctgggaaggaaggcatgtgaacacagtggggaccgggggatggagacagcacggaggcattatgggctggtggtcccaaaggacctaaggagcagggtgttacaggtgaccaagcaggtgagctgaaagggtgggggctgcagccaggggccacatgcactgcagtgttatcaggggacaaccaagatccacagcaggggctggaatggaggagagggccttgtgggtgaggagtcaaggatgtgagaggctaggagttcaacaggtcatttccttgcacgctggtgtctcccaggattgtggcaggacatgaagaagaaggagaaaggaaaatggagagggagggagggagaaaaggacccaagagaggaaataaaagtgttctttgagaaggcaagaaagggagactaatgtgtaaagctggaggatgtttgggggcatcatttaatgatattaaatgtctctattttaatcaaaaagcctaaaaggcttgattgagagtctaaattaccccagggaccaggcttaattgctgcctttgcaattcttaagttgtcatagaagtcggaaattatcagacacttctgagtgtgtcccaaaccacaggacaaaggataagcaagaaaatgaagagtgaaaagggccattctatcggtgcactgggaccacccctcccaagcatgagtgtctgctctctgggctacagtgaggcaggaggcttcaaaggggagcatcagccagaaggtaggatctgggacggaatctcaaggagacaagtctgactcctccaaggacccaaacagggacccaggaaccccctcctcaagctctgggagtaaagggatggtgggaagttctgtcaagttgcagaaaccgtatctttcttttttttaaatatatttctaattggagcataattgctccaatgttgttacaatgttgtgttggtttctaccatacaacaatgtgaatcagccataaatatacatatattccctccctcttgagcctccttcccactgaaaccatatctttctcactcaaatttatggggcctggcccagtgtctcgtatatagtaagtcagcaggtgctcagtcggtgtttgtagaattaagcatattttatttgttaattactaataattattaataaaaaaaagtttccaccagttggttgatgtgtttcccttccagatagattttaaatttcaaatgggaaagggaaggagatatgagcacagtgaactcttcagcagtggacttccagctctcagtggaaagttttctggttggtggagaaaaggtggaaagaacctttcctttgcttctcgaattaccccaaggggtgtggctgctccaccggtcagttcaacgagccttgcgcttgtcaccgctcagttaatcctgcagctaggaatgcaggccaccaaactagcactgtccaatgagctgaccccgggccccattccaacctcaccacagcccttggagggagggatgctattatgtccactgtatcagtcaggacctctgggttcccagaggcccctgcgtgacaccactggccaaggcatgggcatggaccacccaccctccttcacccacagagtcggagcctgtcaccctacacctgtcccccatggaccctagggctgaagtcacagcaagtggccctcctctcaccaactcagagcttagttgctgtgaccctttggataaacactcgccccatcttgtcccaaaacttgtgccgaatcacattctggttctggaggttgaggtcagagatggaaaaatccaaatttcactgccagaagagcttcaactggggggccagggaggggtggaaggcagagagaagtagaggaaatgactcagaaacagctcaacttagaacagcacaaaaatctttcgggtgctgcacagaggtatattttttttaatgaagctgtaccaagggaatgaaaaattgcttatgagcagagggcattggcccagggagcgggtgaactgacaaggcagacagaagaactgctgggagggcagtttgctcagaagcagcaaaggaaactcagagcacatttttttttttactttaaccccttttttttttaactttttattttctatgggaatatagccagtttccagtgaacatcggagggactcagtcatacatttgcatatagccatgctcccccaaacttccctcccatccaggataccatgtaacattgaacaagttccactggctatagagcaggcccttgctgattatcaattttaaatttagcagtgtgcacatgtccatcccaaatgccctaactgttccttagccccatcctttccctcagccaaccataagttcattctaagtctgtgagtctccttctgttttgtaaataatttcatttgtctcatttctttttagagtccacatttaaaggatgtcatacaacgtttctcctcctctgtctggcttctttcactcaatatgacaatctctaggtccatgtaggttactacaaatggtattatttcactctttttaatggctcagtattactggaatgggtgaatttaactcagatgaccattatatctactactgcaggcaggaatccctcagaagaaatggagtaaccatcatggtcaacaaaagagtccgaaatgcagtacttggatgcaatctcaaaaacgacagaatgatctctgttcgtttccaaggcaaaccattcaatatcacagtaatccaagtctatgccccaaccagtaacactgaagaagctgaagtcgaacggttctatgaagacctacaagaccttttagaactaacacccaaaaaagatgtccttttcattataggggactggaatgcaaaagtaggaagtcaagaaacacctggagtaacaggcaaatttggctttggaatatgcaatgaagcagggcaaagactaataaaagtttgccaagaaaatgtacggtcataacaaacaccctcttccaacaacacaagactctac

SEQ ID NO: 48936 - DNA, 1256 bp, Bovine  19866880996475
caaaccctcacaacacagatcaatcactatgatgaagaacagaaagatacatattagtctgtggcagagcacccgtctttaggatccaaagatctctacaaccagcaagagcagatgggggaaagcaaagaataaggaaatgatactgtttgaatccaacttttctgagtccctccattagtagtaacacaggtgaggaagatgagttttatggactgaaacactatgacctccctaagtgagggcaaaggactctggtaacagtaatgcacaaacattttggctgcagggacgcggaggtttagccagatggctatccatagtgtagcaagtaccccagccctattcggctgaattcctaccactttcttgtgagggtcacagcatctttctggaatcctctgtagcacaactagttggggggtgggggggtgcaaatcccagagctaattctttgtatccaggcaggaacagagcttcctgatcagacacctctctaagaaggtagattttttttcttaatgggagttcaacattgagggatagacagcaaagtcactcactcacagtctcaagccaacacggtacagcaggttacggcagtgagggaccagtgtgagcggtcagaagcctatccaggccaaaagcaggtcactcaagaactccctaagaaccaactgctgtgcagctttctccaggatggtcacagtggtgcggtttgtccagacaaaccacagggattaggtcgtgccctgccctaagtatttcaagtttcccagctccacgacgaactccccaagttcactatccctgggccctttggactaggggacaatctgtcactatttcaaacttcctggtccctctccagcctgcatttatgtccccagagaattggggcagcagttggccagactcaagattgtgatgaaatggagtaaacagtgggtccttgtgtgtgtttagaaattaaatgaactctctttggagtcatgggtactcctagctctgcactaggagtaggatattaaaaccaaaaaaaaaaacaccttattttaaaagacactcacttccccaacttttgcacctctcaatcctaacctctccccactcctcccttcatgcacaggccatcagaagatgctgtcccaacactttcagtatctctggggcccaaggataaaatggcattaaaggcatttgacagaagatcccatcccacactgaggattcctcccaggtcaacacagtgaaga

SEQ ID NO: 48937 - DNA, 3497 bp, Bovine  19866881084633
tcggcttactctccagcatgaggatgtcattttccaggcagcagcaaagggcaattttggagagctcaggacaaaggggtcattcagaaaggccttggaaatgatgcccccatccccctgggaactgccttcctacagccagaaactgtgaagagggttcaactgtggtgctgatctcttttaataataccttctggtcccctctctaacagtgtaggttctcctgctgcagcggcagcagcgggtgagtgagtgagagctagctagctggccttctgacacaaaggtgtggagagattccccaatgactgtttaactcacaggaagagcctcagaaagaagaggatgacccgggattgctggatcaatgttttagacagcaatgccaaggcaggaaagaatcacttacccaggaccacaagataactggagtgtgaaaaccttggagtttgcacttttaagctggttggttatctaatgctctctctcaccactacttctgggaagatgctagcaatgggcacaattctccatctgggaaattacactggatcttcctgtccttggcagtgtggcagggaattgcctgaaagaggcagctgtatttggggggtggggggatgcctggcagagggggtgtcaccaagcacatgctgtccaatgggacacaatgatctcatgttgtgtgatccagaagtggtccagcctcaaagacaggggacatgagaacaaatccattttcagggctatacccagccatttaaacccaatccagcaaaacctgtgtagtacagtcagcaaacacgtttgataaaaagacagtaagtattctaggctttgcggaccatatacactgttggaaccactcaaccttgctgttataacatgcaaggacccatagacagtatgtaaaaaggttagtgtggttgtgtttcaataaagctttatttataaaactggcagtgggccgggcttgcccacccctgctctacaccaaatgagtgaggctgggaagaacagctgaagtcctttgagagttcctgagctgctgtggccttccaggtcacaaagagaactaggtaacaacgtggtgtctagcctacagttaatgccctgaagctggcagcaccaccaggacacccagaccattgacctgaacagtcctgccaggctcccgactcagggaaaggaacaaatgccaagaggaaccaacggctgaggagaagggccatgaagaaagatggaaaaaaagaagaaaggcaacgagaggtggcagggagacactgaggaaaatgagctgcaggatggccaaaaatgccaggcactctctcctgatgagtgtcattgtaaaaacacattttggcaaagcagggtgctcaggtctaaagataatgggggctggctgaaatgagaggggtcttgtgtgtgacagtgcaggctccacaagaagatatgggatgcaaaaactgcaagtctgtctccacctgaaactgggaaagagacaggcagcacttcctgccccatcgatccaaagccaggacagtgcacctcataaataaggagacacttttcagggccaagtgccctgtacttgagctttttgtctgctccctgctagggtgtttattacacagtctctcccctacttcacatccttctcaaggcagtctctgggttcctgagtccagctcgatggccatgcctccctctgtggggtcacacatgaggcccaggaggtgctgtgaaatcaacgtaagacctgagtgctgctcctttctgagatcagatttgtagtgactggggaaggtaggcaggggatggagaactgctggcccaaaataagataataaaacatatatatatataaaaagagggggatgtggcagggtcaacgacaatcgcatcaccatacctgttttactgagctaaatgtgattaccaagggaacaggcagaaggtaagaaaacccattcaactgcagccatcacagcagcagtttggcccccgaagagttcctggaatgaagtcttcagtggacactgccctgaaggcgagagttacatgcactgcacgtctgtggtcccatgctcagtcacccaggcaaccacgtggtccttctcctaagggtgggaaggacctctaaccttgaggaccaatctatcaggcttttctgcattcttgtggggtagagggaagatggcaaagagaaacgctccccaggacaactcctgaaataaaaacgaggatactatacaggcaaaagttagtgaacaaacctataacaaaataaaaacccttcttcattcctatgccgttcagaaaggagttttcatatactgtgaaggaaactgcccagaataggctgtaactggttcctttagtcagaatcccaagttatcctccgtttaggccatacttgtctttcctctggataaagaccttccaaacccgtcagcccaacaatacatccaagcagctaagaaaacgtggagaggctctctatcaagaatccccaacttacggctatgaaagatggggacactccaactaagaaagatcagtatcaacccgtggataagactaaggatgccaggggcaccaaagaggatggggaaaacgctttagctttttcaacagtcaaatatcagcaagcacacagacaaaggtcaggtcataatagccatgagacggtagaagggctttgggccacccactcctttcagtgggcagtattctctttgagccctttgtgcttttggatatcaccagcgggccagaaacatgatcaggaagaaaagtggctggggaaacaagagttaaaaaagaaaagggaaagcacctttagaagatgtgaaacaacaggaagaggatactggtgagaaatgaacagaaacgtgactgagagagtaagtgatgaggacgttaccaacaaatgtctcaggcagcccagtgagtggatttcctcccccatctaaagcataaccaaccaaccaacctttgttcctgctccctgtgtgcagtcttcaagtcatgaccttgagtgggctcacctgcttattccaacatgaaacagttctgcagttccttattcaaaggggatattgcagaagggaaattctaaaatatccacccctttaactcaattcctatagggtcaaaaatgtcaatagctactgacaacaggagtgtttggattctggaaacacttctctggcacgcggggagtggggtatctttaattgataacaatgcagcctcactgtgcagttgcaaaatagcggggaaagacaccttgcataccaacataaggactgcttcttcacgaacaaatgcatctgaccacacatgaaatagagggcaatgtgatactgatgagacaattaaggaggttaagcacccccccgttaatatattcactgacatttcaaatcaatatgagagatgtgaaagcttataaacaggtatttgtaccacttaacatcccaaagaagcccaca

SEQ ID NO: 48938 - DNA, 1243 bp, Bovine  19866881096879
gaggctccggagtggtttactgtatttaaagttgggaaccaaataatcccatgttccccccaaggggagagaagaaaaggaaaccttgaaaccctgattgtggtgctgggttcatgtgttgcttctattaaaatgaagaatcattaagttaaaacagtttgtcttctgctccttaggaaaacattgaccacctgaaagcatttttgttcagacttggttgcagaggtggaaactcatttctagagcactcacccaccgcagctgtgtgctttgtttatgcagtgaaagtgaaagctgctcccacatcctagaccttgtccacactgacgttgggcttggtccagttgctaatggattccggggaacaaacaggatttgcctgttcgtgaggtgccagctggctgggttatgggccataaaccataacggagccgttagtagaattcttactcggcccatttttccttcttgacccatttgaaaaaacttcccttgagcctccaccctgagaaggcacctgtgccagaacagtttttcttctaaattatctagaagaagatagttattcttccagttaccagtggctaggtttttcttgtagcagccctccagaatctaggttattattttgaaatccttcctctaaacaaagcattttcaatatatatcagcaaatgctgaaaaaaaaaaaacctacagaggatttgagaaaggttttccccgttgccattttggtctttactggaccttgcgatttggctcgttctcctcgcgctgtcggagccgatcattcccaatgccattatgtaattttctgtcttgggtgcatgtttgtgtgggcgggtggttttgttttgtttttaagtggtggttaatgtcaggctaataataaactggatacgtaggcctggttttgtcataatggccacacgtttgcttatttgtcctctattcccctgagaagcagagaactccccctcctcaagtggtgcctacgtgttggacggggggctcttgtcatcacagctgcctacaaaatgcagcacagtgactagcagctctgccctaaagggacaaactcgaggaatcttctcccggggttttcccacagccaataccttgtcttcctgcgacctaaatggagccaataggaatgcctttgccgttcctgaaccagttccaaaatttggtctgctctgtacccacagttcttagattctgtatctttgcgaaatgtcaggac

SEQ ID NO: 48939 - DNA, 851 bp, Bovine  19866881127427
ggtgcgcccagaccgcagcctgtcagccgtgggtgtatggcatatatgcaggtgctgtatagtttgccttgtggcggtcacactttgtgctggtctgattagccttttctcctggtgccttgtctgtgagatagggtagggttttgctcctgtgatgatggtggattctgtcgctgccttagtccctctgagtgatctgaatccttgctttgttgccaggtttgccaaggagcgcaggctgagaatatggagagactacgtggctcccactgctaatttggaccaaaaggacaaacagtttgttgccaaggtgagtcatctcagcatctggcgctgcactgtgcacgctgtcaggctagtgataatacagagatctgaataatcagtcaagggctgaagcgtttctctggcaaggcaaagcactgatgcgtgcatgtgtgtgtgcgtgattgcctgcacgggtgtgtttgttgtacggaacttggaaactgtaagaatgtaaatttctgctgtagatttgcataacttcattagaaattaatgggttaaaattgtgcaccttgaccctttgaaatctctcatatgctagagattctgtctgtctgcttagcaaataacattctcttagattgctttctttcttgcttgccttttttttttttgtctgtgctgcgcagcttgcaggatcttagttctcaccaggacttgaaccccggccctggcagtgaaagcactgagtcctaacgactaggtctccaggggactccctctcttagatttcttatgcccaaggttataagacctcaaatttctcttctttctgttttgagagtcttgggttttgatttttt

SEQ ID NO: 48940 - DNA, 1105 bp, Bovine  19866881196063
cagagaggcaatcagagaggttggggtggatagacttggcccctcaacttccaaatggtgtgcgtgtaaagcagagaggcaatcagagaggctggggtgggaattcaatgctcttctgaagagtcgagggagatgctgccttacccccactccccgtggctggtccctcctcctctccagaccccactcctgggtatgaggagagccggagggcaggggtggacaagggattgagggagagattgagggcagctggggtattgacccctcctctccgggctgactgcccagctcccggaagagcattagaaccgcagaagcttaaagggccctctgagagctaatcccagccgcagccgcagccatctgagagcggatgtgtgtggaggaaacgcgggggcgagcggaggcccacctaccactcctccttcctatggcctccagggtgcggccatggccccgctgctccccgccgatgtgacggtgacccagctctcccgctccatccacctgtactgcaggccgggcccagcggggtctccagggccccgcccactgctcctgctcctgccgtggctgggggcgaggccagctgcccagggcaagtacctgcagctgtacctggcctgcggcttcgacgtgctggccgtggagagcgcgctgagccacttcctgtgcccacgccagggcctgaggtgggctgcccacgtgctggcactgctgcaggggcctggggccctggccagccgcccactggtggtgcacgcactctccctgggtggctacacctttgcacagatgctcctgctcatgggccaggacctggggcgccacggcagcgtggcccagcgcctgaagggccatattttcgacagcctggtggtgggcagcctggaccgcatggcgctgggtgagtgtactggggcaagggtgagggggcacctgggccacacaagccaggctggactccaggtggatggacaggtctgctgaccaatgggcctgtgatctaagtgtcccagaggtgtctcgagtctctgaccgtcccacctgatgtggccttcctacctggagtgtcggtcgtcttgtcccacctgggccttcc

SEQ ID NO: 48941 - DNA, 903 bp, Bovine  19866881223178
ctgcttctcaagggcatgcctttgctcaagtttctcccatgtgttcatataggacctgggcccctcgatggccccactgtcttatggtctgtgggatttgagattgcttgtactaagcattggctcataaggggtttgtttttcttcacgtgcccactttttaaagctacaggtttaaacacataagctgagaaatacataagattcaaatggtgttggaatgctgcttcgcccacttcacacatgcggtatattaagggttcacctttagcagcagcccaattagtgactgccaatactgctgaagtacgtcagtgtgggattgttagccgttgctatgagaaccctcacttttgcacttcctgactcattttacactgaacaatgcaaatgtgcagagatctgaaggggagggctgataggatggggaactggcaagcacatgaagctctgctctcaaatccctttgaatggtgcgtttcagcgctcattcagttcgtccacctcctgccctcatggaagcttgttttccctaaatccttaaaaaaagaagtaaaatagtttgacctttatttgcagccagcttcaaagcagttcaagtttaatacttagcaggaagattgcctttaatgagccaagtttagaggaggtggattttagtctcttaatgtttagaagatgagatgtgcatgcacagtgagaaaatacgtttgcagctttcattcttacatctgaaatggaaccagtcccccagcagcatttaggaacccccaaaaaactgggggttccttttgttgttgtcattgattcaattttttgcacgtaaaagcaccgctatagcatatgccggtgtgcagtccgtggggccgctaagagtcggacacactagcaacttcactttcc

SEQ ID NO: 48942 - DNA, 748 bp, Bovine  19866881225724
ttgttgttgacttactggctagcccagaagtaacgttgcagatttagactagcatgcacaagggttttaatcaggtggtaccttccttcccgtggagcatttgtcttgcttgactgttctggacctcagccaagcgccagaaaagcatcttcccactgtatatggatggaagagtgtgtgtgaagtgttcattggggaagttcccaacccactaaagctcattgttaccttacctttttaccaatacgcccttagaaaaacactgagaatagatgactgtctcttcttttctccaagaatctgtttaaagagaaggatgactctcattactataaatattgctttcatcccagcctacctcacggcttctgaatgagaggagcccctttggctgctgtgaagactctcaaatacttgatggcttgttaaattttcattatctaatgtgcattaatttaggtacaatagctctgttgctaggagcagagttaggaaggaagagcttggcgagtgcagacggcttctgtcttccgagttgggcaagtgtgcaaaacctcgctgtcctccgagggagcttggggctctgccggccgcgctgcaaacctctgaaattcatccagtgactattcccccagcaatgccacatgatacctgatgcttgcttactctgtcatctgtttaattagctggagagactgaaaggattttgatggctctcacctcgtctgaagctgagagctctgaggtt

SEQ ID NO: 48943 - DNA, 2095 bp, Bovine  19866881228818
acacaatagacttactgctgggaaaatggtttttccaatgtgagtacatttacagggacctgctggaaaagattcactgccatccgctacagatttggctctctgaacttgacacagaagcaagaggcatgggaagtaagcctactcaacttctgggcccagagttggaagaggggagttggggggcagcgtagaagatcacactcatgtgagggaatttacaggaaacttagatgcaaagaggtctacaaaagaaagaaagctctgaaggagatttctctctcacaagctgctataaaattctgggcattgatgtatcagtgattaattatttgaactccagtcctccggagagatttccaaggattagagccaaagcaggagactgacgtctgtaatagagactcgctccccaaccactctgccccctgataccacagaggaggcaaatcacgtgagaacagcaactctcaagatgatttcatattaaattagccaagagctggcagaagctactcagaaggaatctggttaaagagtcacaaatgcaaggcatgaggaaggggaaagaggagttaaagggaatacagagctagtcaacgggcttgctgagaaataagtatggctgccagggaagcaccaccagggcaggagtgcagagagatccaaagctgatcctgtccacggctcagtctctttacctttacttaatggttacaattccaactactaaatcattaatgtgccacaaaaaggacacaattttgatttttttcttaaaaaaaaaaaaaagtagttaagaattgtttagggcagtggttctcaaattttagtgtgtgttagaatttcctgaaggatgtgtgaaaagagatggctggggctgaattccagtttctgtttccataggtttagggcgggaagatgtgggcaagacctgagaattcacagttctaacaagctcccaggtgaaaatgatgttgccggtctgaggaccagactgtgagaaccagtggcttagggaatcaaattaggagacattcaaaaatggcaaggatcaaatgttatcactttattgctacaacttatttatttgggattaaaattatattcacagtatgataatcttcaaatgtattttgaaatacgttggaactattttgaaacctcaaatatttagggactgagaggagcaagagccttttagccaaaagaacaatgagatggtggagaacagatgaggtgctgtgggcagataaatggtcacagctgggtgggaaggggcagtgaacacccaattaattacagatgttagtcaagaacaacttcctctgcaagaatacaaccagtgcacattaacaattacagaaaagactgggcaacgaggacttcttcctatgagttcatgacttgactgcccataccttgtgtacacagaggagctaaagcttgtgggttctgactttaacccaaacccctacactaatcattgagacgaatgtcatagcttgagtcgtataggttggaactgggagttgggaggcgagataggatgaagagtgaacagatcctcttaatatcctgaaagagaaaattatttggaaatggagatattatacagctctccagaagtggccatttgtgctgccttaaatgcagattgattactgctatttggatgttgagtgcatcatctcttctgaagaaagggaaaagctaaatttccccacattcagctgtatcgtcaaatcacttccccacacccgctcttgtaatgcactttcctgttaccacatccacgtgcaggagctgatgtgcctgactcccccacggtgaaaccccaacactgatgtgtgctgaatctcatcagcgacctctggctgtgccgcctacaggcaagccccaaatctggtggggtgtgcacgtttggggttacgggagaaaaagaagcagttactaaagagaaagaccaatctccttctcgagctggtgtccatctgtaccagcatcctgtaacacagccaggtgaagagggcagcacacaatttacccaactccagctttctatgactctgggctacaaaaacccacctgcact

SEQ ID NO: 48944 - DNA, 1472 bp, Bovine  19866881249795
ttgtgcttctcctcttagtttcttatagctgttgttttccgactgggtgacattgtgtgtattctacacaaaggcatgagtatctccgtatatttgtgctgcttgtgtggctggaactcctccagggagagttctggacggagtgatttaatttcccctgactgctgctgaccttggaaattttggacacagatgactgtgactgacacttgtatagaggagaaaaaagacccacactcacccttcatcctccagaggaaggtggtggagatggtggctctgaggagaagaaagaagagacaggaaggggacccatgtgacagtttccagtagtgttttgggggccgctggcattcttgggtttggatagtgtggtatgacaattaggtatcgggatgagttaaaccatgatgcgtaagataatggttagaacactgatgcaaacacaggttgtgcttttcagatgcatttgtaggtttataaggacttgggaatcaagagcatgggtgaaaatacttgtaactgtgaggttacttggaaagggtgggtttctgttcatctctgatcctcctcagagttacttgaaatattttcaacagtcagaacttcatccccttgatgattttatatgtgcttgttacctaccttatgcataaacagtgcctcatttctgaccatgttaatgttctgttttttgtcagggtgttatcactatttctagaaatcattgcccagctctagtgacctcttacataaaatgttttcacgtttacttgtgaatctcatgcctgggtatgcttctaattaaatatttaccaaactgagtgttcatcgggaaatagtgatgtccacttaaatgaatgcctaacgtcaggtagagactcttagcatctccacaggccccatctgaagctgggttttacctttcctctcaaaacagatgaacgcatctgacaagggggtgggaagcagtggtttcattttgtcagaaacattaaataagagagctccttgactctgtgctcatcatagaggttgggaagccatagaggttcatgttccattgatgaaaatgaaatgtgctcaaaattgttctgactctgggggagttgggaagggtgattgtagatcggagaaagcaacataaatacatgtgaataaacagccggccttagcacctaattacaatgattttgaagggggtgttaccaaatacatatggctgggttggagaggtaggagaggatcattgcttatgtctccttttctttgcagcataaatgtatatttttttgtcagtgtatctgtgaaagtgcttttaatttaagacatgccaaagctaaatgatgtcctaatgggacatagagatttctgcttttgtctgtgcttataaacataaaatggttcacatctaccagttgctcacctttctagtaacaccatactcaacagaggcattagtcataactaca

SEQ ID NO: 48945 - DNA, 1851 bp, Bovine  19866881261311
caggacacttcctgaattgtgccctcagcatgacccagacagcccagagctaagaaagtaatgcaaaataaggcaccgtcatacaaaggtcacagcaataagacactccagagcccactggtgctctgaaataaaaatgagaatcatgggccaggcaatctgcaaatatgtgcctcagtgtccctttacacaaggtactaagtaaaggtgacacgcaggacaagtgaaaatgaactaaaaataaagacaaggtaaacttgtttccttggtggctcagtggataaagaatctgcctgcagtgtaggagacctgggctcaatccctgggttgggaagatctggagaaggaaatggcaacctgctccagtattcttacctgggaaatcccatgaacagaggagcctggtgcgctacagtcatggggctgcaagagctggacacgactgagtgactaattcactaccactagactgcttttgttctaagagaagacagtgtatgaagtgaagtgaagtgaagtgaaagttgctcagtcgtgtctgactctttgagactccatggactatacagtccatggaattctctaggccagaatactggagggggtagcttttcccttcttcaggggatctgcccatccctagggattgaacccaaggcctcctgcattgcaggtggattctttaccagctgaaccaccagggaagcccaagaatactggagtgggtagcctatcccttctccagcggatcttcccctactcaggaatcaaaccggggtctcctgcattgcaagcggattatttaccaactgagctatcagggaagccataagatagtgtatggagctcactaaatgctgccagatgagaaggaaggacgcttttaatgcccacagaatgttggccttgttaacacaggacaaggactgctgtgattgcctcgaagagtgaagtaaatgctcctaggtggcggcctccgcagtaggcgggggactttgagcactctcatttctgagggggtaaggtcacctgttccgtggccaaacctgagccaggtgctgggaggactgaagggtaaacgctctcaggaggcgctgacctgttagctacagctgactctgcctagccccacctgctatcccatctgaccaggcaatcattccacatacaggggtgcaggaaccgtgacagaggccagctggctcgggccaaatgccactccctatcaagctgtggggccgtctgcccaaaaaaggccacatgaaaatggaagtgtccaccccacctcaaagtccagagggctctccaagaggctgggagtgatgagaccagcacatacaggactgctgaacagctctctcgactttccccttgagaatcacaacaataacatcatttttaccgggtgcagggagtgttccacagagagccaccaagttgtgtcacgtggaccactgtccaggtgagcagctggaaggtgtgagtgtcatgtctgtttacactgacattcagctttggggctggtttcagacaaccgaggagcccttctctccaggatctccagccatgttctccatctcactcattctgtttccactaggtcactgcccggtggatgactgacttgcatcccctctgagttcctgctcctgagaattcagaccagtgcttctcaagatcctggtatcctctcacttcatcttttttatgtgcttgctagccaagaagacttcgttgagttttccattctataattggcactatgaagacaataggtatactgaatagcttttctaagtattcatgtcatgttctgttccgatcctaacaattacagtttttataaaggta

SEQ ID NO: 48946 - DNA, 1340 bp, Bovine  19866881265306
tgccatctccccgctggcaggtccatgatgtactcaggagagctcaagtttgagaagcggaccatgtcggcccagatcgagggcggcgtccacggcctgcactcgtaagtgcggcggcttcctggccctggctggctggccctgggtcgggcaggcggggccgtggttcagaggctgagccgaggtttcagggatggaggctgcagcagggtgaccccagcaccctctccttcagggcctggcccactctggaaccccgccctttagccccccatgcaggcaggccctcccctcccctcggtggtctcaccccccaacccccgagctgggcacgggagatgtgaccatttgtccctcccagcttcccagcccttgcttgctcagaagcttggtggctggtcgcagggctggcggtgctgggctctcgctattggtggcatcaagcaggccagtggaggctgggggcgcaagcccttggtagggagaagggcagagagaccgatgccagagctggtgctggggcgaccatgggtgggggtagcgctagttggcagcagtagttgcaggcatgcagccccgccctgatcgagagggcccgtccccccaggcagaggcgggcatctaacctgtgtctctttctgccccatcctcccatagctatacctttctgccgtgtaagtaactgcgctgcccggggccaagcgtagagtagagcagggggcagtctgggtggggcctgggctggggtggggggcgctgggctggaggtggagctggggtgtcatcatgggacttggaccctaggactacatcctggtgggggcagctggccttggcctcccctgcaggggaagtgtcccttcctggggtgcagagaggcgtccctgaccacaggcctgaggctgtcctgtctgggaccggacccagtgaccacagggggctcaggccactgcgcctgcatgggtgggtggagatgtgagcggcagagccccggcttggtctgacctcttcctgtgaggatgggccgtgctgtccttagccacctccaccccggccctgaggacagaccctccaccagctgtggcccgaggagcatggctgtctctgggcctggcctggctcttctgggagccttggcctgaagtggatgaacagaggcactgggcttgcttcctgtctcttcccacccccgaccccccaccgtggctgaggggcaggggcttcagcagcagcttactgcctcccctgagtctgggggccacctggcagcccagggccagcctgggcaaggggatctgggaaggcggggcccgcttcccgcacgcccactctggttttcg

SEQ ID NO: 48947 - DNA, 712 bp, Bovine  19866881300802
ggaggaggaagcaagacaggttgtgccagactcatcgcatcaaaaggcactcacctagctgctctctgtcctctccagcaatcagccaatctgttttcacccacaggaccaagaagtctttgtcagatagtgaattttcagaagtcaatccaatttcccaaaagtaactgttgtcagttttagcctcacaataatctatttaaacagtaatagcaacattcactgttgaaattttctatccattcccctctccatccctccggtgcagaaggaacagtaaaaaggctaaggtaagagcagcagcaggagagagtggggaaggaagtgataattgccaaattggataagcagtctctgaatacatgaaaattaacaagacttgttttataacagctttatatctaagtgaaaaagaaatcactgataggatgaggaaaaaatttcatttgattcaaagcatttagaacttttccttggtatttctcttctgtgttagtcgctcagttgagtctgactctttctgacctcaccgactatagcccgccaggcttctctgtccataggatcctccaggcaagaatgctggagtggattgccatttccttttccagaggatcttcccaacccagggatcaaaacctgatctcctgcactgcaatcagattctttaccattgagctacgggaatttcttactatccccgaaaggaaca

SEQ ID NO: 48948 - DNA, 1541 bp, Bovine  19866881374824
tagtgtgcatttatcagttttggctagagaaatggttacagtgggaaaagtttaacaggcctttcccatgatcccctgtttggtcgccccaaaggaaacctattttatccacagtgtagaaggcagttctcatgactttgaggacagatggagtgagatcttccataatttctttgggagatttgggttctcccagtttttctgctcacccctacttcctcatctccatgctatggcctgggttttatacagtccttcgcattcacaagtcaggaaccctgctggaaaacgttgcctgaattctcatctgcagaccaagactcctttacaccctcagaactcacactcctcagaaactcaacgcacatcctctgcacatgggggcgaggtatcctgatctttgggggtgtgctcaaggccgtttccaaagcatgtcaaaggcagggctggaggctctggcagtctcctggggcccaggctggctcctggagcgctgattcctgggcaggcacatcccagccccaaagctaacgttccccggctcccagccgtcttcccaccggttagaactctggtgcaaagttaccccaatccagaaccaagccgtccgccctgcccttcgcctgcctcagtttccccggggtcccgggtgggctgggctgggtggcctgccaagaaagaccggcggagaaggagaaaggagagagccgggcacttacctcgccgctgctggcgccgcgattcctcgatccctccggggctccatgcctgcccgcccctcttatagccgccgaagcacaacttgcgcaactgcccggctggccggggcgcacccgcagcgccggctcccgccctgcggggcggcggggcagcgtcgggccgggcggccgcggtcggggactccagggagggactcggatgcgccaggagccccacgcccaccctccggtatcgcctgaaaagttgggggtggctgggcaggtgtgagaaatcctcgaggtggccccaggatctgaccctcgggtctcggggaacggccgcctgagacagggtggcggtgaggggttcctctgagccggctgggggcggtggcgccccgacagtgaggccggagcagccagctccgctgggcggcaagacccgacggctctgggcccccggggaaacccggccgtaggcctggcctggaaaatcacacctgccttgatgatggtgtggaggggtaaggaaagtcagcctcacaggtcctgaaggcaccggtcgtattgcatcagagacttcctaacgggaacgtgctcccgcaaaatctgtgtgctccgccgagtcccacaggggtccgttttgttcacatctgtatcccacattgatagccccgtgcgttgcacgaagattttcatttttaagatatatttttaaatgaaaatcgcaaatttaggtttaacgtactctttttgcatatttgcatcattaattcttttggctaaaatattctaaagcaaattacaaacatcagggcgtttcatccttaaatacttaagtgt

SEQ ID NO: 48949 - DNA, 1161 bp, Bovine  19866881380974
tctgtcttagggaaatgctaacacaagaccacagagatgtatcaaagaatgttgacatatcaacagagaaaaaaatgggtaagtaaatacacccaaaccacggaacactcctcaaacactgaagaatgagacagacgtataatcatgacactgaaaagtagttttgacaattaattttaaaaaggaagttacagaactgattataacctcatttctgtttctttaaaaaaaaaatgggggggtgtataaatctgcataaaaaaactgcaaagtacatttacttacagggatgagaatgaatgggagaaaattcgtaaggagggtagagggaggaagatttttgcattcaactttacatagttctgtactgtttgaagtcttaagagcaagcattaagtccaaattttaaacatcgacaactgtaaatgactaacactggatggcactcacctgagcatttggaaggatttctgggatgaactagaaaagctggtcaagagaaggaaaggccaccaagggactgcaaacgtgacccttcatcctcaggccttcaaaggcttgagaacgataggaaaattttatctccgtatttggcaagccagtggaataaaaactaaagaccaagaccaccaaagagatcatttggggttttactggtggtggtcttgttaagaaaggggcttataaacaagaaacaggatggatctaaacagacacatcaaaaagcccacgtgtgtggttctgtaggattaaaagggcagaaagtgaggaacagagactcttcatgcttgtggatgacacaaaagacttccacagtaataacgtgccaaggtactggtgccaaattataggaagatctggggaatctacgcaaatagaaggaaaagtggcagatgagtgttaaaatgagcatatggcctaaatcaggcacattaaacaacttctcagctgtcagttctgacctaggaataagctctcagagtcactgtaaatggactcctggggacatcagcccaatattgagctacagattaaaagcaatgcaaagtgttctgggagccatcgagataagtgctaaaaagaaaaaaagaagctactatctcccctcatatacaattccggtgcacggccccaaaagcatacactcctttgcatttatgt

SEQ ID NO: 48950 - DNA, 1358 bp, Bovine  19866881396932
ccattgtggagctcggttttactttttcttccatcttctggcagaggtgaggcttctgggagaagggaaagggcaggttacttttttcttttttaatcttcggcagggccccccgcaggttgaggaacacactcagtgctccagtccctgtgtgagcacgggaccctgaggcttgccaccctcagccgacgtggcactcaattcagctggtgggtgctcttcaagggcgtggggcttccttgagaattcatttattcttctcacaggctgcgtcgcaaaaatacttctgctgtgtgctaagttaatcccctgtgttaagtacaaagctggcagtctggggattcttgttcttaattacatctgatgcaatttagtttggtttttataaacatttcctttgtcatctccacatttttcacttcatattaatgtgattcactcacgccatggaaaagtcctctacattaatgatcaaaacaggccctagggttgagaatgcattgtgatttaaattgacaggtttatgtgaggttgcttgtccttgccttctcagtgccagctgttaccatcagtgtggctgtaaattttttgaataaatggctgaagatattcaccaaatcgagatgttttgaattggctcgtattttctgaccataccttttccgagtaagacttctcccacttgtacgggacgagagcatgtcagtgcaccacaggagaccaagggtcattggagatgccattgacctcttggctgaactcatcagctctcttgtctggtgtaggtaattaacagaaatgactgtagggtttctggaaactcagttgttcccagcaaggtaacattctcctggttgccacttgagagctcttcttgatgagctcttggttttgttttatctgtaggtgcggcagagtacctctgtgatttagagaccgtcagggtgttgagctgagcatgtagctctttggtgaagtgtggtatttgtatcaagtatattcttatgcctttttcagaaaggacgtcttatataaatgaagaaatcagaaattgaaactgcattcctgaacatttcttctgtaggcttacctgtgggaaatggtttattagataccaggatcctcaagatctcctgtctctgggtactgttagaccttactgggtttaaagaccttcttccctggactcccaggttgctcgtaggttctggtgagagtccttatatttataactgattgtcagttggcttgtcttaagccacccactcctgatcttttcacccaagattctgaaatatcgtccttagggctggaactttccatgcctgttctctgcaaactgggcttttattttaggg

SEQ ID NO: 48951 - DNA, 507 bp, Bovine  19866881443967
ggcaccctgcaacagtcccatccttccactccccaggctcgtcttccacccagccccatctagagatgaggctccagggaacgtggcacccaggtctcactccctcttcctccccacaggcacccagctggagaagctgatggagaacatgcgcaatgacattgctagccaccctcccgtcgagggctcctacgccccccgccggggcgaattctgcatcgccaaattcgtagacggagaatggtaagccacctggacccgagcaaggcagagtcttaagcaggagcaggaggaggtctgtctccagggcacccgtctgcagaagcgccagccagacgaggcattcgccctatcggcctgctttccactgagtggtcgctcttgaccttggtcagctctccagagtggtcctctatgttgcccgtttgcaacctgcagtgtaacccacagtttttctgcagtcggcctctagggcacaggagtatccctcctcctctctcctgggat

SEQ ID NO: 48952 - DNA, 861 bp, Bovine  19866881566023
cagccaatgagccaagaaaccagaatgtttttcaaactttctacaactataaaaggctgcagagctttgggacaaagtgtcataaagaatattaccagatggaaaagtcagaattgcggcctgaaaggaaatctacaagcctgtggccatcacaaccagaaattctggtaacaacgaaaaaatgtcagtttccaatcccggggaatgttgaggggaggccaacagaggggacaattgatcaagagaatttatattacaaaattatgacgggggttaatttttaatgaaacttgcaaggtttttaattcaccattcaaggatgtagagggtgagggcagaatttataatcaggcagaatttacagtaacagcagggggctgggaatcagaacatttaggctccagtcctggctccaacccaaaccaccatgtgaccttaggcaagtcacttgtcctcttcaaagttgtctcatccgtagtgagggaacaacaaggatagcaaagattcctaccggcctcaggctctgagagccaaagagagggggagcacggatacgaagagctctcaggactactgacttgacgcaagaggtggaggggaaaagacgggaaatgagggccagagagcgagaaaacttggcgtaactgagcgtcggtggaaacaacagcttcaagaaggccaagtactccaagagttccatggaagagcggacgttaggatctacgaaaaactgcaaactactcagcatatgccaaaatggactgaaggacggtgaatcggaggactgataccaacaaatccccgttaactaatcagtaatcgatctgtcccggtaaaaagccaggagacttgagtcccgcg

SEQ ID NO: 48953 - DNA, 950 bp, Bovine  19866881683290
cttcaggctccctgtaaacggtgggcagtgatggagaaaatacctgttgcgtcctactgactggatcaaaaggaaatgataaggtggtatggtcggtaagctatggagggacagtgggctatatatgcataggctgtcattacaactaccttgtgcctataggattaataatccttcccgttgtcgtaagccaaaaggacatctagtcatatctggattgtgaatccttcagggcgaggcttattcctcatgggacctctgggaaaagtctagtgattctggaggggacagggagaatcagtggaagaataggttaccatttggtttcccctcttctggacaccacttgaagtgacctggagtctcagttgccacccacattcacacctctactctcaagtcagatgcacaccagggtcttgggggtggccgtttgtgatgtattgttgcttgaaacaggtgttttgctaaactgggtaggaaaagttgtgttacagatattcttctcatggatcttgactctggggttcttgtttggtttagtgtagtagtttctcctggaagatttagatttccataggtggcatcctgttgacctggggaggaaagaggaaatagaaaccttcagttggtcacttgctaatttctagcatttaggaaaaaacctggtgagacccagtgggaagagagaagataaagtcatttgttcctttcttgaggaagtgccacggggacagagaagaggttagtttataggaaagagcagtagaagtgatttagaaaaatccaatgaatggtgcaaaataccatcagaattcacagggagactacaaccaacaggttagacttcctaagaattcaaactgacttgaggaagacatctgatggcatgagggtgtgcaaggtgccaagctgtttactaagcatttcactgtcatcagctcatgtaa

SEQ ID NO: 48954 - DNA, 1655 bp, Bovine  19866881902584
tctgagccttttctcctagtccatcgtcctttctcttccattctaagggactcttgtgattacatcccagataatccaggataatctccccatttcaaggtcagttgattagcaactttaattcccctttgtcatgtaacgggttctggagattaaaacatgaatatctgggtgtgggggggatattattcttcctaacatattatatattttgtaaatattttatctggaaagaatttttttttaattttattttatttttaaactttacataattgtattagttttgccaaatatcaaaatgaatccgccacaggtatacatgtgttccccatcctgaaccctcctccctcctccctccccataccatccctctgggtcatcccagtgcactagctccaagcatccagtaccgtgcattgaacctggactggcatctcatttcatacatgatattttacatgtttcaatgccattctcccatatctggaaagaattttggcaaaagctaaaaatgaaaaatcaaagttcttcctaacttgttggcaataagggcctccaatattactctataattcctagcaatattctttttcatgggaaaccagcagcacctagtgtctctccaaataaatttcaacagaaaatatggtgtcctgtaattaaaaaggtacagctcagactaatggtagaaaaaggaaattctcagtactcgtagacatagaaggcagattctgtcttgtgtgttctttagactgaacccctacacccatgcatccagaagtatttaaattaattctgtggggcctggcaccatgctggattctgtgatagatgcggaaagataaggtcctcatctccaaattgcacccagtcttattgggcagataacacactttgtcagttaaaatgtgtgtacccatttacaaaacactgaagacttgatggccaagtgtgccgttaataaccaggcctagctgtatacacattaaaaccccaaagaacactggcttaaataacaggtttctttcttgctgttgtgaaaggattggtatggccatggtttggcagttcatcaaaaagttaaatatagagttactatatgacccagttgattctactcctagatatatatccaagagaattaaaaacatatttttgtagaaaaatttggacactaatgttcataatagcattattcataatagccagaaagtggaaacaacccaaatgtccatcagctaataaatggataaaaaaatgtggtgtgtccatacaagggaacatttcttaaccatgaaagggaatgaagtactgataacatgctacaatatggtagaaactgaaaaacagtaggttaagaagtcagatacaaaaaaaaaaaaaaaaaagaagtcagatacaaaaggccacatattatatgattctgtttatatgaaatgtccagaacaggcaaatccatagagacagaaagcagattagtggttgccagggtctggggagtggggagggaagggtggaggtgtgactgctaatgggtaccaggttatttgggaggtaataaaaaatgtcctgaaattagtggtgatagttgaatagctttgtgaatatattaaaaccctaaaaacccttgaattgtacactttaaatgggtg

SEQ ID NO: 48955 - DNA, 1392 bp, Bovine  19866881979992
ccaaggcccaagagggcaggagagaggctctgcccaccaagaggccagagggacagctgggacacaccccaagctgcaacaggttgtgagggcttagtgatcggaaatgccagaacaacaaaagacgtgtttggtactgcgtttggaataacaaagcattgacattttacagtcgatatgtggggtctggaacagaaagctggaatgacagagcaggcgagggaaaaatccacacaaataagcttctatatgaaaagctggagaatacaaagcaaaacagtacaaatgtttaatgatccatcctggttaatgctgctccaatcaattcacagtattgaactgagttcctgcgtggccagcagaaccaaggacacaaccctttcctctcctgcgggcttctcaccctctggatcccgccagcaaatatctgcaaaccagttagggcctcagactccaccacctgcttcagtgcaatccatgttttcttagcttcttttccctaaacacagacttttcctgaagaatggctgcaatgttagtgctgaggcacggaaggtaaaaacacaggaaacaatgacagttatcacttacggggccccgcccatgagccaggtgtgtgagaatcacactgcgtgcattttcatctcggtatgtgttgccctgtgaaatcaggctgtattacaattaattcatcatccatcttccaactcaaactgatgaggtcgaagagggcaagggctgtgtctttcttgctctgtagccaagtatgagaaatacagcactggaacattatttcttatcctaagcgtttattagccaagcttgcccagcatagaattaagaacaaaagctttcaacatgccttcccagcttttgtcattctcctccccattatccaagacttgtatttaaagagaatgaaagggagacaaataaaatggaattagccgagatccgtgtacttgactctcgtattcatttctttgggccactaatgaaaggtcaggagatttccctctggccaaagatggctcaaaactcgacactggtgtgctgattagttgcccagtaaggaaagagaacattaaattatgtgccatgacattatgctgctttagacaaatttataaattctgctttcttgagtgtatcagtaattctactccaattacacatgtctggctcgaatggataattcacaatcagcatacaaaaagtgacctaacagtcttgaaagtctaacaggaaatcatctctctctgtatcagctggaaacagaataagtgctggacttgaaatgcttctccaagctcaaggagaattttaggttatatgggaagtgaactgtttccactatgcaggatcagatgttcttaagaaaaacacaagcaa

SEQ ID NO: 48956 - DNA, 1068 bp, Bovine  19866882213198
aaaaaaaaaaaaaaaaagaaaaatggaaacagacagcgagaggtgtaggagaaggtacaaattggtcagaagaagagtgcaaatcaaacatttcctgggtgtatgagagtacgggcaaaaatggcctaaagtcttgcatcgtccaatatgggcagcctctaaccacatgtggctatttaaatttcattaaagatcctgtgcctcagttgcaataactacattacaagtatacaatacccagaggggctagtggctgtcacactggacagaaagcacctgttgttctatactcgcagaaagttctactggacagtgctggggggctgcctggtatctccgctcatttcttactggccacaatgagtaggttctgacacctttttggggaagaactgaactgggggaagccagaaggtaccattattcactctccagcaaacctactacacctgaaaactcgaaagctcagcgcgactgcagcatgaacctaccagtgtatgaggctccctgggccctaaccccctttctcccctctcccctgcatgtttacagccactctgacctttgcatattttattccgattctattttacactgttttaattgatgtttaatatagcttaacgctgcatggtgttcaaagcccctcaccagggggccgttcacaggcagaagcacaattaatagcaatccccagaaaattatgccctgtatcgaagttgtcattgcaccatataaatgcttattattactactgagttctccagccctgacgccttcctgtgtttactaggtagcagatcaacctctgtgttagtgccttccctacgctgccacaccatcaggactaaatatagcccgtgtgtgtatgtttagctccatttagctgtgctttggaagaagagggggtaaaaaaatcagagttaattaaattgccggaaaatgtaatttgttcctcccccacttgacaaccccatgaaagacaaacagacatcactgctaccaagatagctaactggcctcagctataaggtggagggaagcccagaccaaggtaacaggacacgg

SEQ ID NO: 48957 - DNA, 1428 bp, Bovine  19866880393455
gctgggcagatttccgctgtcaacctggaagcgccagaggggtgtacatcaaatgcctaacgctttggtgctgactgtaagttgaggagtaattcattgtggacgttggtgaagagtttttacaccttgaggaagaacaggatgttaaataggaaactttattctaaatataatagcgtgctagtggctataattttgtttttgggaattgatgaaatgttctagaaatagatatatgtggattgatgtacaactttggaagatttactaaaaacactgaactatatattctttacaagggtatactttatgtgaattatatctcaggaaatctcttattttttaagtgttaaatttcagtaaatcttgtatacgttcagagagagttgggcatagttccgaaagaaagaaggggtgagacagactagcttggataggaaggaagcacatacccatttttcagatgagcaaatgaagagtcagatcagtttgtcctttgcccatgaagccacagtaaatattcaggccacgacttcacttctagcccttcttggctccagtgtttagatgctttccctaccacactgccggtgcccagaaaaaaaccagcccctggaatgtaacaataacacaaatgacaaataacacagataacacggtaacagtgacttccctctgcagagcaccctcgcctctcttttctctcgtctgttcttacggcatccctatgagagtgatgggtacaggtgtgcctgcatctgtggaggtggggtgtgtctaagaagaaggagatcacatctgctttccagtccgcataaagaacactggcttctcttctctaggcattcagggtgcttccacctccacttagggctctgtctctccctggacctggatatgcatcctgtttctccagtgcaagcagagtttctaagtgaaaccatagagatgtgggatccacagatatttagaaacaaggcctggaattgggtgtcgtgtgagtgtaacgtagaagtcagtgctgttctttggaaagagcagatacacgtttccattgtaaagcacatgtctagattaaagtcacttacatcattatctcccctgcagttcataagagagcttttgatgtcattctcagcttactagtgtaaataatggctctcattctcatcctgttggacaggatggaaacctgacttgggatttgtaaatactgctgcactgcatttactttcacggggacattttctcccccagcagacactggaataaacagcatcctgggaaacagctggtgggggaatcacgaggcattaacctaaggagtgagatcaaaacaaaagctctgtttgcgatctcccgccagagctcacatcccggcagtccccactgttcagctgcgttcaggatgcgtaaataaaataagat

SEQ ID NO: 48958 - DNA, 1748 bp, Bovine  19866880436630
gaagatgcactcattgcattgaacatgtagagacgggttttaaatcttttatctgtggggccacaaatcttctggcttcatatttcataagttagcttctgaatgttatttatccaaagcactcaataatttttgcagcatacttctgagtttctacagtcaacgtaggttccgcctctttttgggtctctttcgggttcaatccctgggtcaggaagagcccctggagaatgaaatggcagcccactccagtatatatatatgtctctgagctaatgggcacagagtgatttacatgcagtatcctctccgtgctctgtcctgccttcacaacaatgaaaacatgccgccttccttgctggtcttgacagtgtaagtccactgtctgcctcagttctcgtgacaacggtgaaagtctgatctcggtttagaggagtgagtaaaagctcacatgtggagggggttcagactaagaaggctgagatttcgctgctactgttttttattttttagctgtctggccatgggtatataccttatgaatttgtgtgtttgtcggtttcctcatctgcaccattgcattgaccagagtatctacagagatccaaatgagcacttagtccttggtagctgataagcctatgaatgagaagtgtattattatttccgttctgcagagaggcagcggaggcactgtgagtttacacactcttgccttgggttatatggcaagtgagtaacactgtggaatttgtatccaagttcaagtacttaaaatccatttgttcctttccattccctctactaaagttcgataagtgttattgtttctctcttccgccccaaactctaatctgaatttgatgggaactagttttctattgtctatgaaggtttcatgctgtactttctttaaaaaaaattgacataatgctctctttctcagtatgaatcatatttgcatagctctgaggatgttaagaactcaattttctcccggaaatcctttgtttttgagcttttgtatgtttatcattgaaatttcaggaatgatagttctatccatgcccatgctcttcaatagacgagtaacacaggccaccaatgtaagccacagatgaaattaaaaatgttctagaagtccaattaaaacagtgaaaaggaaatatgtggcaattttaataatgtattttatttaagccaatgtagccaaaatattatgatgtttaattaatataaaatgactgatgtgatatttctcattctttttttcatactgaatctttgaaacctcctgagtattataccggagaaggcgatggcaccccactccagtactcttgcctggaaaatcccatggacggaggagcctggtaggctgcagtccatggggtcgagaagagttggacatgactgagcgacttcactttcactttcatgcattggagaaggaaatggcaacccactcccgtgttcttgcctggagaatcccagggacgggggagcctagtgggctgccatctatgggatctcacagagtcggacacgactgaagcaacttagcagcagcagcagagtattatatatataaaacacatctcagttggaactagacacattttaagagctcagtagtcacttgtagctaatggatactgtgtagatagaacaggtcttaatttttcaaaggataatgtatacaacaaaaaatgttaaacacctgtgggtgagggaggtactctgtaagg

SEQ ID NO: 48959 - DNA, 2785 bp, Bovine  19866880454595
aaaagaaatgtataataggagggaaggggattggttgggaagagacaagtggacaacgggaatagaacagggcctgcagaagctggagctatctattctggagactgtgcatttagcagaaggatggttaagaccaaaaggttgtataaccatgggagaaaagtaagtatacaccaaaagtgtgtgtcagcttaggagagagaagaatctcccctcgtgattgtgcagtttttaaccctaagtccatctagttttccaatgtctctgtgcaatctaatttgaaaagctgtagaaagttacaaatgcatggcctgccctggattcttcgctgtttgtgagacactgtgtggtttgtttacctattgctgcataatgaaaaaccccaaaatgtagtgacttaaaaacaactattcatcattttttatgatgctgctctttggctgggtggttctccacatgaggttggctcaggtgactcttacggttcattcagcaggaagcttgtagggctggagcattctggactgggtccttgttctgactattggtggaggactttgctttccttgattcctcattcagtagcctagatccaagttgtttcatgaaaaggcaaaacttaacactgttcagaccccctaaagggcttctctggtggctcagatggtaaagaatctgcttgcaatgtggaagatccaggttcaatccctgggttgggaagatatctttgagaagggaatggctacccactccagtgttcctgcctggagaattccatggacagaggagcctggcgggctacagcccatggagttgcagagagctggacactgagaccccataagggctggtctcagatcaaaaacaatactatttctgccatagtttattagctacataaagccagggtaaacagacctcatcacctgatgggaggagctccaagcaccttctgtactatgtgcagtcttatttagacataagctaccacaccctgattaatggaagtatttgatgaactccaaactgtagtcatatacaactatatttccaaagcctatgtcttattcagaaaataggtgaaagatgattagatgaatccacagaataccaaagtagaaacttggttgtatgcagtttgaataatggctatggggatataagtacaaaaagctttctgcggtcacagaagatgaaaattactcaagcaactttctttacttctcagactttcaggatttctcacagcttttaatgtgataatatgcattgctgttttcaaaatactaaatatattgtgaagcattcctgtatggatttgattacagatctcttttttcatggaacactttaatgaagaaatgctttacggaatacattttgggaaatgctgaggcaaagcattagagggccagataaatgtgtgtgtgtgtgtgtgtgtgtgtgtgtgtgtgtgtattaagttacctcattcgtgtccgactctttgcaaccctatggactgtagccgaccaagcttctctgtccatgagattctctaggcaagaatactggagtgggttgccatgccttcctccaggggaccttcctgacccagggattgaagccacatcttttatgtattcggcaccagcaggtggtttctttaccattagcaccacttgggaagccccagatagatggtacatgataatacatcataccctctgagactgcagaaagatgaagaatgtgagggaaagcccacaaaacatactaggacatggaggaaaatgcccagaatgtggagtcagaacacctttaggtcatttccagccctgttgagtatgctgagcaagtgatttcatctgatctatagagtggaaagaatagtgttcctttctcatagaaaggattctgtgcacaggttcaactgggacatgaattatgaagttgtgggaggtagtttccaagtttttttcattatgagagtactgttttttttaatttttctatgaatcctataatctaagtttgcttaccaagtaatgatcaaggaacgatacaggctaaacttggtccactagagagatgtatgcacatatagttggtttaatttttactaataactgttaaggcggattctacctttgatatctctggtggcagcactatcacacgattttactatgtggatttggaggagggccatagatcccctgtcagccctctctttcatctcttagttttgaaattagctgttctctttacattcattcctgccactgcttctcacaagagcaggaagaggaagaggggataatagtcatctcagagacaatgatctcagggcatgttttaaaaatggtggaaagaaaacttctaagatctgtgaatggctggcatgcatgcagttgtacccatcatggttttgccttctgcatttccattcggaaacatgggcatttgcctttttttaatttctctctcttctccctttctttttcatgtttccttatgtcttcctctctcccccccctctctcttcccctcctctctctcagccattttctctctctccctcacaccctttccttctttgttcctctctccatcccactgcctttatcacacctctgttaaatcttcaaggatatactcatcctattctaccccttaagactgagggcctgaatgtacagtaattaagctgcttctggaggctaaatagtgttagtatcatctgctataatgaaaccctgtcaattccacacccccaaccctcctgctcttttaatagtccatt

SEQ ID NO: 48960 - DNA, 1697 bp, Bovine  19866880471520
ccaacaagtggtgacagccggtattgctcactggttaaagacagactccagagccagctgtcatgggctcagactcagtgctgtgatttatcagaagcataactttgcataaattgcttaacctacccagatcttagtttccatcctttaaaataagaatattcacagtcccccattcataagtttgttatagaaattaatagatgagttactatttataaagattttagagcaatggctagaaaaagattttgctcagtaaattttcattccaaaattgaattaaaaaacaatgtcttaaaaattcatcttaacatacctgagatttaccattaaaataactttatataatacacacagtcatataagcacttataaataatggtttcaaggaactacttttaaaagcaagttgatcttgctattctttccaacagaagaaaatagataatttcacctttttaacaaagggtgaaatgtatcacctttttaacaaagggtgacatttatcctttattggtcacatgaaaacttaagtctgttagtatcaatctagaaattttttataaagaaaaaaaaagttgtcatctagtttcaacacatttagtgtcagaaataattgtgctttacagcaaaatggcagccagaagaaagaggtgcagaaatatcaactttaattaaaccctttatttcaaatactcttcacagtatatgcaagaataatttatcactgtgtgaatgaacacttaatacttggtgtggtgtgaaatgggcagagatcttgttgcaccatatgcttttacttttctatttcttcctcttgagattctatggaggcattatcaagtttgtacttgaagtatggggttcaaatcatatatttagcttttactggtgtcctgctcaggcactggccacccagttgtgaataagatatcatcccaaccattaagaagcaaccagtctagtaaggagatggtgctatgaatcagaaatgcctccaaaatctttcacccaaatgagaatgtgaacctggaaaccacctgtagaaaatgtcacccaatggcttccctttacagagaatgaggcacagctgccactctcggagctgaggcatgccccaccgcgagcaaagtggaagatgcttaatcatatctttggctttctgacttaaatgcaggcatcttcctatgacttcacattacctcactataggatttaactcctcctggtcccttccatgcagtcagtttgctttacaagaagcagaatttgatgtagtattgatatgcccaagtcgcgggaggaagctgttaagtgaccacactgcctcctgaatctttctctcgtttctacacagcctttaacatatcctggagtctgtctacaacaaatactgaagtccttattccttgaaaagggacttacataatacatcacaaaatagtattcagggcagtgatggatacttggaattactgtacatgtgtgacttctccagataccattttgccatattacatacaaagcatcagaaaggcttgggtcagtgaaatgaaagagcctcagaagaaaaggagttgttcaccagcaaagtagaattccaccagttcccttatttctgagacttctaaggacagatggctctggtatctccatgtaactcttattcctcaattcctctcttagagaaagca

SEQ ID NO: 48961 - DNA, 2005 bp, Bovine  19866880523689
ttgcttcagtcgtgtccgactctgtgccaccccatagagggcagcccaccaggctcccccgtctctgggattctccaggcaaaaacactggagtgggttgccatttccttctccaatgcatgaaagtgaaaagtgaaagtgaagtcgctcagtcgtgtctgactcctaaggacctcatggactgtagaccaccaggctcctctgtctatgggattttccaggcaagagtactgaagctagattatatttatttttatttgctttccatctcctcttcaccatggccccccaaaacttaaaaataaacttgctgctattttagggcaaaatatatatgtatatattctcttggagaaaggcttttcattttctttctaagtgctcccaggttctataacaatagactcatgtatgtatgtgacttttatagtggatgtgtttagcttttcctctttctctgacattgtattccttttttattcagtagagaagtcatggcgaagtgggaaggcagatccttgggagcatgggaagtgtggatttgaattcttattctactgctaattagctttgttatcttgggcaagttatttaacttctctgaggtttgattcctttctcttttaggaggtaggaacagaataaaacaagccccgaccagtgctgtcgggaagattaattaaaggaaaaatgcatgtagaggcaccaaggctatatatattggggctatgtagtaggtacaagtaaaactggagcatcctctattgcacttgttaatatggtaaagggtagaaagagaaactccatcatttgggcaagaaatagggataaaatgtagagtaggaggaggtttgctcatatgctaggagactgtttgtttattcatttcccaaagatattacaaaggctgtgaatatttatttagttctgctcccaatagcccttctaatagggaattatttgggtacaacgaaagacatttgtaaatgcggctgataagactgacactggacaaggagtgttttgttggacacaagaattctattgtccctggcttcagttgtcaagtgcccggggaacccagaatttatggtgacagcacaatgggcctttcagggcccagcgaaagagctgtgagatcctgctccccggcttttcagggcttctaatctttttatcgggcccggacaatgccggattcagctgctgcctgcgcctcctgactgtccattggccgtcaggtattgtgcggtaattaccatggtgacaatgggccctctctacgccagtccatcggtggtttggaaaacggcaaaggttgtcactttgtattaggggcctctaaaggcatggcttacttagaaaaactaccaaagagaaatcaagataatcgtgttaagagtttgatttaaagggccactgtgtcaaatccatttggagcccaggaactctatggatgtttccttgtaattacagccagacgttgggcatcatcccacacaagcagcaagtagccggccatggcgagtttgcagggagccctgagctgtgggcagctggcagcctttaacgtcatatggagcagagatctcagctgagcctttgaactctgaggggtccctgaacttctctgagaattcagttcctcatatgaaaaggaatggggtggaaaatgcttatggatgaatagtaattatatattccatgagtatgtattaatgtatgcaaatatagtcccatacagatgtgacagttggaccataaagaaggctgagtgccgaagaagtgatgtgtgtgaattatggtgctggagaagactctttagagtcccttggacagcaaggagatcaaaccagtcaatcctaaaggaaatcaaggctgaatattcattggaaggactgatgcttaagccaaagctccaagacattggccacctgattcgaagaacagacacagtggggaaaaaccctgatgcggcaaagtttagggcaggaggagaaggggg

SEQ ID NO: 48962 - DNA, 4224 bp, Bovine  19866880530291
gtcctgccctcattgatgtcatgttctatggggtggtggagaaatgttcttgttgttcagtcgctaagaaaatgctgttgtttagtagctaagttgtgtctgactctttgtgaccttatggactgcagcatgccaggcttccctgttcttcactatatcccagagtttgctcaaactcatgtccattgagtcagtgatgctgtctaaccatctcatcctctgtcgccctcttctcctcctgccctcaatctttcccagtgtcagggtcttttccaatgaggcggctcttccttcacatcaggtggccaaagtatgtgcgcttctgcatcagtacttctaatgaatatttggagttgaattcctttaggattaactggtgatctccttcctgtcctggggactcccagcagtcttctccaacaccacaattcgaaagcatcaattctttggcactcagctttctttctggtccatctctcacatccatacatgactataggaaaaaccatagctttgactagagggaactttgttggccaagtgatgtctctgctttttaatatgacttctatgtctaaaactaataaataagtgcattatagagtatgttagaaggtgatctgtgtcatagtaaaaagaaaataccttgagctaggtgaaatgatcaaaattgatggggaaggttataatattaaataggaaaataaataccttattttctagtcatcaagtcatataggcttattgttattattcctgtttattagagtagtagactgagttttatacaagtctgtgagttttaccagggtcacactcgtagtaagtgttggagctggattcaaatccgagtagtctcatggcagagagttctaaatttcatggacttctgaaagttctagtttgtgtgccccgttgccaaattatatgtgtgtgtgtgtgtgtgtgtgtgtgtgtacactgtctgcatttagaatcagctgtggtggtcttccaggttctccagggcaggagtaagcaattccagctttcataatcccaggctttaattgcccagtgggcaccagaagccctcagtctcccgccgagtcttctattcaaataagacacatgattctaataaagaatcaataacacaaaggccactgcgtattttctcatatgctgaaatggggaggggctcactggggttatcacaccggggtgcaagagaaggggaacgtgaagagggttgcatgtttatttttagtttcaattaataatttttgctgagccatcaagtttggggagactttttaaaaacgtgcagtacaattactttctaattgctggagatgagtagccatctgagtgcaatattccagtattttttttacttgtgaaattattgggcattgttttacacactctgacatttttgttattacctgagagagagaaaatggtcttaggaccacggattgtgcatacgaaaggagacctcagagatggccttggccaaattcctcattttagagatagtgaaatttagaagccctgagaagccaagtaccatacctgcaatccctcagacagtgccaaagaggaaatgccacatttagaaaagcataaattactagcattggggatcgtcttttcctttcctctcattctctagataaggaaatgaaactcaatgtaaactgactacctttctcattggaatccaacccaacctattctccctacaacccactgattttaatgcagatacaaacatgtcattcacttaaaacacttcagtgattctccgtcttcagaataaagatgattttgttatttgtcttgtccttacttttgcagggacatctcttgaggttctcctgttataaatctacttgttctgctgccgtacactctgctctcctccgcactttcctctgccttggcctttgtcttctctttctgcaggtttcatttcaggtgtcacaccttttctgcctctcacttttttctgggaagatgcccttttgctgtgcatgtctctatctttcagttcttagagttgctgatattctgtttatgtcagtctttccattactggaagcccatttagatcagagatggtggttttatcaatctgtgtatattcatccttgcacctggatatagcctgtgatgaacttatttaaaggataaatgagtaaatacataactaaatgatttttggattgatacaggttatgtatctctaatattatttctgtaaatgtttttcaagaagaaaacaaagcaaaaagtaaaaatagagttttgccctcttgctgagaagtctcaagtgaaatatatccttgtaaactttcataatttagatatggaattatagattattgataaaaaattgtttttgcaaagacactttgttgctgttctgtaaatctcagttttcccctacatgaatcatagttcactggatccctgctcttccattccatagaattgtgacagtctttatcaaaattttccatattatattgtgaattcttcattcatttctttaagacagtaattgaacgtatgctaaatctatcattatgctccagggaaggatgaacagatgagtaaaattaaggagttcatagactagtaagagaaataaacacacagaattagttcatatccaaaaataccggtcctaactatacccaatggccaaacgggtatgcaaagggccaggggaattcagaagaggtaaaaacgtattctcatttggggaaatggggaaaactttgtggaaaggaatcatttgactggaaccctacagactattgacaggaaaggagttcatgtatcatgttaatggtagaaattctcaaagatattctggatttttcttcattcaagataacatcatcgactctgcttggcatttgtcttataatttttactatagaactgtttggacttaatgacctcaggagtaatgaggataaatattgtttaatctaagttgttagtctttcaacaaattagacttaagaatgttgctgtgttagcaaggtaaatctactctggattaaatggcccagagaatgatgagaattaagaaaagcattgaatatagacacttcattcattcagtaaatatttactgaagatgtgctgtatagcagtgatatactatttgctgaaagcttcaagtccagtgaggagtcagccatggtagcagatgataataagatcacaattatttttctaaaagtatacatgactatgagtgttgtaggaagctctgcaaagtaggtgttagttgaactgatccttgagaggtgaggtgtctgccagttactttggagcagaaataaacagagacaccacgtattaataggcacagaaacggagaacacagtgtgttgttgaattatttttaaagtttcaagtgatctcctttacttccttatgggaaataacacttttcattttcttttgtggttgcttcagtgtttacattggttgtctttaccttacacaagtattttaccattttcctcccctggcttttgtattaagattgccatacattttgattctgtttatttataaatcatagaagttttttttttttaattctgcttttaaaattaaaaaaaactttaaagagaatttttaaataaaaaaattatatatatgtgtgtgtgtgtgtgtgtgtgcgcgcatataagtgtgcacacatgctaaatcgcttcagccatgtccgactctttgcgaccccatggactgtatccctctaggctcctctgtccatgagaatttccaggcaagaatactggagtaggttgccatgcccttctccaggggatcttgccaacccaggaatcgaaccccagtctccagcattggcaagcaggttctttaccactagcatcacctagaaagcctacatatatatacatacatatacaccatatatatacacactcatatatacatatacacacacataccattcatttcagaggttctttaattccccgtatagatttcactttccctctgataccatattctttctgcttgaaggaattcctttaacatttcttctaatgcagatccactgttgatggactatttcagatttttgtctctctgaaaaaggcttcattctgtctttatgtttgaaagatatttccaccaagtatagcattcttggttgacatggccctccccccaccccaagtaattcag

SEQ ID NO: 48963 - DNA, 1577 bp, Bovine  19866880565630
aatgatgactagttagagcctattgaacatttgaaacatttgtaggatgtaatttattcataccaaatacatcagaaaagtaactctcgtgttaaatgacagcatgaagaaattaaaaggcaaaagtgagcagtcggctttaaacggatgctctgaggtttgtagaaaaatgtcaaaagagttcaaatgttcataatgtgaaagtaaatatttgggcatactgtggaaaggccttgtcctaatgtaagacaatacagttcttcatgaaatataaagaggagactgtttagtctagcttaatttccatatgttttattaataaacaattataccaaaaaggtatgttcttgctccccctcttccttattcagctctgtctagttttcccataaagttcaaaccaattgtaattttcctttttcttactgattttttgtcatttatcagaaagtttgctggatcaataaaacatatatctatgaagacttgaagttaggagactaataatgtgacttggtccataggatgtagcaatagctaaagtcacctgtctattatgcctccctaacgtgtgaggggagatacagacacaaagaagtcaaaggcaggcatattactgctttacacatggctggctttgaccttaaacttggtaaactgagccaaattatatgcagaatacatttgatacggtgtgatatttaaaatgataattttctttaagcttaaatttgcatcttgggacttatcactttgctattgctattgctaagtcgcgtcagtcatgtctgactctgtgcgaccccacagacagcagcccaccggcttccctgtccctgggattctccaggcaagaacgctggaatgggttgccatttccttctccaatgcatgaaagtgaaaagtgaaagtaaagtcgttcagtcgtgtccaactcttagcaaccccatggactgcagcctaccaggctctcctgtccaatcactttagtaaatctaaaataacaatataacttgtagacttttggatcgaagccattctgagtggcgtgaaatggtacctcatagtggttgcaataaatgctggagagggtgtggagaaaagggaaccctcttacactgttggtgggaatgcaaactagtacagccactatggagaacagtgtggagattccttaaaaaactggaaatagagctgccttatgatccagcaatcccattgctgggcatacacactgaggaaaccagaagggaaagagacacgtgtaccccaatgttcattgcacctctgtttataatagccagggcatggaagcaacctagatgtccatcagcagatgaatggataagaaagcagtggtacatatacacaatggagtattactcagccattaaaaagaatacatttgaatcagttctaatgaggtggatgaaactggagcctattatacagagtgaagtaagccagaaggaaaaacataaatacagtatactaacgcatatatatggaatttagaaagatggtaacaataaccctgtatacgagacagcaaaacagacactgatgtatagaacagt

SEQ ID NO: 48964 - DNA, 514 bp, Bovine  19866880581655
acactctctaaaagtttttgctacgtgcacttctcactttcctgcattggagaaggcaatggcaacccactccagtgttcttgcctggagaatcccagggacggaggagcctggtgggctgccgtctatggggtcgcacagagtcggatgcaactgaagcaacttagcagcagcagcagcagaaacagtcacagtctcagacttctcttaggaagaagagcaaactgcactggccatagcaatatggctgatatatgatgtagtaggagagggttctctcttgagcccaaggcttctcaaaagtaaataggagtgtccttctgcaatgtaaaattaagaaaaagaaaatgccattttgttattcatctcttcttagacacttactctgaagatacaagctgtacaaattcaaagtgtcgacaagctccacaaggtcaggaatcatgaatgttttcttctttattgtaaatcaggtggacagaggcataaactaatgctcccaagtgatttctga

SEQ ID NO: 48965 - DNA, 873 bp, Bovine  19866880681219
acaatctggcaacgggtcccagctcacaccagctctctcaccgatgggccagaacaaacttccctaaactcctaaaataggatcaacagttcaggctgagcctcgggccctggctctgacagcaggagcgcccaagccggaattaaaaaccaacctcaaatcagctggaggtcgggagtagcaggtacagaaaaagcgcacatcgtacagagcggtccggaggggacagctgcgatagcccgggcggggcgtaaataaaacccgcactaagcttgtgtccgccagagcctgttccctttgccgggatccctgtgccatcattcccgtcccacgtccgggccagccactgcggccggcacctgcacgcgagctggctgatggagaggccaggcgcgttaaattcagtgcctactcactgcaccatcgcagaggtcaccgcgcaggcgctggccgcctagagtcttccttgagaggcgggagccggccgcgacagtccatctccaaggtaccttccctcctcgatcccagggcacctcccacggggactccagaggctgaagggccgtgagagggtgcggcccagctctgtactggacagtggggagcggcgactggcccgggcagccagagaggcggccactatccctggcaccgccggcagccttgtgaataaaccactgtggcgagacacacacccactgctaatgagtcccacacagacgccagccaggaaggccggagcaagcaaagacaggggcggggcagggccaccgggggggcccacctgggctcacaggtgcggccagcatggcaggggagactgaaacatgtgtcctcccctccaaggaaaagcatctttgccccgccccactc

SEQ ID NO: 48966 - DNA, 1232 bp, Bovine  19866880694558
attctctgactacaaaggctgtgtatatataaatgaataaattttgaccaaccaaaaaaaaaaaaaaaagacagatgtcagcctcagtacaactataggggttcagaacaagcctccctaaaatgtatcacttttgcatgagaattattttgatctaaaagcaattgaaactctatgttttcaagagaaacttctacctttcccttaactatctagaagaatttaatatccccgcccccccagaagggacttccctggtggctcagatggtaaagcgtctgtctacaatgcaggagacctgggttccatccctgggtcaggaagatctgctagagaaggaaatggcaatccactccagtactattgcctggaaaatcccatggacagaggaacctggtaggctacagtccatggggtcgcaaagagtcagacacaactaagcgacttcactttcctttcctttcctttccccccagaagagaattactagtctagagataaatttcatctaagtggtctcatctatatggcagggaaaacatctcatttccaagtatctggtcttctttttgtcctaggaacgacccatctgtttcttggcggccccgtgtcccactctttacctaagcaaggcacacagacctcattttgcccttctctgaccctctcatgtatgtgagagccccatgtgtatgaaattaaatttgatttttttctcctgttaactcattgcacaccaatttatcttatttttgctgaagtatagttgatttactcacatccgttcttagactagccagaagaacctcgaagagtaaagttttcctcctccccaacacaatatttcgcatgtattaagtacttcagaaaccttaactttctcccatttctttattttcctctaaccttaattaggaccctctgaccagaataaagaaaaattatcctgggaaaaaaattagttcacttcagcatgttcaggccaaagcatgattaagtaatatgctctggctagctcctctgatttaatacttagcttctccacatgcagtgcatggcccagcagcatcagagcttcttagaaatacagactctcaggcctcacctctaggttcaccagaatgagcatccgagcaagacccccatgtgatacacatattattatttaatattattattattcctacacctattattaaagaagtgctgcttatggaaacagcaataattta

SEQ ID NO: 48967 - DNA, 1662 bp, Bovine  19866880709945
aaaatatcttgaatgctggacctaaacagaccttactggctttggaaaattactctgcctgggcaaatccagttccttttgggcctttgacaataattatgcttggatgacgctgaatcaatccattgaattgtttctaccttcctgatcttacttttattccccctaaggaaaactgtgatctgtatatgagtactgaggagcatcatagtatggcaggaaagagaagacttgaatcaataaaacccagggatgcacatattgcactgtctcttatggattgtatcatcttgctcgagtgagttaaaacctctgaaatttagttttctcacctttagaaggagtgcaaacacatatctttcacagaatggctgggaagatcaagagacatgatgtttaatatacctgatccactgcttgggccccagtgggttctctgtagatgctcttcttcttgctttcccctcccaccgcccgtttagtgtggcactcagaggcagctgtgatggtcgcctccaggtaggcatccatgattgcagaatgacaaaacccttgtgttcccaatgtagccagtgctctagaggtccagttgcctgtgtggcagacattcttgccaggtctcagacccgactgcattcccacagggcccctcacagcccttcatctgtgtctgtcccatagcacttactgaattctcccagtcgtggactcacatgcctggtgaaacttatgaaactgcctctcccctcaccccccagacagggaaactgtgcttttcacttctccacagcctgcagtgtgatacctggaatataggagatattaagaaagggtaatgacgtgggactcaggccagaatgaccagctgtttaactcggctttcagatctggtcagttttttggttctgttttgccactgtcaacttgtcaatatctcagtctgaggggttcttgattcacaaaacctctcctgaatgccaggactgtgagttatctcatgtcatccttaccccaacccttggaagtaggtgttactgctttcaatttccaagcgagaaaacaaactccaagaggtgacttaccttacccccggccaggtcattcttttgtggtcagcctgaccctcccatagaggaagaaaaataattggcatcctagcacctaaatattgccagacgcagtgtagctgccaataagtacatgtagaatgaaagaaacattatgcagcatctgaaacagatgctttttattatctcttttgcatcttttcaatgaaaaactggaaatcgagagaggttactaacttaactcatagttacatagttagtgagtagcaggcctcgtgttttaaatgaattccatttgaccaagtacttaacctctgttatgctgcctaaagaaagacaggtaaatatttatgagcaaagggaaaaaaaaaaaagagcccttagcattatcattctccatcagctctgagtacggttacaaattctttagctggcaaaagaaataatgggccataaaacacttatccgccctggaccctcacctttcattgtttgtatattgctactttcaaaatcattaagcctgtgactgttcatagggtaattctgagcatattacaattgcttcgagtcagaagccttatatcccaacagc

SEQ ID NO: 48968 - DNA, 3407 bp, Bovine  19866880715349
aacccggttcgatccctgggtcgggaagatcccctggtagaaggaaatggcaacccactcagtattcttgcctggaaaatccccatggacagaggagtctgaaaggctatagtccatggggtcacagagtcagacacgactgagtttgccattttgccctggttgtttttcttttggctaatacaagactggcacccagtgcagttgacgtatcaaaggctgcttccctatcataattttcccttttaatatcctttgtatatatccctcccttgggtgatatcatcatcatggcccttacgtttgtatctccaaaccggtaccatggagaccatcattatgaagaacttttaccttttgttaaagtaatcacaaagtatgcagataaaaatagcatccagttaggagtctaggttgtagacataaaaatttgaaacctgaatttatttaccattaatagaaatactacagtttgtacaagacatatactagtaattaatgacctcatttgcaagtttttgcctaagatggcggggggcgggggtggtggaaaggaaaggcttccatgtttgtggacagggagaagaatataaggtgtcaggatgaaacaccaaggtgattgaaaaacattttcttaccatgggaaataccttacccagaactgaagagcatgaactatcttcccacctctgaaggaagcgcccttctctgtaggcaattgcattcaaggctgcaatgacatttctaagaattcactttcctctctttgccaatatgtttctcttcctcattagtctactgcacaaagaggagaacttccaaaaaagaattgatatttactggtcatctgcaacagcctggcactgtgctaaatgcctttatgaatggaatcaaatttaaccctaaaaactattaatttcctggatgagaatatagcaacttaagacatttacctaatatgtccaaatgtcaggcaattaatatgtagaagagtcatgattcaaacccagatctgttgaaccccaaatactgagatttgctctttggaagctttataaaagagaatactttgcccacctgatgtgaagagctgactcattagaaaagactgaaggcaaaagaagagggtggcagaggggatgtttagatagcatcactgactcaatggacgtgaatacgagcaaactccaggagacagcaggatacaggggcctgcggtccatggggtggcaaagagttggacacggcttagtgacttaacaacaacagtaataaaggagaaggatttgagaaatctcttgatgaaaacttaaaaattgatagaacatttgtcattttctgcctcgtcttattaaccatggaatcaatttgacacttccctgaaaatatgtcttacagaagctcttattttttttcttgtgtgacccgtacatctcagaaatgtgtatgtccaaattgaggggaccctctcaaagatggatatagagtagcgggctaattaaaataatgagagaatctgtagccaaacctaggatacaaaaatgatttcctacagaggttttattattattgtcagtttcattttccatgtattttgctcgagttgtttttcatggactccctgcctattagtggttcttcttgttcataaaggatcagtgaccagagtggacaacaagaaagaccatcacagacatggtgctgtctcctccaatatggccctccctgcagcaccatcccccccattggtgctgatgtctagatctaaaggggggatattgtatgcattcaagcaacagcaaccacctaagtgccaagctagtctggttagacatgcttctcgtctaactatgccatatcctactccgcaccagttcacgagctctggaggacctggattctggtgccgggttttcctatagaaggattcctgagcttcctggaagcacagcccagagcacaaccagaggtttttattatttggtcctaatcgcaaccccaggtcttccctgtagctcacagggttaagagttctcctgcaatgcaggagaccatggttcaattcctgggtcagaaagatcctctggagaagggaatggcaatccactccagtattcttgcctggaaaatcccatggacagaggagactggcggggtccgtggggtcacaaaaagttggacatgactgagcaactgttactactaatcggaaccccatgaggcatgcttgctatcaacttgtgtcctcactttaaaggtgaacaagtaaggctctggcaggacaaatgactccttctaaaacatgtgtttggaccatgccgaggaacagacattcagtccatttattttccacctctcaaactaatcttaaaatccatatgtgaaacattttttaaaagttcttgagattctactgatgaatcactcagagacaataaacgattcagtcagctgggtcctttgatgagctttcatttcatagtctcagtgtgtctgagaggactcagctgttcggaatatgaaacatcttgaattcacaggctggtgtcctgctcagatacatgttttccactagtgtttgattttcaattacctccatgtgtaagccagcctgctgtcatctggaggtacagttttgcatggattgcacactgaagagtagatttttaagccatggcctccacaggtttaaagaaaaataaaaacactcaggtcacgttcccaccaaacttctccatgggtaacaggatgggactcaatagatgacatctcttgggggtgtcattcatatcagagaggtatatttgaccaagcaatttaattaatttcttcataaattttttcatatttatttttattcatgatggcatggcatttgtgatatttcagatcattaaaatacagtaaatgttttaacatttaatttgtgaaagtcttacttgaattcaaataaaattatgagaaggaaaaaataacatttgaagtaatttatgtatatatgtcagtttttttgtgtttgttaagcatagaacaatggtatagcctacaataggaaagaacagtcagcaaatggaatgttaagtttacattctatttgaccagcttttaaaaaaaatcatgatttttcgtagtacatataatttttctccagtgataagagcaatatatgctaatcacacaaacttcagaaaatatagagaagagggctggcagttctgccctgttttgattgagagattggcagcaaagggcagaagatctgtcattaataagatttgccaaaaaccagccagcgcacacaccttagcttctgcaatactcaaaatatctattcagtcctaaatgagactgaacctggtatagatttttttttttttttttacctcacacagactatgttacaattt

SEQ ID NO: 48969 - DNA, 1904 bp, Bovine  19866880827222
aactgcacaaactttgacatttttaatacagggcgtttcatatttgatatatctttgctcatttgttcaaacaatgggaatcctttttaatagacataactctgaaaatatttagatttgaagacatataattttattagaatacttttttttttaacagcaatcctgatgagtttaatttaaccacaatttttacttcatttagcactcaggaaattggaaattatttcatgctatggtaattttcttccttttttttcctccaaacactaactgggatgtgaatgaaataatagtgcttggaaatacaattttcaaaatgttttctcagataaattagtgaagaggtggttagtttgatgatggtgaccaagcaaactagatcagtgggagacccacctttttttctctctctctctttggatccctagcccaggacaggtgctgagcaaatgtttggggcaggaatataaggatgaatgggaaaaggaaaataagttcttcattttatgacctaggtattatagcattttaaactactggaaatgtgtatatggggattcctctgggtaccttgcctccactccgcctccatcaaaatggtactattttgatagtaccattaataatgcttgggatttagatttgacatgactggatatttacccagcatacagtcagatcaaattgggcctggatgcacagagcagatcactgaagcgtcatctgataatctgtgtgacttcctagccctggaactctacttaccgtctgtgggtctcattttttttttatacagtggggatatgtagtctgtctggcattcctccaagaagtctaggaatgactgatctagaataggaaaattaatgtatgacttgctgcacaaatgagagattttattgttgtttctgatgttatttgggctgttttctaccataaattgatctttgtagcatctgcaagaggtgacctctgatccaaagtgaagtcaagagagatttggtttttcttttgaagactttgatctggtagccttagggtaggctttaaactgactctaagaaatggatactgcaatttactgtgtaaggactgtggtcccacgggttctcccagactcgcctctcaactttgttgcagatactcaagtcctttatataaaatggcagagtattttcttataacccaagcacatcctcctgtctactttacatcaactctatatcatttataatacctaattcaatgtcaatgttatgtaaattgctgtaaatacaatgtaaatactatgtgaatagttgctgacctgcagcaaattaaatttcacattttagagttttctggaattaaaaaaaaaaacaaacccatctgtgtggttgaatctgcggatgcagaacccgccaatgcagagtgtcaactggactcattttcaagtggaggctatgaggaatagtccatccttgtccattgttttccaagtttgaatgtgcatttctacatttctctggtggttggaagaaaaggtttatttacatgtcattagcaatactaacggagaaggcgatggcaccccactccagtactcttgcctggaaaatcccatggacagaggagcctggtaggctgcagtccatggggtcgcaaagagtcggacacgactgagcgacttcactttcacttttcactttcatgcattggagaaggaaatggcaacccactccaatgttcttgtctggagaatcccagggacgggggagcctggtgggtttccgtctatggggtcgcacagagtcagacatgactgaagcaacttagcagcagcagcagcagcagcaatactaaagagagaatagcgtcttcttttaaaatagtaaactataaaataaacacaattctcctct

SEQ ID NO: 48970 - DNA, 1300 bp, Bovine  19866880833896
tctgtgggtgtgacgtgaatggggcgctgctgtcctgcaacgcagaagcctacatcctgaacgccggcctgagcaccggggcgctgatcgccatccttgcctgcatcgtcattctcctgggtaagggatctccccgggcacccgtgggaagggcctttcaaccagatgcccatccttggcacacgtatatttcccaagttatatgtgctatatactgtgggtgcaagttgggacaaaaagagaagtggtatctgcctgctcctctatttcagggtatggcgggggggagcaggtgactaaacaagcattagagcagagttgggggaactttgtattgagcaaactgctggcatcaccagactgctagcagaatacatctgggggcatcaacagaggcccaggtagaacatcagaatatttttcaggagagcaatttaggcagagatatagcatatgaacaaccatttgccttacaagaagaatgagaagagttagaggtagaaagagtaattgtgacgtcaaagacggtctatggaggactcaaggaactggatgaacattggcccggctgaagctggatcttggctccccgccaccccccaccccagatgtcatatgtaatatctgggtatatgccccagctcggagggacctgggagaagctttccctgcacttgcccgctgagtttggtgcccctcttccgcacgtcgtcccatctatagtttactctgtaatagcaggaaagcctcaggaagattgcatcagtagttccaaagtctcagaactcatgcatgacaaaaaagtcaggattcaaatctaagtatgtcagacatcaatatatacttattccatcatggttagttgtctactgaatgaattaatggatcctcgatgcatagggaagagccaacaagttgaattcagcaaatagttaatgagtattttcaggataccaggccctggttcagcccagagggataaagagaagaattatacaagatttcagtgatcaaaaagtttatcatctattgaggaaaataggcatgagcagataaatacagaggcacatggtgagcaccatgttggggatatgaacataacaggcagtgggggcacaagagtagaaagtgcctgacattgagtgggaaggtagagacatcttcctggaggatgtaacacacctatcagatgctgagtgttccatctgaggaaaggggctgggatggatggatagtccaagcagaggggacagaaaacagaaatgttctgaaaagttcatcatcaaggggagaggcagat

SEQ ID NO: 48971 - DNA, 1201 bp, Bovine  19866880868090
ttcctctatcagattccatccctctgtgctcctacaaacccatggagctacctccaaaaaactctacaccatggttattgtctgctggcctgtctccatcagaagaaggggtgctctttaaagacatggctttgatacaactgttgtgtagatacatgtgcatcgggttcatttgttgtggctgcatttagtccacggcctaaaacaggaatgctttccaagagatgatttatgaatgaacacacttgggattcttttttcctctccccatgggttatctctcacgcagtacacacattcagcagcacactgctgtattagccagaagcacttggcccacatggagatttaagacatgaccaccaaaagaactgtaatataaccccaccctccaacttggttaagatcagaaagcatgataccaaagaatcagaagagacacactgggggcactacggcgtggaggccccgactctacagagttcactgtatggccctcgacaagctcattaacctctccaaacctcagcatcctcatcataaaagaagcaggatgacggcacataccaaagcactggtgatgtcacacaagacaatgaacgtaaatcatgtagcccagtgtttgcatacgggcatctcattaaatcaggagggtctctgcattgtgttcatccgtcctaaaataaagcaagatcagagaaccacaacttcggttgaagtttgtcctttcagtactgattctggcaaaggtaggacatttccactgcctggcacacgggagcttcctagctcttggtcgatcacgttagtgacagtcacacggtacacactgaagatctgcaaaggagtcagcaagtgaactgactgtctgtttatgattctcatggcaccggctacagacagaaacttggcctctttctccacagtggcctacatcccaaaataggaaatgccttcacagacagacccagcaggcagagggggttaggaggcaggctgccaacatttcaaactgtcagggacagggcagagcctggaggatgctccagcacaggtgagttgcccaggccccaggaagcttttcaggattgatttttatgcgaatgaaagagaatcagtgacctgtgaggagcagcccctgctgagtaatcagtcgggagggtctcagtgtgtgtacacttttcatgagtctaagagcaaa

SEQ ID NO: 48972 - DNA, 1202 bp, Bovine  19866880920292
taggaattaaaaaaaaaaaaaaaaagctggaaggatgaatgaataggatgtggtggattttagtgatgatcagaccactgctaccttccctcccagatttttgttttgccaggacccctgtccggagagggtggggagtgagaagtgagcatgcagttagagcagccttaccctgcccacgagcacagggtcgggtcccgtgtattcctctatcacgaagaactggttccagacccaacccctcttggagcgctgcagcacctggccctccttgcccttctcgtggtgcccatggaacgagggtcgcaggtggctcctccggtccgtggcgaaggcctggctgtggcacagcatgcccaggcacaccagggcggcttgtaaacagtagttctccttcatttttggttacgtggtaggcacaggagaatgcggctgtcaccccgtccgccgaccgtgcggctgcctggcggatggcggcctccccagacgcgtcacgcagacctcactcgggctggaaggtctctcctcgccgagcacatcacgtcagggctgcccacgtccccggtcggcctctgcagggagcaggaaaggtcagattagtcacaggttccatccccacttccattctattctgtaaacactgacccacgctggacgccgtgagggctttgcgctgggtactgaggaggcagatgccagtgagaaatagtctccaggctctagccagttcaccacgcagaataagataaaggtacaggaagaaacccctcaaagtctatatgaggataaaacgtgtgtgctgtggagtccagctgcccaagtctgagagtcagttttaccagttacttagctctgggtttagggtaagccaacactgagcccagtgtgctcatttatgaaatgggccggggaatcctactcagtaaaaggtacagatctgagtcatagccctaagtctcttagcccagacctcctatgtggtcagcacttcatatttatctgttattattatattaatgatcgtgggacttcccctggtggctcagatggtaaagcgtctgcctacaatgtgggagccccgggttcaaaccctgggttgggaagatcccctgcagaaggaaatggcaacccactctagtattcttgccggaaaatcccaggacggaggagcctgggggcgacagtccatggggtcgcagagt

SEQ ID NO: 48973 - DNA, 1219 bp, Bovine  19866880958376
gggtgaatgcactgtaattagatacgctctgtctgtcccagccttcatccgtgcttgttcttcctgagaatccatggccaggatgttgctctgaactccccactcctcccaccggtggagcctaatgacggctgagaagagatctctgtgtgtcttaaactaaatccagggcagggcttccactgctccagtttccgagtcaggtggtcatcgtggtggagaagacgctgcatccgaagacattttcttcagggaaaagtgaacatggagaagtaatcttaatttgtgaaatcatgccagcacagaggaccgtgtcaggaggatttctggcaaataaagaagttcatggaggaagtgagggtttttcttcaactggaacaaccaggggaaaggcaggaaaaggcagtgcttattcacaggatcctttgacaagtattcagtgccagaaggcaagagaataaggctctggccactgtttaccgtggcctgtggggctgtttatgccagctttctggattcggcacctcgcatggtctaaatgagtgaaaaaaaagaggaaagaagagagagacaccagagcctgacctgccatgagaaagggcatccgtagtctctcccacactctcttctcccccctcctctttcttcctttcttctctcttaaactcccatctcatttaacatcctgcgtactagcttctcgcctgagcaaaaaccttgaccatagaaactctgagaacaatgctttatctcaataagcatctcagaactctgcaacagtcagacgactaattaaaccaaataacagtgaaattttgcctccagttctaacaaacgtgcattattcacaagcacttagaatgtaaaagtgccttcctgtttaaagttaaataaactgtccgggcggtaagtgagctttggtttacaaaacactttgtcttactttcaactgagttacttaatactccctcccatgatccatttccattgattcctccttcatcaactgctcatgcattccaacatactcagagctgcaaagaactccactgctgattcaccagggaggcgactatattcagttttaaagaaaaaaagaaagatacaaataagaatccacttaagccagtaatttttttaaaatagagctttcctcttaattataatatagcatcagggggtttttttttttggctcatttcttcttctaaaattcata

SEQ ID NO: 48974 - DNA, 1470 bp, Bovine  19866880975320
tccttatgcaaacaattccagtcccaacactttgtcctaaagtaacccaatagggaagggagttggctcttgaactgtctcactccagtatatgtttcatatatagacatagctgtagtataagatgtagttttcattttcattattattctcgggaacttaagaagcactatataaatgaagtgtcactattagtattattatcttagagtggaaattgcaatttagcagttagaactgggcacactcgccttcgaagtaatgcattggcgattcttgtgttttattcatcaccgttcctccttgcaaacctcagagaatcttcagcttcagcaaatctccacggtgcgtttgggagcattagtcaggagactaatacagcctgagagaacatgtctttgaagtgagggatggagcctgccgaataatctcagctgccctcatcccagcaaccccctcctgccgtgcccgcatcgcaagcccgggagggacctggctttcacttagagagaggcataccttgtgtgcttttcttattggcgcttagcttctgtctcatttctcatgaatggagaaagatctccattcctgcctccattccgcaggcaagcctgcggccaattgccgacagatttttccctaataggctgtccctgtggttccctccttccaggcagaccagcctggtgaaaccctggcattctgataaatagctgtgtggccttgggcaagccacttaacctcagtttcctcatctgtaaagtggcctgttgggtactttccagctctaaaatggtctggctctcaaaccttcttccacaaatcacctggccgtggtgccttctgaccattgaatctcagcattctggaaaaggtgccctccatgtggacaaaaatgccagggtggaaatgcacagatgatttgtgtaagcagagtgcacacgcagggtggtgagtttgggactctgtgaagtatgttgcgtatcaaatttaggactttgaacttcattccccaggtcctaaggagcctttgccagtttagagtggtggtggtggggaggctgtgttcaatactttattaaatgatatctggaccaacattgagaagaactgatagtagcaaggggcagagactctaaacaggaagactggcaggaagctgggactaggcggcagcatttttattagtagaatcgcagatatgtactgagtctttactggctgcacacacagtgctcagcctttcctacaaattatctcaatccatcctccctacaaccttaatgagttggaagctataattatccccatttataaaacatggacaccaagactcagggtagtcgaacaactttccccagcgttatacatctggtaagggggcaactggggattcaaacaggaagattttgcattcttcactgctctgttatcacaggaccgatttaagaggcttccaggataggttca

SEQ ID NO: 48975 - DNA, 1270 bp, Bovine  19866881069763
tgcatgatgtactctgcatataagttaaataagcaaggtgacagcatacagtcttgacgtactcctttcccagtttgggttagggtacaaattgccaaattgattactgatttatacttctgtcatcaaaacaccagtgtgtttgtttctatgaattcttgccaggacaagcactataattttagttgtttttgcttgtttttatgttggtttcattgaaatacagtggtttaaacgctactttagtttagtatgtttgtttgtttacttgtcaatgatgctatatacatgatttttttggtttattgctggtcggtgaagttactcttttgtggtttgctcataatctttactcatttatctattagtactttactgatgatttgagttatctgtatgttaaagatgggatccctttacctgctgtatttcatggaaatattttccctctctctctttgcctttctagttcggttatctttgcgctagctgttccgactgcttgaaatgctcttacaccacatgtctgcgtgattagctatgcctccccttcacggctgtactcaaataacagcttctcactgagaacttctctggtcacaccatttaaaatttgaatagcttctcttccactcgacaattcttttccattttcactggcttatttttttcctccttaccactttttactatacagctatatataactttaattatagctataaatatttatatatagtattatgtgttactcatgtgtcatgcttactgcctgccctctcccattgctaaaatgaaatagtagtatacttttgctaaatattaatcaaacctgagtcttcttatagtctccatcccactctattaaaaagaaaaaaaaaaaaaagctgacaaaaggttttgtgccaagaatactggagcgggtagcctatcccttctccaggggatcttcccaatccaggaattgaactggggtcctctgcatttcaggcagattctttaccagctgaactaccagggaagcccattaaaagaaaaaaagttgccagaatgttttgtacctctagcctcaaggatatttgccctggagaaagcagacatagcctgaagtcaaatagcttttcaaactgttttatgaaagattaaacccaatgaggaaataataacagtgggaggggagacatttaagcttccacctctggtctcaacgaagacaaaaaggtgtgatactcatctgatgggactgacccacaaaacccagaggtacctg

SEQ ID NO: 48976 - DNA, 1739 bp, Bovine  19866881084824
tgcattcaagggaggcagacgtcttcctagccccacgatcccctcactacaaggctttcttctctacagctctcaccattcattccttcacttattcaataataacgtgtcgagtagttctatgtgccagtctttttgcagacataaacactagtattgaggaccaagttaaggtgggacagaaaggaacggggagggagggggaagaaggaaaggaggaagcaaatgtggatggtatggtagctgcagggtgagtgggggtcctgacatctcctgcctccctctcgtccccagcacacagacacccatggcttatccaaagcaaacaccgagttacaggggaggcgggagggcgagaagggagagagctcccaaaataagataggacgaaaagaaaggagaaatggcagcttacttggatctactagactgtctatttttagtggcctaaagacaatcccctccacgaccccgctggattacaatgcaaacagaattagcctcccgaccttctcttccaggtcagctcatcaccaggtcacttctgcagccacatcccctcaaaccccatagcctcctacaaggacgacttctaacacatttgaactgaacgtgagtggatggatttatttcagccattttctgcctttctaattgtttctcctgaagaagtttgaagaccaagttggctttcttaagtactcagctttcactgtttattgctttggttgttttggctgccagttaaaatgctacccattttcagaaatgaggaaaatgcttctggcaattaggaaggatgcttgcttctaatggcattttaacattctaaattattaaaaatagagaaaaggaccaaaaaattctgatattggccagttctcggcttctctgtgaatgtttcaagtgttccttttttcattaaggaaacagagcacttgagcttttaacaagctggctgatatggaataactgacttgaagtacaggaccttctaggtatggcaaatcttttctaatcctattctatttcacccagattctcaataataactatatctttctgctcacctaaagccaaaattgccttgttgtaataggacgattttaaagtaagacacagtacacaccctgcatgaaattgcagtccttccccaaactgaaattatgcgaattgtaaagcaatgtggaagaacatgttggaatttttcaacacggttcattatgaaacaaaatcttcactccaattacgatgatgtaaaaatattcttgagtactggaaaggaggagaaaaataaggacaatttatgagtcagagtggaggaaccgtgggtggtttttcccctctcttcttcctcacttcttatataatgtaaaaaaaaaagatattatctgtcttagacataaatttgcaattgtataaagtctcattaggcaactggcagcatctctcttgcacagaagataacatgaggtggccacacccaaagggaaccaggagcctgatactgaaatccctccatcaatttcccgtagaaccaaaaaaaaaaaaaaaaaaaaaattctgccgagagataccaaaagaaccagccaatttattccaaaatagaaacaggaaaatagtttatgatgctaaatgactgaatcatcaaagtgtccaattaaatattgatatcatcaatttggttctaaagtaccctttggtggggaggatgcaagaagggagttcaacaagtccaa

SEQ ID NO: 48977 - DNA, 983 bp, Bovine  19866881174266
tttcttggctagcttgctttttctaacatacgtgaagagggattataagtggggtgcatccaattgtctcaggaaaggatgatactattttctcttagggagggaactcaatgaagctttgtgtttcctgccagaagaaactccaacatatgggcaatatatcactgctacaaattttcttcaagcacagacatgcaaggggaagaagggatgaacattttttctggactaaatttaacattatggttcctgcaaaattgaccataagtaagacacatggaaagtactccaggatgtaaaattgagggagaatttgctgaggcatggctgtagatactgcttatgcaactggcatcttcttgaaaaattggataaagataaaagctacagaaaattgcagagtctgatgtttatgatggcaaggattgaatacattgccaacatcagagtcccactcctagaagattaaaaagatctaggaaagcatcatctctttgaaatcaccaatggctgagaaaatagtaaaaatgaaagacaatcaaagcaaattttagttcttacacttaaaaagtttcatacatgcatgtacacctacatgtaaacctcatgaatactgtgttattttttaagatcatatgttttcctgtttgtgtattatcccatgtaactctattccttagaaggagctagcaaggtcacaaagcatccccaggaaaatttgtttataatctcaagaaagagtttggcagtcacagtttttatttaggagagtaaatataaatatcccactaatatgtttgtcatttaaaaactagtttagaatgtcagtccaagtggatttcagtttaaagaattctgatgatcagaaaataggttgcttaaagaaattagcaattacaatgaaaagtaaacacacgctttcatataaaatttaaccctttataaaaagagaattcaaaaaaattataaagccaaagaattga

SEQ ID NO: 48978 - DNA, 1768 bp, Bovine  19866881184925
aatgaatggtactttagaattttacatcattaaaattattaatgacatacatgtttttcttgcttattggactacaagttcccttctgaataactctcaccatttctccatagatctatcacagtgctcagcgcctgaatctacacataaaacatgtctgcacacacgcacacacacacacacacacacacacacatacacacaataatggcccctgaatgactgaatccatgactgtaagctctttaagagcaagggggtcctgttgcagagtgcccagcacaaggtctgaatcttgatacctagcatccatttagccttgtaactacttcaccttattcctttgaggtgaaagcgggaattcagcctcggttcactccagcgtctttatgtggagttccctcaatccgcgtgccatgttgcatagctacagtgattatgtaattggttcaggaatgaccagtcacttagctaatgccggtgattcttagaataaaatatgctcacaccttaccaggggatgtgatggtaattctcttgtaactgctagggaagatcatcttcttgagtggattcaacaacagagaaccagagctgaaacacctaggaagagacatcctatcctgcttctatgatttgtgcccagttagatccaagcttgaacctagaagctctccctctaatgcttaatttacttgaaaacatagagttcttctctctgattaaaccagtttgagactagttttctgtcacttgccaccaatgagtcatgtattgagtaggtatcagttaatttcttgaagagattcttcaggcagtaaacaaagctgccattgatggcctgtggaagagctcttaacaaggagcctttgatattggagagaaggtctgaatattaattccagttctctagtgaggcagtgaatcttcatctgaccttcagtaaaagctaaacaaacaagactctatcaactcttcatgagttcttgtcaaaaatccttaaactcacaacactgctcagtaattgatgtgaagatattttgcagtgtagaactacttattgatgatatagttaaaatactgggggaggaacacaaggttagagggtcaggttacttaaatggcatatggtgatggttgatgaggacttatgtggacctatgacaatgaaatattgttttctccctggttttctgttttaagtcagttgggctctatgattcaaaaacttttaaatcttgtctatactattgtatttcagccacagtatccccatctgtataatgagactaataattattatatgtaaacatttatcctagttcaatgactctcaaacattttttggaccacagcccatggtaaaaaagtacatttgtcatctcaacccaagacacacccactcacacttatacctgaaacagaagtttcagaagacagtccttattcttacaatgcaagatatcttctcatatattttttttagcatggccatgatctactaaactagtttcatgcccatcatgaagggtttgatctgcagattgaaaagcattaccataaatcaacaggtggtgcaaaatgcgtttcaggtaaatgcccgttacatctaagtagagcttcggccctaaatccctggagagtctctcaccttaaagaacaagatagcaccacactgactttcagttcttttatagccccagacttgtacctggagtcggtggaagcagctttccatatcctctatccccggacacagctcgatttc

SEQ ID NO: 48979 - DNA, 1911 bp, Bovine  19866881185948
cataaaaccaaaacacacagtattcaaaaatgcatgatgttgtttagacatcattgaggggttatatctaatcctgggaaacatacacacaaaacaccaaatccaactgtgagattttattaaggaaataatggtccatcaataggatgggatgttatgtagtcattaaaaatgattatgtatattatataacagcatgtaagacatttatgatgtgctattaagttaacacatctgattactcaatgactgcaactgtgttaaatgttacacatccacatctatatatatgtggacagagaacataaagaaataatcaggcatgcatgagtgcatgctaagtcgcttcagttgtgtctgactctgtgaccccatggactgtagactaccagattcctttgtccaggggattctccaggcaagaatactggagagggtttccattcctcctccaggggatcttccaaacccaggattgaacccacgtctcctgtggcttctgcattgtaggcactctgtttttttttttaaccactgagccactggggaagccataatcaggcataaaagtggctttattaaaattgttattttaaaaatatttaaaatgccttctaatgctgctctctcactgctttacaaggagtttatttgtttgaaagcgaatacctcagagaccatgaagagatctctcagtgataactgggaatcccattcagtcaaagctgttgcagcatcggatttttctaagtccaccaagccacctacaggtctcatttttactttgcactggttcttcttcagctagtcacacagagatcatctcaatatgctgaaggcagctcctccgtttctctctctcttttataagcctgacacttactctgtctcacacagggtattcaagaaatatttattattttctaagctattcagtacaagaaagtgaaagtgttagtcactcaggtccaactctttgtgaccccataggctagagcccttcaggcttcttttctgtccatgaaattctccaggcaagaatactggagtgggtagcctttcccttctctagtggaacttcccaacctaggcattgaacccggggtctcctgcactgcaggcagattctttaccgtctaagccaccagggaagcccattcaatacatgagtaactcctaagtaactcttgaattctttacgtttatctcttctgccttcttccagtctttgtaatttctctcttgaattctagcaagattttttcaactggtcccactgtatccatctcaaaaccctcaagactgaactcactcaagtttcttaaatgtgtcctgttttcatcaagaccagtccttcaggcactagtgttctctgacccttctctccttatccacttgataaattcctactcacctatgaagacgtagctctagaactgctccctgtaagtggtcatccatgacccatattcatagacactatcacgcgttatcacagttgcttctcaaccaggaagtgattttgccgtacctcaccccagggaatattaggctttgtctggagctatattttatcatcacagctggtggggctgggtgtgtgctttctgacatcaagtaaggagagatcaggatgttgctaaacaccatacaatgcacagaactgccccctacatcaaagaagtctctgtcctgttaaaaatctcaagggtcagaaacaccctctctattttaattgtcttttttgcttaactgtcctgttaaattctgatctccctgtgaccagaactctgtttcttcaattttagatgtccagcctctcacaaagggcctgcctgacaaataataaaaactcaatcactcttggtagaaaaataagttgaatgaattaagaaacaagtgaaaaaaaaa

SEQ ID NO: 48980 - DNA, 1606 bp, Bovine  19866881196188
tataagacgaataagtattagggatataattaatactgctgaatgttatacatgaaagttgttcagtgagtaaatccttaagagttttcatcaaaaagaaatttttgctttttcttttatatctatatgagatgatgaatgttcactaaacttactgtggtaatgatttcatgatgtatgaaagtcagattttatactgtatatcttaagcttatacagtactgtatgtcaattatatctcagtaaaactggaagaaagagagggggtgataatacttgccttgagattactgattagttcttgtatgccttggcacagtttcctcagggaaagaaagatgtttagataaatctagattttggagcagccctcagcatgcatgaagtttcctcgttggatctgccaagctgagtctattaatatagattctccagaacttttcccatctcaaacatccaaggtctgttacattattaggccttctatgaaacgtgaaccaaaccctctgctcaattttctctcagaactgagcctgagaaacaaaaataatggatcttccctcatagtcagctaaattgttgctaaaaatgtgttcctgggattaattcactacaaagatgagcttattgtttattcttattttgtttttttaatttattcaattctaaatattggccagagacagcctgtgactcatactaacctttgtttggtatatgatgaaaatcatataaaatagatggtagtatccctgtgggcaatgataccttagtttaattaggaggaggctggggctcagacaggttaaataatttaatcctgttgtaatcacacagctagcaatttaaagacatggaattcaaaattaatgtattctaaaacatctttccacttaaggcattttggaaatagctggaccaaaaaggttttataaaagagagccagattggttttgctttcagtgtatattctagtaaaacgattaccaccccccccacaccgatttaccacttgagaaatcaatatctctccatcattaaagtataaggagtatcaaatctgaattggatgatggaattaccttggttttaatcaaacattcattttcaacttgattttgtagcctgaagattaagctccttggtatgatgggaaagattggacttgaacactgatgaaaaaattaatttcaagaaccaataaagagtttagctgctggagaggaggcaagggtgggatgggagggagattcctgggaggaatcttttagtaaagggagcagggagagatgtgttctcagaagcccacttttcacaacatatgaaagcaacgttgttgggtttgggagaaatatgaggggacccaaagacaaagaaagtaggagtgactctgtcgtgaaagagtttggaagttgggtaaactttggatatatggaaaaatcaacattagtgatgatgaatggtatagtttccgaagcctaatcaccagccacaaggggctgggataatcactccctctggtttctcctctggaaaagtagctgtgtgaattggcctgtagcataaagctgtcaacttgctttgttaattaatatgactatccctc

SEQ ID NO: 48981 - DNA, 1333 bp, Bovine  19866881196494
catacacatttgacgggaggtagaaattgttgttggttttttcctaaagaaaggtctaagactgagcccattttggattgccacctgaatactctgctaattcctggaatagagtgttttcaatggcctcatcttgaaaatggggttgtcaatgcaataggagtctcggtgtggattaactgctgatttgaatccttgtgaactaaacatttttgctctatgtagctttctaagaaaagaatactacaggagaagcaactgccattagctcagcctgccctgggagaatttaatgaagaaaagcaacctggggagaaaatagcactttttagatacaacccggatacatcattttcaccggcttccccatcctaacttgtctaagcaggatccctttttctcctgagcctggcaaggttttccaatccgccatcctttctttaagtggccgcctacaatttaacatatttattggcatcctcaagtgagccttcaacagaactgagccatttaagggtttgccctcatcttattataaattaggtttgaatatctctcagtatgcacaacattcctcagctacccaagttagaactccttattagactaggaagaatttgcgttttaattagttttacctctggtgtacgaagcccactgagattactacacttagtaaaatttaattaacttgacaaaagatcctaattgttttcgtgccactggtcctttgcagggctaaaattaatgccctccaaattaagcggccaccacaaagcttcattctgactgccctatattgaaaaaaaaattcaaattataattcacgggaagtttttgtttgtcagacaccaggatttgggtgcagaggcagagatttacagcccccctaggaagagctatctaggggcagggatgggaagagggcagcaggaatgagccccccccaccccccgaccacacacgcgcacacacactcactctctctctctctctctctctctctcaacttcattcttgtagaaagctttgtggaaatgagatgaggaacatattgatttgttcaactcctcaaagactgaagcagatataatatatcatgtgaattaataatgaaggcttataagtaaaaaatgctgaatgaataaatattcattcattcatttaggcctccaatatgcatttcccaagtgcctttggggtcaggtgctcacaatggaatatctgactgtaagaacctgggcctttgcagtgtcattctcaatgtgtagctttcctttttgtctgctcactccagctaatatcctatcgccttcaagaccagcaacatttt

SEQ ID NO: 48982 - DNA, 847 bp, Bovine  19866881265762
aataataaaggaattcatgaactgcaaaagggtgggttgatcctgttcctgttccaaaaatatatttaacctggttccccaagcaggttcattagctatatccaggaagctgcaaaaaaacaagtatttagtacatagagagaaaggattcaaaaaaattgctctcaaatgtagacgagcctgtagttatgaaaacatgtaggtcaacaagaggcttgctgctaagtgccttttaaaatcaagatacaagcactgggcctttgtctgggggcatgcctatcttcacatggggaattaagctggatttttcagtgaccttatatactgtggcagcttttgtaaatatcacaatggatggagatcactttgatgaggcttcggtaagtggactctattttggatgatcatttttctcccttagaaaaataattaggtgtcaacagtgagctgagtctatcaacattgtgtaaacgtaattaaactgaatgagggaggtggtaaacagaagagattctacagaaagttgacagcgtggagtggaaggcagttcaccttgggagctgagttcggcatttaagttctgggtttagcatgactgcttatggaacccagatcatgttactcaactgctctggaatttagcttctcgttttttaatagtaggaggttatgccagctagtgccttagagtttctgaaaaatggtgattatgatcttataagttgggggagtctctgaagtggaaaagaagtaaaatcactatgatgacgcagtggtagactgagctttatttttattaccaactaggctaggggccttctcaggaatataaaaatgtactaaggca

SEQ ID NO: 48983 - DNA, 1242 bp, Bovine  19866881302511
atctttgctctactgcactctaagttctgtgaatattaatggaaatttctttgttggatggttggctgcttaaattcatctgccattctgcggttggagttattcaggcaattaatgttgagcatgtactcactctaataggggccaggtgtagggcatggatatgcaggcagcattatgtgtctaaaggtcagactcatgaaacccagcacaggaaagatggcaaggcaccaccaaggtcggtcattttgaatacattttaggtgcaaatgatatagaggcagctgactttttatacttatttgataatctctgataagtcccaggtctaaaaccacttgcctatggggttttacccattgcttttatgctttcaatgcattccaggaggttcttgcagattccacctctgggtcaacagtgggatgtaaggtgttgccaggaatacctctgaagcagaacataatcatgaagatctggagagaagctcaattataccattcaatcactgcacagccacaggccaatttctcaacctttgtgggcctcctcctcctcactgtaagatgagaagaatgatggtaactaccttgaggggatgtttgaggtttaaatgacttcttagaagtaacgttcttggaaaaatgccttggaagagcagaaacactgagttaccaccagtcattattttcagagagagagagttggacaagctcaaccacttcaaaacaatgttgagatcagaaagattaaaaatatttacttatgaagtccaactatccaaattagtttgcctggtgccaaagtacattttgagacaaagaagataaccatggatgtcaggctggtttgaatccagggtaagcggttaactagttgatttttctgggggtggggggtgggggggaatggaacttctctgaacttctttgaacttattttctcacctaatatgagagtaataatagcctgtgtcacaagacttcaataagaatttaaaaagtaaaatacattgtgctgagtaaaaagcaatttaaataaatgactcagatccaccttttcagccactttcactttttgaggtgcaaaatgttttttcacatatttaactaattcctagaaacttcttgtcttttatccagctgtactttgacacagaaggtcagttttctgcagtgcctcctcttgctttgtgtccagcgcagcctactcactcttttatgccgtagtttgcttttatag

SEQ ID NO: 48984 - DNA, 2269 bp, Bovine  19866881340823
ttatttgtctctgagctagaaaagtggtgtggagcctgaaaagtgtctagaaattaaagccaggtaaatacgtttcataaattagttacaatagttgttactacctcttggggattgtgtaggtaacaatcagcaaatggctgatgttctaagacagaaatcaaacatacctctctgaagggatcatggtgtcctgaagctccctgaacgccgcgacttgacagtaacggttgatgtgctcagtcgcttcagtcatggcccacactgcgaccccatggaccgcagcccaccaggctcctctgtccatggattttcccaggcaagaatactgaagtgggttgccatgccctcctccaggggatcttcctaacccagggatggaacccgagtctctggcgagtttcctgccttgcaggcgaactctttacctctgagtcagtggggaagccccagtaatgattgataacttatccagagtcagaacaagtccatccagaaggtgggaggaagtggtctgccgtggacatctagtaaaggatagtcacagaaacacatgctggcaacgtgtagaagtgtctgtgtaaagatgtccaggaggtgagtctcaatgaagtgaggaggaatcttaatcagagattgctttgcttgaaataggggaggggggtagaacagcaattctagaattcagtgaccttcttcagatacattcagataacatctttcaaggaaataacaatgtccctaaatccctaaattattttttcccccttaagtccaacctgtatatttcaaagcagctactttgaaactaaaatatctaattatgaataaaagtctacagctcacctcttgaagaactgccctgactgggttgttctagcagcaagaacaaattcttttcatcaataatcctgtctaaaagccaacattttatgctgaggagggcaggagcagtttgaatcccacgagaaacttttttgactttaatttttaattaaatcgtttcttgcctgcaataaaatagtttagggaaaggtcatccacaaaaaaaaaaaaaaaacatgattttaaaaggagctgagagaatgagaataggagatgcttaaaatcttctctaatttcccacaatacttttagagagtgattcaatgtttaattaaaggcaatcagcatttattaaatgcatacatgttgaaaattctgagctgggggtttaatttgctaccatctcaaaatacccacaaggtctgatcctagctttatgttgattttttttcaagtgaggaaactaaatgtgggtggcatgaagtaatgtacccctggttgtagatctgaaaatgggaacatctaagactaaaacctcaggtttagtaattcaatattatctttctcagccataatctttctcagtgaaggaaaacacaaaagaaacttgaaaaaacacaacgcaaacacttagtaatatgtgcagccagaatctgatagaaattcaaattttctgaacattttcctctgaaatataacaatcagtcctgccacttttcttaaattggaaactgtaatgcactgggttaacagtattcttcttttactgatacttgatacatctttttctcagtaaatgtattgtgtttgagcatatatgcatatgtgggtgtataatgtttgcttctaaaacaagaggacttctggtattattctcctcagatgcccgttcaaattagccataggggaaaaattataaagtgatgaaatcacgcattcatgcatacattcttttattgtcaacagtactgtgatcagttaacaaggtaacactggtaaaaaaaaaatcattttgattttaagtagaattacatctcactattcttcagaaatgcagagaaacttcacattactatggatggcatttttagatttttaagaacatagcagccaatcattcatttctcacccccgccccccgccccgcctctgggggagaactttgttgcacactagaaacttataaatcaaattccaaagaaattaaaatacttatggaacatagggaaaagaactacataattaagtggttgtagtggtttggagcacttagtaacctgataaacacttaatatattaataagatcgtcattgtctctactccaatggggtgctctgtgtgaattgctcttataagccaatcaaaatcacacttatccttaggaaataaaaaatagtagcaatgcctgagacgccctatagtgtattcatatttttaagagtt

SEQ ID NO: 48985 - DNA, 1188 bp, Bovine  19866881345951
ctgataatgaagggaggcaagtggagacatctggggctgtgtgcctgtgtacaaaacatagcctggcaagaacaagagaaactttttgatgaagaggtgccttttaaaaatcgactgcagatattatacattaaaaaaaaaggatgcctgtccattcaagagtaccgagaatattcagtaaagtagaaagaaaagttgagaacaatccatacagaatccagctgggaacattttagagcttttcctttcccccactctacttatttgcttctagcctgtttcagatgcaagttttgcatgatcatgatcatatcccatgcacatttctgcaccttacatctttctcctaaagtatttcacatgtattttttgttaccaatttttcattagcactattttaatggctgcataacagtccatcatatagatgggttatcatttaatactttcttttattatctatttaggttttttattatatcaacaggatgggaaactatggtgtgataaatatatttctgcaaatatatttaggcatgtttattttcccctatgtcttaggttatttcatttggatggatttctgaaagtggaattgctggctcataataaccctctgtgaacatttttaagactcccaatccattaacgccaaattgctttgcgagacttccaaatcaatttacatttccatgcagtgtatgggagttcttagaaagataaatattacgacacagagaaagtatgccagagtctctaggtaagaattgatggaaagagctgttgggtatcaggcttgtagtgtcaggtgaaaggaaacatcaccatatcagtgatatacaaatagagaatattcctggcatctacctgaataataagtgggtgcttgttcttggataatcacctttattctagagccaactcttatgctactacctccatgacatcccctcacatactccagttaaaacaggctactcttctccttgaagatattcagaacctttcctctgacctctcttcttaaaattagtcctaaccaccgtgctcactcaagctcagtttcatcacagatactcacacaatgtttgctgaatttaatctctatctccaaagtccatgatgatatgaaaagaatggaatcaagaagaaagatgagctgcatattactggggagagacaggatga

SEQ ID NO: 48986 - DNA, 2565 bp, Bovine  19866880550325
cacagatgctacaagtggcggggcgacgacaaaccgaaacctgccaataagcaaggtcaacagggggtcaaactgcaaacaactgccttaaaattttttttatgctaacagtgttacttattccaaaagcaaagggtaggggtacctggatttctgttttcacagccagaagcacaatttctgtgtccctcaccctgcaggctaccagggctgcctgcttgccacctcactgagaaggcagaggggcaccatttcagggcccacatccatgaacagctaggatgccaacatggctccctggccagcctccgtcaggccctgaatgccacttctgctctctgacatttctcctgaacactaggcaaagacctagcatcttcaacatgcaaagcgagaaaacagagcagcccagaaagcacagacccagccgtgtgaccgaatcaccaaggactcccacccagaagcgggaaggaagcctggtctctccctctgcaagagaggcgaacatgctctgcctcacccagtgatgctcaagcagaacagaagctgagccagtcaggagactggaagcccagtttcagaaagggactgaatatgagataaaagagagtagattctccaggacagccaatcccctgctgctgtgggcagccaggcccttcgcttcagccctgccctgaggaggaagcaggtaatccaacctctgcgcctgccttgcccccgaggccagccctgcccacatgcacagagtcaaaccccagagcagcagagggtctcgggaccccaggccagaagcccctctgtaacagtaactccaggcggactgaggggctgctgccaggtgccagcagcaggaaggtaggggccatgagctctggctgagcccggtgcccagcatgggggttactactcacagccatggtaggaagccggcgaccccccggccttgccgtactcctgctccgagtagctggtggacaggttgggctggctggagccccggccaaaggtgatctggttgctgcccatgccggtggccacctgggccatgcgctccttggtcttgagggcctgggcccgctcggccttaagccgctcctcgtccttcagcagggccaccaactgcttggccttctcacgtacgttgaccccctggtccttgccgtcacggtcaacgtactggaagtccttcagggtctggatagcaaagatgttctcgcggcactgctgggccacgcgctcggagcccgtcttgatgaggtagtcaagcagcgtcagcgccttgtacacgtgccgccagttcttgccgtggtcgttgagccgcttccacaccatgctcatgatctccgagaaggccaccacgttgtaggtcaggtctgcaatctccgtcatcagggagctggacgggccccatgggtcattggaggtggcttcccgcacttttatctcagcttccgagtagttgttgacaatgtttttcatctgccgtctgatggatgaggtcgtcatctttacgttctgtgacaagtgcagatcctttcagagagagaagcttccccgtctccggcaggttcgtgctccacagaggttcagtctccgtaacaggtctggagcagggtccctgacggtcatttcctctattggagcctcaggtctgagaagctggaagccatgacctagagaaagaagtaacaaacgttactgtgtgtgagttcccgagacagcaggctctctgcaaatggcaggcaggggtcggccagccggggtggtgagaggacatcctccagcccccgaggacaaaaaggatgccatcttcccttcaaaactaagttaagaacaatactacacattaataaccaatacagtttaaactcaagtttaagcctctggaaggaaagcggtaacactgtaactcctggtctattttcaaaccacttctgctggatctgctctgccacacctggcagacgcccgctagaagaatctcacaccatctacactggcttcagagactctctctgaccctcttctcctgacttcttacagagactcccaaccccttcgagaccagggctgaggccccactgggctttcagagcctccagcatctggcacaagctatgtagcactgatacaaccttacatataaactgcttctggcccagtttcctcatctcagagaaaagagaactgaggactccacagtaacaggtccacccagtcctttgccacaaacacctctctccagggaaggaacacctgcggagctggagtgaaggctacgcctctggccacaggcctggtccagagtgtggaggactccacctggtttggttgccagtgggcacccagcactgcgatataaatgctgctgccacaagttaaaagcagcgccccttcccccaggaaggcatctggcaggggacagaggtgagtgcagggacctgaggatgcaagtggagggcaactcgactgtggcggtgggccaccgaaagaggcgaggaaagcactcccttcagagccctcaggggggttcttcagaggaggtgacagggcgggcggaga

SEQ ID NO: 48987 - DNA, 2870 bp, Bovine  19866880848473
gaagtgagacggaaaggggcagggcctaacctttaaaagaatgacatagctgctgaggatacaacataaactggctagaactgattaggcctaaggtggcagatgattcttcaactttcaatagaacttgatcctcattatatgctcactgtaatatattagcatatgctaaatgacacatggactgcaaggagatccaactggtccatcctaaaggagatcagtcctgggtgttcactggaaggactgatgttgaagctgaaactccaatactttggccacctgatgcgaagagctgactcattggaaaagaccctgatgctgggagggactgggggcaggaggagaagggaacgacagaggatgaaatggacatgggtttgggtggactccaggagttggtgatggacagggaggcctggcgtgctgtggttcatgggatcacagagttggacacgactgagcgactgaactgaactgaaatgacacacccacaggtgccatgacagttccaaggctgaccataaaaggccaaaacatgggcagtgacccaattcctggaaatccttgcccctttcccaaaatagttgaaataatcctccctcttattagcccaagaagttacccagcccatcaaaaccaaccaccccatactttaggaccactctaaccttcagagatggaccacattctatctatggaatatgtatctctcagtaaacctgctttcactttactgtggctcactcttgaattcttttctgtgcaaagccgaggactctccctttgaggccctgttccaggaacttgcctgagatctgggacttgaccatcctctcacactccattttcctgcaacatctttacaaaggaggaagaaggtggtcttctctccctcccaactcttcctttgattatgaaaatgtagcccacgtagttctcagggtagagccctctgcctgcccactggtatccttcacaagcattaataaacctacttcttacctttcagtttgcctcttgcttgaattccttctgcactgacacataaagaacctaagtttccttaagtcctgagatgagttgtgtggtttcagttggaagattgtgggtctgagtcccacctgatgtcctatttcacaaggacttactaataaagtgacatttgaataataaattgaaggaagtgaaggagtaaaactttggggatttttacgagaaggaagttccaggcagaggggacaataaatgaaagaccccaagttggaggcatacttcacatgttaaaagaactacaggggtgacgcgtgagtggagtgagtacatgagagagagagtatctacagtgaagtcaaaagggtaatggccaggtgtgtgtatttgtgtgtgtgtgtgtgtgtgtttgtggtgtgtgtcctggggggaaggcatgtaggattttgccaaaaacttggcttctactctgtgcaggataagcatccactggatgattatgagcaggggaataacaacaccaaacaagtctcatcggtttcattctggctgctatctcaggaacagactgaaaggtcaacaaatgcagatggtaaggttgctgcaaaaatccacaggaaagctgatgacagcctgcatcagggaagcagcaaggtgggtgatgctaagaggctggattcctgaacatctttcgaagatagaatgaatagaaatgggacatggatatgggacatgggagaaacagagtaatcaaagatgagtccaggtttgggggctgagcaactataacaacagagttgctatcaacgaaaagtggaaaaactgaaggacaaccaagcttggatgggaacgggtgatcagggttcagtttgaacaaattaagcttgagttttcctttaaatcaaattgaagatggcagatctatgaattggaagtttagagggtaagtacaggttgaaggcactagtggtaaagaatccacctgccaatgcaggagatacaagagacatgtgtcaggatccctgggtcaggaagataccctggaggagggcatggcaacccactccagtattcttgcctggaaaattccatggacagagaggcctggtgggctacagtccatgggggttgcaaagagtcagacacatctgagtgtctgagcacagctccacagaggttaaagttataaagttgggattaacagcaaagagtatttaacaccatggaattggatgagaccaccaaggcacaaaataagctgcaaggactagaccctgaggacctgcccactgaaagctcagggacgaaagggggaataagcaaaacaaactaagagggagtcacagagaggtcacagaagaaccgagagaacatggttgccacggagcaagagacaaaaagacggagggggtgattaatcaatttgcagatgagtcaagaaggattaggactgagggtagatcaatgatttagcaaaatgtcatctttggccaccttgttatatagtttggggagacctgaatcaataacaaccactctggagtaagtcaagtaagaatggaatacagaagttagtgatgatgagtatagacaattctttagaggtgtgagaggaagaacaaaaatggaacatgagcaagaggcagaatggggtcaagagagtttgggttttcattttgtttgaactaggagaaataatagtgcattgatagccacttaagtgtgagtcaatgggaaatttttatgctggacagagagaggaataattgctagagcaacacccttcagtagataagcaaggatgacccctagtacacaagtggtgggactgctctcgagtaagtgaactcggtctctgcagaagaccaagcatgtga

SEQ ID NO: 48988 - DNA, 1517 bp, Bovine  19866881202932
tatcagagtttctagtgacacatttagtagaatatgtgctatgcagcaacagatccctcatggttaggatctctgaatgtatatctggaaggacaagggttctttattctgccttcataaaaatggactgcaagagctgtcctttatatttgctcttaatggggccattaagtatactgtgtattgtgaattcatgtaatgctactggatgtattataaagccatggtatttatatctttccctgaagcacaggatttctttttacttactccggatatctgtaaaatccatctatttattctttttatctctctctgttttttttctctctctttttacttttttccccctttccttccttttgctctttttctttcttccttcttcccatcactaatttaggtaatagtagccaaaaaaagtaaatttgatgtaatatacattttttcactttgaaaaacatatgctttctaaaagaaccaaattcaagaactcagctcccggatcttctgactataaagaaattttaaattagtgttattcttgataatgccttaaattgattgaactattaccttgactgcatccttttaatcaactgaccccacattatgaccttatttgaaataagaaagcagtgaagttgggtcacaaaagacttcattgactgaagtgagcctcttttcaacagtgagcttattttgatctgctttcatataggtttgcctcagtgaaatgagggcacacacaagaacatgccagaagtacatagataagtacgggccactgcaagagcttggagagacgacaacgaggtttgcttctatacactttggtttaatgctaaatttgacatgcttgtaaagaatttaacgggctggaaagcgtaacacttttattatgaaaatatgtatatggttgttttggctcctaatcataatacctcttattagtaatcatttgttttcaatgactaatagcagtaattgcaaaagaatttttgctctgtctgctttaaaaactttggggagaaccaactggacactggagagattggggaagcttcctcagacaagtttatatggaggaagatccagaaatagaaagcagaactgttcagtttctgctaggctctgtgttgtgactaagagtcctgaagcagatgatggttatgagattattgtctttagttttccatcaccactactcagtctccaagctcgttccctctcattttcctgcttactctttagaagggacaaagtgacatctcagtatatattctaacatgaaagaacacgcgtggggcaggcattctgaatcctacaacctgtttgctgggtaatcttatatggggctggaggaaggatggagacagcgagtaggtgtaatggaggatattgatattttttcttaaaaaaaaaaaagaaggaaacaaatctaggtcattaaaactccaggagatagtggaggatgggggagcctggcgtgctgcagttcagagggttacaaagag

SEQ ID NO: 48989 - DNA, 1389 bp, Bovine  19866880501676
atttaatcctttaataataatcagaacttttaagccctgttttcaggagctcacactctgcgaagcaagagcggacagggagagattcattgatgccgaattccagaggcaagataaagagggggtgggagccagaggcatttccttcagcagcttgctttttttctcactccctcgttgagttcgagtcaccggccgtgctgagagctggtgtggtgcccgggggtccctggccctctcggtggaagagggtctgtcttagaggcaggctccccccagggggtgggcctaggtgtgccccccacccctaccccatcctcctggaggacgcagcagtgtgctcctgaactttcaggtggtgagacagaaaggcaaccggggagagcccgacatggaatctgacgtggctccttttgcccacgttgcttcaggacttatttatattggagttatttataggttccgaatacatatcatcaaagacactgtggctgtcatcatttttatgggagcctgaacgtcacacataatactattttcataagaaaaaaatccccaagcaaatgcagttaaaaaccaggctacggaatataaagaagcaaatgaaaatgttatcatctgtaatttcttttaaaaagtttttctgatgctctggactccctctgagttgggggtgataccatggacggaaacgtgactctctttgctcaggcaaaggctaatttttcagcaatggcaaaaatgaggaaaactccgcattttcttcttgtgaagccaatggaaatgtaaatgggctttgtgcctctgtgtggcaatcctcaccaggctttatcacccctctcccaccctcgcccccagaatcccattaggtcctgaggccccgtgcatgcccagggctgcaggggaagaggggaccatggggtagctttcctccccttcctcatcttgcaaagagagttgctagctttaaaatggatcttatgtcctttagaagctagtgtgtgtgtgatggggaggcaaagatgggatcctaagagcaaattcaagctcctccactgctgtttcttagcaacctggtcgtcttggagagctctgacttcggtgggaggcacctgcccactcccccccaaccatccttttgcctagacttctgtccctcgcggggaccttcctcaccttgactccggtggtacccagccttccgagccaccaggccgcgcaggggtgctggcctgcgggaggcagcggctccatctggcggctgcacaccctggggactccccgacttgcctccagcgtggagtgtttacagatctttatcacttgtagctattgtggcagaaccatcaattagctctggacttgcaaaataacacctgggaaaaggtt

SEQ ID NO: 48990 - DNA, 1956 bp, Bovine  19866880505218
tcctcatcctcccagaggggtcagcggtttcatgcatcgctgctcctgatgttaccaggttgggaactttgagacaaacaggttaaactggcctcttaatggatggcttccttaatgctttccaacttcaacgcctgtgaggatctccacaggacgtaggacacagcagaccccgatccatcagggacacagagccctttgtcccaggaaagcccaggggatggaaaaccttcacctttccaaggacttcgtcctaccccagcccacctcactcaccgcaaacccccatctgatccgacctccaggcaccacgaccccatctgatccgacctccaaggcaccacgaccctgtttacagcttgcggccggcatcagcctgggtgacgctctctgctctttaaacctcggcttgagcagacgtggagggtcagtgcggtccaggtgggaaagcgcagtgtcagccctgggacgggggccagtggagggcctggcccagcagggctcccacgtgccctgccaccctgcagtttcccgggcgctcccagcccgccccaagctgcccgcactggccggcacccttcccgagtgggatggccgccatgtagtgacctcctgccagctggactgcaatttggcccgacgtcgcacccccccccttgtttcagtttccattcatcccccggctggacaccagccagaccctctgagagaccagacgggaagggtgggccgctcagactgcatgctggggacagagagccagcctccgagcctcctcttctcagctgcgtggcccagcgggtccctgcagtctttgcagagactggacctcacacacgtgcagtggccccgacaagcgtgcccttccctggccctggggcgcagtgctgccagccttgtgtccctgagggtctcagggccagcagcacacagggccaccccttccgagggacccagctcctgcacacccgcatctgggcctaaagtgttgctccctgtgctgatctgacgggtagctcagcgcccctcagggtcgcgcctgctgtccaggggcctgactttagacctggccgtccattcgaaacttacacccgtgaggcagggcatcctgggtgtcctccacgtcctgtaacctgctgccccacccagcagattgtttaccgtccggtgggggctctgcatctgcgccccacaggagggagtgctcactgctccttgtctgtatggctgcattatacgctgtgaacctactctcggcagtcagttagaaaaggataaatcgacagagacctctgctttgaaatctcactttactttggataaagctaaaacttcctaaaacccaacagcgtgccatgtggagtccaagttaagacagaaaatctctgcgtcttcccatttccaaaagccttgctatcgttgaccttgagggctgacagtctggaggcagagccatgtccccgccggctcaccccgcgagcgggcgaggccaccttccccacagagacgcgagagcacagggaacccgtcccggccagtgctcgccaaggggacagcaggctgcccaggcgcctcccgggagagtgaactggctggagacgtggctccgagcacccgcagcgcccaggccgcctcctcccgggcgccggccgttcccagggccagtgagtcttgattaatggctggctgcgagaggcccccccgccgcctgtgcccgcctcctggggcctccggagcctctgtgccccgttgcctccttccctgcccgggagcttcccggctcaggtcagagcaaaagcaggcttggccgtgccgggcagagtgagggctgaccgctgggagaaccatcaaccgcgccgtgagacgatcaactgagcagtaaattaattaatcatcattttatgcctcatcaagcactttgctgaagctctcagcaggggcctcttgaggagccaa

SEQ ID NO: 48991 - DNA, 1678 bp, Bovine  19866880571074
ctgtaggctcccctgtcctggggttctccaggcaagaatcctggcgtgggcacacaggctccaccacactattctgcacccatgcgtgtattcacgtgtacaaaatcgcccagtgtgggctgtgccaagcatgtagatcaaggcgggagcagctcccacccagggcacaggcggcacttgacaccgggtctgttaacagttaccacctctgagtggcagaagtatgggcgctacccaccattttagaaatatgcgccttgattttcttaatctgttgggttgagcacacactacttttataatcagaaaagtacaaattcaatttctctttttaaaaaaataagggaaccaaacacacgagataaaactatgatttcttctgcagtttgtactgggcctgtgaaattctagtcggatggcatcaccgatttgatggacatgagtttgagcaagctccaggagttggtgatgggcagggaggcctggtgtgctgcaggccatggggttgcaaagagtcagacacaactgagcgactgaactgaactgtaaaattctgaactatattcatacagggcaagcatcatgaaactcacaagaattattatgattttttaaaagcacctgtgctctcacttttaaaaaatacagtgggtctgtgtgtttacatgtgaatttccgggggtgaccaaactttgtattttacttaacatcaaagatgatgcagctcatttggaagagtgggtcagtgccaatgctttcatttccccctttgcagaatgttgacccctgctactgtgacagaaagacaaccagctaaactaatagcccctttctctgctcatcaagcctctcattaacaattaattggactagaagttcataggccattattgctgtgtcaatgagatgcccatgaggccgggaggctgaaacggaatgacccactcgggtgataaataatttccagcggagactcgccttacctcacagaggtcatggtcctggccgcagaaggcgccaccggctgccccttggacaggagcagacgagtctctcttatcagacaagctaatttaagctccgaaacctaaaacgtgtgaaacaccatctcggggcaaacaagagatgcggtcgttgtgtctagagactgacacgtgctcccgagtgtctcacgacaaaaaaggagtccagggtctggctgggttcaggccacccctggtggtgagcgggtatttcgggctccccaagcctccctgcgtgtcacccccaaggacacgggaccctctgacagcgtgactgaaatggattgggacgccttcctagtttaactcgtttattcacgtcacttctgcaggaaggaagcaaatctcacttaggactggagtctgagacgtccgagcgtctcagacactgtcatttcacaccaagctcgttacagactctaatgggccgtgctgctctcagccacccgggaggtgtcccagctataaactaagacagaaccaacaacatgtcaagttaactgaagcaggggaagatctgactaccaaaaagtactgaaaaagaacatgaaatgcaggtgatggttggtgctgggcactgtgcctgtcttctttttcagaagcttcccagaaagtgggaagtaggttctttcaactttattacattctccagcaga

SEQ ID NO: 48992 - DNA, 2183 bp, Bovine  19866880579909
tatatgctaagttgtgtctgaatctttgtgacccagagactgtagcccaccaggctcagactctatctgtggcatttcccagacaagaatactggagtgtgtatatacataaacatatatctgtatgtatatatatattcttatatgtgtatatgtgtgtgtgttagtagctcagttgtataggactctttctgaccccatggactgtagctcgccaggctcttctgtccatggaattctccaggcaagaacactggagtgggttgccattcccttctccaatattatatatattgatgatggacagggagtcctggcatgctgctgtctatggggtcgcaaagagtcggacatgactgaccgactgaactgaactgatgcttttatttcagaaatcctttctcgttcctcctgctcctttcgtggacttacctgtccaggtgtagtgactgttgctggcaggggttcccttctggaaatggattctccatggcagttaatacccctgtggccacctctggcttcaaaagcaagttgctggggctaaatcttcgtcccaccctctgtttcaaactgagctcctgagtcaggccctacacagagcctcaagctgctgcggctgcagaccccatcaaagctgaaattccacatctgaaaaggaatattccctctcagatgttgaataaaatgctcgctgtatatttgggtgcttagattaaaagatttattatgccaaggagagaaatgaagttttggttaaacagatccaaaggctatgaagacggcgaagctttcaagaaataaattgcaattttactgtgaaggcaaatgttcttttcagtcttgatttacactgaacacaaaatgcgagtcaaatggaaatagaatagaggagcgtctcagagaggaacccacagacaaggacacacagtcgcatacatgattaaagcctcctctgtcaaaaaggttgcactggctcttctgaaaaagagtgaagcgtcacatcttctgactcattgtcataactcataatgtgggtaattgttttcaagttttaactgtcagctttgtaagtctcatctgcattgcaaatgagaaatattaattaagtagtgaacatgtttcaaagtgacgctcctccgtgtcttaggggttacaggttcaaagctgcgtttggagacctgttctgaacctgaaaacagacactttgggattaacgcatatttacaacaaattttattttctctttaattcagaaaaatatattttagaataaacttaaactcaggacagatttgtattctcatgtattgttagttggaggctagtaaaaatcttcaagtaagtgaatagagaagctaaattttaaatatttaattttggttttgtatctcctctatttgagaacagcctagcttattagctaaaaaggagaggattttactgatggaagccttgaacttaagctgcaatttaacataaaatgtgatatttcaggttgattaaaatcagaataccaaaacgttcagaacgtggagcagttctcaacaatcaggtgcattcaagagtttcattttcagacagttctggggacctaggttatattgaagtgaaataaattcatgtatatgaaaacttagagatgtgaataagcaacagcctgtgggcttcccagggaatccacgagccccttctgagaaatagaagtaagcgactggagggcagccgcatttccttctgactgcatcctcgtgatgggcatccctcagggggctgggggccggctgtaactgctcgggcagcggggcaggcggggctccgtgagcagccgcgtggggagcagccactgcctctcagtgaggggctgctttgctgggagtggagatctcaggcacttgagtggatcttcttggatgtgggagggagattcaggaaacatcccaggggaaatatgcaccagtgaggcagtggctgctctgccctgttctcagggctgggactccggctctctgactattagacatcaagcctgggtcaaggagtttgcagtcccaggcaagcggccatcaggacccaagtctccagcgtgcccttcctctggctaatggtcaacaaagatggtgaggctgcatgtggagcctctgaggagcagtgttcgaccccagacaccagagcttcctgcc

SEQ ID NO: 48993 - DNA, 1330 bp, Bovine  19866880638205
tcgcagaagtggtagcagtctgtctgttttggtcatcggcttgtttgtgtgcatatttgtgtttgagtgggagcgttaccttgagaagctatgagggaatggaaggcaagggtcgttttattcatcaccttccacgaaggaggaggccaccaaaagtttgttaaaaacacaaaggaaggacgcttcagagacacctgcacacaaagcccccgacacaggtgctgggcgggaaagagcatggcgctcactcaggtgccgggtgcccttcctgggcttctgtgcagcagacgggccgctggcgcagtgtccacgggggcctgtctgtctgccgaccacggggatgtcattagcacatgcacagcactcccctggcccggctactcctgaggacaccgctataatgagcctccctgtgtgattttgcaagggctattctttgagaagcttcgagctcattaccagcattatctcgcaaactctccaaccacccaaagaagtgttttcatatatttattccttttttccggagtcccggccccagagcagggctttgcggaagagaggtcatctttgcaacgagtggataattatactcccagttaatttaatacaaatgacccacatgagtgatctatgcccaaaacatggtttttctaggtgttatattttgatctgaattttcaagatttcacaatccccactgaaattttaaaatttgtagatagcacatcaatcattcctttccgaatggtactgctttgctgcttgttaagcagtgtaaatgccagtattctttacattgagttaattctggagtattttactgaagacattcgtcccggttgcgtcatctcctccgtctttcgtctctgcccccgcatcttctttttctccggcaccatcttgcccagctctgcacggtcacgctcatgttccttccatcaagctggtccttcagtctgaattgttctcccaccctgtgtcagccacagagacagcaagagtcctactcagcaaggatcccggtcggcaggcaggaaggaggctacgactgcaagtccatgtccacagtctatgtgatctcacagccacagctaacagataagagcccctcatgtgtcaggaaactttgtaagctcctcacggagactcactgaaccccacgccacataattaggtaggtgctcttaccatccatgccttctggaggaaaaggtgcgagtggctagttcccccagggagaatacctcgaagctgatgcacaggtgcgaagcactaagtgagccaagggatgacgtaaggacctttgccgactccaggaatcagcagg

SEQ ID NO: 48994 - DNA, 1399 bp, Bovine  19866880656299
tgatcactgaggaaggcctatgtataacgtgcacaccaatgcatagatgtatatatgaatacatgtgtgcatatacactcgtgtatatataaacatacacacgcacagttttctcctgtgctgttccacatcctacacaagaccttgattttgcaaactgttggatttattctgggggccacggtcaccatggcccaggaggggctgttctgagtctgtggcctcgtgcagtgtagcagggccactgcagctgtgtggagcacggacccccaggcaggccgagctgggctcgttttgtgccctgggatggggctcattagagttcttccaaaccgctttttttttaaccatctcccaggaaccagccacccaccacctgtcaaatcagccatcagaggggcaagggcgccggcttgtctgaagacactgggtcatgagggcggattccttcaatcccgtgttctgttgtccccggatccgcctctccccctggaaacggctcaggtacagtgtctgcaaaggaaacacccagaaaactcaatgcagtcatggttttacagtcatcattctatttacacgtgaagcagtgtgaacacacacacatgcccgtgccgtccacgtaggtatgctctggggattctgagctttgcttctgtttagctcacgtttatgctctccacttcgggagcgtctactggacatcagagcctggccagcctgcagctgcgagtgtggggtctggaagtcagaggggacaatgatgctgcgtggcgggacccgaagcctgaggaccatgtcatctgtgcacagtgcgcccgagacaccccagcagaggcacccaccacgcctgaggctctgccagagagtggagctgctcatgtttggatttattttgtgtccaagattcattttattagaactgttttattcttccatggatccatcaagtggaagttaattggcaaaaatatgcttatgatgggttcttccccgttgttattctgcataataagaatttggtgaattgagaagccgcacaagaggcactgttattaatgaggaaacacttaatagtaaaatatggccagtctgactcgcagtacacaccacctctccgtgttatccacaaatactcattaaggcctcaaaagaacacacttgccttcgaataatgcataaaaaatgcactgttctccaaacaaaggtgaaatcgagagacataggaatttcccatgagcactcaggggagcgagagctttgggtttaatgatggagaattagaagcaagtctgtctggaggagaaaaagtgcaagcataaaaattgcgttgtgttgggaagaaatttgttattgccctgacgagattaaccgcggtaattggcactggcttttttttttt

SEQ ID NO: 48995 - DNA, 3015 bp, Bovine  19866880755724
cccctgctggtaaacgtggctatgcctgctgtcaccacattggcagaacccccaggcatgacaggcacacacgcagacacacttactcatgcacacacatgcacacacacacacatgcatacatgcacacacgcaggcacacttactcatgtgcacacacgcacacatgcacacacgcaggcacactcattcacacacacatgcacacacatgaaggcacactcattcacgcacacacatgcacatatgcaggcacatgcattcgtgcacacacattcacacacaggcaaacagtcctcatgctgtttatttattcgaaagtaaatggtgctctgctaatgtgtgagcattctttttttgtttgtttcttttctctcttttttgggggagcatgaaggatatccattcatttaaaaaccagtaaattgaagagaaagaaaggtcatcacaccctctaatgcagcagctgaactgggacaattcaaaacagtggcatttcaaaacaatgttaagttaaaaaaaatacgggttccgtgggttataaaacttattttttgtttggggaaaatggtagaggcaacatgtgtccgtcacattggtgtgagaccttcagacaagacttctgaaaagatttctgcaaacaggagactcctgctttcccagttttctgtctggaaaaaatcagaaagaaagcagagaagcaggatgaaagcggctttcaccaccctaaccttcagcatccctgctcacctggagagcccctctacccagagtgcactaaggggatgattaaaaagaaatgggggtttaaccgcgggtaagcgcggggtccccagagctttgcagagcattgaaccgtgcgtctacagctgtctccacacaagcccgacattctttatttatttgttatgaaatatttatgggtgttatgaaaggtttaaaataatgtgtctgtcgctctctgcccgctctttccctcttgcccgcgcgcggcttctaatgcataaatcattcggggctctggacagcggggctgcacattaggtgggtggagctgctgtatcacattttttctgcctgagagaaaatatcattcctagtaattttctacacttatacaatcggcgttgacagtaaataattgatgtatgaatttaggactaaactccaacacaatatgactttatgtcaagggtgactcccagcagattttgagctaaatcatcttgcaaaatgggttctttcagtgggagaaaaaaagctttttgaaattattttaatggaaaacgggacctcggtgcagctcttcttttgatgaggtcttgctttgcatggctggtaataaaactgagcaatccacccattatgagattggaaatgtttcatttgtgatcacaaatggattttttttaaagactgacacagctgtttttattctgttcatccttttttcttttccctttttttttggggtgtgtgtgtgtgtgtgtgtgtgcgtgtgtgtgagattgcatttatatgtggtaggctgccctctgcttttcatctcagtatcttccatagaaagtacaattatgatttaagttacaagctggatatgtttgtgacttaaagatatacaactaccagaaaggcttcgcataaaggacttctacgtcccagccctgcaattaaaatccttttcggcaggagtgggggcaagcgggcaaatagagaaagctttcatcagatcgtccggagagaaaggcttcgtagctctacagcttccactggagtcctgacaagaagatcaaagcaagcaaatcaggtgaggagcccggagtgagagtctctgtttgctttattctgctccggggccatgacgattcaaaactactgaaaatctttcttcacatgatgtcatttctgctgaaaccatgatccaaagactagagttcaaagtaagcccccctcgtctttggaaaaaaagaaattatttcttctagtagtcacatctgtataaagtttcatttatttaattttagacccatcgtttcttttaaaatattgagatgctcatgtactaaatttaattacatctattatatagatgagatacgataaaattcaaaacctggaaaaaaaaaccatcctctgacagagtgagatgccctgagagtcagaagctgggggtcttttcctcccagaggtaccccagacttccactttcctctctcttcctctgtttctcccctagattctccctcaaggaccacatgctcccccttctttctatagatggcactcacgtatctgtgcacgacactctgaagaaattccaggccaaaaacggtttgtaaaatattcttgctcttagggaagtggagtgatttctgcaaaatataacagatttttaaaacaaattttagagaagcatttttcgctaggtttatttgatctatacctaagtcaaatcacccttcagtcacaaatgatttgaaaattgctaacaaatgggttttatgtaacagatacggaggtccagcagtaacgaatctgcctgtggtgcaggagacctgggtttgatccctggcaacccactccagtatccctgcttggagaatcccatggacggaggggcctggtgggcgacagtctagggagtcacaaagaggcggacaagaccgagcgactgacacgaacgggtgtgtttctgtgacggccgctctgggccgagctctcaggaccctgcgtgtgcaggcctgtgcgcgtgttggacctgtgtgtgcacacgcctgtctgcggattttccagcatttgggaagcagcagcctggccgggctggccggcgggcatggctcccggtgtgggctggcctcaggcagagtgcggcctcctgctcctccgtgtgtgtgtgcgtccgtgtgtgtctgctcatgtgcccagcactccgtcttggcacacctgcttatgtggacacatgccttgggtgcggtggggggcatgggaggactatcagagctgaggggggcactc

SEQ ID NO: 48996 - DNA, 2003 bp, Bovine  19866880830015
gaaacgaccgcctgtgcgtttcttgggcgaacgagtacaggctgttcccaggcgcggagggccggctgcactctggctgcatttctggggggagacctggttttcagaagaatattgtaaggattgcgtcgcccagagagacagccaatggcttgttattttgacaaaaagatcaaaaattaaatgtctatttctttcatgtgatttactagtgttttggtaggggaagtttttttttttccccataaaatataaaacataagagtctttcttttaaattcaataatgcaagaagtgacagtgtgtgtgtgtgtatgtgcacgcgtgttcagtctcttcagtcctgtctgactctttgtgacccttggactgtagccccccaggctcctcgtccaggggattctccaggtaagaattctggagtaggttgccaagcccttttccaggggatcttcctgatctgggatcaaacctgggtctcctgagctgcaggcagattccttacatctgagccaccagggaatcctgagagacaatatctcatcttaaaaacacaagtgaggtctgcatggtaggaacaacgaaaccatgaatgggtacagacttatggggatctcagagtcctgaccttgtttaatcctcctggtttgttgaatcacaggccacaggagtatctgtggtcttgttctacagaccctgagagacctggggagctactgctctggatctggggccagaaggtgctcgagttcactgtgctgactgacgggacaggggctcacagaggaaggcggggccagcgatcagcagtgaccctcaagcgctgaccacccctggggttggttgaggagcggagcgggtgcttgagggacccccagctctggggatccaccagcatcctgggcgacacctctgacggagcccaggcttaactggctttgccatccactggctcctacgttcctcctccatgttcagggtttctgcttctgctgagatactcgctgtaacagagacggagtgacagaaagggaggaagtttgtatgcaggactgctcctggctctaataaagatgcaacacctcacgttaggcagagatttacttgtattgatgcagatttactgctccaggaaaaaaaaagagccttattgtatgatcaaagctaataaaaatagaagacaaatgacgccgtaccctgaatagaagcagtgcactagttaatgaacacttattgaccggcaacctgcagctaatgtagccatggatttttactttgtctcttcgtggttttaagaagcaattggctgggtctccccggaccagaggatgaggtgatagttaacaaagccgcgttttatttagtgctaaacaaagcagtcaatttaaatctgagttggatgggaaaaccatctctttggtttatgtaagctgggatcacttgagcgaggctgtttttagatggttctgtcatgggatactgattgtttattatgtacggccgcatcctgtccatttacaaaaagtgatgggagaatcagtcaatgtcccacagccccggatgggaatttaaaaccaacatccccgtgtgtagtgatttttaaagccaagtccacctaacactgggttgagtcacctatacctaaacttcacagcccttattgaaactccctgcacgtcgagatacaattgaatgagtgcgttgcaacatcacgcacagaacttaaaaagcgcgttgtccgaatcaagttaatgggacttccgaagcctttgggagagcaatacccacattccgagtggtgcccgagggacagtgcatctcaaccgccacagaacctctgaaggaaagctacccgtttccttgcctgtcaccgtgagctcacaagtttaccggggcgccctcttcaaagcatggacagggtcacttgtaggaatgtctgccgtctggcgtggcccttcagtgcagccctgggcgtgaggcaaagcctgtctgctgcagcccgg

SEQ ID NO: 48997 - DNA, 1495 bp, Bovine  19866880879478
tatgtgtatttataaattaaaaaaaaaaaccaagtctttggggaagtgctacttagtagacggtacaatggtgaactggctactccaagtgagatgggaaagtccagtagcatttcaagggaacgagatggaggaagacgtgcgttcactcagtactcgcatctaagcagacacttaatagctgtaatccagtctgatcctaaagactgctctgtggagaaagactgcgtggtgcagagatgagcatgtgagaggcagagctggtctcccctctgccaaggtcacagggaggcagagacttgaacccaggctggctccgtccacagcctgctgtttgaacaacgctgcttagaagtctggctgcccagagaggagaccatatgcccagggcagcatctccgctccgggtgtgggcttggggatggaagtgggtcgtgcgtgaggctgggggagctcgcacagaactcggggctggggccggacggatctgagtgcaatcgaaccacatggaccctcaaggaaggaagatatgaactccatataacttctctcataagcgaaattactccccaacaacaacttaaccaataaaactcaataaaacaaaattgaacccctaataaaacatccaggagacagactgaactacaggaggcttggcttatggagctccagcttccctgagagtcattactctgatgttttaaggtgtaaagtgctgtaggattgtatgtgaacccagagctccaccgcttacataataaccctagtggggttgacacccggaggtgacacccaggtgtcccttcaggataggtggatgcagagctggtctccccagctggggaagaggtcagcaggtgggtctcagcggctggccgtctgcaggatcccctcagagcaggacactgtcctccgaagtcacacaccctcccaggagcagcggtcaccaccccaagcatctattttcagagctgaccataggctcagccacgacctttgtggagagaatctgaccacgtgttctcctccaactcccacagctgccatcccaagggcacccccaacaacagcctgaaccccagtctctgctttagcctgaaacccttaggggaacccaacccacgatgagtaggaactgagacacccaaagtctcttgctctaaagttgtcgtgcgacctactgaccttgcatcgcaaggatgttgctagaagtgaagtccatgttgtcatgtgggtgaaaggacaagtcacttctcaccaacatgcacccactttgggtggagatgacccacaagtagatgggaaatccaagtggatctgtccaccccacagcacttgggtccttcccagtggcgcgtaccaggaatttcagaagctgttttatttaatccgggttatttctgcttctgttcagttacctgtttctgtacatctattgtctttgaaagatctttgacaatttgacaactcggctaaaataaaggagcaaaac

SEQ ID NO: 48998 - DNA, 1277 bp, Bovine  19866880887101
agactttattttcttgggctccaaaatcactgcagatggtgactgcagccatgaaattaaaagatgcttgctccttggaagaaaagttatgaccaacctagacagcatattaaaaagcagagacattactttgacgacaaaggtccatctagtcaaagctatagtttttccagtagtcatgtgtggatgcgagagttggaccataaagaaagctgagcactgaagaactgatgctttcaaactgcggtgttggagaagactcttgagaatcccttggactgcaaggatatctaaccagtccatcctaaaggaaatcaaccctgaatattcattggaaggactgatgctgaagctgaagctccaatactttggccacctgatgcgaagaactgactcattagaaaagaccctgatgctgggcaagattgaaggcaggaggaaaaggggatgaaagaagatgagatggctggatggcatcattgacttgatgggcatgagtttgagcaagctctgggtattggtaaaggacagggaggcctggcgtgctgcagtccacgggggagccaaaagtcagatacgactgagagactgaaccgagctgaactgaagaagcccaacccacctgctgaagatccatgctgaattatattgctgtcatgatcctgcatccaagctctgtaattgtgtattcaaagcaaatgcattatttaaacaataatacactgtctgttagttcctggctgggttaatggttggctaaagcaattacagggccccggggagggacttgcaggggaagcactgagatgcacagccagctgacacgtgcctcttctgtatggtgggaatcagaggtttttataccctgtgctgggcttccctggtggctcagatggtggagaatctgccttcagagcaggagagttgggttcgatccctgggtagggaagatcccctggagaaggggatggctactcactccaatattcttgcctggagaattccattgtcggaggagcctggtgggctgcagagtgtggggttgcaaagagtcggacacgactgaagcgatctaccacgcacgcgcacaagctggttggctctatgcgtgcctgactctcacagtctcaacactgtgtgatgcgccaatcgcgtctcagattacaattccaggaacgccgcccgccatccgtcagtgccttctgcctcctaaattatttgctgagcgctgttttcatctcatctcctcaaagctttaataaagaagtgtaattatt

SEQ ID NO: 48999 - DNA, 2173 bp, Bovine  19866881085934
agttttctttgtgctaatacaagcagaaatccaccatttaaaaacagaaaaagctatgggtcctggttcttgcccgcaggaggtgatccaagagggtgcttatctcctgagaggccgaggtctcctcagggcagggctgaatagtcttcaccgtaagtcattgacaaggcattgcaaatgctgagcaaggcacgtttcagggcttcagctgatgttttatagaaaatgacctctcctggagggacacagcagcttgtgagggtctgactggctgcagtgaaggcagcctgacctcagcgtctgcctgcacacacaggggtggagtgggcagaggccaagcgggactgccgcaggccgcaccggactcttaaaggttttctttccacagttagaaactgactttcacactcctaggctccttccagaaaaccaagccttcaaacacgcgacgttgggtcatgaacaaagactcagagcatttgtgctttgtaaaaccaacctggcgtggcacttagagtgttaaaagaagtgggaggttttaattagatttctgtatttccaaccccagcatgcaatataggcattatgagtagagagatgagtaatcatttcgacattaagtttggggtggaaagaatggattcaatcacttcctccatcagacatcttcagagttcaaaccacactcagagtggccaggagatgttatcctgcatcccggcagaaaacctgaaatggtgggcaggaaattggactgttcctacacaggaaataacagcactctgtcaaaatctacaggagaaacacgtgttcaaatttgctgtcagggcctcgcatatctgatcggagagcgagaggggacaaaattacaggagtcgtgtaatctctgcgcaggacagcatccatggctcccggggtcagcaggaagtgagcagtgactcaaggctctggctgaatgcagcgttttttgccaataaacatatatatgtccaataaaatgggcatgtgtacattatgcgtagtcgctcagacgtgtctgacttttgcaacctcatggactgcagcacgccaggctcctctgtccatggaatttcccaggagagaatactggagtgggttgccacttcctactccaggggatcttcccagccccagagaccgaactcccacctcttgtgtctcctgcaatggcaggctgattgtttatcaccagcgccatctgggaggcccgcatgaatacgctacacgtgtgttaaaattccacgttgattctgaataacaagatttctcgtggaccctatgttgtcaacattttttttacccgagaagtaacaaagatgtgcactttatgtaaaatctccaggtcagtacttggcttattttaaaaaaacaaaaaacaaaaaacaaaaagcttattttaaggagggttgtagaattacagaaaaattgcaaaaagtttccgtctaccgtgatctgcttccatggatcatccacatccagttcagtaaggtgcatctgtaacaattaacgaaccaactccagaacattgtatcactcgaagtccatactttacaaagactccctgattttgtgcctgtttgtcccagatcccactggataccatgtcatgttgttgctcagtagctaagtcacgtccaaccctttgtgaccccgtggactgcagcacgcctggctcccctgtccttcaccatctcccggagcttgctcaagctcacatccactgagttggtgatgccacgcaaccatcgcaccctctgttgcccacttctcctcttgccttcagcctttcccagcatcagggtctttcaaacgagtcagctctttgcatcaggtggccaaagtattggagcttcagcatcagtccttccaatgaatattcagcattgacttccacatcatatccggcatcaacaaacccaaggtcctctagtttgtctgctctgctttcttctagagcttttttaactattgcattttatgtttagctccacgatgagcttcgaattaatgtctgtgaaggatctaaggtgtcccggctcattctgtttgcaggtgaatgcccagctgttacatctttcagttaaccgtctcacccttctccaggagtgagttggaggcatctgtgtggatctctgcgtgggctctctttctg

SEQ ID NO: 49000 - DNA, 1983 bp, Bovine  19866881224392
agatgaataatcccatttgcagtccttctctgccgttcgtcaaagccagggctccagagaagcccaagcacaattgccaacaggctgcactgaaatgaaaacatcatttttccttccgtccagctcagggaactctgaaactgcctctgataattaatccacagagagaaatcaatactacaactggttgaagatgaaacaacccatagcaaaataaacttttgcagggatgcctcagcggcttctgcggacgcagagtgcctgctgcaggtgtggcaatgtggactctaaataaatgctgctttctctccccagatcatcccaccccaaaggtcaattacccgaaccgttttaagttgtacaacacttttgtataaatacattctttgttctccaaatgttgacgggtcgggcttctttttcccattaggcccaacaaatgggtctacagtttggtagtcgcaaatagactgaaagaaatcgtttcggggtgaatgatttacgagtgaggaggaaaatccaggtttctcatatgggctgctcgtaagtccagtgtggtctggtggagggggcgtgtttcctttccttactctggttttgggttttggttgaggttttgttttttcagtttaacttacctttgggaagccaagctgagttggcagcatggactgaccctgtgttaccgttcagcctgctgttcgttacaaagcattacaacacagcgcgttaaagaaatgaaggaggtttaggtcttttgcttaccgggagccctggagtgttcagtgaaggaccacagctcctggagagatgaatccaacacagcacgtcattaggctccagtgagagaagcattcccacagcgaatgagcatcgcttggccgacttccggagcacctgttggattgaacaggctagccgggccccctgactggctggaaggacaggagcctgtgtttagcataccacacggttttcttaatccttataataacctcacactgatctaggtttgcttgggtctggagtcaggctctgcctcttgatagctgtgcatccctggggaggtcacttgccctctctgtgcctgtttcctcttccataaaaacagcacttctctcctggggctgtcatgaggattgacaaagtatgatgtgcgatagagcttagagcagtgctcagggcatgccacgagctacagaaactgccgttatctaattgctgtcctagaaaggtgaggtcccttgctcagacttacacagtgagtttcagagttagaggacatgaccatgtcatttagatgccaaattccgtactctgcccattgtttctggaagtaggaggaaggcaaacaagcacctgggcgtgagcttactgctaactcggctcgtggagcaggtgaggctgaattcttccgagaaccgaggctccctccgaggagtaaacagccacagggtctcatttttgtctttcagtccctgttccttcaaaagcaacaacgtgatactcattgactgtttaaatcaaatttcccctagcgatttgggaaaaaacaaacagagagaaagtgtgttgaaagcccaaagaaaaaggaaacactcccacttctggagaaagccaccaggaggtcccttttcagtccttcctgcatgatgctgggccagtggatggaattcttcataatagaactaaagtaagcatgggaaattctgaaagagatgggaatactagaccacctgacctgcctcttgagaaacctatatgcaggtcaggaagcaacagttagaactggacatggaacaacagactggttccaaataggaaaaggagtccgtcaaggctgtatattgtcactctgcttatttaacttatatgcagagtacatcatgagaaacgctgggctgggaagaagcacaagctggaatcaagattgccgggagaaatatcaataacctcagatatgcagatgacaccactcttatg

SEQ ID NO: 49001 - DNA, 1173 bp, Bovine  19866881241411
cgcccgccctgggggctggtgctggtcgccctactcagggcgggtggcccagaaggacgaatccggcaccgcacacggctgccctcgtcctcgtccaaaggggaaggacaagcagcaactccacgggctgtttccgcggatgctgctctgtgataagggacttctgctcgctgccatctgctgcaggaaaccaggggcccttgaagaagaacgctcctgaattattgatcaatgattagcaaatgcaatcgaaattgtagacttgatgttgtgcagggatccataattcatgagtggacaaaataggaggtggtcgaggcagcagtaggtgatttcagccccgtattgattacgtaaaacaacaggaggggagtgtcgtgtgacagacggaacaaaggccatcggctccccggccgccgcccggagctgggggagcagggctgcagaagcaaacgcgtttccattgtgtctctttgatcaccgtgctgttcgaccaggaccagaggacgtatttgtttataatttatgtcttctctcgctgtaaaagattgatgttccctattaggtgctccagtatctaaatttccacttagtttatacggcggcgacactgtgacagccgtgctggaagctgcctcgccgtccacagcagagggactccgcccggctcggacacccactgagcgtcaggcccagagccgacctgccacgactctcatcggaaactcagcccggacgggggcgggagggcaaggcgatctgatcttgacccccggtcagttctctccaggacagggatcagttgtaggtggacactttctcttctcaggacgttgaggacatcttatatcctccacgtcgatgaccactgaagattgaaaagcacatcactttgttcatgcgtctgatgacatctggtctctcggagcagtgatggccaagggggcgggtggctcccccagggtcaggcgaggtctgcgggcccttggactgcaagatccaaccagtccatcctaaaggagatcagtcctgaaaattcattggaaagactgatgctgaagctgaaactacgatgctttggcctcctgatgcaaagaactgactcattggaaaagaccctgatactgagaaagattgaaggcaggaggagaaggggacgacagaggatgagat

SEQ ID NO: 49002 - DNA, 643 bp, Bovine  19866881269852
cctctgcgggaaaaactggagtttgggtgcctgtgacttgctctcttctgaacttgaaatgactgctgatgagctcacagtaaatcaaccacagcaacgtgtgcgataattagtaaaataaatgtgtgcttaagtattaatgaaataaatatttagcagattatttgggatctttgttctagcctcaagtgcttaaaaaataatgagaggcttattaaaactttaaactatgactggttttcttttcacaatgtccccgtctccctaaattcagaaaagaaaggacctgtgttctaaagagcgtggcttgaccgacagaactgaatctgaagacggtgatcctggacaaggtgggggctgccttgatccgtaagaatcattatccagccagggtttggtcctggtggggaaagcactccagctaccaaaaagaagggcttggaacagggattctgggccccacaagatcactgggtcggaactgaatccagtcccagaaccacgcggcacgctgtgccctgaggggtggctgctgctgcatggctgggaactccaggatacccctctccagccctgcaggagggctcggggggcgcctggaaatgagaacagcagccgtgggccagtggctcccatgacctgg

SEQ ID NO: 49003 - DNA, 1607 bp, Bovine  19866881389036
tcagacctttcaccatggcagacggctatgcaggacatgactttaagcccacccgcttggcacatctctgaccactgcctgctgtcccctctgcccgactctaatggctcatccccaccgtggggtcacagttcctggagagtttctggggggaccaggagcctctggtctgagccggcccatttccaatgcccgggacgagagaatgagctgccaagggtccctgcagagccacatgtgacaaggacctgcagttaacctctgtgatgccccctgcctgggctgcccaccaggctgtccgcttgcccaccatgtgccaaggccacacccaggacagaacttcacaaacgtgacaccggttttccttccctcttagccaaccccttctccagggtgatgccgtggtcagcttcactttcctggagtgggtcacctccacgtggccgaggactcctgcctttcacaccgtgaaaagtgtcccccacatctatacctcctaagcctccttcgatctcagcaggtcctttcaagagtcttgtgccataggaaatgtttctggtcccattattactgggtctgtcaaatatttgatagcttgctacctagcaagctgagtatttggtagcatacatttcagttcatacagatgaaaccccaaagctttcttactgctacttatttaactttaaaaagaacaaaatagacaagagacagaagagcacaaattaagataataaaattagcatttccagccacgcagagaggcagcgtttgccatcgttgcttggctttgataataacctaagagtctaattttattttagttttaagaaataggacattcatcttattaaaaataaatattttatacatgtttccataattacgtttccataattccctggtaacagattgctgttggaactgttcgcacccatctgtcttgctccgttcgggtctggtcacagagcttgattatttcttcattgaagttgtttcatcccaccgagcattacgactttgaatttgtgtcattaatttcatacctgaccctgagctatatttttattacattaaagagttctggaggagatggtgttcatttagaaataagcatcagacaaaaaaatacccagctgaggacacattgaagccttttctgtttcgtctgcgcctctgttcctcttgtgaatgcggtcatcggggtctgaaccaaacgcgtcctcggaggaagtgggaaggtcccctgggtcctaaggagcgaggtggccccagagacccacctgccactcctgcctgcaccccgaggccggactctgctgcccctctgacccggggagggggccttctcagcctcctggcagcccgctggtccttgtaagggcactgcccctggatcaccccctgctttccaggccccgaggttccccttcggccccagagctgcgcccagcccagcatggaggcggacggaggtccagccccaggaggaggcggatgactctctcccagcacctgctgtgcgcgaggcggggcctgagatgaacttttacttttggctttgggtgtttcgcttttttaaaaaattttctcttacacaggacatt

SEQ ID NO: 49004 - DNA, 1687 bp, Bovine  19866881406033
gcctctgtcccccggcgcgcgatctaccttctgatccgaatcgcccaggaccgagctcacacacagcacacccagacctctgagagccgcctggggccaggccccggtctcctcaacagctctgccctaatcgcttatccagttcctggcttacagtcagcatacaattaaaacttgttgagtcaataaaggatttaacaagtaggtgcattttaaaatttaacatggtctggacaaaaataaattcctggggtgcaggagtcgggcctttaaaattccaccaaagtatttctgtgcttatgttgatagctttgccatattcaaatgatcgattccgtgtcaagatgtattttttaaaaaagctagtttaataactctccgttggaagtggttttgtgttttaggtgttgctgtggtgtgagacgcagaggacacgcattcttggctccagcaatttaactgcaatatgtcggtttccagcaggaaatccgatctgagtctgcagcccctcctgactctctgagagtcaataattcaccattttagggcagcgagcccattaacgatgaacagcttgagaatacactcttcattgatcagataaacaaatcatgagatattttattacagaatgatgggccaatttatccatgttttcccgaacagtggacttacattgaatgtgaaatggcaagaaatttgcttcctcagggagctatcataagaaatacaaagtgaaagctgatcgctaaaatggctcatctaagtggatttatattgaatttaacacaaatttaagccagacctctgatcaacaaaagttttacagaatggtgattgctttttctttgttagtcttactctaaatcacatgcaatattctgtttcacatttacatcatgattttagcttattctggttgtttccttttgaaatgcattcattatactggttacttatataagcattatttgtcatagttctgaattcatcttaggcacatgattgagacaactttaaatctattccatgaagatttaaaattgctttttaacttctaaaaatgcaacagttattggctagatgatgcaagtgggatgtgtagggagatacttgtgcatttacagaaaattcacagcatccgtgaaactgagcccaaaacagatgtggtcaaaccagggagtttgggcagctgcgggacttgcctttccggtgttatttcagactgaatattcagagaaattcccctcgtgaggaccgtctatgaacacggggtgaagttacactctctgggaaagcgtctgagaggggcagcggagagatgctggccgggtgtcatgtcagggccatgctcccatccggtgcctggagatagtcccctaggacggcgccacgaggacccacaaaaatgcctgtggccatctgctcctgcagggcaacgtggcccagagctggtgctttcctgacggtgtctgctgatgcctgatggtttagaacttggctgttaaaaggtctgacatggtggggatggtggggcaggagacgatgtctgggtagggggagaccatatcggaggctcccgccaagtcagtacttttgaggaacggtgtcccaaagggcagatgggagaaacatgccttctaaaacatgctgcccatctctaaatgttgacgactagtagagagga

SEQ ID NO: 49005 - DNA, 811 bp, Bovine  19866881925133
aggctgaagcgccttcgctgaggtcactggagtgtccccggggcgggagaggagccagtcaccctcaccctcaggcatggccctgaccacagcccagggggcccgcagagcccctggggattctgtgcaccctgaacggaatttctgcttcttttccttgagaacaatcccttttttcatagtgcagcgttttcacgatgtggttttgaaggagaaaatcagaagcgattagggtgatggcttgctgtctctaagacgcttgatcgcttggtgtcgcattggggaaaggagggcttcacgtcgacaggctatttccgctgcactcggaggtgataaactatactgaaagacatttaaaaatacctgtgcccgatggcgggacgctggcagctgggagaggaagagtttagtacacttcacgtgaaagttctttactggagaagctgacaggtgccccatttgtatgagaaaaaccagctattgttatccaaacctctcagattccttaacactctgcttgacacaggcagatggatcaggatgctgtctgatggcattgttcaccgattctattaataattcctcacaagcacttcactagtgactaaaatgaccttggattctacaaatgaaaaacattcccagccacatccaggggtgagcaggaggcagaaggcccggtgggtcccttcccttcggtcactcgtgtggccccttctcaagaagctttcgtttcaaagatgtgttttatcctcccctgggaatgccatctcagggggtgtgaatttagattaaacgaaactttctgttt

SEQ ID NO: 49006 - DNA, 1282 bp, Bovine  19866880241656
aaactgtcgcgatcgcattaaatcctgcagttgttgtaacacagtaagaccatagctatcatagaggcaccataagataggatgggcattgtaacaccacaaaggagcaaacattacattgagggcttaaacaagatgaaagcatacattgttcacaagtcactacgttaggtccacctgaataattcatgcctacattaagtttgttggagtcattagtaaaaaggaaaacattaggcaagggtggataagctaaaacagaataagtagaattattttctggttggagttcacgctgcagctgccctgtcagtctcgccgggatctcgatgtttatcttgtctcccctgctggccggcgccgcgctggtctggacggcactttgtgggtgcactgtcttctctggccctcactcgctgcacaaacttctttgctctaggtcgcggggtgcagcgaggagggtgcggggcgaggctggaggcgcagaggcgagagctgcctagtgggcggggcaagcgagtgcgcgccgcgaacctggcctgtctggaacccaaattagtgaatctgcgtcctgtggaaaaatacaagcacatcctcgactgctagttaataatgggtcaggacccttccattgtctggagaggaggtccttccatttaactaatggctttgcattcaattgctccgggcaccaatggcgaagcattgcagtagttctggctgaatcggcatttaaaatatttattacagctctctttgctgcatctactgcgagactgaagaccattctcagcaaccctaaccctaaccctaacttgaagggacggacagttattgtgaagggccccagaggcaccctgcggagggacttcaatcacatcaatgtagaactcagtctccttggaaagaaaaagaagaggctccgtgttgacaaatggtggggaaacagaaaggaactggccactgtttgcacaatctgtagtcacgtacagaacatgatcaagggtgttacactgggcttccgttacaagatgaggtcggtgtatgcccacttccccatcaatgttgttattcaggagaatggttctcttgtggaaatccgaaatttttggggtgaaaaatacatacacagtgtttgaataaggccaggggttgcctgttcagtatctcaagcccagaaaaatgagttgattcttgaaggaaatgacattgaacttgtgtcaaattcagctgctttgattcagcaagccaccacagttaaaaacaaggatatcataaaatt

SEQ ID NO: 49007 - DNA, 1077 bp, Bovine  19866880353038
gacatgactgagtaattgaactgaactgaactgaactctttccttggttcccattacattctacatttctgattattctccttgctctttggcttcccttcatggagtcctttatgatctctcttatctctgcccattccttaaatgttcatgttcttcaggttcctcttctcatttcacatactctcctgattcagtctcatctcaaatatataaacaggtggattctttactagctgagccacaagggaagcccagacaaatgtatatttcaggtcagttctctcctgaaccccaagccccaatatccaacttactgctgaatttccccagttggacactcatcaagcacctcaattccagctttccaacacagaattcttaatttcctcctgacccttacatcccatccctccaatcttgcttctcctctgtgttccttctctggaaataaaactaccatccatctagttgactaagccagatatctggtcaaccttcttgattcctatttctctgtcacaactcccatgaaagcagtctctaagtccttcatcataaacatatcttgctattcccatgtcttcatagccattgtttctcccctgatttaaatcactattctctctcctttgatggcctctttgctggtcctccttcaaagtctgaacccttccaagatgtttactgaccacggaccagaataaatgtgcaaaaatgcaattttcatcatatcaaccatttgtttagaacactttgtggttccttcatcattcaggacagggttgaaagtccttaatgtggctcaagtgattggttcctgtgttttcatctttcctcaatcctctcttaaactccttgctccagtttttctgactattaataactttactttttgaatgtgtccatgctttttctttccaccagacctttgaaccctctagtcaagtgttccctctaagaaagtgtttttagaggatccttcaaagatgatctagtactgcatactattatggtgatctcatgtctaatgcttcaccagtggggggggggttagtcactaagtcatgtgcaact

SEQ ID NO: 49008 - DNA, 2290 bp, Bovine  19866880432296
cttaattaaggagtgtttcatttgcagaattatcccaaaagaaaaaaagtcttgtggttgaggccctcttcttagctaagaaacaaattggcattttactactagatttgaaaacatctgagaaagtttttctctgtaatttagaagttattatttttatctaacaggcaaaattttattttgattatatgtatactaatatgtagcatttaaatatgcaatattcaaatattgcaaaaaaaaagacccttggttttgaaatcaggagaccaatttgaccctcttctgccaaaaaaaaaaaaaaaaaaatccctttaaagcttgtggttttcactagtacttttagtgtttagtcaactgtttcataagttttacatcccatatatgagaccatttaataaaagagcggtagatgctttttcagattagaaaaattaattttacattaagaaccacagagatgtcataaatttttatagaaagacaatggccttctacaaaatcttgctcccatacacctgtaagtaaaatatttgagcatgtaaatatacattcctttgtctatttatgtaccacattataaagcacacaaataaaataaggtgacagtatgaggtaaaaagggcttccctggtggctcagtggtaaagaatcctcctgccagtgcaggaaatgtgggtttgattccctaggtcaggaaggttcccttggagaaggaaatggcaacccactccagtatttttgcctggggaataccatggacagaggagtctggcaggctacagcccatggggttgcaagagttggatgcgactttagtaactaaacaacaatagcaacaatgaggtaaaaataaaatagcattttttcacacctaaaggagtgaatgcaatcactactgattggaaaaataaagaaaatgtaatatagcaatttctttctttcttcttttcttttttttttaacttttggaccataccgcacaacatgtgggattttagttccccaaccagggatcgaactcatgccccctgcagtggaagctcagagtcttaattgctagaccaccaggtaagtccctgtggcagtttctgccacagctctgcagagtccttctaaggcaggggacacatgcagaatggtttctgtggcctaacaggtgagacatgtcaggggagatataggcgctccacatacccacagggtgaccttcaacactcactcgaatcagagtcacttgtatctttttaaaaaacactgatacccctgctctaacttcagggatttggttttcattagtctggcagtggagggactaggcatggatttttaaaaaaatcttcttaggagagattagtgttcagctggggttgagaatcactacctcagaccctgggcagctcttcttctttgtgtgggccctgcagggagtttctagggggaagtggtactgaaccatagtgcctggtgggacagtgccatggttgagtggcacagtagaagcagtgatatgactgccatgtcatgggaatgtattcatttgaatcgggacaagcaacaaccatcctttgagatggtgcccagcaaaggttgtgcagctgagggtgaaggtctaattggtttaagagctctggtaagtcatcaggagaatgcttccagaggctgagaccccaagtcagcaggcaggaacaaggactatctattgcagcttaaattaatgtcattcctgtgtcattaagccttccacagcccaaggacacctagggaaactcaggttacagcattaatattgtaacaataagcaacttttacagagagcttcacagcttacaaagctcttttgtatatattatgttacttgatccacatttcagccctgggaggtagtagggtaaatgctattagttccagtctataaaggaaaataatgaagttcagtatttgtctgaagtcatacagtattaaagggcagagccagaatgtcaacttacttctcccagctctgcatcttttctccttttttaccaaatcttggactggtagaaagtgcttggtgatatacagatcaggattcctatgaatgtatgtagttattgatttgtttagaaatgggatacatctctcttaggacttaactgtttttattcttcatcacaaccagagctaataatattcagccataccagttgttaaaatgctgaaagaccttttgctcatttagtaagtagttaagccctctaccaccacaaccccttgtggcccagttcttcccctggactctgttagacct

SEQ ID NO: 49009 - DNA, 1566 bp, Bovine  19866880493429
cagacaattatgtgctctgtgcacatgtttaactagaccagtgatcagaaatgacactttactgcgaaatgacaaagttggatagggtgagtgaacactcccttggtccctttaattctctctgggccaaacaaaataaccaaacacacatgcacacacagctgaaaagtgtttttaaatacctcaggtttttgtgtgtttttaaaaagtttcccaagacagcttgaacaaaccactgcattttaataatggtggtggtagtgacttaagtgctgaggtgcttgtgctcatcaaagttctctccaagcctccctctgtccctctcctgtctctgcctttcggtgttacattgcaggcctcatgtgtgcaggtcacaggtacaggttagaggagatcgccatggggaaataagagaaagataaagggaatcttaccatatctcagttcctatgcaaggaagcattttatatttcttcagtcaaaggggcatataggtcagtcttggccctcttctttgaacttgatgcttcaaagtgattcagacaagacaggaaatggaatttatttgagtagatgtatgtcattttttaatgcatacacgcaatactagtacagttttttaaaatgacagttaatttacaagtttgtgttaatttctggtgtaaagcaaagtgattcagttatacatacacatataaacagtcttttttatattcttctcaattatagtctaagatattgcctatagttccctgtgctatgcagtaggaccttgtttatatatttcacatacagtggtttgtatctgctaatcccaaactcctaatttatcccttaccctcttcccctttggtgaccataggtatgttttctatgtctgtgaatgtgtttctgtttttcaaacaagttcatttgtatcatattttagattccacatataagtggtatatttttctttctctgatttacctcttttagtatgacaatctctagattcatccattttgtttttttaatataaatttatttattttaattggaagctaattactttacaatattgtattggttttgccatacattgacatgagtgggagggggattcaggatggggaacatatgtacacctgtggtggattcatgtcggtgtaggttcatccattttgctccgcatggcattatttcattctattttatgattgagtaatattacatcgtatatatgtgccacatcttatttatctattcatctgtcattggacatttaggttgatttcatgtcttgactattgtaaatagttttgctatgaacactgggggccatgtatcttcaaattgattttcttcggatatatgcccaggagtgggattgttggatcatatgataactccattttcagttttttaaggaaccaccatactattttccatagtggctgtaccaatttacattcccactgacagtacaagagggttctcttttctccacaccctctccagcatttactatttgtagactttttgataatggccattctgagtggtggaggttacagctcatgtaga

SEQ ID NO: 49010 - DNA, 1394 bp, Bovine  19866880527721
cccaccaggctcctcttctgtacggattctccaggcaagaatactaacacattcccttctccatggaatcttcccgacccagggattgaaccctgatctcctgcattgcaggcagattctttaccaactgagctaccaaggaagccccctcttagggtacagagtctcaaaaaaatctctggcaagatttctactagcttagaatttcttgagtcaccatagacgttttccactttttttttttttcccgttacaattaagggtaggggcaaaagaaaacatccagcaagggagtatattagaaactcagggacctgaaatgtcctataaaagtataaaactccccagccctagattctaatgtgtgtttgtttatctctcccattgttatacagtaaactctttccccatatggttattgtgggtttaagatttcattggtttctctcaaatatctgtaatatgatcttccagattgtctcacctacccatcagtttaacactgagaagtattatggaaaccatttcttaattgtatattcattcagtgttagcttgttatatagagcaagaacactaagatcttgtttacacataggtaggcatgcttataatttgtcaactaaatattttcttctttgtacattttttatagattgaccaacctcaacttggcctgccttccagagactactatgaatgcacctgcagcatataaagaggtaaaaacaaaaacaaaaaaccaacaaaactacagaatttaaacttaaccctctatcttcttcactcaggcagatactgaaaatcatacataatagtgagcttcctttgactgactgagtattctcaacagaacaaatgaagatcttttaagaaacaaagaaacttgaaattccttgtttgtgtcttgattcttagtatttaagtcatgtggcccatttttaaaagccaattttatttacttatttatttttaccttttaattttatattggagtacagcccattaacaatgttgtgatagtttcagatgaacaatgaaggggctcagcatacgtatgttgttgttcagtcactaagccctgtccttccctttgtgaccccatgaactgcaacacaccaggcttccctgtccctcattatctcccacaatttgcctaaactcatgtccattgagtcgatgatgccttccaactatctcatcctctgtcgcactcttctgtcctcaatcttttccagcatcagggtcttttctaatgagtcagctcttcacatcaggtagccagaatattggagcttcagcttcagaatcagtccttccaaggaatattcagggttgatttcccttaggattgacggatttgatcttgtgtccaagggactcctaagagtctt

SEQ ID NO: 49011 - DNA, 1390 bp, Bovine  19866880584372
caaaattaaaaacttttgttctgtgcaaatgcagattctgattcagtaggtctgtggtggtccgagattctatacttaaaaagatttctcagatgatgctgaggctgctggtccatgggccacactttaagcagcaaaggacatacactttatggttctcaaattatatgatttcacaagtgaacagattttgttattttctagtgttagcagttaagagaagtagaggagagaattcaatttcagttgacaggttaatagaaaggccccaagagccaatttatagctgaatgcgatgagaaacaaactcttatcttttcacatgcctttcatctattctaatattttattcaaatgacatctattataaatgagtaaccatctgatgaaaaatgatcatgtttcagcatgaatcttaattttacattgatcttatgaccaaaacataagcttctgaaatgaatatatctttgcatttaaactgctttattttttatttatggtaattattcttctcgtattttcagttcatactttgggactttatctgaacccatgagcacaatcatcacaggctataagaaattctgtgggtattctgaatttaactgtgttgtagctcttgggattgttggctaggttttccattctctggtctaatagaaactgaatctcttgttgtatctctaataatgacatttcggtttagacatggtgttgtggtccgttagcggaccggaacctggtggtctggagtcgacaataagaaaatgaaagagagagagagagagaaagaaaggaagaaagacacagggccccaagctctgatggagcaaaagtgctttaatgatctttctgtgagtatatataggctgttgtacaaggaatttcttttgacaatgataaagatcagaataccaaacatacagcaactgttaccaagggaacagggattaacaatggtcctaaggtcaggagacaatccatatctcaagaaagaggattgagactaagcagttttgtcataaggagaatgtttactgaaggagattcatacatgtctcatcctatgacctcagtcctgggagtggtgtgccgttccactcgcttctgttgccagaaactgataaggaacagaggatttatgagaaacagcacataggaatcctgttaaacattccgtgacaacatggtatgtatccaaatttatttccatgtgctaccaactctttctgttcttctaacaaatagagaatagactgtaatttgaaagaaaacatcatgattctaaaagaatcaacatgcattgattctatttagaatatacaattttatcaggaataatgaattataagaaatgaagtggtttttctcatctaaataataaaca

SEQ ID NO: 49012 - DNA, 1394 bp, Bovine  19866880765146
ttccatcgctgacactgtactgagaaggggaaggagaggcggttttccagcacaacttgtgcagacactcggcattcacaagcctggaaacaattctggcctgagggagccctgcctgtggccggcactttgaggatgcccatcaccacataccaaggaacatgtgcatctgattcactccccttagacctctcagatgcatttcctgtggacatctgtggccctggctctggggtaagagtggggagttgaatacaacacagcaacagccacaggaagaatccagactgtggacagctgtccagccttggcacagttcacctttaaatatctggtactttctgactctgactgtggagggggaagagggatgtttacaaatagtcaaaaccaggagaagcacgataaagaaaagaaatgtgtcttctaagcaatcctgaagaggaaagctggtatcttaccttgatatactcatattttaaatataattgattcccgacttcttgaatgcctaatgtttgcaggaaaagtgccaaatgaaatagaaatatcttgattttagactcatgttttctgctttagtttctaccaattcatttgcaaagataaagctgacctttaaccccatccatcttaatcctttccaccagacagtcattcttaccaatcagattattacatttacctacattctttaagttcaattgtaaagaaaactttaaaaacttcaatcggatctgtacaagcagatgtatgtacctagtggctttcagtgtatatttttaataatgttcaaaatttctgaatgccaattcctaaataaaaccaactgctcattgctacaagatactttttaatgtaaaaaatcttttcaagtatagtgattggggaatattacttaaaaagtttgttcaatgtacattaatgcattgtaactttcaaaactgggccaggaaaattaaagaaatttcactagggaaaaattgatgtaattgaaagcttcagacatattaaactgtgtggtctgccatgtttttacttctatcaaactaattttatttgtatagacaagttatttggagaaggaaatggcaacccactctagtattcttgcctagagaatcccatggtcagaggagcctggtgggctgctgtccatagggtcgcacggagccagacacgactgaagcgatttagcatgcatgcatgcattggagaaggaaatggcaacccactccagtattcttgcctggagaatcctggggacaggggagcctggtgggctgccgtctatggggtcacacagagtttgacacgactgaagtgacttagtggcagcagcagcagaccagttattgtcccttcccctagtccacctgtgatatctgttggtt

SEQ ID NO: 49013 - DNA, 1386 bp, Bovine  19866880833659
tgtctgaggttattgatatttctcctggcaatcttgattccgcttgtgcttctccagcccagcatctctcatgatgtactctgcacagaagttaaacaagcagggagacaatatacagccttgacgtactccttttcctacttggaaccagtctgttgttccatgtccagttctaactgttgcttcctgaccttcatataggtttctcaagaggcaggtcaagtggtctggtattcccatctctttcagaattttccacagtttattgtgatacacacagtcaaaggctttggcatagtcaataaagcagaaatagatgtttttctggacttctcttgcttttttgatgatccaacagatgttggaaatttcacctattactatcagtaaatggaagcccaaattactagaaataaggattcaaagaataaacactaaagtttttttttttatagccaagggtattctgggtatacatctatatcatatttttttatggatttgtctcttttttgttgtttttctttatctaatatctgttctttatttctttctcttttcattcttaaatatttaaaaaaaaaaaaacctttccattctcatgaaaaatatattaccagaggatttcagagacatccacaaaatctctatgaagcccacatattcttttaatatatgcttcaattattaaatcaactaagtctcagttcattaaatgttctttgaaaatgtacatgttcacagctatatggataattggataaagaattaataatgtgtaagaagaattcagtttgacggaatgtagaactgtaaaataaaggcatcagacactggagaataagagacaataaaagaagcaaagctgtaaaggtcagaacagactgtgagatgaagtaaggataggttattgagcctgtgtaaatctgcagaggaaaagctctggctgtctagtgtgggaggcaatgttttctgcatctgtcactcaaaagtaatgtaaatgtttacatcacgacaaatgctgaactcatttatattactaacatgatcttcccctgtgtatttctattttgcacttacattctttacaaagaaaataaagaactgtgttctctctttgccatttaatgtcttctatatctccctttactcaaggtaggaatttggtttttccagcactttggggtgtatgtatatataatcctcatagggggagaccagggaactgcaggagtagtcaggtttttgcctttggcagataaaatggcagggagacactcagcagttacacttctgtctctgcggagctgcctcacattccaatccattctctctccctgtgttttgatttttaaattggagatttgagggcacagaataacaagg

SEQ ID NO: 49014 - DNA, 2006 bp, Bovine  19866880883009
ttctgtagtttctttgattctaacagctgactgaaaaatttcagctcttcaaggaaaaataaaatgctttcttctaattcatggagctattgtggggactctatatctcttttctgtgtgtaataatactatttcctcctaaaattcattctgtgttttagacttccatttgtaatatatggactgacacccagcttagaataattaccaaaatatagagcttaatacaccagaccaaatttatttttagctttgagtcatccatcatgtctataatagcaatatgctatgaaattcataacagtctctaaagagcctttgaaaatattataatacctatttagttcttgaacaatttattaataaaacttaaaacttaataaaacctttatctgagttaagtttctcttttaggcttacaaaaataaaacaaaacagaaccactaactctgaagcatgtagataagaatgagtcaaaattctatgacttttatgtttcaatacaagttgtgtgtaacatacctcaggatttgtgtcaaactccaggcttaaacagtggaaaccgttttatctatttacttggttcagaaaggctcagtgcctctaggcaatcaatctaactctttgcagcaagacataagttatttgagatttctacctcaaaacctattatgcccccaaagtgctatctctgattattgttaaacgaagtctcagttggcagaagagttcaccatactagaactcttgatagcttcagagaaatactttattaaattctaaagcactcaagccatacctccaaaatacaggcaaacctccagagtctccttgaaaaattactcatggcccaagcactattggagccataaaaggcaaagcctcagaaccacagagttaaggtagaaatcatgtctttgctctgctaactctataaggaatcttttttgttattgggatctctaaagccccacaaaataccatgttcttgtcaacaccaacttcagacaaatagtccaaacaagaaagtagttcccagctactgtaattcagttcttgctttgacatataagtggagcttgtcattctcaatgcaacatttatcacattgagtatgtctaagcaatccagaaggctcatgccacatatcaatttatcaatagttttgcccagttgtacatgacaagtctctcacataagagtgagacattaagctagtgagtaaatctagctgaacacacagcacctcaaactctacaacagttttattgttatctacttgcaatcataaaaacattgttctttattaaaaatctcctctgaaggatagtcaaatgctcacaatggtgattaaaatgcagagaaccaaagctccccatagttcctaaccagaaagaagttctttggaggaaattatatgctctggtaaattactgttatgtacatgctaaaatttttgaaatgcagcagttgcaagtgttaaatgtctgctttcccatgcaaaaggcaaatgatagtgaacactggtaactctttgttaaatcaactatacagtattaagagtaaacaagatcacaatgtaggtgaaattgcttagtaacctgtaaatcactttagaaagagaaaaaattaagagttacacagagacaaatactgagatgcatgatcatttaagatgctggagtgtaagaaaagatgagaccatttctgtaatctttctgagaaaacaaaaattcctagttgtattttgcctctatatttttcatacttccacaagttcctgaacggaaatcctgtgtttggaagagctacacgaaaaacaaaaagagagagagaaacagagagagagaatctaggattagaaattttatacattgcgtgtatttaacgatggacaagtggaactataaaaataacatcttatagttaatgtgtgtcatcgtctcaataaactaatgcgagttgcatgtttgctattggctatgttaacagtatggtaaaactcc

SEQ ID NO: 49015 - DNA, 1199 bp, Bovine  19866880918731
acatacttcagttcttatttgagaaaatgcagtcttaacatcaaaggttcagggctaagcaaaccaccatccagaactcaaatcccactcaccgcttgtgtttcctcttttttattagacacaaactaaaattgaaataactctaatattttatgatgtgaaaattatataaaattcaattttcagtgtctataaacgtttattaagactgtagaaaatatcctaattaattgaaaatatgcattgtctctgtactgcacatccttttgagttatcagactctgggctttaattttctttgagctatttttcaactctttgtaagttgtagatgactgacagagatgcaaacctgtcttgttaaatacagttttcattgacttcttacacttcatgaaaaaaagttttgttttcatttgtaatttgattcatatactccatatacaatgctgtcctttgaactatttgtagtcccctgtatacgtagaataaaatctttaaatgtgttcattcttatatctttgttaagagtcatgagtttacctttttctggacattatctttttacagaacacagccacccattcatttctgtgttgtctctggtcgctttcatgctataatagcagatctgaatagttacagcagagaccatatggtctgtaaagctgaaaatatttactgtttgccccttttctttttctgcagaacaagttaccaactgctggtctacatcattccaaccatagtcaaactgcaggggttctggtgaggagtccattttgcagcagctgtctgatgttttactttgctgaagttacacacttagtttttgtcctcagcaatatcaagtaaagcaactagatggtaaaaatgcatattaaaatgactatgtctaggtacagaaattagcatttaaaaattcatttctttagatcatatcataaacttcttaaatggattttttaaagctgtaaactggttcctattgaatataagagtccattcagttgtctggccctgccttttccaggagcaaagagaataagttgaattggaaaacaccaagatcattccctatattaccatgtttttgaaatagtattaaattgagaaagacttttaaaaatgacttattaagtagttagaatttttatcttcttttcaatgaaagttcatctcttcacatgtatattttt

SEQ ID NO: 49016 - DNA, 1186 bp, Bovine  19866880995445
gacttaggttgaatgatgaatagtacgtgtgtatacttcttcttcctttactgtagttggttggttttattcttgagaggtctgggtcctcctatcctgcatcttatctctttctttaaataaccaagtgtttcgctagtttctacctcagatgaaagagaaaatgcaggcctgccttagccgtcctgggcctggagtcactctgcactctgataactttggctgttgactttgttcttcaaggtgctgtgacctttgaacatctaggaggctctacggtatgtgggattgttaagggattttattgtttcagtaaagatctgaagctacagttaatacttcttggactctgcttacaatatttctgcaattcataccggatatccaatttgcatttgtttatgtagagtctgtcattataaaattagctgtaagcttgttagtttttctttcatccatgattttatctttgagaattatgatgaaaaaacaaatcaactaatgttgagtatttacaatgtgcaaaacactgactgtactaggtgtctcaattaatagaaagatgtataaagagaagatctatgaagagaaaaatactatattatgtacaggactcctgtgctcacaatttctacacctggaacagtgagaaaactctaccattgccctccccacattctttctcatacaagttgaactgttttgcaaggaaaacaaaagagcaattgagaattcatctgcatcaagagagtataagttctcaagtgagcttttgaaaatactttgccttctgaataaattaattaaacacttttaaagaactgctgagctgtgtggatttttccagcttggaatggtaaatctgtcttcccgctgagcctcgagcccccacttctgaccacttttggacatgtttgcctgactgtcatctcagtctccaactctttaagactaaactctgagggtcacctccaaaccagtcctctcctggatgtttgtactttggcatgtggtacaattgttatcacagcctcccaggtttgaaatcttgagtagaattctgtatttcatgctctctcttgggctatcagtaactcttctgcctctttcaatctatactctagataatcaatgtcaacctagtttacatattcctcccttttgactagacgtcacccaactactc

SEQ ID NO: 49017 - DNA, 1359 bp, Bovine  19866880997918
aatataattttccaccaattataaagaaaggagaataaatagtaaaatgatcatcctaatgttataggtttaaaactataaaaagtagcaatatattcttactaaaagtctattactaagagaatgtgcaattttattccttgtaaaacaaactcaaatggtttcaggataacttactttggcacataaaatataaaatgtgtgtggtatggacatttatataactgcatagttgaacaaaaccactgcctattcagctttatagaggaaattttttttgcttgtttcataagaaatttaaaagagttgctgcctcaagagatgaaaaatagcctcttgaaggaatactaaggactgcttgctttattatactatatttctatggaaatatgagcacatcccatcagcatttcatgaatctgtgtggacatatgagagctttcagttgtttcccagggaagtttcatattacaaaaaagccactgcctaagtcagtgaactgccaattatggttaactgccctctatcttcctcctcagagacaggcagcaggcatttaaattcttatccaatgaccttctcattttaactcattctaaactaatgacttttaagatttaattttaataccataatgagaggaaaaaatataagaaaaaatttgcaactgaatacataatcgcagccctagttggaatatggaataggaaattccattcctaatataattgcccattatttattgattgataagcattcatactcaagtcactgaagacatcacattcataagttctcaatcattatcactttaatttttaatagataagacttcagggttcctatcctacctgtgtgaattattttaatgcaaagctacaacttcaaacaacatgatgctatataaatgacgcatacaacatggacagaaagcaagtcagctgtaaggtaagaagacatccaatttacaagtcccctccagtaactgtcctaggctctatgtatgtacatgaagatagacactagctttgttacagattggtctgcttaaaagtattccagaaggttctgcagtgtaacacctccctcgttttatgacttctgatctcaaattattttttcctgtgcaaactcctgatacaatatgaattgtcatcagacaatattttttcatgttgccgtttaaaaatttaagcccattatgctactacatttgagttcacttgttgaaatgtaattgatttcagtggaaaaatgtgaacaaagagtacatggatcatgaccacagatacactggttagatcatttatatattaatatcatcttgtgttattctagataaagcactaaaagagaaaa

SEQ ID NO: 49018 - DNA, 1541 bp, Bovine  19866881080446
actctgggaacaatcagtcattgttttctgtgtcttttaattccgataagtcattctaaaataagccagtcacaagtatagtggattcttcaatacacttaatgcaatttaacaatagttttactatgacaagtgctaatatacatttcaaatattttgactaaaaagttttagaaggacttctttcatttttcctacaattcccctaaagactcactggtttaatgaccaacaatgcagaaactgttacttcagtgtcatataaaaaggaaatattttgctttcaactaggaagcactttataactcagtcagatgtgggtgtgtatgcataaggaagcatgagtaaagaggagagagccagattatagagaattttagattccttgtcaaattaatatcattaagtccacttctgtgaataaaatagagagtacctgaaggtgttatgctcagctggtcacaggagagtgctagagcaccattaaattacctgcttcaaaatagctggaagaaatcacacactagagaatgacaatgtgcttgaagaagctttaccttgcatggttgattgaaagaaataatagcacttgctggtagaaattatagtagaataccaaatctgcctcataatatctccagatgttaaaaacagaatgatgaagtgtgacagaactatcttgtggtataattattttaatcgttgcagtgctattataaaagatttcaattttgttaaattaccctgtgcattttaaaattccctttcagccagctcttaacacttctactaaattgttatacatctgatgcaggcagcatcctcttgagccagtgagaatggagaatgtggacaaaatcacatttaacaacctagttcttccttgaaataaagctaaacaactgaggtgggattctgagtccttgagtgctttgtagtcaaatacttctctcacaggatttaaataactttatgtatcacaattcatttttatgacttaaagagatgaaaaaaatctatgattcctaatttctagacaaaaacactaaatcacctcagaatccaaaagaattcatgtcggtaactataagaactgcaagtcagattttcaggcatctaggttctgctaggaaaaagaattcttcttcatccaatttgatcatcagttttataagcatcaccttatgatactaaattcatttaaacttaacattccaagagtgctgagtaacatttactaagtacaagggcccctctgaaagatattataattatatagaacttccacagaaattgtgaggtattcagtgaacctatagacacatttcccagagaaatgcaaaataaatatagatacatacaatttgaggagtgtaaggttcaggctctatcacaagatcttcagctgtaagtgtactgtccctttaatacatggattgggggtgggcagggtgcagtttctaccaggctaagtcacatctacttttctctgaggcccatggttagggtacttcaactcaatatcacattattaaactata

SEQ ID NO: 49019 - DNA, 2664 bp, Bovine  19866881086471
ttatattgcccctacccttttccctctccctgttaaccactagtttgtgagtctgtgagtctgctgctattttgttctagttcttatattttttagattttacatataggtgatattatacagtatttgtcttctctatttaaaaaatatttatttaatcatgaagtcattctttgtctcttgtttcttaagtagaagtgggaatgacaaaaagagggaaaaaatggatgtctgtgcttatattatttgaatccttataagaatgaatgaaaaataattattgttgatactgtatttattaaatgagcctaccgaatgatttcttggtgaaaccatcaatgtgtttagaaagaataaaagacagaaaccttttctttcccatttctgtccacacctcccaactgtctctcattattttgtatctaagctgactccttttgcttttaggatatccctctctcatgtgtcttctctttgatgcctcctttatcacatttttatcacattacctccactgtgtcacttagcacccaaacatctacaacacctgcttatgacctaaaggatagacatgtaaacatcttagacattttagattcacagctaacttctcagtattatctgtcatgatcatccttctcaaattctccaacccatagctgtttgcccaactagctgtttgcccaactccatagctgttgctggttcacatgatattactcagagactcatctcacctggaatgcctcctctatgttcacctcatcttagctacaccttatccttctttttcaggctgaccagattctctcctcttctacaaagtgttcctttcacagttcaatccagagtgatttttcaacagtgaaatcttagcactaccagtctattttcctcttaaagcaatcaactgtattctgtactgtgatatttaatagagtgggggattttattcacctgaatttgagaaaagctgttttttaatgataagcagctagagcagggaactgaaagaacgtccctagggctctccagtgggaaacgtcatgtgctgtgagtgtgagaagaggagcaaagaactcaagtggagaaggagaaaaggatggaggaaaatacggtagtgaggagactttgtgggtagtgatagaagagctgccatgcagtgaaatcctagagtgaatctgaaatatcggaataagatacttaggaaattttataatgtactgtattatctaatcatctgtgctatttctacaagcaaattcctgaaagaacagcactacttttcaaggctatcaaaatgagatgtgtttctaatgcactgagacaaggtacaaggagatacaggtttctaaggcttataaagtttgtaaataattcttgcattttttacttgcatggatgtttaattcttttcagggattatgatgtcttctttatacttatgagaagaggtaatgcattttgctgctttataaaattaattctgtaaaacaggactaatcacatgataaatgctactagaaattctttttaataaaatatttttcaaagtcaaagttacttaagaaatacagttacaatgtgcaaaattgtagacatatttaatgaggcaaggagatggtcaacctaccagttttaactagggattgttttgttttttctggatttggaatcttaagggacatcttagctagaatacacagacaaatttttaattcatggcaagaaaaagtaaagagtgcttaatctgctacttcagaataaaagtaagaagaaagataggcagtagttgatagctgacttcaattctttctagtttttatggcatttttagtctagttctttcattcaaatatcaatgctattggaatctattctgggcttatttgtgcctaggatgaaagaacattcccccaaagtacaactagagcatcaagacccattttacttctaaaagccagacagtgcaaaacagtggatagtttcttatggtgggtaattttatgtaagaaaatttaaaatctttccatcttctcttgttaatggaacagtgaatcatggtctgagcgtctgaggaatagaaaggagtgggaggcaccagaatctattcctagatctaccccaattcatgcagtgtatttggacaaatttctaaatgcctctggtgttttggcatcatcagagcattgatttttaaattcgttcattcaatcttgcaacattagtgagtaaccataggtgcccacatataaggatctaaaggcatattttctagaaatccatagacttgaaagagataaatatataaataaatcattgcaattgattgtgactaggaatgtatcacagatgctccagttgcagaggtggaacaaaggaatatgtggggtaggaaggatcagggaagtgttccaagaggaggaaacccttgaatgtgcttgaattctatgtgggagtttactaggaagggttgagagagcaggactttaagtacaaggaacagtatgttcaaactcatggaaacatgaaaggatatttttgagagggagtgctgtaaataacgtgatagagtacattgcgggacagtgggcaatggaggacaagattggagaggaaaatagccaaatactggaggatcttacatcctatgcaaagagctta

SEQ ID NO: 49020 - DNA, 1061 bp, Bovine  19866881231045
tgaatagttaaataaataaggtaggacatacatcagatagtgataagtgctatgggggaaaaaaaaagagagaaaatgaagaagccaagaaggtgataaggactttagtgggggctttatgattttaaataggatagacaggaaaacaaccacttactaatgtgccatctgagcaaacacctgactacgtagaagcatattgtagatacctaggggaagggagaccttagaggattataggaatggcaaggagcccagtgtagctagagctgagagagtgatgagaagagccaagccataggcataaagtcagaaggacaaacaggagcctgaatggttaggactctttacaagtgattatgaagatttgggggcttatccattagttttataagttatagataatttacttctccaatcacataaactgggattctttatttgatgggaataaatggtctagccttctaaccaacttgtgaagtacaattgtgccgtttgttgaggcagctttacgatcataattccaggctggccctggagagcggaataccaagagagtaggctatacaatcttagccactgtaatagggcgaatcaaaaaaataaatctctcttctggttctccagagataaattctgtgcagcattttgaacaaagtgactttatctgaggtgaaaatgatcccacagagaaatcaattctctttagaaaagaatttatcattgggttagaaggataaacaagttacttctgaaaccttttgttaccaagtacatggaaagttaaagttatatgaaaacattcagcttgacacaagtataagacctaaatccattagaatagacatgcatggagacagaagtgattgtggagaacacatctcttgattgtacaccatcccagacacactgagtggagagtgatatgcatgtctgcaataggtgccacagaccaaagtccttgccaggtggagatcctcttacaggttagggatgcagacaacaatacctaaacaataaataagctgattgcagatagttataagtaggtatgaaag

SEQ ID NO: 49021 - DNA, 763 bp, Bovine  19866881247694
gagaggtatgaacacatacaagttttttttttttctaaaccaaacttgcattgaaaatgttatttagagctgcaaatgaacaattatattgaatgcattttaccaacactccatttcagatgtccttcaggaacccaaaactgaagatataatagcagtgcagaaagcaaaaatgttatatagatcttgtataaatgaaagtaagtgctctttattttattttactaagagtatgccaaaatatgtatagacttcataatatatttatattcattatttttaaaagctgctattgagagcagaggcggggaacctctacttagactgttgccagatatatatgattggccagtggcgctagaaaactgggagcaaaaatatggtaagacagtcttccctttaaaaaaattatttctgtataaaatctgttattattatacttcagtatcatattaatgcattaagcatctaatgatatacttcacctttcatttctttaggttcttcttggacagctgagaaatctattgcacaactgaattctaaatatggaaaaaaagtcattattaatttttttgttggcactgatgataaaaactctacgaatcatataattcatgtaagtttatatggccatcagccagagttatctttaatgtgataaaacattcacatgcattggtggtgttgatatttagaaaaaataaggcttattcttatttgacttgtaggaacaaagtggtaataaattcaaggacagata

SEQ ID NO: 49022 - DNA, 995 bp, Bovine  19866881310105
ccgactttgcactttctgagcttctctcttggaaccttctaggaaaaaacaatgatacagagcaggatcatctctaccaatgcctgcatacagaaatccaaaaaaattggatttctgaaactttggttcttgaaacttaaaccacttaagatgctgatgcttagaaagtcctaaagttagtataactttatggagatataagggaatttttttaaaaagcagtttgaaataaaagtacttaacaataagataaaccacttagctataaatgagaatgttataaaagaaacaaaaccacttaatgtgacttatactgatttaaattttgctattatagtgaaaagaggtacatggatacatttatttccaaggaggatattcaataaatcagtaactcagcctcaacattgcttttatagggaatataataaattggtcatgcaaagcactaaagcgtgggaccaacagagaaatattatacagttatttaagaacagacccttacctatctgatttctgcctgacgagtaaaatgcattgactacagctgctccgcttatccacctatagaaaacataagaacttgttacaaaagatactaaattatctgattcaatctgttcacaaccataaaagcattaccactattccaagatgaattttaattttctgtttgaaatatgatcaacaaattaaaattaattcactagatgagagcattcatttaaaaatatttccacttcttgaaaaatgagtgtacacaggtcttcaatctgttatttaatttgcatacatttttaatgatggcatctcacagtgcaaaacccattctaacacatctctttggaaactgcaatggattaaaattatattgaaatttatttagttctgtgttcctgatactaggtgactatgccaacaattctggaacagttgacaaaatatagaaataatgctaaaatttcaattcagcagatttcaggtgctaaaaagta

SEQ ID NO: 49023 - DNA, 1031 bp, Bovine  19866881325589
cctgcctgcagcgcaggaaatgtgatttcaatccctgggttgaaaagatcccctggagaagagaatgactatccgttccagtattcttgcctggagaatcccatagacaggggagcctggagagatgtagtcaatggggtcacatagagtcagacattcctactctttacattctctttcatcaacccaaatttcaaatgctattttgcgaagaatttctcttccctactaactttacatgtattctctgatgagcaaactcatttataaattgcctcttcctactgtaaacatcatcatctttttgttaatattatattaggtgaaactaaatgaacagttccctttttaaaacaaaagcatagcatctaataaattatcactactcctttgtcaattgtcaataggtggataggtttttcaggaaagggaattggagaaaacctagcaaacctccttgatgggagactctctaagagacttgttgggatttgtccgggtaatgaagctagtctatcagcatcattatgctatttcagagatgcagtgatgatagatgtaaatggggtagttgcagagactctctataattaattaccatcttcaagttaacttcagacatttattaacaacatttagatttcgtttgaacagtctatcacaatccttttaagtaggaggcttctaaagcctagcagttgttttcattagctgccaaataaatatgaccgtgaactctgcaagtcagagaagctagcagcacttctgcttccccaaatgttccctcaacttcaggaaaagcaacaaaattcaaaatggactacttttaattcagatctttatttcaaagagcattttaaatatcatctttacatttttcaataacatctaatcggtgcaatcagattgtgatttttacagtgtatgtataatgaacttcctacaagaatcctatgaggtcagtgtttgctttatctccagttaaccactaaagggccagaagctgcaaatgttccctttacacatctaca

SEQ ID NO: 49024 - DNA, 1311 bp, Bovine  19866881404179
aatgctaaaactatattgcatgtcatggattacatgagtttatgtaggttgtatgttttcgttttcctccctgtgttatgtagcctctaaaatgtgccccagtgatccctatctccaggcattcacacctttgtgtaatcctttcctcctgagtgtgggttagactcagtgattcccctctaatgaataaactaagcaaatgtggtgggatgatactcctgagattcagttcagttgctcagttgtgtctgactctttgcaactgcatggactgcagcacaccaggcttaggttacacaaaggctctaacttcatcttttctctctctctctctctctctctctgtctctctctctcttgctttgagtgaaaccagctgccctatggagtgagcttaccccacaagacaagatactgagggttccctgccaacagacagcaagaaactgaggccctcagttcaacaactgataacaaacgtaatcttgaaacaaccacacagataagcttgtaaagatatccccctccaggcgagcagagatctgcacagctcaaatgatgtgacaataccttgatcataccctcatggaggccttgagtcggaggtccagctaggttgcagccagattcctaacccacagaaactaagagatgacaaatactagctcttttaaactattaattgtggagcaatagatatcaaatgcacttcctctcaaaaatgaggaaactttgaattggatcttgaaagaaataaaaagtctgcttttgcaggaccatgagcaagtggggatgactgatcttgtcataatcttcctcgtgtctctgtttttcctcctgtatacttcagtagcccctctcctcagtccctccttccctggggcacagaaggttagagggagctgcagaggttcctcagaggaaaggttcagcatgtgaggtaaggttggggatgaggcatgagcaaaaccttctgctcacttctttcagagacattccatttttacgtaaatcacaaattgagattccacctaaaatttcatgtgaagaaagcatctcattgaaaaagcaagtctgaactctcataaagcacttatttagcacttgttctttctagaacaaagggctgggtgtttgaaaggatgagccttattcctgggcctgctacacagttcctggagtcccagtttcctcctgtctctgagatgaaattacctgtcccacctccatcacaagatcattgagagtcttatctgtggggaccctgcatgccatctgtttctgggccggaacactccagccagatatcat

SEQ ID NO: 49025 - DNA, 2223 bp, Bovine  19866881416953
tgtatctcaatgttggtatgtcatgaacttattttgattgacttctgtccttgagaactctttatccctcttttcttattacaaagccaccaacgtccagatcaaatggtacctcctctggaaagtctgcatgtcctatctcttctctctccccaccctcagccaatcaagtcatccttcttgcttcctggttctttgtatagatctctcttaataacattcaccctatcccatcagttataattcatacattctttgcttccactcaatcagtttctgaaaatcatgcaacatgtcttattaatatttaaagacttaatatttaaaaggtgcttaccacctgctaggcactcaatatgtatttatgttaataaaatgaataaaaataaattaattcacatagaatttaatgccatgattatgatagtactagccgttaacctacttctcatccatctttaaatgaattgaagatttttacagaatttaggagttttcatgatttttcactgagacaacaatcttaacaaaaatatagaagctatcttcatacatacatatatatattcaatacatatatatacatacatatatatgtacatacaattattctgctgaagatcataaacaatcaaacattataacaagcctccactaaagatttaaacagtactctggaatcatttatatacttcactgcattgtgtagatttttcatgttgtgtgcctttaagatatccttgaattggtatgtccatggtaaccagaaccatgtagagtctaagaaaatgttactgattctctctttgaatttcaagaagcacttctctgtgatgcttaaagcctaaattactagattttccttctttgaaagtctcttttaaagggacttttctaatatggaaattttttcttataaaacagcaaaaattacacaatggagatcttacatttatagtggaaaatctattagctgcaatcccaagcttcatatcttatttgttaaaaaatacctctcctagacttagcaaaattaccacatttaattacattgtattgtaaaaacaaatatgaagggaccttgatttaaaaaagggctatgggattcttttcacagcctatcatatagtctttcaagctcaaatatgccagccagagcagcaaagcctgaaagaataaaggtatgatttggaaggctctataaataaaaagttgagcatagtaaaactgagacattcattctttttactgattttacagagggaaatggacactatttcaaaagatttttatgcatccatagatgagagcattgaagtttgtcaccaaagaaaggatactcagaaccaaactggactgttgtgtatgatatttacacttgatattagtgaacacttaataaatgtcaagaactacttttcaccagggttaggtcaatccatcctcacaataaatattggtggtaaacagtattattatctccatctacagaagaagaaatggaagcacagagaggttagtaattctcccaaggtcacatttctagcagttagcagaactaggattaaaacttaggaagttgcatttccttttttaggagatcttctggaccaagggatcaagcccttgtctcctgcactggcaagcagattctttaccataacacagggagcccagcctggagctctgtgatgacctagggagtgggatgggggagagaggagggagccttacaagggaggggatgtatatataattatggtagattgcactgctataagcagaaaccaacacaacattgtaaagcaattttcctccaattaaaaaaaattttttttaattaaaaaaaaaaaacaaaactatgaagcctgctcctgatctcacattttatacttaggactgcacttccagggaatattcctgaaggagtttgatgccatgctagacagaacataggtctgaaacttaaggtaaatcttattattcatagatatgaggctctcatttcagaaggaaaaaaatgtcaaactttatttgaaaattgatagtaaggccaagttgtttgcaatggaggatacactttatagacagaaacaataattttattgatttcttgatcacagctactaagagaactgaataaaattttttggccactaggggcctggtgggctacagtccatggcaaagagtcagacacgggaaaatgcacgcagcaacaca

SEQ ID NO: 49026 - DNA, 1484 bp, Bovine  19866881513212
actgctgactgacactggaatttgatgccaaggaaattgatcaaatctccatccataaatattctatactactaataatgagttagcaggtattgattaattgttatgtaataagcactatgattaaatatcttaggtgcaaccaggtaaggatcagtattatccccacttttacaaatgaataagctcaggcacagagacattagtatatggttattcagtaagtagtaaagttgtatataaggagttctataggccaaagaaggaagagaagacgacttggtggaggcctgagtggactgggctaggggagttttaactctggcattcatgtttcacacacttaacaagtaataaataaatgaccactcatttccttttccatcagtatgcacagttaaactactgtgcattttgctcatgtgtatttccatttgcttttctgccatgcccccctttaaaatattaaacagacgaacaaaaattatgttttacttttaaacagctcttttctttcttccagctgtttgtgtcagtgctagctctcattaataaagctagatggattagttaaatgctaatgtcaaatggtaagtgctaggcactttttcccttgtgagatactgaaatgtgaagtctgggccagtagcaatgacggatattgttcttggaggaattaagacctctgaaaattgtgggaatgattaatggttacttcatcttctgtttatacggcagagtttgcacttcattattcttggctttttagatataggctatatttaaccaggctctttcaatttttaaaatgatactgttatgatatgtacattattctctcactaacttatgttgcctattgtgtgcaaggtgctacacaaggatctgggcataaagattaaataagttgatacaatccttatattttcatatgaatgtgagtctggaagctatatttaatcagaccctttcaatttttaaaataatactgacatcattttacaaatatctatttgattataataatgataactgtcaagggatgatgcagatttatgatatatcagggacactgattatatgaagatttgggaagggaagtgagtgccagattatgacaagtttggtagactttcagtcaatcttatgttgagagcaatgaaaagtcataaagtagtcatttaaaaataaaaacctataactacagaccaccggaatagtgaaatcatcagattgtagggccttgtcttagtgtggtagtctttgaaactacaaattagaaagttcagtatgtgtcagaacagcttggtcattgataaattactgcaatctaggaattcgaaaggaaaatacatttgatagaaggaacaaattttgaattgatgtgtcaaatcaataaccttagagtattcataagaaccccttacaggtaatccaggcctggtatcctagctagaaatgtagaatgggagccattcaaagga

SEQ ID NO: 49027 - DNA, 1242 bp, Bovine  19866881608016
ggataaagacacaggagtaacacccttgcagtagtcagtgaaatggaggagagtactcttgctagtgttttctcacctcattaacaaaaaagcatcccatagtgtataaaaaaatcttagagattgatattggaaaattcaaattaccatttctttgcagtcaagtagcaattccctgctgaatgcagatgaatttatatgatttgaaatacagttaattcaaaacactgcatgcttgtactttggaatcgttggtcccattaggtatgaactcagacatgtttattttcttcaaagtgaaacaagaattctgattactttttaataggaaaagaatggagttggcaggactatacataaaaacatccttttatccctgttaccttagtgattaagtgtttaatacagaaacagatgaaatttttattgaacagcagatccaggatagagatgctagttagacagcctcctaattgcagggtatccttggaagagagagccctctccccaggaaattgtttacttagcatttaataatggtcatggaataccagtatctaaatgttacttaaagatgtcctcttgaatttcaaattaataacagcttacattttgcttaggttcttgtttgataaaatattttcatttccctacaaattttttgtgtgatcctcttgagtcactgtgaatttaaatgtgccttttcactcagcttgacaggaaggatgcccctttcactgataatcagtagggttataaaaccccctggaaactgtgaaagggttaagtactcttcagctcttcttcatatttatcctgtgtggacatatatttgaagctcagaactacccattgatcccaaatgtgtggtatggccttcctaattgtagttgtctagttgctgttgtgtccaattttttttgctacctcatggactatagcccatcaggctcttccatccatgggatttcccaggcaagaatattagagtggattgccatttcctcctctaggggatcttcctgacccagggattgaaccctagtctcctgcattggcaagtggattctttaccactgagccaccaggaagcccttaccaaattgatgctgggacttgaaattttgagtaaattttgatgtgggacttgaaattttgaataaattttaagttgtttaaactgctgatagataataactaaatagcagtgggctgagatttatgaaagtgttattcaatttc

SEQ ID NO: 49028 - DNA, 989 bp, Bovine  19866881653065
ataataaagataatatctggaggagaattttaatatagagctctgtgaagcactgagtggattgagaatgatcgaattttatccaatagaataaaaacataaaataatatacagttattctaaacataattatatgggcttcccaggtggcacagttggtaaagaatctgcctgccaatgaatgagacacaaaagatgtgggtttgatccctgaattggagagatcccctggaagagaaaatggcaactcactctaatatccttgcctggaaaattccatggacagaggagcctggtgggctacagtccataggttcacaaagagtaggatacaactgagtgcagacacagtcattccaaatataactatacagtgtaaactatcattcattcattcattcaacatctgtttggatgtctaaggttcagacaatgtacattaatggtaaacagaacgttagagttcctgcctttaagaagcttatggtccagtcatttttcaaattatcttcttccttaaattcctctcaaaaacctctcatcccaagggattccatacagtaaatatttaatgcttaggatgagaatgtccttatgcacaacaaattgaccaagtcttaaattagtaatgaggtaatgcaggaggagccctgcatcttattttccctagacccatttgggctgttcatgcctgctcagttgtgtctgactttttgtgaccccgtggactataccctgccagactcctctgtccatgggattctccaggcaggaatactggagcaagttgtcatttccttcttcaagggatcttcccaacccaggtatcaaacccacaactcttgcgtctcctgcattggcaggcagattctttaccagctgagccaccaggtctccaaggtttcaatgacattatttcaatatctcagtatcttgaggatagaattctttaccgtctgagccagtaaagattctgcctgcaatgcagg

SEQ ID NO: 49029 - DNA, 1143 bp, Bovine  19866881734600
gagtatatagatagattgcctttaggacttttgggcagcctattatggactgatttatctgtgatctgctattttccagttatattaaagaagggaacggtttcatagcatctcatgccttttcacaattaattccaaattgatgaattatactttatttggggcaatcaactcaagtcagcttgattagtgacaaaagacattcaaagaagaaatgttaaatcagaactttcattccagagaacaaacaaaaaatgggaagattttcaggaaaaaaatagctgtatattttaatataaagttcccatcaattcttatagctttctttatttctcttcctccattcttctcttcctttcttctcatcacagaggctttgcacaggtctttttaactgatttttttagttgatgggggggagtaaaatatgaacaattcaaagggcaatcacatgccattttgaaaatggtgagcctgtccacaattggaaagggtttttataaatgttagaatgttcatgggcaaacagtgcctaaatgctcattttagtatatcaacaaaaataagactggttttaaaaaatttatagcaattaatggtaagcgtggaagtccagagtggcttcctatgacattatttctaattgtcactctccaacttttccagcagtaacactggaccatcacacagttaccttctatgacaccaaaatttaaagagggaaaagtgagcagaaagttttcgaaaggtaacatccttaaacttgtgagagttcactggaatcactttcagacaccaaaaagtgaattaatctttagaaaactccactgaccaagacaaagtgaaatttcctgagtttttgcttatcacctgaaattcaacaaacacaatattaatccattgttttttctcccaataataagttaatgaaatgagccagtacctgccaactgaacaagaaaactcggaggtttccagattaatcccttcctctcattcctcccatttctattggttccatagatttcctgttcattttgctttctcagcaccattaagatctgctccatctttttcattcccattgttttggtgtaagttttcattatctgcctgaattattgtaattttcttctaagttac

SEQ ID NO: 49030 - DNA, 784 bp, Bovine  19866881798274
ctatccaagtttttatgatttctgataagaaaagactttcaaaaagactagagagaccacaggacactactgcttacagatactactatttctaaaaggcaattgaatgaaaacttctaaatcactagagtcagatgttgccacagcttctatatcaaataaataagatatctgaaaaaattttatttcaacttctagacacacttttttgcttctttaacaaaagctaatttccttttcctttactcattcccactgggcaaatcctcattctgttcctaaaacccatcagtttcctgcctcagggcaaagcaccatttgacattactgggagctccaaacctggcccagagatgtggggacaggacacagggataagactgttaaccaggccatgaaatttaatattcataacctcagatttacttcccatgatattcaagcaaaggaatgaaaatagatcagcattcagtaaactctcgctattcttgctagctttatcattaatttatttagaaagatggttaacagaaatggtttggggatgggggaaaactatagaaacttgaactagagttacagatggaatcctgtttttctctaaagattagtctaacattttcaacatgtttttgcagatttttcattccttcctcatcaggtttaagcgctttgtaaactgtagttttgccaacccaaaacgttgtgacactgaaaatcagcttttctgaatcaaagcaaaattgtcacagactagtaatgaaactagtaagttacatcaatt

SEQ ID NO: 49031 - DNA, 924 bp, Bovine  19866880707184
ttgtttttttaaattatttactccctttggattccccttttcctggcttgattgcttggctcttttcatgtttcttactgtctaatacatgtgtataagatttcatgattattcaactcactaattagcactctttgggttttttgttcagagtcactaatgtacctaattgttcttgcttcctgcccatctctctccatccggcctgtggagacattaggagagatctgacagctgccttgtcaaaatccaggcgcatctcctccggtgttgccctggtgcattcatcttaataatccaggcaaagggagaacagagggtggtctgaattgtctttagtcttcataatcaccggcttatcttctaagcattcacaagttatccttttagcatttacttatatatacacaggcgatgagaaatctgccctctttctttctcagacaccaacaacaaccacttgtgattttatttgcaaaatccttcctctaagcacagatgcagtgggttccaaccagcgcagggataaagttttctgcactcccttcccaccagctctgctcccctttttagtctgaaatttataatccttgacagaaaagaccaaaatcaaatggaattttgagaacttctgatgtctatatgtccttccctttcattctgctggcaattgagctaaggccgcaggtgtgtttggccttgaacccctctgaggagccgcctatcatttcagtcttcagtgtttctgctgctcttcttgcaggctgctgacacctcttacttttaacaggtgcatttacagctgcatcttgctcaaggtctcccagtgatactgaacttctcaatctctctgctcctagtctctttatttctaaaatgatagagttggacctggggtctctaaggttctgtaaaaactggctg

SEQ ID NO: 49032 - DNA, 991 bp, Bovine  19866880869964
ccagaatactagagtgggtagccattcccttctccaggggatcttcccaacccagggatagaacccaggtctctcacattgcaggcggattctttaccatctgagccacaagggaagcccaagaatgctggagtgggtagcctatcccttctccagcggatcttcccaacccagaaattgaaccggggtctcctgcattgcaggtggattctttgccaactgagctaccaggaagccccctaatcaaatatactccaatataaaataaaaaattttaatttaattgtaattggaggataactgttttacaatgtggtttaagctgtacaacaatgtgaatcagccataatcatgcatatatctcctccctcttgaccctccctcccaccaccccctaaaataaaacttttttaaaaagcaattattttttaatgcttcaggactgttctattgttttgctattggatgctctactttcttgactgaatttccagtttgtaaaatgtttaagaggaaatgatgaacttagtctgcatgtgcatattttcatcttatcagtactcagcataaagcattataaaaagccaagtaaggagttggtgggcatacatctgatttattgaagtgaggagttctgtactgctattcaacttttagaatttgcccatttttcaagggaaatgagcatatttgacagaatctggtaatccaggaaatgctgaatatgatctattggtagttcaatccactattatgaaaaaatggtggtcaacagctttttattcttaatatttaaagcgcttcaataaaaactctgaaaccagaggttacagaaatatgtaagcatacttgggctagagttcataaaatcactaatcaatggagtctataaaccctctgaaaaccttaatttctcaagtcgttccaactgtcttacaattcagttgaataggcattaaggtctttgtttaaaagacacacacacacacac

SEQ ID NO: 49033 - DNA, 1820 bp, Bovine  19866880900981
tgttcactgtcagaccttgtattattagttggaaagtattcatttatgaatgagagatctgagagatgctgaactggaaatgacttaagccatgagaaatacttattttctcactcaacaagaaatccaaaagtctcggggtctgggatgggtttattcagcacagcataagcatagcttccactgttctgctctgtcatcctcagcatggtggcttttaccctcaggctcaattcctcttgaactccaggtgattgccatggctcagacgtcacatcctctctcataaccatgtagaaaaaaatacatcccttcttctgcaggaaaacctgcccatgaacccccttatatctcactggccagacgtatatcacaccagtcacaggcaaggagatagaagtactgtttaagtattcacgtcttgaaatcagagttctttcagcaagaaagaggaagcaagtgtgagtgtgtgtgggtgggtgtgtttggagtggccgctttcggtgtctgctagggtttatactcagcagtttactctgtctataagcctcaggcccctggtcactggaattattactgttctcaaaacagcatgtcattttttcatgcattctcctgccttaccaatgtgcctgcaacgccttcctgtgcttcaagaacacacgactcttcacagcctgttaggttccaagctgcttccaagacagcactactcagcctcagtccttcagcaggttttgtgtttatagtgcatttctcactttggtttctttctaccttcatttctacatttgacttctattccggtagactatagggccctatctccatcagttgtgtccttgccatggcctttgtgtgtcttaaatctagtgatacatattgaatgtaaattaatatcacacctgtttggtttgcagggctgtgctaccagcatagtctcccaagatggtgagcagaacggtcttatggggagagtggatgaaggtgtagatgaatttttcaccaagaaggtgaccaaaatggattccaagtgagttcagagtcatttcactaatcacaccatttaattcacatttaaattactaacagtgataattttaaacttagtatgtactaaggctcttatttcataagtatataagatagacatttgacagagggtttacttttctggtggtttgcaagaccaccatcaactgggaacttgttagaaacgtgaattctcaaacctgtagcccagacctactgaatgagaaactagaggtgggggctgacaacctgtgttttaataagccctccagggtatactgagacacactcaagttgaagaaccactgtaatatctaaatcagaccacaaaatgtatctccccaagagtttttttttttttttttcccctttagggctttattacattcatctggatgtatctcagacaatgagatacgtttggcaggctgaaattactaacagtggacccttgaacaatgcaggtttgaatggcttgggtccacttatttgtggatttgtttcaatagtagatacttcgatactacacgggccctggctggttgcatctgtggatgtggacaaactcggatactgaggactgactgtgaattaactccctcattattcagaggtcaactgtatttttaaattccccgtgtttataatttgatatgtctgggagcacacatcattcattgctaagtagcacagctttaccagagtcagaacgacaacagaattagtaaagaggcttcagatttagcctctaaaagttctgtctaattttctataccaagacagagttt

SEQ ID NO: 49034 - DNA, 924 bp, Bovine  19866880962898
tttgatctttcccaacccttggcattggatttctatgcattccttcatctgccttcaacaaatgccagcattatcccatgggccctacttgaatttctctgaggcagctacaggttgccccgtcagatgagtgtggggaggtaaacgaggtaactggacacatactcatgagtaacaccatccagctgactgtggggtactgctgcatgtacctgtgtcaaacctgcacttgactcatagagcaatttattcttgatgtatgcgattgcacactgtaattaacagagcacactaataatttgtataaattatatatatcagatcttgggtatggtttttacattctcccatggggaacttcttccttcccgacgtggaattgtacatttaaatttggtacggtgacctttgtgataccaccaccaagtgagttaagaaccgagtgaaaggcccatggctgattctaccatgctcccagattaatgtatatagttgattggaatgaggttttatgaatattcatgttttttgaaggcctttaatttctgttcttcatattagcttttaatgtgtgattaagagagaatactttgacacctgtaaaaaatcaaaatactactttttaagacatttcacaaatattcacttacattacaggctgaggtattttattcatatgtatatttataccaataaaatgattttacaagtggaaaaaaaatgaacatttttttgaatattttttatgaatattttttcatttttttatgaatatttcatttgttttctgatctgtaagtgtagaggaagcctgagtttccattctggtttatatagtctacctattagattttataacaatttttcttttaattaaacatgttacttaacatgtatagtttactttttagaaaataattatat

SEQ ID NO: 49035 - DNA, 1634 bp, Bovine  19866881087316
tgcatgaccaccatgaggaccatagggcaaggcatacccagtcctgagttgctttcattttctaggaacggtctggttgccatgacacagaaagaggcaggagtagatagagatctctttgtccttcactctaaggatgatccaagttagaagggcggtattttcttgattcaggtggctgggaggcaagcaggtagggccattcctgccataagcgcctgttgaatcctaggaccagaaacagggcctgtggtgtggagtatcttgttgagacaaggcagagctctcgataaagaaaacaaatacttgggcagaatttttaagccataaaaatagcatttttttccagttctaaaaattatgtctttaatcattgttttaacaaggctaatgaattggtaagtagccaaaaaccagagctaagtttggtgttgtttaatgaaaaagaacatttttgtgtagaaagtgcaagtcaatggattttgtgctgtaaagatttcctttctactctcagcctaacctttgggtctaagccacccaaagatactcccgttttcacagtggcaattaaccccaggtgcaaggatcggtattctaaagaaaatcaacttgctaagctctggaattcttaccctgaacctgtgagtggtacaaactcacagctgattggaaaagagtagagcattagatttacctttttaaattgtatgtacttccacctttcataatcaaagaaacaaatcatttttgtttatcattgacatctaccaccaaatatttcaagttgtgatccttgtgtagtgccactgggggaaaaaaaatatgaagtatgtactgtaaaggcagagaccttgaattggtgatgcttttctaaatgagcctgtacattttctttggcagcatttagatagatcttaagtgatccaggaagttgggacacaagaaaaactgttggatagaaaattctcagaagcatctaagtgcaagcctacaacctttccaccatggaattatacgttcctggcaggtagaaattgtgccacacatggagctagagcactgctgaatgtgactgctctgggagatgctgtaactttattacctacaatgtttgtttgtagcccccagccctgagatattccccccaggacattccaaagtaactgcctcatcaccagccttctgcttatagttaagagactgttaacagatcctggcattttctgtttgtgatgttcatgatatctactatatctatttttgaacatttctttaacagacatagtggagattctgggcatctctcactcttttttttttcccccctcttcctgggtatctttatgttgtcttccatttctccctggtccaaaagtcaattccatttcagtgtgtaagtctctttaaagaaccaatagttatcatcacactagggaaggttcagagctgtaaattaaacgttgaaatgcatattatagtttaaggattgtcttcatggagatggaagcaatgattgatctcttagaaggaatttcttcacttagtcaacacctattaaacttacactttgagggctgaaatagagattgaatgacttgatgaggcctgttgtctgtggggaggatgactgagag

SEQ ID NO: 49036 - DNA, 1527 bp, Bovine  19866881225522
tattaccatccatcatttggagatttggttgctacctagcccagtggtctggtgaaagaagagttaataattcatactgttcctcaagggctctttcttgctatttccctggctctctggtataagtcagagcctgtaccttctgtctaaattgaaggcaaaagccccaaactgcagcagtttctttgaaggccagtgtgtatgtgaggaaggtcattgaggttaggaagagaaagcaattaaaggctgtgagtctgggagcattcagacaaataaaaagccatctcatgtgtcaggtgaattgacaaagcctaaaatacttctgaagtattcacattctgaaaggagagtaatacttttcttccaaaatagattttgtgtttaaaaagtaaacaacctccttagagtacccgaggttctgccagcagagtgaacttggttgctgggactgttggtcacaccacatcagggcagtgatgaaacatcagaaaataccagatggtctttctagctgtttacaatagaaaaaaaatctcagtatctgaaattctctatgctggacatgagactgtgtagcctcttacataaatagcttcagcctcagacttcagtactaggatggtatttggagaatatgttggggagaatatcaggaagtcaggatttagggttttctggctggtgttaggcattaggtgatataatggtaagttaatgtgtgtgctcttgcttttaagtttttttttttttttttttgccatcctccttgagcagagaatggctttggaatctaatactgggggaaatgctcatccttgctttgttttaaacaacgctgaatgttattccttgtgctaaactacctagacagtgttgcctatgagagatgtatctgtagtgggagaatcatttcctccattcctaactatctgatcatctttgtgatttggtttccaaacaggactgttatatgggacaagaacaacattactgcacaaggctttcaagatatagctgttgctatggaaaagtaagttttacgtaggacttccttctagaaaagtagaaaagaaccagtggtgtttgtgttatcaacggggtaatacgagtgatgatagattaactcagacccggactgtccgagtctcagtctactgctcaccagccgtgacacctgggaatacggagactttgttctggtatgagtttcttcatccataaaatgagggcatagatgctcattctgccaaagtcgcagatatcatggtggaggcccactcagtgctcgccttgcttctttctccttgtggttttaaacctatttccacagggtcttgctttcttgcccagatgacaactctgaatccagtggtgagaaaaaagctgggctccagaaaataaagtcaaagtgaaagtcactcagttgtgtctgactctttgtgaccccatggactctacagtctgtggaattctccagaatactggagtgggtagccgttcccttctccaggggatcttcccaaccca

SEQ ID NO: 49037 - DNA, 828 bp, Bovine  19866881382939
cacatgccctttccatacttaatagccatattatccatctcaagcaaatcgtttcatttcccttagctcacattcttcagctataaaatggtgatcacatgaatagcttctctgcccatcttcacagatgttggaaggataaaatgtgcagaaacattttaaaaactctgaagtggtatttaagtaggtttttaagtgtaataattactaatgtttataaagtgttcatgaatatttttattattattcattttttgatgttatagcaattataattttacctaacactgaagcttttcttttaaaagaggaaaactagcagtatttagagtggtttgctactactgctcttttgatagagatattaaatgattcaccctgatttgaggtttctgatttgtgaaattgcacaggaattcaaacttgatatattttccggggacatctgtaactttgttagctaatacccaggaggtcagtctggtgtggcgtaaattggtgtgtacgtgtctttctatatcttaattgtgaatgcctctgctttaagtaaagccagcacactatcacacttcagatgccagcatgaagcctgggcagatctgccaagtgtctgatttaaagtgattgcctgagatcagtgatcacccagcagtcacaagtcatcccgggacagctctgaatccccagtctcaccctgggactctgttgtgtccctgccgtccgagagctcggagtcatatatagccacctttcagttttacggcgggcgcctccgggtctgcgtcctcatctctctctctctctccgctttatgctgcattgcaggcg

SEQ ID NO: 49038 - DNA, 1268 bp, Bovine  19866881476622
cgaacagtgaatttgtaactattcaagtacagtggcaagtcagagcatttcaataaggtaccatttgattggttaaaaaattgtttaaaaggcgagggatatacatataaaagaaataaccaaagcttcacaaccagactatattttcttaatttactccagcccaagtttgttttcatttatgtcaatggatgaattgttctcgctacatggtacatatggtttccattaagtttgtctttatccagatgtttttcattcctaccattaaatctcgaattttgaaactgcagaggcaggttgacattggtaaagaaagtctattacctgtgtgtttatggcagtgtttaaggctgatttttggaaatccttagccctgttcgcacattcttatatgctattttcaaagataaaaacagaatcacacttgaccttatcaacatagcatcaagggtggtgactttttccctcttgcacaaattaaaatgccactctgtgcttttgattttcacatagtgaggtgaagttgacagtagcctccttcctgtctgatcgaatcgtggatgaaattctggatgcactttcacactgccatcacaaattggtgagtgctgtggtcatttgtacgggacagcctggttcattctgtggtgatgcagggcagcctccagcgtgggaatgtggttgattttctacattttatttctttgtagctttatgggttaaaatcctagttttccttcttcttcttcattgtttccagctgttctagagcatgttagaatttctccagagggaatggcagggcaaagcagaagtgataatatccagaattgttgttcatgtataataaacacaggtcaaaaatttgatgggagatgatgttgggactgaagtctaaaactgagagcttcattttaaagattatagttgacccttgaacaacactgggagctaggggcagagaccctccttgtagtcaaaaatccatgtataacttatagttgactctccacatctgaggagtccaccaacccggattgtatagtattacactatttcttactgaaaaaaattctcacgtaagtaggcccgcatgtgtcaaaaccatgttgttcagggctcacctatgtatttatctgtgcttgttgttttctgatattatttgataacagaatattcttaaaaacatggcagaaatgaattgtccaaagagtgaaagaattaaatggacatattctagtgaatgataaccatcgagtgtctag

SEQ ID NO: 49039 - DNA, 1847 bp, Bovine  19866881508788
gcttatgttaaattttctcactttctccacatttcttaacttttcttacatattctctattttgttagtcaatgtgtactcccttcagacaacttgaatgagcacaccctgcatttgaaatgcagccataagattttattttgccagtatcttcccaagggtctatatttcttaactgtgaaaacaattaatggtatttagaaatcctctagaatatctgtaaaataaactgggttaatatcctttacatggcagttacactcaatattcttgcagtgagcaaaggactagctgtcattcgttacaagcaaatacaacttccacactgaagtgctctagaatctgtttcttttgcattggaaaatataaaatgtaggaaaagaagaaaactcagagaactctcccagcaaactgagttagtacttgccaaaatgcaacctacgcccctcaggcctcatttcctcagtaaacctgatatttaccagggaagtatttcacagttgaaaccctgggggaaatgaagaattttcaaggccaaaacaagcattctaaaagttaagtccagaagggaaaaataagtttccttatgttaaaacgttcagatcctatttattcacctaagattactctgggaataaatgttaggatcaaaaacaaggggtggggggcaggaggagagctgtcatttaaaaatacctaaaagagaccagttcagagaaaataccacctcttttcaaaggaggactttctccccacttcctgccttttttctcctccaggaagtttgctaagaaagttggctcttccggtagtttctttggcttttctgaactactatttttttctgaaagatggctcaaagagctatttgaaattattctcattcagaattcagaatgtgtaccactggccacaatacagggcttccctgctggctcagatggtaaagaatctgctgcaatgtgggagacccagcttggatccctgggttgggaagccttggagaagacacaggatgagcgaatattaaggataaaatctccctaattatgttgacaccaaaacagtcttgcacaaggaagctcggtgccaacgagcttagagcaaacagctagtagcaaacccaggccacaaatccaggcctgctagtccctttttttttttaattcactatagtaaaaacatacttttacaaaataatccattcactttagcttttgacagtataacattttactcaatttcagaaacagaggaaggattctttttttaagcaagtaaaatattgtactactagtgaaataaataagaatatagttatttaagaaactgaacattgattgtagtaaaaatgcatttttccctacatagttttaagaaaatcaaggtgctagaaagctttatcaatagacaaatggggattatttatttgtaacatgatgctcacttgtcaggtaaactgaaagaaaaaaaaagaaaatccctgcctacagtctgctgaaagtatcaaaaattgaatgtgaactcagtgaagaggaaattaatgagtaacatttaattaagatgctgtgatgaggatttgcttccattcatgcccgaagtccctgaagggaagggaacttgcaactcaaaacgactgaaagtaaagaaaacaagggagtggggaatagaaaaagcagggcatttgggagcctggacctcagggatagttgagaatgagaaaagcaggcaatgccacatgcaaataaggaagctgtgacgagcggagagcactggtgaccatgacaaggggtcagaaaggtcagcctcaagaaatgtgggggaatgtctatttacagaaaaatatt

SEQ ID NO: 49040 - DNA, 701 bp, Bovine  19866881786100
ttcgcaaaacaggcagtgaatttaaaaatattctcagggatgtgcctgaaagcaagcagagtgttgatgaagagggtatgaacattgaaaaggagaaaagtgcttattccattcatgtttttaaaaaaagtacttagacttctagggtttaaatttctaattcttgtcatattacttgttttccagattagtagaaaattggcatcataataccttcttgtaacagaaaaattttactgatctactttacaacttaaaaaatttttctttttaacctcaaggtaaagagaagtaatttaggattcttgagcttggagtaagagttttttttaaaattattctttgcacaaacttggtaaaataaacacagaaactactccatcttatttttgtggtgatagagacaatttaactctcattaaaaaaaattggtatgtctaagaattatgtgttaaatatgagtttaacaggaaaaatatgtgatggtgtttataaggttctaacagtaatccttaacttatagtaaaagtgggtattgaattccatggagaataggtataaatccattataaaaattgaatcaaatgagtaagatttccaagcagtataggtattgtgctgctttttttagatgctttgagaatagagccattcatttcattcactgcctgccaccatggggatttattgatatttacgat

SEQ ID NO: 49041 - DNA, 1002 bp, Bovine  19866880788823
ttctcattgtatgccaggtccagtctgagcgctaaacctgtgttcactctttgaagctttacaactacttgggaggtagatacgatcatagccattggatatttgaggtatggtgcactatcttattagattctcaaccttaaattagtcagttatgttcagttcctgtgctcctttcataaaagtgtttatgagaatgaaaaagtatatgacagtcttcacaaactgcaaagtgatattcaaacatgaagtcattgttttttcaacccagatcttataagcatgcacaggtgagatggtgcaggataagaaggcttgacccttggcgtgtattgacccaattgtgaacaaattggaaaacactagggcaaattgtgggggtctgtagagattattactgatgctcaccattgtcatctctggtacctagaacattgcctaacccataaagcaggcactacataaatatcagctgaagggagaaatgatggtacaaccaaacagaggaaaaaaggaaagaaaaattcacctgcaccagaccaggaaggacactctatccataagatattctgggtgttaataggttctccctgagcatgggatatagatcacagtataaaatgaggggaaatgcctgacctatttactattgcctcgaaagctggaacattttcatagtgcatcagaaaggcattttttaggacaacttggtaattcatctttattttcttgtatacacaatgcattctgtttaaaaagagatactaatgtatttacgttaaagcatatggatttacagcctgggataaaatatattcatagatagtgtaccttaatcctgtttagggaaaaggaagagtcaactggaatcagattagtattgatgaactgtcacttggattgacaaaagcagtacacaatacacttagcaaatacccaaatcgagctataaagctccacagattttggggttttgacacctgctttttttttttctttctt

SEQ ID NO: 49042 - DNA, 1762 bp, Bovine  19866880854910
atgttttgaaatattcttattcctatgagtttttaaaaattctattatcaagggaattattttctaaaatatcttaagctttaagtgtttttccttttgaaggttgatcttttctgcttgtaaattccattttagtcaataatcaaatttcatatatgtatttaatttcctgagcagttacttgaatacttgatacctaaaacattttctgatatagtatttggaatggacccaggatcaggctccataaacccatttacctccctccaaataagctaagcccagacaatcttactgtgttccttagtagaacaggaagccccttaagaagattaaattacttatggttatttgtcacctaaaatctcccatatcatttttgtcatagtctctcccttgaaggatctttttttttttttttagaagttatcctttgctgtgattttctagattctcactaccccaatatccaactcagttctgcccatccttgttatttccctgctgaagactttttcttcctttgctgtatcactcggtgcacaatagactctacaaaccagggaaatcatccatggttagccatggcttaagatggctttcaactaaagctgagatcctcatgagttggcactgtatttaattgcatccctctagttcctctgtttttctggagtaaaaacagtaaaaaaacagtcctattcatttcacaaacttttatgtagcatataatgcgggagactcgggttcatccctgggttgggaagatcccctggagaagggaatggcaacccactccagtattcttgctgggataattccacagacagaggaggccagcgggcatacagtccatggtcacaaagagtcaaacatgattgaacaactaacacttttactttttcaagaaccaatgtgaagtcaaattatatacattttacaatgtatattgtaaacctttcttaaacattttcttttttgatagacaactacataaattttaggacatgatatgaatatctttgcagacttagaggaaatagccacttttttgtaacccgtggttacaggttatataccaaagagtcatatttacacatatagagctacgtgttttactgcatgataatttctattgtttacagacataatgtcacttaattaagagaacattgtgagtgataatggggtctttggtgtttccatggttagttgccaattccttccccactttcagtatctttttctgctgtggaggatgagtgcttttcattttccatttttgtctagtggatactctatctgacaaaatcaaccatggatttcaaattcccatctgcagaatatttctatcttctaaatattttcctaggaagttatcagttggttgatcattttcagcctgcaaccacacagttacatctgcagctgaggaggatgttgaagactccatagcaacaccatctgttgttcacagaatgtttttctttctgataaagatgggaggtgttagttgtaattaggcaagttgcatgctggaatcagaagcttttttgatttaccaggatttctgcaccaataagtgcctctgaccctgtgggtattcataaatccagggagagttagaactaacattgttattgtcagttataatttttcacactagaacaggagtccgcaaagttcagaccccgggtcacatccagctggtggtttgtttttataaataaagttttattgagacacagccacacccattcat

SEQ ID NO: 49043 - DNA, 1567 bp, Bovine  19866880881988
cagtgcatcagagatgccatccctcccaataaaacaagcctaatcaattgctccagtgataggtcaggtcaactgaagagaaaaacaaagaagagcttcattcattcctattagtcaggaaaggctttatggcaagatgatagcttcatctgtccattgaagaatgggaaaataattggtagaaattatgaggaaaagtaaaatgtaagaatgcatggaatggaaaagcaaggaaatggtgaattctggatcaaagggtataacaacaaacaatgatggagacagtcctagactagggtgtctaagaactgggtgtcactgtgacttggtgaaccaaagaaacatggaaaaggagaaatgcatatcgtttctttctttcttcctttctcttcctctcttcatcctttccctgttctccttcattctttccatttcatgcttccatacattcaataactatcaaattttcaccatgggtcaagcattaaagataaaaaatacaaaacagaaaattctctgtccacttcccatggacaaacactttcaagagaaggagccaaaaaggacagacttgacagtgacattccgagagcaaaagtctaggacatcagagaagatccaggtgtgtgggtccatgtacagaggtacagagtagagtaagacagaggaaaggaaataagacgtcttgaactgatcagtgctaagaaaagaaatacaattctaaagtgttgggaatggtgaattttccaaaggaatgacactctgacatcatgagaactggggcagagatctggagagagagagaggatgagatggatatctcagctaaaaaacctcccaggcagcaagaatagtaagtgcaaaggacacttgtattactggggttgggggagggtactgcagaggttttggtgactatggtcaaggtcagaaaagatttgagggcatgaccctgttcaggtatggaaaataaggataatagctgaggctagaagggatactggaaggccaaaatggtaatgccatgaggaacatgtgtactcagtgagatgcccctccgtgacaactgtctctttctatctctgagttatttacttaattgaagcaaaggaaatgatgcaatgagaaagaaaaagtgaaatgttaagtgctacctttgtagagcatgataatccctgaatcccttcactaccacatgctgattcatgtcaatgtatggcaaaacccaccacaatactgtaaagtaattagcctccagttaaaataaagtaacttaaaaaaaaaaaaagcactgtgctcagttcttaaatttctatttgctaatacaggaccatctttagcccacaggggaaaagttctccagcaggtcctggtttgacccttagcttagagggaacggcaagccaagagaggaggctgagggagaggagatctaataatgatgttttatttcaaacgactcctccacaactgaagccacttgtctgcacaagcgaaccaataaaattgagtcataaacctccctccactgactctgggagcgggaatgcgtggtgatgtatctgtg

SEQ ID NO: 49044 - DNA, 1177 bp, Bovine  19866880946325
ctcagcagggatttctgttttagagaaagatattttatgggactacaagaaggtttgttggaacttcccaatatccttgaactgcaagcagcagcaattttagacactgttaattcagtgaacttaagaaaagaaaagaaaggaaacccacacaattgtcagtactaaatgaactgagaagtagtatgaaaaagtatgttggactcaattctttctatattctgtttttactgctaaggaatacttcagacttcagtgttgttaaatgccattgagtagaatggaaccaacagaatatagcatttgtttagatatgtatatgtttttgtgttatattgtggtggaagagtacattgaacaaagcaagtgagacttttaagatgctattgaacagcaaggttatttcccagatgcagtgtaaccctttagaacccacttgaaacctgtaggtttagaacccacttaaaacccagttaaaacccacttaaaacctgaccttggatggatgtaagacaggctgcctggctttgctggtcagtcagatagagtcatctggacaaatcaagtcacaaaaccaatcccatttcagtaattcaagggagaagaggaaaagatggagaagggtcttccttgaccagtgctgttgttggtgcaagtgttctctgaacttgacttttgtcatggggactttatttcaggaggattttgtagggatctctcactaactcttgccttgatactgacaattgcctcttcctggctggtggccatggttgtctacatatgtgtatttagatttttgtatttgtctctttggcatccatttatcacagaactaataatatagtaactatagttctttttttttttttctgttcttgacggtctgacatttaggggccttgcagacacaggaaaagactgttcccccagggctatttatggacccttgaacaacacagaggctaagggtgccaacccctctccagatgaacatctgcatataactttagtcggccctccctacctatggctctgcatctgcagattcaacaattgtgaatcatatagtactatggtatgtatttattgaaaaaagagccatgtatacgtgggcatgtgcagttacagttcaaagtcatgttgttcaaggatcagctgtaatttacagtggtaa

SEQ ID NO: 49045 - DNA, 644 bp, Bovine  19866881236525
caaaagactctagatagctgactgttctatatgagatatggttactagtcttttagccagactattcagagtctttggagagtgcccaaggtgtgcccattgtcctgaaaactgaataggtgggtgtggttatccatggaagaacataagcaattgtcctgagcccctggttaagctactgtatctaagggacattattttcttagtattattattatcttctactgcttattcttactcaactattcaactaaaataactgatttatttacataagtttcttactatattcattcattcttatttccattttttattctgttcctctttctttgctttacacatgtagaaactaaagcttaaagagaaaaataaacctggatagggtcactcagatcctgaatatcagtgaagattcacaacccaggtatgttagattctactatgaaatatgcatccagactccaatctcccaagagcttgtgcagtctgatgactcaaaaagacaaacttctcattaagctgaaaatgaaattgcctaaacttctcgttccacaccatatggttgaatcccagatgacaggaagctcatttctgcaacacactaggctcatttcactgagtaggatgtgagacttgtgggg

SEQ ID NO: 49046 - DNA, 889 bp, Bovine  19866881810155
ttcttctgtattaatgtgtctctcatactgcagcttgtattgttacttaaatttttgtgtgtttaagtcttgtctcctcaattagcctgaaagttccctgaggtcagggactatgacttattcttctctgcagccccaagagtaccatttctgtgtgtgtgtcccaaagtcatgtccaactctttgtgaccccacgggatttccaaggcaagaatactggattgggttgccattcccttctctagggggtcttcctgacccagggattgaacccacatctcctgtatttcctgccttggcaggcagattctttatcattgagctacctgggaaaccctcacagtaccatttagtacattgttgatgaaatctattgaaggaactctctcatgtgctgagttctccttcataatgtaatgacttcataatcttcataaacttgaagttctgtgtcttttcaaggcacagtgatagattccccaaggggacttagtaagaagtggtggatcagggtcagactgctttggcttatataacagctccgttactcattagctatctgacttcagcaacgtatttaaacctctccaaagctagtttccttcagatactacagtgctaataattgtgcctgtgtcccaaatttggtttatgaattgagtaagttaacacatgtaaattggttggaagaggccctcgtgtttggtaaatgatcaataaatggttgctgctataattgttactattctcaatgcccttcagccaaagaccaccaagaacacacttgtagttggtcaggttgggtttattactcattgcaattagggagaacacacaccatgaggaacagggatcatctcaggagacagcatagaaagaattgtaggaa

SEQ ID NO: 49047 - DNA, 2677 bp, Bovine  19866880568506
tgcattgtgtattgttttgtttatttttatgtggtcttaccccaaagttgatttgctgtgaagatgatatttttaagctcctggcaccaacttcttctgaggtcttagatgccccaatcttggagaacttggttgttgtgtactcaaaaatcaattaagagtagtgtctgcatgagaaaacgacattcttaccacttagttaagaaaagaaacttgatatttacccatattttatgttaccaatagtgagtgttatacacacttgggtgtttaatacagagagagatttcctttgggaagcttatctttaaatcaatatgatatgaattttctcaaagccctgggagaccctaaatcaaagtaaagaagccactttttagagcagttaaacccaccacacagtcccatgaaggcagaaagatactgaacatttaagaatgttagaacacatgtgtagagtgcctcactcagaacttgtatacagaagaactaataggttttgtctataataagcattaataacattaaaatacacatatacatgaaaatatctaagatttacagtgttgactttgttgctattactgaccagggttcttgccttccttaatgaataaaaactgataagaggtcagacaagaaggttccagcctgtctcattgctaggcactattcttggtgtctcttgtgcattatcatattttatccctacttacagataagaaaactaagagaaaacttcagtcctttttcagagattgaaaaagcagaaattatcaggaacctaagtccagaatgcagactcctaaacatatagggtcctactgctatgtagcttattttgtatagttggaaaaacagatatgtaaataattaaatctcagattagtaattcactaccttggtcctctctgaggcccagtgttattatacatagaacagacttcaaaatatacattgggggatttccctggtggtctggtggctaagactcctccttcccgtctaggtgatgcaggtttgatcccagatctgggaactaagatcccacatgccatgagaaaagtccatgctaagaacccaggcagctaaataaatattaaatatatatataggtagcaactgctggtgaagattaaattacactctacattatgcctcacctcaaatattcaatagatgctataatggaaagaatgaataaccaagcactgtgaaagcactgaaatcttgactcatttttttttcaacttgttttaaattgttggaacacgaacatttaatactgaatattttcaggaattccctggtagtacagtggtttaagactgtttctactgcaaggggcacgggttcaacccctagtcagggaattaggatcccacatatcaggcagcacagccagaaaacaaacaaacaaaattattggcctagagaagagtgatgactccatgctagcaatgtttaaagtattctatttttctattaaacagtactaaggaatgagtgaccattttagcttttttcatcttcttgctacatatcttattgaaagctcaaaaatattttattaaaaccaccatatatatatggtgtgtttcagtggttcgcttttcgtaacacaatccaccaaagataaaaggtatgttatgttctgcattaacagaccctctttgatcaacatatacttttcaattactgaacctgtttaatgccttcatataacttaattcaatttgtaaatacatttgtttcttctttcctgttttatcttctgccttcccctcaataatataagcaaggcccttacttttggtaattagtgatgactgtgaataactataatgccaatagatgactgagtgaacatgattccaagggaacagaagaatgaaagtcatgcacagtatgtcatttccaaatatatactgaataattaccttgagccagaaatttacaattaccttcattggcatgtttactcacaaaagcaagccattgatttgcttgcttcaaaatcaagctctgaatttggtttgattataaagctttgcatctcctacccacagaaggcaactagtattttgtgaaaatacattcagcaacaaaaaaagaacaaatatttcattcagtgactgtaaaatagatgatttatcttaatgtatttaggatcgcgtgctacgtgctaagttgcttcagtcgtgtctgactcgtggcgaccctatggactgtagcctgccaagctctcctgtccatggaattctcaagcaagaatactggagtgagttgccatgccctcctccaggtcaaagacaacatttggaaacaaacaacaaatagcctagtgaataacacatccattaaatcacttcaaatttttgtttggtgtttctaatttcttttttaataaaaaattggtaaggaagttgggagtggggtaccttctttaaatagattttttcccatttgcttctaaaatcaattacacgcaccacttataagtgaaaacagctgattacttaaacgccaactgagtaagcttttacttaaatgccaagtgaagaatgcaaatttaaaaacagtatttgcaactattcaaataccaaaatggaatcaatttaaaccacaaaaaggagatgtgttttggagttgaatgtcatatcagcaatgtgatcat

SEQ ID NO: 49048 - DNA, 1629 bp, Bovine  19866880606129
tcaatcctgtggctccaactgggcatcttccttcaaactataaacttccttcagcttaaatttaaattaacttcatcaggaaagtaggtgaagaaaaatattacgtttcaactgtaagtttggaagggattctgttgttgtgcccctttgcgaattctgtaatggcaaaactgccttgatgcaaacaacccttcttgtaacacaggtgcatgatacacatggtttaggaaaaggaaaccagttatactctgagacccatgtgtaatgaagtaatgtctctaaaattaccattgacattctaccttctttggtggcaagtcttgcaaaagcaacagctaaatgaataaacttgttacttcaatttgtgaaggattataactggtacatctactcatgagggcctcagtgtttcataaattgagagttgccttctaaattaattaaagaagaccaagtaggagaaacacagatctagtcaacttgattgtagagccttgggatgtagcaagtctctagaagttaaatgtcatagaacggactcttttaaaaaaatgcaaaccgatcttctagagagtcaattaatttggttatctatcatggtttgggtgagtgaggcactgaaaaacagcttattcttactaagaaagaattttataaatatgtcatacttaacttgacaattgtatgcaagaacttttagtataataaaatataattcatttttaaaaattatatgatatggatttgtgcttctaggaaaggtagatcaagccttccactgaagacaactaggaaatctagaccaaaaatttatgaaacttatacattccatatgtaaaatagatatccaataggaatttgctgtatgactagggagctcagacctggtgttctgtgacaacctagaggggtgggatggcatgggagtggggaaggaggttcaagagggaagggacatatgtatacctatggctgattcatggtgatgtatggcagaaatcaaccacaatattataaaataattatcttcaaattaaaaataatttttttaatttccattaccataataaaaatgtgggttctgcagtcagagagtttacaaatgagtacagaaatcactctaagtcactagcaataataaagtgtgaacaagctgtaacagaataacaggagtcctaaaccttgtctgagatggggagaagatgtcaggaaagacctctcctggaggaacgcgtgtttaagctgaagccaaatgagagtctaatctgctgtgaaggagaacctgggaataattcaggagacccacattcaaccacacctgctagatgcatgagagtaggatacgaaaagaggaagttaggaaaaaacacattattttttactggctagggatgtgaccctgaacaagtatgtggaaaccctgatcctggtgaactcatgtgagcagaaagtaatattttcttcttggaggataaacagtttaagccatctagacgtacatttatcaaactgtattccaaggacaactagtctcatagattaacctacatcaaaaaggtatgtggtcaactgcctttgaaagactctgaacattattaccacctcttcaagaatcacaaatcatgctat

SEQ ID NO: 49049 - DNA, 1365 bp, Bovine  19866880636464
ttgagtaaactccaggagtcggtgatggacagggaggcccggcgtgctgcagtccgtggggtcgcagagtcagacacgactgggtgactgaacaacaacttgcctgtggtctcgtgacagatgaatataacagatgaaagggctgagtcctcttaggtctatcatttattagcagtatgatgttggataatttacctaacctctttgagctcataatagagatactcatcgtgcagacttcatagttattatgaaacaaaataatgtatgtgagatgcttcacacaatggttggtacttgttaagtaccaattaaagacttattgaggtaagtctttcagaatctgtttgctgttaacgacctttagtcctttgatccatatattaccatcttatcaacttttccccatcttcatttctttcgcaacccaataacattcagtatgtgagcagttactgcttttcctcaaagctgcttaatgggacgtgtatcagataggtgaatatttactttacaacctgagtggtagttttgattctccaagtcttgaaaaataatacaaaaaaagcattaaaaatagtggtatagcatttaagattaagcattgtgcttttaatatgatagtgtttcaacttgatttttgaaaagagggcttgagataatttaagtgctacttttagtagtgcataaaattattcctttgagttccagagctattgggcataaatttaagtagattatgacttaagaagaaaaacttgcttttatccatatcatgtaactagttgggctttcagattgtttttgtgggtctgttacttcacataaacaatgctagatcaaaaaataatcataaaaagtctgtttcatgttatttttgagttctatcttcttgtgagtctccattttcctatttctcattatcatgactttaagttgtgggcatttcaggtcagggctcagggaatgttaccagtgcttttcatcctttttcaaaaggatgtcatttggaagagaaaaggattggctacatcaaacaaaaagctggcctggcagtgactctatttgcaggattccacaccacagagggtgacttagactgtggtttcatgttttgtggtttggtagaaccaaaacagggtgttcagccattttagaaaaaaaagttctcagttggactgctgctaagtcacttcagtcgtgtccgactctgtgagaccccatggacggcagcccaccaggctccaccatccctgggattctccaggcaagaacactggagtgggttgccatttccttctccagtgcatgaaagtgaaaagtgaaaagtgaaagtgaaatcgctcaatcgtgtccgacccctca

SEQ ID NO: 49050 - DNA, 3397 bp, Bovine  19866880819975
aaacatactcttttttgttaccttgggaaaaagggtaaaaaaaaaaaaaaaatagtagtgtgctctctgttcctctacttagcatacttaacctttagaaattcagaatcttctttggaaagaaaaaaatcttgacttttagagacaccacagacctttttttttttttaggaaggagagattgatgatatagcagtttgaatttatgggagaaaatcaagacaaaaaagttggatcttgggctacagaaagcaaataattttccagaaaatttaatgatggcatctgtggaagttatagtctttgaaaatgttttaaaagagtgtgctcagtatgaaagataaaacctagagcttgttatacagagtgaagtaagtcagaaagagaaaaacaaaattcatacactaacgcctatatggaatctagagaaatggtgctgatgaacctgtctgcggggaagcagtagagacacagacatagagaacaagcttatggacacagtggggaaggacaaggtgcgataaactgagagaatagccctgaagcatatatactgctaagtcgcgtcagttgtgtccgactctgtgcgaccccatagacggcagcccaccaggctcccccatccctgggattctccacgcaagaacactggagtgggttgccgtttccttctccaatgcatgaaagtgaaaagtgaaagtgaagtcgctcagtcgtgtccgactctgtgcgaccccatggactgcagcaccaggctcctctgtccatgggattttccaggcaacagtactggagtggggtgccattgccttctccaacatatatactaccatatgtaaaatagatagctaacagcaaattgctgtataacagaaggagctcaacgtggtattctgtgacaacctccaggggtgggatgcagtagccggtgggagcaagtttcaagagggaggggacatatgtgtacttatggctgattcacactgttgtacggcagaaaccaacacagcactgtaaagcaattatcctccaattaaaaataaattaaaaaaagacccaattagaagatcctgtgtttgaaaagcaagatatactaaatgaataggtcagtctttaaagacactaatggattcttacggaatatggataaatttaatctatatacctttgttacagtgacatcaggtatttgaatttactttgcatatttttgatttaacctgatttgattttttcccccctaaatctcaacatatgtattacattctttggtatgtctttaatcttaaatttacaagcacgtggttattaactggcctttggtgtttggggaggaaatatttaaatggatttcattttttaagtggtttaatagttcatctccaaaatgtgtagcctatattttaggttcgttataaactttgcctttgtaaagaggaaaaaaaaatgctctgggttattcatcttttcttttcttttttttctaattttattttatttttaaactttacataattgtattagttttgccaaatatcaaaatgaatccgccacaggtatacatgtgttccccatcctgatattcatcttttcaattgagttcttttttagaaaaaaaaggaggaagcagtagctacttaaggacaagaagtatattcaaacatacacacacatacacagcatccatgacatttagaactggttaacttacattttacttgtgcatgatgtctgacttcagcctcctagttctaaacagtaaacattgacatttaagatgttagctcctccaagaacagcgctttccctcccttcctctttaattccaccttaacgcatctgcaaagacgaaaggaaaccagcccacattttagcccctcctaccaaggataagacttgaacttctctgtggtcccgggctaagaaaggatcccgacagaaaactagaggcgtaaaggagcccgaaggatctaactgtaactctgggaactgtaagcaatctatttactcttcccccacccccacccccgctagctccaggtctctctcccactctcgctaacttttagtttctaccttgcttggaaggaaggagggacggagggaagactaggagtcatcgctctctcgaaagtctgcatgtcctctgccttttgcaatgagacacagatcgggggaccttaatttccttctaacaaatgccagtttgctttccgggggctagatgcactgtggagtccgagataaggcgtttccttcttttacagcccggaaagaaagctaacgttcagaaccgcggcgaggtgactcgagctagagctccacgtgaggtggtggccaatacccatactcaagcaacctgctgtttgacagtcctgaggatctttagtgaaggaatttatcgattcatttaaggtttaattgataaacggtcatttcggttacttatgcaaagcgtacctgggtatttaatgtgtagcagtgttgtgcgaaaagacagacaacattgaaaaactgattgtacaatgactggccttctgattcgtccttctaagttattggacatgccaagagggcagagcttggaactagatgtggaaaagatttgctcaaataagaaagttaagttttgagtgtgaaactattttagtaatttcgtattgaaagcattccttaaaaaaagaataaaaaagccacttggatttgaaatgatagtggtttaacttatttaagtctcctatattgtactcattttagtcttagaaatgacctcaaaaagtaaaacaagaaatggtcttcaggttggttgatgacgtaagcacgtattcatctaagggaggtggagcacgctggaggcagaccatttgggtgtatgtcaatttcaagctatgatatttgcatgtataaccttttggattcaaagggaatttctgttttgttttatttctgtttgttgcacaaatttgaaactgtggcctaagagatgtttgcagggaagagtaatgaaacaaatcttgcttaagagttttaaaattatattccagatatctctaaaccttgccgatcaagttgaatattgggattaaacaacaggtatttggttctttcattgtgcaaaggaagagttaaattttcatttaagcaataattgtgaaatgcacagagaagtgtttaatctgcatttgctcaaaactgcttcacaaacttcctgtaggggaagcacatttcatgggacaagaaactaagaaatctatttaataattttccttttctcaattaaacatgaatgaaaaatatcttgaaagtgacttgcaatgttaatttctttttttttttttttttttacattttacatttatcagcttcttgctaacagtacctgataaagctcatccca

SEQ ID NO: 49051 - DNA, 1716 bp, Bovine  19866880846971
cgtatgttacagaaaagtattccccttgctcaatacagtacatcctagtattatacaaataaacacaaactcatacagacacactgaaaaagctataactcagaatgacccatggggcttatttcctgttagattctgtccctggttctgctctctaattctctttgaatacatttcagcaatgattcattttgtcagtctgccagtagtctttcctcctgagcgagtagcatgtacttcacgtacgttagcagaaacacaattgagaagttttgcccaggattaccttatttgcttcttaaaagtgtcagatttttttttcatattggtaatatgcctctctaagactacgtatcatatgacaaacagagccagttgtttagaacaccaaaggaatgtttctctagaaatgacttagccctgcatctggtcttgccctaatgtatttatgagattctaatcaaatcttttatttcattatttttttctcacctactccttgccacccctatctcctcctcaaagctcaagtctgaagtccatgaagagctgagctaacaatattagctaatatttcttgagtcacgtgtcagagattaaagtgctttgtacagattacttcattttatcctcacaactgccaaatcagacaagcagggaaagttattctttttacaaataaggaaattggacgcatacagggggtgaagctagaatctgaactcttggtattaactatcatgctataactctttggtgtcagttactcactcgtgtctgactctttgcgaccccatggactgcagcacgccaggcttccctgtccttcaccattttccggagattgctcaaactcatgtccattgagtaagtgatgccatcctgcaatctcatcctttgtcatccccttatccttctatcttcatctttaccagcatcagggtcttttctttctttttttaaaattaatttattttaattggaggctaattactttacaatattgtagtggtttttgccatatattaatatgaatcagccatgggttacatgtgttccccatcatgaaccccctacccacctccctccccatcccatccctcagggtcaccccagtgcaccagcccatcagggtcttttctaatgagttggctcttagcatcaggtggccaatatattggaggttcagcttcagcatcaatccttccaaagaatattcaggactgatttcctctaggattgactggtttgatctccttgctgtccaagagactctcaagagtcttctccaacaccacagttcaaaagcatcaattcttcggcgctcagcttttttatagtccaactctcacatccatacatgactattggaaaaaccatagctttgaatagacagaacttctttggcaaaggtctttaatatgctttttaatatgctgtctaggtttgtcatagctttccttgcaaacagcaaatgtcttttaatttcatggctacagtcaccatctgcaatgattttggagcccaagaaaataactgtttccattgtttccctatctacttgccatgaagtgatgggaccagatgccataatgttagttttttgaatcttgagttttaagccacctttttcactctcttctttcactttcatcaagaagctctttagattctctttgctttctgccataagggtggtgtcatctgcatatctga

SEQ ID NO: 49052 - DNA, 2194 bp, Bovine  19866880945202
caatggctttgcacaaagaggggtgctcttcctgggggagggctggcagctacaattctactaatgctgccatttcccgagcatctctgcgctggtcactgagtcatacgttatctctaacgcttatgaaatgttgccaggggagtttcagtagtctcttttttagagataagaaagctgaaactcagaaattttaggaacttgctcaagggcacccagttagttaatagttccagcatatatgtattacaagtcagcgaacacctatcaatcattcatatcgacctctttcactcttagaaatatcctgatttgtataacaaattgtatggtcatcctaagtaaacagcccacctagaatttgaaccctcatatatctgaatccaaaacccaaactttccccacccaatcccatcgcctctcattcctgatgatgcatttacagcaagctggctatgccagcacgaatgttcctatactcctgctcctttcactggtggggataactggggtctataaatgtggggagaagtcagaggccttcaaccactgctaaagagagtacaaaataggtaattcttgaaaagcatctgagcatgaatataaaaatcatgaacagaattattttagataaaataaaagcataattatccttacatatatatattttttaaatcatttggaaacaccatgaaaacctccctgagaaataaccacagaaatgtaacaactgaatccatccatggaatagagactggcaggtgcaatgttctgaatccacagagggatgttgaagcactgaaaaaatctcaaaataatgaatccaggaaaattaaagtcttactatgcaagtaaaacagtgaacattaggacaactttcagaactttttacatacatatgtgtacaatgcatacaaaaatgcatatcatatatagtgtatgtatataaatacatatattatatatacagaaaaaagaacgggaagagattgagaaggcaagaaaagcagacaagacaacatcaaaaggttattcttttacaactagcagatttctgaaataggaagtcaattatttttataggaaatactcatttccatagatttaatgaatgccctagtttaattgatattgattttaacaactagttttaaattcatttaattaaaggagtaaaatttgtgacccaccaatagtattatgaaggagaagtgacttaggaaatgcacccgtgttatgaaccttgtaatattattctgagagagcagaagagcttggagacaccagagtactcatcattcctgattaaatatttatatttgctctcatgagtttttccaccttacctaagcgattctgaaactatgtccatgcaggcaggtatctcacatgctcagtttatttaatcattttactgaaagtgtctaccttataagagtaattttgccataacagttatataccttgatttttcttctctcatattttgcttatcaaaggaaaaaaagggaaacaaaaatccaaagcttggtgtgattgttaagtaatctattttatgatgctagagaattctgttaaggtgattacactgcacgtaccttaacattttctaaaaatgaataataagaactgttcttacaggactatttttggagggccgtgaatggttcaatgttgtaaaatgacatccaacacctgtgtaaattcctatctgaatagtccttgaaagaaggcacattttcaagattactaaaatgccctttgaaacataaatattcactgtagtgtatttatatcaacatgatgccaacataagctattgataatttatttgatataaaagattagttgaatttctttgtaaatgtaggaaaaaatcatatgctgtttaaatattgttcatttcagttaatctgatgatatatcattccaacataattttattgtgtgtcttgtgttttttaaacctttgggagacccatagaaacaataagtacaaaaactactctattgaaaagctcaaaacttctacaaagatttcataatacaaaatgcttataaatatgctacatagtctttacctacttttaaggttttactatacattaaactcagacaaatatcatttttagaaagttatttcttttgttgacctaaaagtcagaacgaacaattagcaatctcgtcaaataaa

SEQ ID NO: 49053 - DNA, 1316 bp, Bovine  19866880989905
aaatagtaagtatataaagaaacttatctttaagggtattcataaataaatctataaaacaactttaatgtccaagagtaagctattagttacataggttagggctttccatactactgggtattaaccagctaatcaaaatgatgatgcactgtttaacacaaaattatccagaaggaaagcatattaaagtattaacagtggttaactgaagggtaagaattttgaaattttttcttcatatattttctagtctaacaggtgctatcttgttgacttgatacaatcaaatcaacatacaagttctttaccactggtaatcaaaaataaaaatcaagtctaaagtaaaacaaagatttaaaaattctttttggtagatggttaacatagaatacttatttaaaataacacaacctaatcaattacaagaaactagcactttttgatacatatcattttaatcagttaaatgagttctttaatgagttacaagaaaatagttttgaaaaggaacaatatttgaaattgggaaactacataaaaatgcctagaagtaactactatttctttatgaatttatagttcattttaggacatactaagagctaatcttaaactaaataaagtattgcatatatgattaaaaaccaataactaaatattatgaataaggtttttgtaagactcatccaaatatgcaaatccatgtatctaaatatatacaaaactgtgtataaattgtgtagaccaaaactgtgtatatcaaaaaattatatatataaagaatatataaaaagaaaaccacttcaaaaataccttatcttgttgtgctttaagttcttcatattgagtcttgtacctacgtccaattttcttgacttgagtaatagttttaaccttttcttgaatatcaattattttggcatctaactccttctggatattttccttttctgttcttactttatttaaatcttcctttagactctggattaagttctggttgttagtcaaagatgcatttgatctaagcaaaagagatgggataaaagagaaagactaaatacttgagacttttccaattttaaaaccttttaagttatatttttattgtgttgctttagtgtgtgttttatttagaaaactctaagaaaagcacacacacacacatccttcaaaagagaaatccttaacttgtgaacctgtggtactttagaaaaatgtgactgacttattacatgccatatatacccattttagagatgagaaaaactgagctataagttgttaagtaacatgcacacttttactctgca

SEQ ID NO: 49054 - DNA, 1555 bp, Bovine  19866881048872
cttgttttctttgctcttcaattcaacttctatctcactcatttaaaaacatattcatggttatctgctcaagctctgtatcacaggtggattctaggatggtatctgagaacttggcagaggtaaggaacatgaagcagtctttatgaattgactagtaccaacctctgggtggaaaaccaggagtgagtcctacttctgatactagctttgtggctttaggcaaatttataaagctgtatgagtcttagcttcctcagttgtaaaatgcagataatacatgagattagaagacttttctcatgaggcttattgtgataatgagagaataatgtgaaatgccacatgaatataaggtggtattattatatgggtttgtaaatcttgatatatatgtatatatatatatacatacatatacacacacatatatatatacaccacgtctttagtttgagtattaaggactcaagcactaccattaagataaatgcaaatgaatatgactctacacttcacttattcaggcattattctagcacataaaaaaagtgactgagtgtgtgtgtgtgtgtgggtgtgtattttaattagctgttaggtgattttacattttaaaattctctcaccagtaagcattttgtaggactttagaaataggctggtgaaatgagcatttaggaacacttttacgaatcatcatgtcattcatcttcagagggttaaatgtcaactcaggtatggatgtccagggtcttccttaaatttgaaaatgataaaattattgttatgaactaaaacaaatgctccctagtggctcagagggtaaagcatctgcctccaatgcaggagacccgggttcgatccctgggtcaggaagatcccctggagaaggaaatggcaacccactccagtgttcttgcctggagaatcccagggacggggaagcctggtgggctgctgtctctggggtcgcagagtcggacacgactgaagcgacttagcagcagcagcagcagtgcagtaaaccagtggaattttccctcaattgtggttgttctcaagacaaaatttatacaaaatataatttaacagaaatgataaagcagaaaggaaaaagctgataaaaggaatcaaagaaaatgtcttacatatttgtttctttagtggctaagtgtatactaaaatacttagtaggtcattactgaagaataaatcataataacaaatagttaagatgagtatggatattttcccaattgggcttaattttacattaaaaaagattatgatagactataaaataatttagtttctcagctttaccacataatatttatcaaatgctcactaatctaacttcttagagttttcaacttgtaagaaaatacttttatcttccttaaatttcttagatgttaataagaaagctaattttaaaaataatatttttcattgtatgtgaactttggagtgagttttattgtggcatttgttagccatggagcagggagacactggacttctcctatagacataataaaaacttccattt

SEQ ID NO: 49055 - DNA, 1737 bp, Bovine  19866881050347
aaaaaattttagaaaattcaaataccccctgaaagataaaaaaaccacctttcacaaatttttttaaaaagaaaaaacagaaacctcgttattaaaatgagagatacttttgaaaatagtagttgaaaacagtttaatttacttattgtttcttactactgatattaatggttagtctatcattagtcttaaaatatacattaataactaaaatatttcaatgctgatttttagatattttattagttgtctgaatacaaaggaaaaacaggtgttttttttttttttatattacaaaaatatacctgtaaatgttttgctactttaatgaatcaaatagatctccacttctcactgggttcacattacagttattaggtaggtcatatgctggttagttttgggccaagaggacttgcaatttgaaaagtaaagcagaagagcaacaaaacaaatgaactcctcacaagtcaacttatagatcccaatagtcaccatataagggtattggcaacagatgaactatcctggctttattaataaaatcactctcacacaggtatgtgcacaaataaacagagcctaccaaaagcatatctgaaggacaagcgtacctacacaccacatgcacacaccacactccactctagtttgctgtttttcgttgtttttatttccatcatattttcccctggtggtctcttctctctgccatggtaaagcagtaaactgaaaataacttatgctaaacaacctaccatggacggtgagcttggtgctcgtgctgcttgatcctgccacgttagctgccatgcacgtgtactgaccccgcgtcaccaggctgagcaaatgctatctgcagagcaccggagctgaggatgcgctggcggactgactccacaattacatgcccatctttatgccacatgatgtcaggtggtgggaggccatctgccttacagggtagcatgatgggcttatccacaacagtgatgtattccttaggatgagggctaatgactggaggaactaaaagttacaaagtttaaacatcattttaaaagcctgaatgtactatttatgcaatgtggtcttattctagcaaaatgaagtcacgttgttaagaaacaaagccctgattttaccatatcatcaccaaagggttgctacagtttgtttttgctggaaaagaagattcattgaatctactgcagaaaattattctctacatagttaacaaatataaacgacaatcaaccttgagatttaaacatgtactcatgagggattgcatgtccagaaaactaagaatgtgttgataggggtattttctttaacatacatgtattatgtgattcattcatcagctccttaaactttaaaaatagatctcttcaaggtttggaaattattcacctgctcagacccttttattcatgcttttcccgcagtgcttatgatctcatatactgggaccatatttaacaatgtattattttaatgaataaagaagtgggatgttgaaaagaattacaattaatctttgaacagcacagggggtagggatgatgactctctgcactacagaaaatccaaatttaacttataatcggccttcagtatccttggcccctctgtatatgtggttttatgtctttagatttaaccaactttggcttgtgcagtaatgtagtatttactactgaataagtggacctgcatggtttgaatcgtatt

SEQ ID NO: 49056 - DNA, 1250 bp, Bovine  19866881088244
ctgcctgggttaaatcccgtttccgacctgttacactaatcttgggtgaattacttaactccaagtaagaaaatgcttttttaaaaactagatacaagtaatcaacaacaaaaaaatataatcatgaatgaaacacagcagaaaattctcctaattttttatatactactcaagttttgaaaacctatgagtactcggaaatcctagtctagtaacctgagaataaagtatttttattttgttagcaaacacaaatttaactatataaagagacaaacatgatgacctggtgggcgtgttctgtggcccactcttcatccaagttatccaatttggctttggaatgtgtggggctctcattctgttcttctttgggtggtgttcttgtggcaagaatcacataatccttttgtgaggaacacttgaaaacaaattagaaaagcttactagagggaaatgtcaccgaggaatgcaaagccttcatgatatgcaaaaactgagcaatattcatagcagcttaaattgtcaatacctgtattataatggaatgaatctacagggaaaccaatgttgatggacagccctacaatatttccctcacgtgttatctttcaatctatttaataccagctccttattcatttggcatcatgaatatgcatcatgcagtgggcctttaaaatggtttactagatgaccgaaagaactgcatcttaaaaacgtatttatatatttctggctgcgttgggtcttctctgctgcgcgtgggctttctctagctacatgcacaggcttctctcactgtgtagcacgagctccagagcagaggctcagcagtcatggcacacaggtttagttgctctgtgacatgtgcgatcttccgggaccagggatcaaacccctgccccttgcattggcaggcggattcttaaccactggaccaccaaggcaggcccataaacagcacatacactaaaagatgacatgcttggtcaattttctagttattttatttattttctaagtaatctcaacagatgagataattcaacaaatataaaatccctggaaaataaagcaagaaatgaccttgtgcatcttactttcactgaaacaatggtagtggggaacttgctcatagggtccacagaaaaaccaagtgggtgtaggacagataaccgaagtgttatattagatggatgttcctcagttttaacagcaattaaatgctaaccaaaaggggaaaccta

SEQ ID NO: 49057 - DNA, 1658 bp, Bovine  19866881099115
gacctttgttggcaaaataatgtctctgcttttcaatatgctatctaatttggtcctaacttttcttccaaggagtaagcgtcttttaatgtcatggctgcagtcaccactctgcagtgattttggagcccaaaaaaataaagtctgacactgtttccacagtttccccatctatttcccatgaagtgatgggaccagatgccatgatctttgttttctgaatgttgagttttaagccaactttttcactctccttatatatagtaatgttgtgtcatacaacattactgtatataaaatagataaccagcaagaatttactgtatagcacagggagctatactcagtattttgtaataattatatattacaatatataatatacaatatatattacaatattaaaatacacattacattaatatattataatatattagcaataattacataaatatatcaatatattacaatatgtaatatacaatatatatatacaatatacaatatacaatataattgcagtatataattatatttcctataaaggaaaataatctgaaaaaaagagcatatatatatatatattttgtggaggggactgcaatgggtctttgtttgtgctctaattgacgtgtatgggcttagttgccctggtggatatgagatcttagttccccaatcagggctcaaacccacagtccctgcattgcaaagcagattcttaaccactggtcaacggggaagtccccaaaagtatatatttcttgatgcaaatactttcaggaatggtaatcatggcttagtagtaaagaatccacctgcaatgcaggagatacaggagatatgggtacaatctctgggttgggaggttccctgaaggagaaaatggactgaaaaatcccatggaaagaggagcctggtggctacaatccaaagagtctcaaagagtcagacacgactgagcgactgagcacacgcaatccttcaaatacacttttatgtgactctataaatcagatagtatcctcatggagttgtttggccactagatagtaaaagaaaaaagtgtctactcgggtggtcaggaagccagatcagagaaagaggcaccgtgaatgaggaaaagtgcagaggggatcaggcgactggagacaggcttcccagtaatcttgcctgaaaccaaggctttacttttcttatacagattataaagaaagctgggcgccgaagaactgatgcttttgaactgtggtgttggagaagactcttgagagtcccttggactgcaaggacatccaaccagtccatcctaaaggaaatcagtcctgaatattcattggaaggactgatactgaagctgaaactccaatactcttatgtgtgtccaatgtggatattgtttaaaatacaacaaccaggggctagggagagtaggtaatcaagaggcaatggtatgaataaccttgtatgcccttcagaaaatgactgcgtaataacccgtgtccagccttgaaacagcatagttgattatgtttctgaatgctctattcaatcatttcaaaacttgtccatggttaaagagtaacaacattattatttcctttttcccaagggaattaccaaattgcaaaatcctgttatgaggacctaggcct

SEQ ID NO: 49058 - DNA, 887 bp, Bovine  19866881206067
atcttctcataataaatctaagaaaactgtcggttcaatcagatgttattattttacttaccttcctgtgactccacttgtgtagtgggcatcactgtggctgttggggtagtagtaggatttgtaacagttgcaggtgtaaccattgggcggatactagctctgggtgttgacttattcccagccatagccgcagctgtcactttacttggcgtagatacaacaggggttggcttgatattggctgttggtgggtctgacatgctggcacttatggaaagaaaaatgtgaaaataataattcacaaaaagtactacaaacattccttataaagtacaaatactccaaagaaagtaaagcacatacgcttactgaagtgaatgtccagtaattattaccttaatacacattcaaactgttttcctaacactgctttgagtagatttttggcagattaggaaaaaattaaagacagtaaatactattgttcagtcgctcagtcgtgtcagactgtttgcgaccccatggactgtagaacgtcaggcttacttagacagtaagtacaatttaatatttttttgttcactaaatattacgaaactcttattgaagaagttctgaatttaagcattagaaactgtgcaggaaatactctacagtggtgcatcctgacaaggcagaacgtattaactgttgattactgaacctcagtctcaccttagcctcttgctcttcaattatataattttataacgtaaactttatttctccccaaagatcactaggtcctccctgtattttaaaagaaaagcaggaaacagactgtaaacagactgcaaaagaacaaaactcacattcctctttcaccagagctggggagttgtttt

SEQ ID NO: 49059 - DNA, 718 bp, Bovine  19866881268784
caaagtcactcgagaatcaagtggagaacctgcagaaggtatgagtggaagagaagtgaaaggtgtatgttcataattgtttccttgttgaaaagctagaaaaatacaatggaatataattcagtcataaaggaattttgaaaaaagaaaaatgggttaaacactgatactttctctttttatatggaaatatataattttttttgaatgacttatgtatgcagataatacctaatcatcttgcaagtgtccttaacttgattaccattttatatttatactttcatttaatctaaacaaattaataagttttatgctttaagtctgtcggggatgtagttatattgatttggctgaattacatggttaatactttgtcttcctttaaaaaagactttatctgagaaagagatagaagcaagaagtctccaggaacagactctggagcttcaatctgaacttgcacgacttcgtcaggaccttcaagatagaaccacacaggaagagcaactccgacagcagataactgaaaaggaagaaaaaacaagaaaggccattgtagcagcaaaatcaaaaattgcacatttagctggtaagtttctgtatgctttatgattcgaatttgatggtgaaagttggttatttgatacagggttagaattaaatgggaaaggaaaagtaaataatactaaatgaccttctgtctatgtgtttgcat

SEQ ID NO: 49060 - DNA, 872 bp, Bovine  19866881284640
cgtgttctttccttatattttgttactttgttctgttccatattctatagtctgtgtattctcttatccacaaccccaccacctccaaactctttcccatatttattttcattgggtttatttccattttccatactccagtgactatagtaaattttgagatttgtaaggtaaccaaaaatgagaaggttgggaaatgctctattgcgtggtatccaggttaaagtagggcctaaacagcttgaccttacccatagcagtcatcttgtctgccctcagcttccccaagtgtaaaataacttcacaacttgcaagcttgaagagtaacaatatgtgtgaacaaacgggggtagccaacatttctgaaacagaggtctttgattaggggcagtgattgggacagacgaaaacaagccctactgtttggcatacggggattgacagataaactgcctcctcatttggaacatcctcatttctcatatcaacaatctctctcttgttgtttttggctcgcacttcaaggtttcttcaaacccaacatctgaagcaaccgccaacagaagagaggaactgcagaagcagcggttccaaagagcctgccaggcagacagtcaggttcagcctgtaggtctggtagttgtttctggtgcatatcaaaggatgcctatttttcatctctctaccatgttgccaaagaggtaataataacgaagtgtgaggctgtaaggaacagccctacatcaaatgcgtgtccttctttgatccaactgagccagatgatagtgatttttgctgtcaagagagccatggcagaaggccagccagtgcagcaacatttgagctgggccgtgtgtcaattaaggacagat

SEQ ID NO: 49061 - DNA, 960 bp, Bovine  19866881294291
ctagtgatgatttagttgcaggcgctaataaaaagttttactgtaatttaaaagggagactgaaaataacttggcaagtactgaatattcacctatattatttcaaacagtacgagtaaaacctaggctgttatataaatttaagtgttcttgctatagattacagggaatctggaaagagttagtattgctgaggtttttgtgcatggtgccagatgttaaaagctgcatagtattgaagttttaccactcctataaagcatttccccatagttttagtccacactgatggctcctcttcttgactgcctgaggcacacattgttactaacatttattccttgtggggcctctgaaatagctggacctttaaaatcttccagtttatctcctcatcaaatgcacttaaagttatattatgtgacatttgaatatatgctttttcttaaagcttcttgtttttgagtgcgttattagttcttaagaagctaattggaaatatggaaagtatgatgagatctagataactgcactttaaaatctacctataatcagagcagagatacacaaaaggttccttttagtggctgaaagacccagggggtcagataaacttgcctataactgtgttaaaatctctacgtaatatgtcaatcagaatgggatgggtacagatcaacgtagaaacagggagacagctaagtcattatgggaaatgtttgcagtgcccatccaagttctgtctaaaagtgagggagcctccgctatctgagttagggttcacgtggtcctatatggttctgactagtgatgaaagagctgtagtctctagactctgagattttcccatctcattggtaagaacacatcgattgtgagattaacttaatcaaccaaatgctattcctgtttaatgcatctgaattactttctctatcttattcccaaactcagcaacca

SEQ ID NO: 49062 - DNA, 854 bp, Bovine  19866881302551
agattatggagtgtaaaatttttaaaaaaaagtacattatgaggcccttatttttcagagtgtgaataatgaaagtagatatacataaagaaatataataaggaagacacataaacactaacgtgggaggctggcagaaggaagagtaataattccagacggggaatttgcaagcatttctcaaaggagacaggatttaagctcagtctagaagactgagtgggatttaaagagttgtgacaaagggtgtcaggcagaggaaacaactttagcaaaagtaggaagatggagaaaatagagcatgttttgaaacaagtgtggctccatacctgtggcaagtcagaaagtgtaaagggggtgaaattcaagaaaaagccatgaaccaatatgagtttcgaaagccagactaggaaattatgaaatgcaatcactgaagttttctagccaggtagtaacatgatctttgagaagttaactcttggctttgtttaaaactacctcagttgaagttggaaagacctaaaatgttcaattcatttaaaaaaatgggtgcgtaaatggaagcattaggcaaaggggtgaattaaagagagttaaggaaagaaacttagaggatgtctgcatttaacatcaaaggggaaaacagagtcaaaagtgggagactgctttttataggtgcgaagtttagccttaagtaagcattagtcacttagtcatgtcctactctctttgatcccatagactatagctccccaagctcttctgtccatggaattctctaggcaagaatactggagtgggttgccatttccttttccaggggaccttcccaacccaaggattaaacctaggtt

SEQ ID NO: 49063 - DNA, 1947 bp, Bovine  19866881334022
tagtgtctaagccaaagcagatctgctttcttttccactgggttattaaatgtcttataaaataacgaattcattttaacatctttaagtgaaaaatgatgagcataaaatgttaccaagcgtcgtaacattcgtatgtcattgtgatataccaccaaaaactctatccactaacatctgtcagaattatgcatatgttggaaagggaaagaaatagaaacaacatttattccctgtttctgtaattttggttatcatgcagaacccaaatttgactcttagtattggcttaatttgttctttttcaagaagacttgattaccatttgcaagccatttgacacttttattttgaatcaagcatcactcaaactgagagaatgatctcaacacccactctattcagatacaaatattagaagtcaatgcatgatacaggaactacatgacagaagggtgacgacagtttgttaataatcattacctctaactctgtaccatttatgtattttgttcaatcacagggtactttagtgttcaaacagtatcatcctatgtcataagggcatttattattgagtgaggtgcactaatttttctcgggtttttatgcaaatgtgatcatttttacatcttatttcatggactcaattcacttttaattggcacgtcaacaggagagtaagtctaaatattctggaaaacagaaggaaaaatgctctgaactagatgaaaatttattgccatagatagatgtttacagaataattccttagacctgtgaaaatttttcaaattccttcataatcacaagttatgccttgaaaaacaatgagaaaaaattgatccacattgtaaaatagttcactgtaaaagaatgtttgaagataataataaagattaaaatataaaatgaaataaaataaaataaaatataaaatgaaacaattttatgagaatattaacattttattatgtcctgcaaaggatataaaatatttaaatgctatgaaaacaaacttcatccttgcttcattttttacatattctggaattttctagtaacactgagtttaatgcaaaatcataaaaattacaccattgaccatttctccatcatattaattccaaaatcatataaactgcataaacatgttaatactgaaaaaacatttattttttaaatgtttgcatatttattttattgaaatttcagtggttgaaacacactgcctcttactcaagaaaattaggaataggaaagcatggatttaaaatgctcttaccatggctgaattcttaatccaccgacgttctggaataggatttccagccagtagagcacaaggcaaagtaagctgctgtccttcaattacactggtcactggggggctgattccaatgagtggagcgactaaatcagagagaacacacagccgccatcagccctatttcactcaaaagaaaggcccattcttttatagaccgagatgactactaatgaagccattagaaaaccgagttttcaagaacaagatatttaaatgcacaaattagaagatagagatacaggacccttctaagcaaaagagactggcaagaggacaagtaatagtatagaagtaaagaaagctacatagaataggtctacagcttaaaggccagaaaagtcaagccaagaaatttgcaaaatattcaacagacagatggagagtgagtgaaagcaccgataaatagaaaagtagaatcatcagcaaatattcatctgggaacttattggacaagggacaattagaagggatgagattaggaggaggctgtcctaacagctcaggcaaacagaatgatagaaggcacagaggctttgtaaacgtatccctttctagaaattgatgaataaactcaacatgagtcaaagtaaaagccctagtaaagtaaaaaccaaagt

SEQ ID NO: 49064 - DNA, 828 bp, Bovine  19866881334251
gccccattctggatgctcttgtttagccatcacacactctgttgtgttcccgtagccaaatggtggcatacatcatcagaccaggcaccagaccaaagacttcctggcccacagcaaacttcaagtgttcaggaacatgaggcgggtagatcatttcgacctgagtatctttgactgtgggaggatacatctctccattaatcatctaaaaaagtatcagtaagaagaagtaagaaacaaattttcatcattagagatttggaacataggtgggtggttagtggtaatgaattcttaatatttaaatggaacaaacctgatatttcatttttccatccttgaaaaggcgcagcttatgctgtctctctaaagattcaccataaatgtgacttaagtccacctagaagattatggaaaatttttgatttgctactgaagttgttcttatgtaaaatgcctaggatgtatttattactagataatgtgatgatgtagtttgctttaaaattttcagtaacacattttttttcacagccacaaaataataaattaacttgcttatccactaaaaataaccccatagcttataaatctaaatgtctcctattagtgtctcatatggaacctgtataagaaattttcactctaattatatgatatttcttttaaaaagcagcagaaaatgttttgatataaaatacttattcattgaagctatgtcactgaaccccaagagataataatgctgcaaaaatctcaccttataatatttaaggcagcataatcaaggtaacaaattttttgaagacaacttttttgcagatccaa

SEQ ID NO: 49065 - DNA, 1290 bp, Bovine  19866881437834
catcgtgataaaccacccgtatagattactaactctaatctcttcacatgttaaagtcagatgttaacattttgttttcaaaaaattacagaatcttctgtatcaccttgaacgttcttcattcttccagaatcatattcacaaaaaattatgaccttcataaagtgagttcacacaccaactccttgaactctgtttacagtaatgaagccagatgatgtgagactgggggaaatcccatatcctttctgtggctgatgacttctttaatagtgccatttttttttttcttaccttagtcaatgtatgatataatgctcaactatagtacaccttcctaatctggctatgaagatgggtagcttactcagaaaaatggaaaagttgttttcagtctataattcttaaaatttagtcacaaaaacatggatcaaatattactattcagaagagaaattgcctgatactggagagcaaggattatctttgtgttcgtgcttgcaactactaccttttctactttaattaaagtggatgctacaggaacatttgtcaagttgaagatgagaggaatccaaatataaggaaacagtttcagagctttaactgaaaagttgagataaaattgagataaaaattaatctggcaagaaactatgctaaatacagaaatgacatgatactgctagtctccttaaaggaaaatgcttaataaacctttgaaaaataatttcagttcctctcgttaaaatgagagaagcaataccttccagctctagctgttaaaggactaaatgaggtagtggatataaagcacccagtgccgttctggcacctctgaggacttgactcaggttaattcctttctttcccttctttgtgaacctcctccataaggattttggagtaccctttttttttttttcctatgccacgtggcatgcaggattgaaactgtgccctctgcagtggaaacagagagttttaaccactggattcccagggaagtccaaaatacactcttcttgattgactaggacaaaatactaagcataatcatgttattaatgaatctaaccattttcaattttattttctctatgtttttaaaaacaggagttttgtagcagcatctctttgtccagtttgtatttattgggcacctactacatgccaggtcctaccagatcctgaagagatggctctgaacatgtccacaaaacctctgaacctcacgggggaagacaaaaatccatcaaataattatgcaaataattaattacaattatcc

SEQ ID NO: 49066 - DNA, 886 bp, Bovine  19866881480380
ctagaagtcataaataattgtagtaagttatttagtaggttctttgtttcataatttctataatcttgtgatttaatttaaataagtcagcctgttgacttctgataatgatgtattttgtgaagaggtgtcacatcattctttttacatttctgaagcttcaagcttagatgatatttctcttgtgtcaactccaaaacgctcaagtacatcacagacagcttccactcctgctccagtgattgagccagcagaggctatagaggctaaggctgcacttaaacaggtaaaatacccctaacttgacacctttatcttgagtcacgtttttgagaacatgtaataatttcatctaataatttctctaatatgtagctgcaggaaatttttgagaactacaaaaaagaaaaggcagataatgaaaaaatgcagaatgagcagcttgagaaacttcaggagcaagtcacagatttgcgatcacaaaataccaaaatctctacccagctagattttgcttctaaacggtaaattttcttttcaaaagttaagtctaaacataatacttggtattcagtggaatcaaattcaagagttaatttgtgacaatattactttttttggtggatacaggttgaaaagttacaaagggttcatttttcacttttgattaatgattcttgtgaatgttattaggggatccaggtaagttcatataaggagtgtttgtatttttccttccagaggttaaaggacatactgattccataggacttaattattttaattaaggaggataagagaagtatgagaaatttcattcagccttttctagtctaggtagaagagaagcaggcactagagttaatttgggaaaatgactttttgg

SEQ ID NO: 49067 - DNA, 848 bp, Bovine  19866881496286
atacacatgtctggcatccagtcctgcaggagatgatgataaagagtatttagtgagagtgcatggtaacgctggaaaatgtcctgcagtccatcatacacttatacctaattaaaaggcataatttatggaacatagggcagctatccaacacatcataaaactatgtttatatattaggaaatatgtattttgcaaatttgatttttatatttgactgatcatgtgctcatgggactagtttaatggatttttgagttatatgtctgttcctgcacaagtaattcatataaatttattttaaatcatagaatataaattggaataaaaatgaaaataaaaagtattcataatctcatctcacagaataagacctttttacatataaatattgtcacagaagtgtgatcatgtggcatacagtatttaactctttatctcagtggcatgttgaacatgttttcatgtcaaaaaaatatatatttttataacattacttttaagcgattgcatgatttccaattttatgaacatgccattacttacttaatacattccttatttttggctgtttctatattttcaccaacttaataagcagcactattatagacattcttgtataagtctgttggcctatttttaattattttgttttaataaatttctataagtccactttcttgattatatgcaagtatatgcatatgcatgtacatacacacacacacacacattcaagaccaaattaccttctagaaaagttgggccaattagactatggctggtcctactttgacatagagctggaaattactgttcaaagagaggaacatttaaagaactta

SEQ ID NO: 49068 - DNA, 1698 bp, Bovine  19866881515255
caaaaccaataccaaaacccaataagaccagtagtactatcaatattgtcttgtcttttgttgaagatctgtgcttgcatcatcttagttgagtcaagatcctctgaactaggcaccatttttaaggacacagtgattcaaaaagatagtaaagagcagaggcagaatgtgaatccagaaaagcacaactgcagagcccatgctctaggctagactgcttaagggatttaacatttttaacgtttactaaataaaacattctgtcaatggcaattacaacctacattgtatcaaaaaaaaaatcagtgtaatttttttctaaataatgttattatataatatgactcacaatgtaataaatataattccacaaaaactaagaaacatatgcttttctccacaggtcctcctattatcactcttgaaccagtagaaactattattaatgctggcagcaaagtcatcttgaattgtcaagcaactggagagcctcgtccaaccattacatggtcccgtcaagggcactctatcctctgggatgagagaattaatgtgttgtccaataactcattacatattgctgctgctcagaaagaagatacgtctgagtatgaatgcgttgctcgaaacttgatgggttctgtccttgtgagagtgcctgtcatagtccagggtgagtgtgatattcgtttaccctgatatattcttattaaacagtacctggggcaatctaaacaataaaaatcattaagcatcttagaccacagctcttgtacccttaagatacttctagattatagggataggacaaaaatcacattacaaactgatgagattaaaaacagtacagatgagagctgcagaataccaagttaataattcaaaatcccaaatggaattttgtttttaaaacttggttaaaattattctcaaaaatcagtgcatagttttgcttcaaagaatgatttatttccaaaaggtaaacagcatataaatgtcttcatcgctcactctttcaacagccatgcccaaatgagtcaggactggaaccaggaagaaactctagttaaccgctcagttcttcttggatgcttcggttttaattttacacggaagaagagcttccataaacaatgtctcagcctttctaggttcagcgctagacccagtgcatatcttccatgagatctgacttacagtgttggtgtttacaataacggagaccaagtacggtgttttatttgcagtgcccggtggcttttcccagtggtcggcctggagaccctgcagtgccacctgtggaaaggggatccagaagaggagtcgtctgtgcaacaacccctctccagccaacggggggaagccttgccagggatcagattcagaaatgcaaaactgtcaccagaagccatgtccaggtacacctctttattcaacagacaggcacgtggttcagtaggtaccctcttctgtcgcccaagtctggcttgtctcagtataagttctttctactgaaatgtctctgatcgtgttaacgtgtcgcctttggatagtggacgggaactggtcagaatggagtccctgggaagaatgcacgaggagctgtggacgcggcaaccgaaccaggaccagaacttgcaataatccatcagctcaacacggtgggcggccatgtgaagggactgccgtggaaatcat

SEQ ID NO: 49069 - DNA, 600 bp, Bovine  19866881551277
ggctactaagagacgttgattttgctgttgaagctcttcaatgtttctataagatactagatgctgtgatattacttcagatgaactacttatatcagcagagcttacttcctcatcacggattacatggttacccctcgcttcttcaagttccatcagaagcactctaatctaaaaaaaaaagttttcatatgttatcaaatagtattggttttgactttggaaatgtttagaagtgaaaattttcaaatgacaaggttactttacaaacacctttgatggagtattaaattatcttgaaaaaactaattttcaagcttatcattttagatattaagaactaaataaagaaaatcttaatcagaaacttatttctcatttctatgaaaagtatgtaatgaaaactgttattttttaaaaagaagtcaaattataattccagaggcatggttccttttttgtagaacaatgaccatataaaacacttggaaatacatacgcattgtgtctgtatgcttgcacctgcatgcttagatatgtattacgtagctgggcagaaggggagcagggaaatagatgctacttcattcatagaaattt

SEQ ID NO: 49070 - DNA, 992 bp, Bovine  19866881626134
acgaaacgtagggaaatgacatagcattctcgcacaggtcagcagggggtgtcacttcaccagccttcttgtcgtcctgtaagctcctatagttggagaagagatctttgaatgaacaaagcattccagtgaaattcacccaggacagctgtgactcttctcattttattcccttctaaaatgacaacccactccagtattcttgcctagagaatcctgtggacagagaagcttggtgggctgccatctatggggtcacacagagtcggacacaactgaagcgacttagcagcattaatctcatgtttccttatagttttcagaactatctttctagacttctgtagaaaattaatatattgctacataaataaattttgttcctggactcagttcctatctgtgtgtgggcagggtcgggggtggggggcgttcccaaaccaatgagcaattctcagatgccagcaaggtgtccaagaagtcaattcatttctggccctatacctaactggagattgaatcagattccactggaaaagagctcagttccaccataccctcctccacttcagatgtcagtcttgggtccaactggttacctgtgcttctgaccaattggtgataaatcaaaggttcctatcaccccatccttgggtttcattagcttgttagaatggctcacaggattcaagaaagtccattcactctctcaatcactgatttattacaaaggatattaaaggatatgagccagccagacaaagggaaacatagagtggtaaggaggtggggaaggggtcccacacaaagaggcgttgtccttgtggagcatggggcctgacactgtggtgcatggaaatgttcttataagaacttgttatgaccggataaggaatgggtgaggaacagatggatttcagagattttttaattttaattgttaaaaaaaaattttaaatgcttatttggagcctgttgcgaatagcaagaca

SEQ ID NO: 49071 - DNA, 1041 bp, Bovine  19866881855659
atgtgtgaatagtagatgttcctcatctctgctctatcaggactgtttaaaatgtgaatgatgaaatgtcatttgtgtttgcataatcttcactttctgttccttactcttcctttattatcaccccaaatctctgcctatttctagtctatttaactaaaatagctttttccctcattaataccgtgaactcactcaagaaaatgtttttcttattatcatctgactgtcttgataaaaacaactttgatcaaattctacactggaatccttagatcttttaaaaccagtcaggaaatagagagatgacataccataatctctgcaaaattccatatcttgaaagtacctaaggatacatagtataatgatgagaaattttatttttcctcaagatagttgatatttaatagtgatttctaagtttgttgtaaaatatcacaaagctttaatttctttcttaggtacccccaaaccaaccatcaaatggttgcggaatggtagagagctgacaggccaagagcctggtatttctatattagaagacggcacattgttggttattgcttctgttacaccatatgacaacggggagtatatttgtgtggcagtcaatgaagctggaaccacagaaagaagatataatctcaaagtccatggtaaatacagataaagtcatataactgaatatgtaacatgttcaaattcctttatatgtttttctttcagtgtagtatcatttaatatttacataaaaagacatgttatcaatttaaaaactagtagtctaacttcatgtattcatttgacttaaaatttcatataattttttattgtgattttacatcactgaaaattcaaacggtagaaaaagatacaaagtcaaaagtctcctggccctgagctaagcaatctactttatcctccctatgggcaaggaaagttgttagaggtgtgtgtgtgtttgtgtgtatcttcccagagatattttctgcaaaaatgaagaaatacgaatatatatttcatcctcttttttttttt

SEQ ID NO: 49072 - DNA, 1442 bp, Bovine  19866881909583
ctatgaagaacacctaaagcaataaaagtaaaccatcttgtgtatttggaattgaaggaaaatctaagataatttctaagagattgaatataaactcagtgtattatatgactgacataaaattccccttaagagaaatctattatgtcaatgatcgtcttttaaggtgtgtgtgtgtgtttatattactttggtaacttgaaaatgagtttaagtttttgcctctcattaatgtttatatttggaaaataacttacatcaaaatagagttacttcctaagaaaagagattccctaagctacctattcttgtttatatgttttcttctaacactaatctgacatctattccataatgatatgcctgtttcttcttgctttgactacatggaaagaatacttggttacatacagaggaactttgaaccagatgcttctctgtgcaaatggaaattgacaaaaggagaggttttcttcattaaagtttgtttttcactggcataaattattttaagggttttcaaaataccgttccaatttctagaacagagaaagtaaatggctggaagaataggattttgcctgtggttatgcctggcagtcacattgatttgtatccttttttgttatcaaagaataattaattttcttttgattcatgtaaactacttaggcagaaaatctgcttccattggctgcttgccaacaatctctgtactatgattcatttagttcttgcttgagaaacaggaacatttttccattctgcttgttttcacctattgcatttgctgtgtcatgtgctctactttggcacatcttcccagggaagatggttctggaaagaaataaggtgccaaagttctaacaagtcagttaatattgcttttgtctctatggtaggagaacgcagtaatcagtgtccccctgggtttgccttagacttggttggacccttttgtgctggtaagtacaacaataagtgatgcatttttgtttttcataatctgttcatgctatcattaacggacagttactgtcattttgatcgatatttattaatcacaatagtcctctaactgtctctttttacaggtgaggaaattgagatgtgaagaagttgagtgcctaagttcactcagctatcagatggcagagctagatttgaatttgagatagatgcaaagcccatgctgtttcagttagttccacaatcaagtgtgccaggaatcatgatcaagtccagggatagactgaacacaggaaccaaacactggactgtgtttggccacctgattgcacaaatgtgaaacagcagtaattcaagtctaagtcacctaaccctagaattgcccagctgtagcagagggctggattgtgggtggaggactgatgactaaacctgccctgtgccatccatgtgccagcgcagggagagtcaca

SEQ ID NO: 49073 - DNA, 707 bp, Bovine  19866882149256
acagaatacacaccctctgcagtagaagcgcagaaccctaaccactgaatcaccagggagttccaaaatctccttctggtactacaaggcagaaacaatgccttatgaactaaatccttcctaaggatgtttactgtaatggaaaaaatgagtaagtcatggtataattaaaaatgtaactcaaactgacatgcttacttcaagaaaaacaacacttacaaagaacatctgcttcactgtcagaaaattagaaaaatgaactgttacatattcacacactgagtagacagtgctagaaggcagaatgcaaagtccaatggcacttctgagtcacagacaattttgtcaatctcaaaagtaaatgctttgtacaaaatattttagtataatttaaccaagtctggcaataacaccgaaatttacatcttatttcaaaattgttatgatcttcaggtataaccctctccgaaagatacatgaaactgatgccatttagaatattacctattcatcttggaggtttaattttctgttcgtagtcaaggaaatctgaaaaaattaccttagaaaattaatgcatctacgaaaccagtatgtacctgcaatctgtggttacttgtgattagcctgaaacagtttctttattttatacagataaaataattttagaataaagtgatcctaaaactttacccagagaagaaagt

SEQ ID NO: 49074 - DNA, 606 bp, Bovine  19866882194102
tacaacttatcctaaacaaaataaaatgaaggaaaaccattttggtcaaccagagggaaaaaatggcaggtaccagtttaaaacacccatgaggctataaacttccttattctttgaattttaaaaaaaggctgaaatggagttcattctatgtttctgtaactgtttttaaaatggaaattggaaattcaataaaacatatgaaaagaatatacaacagtattggcaacgttacataatagtaccagggctgtcagtggaagcgttgctactaacagcagtattttctggattttgaccccccaaacctccattcacttaataatgctgtaactgaaagagtatcttgtttctattggtagaagtaaaaataaacagaaagacctttacatacctcagttcctacaggtataacacttttcagcttctttggaagaggcatttccactgtatcctcagaaatctggtctgatgcttccatggtgctatcttcttcctcttcacgtgtacgctttggcaaagacgaacttggggtagctgaaactgtgaaattatgtaacttaaatcttgaattacagcatgataacagctcaatttagagttaat

SEQ ID NO: 49075 - DNA, 707 bp, Bovine  19866882198893
ctgctttggtttctgccgttattgttccctgatagttccctaggttgtttaggaaaaaattaagctaagaatttttttttaatctatttgtatggttaaatatatgtaagttttcctatttctattaaaataccttttcataaacacaattgcataaacaagctcatggtgaaaaaaactgatttttcactgctcagtaggctcctatttttataaaacactgcttatttccatagaatgaagatgctggtgattatacatgtgtagctaccaacgaagctggggtggtggaacgcagcatgagtctgactttgcagagtaagctgcttaattacttaaacacttgactgaagaaatgtccatataattgttcatttaactttctagcaaatacaataatggtagctttcagagtctaatttagtttgctgctgctgatacagcaattgttatcaaccagaagactgatacaactttgcacaggtatttttgtctattttacctaacatatgcagttcaaatttgcagtggtttggtatcagagcttttgttgttgttcgcaatatattcagtcaaataccctttttatagctccctaccagtcttgtaaggagcttacaaagatgtcattttatggcactttaaaactaggtgttaaagactaatgtaaatgaactcaagagttctctggatcaattgctgtcaat

SEQ ID NO: 49076 - DNA, 2412 bp, Bovine  19866880365908
caggactgatttcctttaggatggactggttggatctccttgcagtccaagggactctcaagactcttctccaacaccacagttcaaaagcatcaattcttcggcgctcagctttcttcacagtccaactctcacattcatacataactactggaaaagccatagccttgaccagacggacctttgttggcaaagtaatgtctccgctttttaatatactatctaggttggtcataacttttcttccaaggagtaagcatcttttaatttcatggctgcagtcaccatctgcagtgattttggagtcccacccccccaaaataactcatgttaacaatcatatattgaattttacattgtaattatgttaccatttcataagtgcatatctgatcctgtcaactagaattttattcattgtaatagatatagttcattgagctcctactttgttccgttatctcaaatcctcataaaaacctcctgaaggtgggtgtagaagctgtcatcacctcacccaatctgccttgtcacttacttctagtgcatggccatggaatctccctggtgactctctttagaagttttactttctctcccctgtgaacatgggacatctaagaagtgcagtgagttaaagaatctaggagcagccttcaccaaaggtggaagggagttgcagatgtaagtaccctcagctcctcactcctcatggaggataactctgaggtgagtttaagatagtttctcacagttccccccggggatcaagcccctctcccttgcccacggtgattccctatctgatgacacaccctttatttgcttccttcccttccctgtctcacttccctctgtcatggagcctcttgggatcacctcccaaataacttataattcaattctagtcttagagtctgattctgggggaagctaacttagcaacagatattgctatccacacatgtaacagatgacaaaacggagattcagagaggttaagtaacttgaccgaagttctagagttaacagaggcagaggaaggatttaaatacagtctttctgtcccagcaactcaggtttggagctgatttactgtctgtattatcatactgtaatgctctgtgaacactcgacaaagaatctagtcaagtgactgtaaaaaccataaagatttcaagtcagtttagcttttctttccctaatatgatttatcacaatgttaaatgctgcatttatttatgtggctagatgattaaacgtttacctctctctctaaattgtatgatctatgagagcaaagatcgtacctattttggcttactgttgtttccctcagttcagttcagtttagtcgctcagtcgtgtccaactctttgtgaccacatgaattgcagcacgccaggcctccctgttcatcaccaattcctggagttaactcaaactaacgtccatcgagtcagtgatgccatccagccatctcatcctctgtcgtccccttctcctcctgcccccaatccctcccagcatcagagtcttttccaatgagtcaactcttcacatgaggtggccaaagtactggagtttcagcatcattccttccaaagaacacccaggactgatctcctttagaatggactggttggatctccttgcagtccaagggactctcaagagtcttctccaacaccatagatcaaaagcatcaattcttcagcgctcagctttctttatagtccaactctcacatccatacatgactattggaaaaaccatagccttgactagacggacctttgttggcaaagtaacaaaggtctctgctttttaatatgctgtctaggttggtcatagcttttcttccaaggagcaagtgtcttttaatttcatggctgcaatcaccatctgcagtgattttggagcctcccaaaataaagtctgccactgtttccactgtttccccatctattggccatgaagtggccatgatcttagttttttaatgttcttagttttagttcttagttctgaatgatcttagttttctgaatgttcttcttcgctttctgccataagcttggtttcatttatttatctgaggttttctgaatgttcttagttttagttcttagttctgaatgatcttagttttctgaatgttcttcttcactttctgccataagcttggtttcatttatttatctgaggttattgatatttctccctacaatcttgattccagcttgtgcctcatccagtccagcgtttctcatgatgtactctgaatagaagttaaataagcagggtgacaatatacagccttgacatactcctttccagatttggaaccagcctgttccacgtccagttactaagtgttgcttctgacctgcatacagctcgtcaggaggg

SEQ ID NO: 49077 - DNA, 679 bp, Bovine  19866880413920
atcagagccaaggcatctggaactcaatgcggggccctggccgggatggagacaagactgaacatgaacgtgtaactcaacgtgtgtcacgtcaggcagtgggccaggggttttccccgcattctcttacaggggtgggaggccaggcggctggaactcctcttgaggcagcctttgttctttgcatccgggccagtggcctcctcgtcctgcagtgtcctctcaacaggccatagctaggtacagctgaggctgcaggccctcagtgattccccggggcagacatattgctagggtcacccctgcagcaagggaaggaagctgactgccgtcttaacaggaagacctgttgagatggcagtcagcctccttctttttgggcctgctgagaggaggccctccctcagctctctctgttgtaacttaagtccaattcacctccttcccctcagaggcccccagattcacaggggaccccgtgaccctttctcaccatccctctggcgtcctgactttccctcgttttgtgagcacgacaggggaggggagggctggggagggcccagcctgcaccacccttgtgctgggccctcactcccaggccggtgggctctcaccggtttttcagcaactccgacgaccacctgcttaaaaacatcgagctgttcgacaagctctc

SEQ ID NO: 49078 - DNA, 3745 bp, Bovine  19866880419940
ggcacatgtggtgagtaagtgggtgtgggggcagcttaggtccacgacactgcaggtcagaaagtgagagctcatagcatgcagttcactctggacccagtgaagtcctgaggtggagctgtatctgccattcatcgttgtgtgagtcttgcctgatttatgactttcccagttctccgtgattttgtggaatttgtgtgtgtgtgtgtgtgtgctcagttgctcagtcatgtctaattgcaattccatggactatagcccgacaggctcctctgtccatggaattttccgggcaagaatactggagatttctttctccaggggattttccttagtcagggattgaactgtgtctattgcatctcctgcattggcaggtggattctttaccactgtgccatctggggaggcccctgtgggatgaggacttaggtcaaagcggtctggtgactttttgctacagagctgccaatgagttggttttttcccttggtgtttaattctgtatcctgaaagcatagttgggtggcctatccaggggtgcatcgaagggctgaattcaggacaacttcatttcttcttttcatgaagggccaggatgggctcttgggtccctggcagtgttatcctggcatgagccaggcagaagagcccaggcctgcattattctgcctcagttgtggtgctgagggcacagggctctccagacctctaaaccagtttctctctgactcccaggggcactttccgcttcgagaggcctgatggttcccactttgacgtccggatccctcccttctccctggaaagcaataaagatgagaagacaccgccctcaggccttcattggtaggccagcagaggccctgagcacccaggctccgccccgaacaacagcccacatcccatgagagttgctgcagaactctgtcacggccacagtgggtctcttaatcgtttgtgccatttgacttcggtgttcttactttggcgggtggagtatgacttctccagaagacccacgtgggcctcctccaaggctggccttccccgtatgccctgcctacgctgtgttccagtaaacctttccatcaggaactgtgttcagcggccataggtgtgggggttccctagcctgtcacacagttgttagaatgcgaggtttgggcaataaaccagtgcgcgcttggccaccctcgccgtttctgcccccccgacgtctcaggctccctttctgacccggcgggggcccttggttactgtccttaactgcccttcaggaagctgccccttcagctagggtgtctgtctccatcgtggggcaggggtttgcctgatgtctcccaggtcactcagccagtgaagtgggggatgggctggactctgttttctttaccctctgccaagtgcagagctggagggcggcagcaaggtcaaaggagtaaggcaagcctgttgggtttcctggagcagtgggcctgccagccacgggcacaagtctgtcaggcctccagttcagaaatgcagaaactcagccagggagcgttaggtatggacagtgactaagccaagctactttctgagcttcttgaagatctccaagagccagagataaaaatgtgctgcatttttgccccgattcttaggattcttgcttgctccctgactaccattttcttaatattaaatttcagttccagccctttatagtgttgtccttaatcccccaccttagctcagctggcaaagaatccgcctgcaatgcaggagaccccggtacgattcctgggtcgggaagatctgctggagaagggataggctacccactccagtattgttgggcctccctggtggctcagctggtaaagaatccacctgctatatgggagacctgggttcgatccctgggttgggaagatcccctgtagaagggaaaggctacccactccagtattctggcctggagaattccatggactgtatagtctgtggggtcgtaaaaagtcagacatgactgaccaattttcactaatcctccaccagggggagcctgggttgcagggcaactgagtgcaatggggcataggccccagtgagaaggtcaggtcaggtggtaaacagaaatacatgaattatggccacacagcagtgagtgaccaagctctactccctgtaagcacggctctgaagcactgcagtgtaacacaggtttattagaaattagtgtttgcttccatcacctatgctgagcaacagagaattgtagttacatgataaagaagttctttcatgccaggacctgtgccatccttcagcagaccctggtcaggtaatagatcagaacctaatgctggcccgtgtggttaacagcaggcttccagttttcttagaaactgacaaggtttaaccttgatccacactttttgtgtacattccccagggctgctcagaattgaaaaatttacacagccaagagcattttctgaatggggctgggaaactcaaaattccccaaacccttacaacacagtctgactttaaaagctaagattacttcagtgagttcaatgttagtattttaaaaccaaagagagattttcaactggaagagataagtgcccagagtcccagactcttgtgctgtctcaggaagaaaagactgctcaccactgagacagctgaggatctcaaagtcccagcagtgaagagaggcccagggactggggaggttaagggacaagcattaaaatacctcagtggggagctgggactttgagtattaacgggctttgggaaggcagctgaggaaacagactggtggcctcaagcagaagcattccagtcactgtgggaaacccagagttggaatctggccaaagaaatggatttgtcttcatcttattactccagtgaaggcttgaagaaccgttcatagctgaccatcaaggtgcctcacctgaaagtctatacattcaagagtacgactagcgtaaaacgcctgattagagtcacctttctcctgccctagcacaggtcttcgtgtctactaatcctggcctggcatttgcccataggctcaactgtaagcagccacttagctatggtcagagtagtcaagagacatgaacttgatcagctatgtcctttcctgactgagtgggtactgctgagtgcagtgctggtttgttaggttggctgaacagctccttcctggtggcattcctttagaaaagaattcagataggcagctgcccgcgggccaagccaaacagaagggaatgaaaaccgaagccctgaagaggagcttggaacttgcacccttacccaagggtgcggcatctctagagccaaatttacccaacaagaaagaaatgaagaaccctttcaaggcttttaggctacacacattctcctgtgttcagggactcaccactgggcagaaccaccatccccaaaaccaacaacatggatgggggcggggggatggatggccaagcataaccacctcagtggggcccccgggaatgcagggctctgtgtttgctgtcctcggatgacgggcagttgggtggtgggggcccatgggctccagccttcctgctgcagctcctgccccctgccaccacaacggccctctgagcttacagtaagtgagaacagcttgcttcagagccaagggcgagagaatcaaagagaacagtcatgtaagaccctaaaagtcagtgcatatgtgactctgaagatg

SEQ ID NO: 49079 - DNA, 1561 bp, Bovine  19866880529466
cctggctgtagtccatagggttgcacagagtcagaaacgactgataatagtagagatcgtgtatataaaactcgtagtagcaggtatcccagacatatttggtttgtcacttttaaagagcacagagtatgtcttccttttctctcatggcccccagagggtctggggcagagctgtgcacggtcctggcgtgatgttgaggccacctcgttgccccctgcaggtatacaacgtggacccgaaagcctacaacggctcgcagctgccggtgagagtcgaggtggacatgatgcgggttatggaggtgttcctggctcagttgcggtgaggccctggggatccgcttgggggcgtggctgctgagtctgactcttgcctcttgggctgcctggagtgaactcttatctggcagggataccttggctgtacctggagccccaaggaaaccaagaaaggtttccaagaatcccttcatccttctcctaagaaagactagttgctgacaaaaactgttttaggaaaaatagccttatgaatccgtggtggctcagtggtaaagaatccgcctgccaatacaggagacgtgagttcaatccctggatcgggaagatcccctagaggaggaaatggcaacccactccagtattcttgcttgggaaatcccatggacagaggagcctgacgggctacagtccatggggtcacaagagtcggacacgacttagcaactaaacttcaacaacaagaacaaaaagtgaaatcattggttaaagcggagcttggggctcggaactgcttagggttgcgtctcaccccctaagaccctgaggtgcttcctacaacccctgtggttctgggtgagatggaaaatcttgatagttactctaggaatctcgaccatcttctcccaccttgtggtctctgctcctttgatcttctgcgctgttcctacaggctgctctttgggattgctcagccccagctgcctccaaaatgcctgttttttgggcctaagagtgaagggataatgacctgggagttagaccgtttgctctgggcccggtccgtggagaacctggccacagccaccaccactctcacctccctggcccagcttctgggcaagatcagcaatattgtcatcaaggacgatgtggcatctgaggtaagcaggcaggggatgcattctgtggcttaggactggagtggccagcaacagccagggagtggtgaaggcagagagccatttgagattcagagagtgtgtgggcatgccatcctcagtgcccaggcttcctctagagggcagtgccagctccccaggaggagtgcagtgtgggtgtgaagtgttaaatgggcactaagaagataacccctggcccttttatgctatactatgctatgctaagtcacttcagtcgtgtctgactctgtgtgaccccatagacagcagccaccaggctcccctgtccctgggattctccaggcaagaacactggagtgggttgccatttccttctccaatgcatgaaagtgaaaagtgaaagtgaagtcgctcagt

SEQ ID NO: 49080 - DNA, 1646 bp, Bovine  19866880532195
gtggtgggaggacttgaggaggtcctagacccctcaagtaggcatgaaatcggcattctgtgccaagtggacattttctgggtagagggatcttatttctcactagagccaaaaagtgtggggaacaggaccaaaactgttacctatgggaaaggatgaggttggagaatgggatgtggcctgctgagaagcaataaattagtaacggactcaggcaatgcaccccactccagtactcttgcctggaaaatcccatggatggaggagcctggtaggctgcagtccttggggtcgagaagagtcaggcacaactgagcgacttcactttcacttttcactttcatgcattggagaaggaaatggcaacccactccagtgttcttgcctggagaatcccagggacagcggagcctggtgggctgccttctatgcggtcgcacagagtcggacacgactgaagcaacttagcagcagtaggaatcttatccactccaaagagttaatattcactcagcagactgtgctgagaagactggcctggggaaatcaatgtaccctagagatgaacccagaaatgaaaactttgttcttttatgataaaaagaaaaaaattccccagctcctaccccctcttccactgccctaaatacacaaagggtgagtgaactacccagccggggatgtgcctcatcaaacagatcacagatcaataaccactgcagtagaacgaagttggggctgctccaggagttggacttcttgtcggctttagctcccaacaccctgtgaggcacatataattagtctcatttgcctaaaaagagaactaaggcagataaagcagtttgcttgaggtcacatggccagtggatcgacagagtgggacttctttctgcgcttcaggctccctgcgctagtcctcttcagagaggtccctgagcttggcaaggatcctgttcgtagctgtcccagacccacagttctaggaacatgaccctttgctgcaatagcctctggggtcggggcacttgggggctgggctggaggtggagcaaacagagcagtagaaaaggcagctcctcttctctggttcccccgcctccactccccatctctccgcttcctccttttctcaggcatcaaagcagagaccacgggaacctagttaaccaggctcgaggctggaggccccgccatgacatccctaaggccccttctgatgctggccctgctggcgtgggttgttgtggctgaccaaggtgcggaagggtgttgttggccactggggtcaaggtggggtgggaaagggtagcctgggcttggccgtgccagctgacacgggctcctcacagagtcctgcaagggccgctgcaccgagggcttcaacgccaccaggaagtgtcagtgtgacgagctctgttcttactaccagagctgctgtgccgacttcatggctgagtgcaagccccaaggtgcgtgcagagcggctgggcgggcctggggtccccggtgcagctggagagtcaccaccaccctctctgcccgcagtgactcgtggggatgtgttccatctgccagaagatgagtatgggttccatgactacagcgacgcgcagaccgtcaacagcaacgggaagcacagcccg

SEQ ID NO: 49081 - DNA, 1197 bp, Bovine  19866880556059
tccttccggtagaaagcatgaaaggcacctagcggggcaaagtagatgggcagtcagccagagaggaaagatctgcaaggaagccctctgctagagggataaacagctccatgaaattcagcactgggaaccctggctcacccagggcacatgcttgtcctgccatgggggaacataatgctgcagaaaggataggggtttcttttgatcacttgagtcctcacatttctgggtcaagggaccactgctgaggacaggaggtggcggggggtccctacctaaccaacttttccctcacccctagctgacgttcttaccactggaccactaaagcctgaggtgctacctcaaaatgctgatttcgcatgaagcccagggcctctttaatcttctgaattgtgctgggcccttttcgactgaagctgctggttggctgccctcggtctaggtaatcacagctttcctacagttggaagaaaagagaaagagcaacaacaccattacttgctttgtcttgctttgtctcaccacatagaaaactgcttcttgtcacaggatgaccttctcagagtaagtctagaaaaatctcctcatatacccgtacacacatgctgttctgtgggagacccacagatgtttggggcaagggagaagcagctactcatcctgatgaggtgacttctggttcgtgtcaaaacataggctcttttttaggggggtacctgcagagaaatggttggtgtagcaaaggcattcctgtagatccagtccgcctcttcttccagttcatcatcttcagcccccttgacagggatggaacggagctgcaggggataacacaggcgcatgagactgattttatcttgtatctcgtgcagcaaaaacacgcacttctggataaaaatatgtgctccagaggcacatgttttcagtacctggaaaagtattgtctggcaagaagtaggcatgtcgtatatttgctaaacagagagagccattttcaagaaccctaagacacatcagagtctatgttgaggccagacttcctatacccctggtcagattgggggttcaaagccaagttcctatatatcatttttgttttttttggctgcgccaccctgactagggattgaactcgtgccccctgcagtggaagtatggagtcttcgccattggactgccaggaaagccccc

SEQ ID NO: 49082 - DNA, 1971 bp, Bovine  19866880579701
tgactgatgctttgagcctggtgacttgatagtaagaataatatcagaaataggaaagccagaggctacacaggtttgtggagatgtaggattgttaagttcaaatttggacatgctgagtttgtcgtgcaagtagtacatctggataacgtctaaaaaacaggcggaaatgaggatctaaaagcttcggcttagagttagagattgggagtttcagcatagagctaagagttaatgcccaggagataatgcttaactgtgtggcaggtatcctgtaaaatactttatatactattccatttaattctctcaaaaaccatattagatagttactattattttacacacaaggaaacaggttaaagccaactgccaaagattaccatccaagtaattggcagagataggatcttgaacataggcacgctagtctaattctggagacagtgctcttaacctaccattgttggacaaactttagaagaaagcacagggaacaggccaaggagagacctcgagagatagacttatctctaaaacctgggagaaggtggacgacctaaaggcatgatcagagaaagcagtagagctagaacacagtgacactgatggcaagggaatgatttatgtggaaaggagtagtcaacaaatagcatttaaaacaatttgaagtcgagagggaggggacatatgtatacctgtggctgatttatgttgatgtttgacagaaaccagcacaattctgtaaagcagttatccttcaatttaaaacataaaataaaaattaaaaaaatacataaactgaaaaatagaaggaacacgatggaagggaaaaagatcctagagtaattcagaggtggatatgcctaagagaaagaaatgctagcgtttacatagtgtttctaagtttctcttgggaatctaactttttaaaattgaaggaaaatgaaatgacaactgttacccaaaaggggtggagtgggctgagctggagttgcaggttggggagaatatgttctagagaaattgaaagaaggtgagtttggccctggatgtgttctctttgctttgactctgtggctttccacctgccttcttattcctctgccaggtgcctacatgttgaagaagctgattgaagagacagataggttcgtagtgttcacagaagaggagtcaggtgtgagtgaccagttgtgtggcattgctgcctgccagactgatgacatatataaccgaaactgccttatcgaactggtcaactgccaggtaccttctctttactagagtaccccaaaatagggctagatgataatcatgtgtgtttacctgcccccctccacttctacataagaataggtgggtagagctccaaaacactatactttttattaataacagatatcatggataatcgcttccattagtagaagccagcagagctcactaagccagaattagacccacctgtagtcactggtacagtcctttgactaaccttccattttcttcccggcccctgtgctgtgactctgcttctgtttctggcatagatggttcttcgtggagcagagacggaaggctgtgtcattgtgtctgctgccaaagcccagctgctccagtgccaacaccatccagcctggtatggtgacacattgaagcaaaagacttcctggacttgcatcctagatggcatgcagtactttgccaccactgaaagcagccccactgagcaggatggcccacagctctggttagaggttagtcggcaggactgggaaggcctgatatctctccagttctccatagttggcacctttcaccaaaatggcttgcagggtccttgatagtaccttttgctagcaggttgtagaataatgaggctcgtaacacttgaatatagaaactccatgcagtctctggcctgtgatctgtgacaacatagtgctttttctttttttttagatctca

SEQ ID NO: 49083 - DNA, 1227 bp, Bovine  19866880592928
atacaaggttgatttctgagttcttcatagaactaaatgtactgttccttattctgatattctctctctcctatctttttggtgtgaaaagaatgatagttatttattattcttatttgttgttttatgatgattgttgtttattatccttatttggtaaaataagttagcaaaattatcttaataaattgtgctgctgctgctgctaagtcacttcagtcgtgtccaactctatgcgaccccatagacagcagcccaccaggctcccccaaccctgggattctccaggcaagaacattgcagtgggttgccatttccttctccaatgcatgaaagtgaaaagtgaaagtgaagtcactcagccgtgtccaactcttagcgaccccatggactgcagcccaccaggctcctccgtccatgggattttccaggcaagagtactggagtggggtgccattaccttctccaaatctattgcacaccaccaattaaaaacataagttactggtctgcctgagaaatagcagagtatattttccgggagaatatcagtatgcctagattgtatcatgataacagattatatatcaccatttttacttagggaaactatggactcgcttggagtcacttagaattccagcctctatcctctaaccaagagtgtccaccccagtggcaaaactgagaggggctggatgcagagggcctgtgatgctctactggattgaggtcagccttgcctgacctgaaaaaagtgtaactgtcaattttgtgtctctaaacaggtagatatactggataagttgaaaaaaaaaatgaagaaatgtcaagagaaagggcccagaatgacatgttgactatttggggggaacccagaattcatggggagcctgctgtagggcagagagaagaatcacgagtaagaagaagctcagccaacttggctgaggcttaaccttataagcctctgtttccatagctgctaagtggaaatgatcaccctgccttgtctctctggagtgtttgcttgtggattgaatgataatggataggagagtgctttgcaaactacaacgtcccagacaaatttaagaaatgactctctcttactttgttgacaattgaaaaggcaatatttctagacatatgagatagctccaagcaaacgctttactgagaagagatgaggaaatgtacgggcctgtaggctaaatactgtcagaa

SEQ ID NO: 49084 - DNA, 1202 bp, Bovine  19866880639701
cagtgttaggacacccccaccaacaaatctgctccaaaagatgcctgaaaagaaggcacccatagcctacaaggcaagggagagaatgggttagggcccagatactacggttttcttggaagttagggggaatatccagggtatcagaaggagggataagaaatcctttaatagcttcactctgaaacaaagtttacagtggattcaacagtagtaaatcttgatctctggctggaaggccatgattgctggctttaagtagtgaaccaagggctcattctgcaagccctcagcactgtagcatgtgggacacggtggggatggggtttagaaaagatggtctttactttccaggttaggtactttcaggtataggcaccaggcctataccacatccccagcttctcacttaccatgacgtggtggacgaggtattcccaagaagctcttgactgatggctaatcacgatatccaccgtgtcgtggatgaaataccctagccgagggatgggggagaggttgtaaagggtaccgaattagaagtttatccctgtctccccacccatttaatgcctcccggcaagatctacctgcggagaagcaaacaagcaggtagccagaaagcgaccatgctttctcgatctccaccagcatctcaggggtctgccatatactgaaagagagtgaagaaggcaagctctcatcatttcagtatcccaaaggtcccacaaatcctattacggtagccagtccactattggctgacgagcgagaaggggcttggctgaaacccaggtgtgtcccgtttcccaggtgagaacaccctcccccgcccccacccctcaccccgcgccgcctggggctgccgccgctcctggttggacagcattccaagccgagaatcaggtgagactgcctgggccatagcccgccgatgagtgatggaaagcggaatccccagccaccttcactcccccagccctccactcaccacagcagcgcccagatccccgacacaatggaatgcgcgaaggagacgagcaggttacgccagcgccaggtccgcagggggtcggcccgcacgtgcgcaggcaggggcaggcgacagagcgcgtgccggactgcccggaaggtcagcgtggcgcccaggagaagcggcagggcggggaccagcactgggggcatgctggccctccctgcct

SEQ ID NO: 49085 - DNA, 3228 bp, Bovine  19866880641367
tgtatcctgatactccttttttaaaaacaattacattttttcttttgcaattaatgttttttcttttgtggttaaaaaagtattttttggctgcatccggtcttagttgcagcatgtgggcttccttctggttgtggtggctaggctgcccagcagcatgtgggacctcagttccctgaccagggacagaacctgtgtcccctacattggaaggcagattcttaactactggaccaccagggaagccccctgattctcctttttttgctctttatgtttcaaccacacagaactggagtttccccaaacccggcatgttctttcttgcctctttgtacaagctattcctgctgctgaatgtctttacttcatcttctacctggctgacttctaactcagcaagattcagttcaggtgtcacctctgccaggggccttctggagtctctgctctcctgggctgtattcccacagcacctaggcttctgtctgtcactgcccccaccttgtcatcaccccttagatggtgagctccaaggacaaggcctgtgcctagcgcttgcagtgttttcaggaccaggcacacagtaggagcacaagcgtcagcacttctataactgacaagctcgtagcgtgcactccttcagcacctgcgagagggctgtgggtcattatggagtgggacctggcctgggcaccagaagatctggttttcagtcccagcactgacatgtctagctacggaccatgccccgaacctcagtttgcttatctaataaatgggataatactctccaatcattccctccactgggggaccaagggcatagacgggcctcgggagggagaggtttgctcactgagatggtgattatgtcctttcccaaaaggctacctgggtacccagctgggcgctcccaacgggtaagggctggcacctgggcatctcttcccctttctgccacttactcgaatcctaagaagaggatctgtagccacacccaggaaagcagcagtaagatgatcatggcagggaaggcaaagccgaaccaggaggcaaagttcaccacgttgccatttcgggggaagatcctgaaggggaataagggctgctgtgtggcattgcctggtgacaagccagctccctttgtcccccagtcagaatgcagaccctctccccctcaatcactcacgagttgacctggccttgcagcaccaggttgggagtggtgccggtcagggtggcgatgcccccgatgctggctgagtagcacacacacaggctcagtccctggctgaagcggagctgctccttgttctgctgtgtcttggactccgaaggagtcggtagagcagggcaatcctgcttgttgtctgggaacaagggagagctggggtcgggagtgggtgcagggccagattcggggagcatggcaggggctccatggcctctgaggtgccttgttacttagcagcctagacccaggctgggggggagggccgaggctgcccccaggtctggaaggacaggcactccctggggtctcaggatggagtgaccctcagataccacctggcccaacccctctcaagagagggaaactgagacacagagaaggggaagaagattatccaagctgcacaggaagagtggagcccggacccctgacagcccacccaggctcctgctctcggcctgccagggtctcctagcatctcggtttgcccaggactgagggaattcccagcctgtgggacttttcatttcaaaaccaggaaaaatctcagcccaccaggacaagctggtcactgaacttcttgcttccctcttctgtcccaaaagttgccaagatatggatttccctgatggtccagtggttaagactctgtcctccaaagcaggggtggggggtgtgtaggatcgatccccagtcagagaactaaggtcccacatgccgtgggagtgtggccaaaaattaaaaaaaaaatcggtgctcagatgactcctcctatcatgaacatcatctcagaccctccccaagaggggtttgggacagggcctggcctcacctttctcatcaagcttggtctcttccttctgttcctggagttcaaaggcagggttgtgcctgccctcctcaacatccctgtctgtgggcatcttgtgcagctgctccagaacggcgtgggctatgggcagcatcatggcagtggtggccgtgttgctgatccacatggacaagaaggccgtaaccaacatgaagcccagaatcagcctggcgatggacagacccacacactggtgttccagattcctgcaggggctggcggcccagaatgcccacaccccaggccctcccgtcttggtctgtggggactcacagggcgggccgcaccccgatgatgaggagcacgcggagggcgatgcgtttgtgcagattccaggtctccacggcgagggccaccatcatccccccaatgaataggatgttggtgtctttcaggtactcaaggctgacctgcgtggggacagggcttacagggtgctgacgctgctatttctgccaacagaaaaagattggttccctgggctcttggacccaaatggaaatggtctttggatcccccattgttgcatattaagcagtttcctctctttctgattaacccgttctcccgtcagcaatgactgagagatcgtccagcctgaatccttccatgcttaaaaccactgactgggagaatttaatgctgtttcagaatctaaagttgtggttctccgtggtccctgggtcagcatcatcactggcctggaacgtgctagaaatgaaatgcttagaccctgccccagatctatgaaatcagaaactctggggtggtgcccagcaaaatctttgtttaactggccctgcaggtgatcatggtgcatgctcaagtttcagaaccaccgaattagaaggagacagactctttggctggctatcaagccccctttccctccctagcctaggcctaattgctttcactttgaattaactcttgacaccaactgtgcccctggcatttctagaatgccttcttcctggtcttctagctgactcctccctctgtgctccccgacctaccaggcagaggcagggacccatcttccatgcgctctgcctctgatgaggtttcttccatcatcaccatcctagggcagacccctccatcctgggagcatgtcctc

SEQ ID NO: 49086 - DNA, 1237 bp, Bovine  19866880645152
gttcatgggtggggttgggtattgagagagaacgggaggaccagtcacacacttccccccaatgccttacttggtcttcttaactcaatatcagtgatgcagaggagggggagttgggaatgtactgaaactaacgagtattggtgacattctttcatctcctcgcctgcccctgaccctctcctagtctttcctctcaccctctccgtgtcctcctctcatctgccctttgcccttacagatgggttgttgctgtcccagagccgccagcgcattgtctgcctcaactccctcaaggctaacgtgcaggtctgttgaccaagaatcatccctttttctgctctccccatacgtcattgagtcgtgagcatgtaaaataaaacctgaacccgcagttccggtgtgctcgtttccaggtgaccaccattgacctctcagcctccctggttctgaacacttgtattattcattaccggcaccaggagttctctcactggctacacatgctagcgctggaaacccaggagtctagttcatctgttcttaagcaaaggaaggacaggtcagtgtaatctttttcggccactatcttatcaggtgcattcttagattttttggtctagagtggcatcttgtgttaagtatgtatttagttgtttgatcttttttaaatctcagtttcaacagcccagtcttaacagcaaacatgctttatattttctgttagatgagactctggcagtagaatgaatgacagaattctttgtttttatgtcctcggtgcccagcacagttccttattatgtaaaatgaacatttcttgaactgaacttagataatcgatatctcatttgccttggattataaggtgcctgccatgtcatgagtgccctgtctgtgtgtatagtacttgcactgtgtcccatagaggtcagtggtttgtaagtgatgctacttggtggtattaagttgaatcataagatatactgatattcatcatatttgatatatactatttgatacatgaaaatagcaatttcatctggttcaacctcataagtctctatggattatcactgggagtaggaggaagctgatgagttcaatctttttctagttgcatcctttcctaagaatcacaacaaaactcaccgtgccttttgagagcttctgaaatctgtaacatgataggaagttgcagttctttccttgtcagacaatgaagtcttgtccccgt

SEQ ID NO: 49087 - DNA, 1671 bp, Bovine  19866880662866
tttcttaaactaccccccctgccaaatgtacctgtggaacctccttctggttccaagttcctggactctaggaagtccatttgggctcttagggggccaggggagcaggccaagctctaaagcagagccgagggtgatctggtagtgacatctgctccctgtcctgctgagaagagggtggctccggctcctctgctgtccccatcgtcctccatatcctgtctagctttctcagccccatctcagtcgtgggatagaactccacccagtctcgcagctgaagccctgggagcacccatgcctttctggatggaaccatgggaggattttcataaagtacaggatttcagacatagactgccagagtttgaagtgtgaggatggggagatgaggccagcttctttggtgaagccccggaggagcagggttgcccacccatattcccacgaggccccttttcctccgggattccccacctcctggaggcggggccaggcctctgagcaggataaatccccacactcggaggggactagtgtgggcacagccttggcatggctgtctggctcctcactctgccggctccatgaccagcccagtggatgcatctccagcaggtgatctggtgggaaagggtgggcagggggaggatgtggggaaggtgatggggcagtctgaagaggggtggggagtaggggcttcagggtcgactgggggctttgagactggggtggaggctctcacagggagtcctggcttgacccccccactgtggcctgcaggccatgccagtgggttgggtccccaccggagaaagaggaccaccttcagcagagggcagctgctggagctggagcgagtgtttgcagcacggccctaccccgacatcggcacccgtgagcacctagcccgggtcacctctcttcctgaggccaagatacaggtgagctgtgatcacccccctcaggatgggggtgcacttgcacagtgagtttctaagcttgacccacagtccgttctctctgggtatcctgcctccagattctgcttcccctgtacctggggggaggggatgctggaaccagaagaggctccttctttccttaccaggtgtggttccagaaccgcagagccaagagaatcaagaatagaaagccaggaagcctaagccccaggcctgagcctccccagagatcctgttctcttccggacaccatccagcggtccccggagccctggacccttggccagcctccaccctccaacagcacagctcagtgtgcctctgtgtgtcgacatgcttcctgcccagctcctggcttgggtccaggccaggggtgggtgggggctaaagctgcagccccctgggcaccagctgggtcttccgggccccacctctcttctgagcgagctgctccccagacctcactgggcattctttctgacctcatctatgcctcagccatagtcaccaacctggaccattcctaacctaggtctaggacttgcaagacccctactctggttcccgtagcccactctgccccctaggattgaacacaccggaagtggatctcctgaaccctccttttacacaagggagttttcttacaggatgaaagtattagctcagggatccctgccttccactgtcctccagaccagcctag

SEQ ID NO: 49088 - DNA, 2972 bp, Bovine  19866880698004
accttaaagcatttgctatgtttattaagttcctatttattccttaaggagtagacatttgcaaatcatatatcagaaaaggggttaatatccagaatagacaaaggactcctacaactcaacaacaaaaataatccaatttaaaaatgggtaaaggacttgaatagatatttctccaaagaaaatatatgaatgacaactaagcatatgaaagtgtgttagtcactcagtcgtgtcctactctttaagaccccatagactggcagcctgccaggctcctctgtccatgggattctccaggcaacaatactggaatgggttgccatttccttctccaagcatattaagagatgctcaaaaacttccagaaatgtccaggaccagatcatttcacaggttgaattttaccaatccttcaaagaaaacataatacccatttgtctcaagctcctccaaaaaatttaaaagaacacttcctaatccattttacaaggccaaaattacactgataccaaatctgaacaaggataacacaaaactcaacagatctggcagactgaaagatgggcaaggacagggtaattaactatctgcttatgaaataacagaatgtgacattctttgaatagtaaatatgctttttttttcatatgttcacggaacactcacaaaaaaattcaccctatacttggctaaaaagacaacagattacagtccgatcataatgtaagaaaataaatttaaaaggtgacacaaaatggtttttaagcacttggaaatcaagaatccctcctagatagccccaggattaaagataaaaatcaaaagacagttataaactagctaaaaagcatgacaaaggatgactataatataataagaacacttagaaaacaatgaaaaagagataacaacccaatagaaaaataagcaaataatataaataagcgtttgactacctctcggaacggatggatattggctcattcttgcagctgactgacttctccataagtgagcccttattaagaggagaccactaatcaaagtgatagtatttctgagacgtttggtaaagactgaaagggggaggaggtgataaaaactaacacctaaatagagatgtgggctctcagtggacttcctttaacgaccctagggcacctctctgttggcctgaatagatgtaagtggatgtcgtctaggcagaaaacttcattatcgttattaattacgttccagccctggccctctgttcctctgagctctcggcctcggcaaagagcccagtcgagagactggccaggcgaatctcacctgcagccccagtttgcatggtgatggggtcggcgagtgtgggggcccttttccagagttggtgggggcgtcgggctgcaaggcaagttctcgaagaggcgttctcatagctgcttttccctaagaaagaagagagcatgaaagtaagcctgggctctgccaaccggccctaagaagctctcctccctcaagctccggagcaataaacaagagtaggctccaaccccagtgctccgaacatcaggaccggaaaactccacacgccgcccgcctcaggctcgactcttgctttccaaaacgctcggcacagccacagacccccgaaaccccggtctaggtctctcgctccatgaggcccttcggctcaccggctggggcgaaggcgacaggctaagattgagttttttcatccgccacatcttcgacacagaacgcgggatgaacacctcccacacgtaagagacaacgccatgcccacccgccgcctttatttgaacctgcttcgcgcttcccgattggctgcgaagcctcagtgcgtcaggcgggcgcgtccgctccggactggggcccggcgggcaagggcggggcttggattggcccctcccggccatgcccaccgtgggcgcgcgcgcgcgcgtgtgccctgcggtctgatccccagcgtcaaccctcgatgcgggcggtgggagaggggcgctcaacgcccaaggccagtctttcggcctcacctccgagagcgtaatgggtagctggacggtcgaggaatccatccctctagtttcgagaaggccactctcactcccagtcaaaaaagttgtccccgtggcctggccttagaagtctctcgctcaggtttcccacagttactttagccgtgaccagcaggagccggccgaggggtctagaagggaaggtaagtggagtgggttttgttttttcacttagggttgcttggtccgcgaacaggtcttgcgtccgtgatgaactcaaacagcctgcgctgtcatttaacctctcccagaatttctggtgttttcttaggacttacctcagagcccgcaacaagtttacttaaacagtcatagctcacaagtatctggacatttattaaggcacctggcactcttccagatgccttttatatctcctttaatccttaaaagaactatgaaataggtgctgtaaatattcccgttttacagacataggaactgggtcacacgtaatgtcttttgttcaatgcccctcaggtagtggcagggtacagattgccacccacactaccaactatattctattgtctcttgagacccgtgtgtgaaactagctactggaagtgggattgattttggaaaacagcctaaaggtaagtatttggagttatagtttattacgaagtatgttcgtttcaacactcacaggcaccttattgacactctgaagtcataatgaatttggaaaaggcaataacccaaggaggaaaaatcataatgttacaaacttcagggctctcaggggatgggctcttctgtattatccagtagcagagccactagccatgtggctactgagcacttcatgtggctactgagcacttcaaatgtggcgagtccaaactgagactgtaggagtaaaacacaaacggattttgagga

SEQ ID NO: 49089 - DNA, 1127 bp, Bovine  19866880719261
agcttgggaagaaatgagaggctgttcccaccgctggccctcaggatgctgtgggactgaggaatttgggcgggagctggccagccaatgtgacccaggatgctggggctgcagaactcattgccttcctgggagagattaggatctgcctctgtgggcggcaggctcagctgcagctctgccagaaagtggggtgtgggcttcacagtcttagagtgtcctagggagctggctgtttcacctgaccttcccacggacaggatctagtctctttcaaccatagaaggggcttctggggttccaccagactctttccctagaggcaaaacaaacacccttctctctccatttgctcaaggccaaacagcaggtgggatcacttgctgctggctcaggctttctggcttcccacttcccttgtctgcaggctccccaggccctccaacaaaaacccctccttctggggtgggtgcaggggaagtcagaacttgtgtataaggagtaccttctccaaggcgtacagcctgatggatacagtctcacttgctgcccgggcaaagggcgggagctgagacccaggtaatccagaactcagctccacccaccagtgggtgatttctgaccccaccatcttcccaattttgctgtctggagataatttgaggttgatattcaaacaaggggctttcctgatggttcagcggtatagaatccacctgccagtgcaggagatgcaggtttgattcctggctcgagaagattccttggaggagggtatggcaacccacttcagtattcttgcctgagaaatctcatggacagaggagcctgaccaggctacagtcctggggtcgcaaagagtgggacacaacttagcaactgaacaagaattccagcaagttcgtacttgctgagctgccaccgaatgacgaaatgggcaagatggccagagttctggccaagaacaaaaaagcatggtcatccatcagagcttctggacgggagaggagcaaggagagatggcactgggattcaagcagcagcaaagccggtatccagggctcgccctctagatcccagcatgtcagggggccaaagtctcattacctgtaaagcgtttagagtgt

SEQ ID NO: 49090 - DNA, 1422 bp, Bovine  19866880767104
cgcggccggactcacctcccctagcaaagccggatagagcggagccagcggcggacacgcgcaaccagccgccgaggccccgcccccgcctcacactgaccggctgccctagccaatccacggcccacctgtccgcgtccgcctccaatcctgggccggcagcttcagacaggcgcactgttcggccagtggcgacaagatgtgggtctcctggggaaatcccgcccccgacccaggatgggcagatagaaaaaccaatcaaaaggcagagttgggcctgaccgacaaggccaaaagcgaattaaacaccaaagatctccgtgacattttctttcgcctctctcctcttttctttttcttcttttatttttttggtaggagcaggaagctgcgtgctaatcccgcctgcaaaagctggaagagagggttggaacgaaagaaccaatcgtgagccggggagcaaaaacagagcaaccaatcattggcttgaagaggaagtgggctgagactggaaccagatagacatttgatttgacaaatgaaaaaggaaattgatttcggtcccacccttccgatctcctataggtcaggattgtggagaatcgctgtcatatcagcgacgacctcctcaaggggcgggccaactgaaagggggtgtggtttcagggaagagggcgggacctagaggaagaaggcggagtccaaatcatccattgataggaaccatctactatcccttttagagacttcaggtgtggagaaataggtggcgccaagaggggatgtcgagcttcagaaactcaatcaaggttattcatcagggcgatcacaaaagaaactcaaagactgatggttcataacctacagctggtcttccatggctaatcctcttagtggcaaaaagacattatttccagttttcacaactaacacgctcatggaacaataggcctatagatataattaaaacaacaaaaataataaacctaaccacaaagactgtaattttatcccatactttctaataaattctatcccatactttctaataaattctagtcattgaaagtttactaaaataaagtttactttcacataacctcacttacctaaatctacttttctttaaaaatacgaaataataagcttacagaccttacccttactaaaactgtgcactcagaaccctggaaatcatcattgatttctctcctgcctgcccactccttcccttctaatcaatcatcaagtcttaaacacttctgaacacttaaacacatgggcttccctcatggcttagatggtgaagactgtgcccgcaatgtgggagactcaggttcgacccctggctcaggaagatcccctggagaaggcaatgacaacccactccagtattcttgccttgagaaatcagctctggcg

SEQ ID NO: 49091 - DNA, 1676 bp, Bovine  19866880834586
agtctaacttataaatggaagtattaatagatatttgctgtagcattttctctttgagaaataaatatcctatgcactgtagtatcagcagacttcattgaaatgttccttatccatagatctgagccatttaaataattttatttatttttggctgtgctgggtcttcattgctgcatgggcttttttctagttgtggcgagcaggggcttctctttgcggtgactctcttgttgcagagcccaggctctagagcacagactcaacagttgtgcacacaaacttaggtgtttcaaggcatgtgggatcttcctgaatcagggataaaacctgtgtctcatgcattagcagctggattctttaccactgagccatcagggaagcctggatctgacccattttatacaactttctcaatatttcccgttgttttcatgaactgctcatttccttttgtgtttcttagaggtccaaacgtatggccaagtcacttttcccagaaagcttttgcacagagatgtttaattctgtgcaaaacaagccacttgagaaactccattatcctggagggcagtgatactgagggccaccccatgggttagttaagtgcaggaaatagtgctttgtatttgcaaatcccagaaccaggagaagtattctctaggtaagaattttccatcctgaacgtattagaatgagacgttattgctaattgggttagaataatcatagcacttacagaaaattgttaaggcagtttgctatctacaagggcatatttgtgagaagaccatttttttggtctcttattgggcccagctaactagacgtggccttacacagtgtcacagttttctgggcaccacagcttttcaccaatgtgaaagattatgtgtggtgtgaagacacacagcaggcacatgcagactcataaattactgtcaccttggaatgccttggtggccaaaaccgttttctttatttctatcatatagatcccaagtgaacatttttctgtcttgttttgtttttttatagtccagaaagtgaaaatagaggctcctaccagttaatctggaactttccttaagttttctgctcccctccatatttggtcctcgtctctcaggctgtgacataagagtaatgaaaggttgtttccatgagcttactaaccctctgtatttcctgtttgttcatagttggatttgatcacagatctcttgggcactccatcactggaagcaatgaggacggcttgtgaaggcgctaaggcacacatactcaggggtcctcataaacaggtgaggccctgtatttggtcaccatctggcagagtttccctcccacagaataacgagatgaaaatttttaaacaaaaacattacatgtaggttttattcattttttttatgtcatggccataggtaaaatgttaaaatatttgtcaaacccaataggatatagtaattcccagtgctgtaggagaaagtatttttgtagcacctttgctagtaaatgacctctggctttggtctcctggtttttgtgttgttggggacaagttacaggggggtggatccttgacctcagtaccataacctcgtatatgtgtatcaagctgtcattttcacatactgagccgaaatacccggtatctctcattccagccagga

SEQ ID NO: 49092 - DNA, 1933 bp, Bovine  19866880862295
atcctactgactttttttcccccctttaaattggaacttgtaacctctccaagccttggatttagaaagacccagagtcaataaaaacaatccctatttttaaaaaaatacttgcggacttttctgcagcaaatggaaggaatgggcaatcccacaaccaggagacttaggtgaggacgagctgtagggagacggccgggccgcagcctgtctgctcaccctacctgagggaggagcgagcagcgttcagagatcacatacactgtcagggagccctctgcttgctccgatggctcagctaacatggcttctgcctctggggacgagagcagggggtttaccaggagcagaaaacaccattccctctccctctggctcccccaggacgcctagtccatcactccacctcccactcacacccagctgacacgtggccaggtttggacctcaagtggcccacgctaggatacaaggtctctcacacccagctttcccagagaggttccctggtggcctagtggtcaggattctgggctttcccattgccatggcctgggttcaatccctggtcagggaagtgagatagccacaagctgcataatgcagccaaaaaaaaaagacaaagtatggaaactacacacttagagatcagaaggtaaaagagggcttcctgttaaaaatgatcaccccttctagtaccttgtatattgcccagtgacaaggccgcctcctcatgatccaaagccctccgataggccttctggaaacggcatttgattttcagtttatctgagagaaaacaaagaggcataacgagaagagcccacctttccagccctaacactgtccagcatcctggagagcaagatgatgatatgcagagaaagaccaagaagcttcagccatttctaatgatttatgcagactgtgtgtgcatgctcggtggtgtctgactctttctgaccccatggactgtagcccaccaggcccctctgtccatgggattttctaggcaagaatactggagtgggttgccatgccctcctccagaggatcttcctgatgtagggatcaaaatcacgtctcttgcatttcctgcactggcaggcaggttctttaccactagcgccacctgaaaaaccacggatgatataaatacacggcactccacctcgtccacctgccagctcttgcctctccctgtgaaccttcaacctgaagtatcctccccacagggaaatctactacaatattcattacaataaaaaggtataaggaggaaaaccatatgattatttcaataaatgcctcaaaagaattaaactcagtacacattcttgataaaaagaagatgctggaatggagagtcagacatagagaacggacacgtcaggacttccctggtggtccagtggctgagattccacactcccaatacagggggcctgggttgatccctggtcagggagctaagatcctgcatgtcagtcacacagggcaaccaaaagaaaaaaatattttgagttaaaaaaaaaaaacctgaacctaattttaaacaaaccactagatctatcagtttataggaaataacgataatgaatacgttaaaaaaaatctgccaaatccagaatgtgagatgtcctaacaaacaaaggacctggtttctccaacaaatcaatgaaaagaaatatactggaatggggtaaggaagagctgatatataataaaagaaaaaagagaaacttaacaaaatggaggtcataatgttaggattaaatgaggcaacacatgtaaataaagtgtttcacctagtttctggcacataatgaacaactaatattagttatgctagtgttatcccttcctcacctcctcatttaacctgaatttctatacttcctttaaaaatctggcttaaaaattacaacgctcg

SEQ ID NO: 49093 - DNA, 1075 bp, Bovine  19866880865960
tcccaacttccacagccttggggctttccagtcttgctcatggccacccctccccaggcaaccactactgggaatatgtgttccagcagcagcccagtcaagaggattgtgaaggcagctccctgccggccgcatttaaacactttgccctgatgcagcgggacagctgggtggacatcttccgacttctcttctggggcggttcctatggtacggagggagggtggaagcgtgagtcttgcttcccggtccagggggctaggagcccccaggtagagggagggctgggccagcctgagaggctgcaattgtgcagcaatcaatcaaaagctgtttgctcaggttgctcaggccagactttgcttctgttgacgttggtggagggaggcttgcctccactcggaccccacactttggactttgcctagcacagccagcagaaggaggggctgtgactggggcaaccggggagggctacggtggagggaagccaggggaaaggccgggatggggggctctgccactagcctgatggctgtccttggacaaggcagacagcccatccttggccaccaaggatctgcattcaccccttcctcaccgcaggtggtgctggacagccccagctcatcagccgcaactggtttggtctgccgggacgactggatgcggccatggccggccacatctatgtctcaggctcagctcccagcttcccccgggccaagatgactaagtctgcacgccgccatcgcaaacgctaccgctcgctccgaagccgtggtcgaggccgaggccgaaaccagaacccctaccggcgatctcgatctgccttcctgtcctggctctccagcgaggagctgggcctgggagccaacaactatgatagcttcgagatggactggcttgtgcctgccacctgtgagcccatccagagtgtctacttcttctcagaaggtgggagcccctgcccgccctgtagctaggtctggctgggtcgttcctgctgtccctggtccctgggggctgaccacagcccttgagtggtgacaaggcaggccggagtcctcgggtg

SEQ ID NO: 49094 - DNA, 783 bp, Bovine  19866880944748
tctagcacagaccgattgcaaactccaagtctccagaagctgagcagagtctccagaagtgcagggagctggagtgtcctggaacaagtgggcgcaggagcaaggggtgcagctgaggctcccttctctccagggtctgtcagccagagccctaagcccttcgattaaccctcctccctctaactaatcctggcagaagcctgggtaatacctcccaccccgaatctgtgtggaacctggccctatttagggattaggtaatggagataaacttcaaaagcaaacagcccccatcccaattcatttgcagcacagaacaatccagattaaggtacagagttggggttttatttgaagattagttggtattacagatgacagtgataccaaaacccaacgctgccaacgtgcacgctcctccccaccacatcctgagtctgtcaggttgtctttgcagccccaggtcagatggcagccaatctcatatttgtgaaaattaaatcaacataagccctgggttcctatttctactttatgactttaatatcactccctcttcagatccatggctctgattaatttgtccaggtggcaggaggacaggagaggggggccctgaactataaaacgactggtccctgcagtctaaaattaggatcagccctctcccagccttcttaacagtcaggtaatggcctaaagggccgttgggtacagggtgatggcccattgtcctttggaggggaggaggtattgtcagcttgggatgagaagaattgggaa

SEQ ID NO: 49095 - DNA, 849 bp, Bovine  19866880993249
caggtgttgcctgggctgtgatgagtctgagccagcatatgcagcagaaataagaggggacagatttgaggggttgtccagaggtagaatttgttaggattcagagaccagtggtgggcttccctggtggctcagtagtaaagaatcttcctgcaatgcgggagacctgggttcgatccctaggtcaagaagatcccctggagaagggaatggctacccacttcagtattcctgcctggagaattccagggacaggggagcctggctggctacagtccatagggtcacaaagagtcggacccgactaagcgactaacatgcacacacacacaggccggtggcgtgggggttgaggagaaggcaggctgtctctgtgacagctttgggaagtcaggggtatctctgatgaggcagggagccaaggtagaggctaaggtcaaattcaaagagcaggatataagaagtaagcgttcctagccacagggtttgactacaggtttagcaacggtgatatgaagttccttgtgccttaaataatagcaaacccatgctttaaattaaattaaagcatttttaaactcttctgagtggacccacacaggcattctctgctgttattacggagaatgactaagtattataattgagctgaaaataatctcccgcccatacttgctgggttggtttctaagtattgagtttttaagtaatgtaacaaagttgcattctctccaagtgttaattttaaaaactgcagatggtaaccatctgttacacgactagcattttacaatgtttgattagcactttatatagtttggggaagcctgcccaaggagtctgccctgc

SEQ ID NO: 49096 - DNA, 1545 bp, Bovine  19866881008939
caggggattttcctgacccagggatcgaaacccgcatctcctgcagctcctgctttgcaggcagattctttgcccactgagtcactgggcaagccctaatagataagtggcctgattcttccttctcatgacagagatggttttatcaatagcccatgatggaccaggtctgattgttgaggctcccttggtgatgggcactaccaatcctggcttcagcaactttctttcatctatgttttcttgacggacaatttctgtttcctctgcacaacctccccattcaatctgacacattctttaggactgggcttcccttatggctcagctggtaaagaatccgcctgaaatgcgggagacctaggttcgctccttgagttgggaagattccctggagaagggaaaggctaactgctctagtattctggcctagagaattccatggactgcatataccatggggtagcaaagagtttgacacgactgagcgaccttaacttcattcacttaggactgttaataccttcaactactcagtggagtcacccttctccttcaggtaactatgcatatgtctaatcccatcattgtcttatttaaggtccaagttgcgtgtgtgtgtgtgttaatgggcatctcatttatagacttcatgtagccacaatactcccaaagtagcccaaggggctgggtaattctcagttcaatggttctcaattagggctagaggtgagggtaccatgggataggaaagagtcaagaataaaaatcacctagggaatttttctgaactgtgcatggttgactccttactccactgccaactctgataaactagagggttggagtggctggagaggacaagtatgagcattttggataaactgcagaggatagtctgaaaatcttcatcctcctccaaaatacttgggagaactttcatacacctcaagtgagccactgactgtggctggaaacttgaaacacacagactcttgtgtcaaaggaactatgccttttgggaacctagtggtccagtggttaagaatctaccttgcaatgtaggggacgcagtgttaatccctggtcggaaaactgggattctacatgctgcaaagcatgctccacaactagagagtccatgtgccacaacaaaaatcgtgtgtgctgcaacaaagacccaatgcagccaaattaatattttttttttaaaaaaggaactgaggctttaatccacgaatctggagcccagctgcttttgaaaatacagggccatcccacaaaacttccttggatacttctccatcagccaggtctttgccactatttttgtttcagaaccacccacctagttgaggctttctttctcaggaaaggcatttacccagcagagttctcacccaccagaaagtggtaaagatgaggactggaggaagtgagagctgcaaggcaagaagaatatctgtcccctgatgactgatttcctcccaaccccctataattatttctttgcagcaggaaagacgactaaatgttttagaaagt

SEQ ID NO: 49097 - DNA, 1449 bp, Bovine  19866881061853
ttcttgcctggagaatcccatggacggagaagcctggtaggctgcagtccatggggtcacacagagtcggacacgactgaagcgacttggcagcagcattgtcgaaggtcaagggccaaagcaggccatatctgaccagaaactgtgtgtgtgtctatctttggtgctatttaaaggccttagctgtacccgggtgtctcagctttgaaggcctgtgtctctaatcacttttgttgctttggggtgggcaatgatgagtgtgttgcttccatatggggaaataataataataaaagccttgagttattttcagattctccttgaaaaaatgccgaattttaacatctgttgtgtttttcctccctaaagagaagaaattttctcctcgaactaaaaagcttgtagagatcacataatggttaggctgaaatttgcaaatatctttcttggtttgaaccagatcaactcttggggaaaaactctgaaacagtaagaattcagtttggattaggacacggagaggatggaagcattttgtgatatcatttgcatctgggtagcattgcttctattaaaataaggaaaaacaggtgagcatctaggcctgaaatcagccctgtgtgctcactctaagtttagaggagtgcaggaccgttcagtagcagctctggtctagaaatccatgtgcataggccaggtgaatattttaatggataacagtgctaagttgagtcaagtgtgagtcaggtataaatggaaacagttttattacctttttggggaataatcaatgactagttgcatgctgagattgtagtaagattaaactgaactccaagtccgtattaattatattcaagtaatcttagcatttactgtgtgctagccattgttctaggactctaagtattaactgattttatcttaccagcaatgaggtgggtactataattaggtaaccagcttagtgagatttaagtgctttgctcagcggcaggcactctgcccccaggtaccatgctcttcactctgcttggggtttaagggtgttgaccctccaaacagttgaaaatccacttataacttatagtcagcccttggtactcacgttcctccctatcctcagattcagccagccactgactgaccatgtagtatttaccgttgaaaaaaaatccgtgtatacgtggacctgcacaattcaaacccatgttgttcgagggtcaactgtattttaaattttgctattatcattctgaacctcttagaaattacaaatttcttgtacaaatcttcttggatttatgaaataagtggatctgagagcatgaataataattagaagggtgaagttcaaatgaatcagaatgccttttaaattttgttgtaaatcttttaaaataggtctgtccctccaattttttttttttaagtaaatctagaaagcaa

SEQ ID NO: 49098 - DNA, 1434 bp, Bovine  19866881088315
attcctagcttggaagttgtcttataatatcaaggcgccatccaggaggttgaatgccacagaccttcagtagtcttatctggggagagccctaggcttctcttgggagcacagaaggggcaacctcagaccccttgcttcctccccctgcctccccaaccccccggcaacatggatctgcatctttcgttttgacagtgttatcacgaagctggggtccatgctagcactgagaccactcaaaaagctatacagtctgttcctctacaaatatcccactgatctcctaaaaaaaaaaacaacatttgaactaggggagttaagaatgaagaggaatttgagatttggagatgatttaaattgtctaaaattgcatcttcacagaagttagatttaccttctttccattcacccccctaccccgccaaaaaaaaacaaaaaaaattcatatctgtacttgaggaaatctggcccttggaggttggtgttgctgttgtgaaaagacaaacctcaggatggttttcatatcatttctttataaagaaggatactgttggccaatacacccgtttgtgtgttcagcaaactaagagcctgttaagtgccactcgttgttcttgacaggcaacacacctggatgtgtgttatcacagataaattctgggcagcacacaggggctggaagagctgagaaaagctgctaggtgaaggtaacatttgagttagagcttgtgtgtgtgtgctaagtcacttcgattgtgtccgactcccatggactgtagcccaccgggctcctctgtctatatcgaattccccaggcaagagtactggagtatgttgccatttctcactcgggatcttcctgacccagggagtgaacctgtcttacatctcctgcattggcaggtgggttctttaccactagtgccacctgggagagcttgtgagttttgattaaatgaccgtccaggctgcaccactaaagccagctgtgagtgcttttggcccaccagctgtgagtccgctgcccaggggctgcgtgatgagcggcacgtccgcagggttggagctgcggaagccagtcctgccagctggctgtactcaccgtgttcctcgtcttttcccagctgagaaacctgcagcagtggtatatcgaggagttcaaagaccctctgctccagacccccccagcgtggttcaagtccttcctgttctgcgagcttgtgtttcagctgcctttctttcccatcgcagcatatgccttcttcaaaggtgagtaagtgagaaatcccatttttgccctgagaccaggtctcagaaatctttggggaaagttccaccaaggaaggggagtggtccctgaaggatgtgtgagggtgatacaggagtgggaaggtcaggatcaatcttggaagggacatcagtgggctcagg

SEQ ID NO: 49099 - DNA, 1267 bp, Bovine  19866881146666
atttttcttgagggaaaacattaagaggcagtagtgggttaagagccttctttacccatcagaccagtcaacatggattcaaaccccttgatcaagttatctacctctctgagctatagtttcttcatctttaaaataagagtgaagtattgagaataattcctgacacactaaatttaaaaaaacaattcatctctataacctcccacagggattagtattaatacaatgttaaatatataacagtgctaaatgtttggccacatgaataaataaagctgaggagatactgactaaggtgggtaaagttaagaattttgctgctcttggactgttctacctaacttttcctctgttttgcctttctaagtgtttgtcttaggcttcggtgctaaggagccagaactggtgatggtgggtaaatcaaagtttttgtttaaaaacatcaaatgcttttcaagtaatcagcttggaaactaaaacgggaaagagtgaaaatcagatcctcagtgctctcaggatatgtagatttttttctatcactgtactttctaatctatattatttatatgattatatcatccactagattacaaacctgttaagtcagacactatcttattcaacaaatatctatttagcacctactatatgttaggtactgttctaagtgctgggaacacaacagtgagcaaaacagataaaaattcttggttctaggaacatagttgatgcttatgtttatggaataaatgaagaggaaattctaacaatatggaaatcttcaaaattcttaggatggagatttccggtcttcgctggtacttttgctgcagaaagagtgcacttatatctgcatttacacattttattttgcttgttcttagcttttcactggctcctaaggttccctgaggttagagagctctttcatagcactagggaattacatattgtgtatataaaatacagtctactcatactatcaattaaactgctgcatctgggagtagtttatttgatagtattacattactgcctaccaaagactttaactggctgaaatgtaggttccctcactgcctttatgacaagaaattcctgtttaaacactgcctgcacaagccaaacctattattcaaatagggacacttcagaaagtaaaaggagaaacttattaataccaggacatcaggtaaaatccaggagtcctggcaactgcagcacaccgtcatctagttagacttctcatttctactgattttag

SEQ ID NO: 49100 - DNA, 3527 bp, Bovine  19866881148114
acccttgccgttccctggccttatgctccctgtggccccccgcccaacgccatcgccttctcattcggaggcctcagagtgacagacatggtgagtggcaggggtctcaaatgcctcagcacgcaccgccctgtctttccaccttgatgggccaccgagtagcttaaagcctctgagatcctcggagttgacagtggaccccgctggggtgggtgacgggggggaggggagggcatggtccccacttgagggtctccgggccctgccaggcctagaccactgagagggagagaaggagtgaggaatgtaggggcaccgagaagctaggcacccacacctgggagatggactcagggccctggcagcgccccttccccgtcagcactggagtagaggcagcggtggggacgtcgccttgtgccgcaggttagactccaaagaggacttcccagggagagttttgctagtgagagagctccaagcacccgtgaatacctaagggataggtgctggcccagctcagcgcccacacattcagactggctctcctcaccccaggcccgagcgggattcatgctcaacatcatcggggttctggtcatcacactggccatcaacagctggagcatccccatgttcgacctgcacagcttcccctcctgggcccagtccaacaccacaggcctctgtggggtcagccaggcaaatgtcacaacatctagcccctagtctgagggataatctggcccaagccagaaagacccacctcgttcctactcttgtgagctgggaggggacaccaggctccaagccaaactttgaaaggcacatgtatatctaacctcctgtgtgtctgcaaggaagaggcatgtgagctcagtcctgtgtgtctgaggaaagtgtgtgtatgtacacgcgtgtgtgtgtaaagatggtgtgtcatgtgaggatgtttggcaaggggggattgtgtgtgtgcacacgatccaaggtgtgtacacttgaccgtgtacccgtgagaggtcacaggcatgacagcttgctctgtctggcactccaggtctttatctccccagcttggtgggcgaccagacccctttgtcctctatttattgaaactcaggcttagagccgcctgggcagcaaagcctaccagcagttgtcatggcaacagtctctgggaccggcctaacatactgagttctccccagcctctcaggtttggggggagggttcaaatatctgccccattaaagttttgctgtagagtgtgtggttggtttttcatggcactttccaggactgggtccccacacgtggttcaggccccaggttggggaatacgctgggaggggacctggcatctatcctggatggcggcccccttggctcccttcccacccaggggagaaggtaatagccaggaacctctgccaaggccagtcggagtgggcgcagccacccaggaaagcagcactgacatcacctggcctggctaattgggagctgccagtccctgcgtgtcttagagaaaaccagcctcccggttcccagagcactccctgggcatttacataaaaccctctgcccctgccaactcctcacggacccctccaccagctggaaaaaccagtccctccagaccaggggaggcaggctgacccatgctaagggcccagaaagctggaccctcacccaaaatggcagcctgcagcaggacgcatacacgtgaggctcacaggaacaggttcagagccggccatggccttccgagtccaggaccggaccgcactctggatcattctgcttcccaacctaccttccccagctctgccttcatgaattccagagttttcattatctggcaaagtcaggtgggggtggggaaggatgttaccacgtccttcgtccatgctgggagctcaacaccccttcctggctggaaggtcacctagatggaaatttccaaacatcttgtccagttcccttgtgcagccagagggaaaaaaaaaaagattttttttttccctcatgcccagtaaaattgggagctgagttgtgaagagagaaaaccaaaaaggatttcattctggatttccccctgggctggggctggcgggggttcagggttgatgggaggcatagatgggaggaagctgctgtgtggggtaggggggggacatggctgtccccaggggacaggggatgctgacaggacatgccagacatccagcagagtgaagagtgtcaggagaggggcccagccccccaggctggcattcctcactcatgaagcacagtcataaatcacggctcccacccagacccacactaggaccccaccaaggccccaggcgacagcccccacccccactgggagcgggctggccccagaacggtgagactcctccgggggcttacccacaatgcagtgggctcctaagggggagaacactctgcaaactaggactttctttgccaccctggttgggtacccacagtccagccctggctggggaacagatgggcatgcttcctaggggacacatgccctccaactgttctcagctccccttcatacctgtctgattccccctcagtcctgctcagagagggccagatgtgcattgaggtcacacagcagccccagggggatgaggactgtcttctcagggaaggaggtggatgaaaagtggcctgaggggtgagggggcggcaatggtgggtgccctggcagagcacagggcaggcttccccgggtgcatagaaatcaccttccacagcaggcgggagggcagagacgggaggcaggcggcacctgtcagcctaatcaccatcattagctgggcaataaagtagcacagaggggcggagccgggctttgaaggaagggcctgtcaacccaggtcgggttcgagcaggtggcctagcagctcagccgctcctgggcacacacgctctgggccgcaggaagatggggctttgcagagacgggggtctatgccctcccaccctggaccccaccctctcccccatggcttccaggaaggcagcaaggggctttgggtgtctcctgccagctgaacttgtgcagtgctgggactcaagaacgtctatcgtagtgagttccccattgctaggggagatcgatgaggcccgaacaacttgaggacagtctgcctgacacgccgtgcccccagttcctagcaacagtctggtgactgttgtatgaatgataaacatattagaagaatgcgagtgtttcttgcttctggagagaagtctgacctcaaatcccctttccaggctgctgtgtgtggagtgctgtgtgatcttgagccaatgtcaccttttaggctcatcagatagacccagttttcccctgcccctgtcccctagggccctgggaatgtccctggtaacctcctccctcttcttgctggccaaccccagccccagaggcaactgtagcagcaagaaggcctagcaaagagctaccaagccaagtgttttttttttttttttta

SEQ ID NO: 49101 - DNA, 772 bp, Bovine  19866881268345
tagtgggttaagaagtaaggtggacttcaggaccagcattcaaccctgggctcagccttgggctactatccctcccagtgcctgcctggccccagggccccaagatgggtccccagtgtcgtctcttctcttctttctctaggagatcgtgactgctttgagctgtggcaagaacatcgtgcctgtcattgacggcttcaagtggccagagccccaggccctgccggaggacatgcaggctgtgctcaccttcaacggcatcaagtgaggagggggcggggcgggttacacaggcccccggcccgcagtgccctctgcccagccctctgacccagccgcctgtgtacccacaggtggtcccacgagtaccaggaggccaccattgagaagatcatccgcttcctgcagggccgctcctcccgggactcatctgctggctccgacaccagtttggagagcgctgcaccccctgggccccatctaaccagcccctagctcccatttccatcatgactcccatttccctcatcctccccaccccagtggaacagcccctcaaactggcctccctgggctgaggcagcctaggctcttctcaggaaatagctaactcccctgccctcatggtccacctcaaacccaacatcctcagtatctgcaaagagaagggaagccaggcattgggggtgctaagacctcccccaggcccttgccctctgttcctgtcttgagtgtggaagggtcactgctcagctctgaggaggttctggag

SEQ ID NO: 49102 - DNA, 1102 bp, Bovine  19866881291916
ctctgtagcaggttgacaagaccagtgacctccagccgtgccaaaaccttctgtatgattcaattagccaaacttattcaaagcacaagatgtgaaacggtttaggtaaagatcaccaatcatctttaaaggcagacatcccctgtacagagtctctctattcacaccactacaattaactattaaatctgaactcactacagtttcctgagagttcatcttttcgaaatgtcagagtgccatatttttttctgaaaaagttctgagctaggtacctcagaactaccagctaggtctatgatggtttgtcacgtgcttattgacagtattacaactattgcctaaggcactctgtgtgttacccccaagcaacaaaaggatcaaactgacaagctattttagttagacaatcattgttgatctgcattagatgacccaatcaacaaataatgcacctgagtattacggaagcacagggaattgcaagtaaaacccaaatataatgtaaagaacttctactcaatgacttttttctgtttggttggatgacaaatggaaaagtttctttggccttgacaatctgcatcaaagaaatcaaatcagcatattatataaacagttgatgcttgaaatgctaggacagcaacaaatctaataagaaccaccaagaatagactcaattctacatatagaagtcagtgaaaccctaatgctccaagttgtgaagataataaaatattctagtattccattagaagacagccttttgtataaggaacaacaccactacaattgccgatgctttgagggttaaattccagaattcaaatattcagttaatgtattttgcaaatattctcctagcacaacatataaaagagaactatatataccactatttctttttcaggacatgcaccagtggtaacaactgatagctaaaagaagttgcaagtagttctgagggagactgttgttttagcttgtttgaaaaggcaattccttctgaaatgtattttttttaggaaaaaaattttttcttctaagctgatagtcaatagaacataaaaatttcccctaaggataagccaaatttcttttt

SEQ ID NO: 49103 - DNA, 1270 bp, Bovine  19866881310310
atggctgccatgctgtagtggctggagaagacaaaggtcaagacactgaaggtagggactgggccttctttgctggtaggccgcctagtgaagctgtccaatacatctgttaaatgaggaagtgaaaaggaagaagggtggctatgcagttacataaggagaaatagggttcacagaatgttttgtttgaaaatgttcatagcctgtaagaagaaaaacaaacatgaaagaggcagaagtgagcattctgtccaggacctggagttcagacgcttgggcaaggaggaaggagggacacttccccaggctagaagtcgatgggggtgggagcagccagggatgaagcccacgcaatgatgtgttgagagcagcagtcgcggggtacaaatttccggggaagcattcatagtttcattcatttgagcacttcctgtgccgtggaaaacagagagagctgaccagagacctgtagaaggatgaccaagtaccactgaaggcccagcagaagtcccaaagcaatcatctcctttccttaagcaggactcagtccggtaccctcaaaggacaaagccaattgtaggaaggaaaaggaagtgcagactttactctgtggttgctgatggagctgctgtcgtgttggagtttcgtttggggacaccctgggacagtcccttccctgaaactgtcccttcttacctagactctggctcactcctcttcttctctccagatcctactcctattatgcttcttccaagaagccccgtgcccccaatttcagtgagtgtccttgctcccacaggccttcctcccaaccctgtccctccctatcagggtctgcctcacaccatcctgaactgttacagactgtgtctcctctcctcatcccctcccccagcccctgtggagagcagggactattgtcttttaaaggctgcatctcctgggggctgtccctggagcttctccggagccgttttctgagtgaatggagtggggaggggctgctgctacctctgtgtactctctcagatataaacaggttgcccagctgggggagaggacacctgctggctagtgtggagtccagcacagatgcttctactttatcctctgaaggtgggtcctccttcaagtgggggcggggtgtgtggaaatctctggccccaggggttaggcaggagggagggaggtgtttggtcctgaaagggtcacctagctgccctaccccagctccttctcgtgccccgcagagagtgccacccctttc

SEQ ID NO: 49104 - DNA, 738 bp, Bovine  19866881325285
ccaccaccaccatcaccaccaccttcccacctccctcctcctcaccttcaccaccaccaccaccctcagcaccatcttcatcccgggtcggctgctgcggtccaccccgtgcagcagcatacttcttcggcagctgcggcagccgccgccgcagccgcagctgcagccatgttaaaccctgggcaacagcagccttacttcccatcaccggcaccgggtcaggctccgggaccagctgcagcagccccagctcaggtacaggctgccgcagctgccacagttaaggcgcaccatcatcagcactcgcatcatccacaacagcagctggatattgagccggatagacctattggatatggagcctttggtgtcgtctggtgagtatccaaggaagaatcacgacttctggtttcttctcaaggttgctgggcaaggccttttctcatggtttttctccatgtcgacccaagtggaacaagctgctcaactataggaagtcacccttcattacctggtaaaaggggccttgatggcattggctgtctaggcttaagctttgaagtcctggccagttttggtggagcaccctctgttgaactcacagaagtttgttgtctaccagacttacagcgtaggacctaaggaagccactgaatggagaatcagtaaataggtgaatgcatgggaacgcttattcctctacagaccttggccgtccctcatgtttgattgagtttg

SEQ ID NO: 49105 - DNA, 1072 bp, Bovine  19866881359765
aaggggcccgggccagggcctgctggacagtggacttgctcagggcctggtgacgcgatgctggggctgtgggggggcagtgaggactcccggctccggagggccatcaggcacaaaagacgagcagctgaagccggcgtgcttctggggtggacagagggtagacagcctgtgagcggaggctggatccagacccgactctgtgcgagggtagagggtctgtggctgagctctggggagcccccggtggaggagggagacctcacccgcccttggaagccttgatctgatgaggacgcactgcttcgaacctcaagatcacccccaataggacggatgcacagccctgccctgggaaagtcccagacccaggggacaagcagaggcccagatctctacacttcgggatctgggagtccctgggtacttgtttgctgggagaaaggacaagacagaagcagggaggtcccaggggggtgggggtgatggcccacctgctgtcgtgcagccctctggtcttggcctcagcccaggccaaggtgccaggtacttacgttctgcggggcgggggagcctgggaggcccggtgcctgcatgaagtccccttggggctcgccctccagcctggcagggcccggcagcgtgacgtcagactgtggcgggagtagcgacaccatcacccagtcctggcctcgaagaaagccggctgtgatgagagcgaggaccagcgtcgggggctgaccaagcccgagtccacccctcccaccccctccctgggctgggaccctgcctccagccagacgtctgatgagagagagagacagacaggcagagacagacagacagacaagctgagagaaacatcagaaacagaaggaagcagataaacagtgtgagagacagacggggaaagacacacagggagaagctggggaacctgcagggacgtggattctggtggccccgtgagcctggcatgacactgaggagtgtgtggcctctagggttctctcctgtgtctgccacactccaaagtacctgtgactctgtgcaggcctctgccctttctgag

SEQ ID NO: 49106 - DNA, 928 bp, Bovine  19866881372951
ggtgatggcatcgcagcatgtcatcgattatgtctatttttttttctttcttttttcacctttagcatgtgacttcatactctcttgcctattgcctcgtagtcacaaaatgacaatagcttgtccacaaatcatgtccatattcaaagcaagaaaatggagcaaagagggaacactagcaggatctgttccttttctcaggaaagcaaacattttcccagaagcctgcctagcaaacctctgcttatgtgttactgtccagaactgtatggcatgtggcctccctgaaggcaagaaaggctttttttttttttaagtgtcttttctatcccagttaataacgatagagataaaggataaaaggattgggagggtgtgttaggttagccagccattgactgttcccaacctgttttaattatgtacatcatcctggcaccagaggtggtgctcagaagacatcatttgatcggccaagccctctgctcatttttgcagttgggagactgaaattaagccccactgaatcacttgatctgagagtgagaaagggagttgggtcctttaaggtcaggaaataacggacagacaagaacactggtattttctatgtattgtctcttttctacagctcattacatgagtttgagtaggctctgggagttggtgatggacagggaaggctggcatgctgcagtccatggggtcgcaaagagtcagatgtgactgaacgacaactcaagatcttggatgaagggaatcttagctgccacggcccaggaatctattaaggcagatacttgttgaggctctgccatgttgataggattgagaagtcttctaccagcctagtccctttgttcatctcataaggtttagagcttcatttttcctcagactgttctcagctaattgtgtcagaaataag

SEQ ID NO: 49107 - DNA, 1443 bp, Bovine  19866881381411
cggagaaggagacctttagggggttgtgtgatggcacacctgacatggatgcctggacttcaactcctgttgggacctcgtctctctacctctgaggttcctaaggatttgagggattgctttctttgtttccaacttaaacggcggtgcttagttcatctgatttcatttgggtggaggggacactcgggctagggtcttgatcagcgtgactgaatgtatatggctgagtggtgttttgggagacaggagtattgccccagaagatccacctccagttcatgatcctttgccaggctttctaagacctgcagggggtgagggtggccaccctttaggagagggtcttgtgaactcaaaaggatttttctgcaggtggcttgtggtccggttggccaccaagtggtgtcagcagaagctgcaggcggaactaaagattggctcctttttttggattcagaatgtcagtcttaagtttcagcagcaccagcaaacagtggtgagtcctgggaaactcctggggaatgtatgtgggttgatctagctgaatttcaacttctaatgtcctttttaaaaaatcctggtggctttcctagttaacccagccttgccacccctttgccaagatgattttagagcctatttgagaatactggaactgatgcaagttctttcaaaaatgcttttgaggcacagggtttccagggcatgtaaaaaaatagggaagtaaagtacagaacaaaaatacagaagtaacacagagaccaaagataacgaagattaccattctaatataaaaggggaaatggcaaaaatccatgagagagaaatattaaagtctaaccaatgtcactgagaggaacaagatatagtgctgaggagaaaggctgggggaaatggaatggagaatagtggaagggctctcgtacttcctcctcttataacctttcttgtcctgtcaaactgctctgggcttacctaacagccagtgtacaaagcttcctctcacactgttttaggaaatcgatagcctgtggatttccagcaaactccttagccatgatctgccgtgagtactctatctcttcactctcctcttggggaatgttttgggattgtggtttgcatattgagattcatttccagaggccccacagcccaaggagggaagcaggttcttgatggtgtctctgggttagcctggaagctgttgttttgtgagacagatattgataagtactctgagactgtcttccatgatttgagctgtttttagggaggatgggaaaatgagtatgagggaggggaaaagactggtatggaagggggtttggacctggtggcagtgagatttctctcctgtacagacactatgtggccttgtgctttggagaagtacgtatcagaactgacctacagaagggttctagcctgtttgccccg

SEQ ID NO: 49108 - DNA, 679 bp, Bovine  19866881400530
tggggggtgggaggaggaagtgacttcagagcatggcctaagcctggcagatctggaatctagattcacttttcttcttcatgtagtacaggactccttcacctggagttcttatgcagcttcagaattctctgaaactgtacatggaatgttgtgtgtgtacatatttttcagggagaagagctgtactttttaaaaagttcacacgggactagattcttataagaaccatcaccagagtgcctgagcagtgggcagaaagcaggcagggctgggtgggagtgttgccaggaggtgggcctggaggagctgtgtcttcttggtttcagggaggaggggtggagagcagccatggacctcagagccggaggttcctcctgttaccctgtgccatgggctctgtgctccttatcacctgccaccaggctcgtcaggtggtttttgcctgctgtctgccctgaggtacctggagacaaacaataaccctcaggggcctgtctgaatccctaggctggatcctcatagaccgatgcggaaagcactttggcaccatcctgaattacctccgagatgacacgatcgtcctccctcaaaaccggcaagagatcaaggaactgatggctgaagcgaaatattacctcattcagggtctggtgaacatgtgccagtctgccctgca

SEQ ID NO: 49109 - DNA, 739 bp, Bovine  19866881414782
gcccttcttttctctccgattctttgttcctccacaaaccttcgttgtgcacccactatgcgcccaccttgtccagagtgctggacaagacgcatacgatgtcgattccttcgggcgctcatgatgtcacgagagagagttcatttctccacccatatttgttgtgatcctctctgggtcaggcatcaggctgggcattgaaactagagacagatggggtccctgtcctcctaggggactcagtctaagtggaggagggatcatagaggatatatctccagcatgatagaggatagacagctgcagggctcccccgaaggtccagaggtgtgggaacccaaggaatggcaagaggctccacttggagaagacagatttggtatctgaacagggccttaaaggaggaataggattttgacccacagaggggccaaggatgggcatttcagcctgggaaacagccttcattcatgctgtcacctcctctccatgtgtcctctttatcctagtatcatcagtcctaaagctcagacaagcccagtcctggtttctccttataggtcggctgggactaggcaccagggagtcccacagctgcccccagcaggtacccatgcccccaggacaggaagcccagagggttatatgtggcattgactcctctgtgatcctcacagtgcctggccaagccctggcctgtgggagcaacaggtaagtgggagcagcaggtaattaggtg

SEQ ID NO: 49110 - DNA, 1186 bp, Bovine  19866881588562
tgctgattagtctaaacaataaaggcccaccccatggtaactgtagatggggccacacccaccccaaccgcctgggggacaagagaatttaggaagagaataagagatagacagcctactccagtgttcttgggcttccctggtggctcagatgggaaagaatctgcctacaatgtgggagaccctggaggaggacatggcaacccactcctgtattcttgcctggagattccctatggacagaggagcctggcaggttatagtccatgggctcgcaaagagtcagacacgaccgagcgactaaggacagcacagcactgagatgctgttggtagaggaagggtgaacgaatgctagacaagcaggcagcggacagtcatgactacatcctctcactgttccagctactcggaaactccggagtggttaagagcacagcctggagttccactacctgggtttgaatccaagtaccacgactgtgaacagattgatcttgagaccattacttaacctcactgtgcctccatttcctataaagtgaagataatgatagcatctgcctcataggattgggatgaggattaactgagtttgtgttcgtaaagcagttagaacaaagattagcacttagcaagcatttgttaaaataaatgtgttcagaactagtggggggatgatgcacagagcagaggagcaaataaatgcttgtagacgggatggaatgagtgacaaatctgggagcaagtccccaaactgttcagactttcctgcccagccactctatttctcagggctggtcctcctgctctggagttccgttgttttgaggctgttttccgaggaagctggcagatggatggagataagtcccccttgcccccacaaccatgattaagatggcacttccctagaagacatcattagagcaataccctgtcttacaaactgacaagaattctgtagtctggatcctgggggctcatcaggcacttctagaataaatgatctacctgtgtcacgatcatctgtatgaagatttagggctggtttatcttcagcctgtgacttttcacgcttctcaagctgttcaaaaacgaactgtaatcaagctgatctatagatagacagttcctgtttctgtgcatgctgaatgatgatgggtgtgtttatgtatttgcataaa

SEQ ID NO: 49111 - DNA, 831 bp, Bovine  19866881647194
aattatagcagaactacagtcccacccctaatctaatcacaatctcctaacttctattgtgaagcaaaatgctgaagcagctacaatatatagatgtgcttcaggtttttaattagttggccttttaaaaataaccaaaccccaaaatactgcaaatacaaaacaggaggcaagattcccagctgtggcaaactgaagaaatcagcaaatcttcttacaaaactactacaaaactggacaagtgtgccagaaacaaccattaccaggctccagaaaataactaaagtcaagtgacaaatttaagtgtttatgaaaaacgtggagctttgggtaagaacagagggagtcagaggtgttactgtttggggttattccttatccaccctccaccccaagacactctatgcagcagttgtacctgagcagggctggccacagaaaccagtggcttcactgtctgagattgctgaagtaatctaaaatggaaggcaaaacctcacacccagtggcactgacagtaaaactattaaacccaactcgaagagaacagataaagtttactgctctgctagcctgagcctgctgtctcagttgggaagaggtacagactaacagaaatccagaaatttaataaggagattctagaaatgagagccacagagggcttggtaaactctgcaggtggactgcagaggtcctaaactacctattgagggctgactaggaggcttcctacatataaaggggaaaatgggaagcttagcaaaaagtaaaaactgaggcatacatgaaaacctgatgaacaccctaagacactcacagatgctcagc

SEQ ID NO: 49112 - DNA, 729 bp, Bovine  19866881769519
ccccttgttctggcctctaagcccacttgtatctcttcctagaactctaggctccaggtttgtagatgtggaatgcccagaaaagcctggggtttggcttctgacctgagagtgtagacaggtcagctcttccctccatactctatctcattccacagaaggaagtaatgccaaccttggttggggggtccctgtgttcatctggtatcagcgtggagtagactaaaacatttggagacttcttggtctaggaagtctagacctagacagggaatggcagggaatatccatctcaaaaaaagggtgctgaggccaacgatgatgcactcttttgtgaatgaggtcagctatgtcatcttccatacttcccactctgagcctcagtttccttatctattaacaaaggaataatatgattcgcccaaagagttgttgtggaataaagagattatgtttaaagttctcaacacaatccctggtatacagcagatgctcagtagacacgtgccccctttctatttatcaagcccagtggtgctggtaggaaatgaggatgtgctggcttgcccacttgggtacagaaaattatgttctggggctagaactagagccctgactcaattcacctttctctgggactccaattagtagtaaaagctctgctcccttaacctgataaccagtgaagtttcacagtgaaagggcagctgtcaggaccttctcatgggg

SEQ ID NO: 49113 - DNA, 940 bp, Bovine  19866881848958
aacacaaaattgcaatcactttgttaaaaagtttggtgtttattataaagctaaacatacacttattatctgacccagtactttctcttaagcattttctgaagagaaatgaaagcatacatccacacaaagatttgcctacaaatgttcactgcagtttcatttataatagacaagaactggaaacccgaacgtccattaacatgagaatggattaaaaaattgtgctatataaatacagtgcaatattattcaacagaaaaaaggaacaaactattgacccatgcaacataaatcttaaggactgaaatgtgcgcactggatttggtacctagctgctagttaatatttaatagctcactggtcatttacttgtcagagcagtttgagctgtgttaagtgtaagaaagatacatatagtggactgggagtaaatgagaagtgaagaagcagagaaaataactgaagaccaatctttcaaggagcttggctgtgaagagaaacaagattatgtttgtaacctagaaagacggtaaggattgaatttcggggtgagttttgaacaagtttataggctatggggaaacgtaagacaaagagacaatgactgaaaatctgagagaagataatacatggaacaaagcccctggaaaaactggaagagaataggatccagggacagaaaagtagaagaaagctgaataatgttgacacacgtttgtctgtgggtagagcaggaagtcatccatcctttggttttatgttccctgtgaaacacagaatgatgtcatctgtggaaagtgaggaagaggtggagtagaaacttaagagatttgaaatagcagttgtgggaagtggaggaaaaaactgacctgtgtaagacttgagaacactgaaaggccaacaaaagttataaaccatgtactatgttaaactgcca

SEQ ID NO: 49114 - DNA, 1274 bp, Bovine  19866881061112
cccaccccagagccctaagtgctcagcatcgtaaataaaacccacctaataaatctcccctgtaaattttctgcgtagaatttcattactcgttctcgtttccagtcattaggttttagtccaatttggagttgtcccgatggctgtgtaaatcacgcctgcactctggggagtgcgaactccagggaaaaatcgtgcctgggcctgtgggggtgacagctcgagcctgaagacctggactctgagttgtcgcctgtggcgtgtcagctgttggtggcaagcgcctgttcttccccttgccctggaaaagggaaaggtgctaacatgaattgagcactttatgtatgccaggatctttatatatatccccccttttttttattatttatttatttgactgcgttggctcttagtggcatgtaggatctttccttgcatggcatgggctctttagttgaggcacgtgggcttagtagttgtggtgtgtgggcttagttgcttcgaggcaggtgggatctcagttctctgaccagagattgaacctgcatcccttgcattgcaaggtggattcttaaccactagaccatcagagaagcccctatacacatcatgttaaatcctcatataagccctgcaaagtacgaattactgtctctatcttaaagaatgggatggaagcttggagagggtaagttgcttgtacgaggtacacagctcagctggtgtgtaccttgatagtctggttagggcccaggtttatccgactcctgggatttctttggagggaatgatgctgaagctgaaactccagtactttggccacctcatgtgaagggttaactcattggaaaagactctgatgctgggagggattgggggcaggaggagaagggaacgacagaggatgagatggctggatggcatcactgactcgatggacgtgagtctgagtgaactccgggagttggtgatggacagggaggcctggcgtgctgtgattcgtggggtcgcaaggagtcagacatgactgagtgaccgaactgaactgagagccattgcacctgctgcctcccagcttcatggatggaggggcttatgaagagtttagcacaatgccaccacttccaggaagcgttcctccgttactagcaggagtctgtctttccgtcatctgtttcccccgtatgaactctgaaccactttgggagcttttgtcacctccagtggctttccatgacccttcatctgctgtgctgtcacacggctccctgggc

SEQ ID NO: 49115 - DNA, 1798 bp, Bovine  19866880351699
tcccccttctgggtgactgttatctctgtctaagctgagattcgtgtagtgtgtattgaaacatgattaaggtgtaaattagaatcagttctacaggtatgtgtgactactctttgtctcttaattggaatattcctactgatttgtttaaaaaataattccaaagtaatgcctgatcttcatattgtcagaagcttctacaagctttaaacttgcagtttaaacattgtacttccatgaagaaactagcttgacgaggactacagactcactagaggtcaaggtgaatcctggtgagaaagatgactttggatggtgacactctgtgctgttttgggcaacatattattgtctgttgagaacatggggcttccccagtggctcagaggtaaagaactcacctgccagtacaggagacacagaagatacgggtttgatccctgggtcggaaagatcccctggaaaagaaaagggcaactcactccagtattcttgcctggagaatcccatggagagaggaacctggtgggtaacaatccatagggttgccaagagtcagatatgactgaatgactgagcacacacacacacacacacacacacactgagaacacattatatttaatatgcctgatatggggagtgagaggaacttctctatggtgtagaggtttctgagaataaagctaagcattgcagaggctgggtatgtatcaagtgatatcgaatggccgtggacttggccagacctgggtgtgagcctcaagtctactgctcaatagttgtttaacttcagatgagttactgagcctctcacactcagcttgtctataaaaataaggctaaaaataagtcccttgcatggaggttgtaaggattaaatacaataatgtatgtaaaatagttagtacagggactgacataagaaatgctccataaattgctacttctaatcgtcatgattcataattaaatcttacattgtaactgatatttaactaatagctaatgatctatggcagttcagatttaataattaataagttatgcgagggattgggggcaggaggagaaggggacgacagaggatgagatggctggatggcatcactgactcgatggacatgagtttgggtgaactccaggagttggtgatggacagggaggacctggcgtgctgcaattcatggggtcgcaaagagtcggacacaactgagcgactgaactgaactgatgctagttttggagccatgaggattaccaccacttctataaccaccgtcacctttagatgtcacgtgtgagaagacgcatcagctgagggactcagccaggttgaccttgtcccaggacccaagaagagctatctggtcctgaatcagaacatcgtaacttcatcctgctccaggatggagaagacctggctccaagagctggtctttggttggtcaactcttgtaaaggaacaatagtgaaagacttagcgaataccttcagcccccatctggtccttgtcaaaaagaagagctgtggttgggttgaagctgattagtacatcaaatcaggctcctgaaacgccgtagcggccacctccacttccccttgccctgtcggctcaccgccacacgtatgaatgaagaaaggctcttgcttatggcaggtcacacctccaagctgcctgttctcagacttgcatgaatcctccgtcatcgccccatatagctggtgtcaagtgctgagtgtggaagccgagtagagaggtgacacggttttaattatattttaaagaaagttcctt

SEQ ID NO: 49116 - DNA, 1400 bp, Bovine  19866880355410
atgagacctatttgacattcatgagatattgaaaaagcctgatccccttgatatcacatcaccagggggcggggctgggaagaaaagactgaaagggaaggagagggagggaggaagagagggagagaggggaagatgggaaggagggaatgaggtgggaagagggagggagaggaaaaggaaacacacttttaaaacaaatacctcttcctttgttccctgcaaagactaccaattaggggttcagaatagaggagatgagaacatgctccaccaaaatatgcctcttgccagattaattattttcactgaaagcagttaaaaaataacacatgcaggaaggtctctctgattgcctccttttacagagcatacattttctttgagaaagctatcctccgtgtaccaggaaggagaaaacattcttatcaccaggagttgatgctgaattcaatctattcaaataaacctactaaaatcatgatcatctttcattggtttcctccatatatttcctggtcatcttcccacaatttatttcccctagaacaaaccccattttcctttgtcatatcatgtctccacacttttgtttttattaaaatgctctataagctctcaagcctatctgcttcttgagtcatacatctatatctatatatatatatacacacacacatatatgcctctgtacatctaaaaatatttccattgagtgaaatgtaatgttttcctcctgtttatctgtcttttttcagctaaatttcaggcctcgacacagaatttaggaaggtggaagaaaagcctttctccccctaccacactttatgactacccaccacaaaactgtatcaagctaagcttcttgtaaaaagtcagacacactctgtcttgacagaattaaagaaagaaaaatgaaaaatgcccacattcttaagataactgagcacttctcagcatgaagaaattgcccaaataaaactcagtaacattctacttttagaaggatggacaagactagatacacaaaaaaatgtttaaaagtcccaagaccatattctcccaaactgttctcatttttttctcgtactctccaaagaaccattcctttgctttatcaccccgctggctgtgactgggtctccctcagagcccaagggactgtgggtaggagaaagcagtataatacgtatttttttttttcctgaaactctgtagaagttttcctcacaccagctacttttcgtggtgacctagatcatcattcacctggtataaatgagcttggctgtgaacaaggttaagaattagacctgaggatgatctattagttcatcttgcttgtctcatggggcaaagcagaatgtttctcggagagttttctgaatgcttttcccaag

SEQ ID NO: 49117 - DNA, 4565 bp, Bovine  19866880369694
tgcccatggtgggggccactctgatagcacatctttggcattcgcctccccccattccctgtctccacctccccagcccctcactcctgccccagatacccatttgccaaagaaaccgcctgcatacaaagtttgtctcaagacgtcttttaaggaaacctgtcctaagatacatttctattcgtaggcctctcccgccttctgcagaagtgtaccattttagactaaattcagtgtgactgctgtcgggacattattagtgaatatgaaagagcccctcacttttccatttctaatatggtttaagcaccaggggccagtggactgaaatgatcccattaaaatggccagtgacctatttttcccttttgatagaggagaggttcttttaacgtgtgtttctagttcactgtattgctcctctgtgagcctcgttagaaagccttgaccttatgaaagaaattaaagtatagggccatttcttgatattcccctccattatctgtatgcttttgatctttgtaaagtgtaaacagtctggggagagtgctgatgaggacagcactgtagccttgatcccacatgagctgatcagacttgcatggcagaaaaccaccacacagtctgaagctgcattctgaattccggtggaccatggtctaagcgtttgttcttggtctcttggtaaccctgggtggcagatgacaacacgcatttcactctccctcctgaacgctgcatgcaatgcccgtgattcggacgtgtagtgttgcctgtcatgaggacacatttatgtaatggggcatgttcaattgagggcttcccaggcagcacagtggtaaagaatcttcctgcaacgcaggagacacaagagacatgggttcgatccctgggtcgggaggataccttgaagaatgaaatggcaacccactccagaattcttgcctggaaaattccatggacagaggagcctagcaggctacagtccatggggtcacaaagagtcagagatgactgagcacacacacgtttagctggctgagcagggcccagaagagactcctgtaggcgaagatggttaggtgcccacgagtggcagggattaagctctccacactgcctgatgcctctgctgcatcagtagggttggttccctgctaagatggcacagccacctagacacccatgtttgtgtgtgtgtgtgtgtgtgtgtgtaagggcatggggactcagctgagagaactgcagagtgctctaaaacccacgagctcagggtgcgttgactgtggcgcttttctccctcactccagatgagctgacgctgctgccatatttctagtggcaacgactcacttggcaactcaggaagctaccgttgtccatgaatttcggagaatgcccagcggccccacaggatgtctgcagcttggcagagaccttgttaaacgtagaatcgattctatagggcaaagtatgtttgtttttaatcttgcggtccagaatgtggggtgttctttcttggaggagagatttgtacaacataaagtcaactgttttaaggtgtacaagcagtggcacgtggtacacccccagtgatgtaggaccaccatctctgtctagttcaggatactttcatctcccaaatgagaccacacaggggagtggtaatgtggttttaatgtctgacaacctcgataatcgcctttttgtgaggagggaaaaaaaaatccaagaacaaatcttatgctttttaattttattctattttaaaataacatatgcttttgggctccttcaaatttataaaggcaatacattttcagtgcaaaaaactaaaaaaaaaaaaaattactaaaatcagaagtaccaccagacacatagcaaagtacatacaaggccggtttggaaaaaataatctcaaaatcttctgtgtctgggtagaggtgtggacctgtgaaggactttgcacaatgactttttgtcaagccactgtgtgattttcctaagtcttttctagtgtatgtgaaggtgggttaggatcaggtcagacccgaggcaaaaatccgagccctgcaactttctagctgtgtgacctcaaaaaagacgggtaaactttttctgaggcttggctttcttgcctgtaaaatggggttaataacctgcttcatgaggctatcttgaaaaggaaatgccttgcacacagtgtgagtgatgaataaatgacagtttttaaaggagaagcaagaaggacaaaaccaggcagagaggcagatgtttgggggctcactcggcccaaccccaggctagtgcccttcccagtcgtttcatcttcacagcaggtttgatttaagctcatgcctccacaaacagactcccacatactgaagctggaatgccagacatctactgctgggcactgtcatctactgccagagcccgttacccagcttaaagcaccatgaccctggctagcgagtgatgccatggcgcgccagccccaggggggacgatcagaaggtgccgggtggcgcagctgggttgtgtgctctgtgcccagctgactccgtcagttgcagggaaggctttggaaccagcaccttccctggcttcctgggggtggcggctgtctaattcatgtagctgagaggaggctcacatcctaggttcccaagagctggttttgtgcagggcctgagtgccccatcttctgtggtccagttatgaaatgaaatttagaatcccactacttctgcctgggtgatgtgtcccgtcccttcaatttgtaatgcatttagcaaattgtcaaacacctgtgtgttagatacctttcaaggtgttgacatctggaagtcaaaagacatggtcctgggcttctcgggagtccctgtctagaatagtcatgcccagagtaccctatagatttttcctcttgcaaggtgttgtccttggccagacaggtctgagtaactgtgtacaggacatgactcttgaagagtcctagcacacattagcatttgaaacttctaagatgtcccacagtaaaagcaaaaaggacaattaagtctaacttgatgtttgccactcttgtctaaacgtgaaatctttttgccacttaacacttattaacatctctgggaactggtgttccctgctagtctggaagaaatctgtcacaagctaacaaagttttacagagactgatacacagaactctccaaagattattcttcatatagtcgaagctctatgaagtaccttcagaacctttgagatctgattccatttcagaaagttctgaagagagaaagattgcaaactgcagtgtttctcttgcaaatccggttctgtatgtcagagaggctagcagtgtgtgtgtgtgtgtgtgtgcatgtgtgtgtgtgtacacccactgacaagttgttggtgccatggggacctggatgctcacatccctcagctccagtcagtcagttgtttgatgggaatttggtcagaacactgagagcttaaagtttctcaggagaacatagaaatctgtaatgtttaaatatgaagtttcacagcattaatttgtcttccaatttattaaacattgtgctgcccaagcacaaagaaaatgacaccaaaattctacagctgagtcctgtagatgagctgccaggttgtgaccttgtgctggggagatgggggttgtgaccttgcgctggggagatgggggttgtgacctatttgcaaagtagtgagaggcatagaaccaaagggtctgcgaggcagactccacgctgacataattacattggtagccagaccctccacgcactgctggttttccacatcggtctgctttgccttgtcagtcagtggccttgatattaactcaaatgacatttcttccttcctgatgcagtgtctgcaactagcttccaggatagcacagcctcctccattcttgctattctttctttcctctccaatgttggaaagcaccaggctttcatgtttgaccctgattccttctttatttgcactcacttccttagagatctcacatggccttgtggcattcaatgccatctctatgccaagaacatgcatatttatctttccagcccagttctcctttctgaactccagacttgtagatctgagtctcttgacatctccagtctagtagctcttgaacctggcagagcccaagtggatatcctggtctcctcagccccctaaatctcctccacacacagcctccccaccttgatcaggggcttggcactagttgcaatgggaccatgcagttaactctctcacttccttcaaatctaattaaatgttcccttctccctgagttagacgccatatcccatccttggtacctctgatttctcccatcctgatttatcctcttccaatggcaccccacttcagtactcttgcttggaaaatcccatggacggaggagcctgttaggctgcaatccatggggtcgctgggagttggacacgactgaacgacttcactttcacttttcactctcatgcattggagaaggaaatggcaacccactc

SEQ ID NO: 49118 - DNA, 1716 bp, Bovine  19866880481996
cttcttcagcatactggttggggcataggcttgaattactgtgatattgaatggtttgccttggaaatgaacagagatcattctgtcatttttgagattgcatccaagtactgcatttcggactctcttgttgaccgtgatggctactccatttcttctgagggattcctgcccgcagtagtagatataatagtaacataagtttgttttcttgttttctacatctgtgactctatttgtaccatttttttagattccacatataagcaacatcgtatttgtctttgtctttcttcatgtagttccacaatccctaggtccatccacactgccgcacgttggtatcatgttgttctttttttatgactgaacaacattccgttgtcaatatctaccacatccttcgtctaaccgcgtgatatatctataccccacacttgctctcctacactaatccgtccatcaccctgaatcatatggtccccaccccttcacttcttattacatcattttaggcatctctatgcattcctaaagaacaactaaatatacatacttttaagtttataaaaaagtatcatactgcatcttatctttggggaattacctctgttccttatgaagctcagtccctatgggctagttgtctccatcaagcagttattttggtcactgagcaatattccatcatatgagtatatcgaattttactcccatactttctgaatggcagtggtcatgtccaggctttcactattttaatcagagctacttggaagattcttatgcatgtggataagaatttctctcaagtacacacctgggtacatagtattgccggattttggggaatcatggatgtcaacttttggagacaaaaacaaatggctttccaaagacgttgctctgatctgttctctcactgttaatactggagccctcctgaaggcttatatcctctcccgtccaccatattgccagatttaggtatagctcaaagttgtcagtacttagaagtagtatctttacggtaacttgatcttgtgtggtgaaaagctgaagttaggacccatgagtagaagttgctcaggctgagaaagagtggtctcctagtacaccttgtcaaccggagtcagactgtctaaggagcattagacagactatctaagctgtccatccctggaacattcagcccagggcattcctgaccctgggacgcaatgtggctgaagggatacaggtgtcacgtgggcgttcagactggagagctttaaaatgtgtttcagaccctgattctagcatcaaactgttttcaaatatttgtttctggacctttaaatagatacctgaaattataagatgctattttaaagcattttgatcttttatcgtttaaaaccaaccaaataaattcctttaaacccttgagcagtactgaggtgagattaattaaaagattaggactctcgaaagatttttatgttttttttaatacataaagttataactcccaacaacaatattttcagctttaatgggaacatcaaagatactaatattttaaaatcaggtcgtatgtgtgtgtgtatgccaagcccaggatttttgtatctatatgtgcacgtgtatagtgcctattgattatctcagtaataaataattgcgggatacacaagaagaacctgaaaaggtgaagatatctcttttttactctga

SEQ ID NO: 49119 - DNA, 1989 bp, Bovine  19866880506953
agagacccccaccccagcaacttgcagcaaatggagaaatgtccccagtgtttcagagccaactttgatacagaaggaaaaacagtggggggacctagacactggtggggtgagtgtgagcctaaatgaggttcattagcatgtaccccagccacgaatgtttatgagggtcatggatcttctgctccatatctggctgccagcacgctggttttacactttgccacatagatttaatttcccttagtggaagaaaaccacattaagaagtcatttccttcctctgcagaggcagagatgacgcaatggctacaggcgagtcaaacgggattgctatttttctcctcaagaactaattttcattttgatactagctttaggtctgttataaatccatcttgtaactatttcagtaggatgacagagaacaatgcaaagcccggaaaatatggcctccccacttctggtactgccgtcggaagacggagaaatcaagcattaagtggcctcatcaaggcagatcgcaccagatgaatccaaataatttagagcctgcaaacggtaatgcctccttggttatcaggctaccgtctgttatagtcatatgcctcccagatggcagcatcatgccaatgcttagaaagttgtttatgggaaataggaaataagtaaaacaaaaacgaatggtatttgcagagctctatggtatatggtttttaaaacctaggggtttctagtcctaaaagtccccaatggaagcatgtggctttcttcagaacagccatgctcaaccctggctgcccacaggaatcacagagagaactttaaaaactacagatggtggctccgccccaggggttcaggtttaattggtccaggggggcagcctggcgggtggggactgttttcaaacctctcaggcaattctcaggtgcacttgcagtcaagaaacagtgtgtttgggagaagtttgtgtgcacagatagaacccacatatattacagaaagaatattatacattggcctttaagcccattgtttgcgactcaacagtatggcggctttccttggcaacctctgctctggaactgccctttttctctatccaaggatcgtctgagccacaaggctcttttcccagctacatcaggatgctggtctggtgcgggagcttttgaattcatgtggagtctgcaggaatagggagtctgcaggaatatgagcaagcctcatgtcctggaagagctgcctgggtgacttagaaatgaattgtgctgtgggtcagagtaaggttctgtttccccaagcagcccaagaacctgctggctggaaaccactgcctagctaactaacagataagccctaatcatgactctaaacagcgccttatccaaaggcactatttgcctcaagtgaccttcaatggtggaggaggggatggcaacccattcaagtattcttgactggaggagcccagcgggttatagtccatggggttgcaaagagtcagacatgactgagcacgcatgtacccatgagctttaatggaggggtttcacttagaagaactttccagattaccttagaccatccatagggaaaggcagtgactacttattcatccaccagatacttatggtgtccttgcaatgccagggcacagccctcacacgaatgcacctaccagactgactcctctactgccctcatgcaccacccaggtggggaaggtaacaccaaacagttgcttacagatgagatgggccttaccacacgagaacagtgctgggcggggctcacctagcctgaaaggcttctgagaagtgacttcgtttcacaaggaaagaaagagactgttagaataaagagcgatggtggcagtggggagtggcgattaccctaaggaacttccagcaagggctctccaagaagatgagaagtgcaagctctctaccctctctctgccttagcttccccctccgtaaaagg

SEQ ID NO: 49120 - DNA, 1290 bp, Bovine  19866880513996
attgagggcaggaggacagggtgcgacagaggatgagatggttaaatagcattaccaattcagtggacatgaatttgaacgaactctggaagatagtggaggacagaggagcctggtgtgctactgtccatggaaccacaaagagtaagaaacaacttaatgactgaacaacagcagtgataacgattgagaggcatcagagaagtgggggaggaattccgtagctttggtggtggtgatgttctctatcagctctccatccacagagcagagcatggacccatcctcactgaatgcattattgtaactacacgtgactgtaactacatgtactgtattcttggtgcttcatctgcctgcctcctgccacaggagaggaccctggaggtcattcacaaatctgagtctccagcagttacctcactttgtctaagataggttagtctgattatttaaatgatagtcaacacactggtactgatcttcagtgcatataccaaagccacacatgattagaatgacatcagatggaaggtagaggttgctattttgagtcctgaggttgaagactgagccagacttgactttacactggaggagcaagttgggattctcaggagattctgacttgttcttctcaactgtacgagcaagagtaaggaaagagcagaaaagaggagagggtcatagaaagttaacactggaaaggacttagagacgtttgattcaggagagcaaatataaaccaggcgcctgctcctctccatttgacacccgtggtagatatcctcattcctcacagctgacttttcctctcaagtttggacttcttgatataaccctctaggtagcaccagttcatgctacgtggttgacacttggcttccaaacctctctgctactcctgatcttgtttatctctctttatttatatatgagatacatagttatattagttcactttattttttcttcttcagtagaaaatcagtctgtaagaggagagctttcttcataagagaaatcacccacctttcccccacagcctaaactagtgtccgtcagttctcactgtggagggatcaccttggtgattctttacagttctttgaaagggatcatgtgttttatttgtaagatctagttaaagaatcggtgtatgtgctgtttcttactgtgagccagtaccttgctgtattagacacgtatggagctctggtgcaagggactaccatacaagagaggtcttggtcaaaaactgtgccaagtcttacaattttgttatatttt

SEQ ID NO: 49121 - DNA, 1770 bp, Bovine  19866880530027
ggcttccctagcagttcagacagtaaagagtctgcctgtagtgtgggagacccgggttcaaaccctgggttgggaagatcccctggagaaggaaatggtaacccactccagtatccttgcctggaaaattccctggatgaggagccgggcgtgctatagttcatggagttgcaaagagtcggacatgactgagcgacttcactgtcacttttctggtattcttgcctggagaattccatggatagaggagccttctgggctatagtccacagggtccaaagagttggacataactgagcaattgaaacaaaagaggctttgttgtccaccaccgatgcgtgttcagagtaagcagggaatgttccaggtccatggaccagctttcaatccagtctctgtctccaaaggagcaatttggcatcagggaacaaaagtcagaaacttacaataggaattcatgccgctaagatcccagggaacatggggtccgatactaaaaaatatgaggaaagcaaggcgttttaaaaatgctttttagagcaggtaagagacacaaagagcccctcactgctttacacttgtaaggagacccctgctggactcccaattctaatctgcagtaaaaagccacagggcttcttgttcccttgacttgctttcttgtttcaccagagcctctggcaggaaaactcaaaccagagaggcgccttagaattggcttcagcagggacttctctgtcaatcagctgctgagacgaaacataaaggtggggacatgacacagtttgtttttgatttctctgtcttctgatgcgatcgtcctagagcaccatggccatcagctgtgtactcacagctcccttcggtacagagctctggaaaattaaaccgtagaatcagattgaaataatgctaatggtggtgatgagaacacagaggcctggggggactggggtcctggctgagctcacagaggcagggtaaatggggtgggtcatctcgtttaacaatggaaaaatggtgtcatgcgcacggatctatttgttccttcctcttctatcacctgtcttgtagttgtttaagtgcatttattaagctcacatagtttaaaagtccaggggtcttttggtttcaggtagggctagatccaggaaattcaaactacgccattagagtttagtctgtgtgtgtctgtttcctccccactccccacctttctacctgtatctctcgcttacttattcatgaagaagttaaaaattaaaaggtctcaatgacaataacatcccacactgaggtacagagctaggtgggggttagtcaaagaagatatgccgaaggaggaagtatctgagtttgcgattgtaacccccagggaggagagtgatctaaagaggtattgttcaacctgtggtctctgaacacccacccacaacacccatctgatgtgcttgttggtcatgctgcagtttcctgggcctcgtcccagaccagcagaatgagattcctggaggggcgaggccctgctatgcgttccttcagcatgttccatctggatgttgtgtgtgttccagtttaaagcaaccttcctgagtcgtgtacacagaccaccctgacttggcactgagttgtgctgaaggcagacagcctcctgaggccctaaattatggcctcctctttttcatgcagcagtgcagaaagcatggatatcttgtgaagagcccactctaggtaggcatagtagatatgaaatgcacaggaagtttccat

SEQ ID NO: 49122 - DNA, 1366 bp, Bovine  19866880569320
aatttctcctgcattcttatgtcgtatttcccaaacagcatgttgtgagacactagttctgtggcatgttagatgttctccagaagcaacaatttccatgataaataatttcagggaaaattgcataatgtattaaaagttctaaaagatcttgcaaaaagagaacctttccacttttctttcagctaacattttccttaatcatttcaatacaacctatatagttatttttttctcaaatatcaatcaacaaatttggggaatctaccattctgtagaaaactttggcaatgctgctttgccagtagtaacatgcaatttccatccctgtctcttcagtttaaaaatgtgtaattgatctttgtcttattttaagttaattgattcaacaagcattttgtggtctgttactatgtgccacatctgaactagaggattcgagagcttctctaggctttgttttccagctcagcacttcagtcgtgtccaactcttgtgaccccatggactggtgcccatcaggcttacctgtccatgggattctccaggcaagaatattgcagtgggttgctataccctcctccaggggatcttcctgactcagggatcaaacccatgtctcttaatctcctgcattggcaggtgagttctttatcactagtgctacctgggaagtcccagatcttctattaccctggggcaaaattgctgcctttagcttattgctgctctccatgagttccctcactcaactttaggctccatgctttaactagggtatacatgaaatagggcacaaaagccttctctttcaaagcattgtcacctgtttgtcagctcactgtcaaactggctccagggagaaagatagaaatagtttggttccatcaatgagtgctagaagcatatattaaaagttcccagtattaatttctttgtaaaatatttttttcaagaatttgtatattgcaaaatacaatataacattcatatcaagtgatatagggattgctttaagcaaaacttgttctctgtataatgaatactgccataaaaatacatattcatttcctgatcacaaatcatagcaatttaagccatcttccctctagctcaactatgaggagaggaaaatgtgtgtgagccccctcctctttggacagagatgcgttcttctctggaaggaagcttctctgcatgccaggttgcacggagaaaagcctttctctccagggcttctcatgagggctctgggggtgctggcgaggccatcatttgaaataccaccaaggaggtactgaaagatcaccacacagcagggaagtagcctatttttcaaacacaggtcagcataattctctcaaaa

SEQ ID NO: 49123 - DNA, 1716 bp, Bovine  19866880644256
acatttgtgttgtctgccaacacgtttccctcactttccttttgagtatttggcgcttcctcatcagcattctgggtgatttgaatagcagtccgtctttgtccccaagggtagaataggggacccaggtcaaggtcaggttgaagatctcatactcctggtcacagtgattggggtttaggagtggcagcctaagctagtaaaataagcgggaacctaaaaacttatacaggagctactgaaattgaaaaaaaaaaaaagcctattctgcttgatcccattgaactagaacctggaaaaataagaaattcgagttggtagctattttgctaccctcagagagacagtcattggggtcaacacagatatcagatgaagaaaaactgagttctttttatgtcgtttcagccacaaatacagccacagctcagttaagaccttccctggacatttcaactatgtgagctaaaaaaaagagtgccttttcccccataatctagattgaattgagtttttttgtatccacgtcataatgaatacaggcagactccactttgcatgatagcgcaggacaataaaaatgaccttgcaagctgaaaccatgcagtgatcttaatagtcaataagaagaattacagttggtctgtggccttaaaagagctttcctactggctcagatggagaaggcaatggcaccccactccagtactcttgcctggaaaatcccatggaaggagaagcctggtaggttgcagtccatggggtcgctaagagtcggacacgactgagtgacttcactttcacgtttcactttcatgcactggagaaggaaatggcaacccactccagtgttcttgcctggagaatcccagggacgggggagcctggtgagctgccatctatggggtcgcacagagtcggacatgactgaatcgacttggcagcagcagcagtggctcagatggtaaagaatctacctgcaatgtcggcgacctgggtttgatccttggtttggggagattcccctagaggagggcatggtaacccattccagtattcttacctggagaattccatggacagaggatcctggcaggctacagtctatggagtcacaagagttgtacataactgagctactatgtacacaaacacacaaaacatattttaatcaaaacattaaaaatatttgggggaaataaaagaattagttatataatatttagtacacagaaatttaaaacattagaaacattaagaattgaagtgttttatttttttatgcaaaacttatcaaaaggagtttaaatagtctttgctttattattataacttaagatacagagtgagtatcctttctatgccttggcgagtatcatactctttactaagtttggattagcttctaacatttcagcttttgcactttcagtgctgtgaaatatctccataacttcttttggactgaagcatttttgtttgtttttgccaacatcacttcctctgggacatcattctttttgtcatagccactttcctcatttatgttaatgtgctccctttatgaaatttctgtggctgcatgtctagagtctctggaactttgacagtgtcaacagtgactctgtttaccttcagcttgaattctgcaaaatcatgccattttctgaaacaatgaaatcagcctttactgtcagtaaaaggttctttttcagt

SEQ ID NO: 49124 - DNA, 3114 bp, Bovine  19866880667941
ctgctgacttctggctgtgtcttcacttgtggaaggagctaagagtaactctgttgggcctcttttataagggctttaatctcattaatctcatttctgagagctctgcccttaagacctagtacatgtgtgctcagtcatgtctgagtctttgtaaccccatggactgtaggctcctctgtccatgggatcctccaggcaagaatacttgagtgggttgccatttcctcctccaggggatcttctcaacccagggattgaacctgggtctcctacattgtaggtgggttctttaccactgtgccacgtgggaagcctctttaagacttaactatctcccaaaggcccacctcgtaataggatcacactgggcactagaatttcaacatatgaatttggaggcaacacaaacattctgaccatacaatagtatagactggcctctgatgatgaagaaagagagaaataagaatcagtagattctggtcatcgcctgcttgactggatgattattgagacctgattctacatctagcttcccttcttcatgcagcacctaaagccctagtaagggccaagccagcatccctatggtagccatcaacatgacatcaatcaccaggtatcatctgtctggatcataaaggtgtcttaccttgggaccaagactgagggatgagagatgggattggggtctctgccatcttctttgcctctgaaatgaacccacatagatatcctggcccccattctttaaaggagctgagtatacaacttgacccgagtagatggatcagagaagactagaatgaaccatttcccttacttctttccttttctgggtaacttgagtcccctctatgtttctgtttctgagcctggtttgattctgatcctgaccttgggcatggactccgcattgaatagtattctgaaaggtcagtggatctacttatgctctcttaggcacactgagtctgccccagagacatagagttcttctattttttaacagctcttttcctattaagaagtgcttccttgtatgtaacctcatgcttctgtactgctgtttgtggaggcaaaaaacagctggatgttatcggtgattgagtctccagtatgatcaaaagattcttggtctaaacttttctaggttgaaaactccagtcttaacctatttttttgtaagtcttattttcctccttttccaccatattgtaagcattccaagaaaaagcttccttaaatttgttaatcactagaatcatcttgagacctttctaaatatgccaaattgcacatcattctccagacttccggtacaagaattacagggcctggggtggtttgggggagaaggcaatggcaccccactccagtactcttgcctggaaaatcccatggacagaggaagcctggtaggctgaggtccacggggtcgctaatagtcggacacgactgagcgacttcactttcacttttcactttcatgcattggagaaggaaatggcaacccactccagtgttcttgcctggagaatcccagggacgggggagcctggtgggctgccgtctgtggggtctcacagagtcggacacaactgaagcgatttagcagcagcaacagatactctctaaagcaccttcaagatttaagatcctctgtgcttgttagtttcaggtaaagacagcagctaaagtaagaagtggtacttatagtacagaaattaagcatgcctctggggtctcagcttccctggtggctcagctggtaaagaatctgcctgcaatgcgggagacctgggttcgattcctggattggaaagatcccctggagaaggggaaggctacccactccagtattctggcctggagaattccatggactgtatagagtccgcaaagtgccagacacaactgaacgactttcactttcactttcgggggtctcaaccctagttcattacttacagttggatgactttgggcaagtttctcaagctcccattttcatttgcttcctatgtccttggaaaccatgtagaagatttgttgcaaaaatcacatgctcacaaattcccatcattagttcagcacctgactaggtaggatttattggtctccagctaggcagaagtgactcattttaggcaactcaatgaaaaataaaatgtattgagaggatgcaggtaagtgttggaatcaatggaagtctgaactgtcaagtttccagagcagtggcctaattttaacacgcataaaaataacctggggtcttgttgaatgcataagctaaatctagactgtagcctgaaagattctgcatttctaccaaaatcccagctgaggaaatcctgctggtccgcttcgaaagacagaagataaaggagctccagggacctgagaatgaacaagtgataggatattattccctttcagacaagggcatcgccgtctgctcggattctctttcgtcaccaagctcagtattaactcgtctgggagaatccactggcctcagattggctcaccatgctgccacatactctgagttactagaggatagggggtagaccgacagttccactaagctggtctgcaccaggggaggtcagagtccctaaagcaatagttctcaaaatgtggtccccaggccagcagtaaatacaaattctaaaaagccatcacaactctgttatcaaaagaagaaggaacaaatgttggaagatactatgaatcgaattgtgtgctcctaaaattcatatatcaaaaccgtaacctccaatgtgactgtatttggagacagggcctgtgaggcggtgataagagttaaatgaggtcatcagggtagggttctaattagatagggtctgtgtgctctaatcagagggcacatcagagatttttccaccatgtgaagacccagcaagaaagtggctgacggcaagccaggaggtaaaccagcaggaaacgaatgggccagaacgttgagcttgggattttcagcctccagaaccacgagaggtaaatctgtttattaagtcacgcaacatgtgattttggttgtagcagccgatcagactaatacagaagtaatatattcaggaagat

SEQ ID NO: 49125 - DNA, 846 bp, Bovine  19866880671169
taatgtaatttggggaaaaaatttatgcacacaccccacatatatatgtgtattgatagttcccagaaaacctactattttacaagtattgttgattagcagtgagatgtgagtaaaaaatatgtgtaaacaaattagtaaataatcggtacatgtggtactgagaaatggcacaagctacgtgagaggtgcatgactatattggaagggaatgtgaagaggggatgtatgtatgtgtacagctgattcattttgctgtacggtggaaataacccattgtaaagcaactatattaaaaaaaaattcttctgtttgtccaaaacaaggcaaaaaagatttagaaaacggacctgtctattgatggtaacatacactgagttagtggatgagaaaggaagagaggtgggtggagtggttactcaaaaatacacttacaaaatattttactttccatttatcatttgggaccagttgaattcacagttatattattctcgggagctgtgagggtgcattaagaataataaggacattggctaaatgctttaggcattatggagccataatacaccacatgtcttattgttaattcatgttgctagcccactcttttaatagcagccaggagccataatgacacacgctgtgaatatatattaaaaccatccacacaagttgctctagtggtatcggttatttggatgttattttgggatccagaaaggtttggaggcagctagacagaaatggcatctattgggggtttttcttttctcataatgctgtgaagaaagtgccaactctaaatgcttaatctgtgcttcttccatctgtgctctggcccgg

SEQ ID NO: 49126 - DNA, 859 bp, Bovine  19866880671193
tggaggaaagttaatttttccttttgttaatctaatggccacaggcagcgccagtgctattgcagcaaaagtctggaacgactgtcaagctccctggtgatccaataaatgcagtggcaaataaaacaacttccctggaaggcacagggatttaaataatttccgcagatggtctctgcttctctcagtgaagagagaaaaaggctaattgcaacctaatcagaccacactgacatccaggcaaatccattcttttgatcctttcacttttcttctctgaaaactagaaggaaaaataaacagtatcttccagctgcagggaagtactacaggtttggggtttcagaaagtgatgatgtgttttcctctccctgggaagctattctattccctggcctcctttccttatcctttcttatagaactgctttgtaggctgggactcttaactagaacaaagactactatatgtaaaatgaatgaaagctataggctacctggttctactgaaggaaactcagaatctgtcatatctgtaactcaagtaatttaaggaatgtgaaacagagaagcttgcgtgcagccaagatgttccaagtgcactggggtgataagcccagatgaagctcttataaccatgtctcttgctccaaagccctttatgaaggtttgagatgttccagagagagccaccaggtactggtcaaaagcctgtccaggaacctgcactttagactccaagaaacgtgatgagaaagcagcagaggcagctggaatatgacactgactccagagttaacgagtgttagtttacttgagtgttacatccatcttttaaaaatattcttcttactgcttaa

SEQ ID NO: 49127 - DNA, 2223 bp, Bovine  19866880677510
tggagacttcagggctcctggccttgcctccatcctgcagtgtggcctggagcaagtcgcacagcctttctgggcgacatttttctgcgtctccggggacactggctcactgggttctctctactctaacaagacaacacgtacaagggtatgatcctcaggaagtattcaaaattgccctttaggaatctttcagttccaaaattcctcattctctgtttattatctatgtgattggcaaagtgaaaataatgggagaatggtacttagagttaagaaggcagcaggcaggccatgtgggtactagaagaaatgcactgcatttgacattacagaagcgagttctaatgtctttagttatgtctgactctttgcgaccccatgaactgtagcctaccaggctcctctgtccatggccattctccaggcaagaatactagagtgggttgccatgccctcctccaggggatcttcccaacccagggatcaaacccaggtctcccgcattgcaggtggattctttaccatctgagtcaccagggaagcccatgtaccctgggtttctagctgactgatactgaacaatctggtgttcctccctgggcctctgacgtcttgttaatgcaacagaaggactgggtgataggatgttggagttacgtccaagatcaagaagtccatgcttcctttgtgccgttggctcagacctgaattgtgtataacagtcagtctttccctgaattgtgtataacagtcagtctttccctgaattgtgtataacagtcagtctttccctgttacctgacaagctgagatgtcacttgtggtcacataggtgaaagcaccgtaacatgtaggcatgccctctatttcatggagttataatgccatcgtgatgtagtattactaaaaaaaaagaaacagaatttttagtcctcatatattccaccatctcttgaaatacagagactaggacttctgtacatctggtaggcatcatgatcgcatgaagatgtataattagaacaagacactgagaccacagtatttctgtggttgcttcctgaacaagcatgtttctaaaaacatccatgggaaattctgatgtggaatcagtgttgagaagccctgatgggtaccttttatatataggaagtccttggattctagcaatttctctccagacttcggggttcttctgtgactcactagttctataatcatgagtaagttattgaatctctcagtgcttgattcctcatctcaaaagcggggataggaacctctccttcaacttgctggacagattagatgagatactggctgtcttttgaaagctgggtaccatgtagcaaatgctagggtaactattatatttggtcgggaaagtcccgatcctacagaagtaattgggccaggcatgtttggggtatgttttggggtatcccagattcaacagataacaagttaaaagacctttaatattcctaattctcactgaaatttgttactctgccatcattctggccatatcattagatttagtgtataattgaacatgtttgatttaataaattagttgaatgggtgatcattatgatttgggtttcatttgagtccttgaggcaatatttgctgatataaaaatattaggtaatttggaagaattattagaaagattaaaatattaatatgtccccttatttcaaatttataatctcactaattataaatatccatctttccttgtatgtcacttgtaatttttgatttattgcacacaatttatagaaatgtgtgtgtgtttatttgattgggtgtttttatttcagttcaataacttaatcatttttttaagatttacataaatgcctgaaattgatacaaggaagagaattgccacctaattcaaatgtaacagtcaggatatacagtctttctcccataatagttattggacaaggcgtaacacaagaatttaaatcaaagtaaaaagcattatttttactgtgcacctgttaagatgcttctttattggagactatttgtgatatgtttaaaagtacagaagaaaatttatctctagttcgccactttttgtcacttgctattgcttcatttgcgtttacttgcggcactcaaattttatcttgaggttttgtcctgaaagtactttctcagccaccattcgctcgcagtgatatttccaccatctccccgcca

SEQ ID NO: 49128 - DNA, 1139 bp, Bovine  19866880713273
gagacagctggatttcgatctggctaccctctagaagtagatactgaacgtgagctctccttattcccaaactgggtagaatataaatgtgtacatggtaaagtgctattaaattatttatgttgtttgtggttttccagcagctctcccatgaattgcagatctttagcattactttctgatctatactagacgaaaaagcttttcacagactttttgaagtgattctcacagcagagtgtatatgtgggttggttttgttttttttttttttttaaatctctcattgggaatgatccttaaatatttctttcagccgctgagtgtacttcattcctcttctactgaaattcttctgcaactcttaacacctaagagcatttttatggcattgtcattatgctgtattcttatgcctacgctggcacattatggatagatacttctgcgtggcaataagtttctttgtcagtactctcctcaccatacttatttaaagttcacttgcttctgtatatttctgggaccataccaagaatactgaattttcataacaattacttagagatgttgtaagagttagaaatgattccatattgttaaggaagaggaaaaagagtcttggaaatagtctccttttgccctaattagagaatggcagatcgtttgtttgtaggctgatattcttccttccctcgtggcagctgttgtcgctcattgttgttcagttgctaaatcctgtctttgtgaccctatgaactgcagcacatcagttttctctgtccatcactgaactagtaaatctccccattcttccctccttatccctaccaaggcctcagagtcttcaacagactgctctaagcagctgcacaggttacttggagttagcagaagagaggaaacccatttcctaaacttggtgttgtgctaggagaacaggcgatgagcagagcccccaccccgctggctggctggtcctcgtcctagttccaaagacacagtgacgttgctggttggcttggagaagggggaagagctttgatggctcacactggcagttaaatgctctagtttataagtgacataatcacttttgctcacgactccctggcggaattccttccactttacccaac

SEQ ID NO: 49129 - DNA, 2356 bp, Bovine  19866880791110
accccatccctctggcaatggttcttggttcagcaatgggcctgtgattcaagttgggcctgtgattcaagttaggccagagttctctgagcatatctgagaaaagcagtctttccactgtaagttagtgagatgggttcaatccctgggccagaagatcccttggaggaggaaatggcaacccactccagtattcttgcctggaacattccatggacagaggagcctggcaggctacagcccatgaggtcacagagtgtgggacatgactgagcaatataagcctcaagctgctggcatttataacaccttccttggggagaggccccctgaaagatgcagaggcacaaagcccaggtgacattctgtgcccctagatccagccatgctctatcaactcttccattagactttctgctacatgagctaatccattctttctcttgcccttttaacagcctgagctggttttggtcacgtgtaatcgaaggagctcttcatttcctaaggctgtagtctgctgaccatggcttcttgagagctggcctggctctttcccgtagcaccagaagcctggtacatgccctgccctcgtgaaagcctgctcaatgaacacacttccagaccacacccttccagggcaaggacatttccatgcagtcaggctgggggggtggaggggtgggttatcaaacaggagctgcctgggagtggggctttataatattttggatcaaacgctcatataataaggaagcgatcacatggacactcagcattggaagtgtccaggtcaaccggaagagaaggagaagggcattgagccagacaaggaggatcttagaggagcttagaataagacagtaggagctgggcagccaccaggtggatttcgcatttctgcattcctacagtgactaagtcttaatcattatgacagtatttctgcggcaaatggaattaacaaccccgcgtgctttggaaatgttaaattgttaataaatcccttagagcttggcttcttctttgaactccagtactggttcagggccaaacataggtgtgttaaaccatctcactttgaactggtaactcagggcttctcgatgatgcctaggagagagtcccttccactgtggggagacacagatggtactgatatttgattcttgtttttaaatctaaagcctggccatatctggcaaaagaagtcaagaaaacatgactttccaacctgtttggaaggtgagggtgctaggtattccttcaccgtgatccaaaaaatctacactatagcaaagcttcgcccagatttgggtttcaatcctggatttggggcctgaaaggccttaaacagataacttaatgcccatgtgccccggtggtctcatgtgtaaaacaggactgcagcacttccttgcagatattttacaaagactacatgagactgctgatgttaaatgctcagtaagacagtaagtccacaataagagctctaagtacagcagcaatgactgtgatgacaatgatcaacatcatttcgaaactttaagccagactttgcagtgctgaacgcactagtgatggctgaacaccctgtgtgttttccacctgccaccgtttctccaggcacggcccacaccagcaccatgaacgtcagagtccctttccttttgttcttatcctctgttgaaggtcatgaactctcgagcttctgacggaggctgagagaggagctccctctctcaagctccaaaagcaccttgcttgctccacctgaacccaccacacctctcaactactgccccatgatgccgatttacttgcttctagcatccgaagaacggatgcttttgaactgtggtgttggagaagactcttgagagtcccttggactgcaaggagatccaaccagcccattctgaaggagatcagccctggggtttctttggaaggaatgatgctaaactgaaactccagtactttggccacctcatgcgaagagttgactcactggaaaagattctgatgctgggagggattgggggcaggaggagaaggggacggcagaggacgagatggctggatggcatcactgactcgatggacgtgagtctgggtgaactccgggagttggtgatggacagggaggcctggcatgctgcgattcatggggtcgcaacgagtcgacatgactgagcgactgaactgaactgaactgagcattttcctgattaaatggaggttttggggacttccctgttggcacagtgcataagaatccacctgccaatgcaggggacatgggttcaatccctgattcgggaagacgccacatgacgtggagcaacgaagc

SEQ ID NO: 49130 - DNA, 1729 bp, Bovine  19866880792873
aactatcgtttatgagatggagtccatcatgtggggaggacagacggcagctggctacttaattccaaatgtttccacaaaaagtgattttggatatggggaattatttcaagctaccttcacataaagagccatcatcagtggtccaaataaacacaagtaattaatctttgtcaccttcacagtacacttcatttctttagagcacttttcaaagtttatagtaattttttaaaatctgctcactattccttctttttttttggcaggggtaggaggagggtggtggtggattgtgtccccaacacacaacaaactctgggtaggaagaaactctgactctttggtccagttttgcatgtccactgtctgtcagagttccggctcaataagtgttgaatgaatacatgtgcagatggcatcctgaatgggtggcagagtggaaggaggaaaggatggaagccaggaagccaggaagctagcaagaagggccttctgggtaacagatcccaataatgaaagcaagtctcgaggatgacaaaatctcagtctcattacactacaggagaagtaaagactcgcccacctacagatgcaggaaaacaacaaaaatgggtttatttaaacaagtgggatagcaatagaaaaaaccaatactaatagcagtcagcaattacgcagcacatgctgtgtgccgggtgctattctaaatgctttatatacgtaaactcttaattcttaatgaggaaaaagtgagtattctttcttgatccagaggcaaaattatatcaatcaggggaatctgcccatggccatgcatggcccacataactaacacacacacacacacccatccacccacacacacacacacacacccacccacccacccacccaatggtccatgatcacctggcagcatttaattctacaagcaaatttaacccctcactaagtgtctagccaagaagactacctagttttcaggtctggaaatctgaagaatcaatctgcaatttgtttcctgcaaaaatgtcattgccttcttcatacccatcactggagaaattacttttcagacccttctacggcttgggaataagtaagccctaatgagttcaaaagttggtaatgacactgctaatttggaggcttgtctggcagccagtcaggctcccttcttcactggaaaaaacaggattatcaagtgcgctagaagaactgtctccccatgattgatgggaagaaaaagtaatcacctttgaagtgccacaacatataatacctctgcagtgttctctttcttcttctgacacccatgagtaattgaagggaagggagcttcttagaatgaccaatgaagtgaagatgacaaccctctctctgccatctaccaagaaactgacacgctaaagtcttagacagtggagagctgatatgatgtacagtgtctttgatgggctcctctgatgcttggctcagcgtgtacctgctaccaatcagactgcctaggctttgggtaaaacatagatccaaagatataagagttactgcttctttggaggtcaaaggcctgggacctgttgtgagaatagcagcttgagggtgaaggggaaagtcctcagggtacaagtgaatgaaatccatgaggaaagcaagatggaacaggtaagaaatgctgcatgctacttcaaaatgttatctcagcatactcacatactcagctatt

SEQ ID NO: 49131 - DNA, 1936 bp, Bovine  19866880819228
aaaaaggactgcagcatgattactactgctcattctgatccctagtaggcatacacaccctcccctgagtccccttcctgaatgctcctccctccgttatttctaggctctggtcacaactgttgtttccctttcttgcttccttccagcctgggctctgtttctcattttttcaatgtcttcttacctgtagctacagagcataaccgcctggagaaggaaatggcaacccactctagtattcttgcctgggaaatcccatggatagaggagcctggcgggttactgtccttgggtctcaaaagagttgaacatgactgaacacatacacacacacacacacacacacacacgctttatgaaacattttgtaaaaggaaaaattgtacatttttataatatttgtatgagtaaatataatgttctgaaaataaaagctaaaaaaaaaaaaaaaaagctactaagcttaccatgttgttttgccagccatgcaagcatcacgataaaaggcgacaaagcacaggtatagaactggactttgatttttatatttatttattgaccatcctgagtggcattgtgagatcctagttcaccgaccagttggaacccacacccccttggaagcatggagtcttaaccactggaacacaaaggtatttgagagtgaggagaggagatttgggggcaggcagttcagctgtggagctgtggagaggtctgccttcctccaagggctgctgaggtggcaagaaaccagaggtctttcctaggtcctgagatccaaaggttcagtcatttctcagagaattcccagtggtgctaagaaagtgatgtgtacctctgtctcggttggagacttagcagggggctttggaagaagcccttggcagccagtaattatgaaaataaaagtctaatagtataaaagacagtgattagattagtgacacttaaaatcattgaatagtgaaaagagggctgagtttgtagagtcacaataagcttgttgcttagaagtcatgaagggaagtcagctgtgtgtttagcttttacattagtaaatgaaaactctcccattagtacctcaggaaagatgtgtttctattatgaaacaaagcacggattgattatgcactgcatagatgctgtataatacagagctcagagagcagattccggtgcctgacacacctgactgaaccctgcttctgctgtttcctagctatgtgactgtcttagcttgggctgctataataaaatactatgggttggtgacttaagcgacagacatttatttctcacaactctggaggccggacatcctgagatcagtgtggtgacttctggtgaggcccgtcttcctggtttgcagatggacaccttcttgctatgtcctcacatggcagagagtgagcactctgctcttctcttcttgtgatgagaacgcagatcccatcgtgagggcaccatgacctaatctgattatggcctcttggccccatttctaaataccatcccattgggggttatggcttcaacatatggatttaggagggggtgcagacattctatccataacaatgaccttgagcaaatacttaagctctttatacctaatcttctgcaaaacaggtaagtacctcctcaaatggggcgtttcaataaagtgcttgcccagggcctgccacagagctagtgcttagtgaacatcagctctccccaaggaactctgctgggttatgtctgcctgaagggaacttgaatcccaggaggagggtctcgcttcttttgtaatgaactgtttcctcaaggaaaagatccttttggatgaaaaactaactatgtgaacatgaatgtgtgtgtgtcttaatagccaaaggttaactgtaatgtaatttggggaaaaaatttatgtacacacacacatatatat

SEQ ID NO: 49132 - DNA, 765 bp, Bovine  19866880868805
tagcttgtgacatcttcatatgtttcaatactggttataattcagtctctctttgttgtctccccctccgcccccccaacccccacccccgcaaaactgggtggacagaaagaaggtctcacatctgcagatctgagtcagacttcaggctggtggcgatgagtcactttttgcatctttacactgacgctgtgaagacgggcacatgatcatccccatttgataggtgagacaactgaagtgaggaaacttgcccagcgtttgagtgctagtgagtgtcagagccaggagaggatgcaggtgagctgagtcatggggacggcggaagcccagccagggtcaggttcaaggtcagcacttggaagtggggtggggcgaagactggctcttctgtggcctgcagatcctagatctctgctctcatcaccctttacttgccaagcccagctaggaacagcttggactatgacagccagagcagtaaattacgtggactgctcctctgtttgacaagaattacccaggaatcaaggagaaggaaccctcagataggcagaaattctcgaacggtccccctgagaaatagcaacgccttgccggtgagctcgctgtgcacatttgctgctctctggatgggtcccagttgggccaacttctgttcctggctgtttgtctgtatcctggcagctcagaggtgtgatttctccaaatgccacattcctgctgagcccacgggatgaattgtgcaatttcaggtgagcgcat

SEQ ID NO: 49133 - DNA, 928 bp, Bovine  19866880884238
tatcattttagacagccttatgtgcattttataagaatggatgtttcctataagcttatggggttgctcttgagcattaaataagaatctaagtttcacagggcctggcaaagggtactcagtcagagttagatcctagcattgggttgtccaaaaagttcatctgggtttttccgtaagatgttacagaaaaccccaagcaaactttttagccagtccaatagttagcagtgaactacaaattagtaggtacaattgtatgattctagagataagttccatacagcacttggtagaagtctaatatgcaagttggaccctagacttcaaggtctcctcttcatccccagttggcaaagagtcagcacctgttcgtggtgaactggggatggagagaggaccttgactcatgatgtagctctggcatttctgaacggcgtgctgcgagatgagtccctctgagcctctcttttcccttctgcaagacgtgaatggttctaccagcctcccaggatccttgggaatttcatgagcacatgccaggagagttctggggacagaggaagtcagcaaatgttgttctctcatctccccacctctctccccactccgttttctctcccaggacctctccactcctctcctgtttgggcttacccctcagctactggagtattcagaccacactcacacagtcctcccagttatattttagaccccacctcttttcctgagtaccactccgatcctgatcctggagttgatgagtattgatggtgacgtttgtgttcatctgtggcccaagaacgggtgcacgtgttgcctgcctcaggttaacagctctgttgaagacaggaagcaaattacctgtttgaaggtggtcctttgcacctgaaattcattatagatttaaagccattttgaaaat

SEQ ID NO: 49134 - DNA, 1039 bp, Bovine  19866880936155
cggctgtagtccatggagtcacatagagttaaacccaacttagcaactgaacaacagcaaatgtggctactaatcatttttaattgtgtacgtaactcatagtctatctatacggggcagtcttgctttagaatgcaacgtgcaaatttcagactgggggcactgaagatagatgtaacccgatagtaacaaaagcacacattgtggtcacccaagctgcaattacaaatgccaggctatgtttccagggttctatgtgccattctctgaagctggcaactcagaggcctattgttcatctctgctcgtgtacaagacacgatagttttaaagactgagccctgctccaagctaaggggtaatgggatttataaaggttatttgaataagttcatctttcttcgtttaatgaatgacagatgagaactgaaaaacagcaaaggccttttcaaatgctttggggctttaaaatggtgcttttatcttcctttccaccctaattcttgcttattttgcttttcttctttaaaagagagatcaatcaaaatatttaggggctttcctctttgaggccgttgtaatttatattgatagaaatgtgtcagcgtttaatccatatctttcttctttttgctgtatttatccatttctgctcagcacttattcctcctataattttttcctatccccattccccacactctcaactctccaagtaaaatggatttgaaaaaatttcttatgggtgatgtttatttaaaaaaatatttaaaattaaaaaaaaaaacttctttattaaaaatatgtatttatatatttatttggctgtcccaagtcttggttgtggcatgtggcaaccagttccctgatcagggactgaaaccagattccctgcattgggagtaaggaaccccagtgttggttcagcccttgaaccaacagggagtccccttatgggagatcttgatagttggctttagtgggtcataagctccaaagttatcaaaactttttcagacactcctcgtaagagactgtt

SEQ ID NO: 49135 - DNA, 2920 bp, Bovine  19866880988788
ctcctttgtccatgggattgtccaggcaagaacactagagtgggttgccatttcctactccagaggatctgcccgacctagggatcaaactcgtgtctcttacatcccctgcatcggcaggcaggttctttatcactaatgccacgtggtaagtccagttcaaaaccccttctgcagttctaagcagaagcaggtcatctctgcagagacaatccagccacattatacttactgtgtcagagctgacctatatgaaaaaagtggcacccagcaaaggttaactaaaatatatataatgactcatttctgcaagatgtgactttacatggaaagaagaaagtctaagaaacagtgtccaatgggccttctagactgccggtagttgcattcaccacccttctatataacgatccctggtgtgtaatagaaaaagatgtggtccagtggctaatgaaaccagaacagtacaaagaacacatacactttaatttattgtccctctggtgcatctggattcttatccaaaaaacctctttaattagagtgctctcaggtgggaatgtgtctgtctcttcagtagcacatggataataagaaaaaggcaaacaacctctttgtttcttaccagcactctattctctaatcatctttcctaaattcagctcaggcttccgcctgagttcatttcatcttcatcagcattgccattttctatctcatatttcaaagagtgattggaaagcagatatttaatcagaaaagcttgagattcattttttggacacccaatctgtcttcagaggctttgagacagacaaaattgccgttgactacaaaagcaacccaagtctgtgtccttgagaaacactgaaacctgaaggctttagagatagccagatctggttcaaattccaacttaatcatttattagctgtttgatcttgggtgacttgcccaactctgcagagcttcagttttctcttctgcaagatggaggtaactccctaaaatgtatatttgttcaggctgcttcatgcatttgtccttatatatgcattggcccttacgtatataagagaaaccagcttgagctaacttgggcaaaagggggttctcttacaaggagaaaattaaggcctcagagaaatagggttaactgtggactgtctgaacgatggaagggagctccagaatatgctgtcaccctccatggagaccaaggccaggagggtatccaggcctcaggaaaggttgacactgggcatgggatgctgccaggaactcaaccagtgctctttccccatctcttgactgtttctctctgtgaatctacatcatctttccccacttttttggcttctcatttagctccaggctgctagcagaagtcggcattaccagagtttctgaatgtagctgctccctgtccagccacatgaagaagattccccactgatttctgttgatctcaattcccaatcacaaggaaggaattctgattggtccagctggggtaatatggtacccaagtttgctctgatctgatgaggttgggacagagggtcattctgtacaggatggctcctgtggaggagatctactgcttttgatagcaaggttagtttaagggcaaccagtgaccttgaaggacacccctaaaatgtattcactaccttttgtaagaatatatgagctgacacagtacctggaaaggaataggcattgaataaagataactagaatgtcctagtcaataagagtttttatgagatgaatttaaattgaccttccagttttcatccacataagtttcttgttttctgagtgggataatgcaattggtaatttgaatcccaaaatttaccactgagatcttgacattcaaaaaaaaaaaaaaaaaaaaaattctattcagcagcccaaccctggagacttacagtgaggacttctgctctgccctccagaccaggtacagtgggggctgctctgccagtcctggagggtggaccgtggctgctcaccatcaccctagtgagaatggggactctgtggcctttcctgggaccacagtgtacgtaccccagaaggcatcttactacagacacaagatgactctgctttgtccagatgctttctgattagaaggccccaaatatcatgcacatgaaagagaaaagcaaaaattgggaagtaaaactacaaatgctttccaattgcagagttgagcatcaggcctgatattaagccttttggtcttcagtgaggttatttatgtgtgtatgtctcttcagtcgcatctgactctttgcaaccttagggatcttaacccttcaggctcctctctttatgggattcttcaggcaagaatactggagtgggttgccataccttcctccaggggattttcctgacccggagatggaacccatgtctcttatgtctcctgcattgtcaggagatttctttaccattagcgccacctgggaaggtttataatgtaatatagagtcctttggggatggaggaagctaatggtctgtctgactgctgaggaatcctaagtgagactttttcttacaaacccaaaggctcttttataagctatgtgttctcaggaatccctgggatgcttccctaaaactaaaacaacactctaggctacagactaaggctccaactaagcctatctatttgatcagttatgacttctagccagagaaatgactcgtctcctgaaagagtgtttctcaaaagatccattgaaagtgcattttgctatgatttcttccttctctgtttcattcgtctccctccttcaagctcttcctaacttctgccagtgaatctctctctgtcccatacccatttttcataagcaaggagcatgagaaacaccactttccttttgcccagtccttcc

SEQ ID NO: 49136 - DNA, 691 bp, Bovine  19866881052221
gtatctgaacacaagtgttggtataaatcccagtgctagggaactgggaatgctgttaaccaaaccagcaagactgggaaatgctgaatattctacctctttctttgaaaagtcaaaaaacaaagagacccttgaagctccatttaaaccaatcttccagattgacctgagcaatgacaaagagcccttcaccaccatcgttttccttccctccagaatacctatttacactctgtagaacataagtgaaggattaacctatgaccgtgacttatctgtagtttatctatttagtataatatactatattgtagatttaatgtcagtctgtttgcctgtctttacctcattttatttttctcttctcttcttgatctcttttccttcttccacctccacacttgcattattaattacttgtccaaggccaaaataagtcaggagtacaaattcaatgaacaaacaacccaaagctcttaacttcctgatggcaaatttatatgaaattagtgacatctacttcaatatgcattaacctccttctcacaagctgctgcttttatctcaggttctcaatatgctttaggatgtctttcatttcttccttatctccgctcctacttcccccaaagacttttaaaaaaacatgtttggggttgataggatcggtgcacttcctcgaaatcaaagt

SEQ ID NO: 49137 - DNA, 767 bp, Bovine  19866881087728
acctgaggtggtttagcccctgggccaaaggagaggggttagactataccatcagagcaatggaggaaaacgtgagaggaggtatcatcagagaggaaactgactcaggctgaggaacagaaagggaaccaaatggacacagtggaacagaaatggataaagatgagagcgacaaagtagctcaacagctgcatttttttcctccctgaaggcatggcatgagcggggaatagatgttaataatcacaacactcctgaagctcacacaggcagacagagtgtgggggagcccctaaggggatggagtgatggccaagtagctcactgggtgattctcctcccaatcattccaggaatcccctggtatgaaaatgcaactatttcagggagaaccacgtttaataatacacgactttagacaaccaaattctatacctctaagccaaccttccactccctccacctctaacacaaccaggaatttactctccagaaacaaacaaacaaacacagagatattatcacaatggactcagagaaacatttgtaccccctcccctcatctgaaaacttgccttggctgacttcatgtctgctcccagacgtcacttaacaaaagactttagaaacttcaggaacaatttatttaaagaaaactccatttccaggatcctatgactgtattccaaggtaataaaatataaatgagaataaagaacaagctaataaactgaattgaaggctgcatttcaataataaggtttggg

SEQ ID NO: 49138 - DNA, 1413 bp, Bovine  19866881089078
tactatggcacctgatgcaaagggttgactcattggaaaagatcctgatgctagaaaagattgagggcagggagaaaagggggcaacagaggatgagatgttggatggcatcactgattcaatggacatgagtttgagcaaactcgaggagatagtgagggacaaggaagcctggcgtgctgcagtccatggggtcacaaagaattgaacacaacttagcaattgaacaagaagcaaagagacaatgaaataatgaaagtacaaggaaaagattttaagaatgctaactataaccacagcaatgactttacaagtctccaaatacggttcagcaatgaggaccagtatagaatgaaaaaaaaaaaattgggtgttttccttttttaatttttgtttctgtgaaaaacatcattaaaatagttaatattcacaggcagtatctgaggcaagagtaagtgtgtcaccctttgcagaaacatggagcatgtacaagtataatgttgcttttttttttagaatcgtgtgatatatttgaacatatagcagctataagaaaaaaatgctgccagtatgttggtaatggttgggaggatggttagatggctgcatattgaattaagcagaatcaaggtccagaagaacaaggctgaactgccacacacatccttactacctcctgcgtaccctgactccaagtattattgctccagtaacaccccaaaacttacagtgttctgaacttgatagtgtcttggggtatctgtatctttttttgacactgtaattcttgattgaccattagaattttctgcagtgtctcatatggtagctgctaaccatatgtggccaccgagcacctgaaacgtggcttacgcagcctgggaactgaacgtttcattttattgatttattatgtaatttaaatttaaatagccatatgtggcaaggggctgctggtggttgcataacacaggcctagatggctccctttcttccttccctaactgggccagcaaactcctgctcatccctcaagacccaattcaaatgccccttcctccagactgcccttcctgttccctctatagcagctgtatggacctccagaatatatacttagcatactgtattagttattttatgacattgatcctcccactaggtgagaatctcttgagggaggggaatctgtctggctcatctctaaatacttagttgagtgcttggaacacgagaattttttgacaaatatttgctagatgctcaagcgagacagtgaaaccatctttagatatgaacaaatatgagcagagattcccaagaaagttcttccccagagaaggttttgctgccttcacacaagaagttgcaaaccagttatgaccttcagagttggcagtattttgtcatgtg

SEQ ID NO: 49139 - DNA, 1161 bp, Bovine  19866881116639
ttttccttttggcaaagcaccttcatagattcaaacatggttcactatgccttaaacaaggacttagagttgtgctgtccagcagggtagccactgacctcatgtcattatcgtacacatgatatgtggccagtctacatcacgtgctgttaatctaaaatacacactcaatttcaaagactgatcacagaaaaagaatacaaaatatcacattaatttttaaaaactaattacacattgaagtatttgagataccaggttgaataaactatattaaaattaaattcacttacacctttttactttttaaatgtgatgattagaaaatgtaaaaattacatttgtggtttgccttttatttctactgggtatgggtatagagggtaaggagaaaaaataagatgatgagctcccatttctggctaatatatatatttttttaatttgtcatattaccagttatattttttttcagattaaacatgcacattttcacacagaacatattctgacagaagacatgagaagtgtgcacttgctatcataatgattattttgtagataacaacagctgtttgcctatacaagcaggagactgtttttccacataccaccaagtactagcgttcaatcatgaaagaaacataattctccctggactttccccacatggtatacataagtagcaagctgtgcatgcgtatgtagtctaaaaatatgaaccaagttggggccactctctggctgatgactttgccccttctctcttaatatggcaaatacagagtgctcacatcaggctgacagagaagcaagtgaatcattaaggcccatacaaaatccacacaggataggtgagcaccatttctgttcttccttgcagaggagattagaagacatttattccctgatggagtatgaaaacactgagtaaaagtcaactattaaagaacatagtttgttttatgacacttaaagagtcgcttgaaagtctcacaattctcacaattccatcaatcatactgtgtaattaaaaatgcattgtggggctatcattaaaaaagtctacaaataataaatgctggagagggtgtggagaaaagggaaccctcttccctgctggtgggaacataaattgatacaggcactgggagatcagta

SEQ ID NO: 49140 - DNA, 2045 bp, Bovine  19866881154054
ctgcggatggagtgagggtggaagggaaatgtcatcaggactacactcctgatgaagagggaggactctgcagccagatggcctggtttccttcccagagctaacacctatcatttctatgactctttcaaaagtcaacctttttagcctcatctatttataaggttataaaatgggggtcttaatagtatcctgcctcataggggtgttgtgaagatcaaacagatgataatacatgtaaatgtctttgacatagcacttgacacacaggaaagtctcaataaatatctgctattagtttataattttcacttaatcctcatgaatctaaaaatagggcattgatattttatacttagactaaggtttatggaggcagtcacttaacaacaacgataagaacaaaacacaagttacagataggagagttgggattcaaacccaggcttgtctgaaagcctgattttccattttatcatctgagctgatcctcagaacaccttgtactcagttgctgttgttcagttcctcagttgtgtccgactctttgcgaccccatggactgtagcccgccagtcttccctgtccttcactgtctcccagagttggctcaaactcatgtccattgaattgatgatgtcatccaaccagttcatcttctgttgcccccttgtcctcttgccctcaatctttcccaaatggcatttgacccaaactgcatcagggtcttttcaaatgagttggttcttcgcatcaggtagccagagtattggagcttcagcttcagcatcagtccttccaatgaattttcagggttgatttcctttaggattgactgctttgcactctgtaagcatagccaaagatacataagggagatgttttttaaatattttgtctccctcaacatagattcatctgcattgtttttctctgcttagaataatgtgacttccatctaaaactacccaggggactctctctgtaattttattatacaggtgaaggttaactaacttaaatgctactttattgctggatgtcaatttacagcagaattatatgttttagatgtttaatttttcattagtgctaccaaacaaattcctttagtaattggaggtcctgacatatagcaaagtgggtattggctgttaaatttatttgggggtctgtgacacaaaaatgtggcaaatattttgatgcttttttaatgtcagtgttttacaggtttcggtggactatcttttccacctgatgctcagagtttggggggttattttagtcactgtcaaatcaaatatactgtgaaaggcaaagtgctttatagaccttaaagtgctatgtaaatgtaaggcattattattcagactcaccttcttccctctgttgatgcagttggggcatttattctctgtcattttgctgtgaaatactaggtgctaagtactagtaatcgctgaagatattattctctcactattttgctgtatatgtttcaggacaatgtgcataaaattctctaactccatgtaaccacttcattttaagtttaaagttttaaacctgtgacatctaaataactggcttgggtaaaatgtttattttgttaaaaaaaaaaaaaagtagttaaacttgttccgatgaatcctgtgacaaggattgaatagtttggactaaatatgagtggtcagtccagtcttctcagatgattaatttgttacaggccacattacacaccttgaatacagaacagggagtgaaaggccctaaaataatgggtgctttggttgaaactggacatttcagctcaaacagatccagacagaactgaaaacatttgtttcagtactcagtaaaaagaataaaatataaaaggagacatctgtttgagtgtaaagtgtgtggatctacgtattgcttagtgaaagaggcagccctggtttgagatgcccctggtttcagggccaggtggaggggcaccctggattgcccagggtgcagggacctttcaccgcctacctaatatggtcctggttttccgt

SEQ ID NO: 49141 - DNA, 1855 bp, Bovine  19866881170337
tttcttacttatagcttatgaattaatgaaccactgagattaagggtatttactaaagatgataaggttttgatactgataacttcttaagaattgaaagaagaagtcaaattttctaataaaacataattagggagacctggccattataaaagttacagtctgaaagtttatactagaaaagcatatgatcattgtccataaaaatctttcactgagataactaaactcattttttctgaagagaagagagctgacactcgcctttactaagccatgcaaaatagccctcgtcagtcccaaagacacttcactctgcaaattcattacattttccaaagatcctatggaactattttatatcatccttaaaattattccctgtatcaaccaaaattggatactccacacacacagtcacaaacacacggacattcagaagaggaattagacaatctaaataggtgggtgatcaaatttaaaggaccacttctaacctagatctggctgtgtatttgtgtagtactctcctcacaatacctaagtgatttgaagctattttattcaccaatacagaatccttatgaagttagtggtctctcatccatcatttaaacagttcctaaaaaatccccttcctctacaaaatctcctaaggagaagagggtggttttttccctctggcttcatctttcctggacctgaaacaaatctgtggctaattgtttatctctatattcctaaatatgcactggccttcaatgtgaaatgctgcattgtggctctccatatttctgggcggggttcatctacatcttttctggaggatgcaaaagccatcgcgacagggactaaatcaacaacatgcagatgatggggaaatatgggattctggtaaacctgtaaagcagcgaaagttaccacctctgcttttaaatcgaatataaagaaactaaggtagtacaagccatggacacacagggtctcacaaacaaatacaaaggagagttttaaattcattgaggcatttcagaacagaaaaccagttcagttttcaatccctgtattttcgaggggaaagtttcttcagaacctgagtgttctaatgaatacttgccaatctctaattttcaggggcctgtttttgcttgcctttttactctatgcagtcctggccagcttcaaagattgatgagatctgagagtggtattagatttaacaccatttcaagatgggctttaagctcagtgtgaatgagttggataggaaaagaaataggaaggaagaggaaggttctatggttgaaactcctggccttacagcaaattgaaatattattattgcaatctcctccagaaatctctggggtggtccatgatgctctcagatcatgctgtttctcatggtggcatctgaatgaagatattatagggtagaataaattgtaaatttatatgccacccaaccagggtgagaaatttcttgaaaccagtgccattttctgagactgctccttgcttactccacatgggatgtttggcctgtgctaagcagagaaccagttacacggggtcagcgtctcagcagttcttttcctcaagcttagttcccttgtacaagggatgggttatagaatactgatcactgtttaaagatttctcactttgccttcaggggcatcatcaaaatcttcttgttctgattctatcagaaaccaagattttaagcaagtagttaaacaaaatcttcatgaaatgaaacatgcaaaataagattgatagtgataaaatgtttagaagctgtcgttgacaattctcaaagcacagaataagagttaaaaaatagacgtttcaa

SEQ ID NO: 49142 - DNA, 982 bp, Bovine  19866881174011
aaatgtcactacccccccccctttttttttaaatgtttctacacaattgaagacaacattactctttccagagtgggaggctgaagacaactgtgggtgggggcttctttagaagaaggattgagtgtttacttttaaagcagtctcagaacatttaaaaatagggattccctttgccaagcctcctggggctcccactcccccaacagctgctctctctcctggccttttctgctttttgccccttcctcacctccttctccttcctttttgcttctaatcactcatttgccacccactccaggaaaaaaaaaacctgtcttctcccctcttattttttgtttgcttttgttttgaaaaataataattccaaatgaacaaaaaagatgcgtgggaaggagatgatttgtgagctcttagttattccaccaactgccaagttttaagttcttcctgcagctcacactaacctcttgagcaaccagaaattgcaattcctcactaaagcctagatgattctaagcataaagcagaacatgaataaggggcaggggatgcattctgattattcatgagctctgaaaaatgccccaagaatgtctaatggttttatgttaactattaaaaacttgtgggcttcttaggtggctcagccataaagaatccatatgtcagtgcaggagatgtaggttaggaagatcccctggagaaggaaatggcaacccactccagtattcctgcctgggagatcccacggacaggggagcctggtaggctacagtccatggggttgcaaaagagtccggcatgacttagttactgaaacaacaactaacaaattaacaagttataccaaaaatgtactaattatagatttttccattttaatgtgttttcaacattgaaacctcccatttactgtcattattttaatgatggagaatgtctagaacccaatctgggttaatctacaaatgtagaa

SEQ ID NO: 49143 - DNA, 707 bp, Bovine  19866881202877
tggttatatagagcgaagcctggtgggctgcagtccatggggtcacaaagaattggacaggactgagcaactgaaatgaccttataagggagggttttgttcttgaatttcatgtgaaactatcagagttttagaaagtgtgtagtgcgtgatatttggtcctgaattttggactaattttgaattacacagtagtttttcttcagctgaggagcagctgaaaaaggtgatgggaatagatttccctctggttctagataaaaggattaaagcaatcacaaagcagaaacgggaggggcgtaagataaggtaatcacgaaataaaacaaatagcaggaaagcaaagaagtccccatttcagcggtagatagaggatcagaaggagaatgtccttgttgccatttctcagtgtgcagacaatgagcagtcttaaaaggggaggcagtttctgtcttgagatttcatttataacttaattatgtgttctacaataaattccttttacggtaatgttaattgagaatgaatgcggttattacttacattttgatcttgtattacttcagtaacttcttataaatcagcctttttagatgcaaatagaaagtgcttccagattttaacctggaaagggcaaactccatagcaaaaagagagaaggtgagcaatcttcataaattgccatatatgactcattctcttatgag

SEQ ID NO: 49144 - DNA, 1387 bp, Bovine  19866881214366
attcgatgttaaaagccccgtggtagctgtgttaagcattacagccacatgcagatgagcatcaaaggcacattaagtttatctggcatcgcttggaaccaagcattgccttacttgctcacagccagtctcaaagccataaaaccttatttcacaaaaatgtaacattaacaccccagttaaacttgcttctgatttctaacatggaggtggggaaaaaaaaaagaacttttctatgattttggcttaggaactaactgcataggaatttgcatttgtatgaaggagactgaaactcagcttcagaatcatccaggatttcattctcttattttattttattaagaaagcagagactctcccaataaatcctcctcccctcttctggcacacttaaaacccatttctgagctccactgaccacatcacgttgacctttggtattgagtaccaagggagggaaagagtaggtgtgtgggtggagagaaagagaacagaggggaacacgggtcgaggagtgaggggacaacccaaatgtggggccaccgcatgagcaagccctctgctccacattagcaaagcaacaaaagacggcatagaacagaaccagaaggcggtcagaggcgccccggcctcaccggagacacagcaatccaaacccggcatctgcgctgcttcccagacaccacttcccacgagctccctggactcaggcttgcatttcaggactccatgatttagtttctgtttgagcatttggacaataatcattttactacaaaaggtaaatgtcttgtaaactaatgggaaacatattgcttggcaaagtttataatgtcaggatttatggctctaatgcctagggtctctctgacctcgaagataacatagtgaaacagtaatgtgctctaaatgactcagtgtgattttttattagttctcgtaatcaccccctattaatttgtatgcacataataagcactcaccttcacagtctgtccagcttcggggccatcctggaaacaggaaaacaaagaaaaaaaaaaagaggtgagaacagatagatggtatctcctgcttattcagaaatagcgcccattaataatttagatccaatttcattgtgtgttaatttatagtttcctcaaggggaccatgagcttcaaatgtgtagaacctgacggttctccatttctgtctgagagtaagtgagaagttatgtacaaaaatgatacaaattatccagtgagccaacccccttcctacttttcatgctctttgcttttggctacggttttaattccattaatggaagactggaaatgtttggggaggtgaagcatcataccttttggttatctttaaaccagatgtagtttaaagtctg

SEQ ID NO: 49145 - DNA, 691 bp, Bovine  19866881242736
cacagtggtaaagaatcctctgactagcagatccaaggagtttgacccttggatctggaagatccgttgtaggagaaaatggcaacccactccagtattcttgcctgaaaaatcccatggacagaggagcctggcgggctatagtccatgggaccacaaagactcagacacgagttagcgattaaacagcaacagcaaaattttaaattagttagacctgcatcactttctacagtagaatctctctctttcccctctttacactctaattcactatagatgggactgtccacagcagtagaaaaacttcccttttctgtttgaaagacccccttttaaagtcctggatcctgttaatttctgatggaaaataacttctaacattggtggacagctagaatgtcagtgagcctgctttgggtggcgtgtttataaaatcgtgtatcgcttcctcctgtgacctgtcataaaacgtgacataacgcaacgtgacagctccagttttcaggatggcatcttgtgttctgctttcaaactccaccgtttcagttacccaacagaagttggctgacctcagtagagcagacggggaactgttaacaggttgccaactctaaatgagtgtggagcagcttagcgtatctctagaataattcctttaaaacacagttaatcatcatttcacatacgt

SEQ ID NO: 49146 - DNA, 1682 bp, Bovine  19866881259766
gagagccaaagagagggagagatagataggagaaatggtaatggaagagaagcattgactatccgtcagtccgctggctaatggatgcccatctctttgtccaaacatgacaccaggctatacaacaggctctcgtgccaggcagcagcagaagcattctgctgttttctttgtaaccctttgccttgccaaatgcctgtgaaggaagctctcccctagcccgtcaacaaccaagactaacagggtaattctggcaagggttgttggcagaaatctctgccatctcaagcgccgggctctaaggagggacccagtcccctcgttacataaacaaaatgttggcaggccagagagtggaaaaagaagcatggcaaaaatgtatacttttggaggaaaaaaaatctcaacttaagccatattgtttttattgtctctggaaaaacctttctactgtgtgtttccaattggaaaccatttgaggcgcttttctttctactggaaaaacacggatagcaagatctgcttcctgcatgagggagaacaggctgagagccagggagaggaaaggtcaatgtgctcagacctgatctccatctgtagggagcagaaagtgggccgggcgtggagagccctccacgtccttctctccaggcggtgtgtcagctgcgcgtgcccctagccctggggaagcggtgttcacttagtaaggttggtggctgccctgcactatgaagagcactgatccctgtagctgtgtcgagaattggccatggggcagcccaggactgggggtggtggaccaggctccagagctgaactgccggggcttgcctggctccactggccccttgcacagggacttggggcaagttacctaactctcagtgccttgatttccttctggcatgacagttagccaggtagttaatagtgaaggctcagagccaggctgcctgggtttgaatcctccacttgctggctgtgtgactatgggcaaaatttacctccttgtcctgggtggcattttttcatctggaagaaggtgactgtgatagggtgtctgggagcctgggatgagctaatacgggggagtgctgagaatgaatggctgctgatgggcagggctaggcccctcctcccagcctagtcccgccctctctctcgacctttctcccttctctctggctactcctgcctcctttcagtcttggacagcctgggctttctcctacctgagggttttccccagactgtcccttctgcctacagcaactgtctgccgacttgtgacttcacttctgcctccagctctcagctcctacatcaccagggaggtttttcataaactcctggacaagatcaggcacaccaccccacccctcatttcatatatttccctttatcccatttatcacagttttcatgttttaacttgtcaagggattgtcccagagtccttgttagaatgccaacttgcttcttcaccattatatcctcagcattttagtatatggcctttgctgggtgtttgtggaatgaatggagagtgagtgagtgaatatatgaagaatgtacccttcccttgagccagcctctctccttcttatctaagaatgagaattgggttgtcatggagccaagcttaaatccactctgattttttgcaaggatgagtgttaaca

SEQ ID NO: 49147 - DNA, 837 bp, Bovine  19866881279702
tcaggctgagattcttcttgctgttgtcatcagtgtggcctttatccattctcagcagagacacagcatccactcgtgccgatttaaggtgaccgtgtccaccgtgtgcctacatggtgagatctgagaggaggcaggtgccatggagcctgcacgatgcacgctggcttttcccaggtgatccctctgtgtgtgtctccatatgctgactgtgactttcagccctgtcttcttttcatttaatagaaacagaggcgcacagctgcttgcttatttctgcctcttcagttggttctggcacaattcctccccgcctcccccaatagaggtccctcctgagttacctatcttgaaactccacacgcagtgcaccttctgttcctggcaaacttcctctccccaaagcaggcccctttgtttccattccgggaggaaccatgcccttggatgtgtcttctttcctgttgactaaaccgcttcaactcttttagaagggggacccagctcaggcctcattagtggacttggcatttgtgaattgcattattaataattgtgcatacgaaatgcctgtggaatcctaagccccaggcacaactcaagccctgtcctggtcacagtcatggaaactaaacatgtattcaggagtcgaaacatgaccgtggcaggcgtttttgcttttgcaaagctctgtaacaaagactgagccggtgttcgtcccgctgacggccacagacatttcagccataaggacgacgcagttggcaatgctgtagacccgccacctttttcaggcctgataattcagaagagggcaggataaaaatagaggaggcg

SEQ ID NO: 49148 - DNA, 999 bp, Bovine  19866881300414
tgtactggaaaggtggatactgtttagaaaagagcttgaaatcgggaaaccagtaccatgtccttaataagagatgttcaagacaatgggggctggatttggggccaatggagtgaagtggacagatttgtctgctgcccagaagtacaacctagatgtgattgggcaggtgaatgagtaaaggaaatgtatgtctacatcgtggggattattcagcactcagaagaatgaactattaagctacacaaaaacttgcatgtatcacctgagagttatgctgagtgaagaaggccagtttctaaaggttacatgttgtatgattccatatattcacatacagtattattaaaatgatagaagtagagaaatggagaacagatgagtggttgcaagtgtttagtgatgggcggggaactgcagtggaagggaaatggctttggtcacaaaaggcaatatgagggatcttcgagaatgggaatgttctgtctttcgagaaaaacatacaaaatgaatgatttaactgaggctgcaggtttatttttgtgattgttattttagacacagcatgtgattatagtcattgcttctgcacttatgccaattggtgtttagaaattaaaagtgtgatgtaatgaaactagttcattattctggtccaacttctattgctaactaagttgtgaccttggtcatgttcttcaaatttactggaacttaggctcctcttgagggttttggaataattactgtcagaggtcccttccagctgtagaatttgatggtttcatgtttgaatgcatcaattgcatttcagcatctcaaaagtacactcagacatgcaacagtgagtctgttatgttatttattttatttcatcaagaatgtttttgcatgggttattttaatgtgtggaacttaattagcatttctttccatcatcccaaaggtcaagatcccccaattcccctctgcagttagagttctctaagtacagcagat

SEQ ID NO: 49149 - DNA, 1243 bp, Bovine  19866881333462
cagagatttgagatgggaaatcaattaaaaaggctgagtaacatgaagaagaacatgataaagggtcatgataaaaaccgaagaattacaggtaaggaaaatactcttattaaaagtggggaaatgtaaggaactcagagaaacatttttaactgctatatttgctttagtttcaaatacaaggtcactgcaactataaagcactgtgcagtcaaagagctctatctgaatctctcataatctttcaggagtgtagggcagagaacgatagcaggctgtaactcaacaacttttcaaaactttctagtactttctcacccttagtgattttctctcacccattctcgattttgccttcagtagaaagatttttcacattcagatggtttgtagacacggcttgcttttgctcatagcatcagggcagtaagatgaactaaagcagttctgatgcggtttcttctccaaatttatttccagctgtacaaagaagccaggtgaagggtggggagaaagtgagtaaccggagttagcttctttcttgtcatcctctacattaactcagattccccaaaatcttcctggggtcggggtggggttgagtcacatcacccatggccaatgacttaattattcagggcgacagaatgaaacctctatagagattccaaagtaacaggcttggaaagcctctcaattagtgaacacagaaaggtgctaggaaggtgtcacaccggagcgctcatggaagctctgtatcccttccccctgctcctgagttgtatcctttataataaactggtcatagtaactaaagcactttactgagttctatgagttgtttatagaaaattactgaagctgaggagagggtggtgggaacccctgaatatatagcccatcagaaacttgtgactttcaaccggcattgaagtaaaggcgggtttgtaaggctgagcccttaacttgtgggatagtgctaaccctaggtagacaatgtcagaactgaattgaggtggcggacactcagctggcattggagaactggttgttggtgtcagaaaacaccacaaccttctgcttagacaaaagatactgactgtagccctaacaaaatgagattgaaaaaatgagactaaaaaaacaaagagcttaacaagtgaaaaagttttattaacatctgcactgtacacacacatgggagtatccagtgacaataattcaaagatgcggttagaacacg

SEQ ID NO: 49150 - DNA, 816 bp, Bovine  19866881361694
acttcatgaaccaaaaagaaaaaaaaaaaaactgcaacggtctgctcgagttgaaaacaaaatgagatgctgtaaaactgagaaccatcccaactacagcaaatgatcgttattgttgctgcatttctgtttaaaaaaattttgataagtttggaatttgctcatcaaggataataattgatgatttaaaaataatcttatgagcatttccatgacgaatatgaactatttaaatatagagtcgtgacagagaaatggaaatgtactgattctgatgattaattaagacaagcagaatattattctcaaagctgctcaggcttgctcccatttatttttccatatctgatctattctagggattcagaatagaaaagtcactaaaataaatcaaaccatcaaaatattactgattctgatgaagctgattagcatgtgcatgtatgaatatggagtaagtcagcatcaaataatatgatgaagaattaaaaagaaaagaatcagtcattcttctgaactaattttaaaaaatctgtattcatctctacgaagatcagtatgtcatttaatgacaaacaaggaacattccagcttgtactgcagacttccgcagaccctataaaatgaagtatttgctctaacaaataatcctagtccttgcaaatatttaaaataattcttaattcacttcaaaaaacaacaccaggatgaccatgaagtatttttaagaaagattcaattaatttgagttaagtagcacagttgagaagcacagttgcagagtttgaatcaaagtaggggcatctcaaaagtcat

SEQ ID NO: 49151 - DNA, 1404 bp, Bovine  19866881487262
catggaacaggcctcagaactgcccatcaaggggcaaggaggctggaagacatatccttccactcttgcttgtcattggcagagggtcactcttggggagccatcagctccccagaacttcatgcccgctccctagagtggtgacagaaagaagccctgaagtggggaggacaagaaacgtgtcagaggacggcctcaacatgaacatgaagggtgaggcacgggggatatggccaaggcacacggctttggctcccaccagaaatacacatgtatgaaaacatggcatcattgattcaacatctacttagcaagctcttattatgtgcggacactcttgtaggtactgggaatacactgaggggcaaaacagagattatagtcttaattaatacccagcacaactgggctgggcagaggcagattctgtgggctacatatcacaatctagttcacagcattgactttaagaggagtagcagggtcatcattattggactttcccatcaccgtccaggtatgctgtggcctgtgatctagttatgatcttgaatcaagaactggagcaagagggcttccctggtgctcagtgataaagagtccacctgccaatgcaggagacacgggtccaatccccactccaggaagatcccacatgccgtggggggagctaagctcatgcaccacaactctgctttccagaccagaagccaaaactagagaaaagcccatgcagcaatgaagacccagcactgcaatgaataaagaaataaaagaaaaaatgaactagaacaagcagataggtactggaaggaagtagagttttccattaaaggacagtgaagtgtattttgctttcgaactctttggggacatctttcctgtaatggcttatgcccagaagcaccgcagaccttcctgctatagttatgacagctgagcagggtgtgtagcctctagacatagaaaggactcatgttagtttgaccacctggggattatactggcattggcaacttcacatatgccctgcagaaactaagtgatctccatttcaaacaaaaaaatactctgccttccaaatgatacagaattctattttatcgacaccggccaggtagaaccaagtatttgccagaactctagatgtgggtagttgtttataaaaccttagaatatcgtcaagtgttgttttaaataaaccattacacttacaaagaaagcaataaattgtgagattcaggtgaaagacataatatacctatctgaaaaaaaaaagtataaacaaataaacatctattgtatcctcctatgtacatactttagaatatggtaaaagtcaatttttacctattctggtggtctttcccatttggcatttcccatctcatggaaataaggtca

SEQ ID NO: 49152 - DNA, 1336 bp, Bovine  19866881512047
gtcaggagaagtgaggcatgactgctaataggtgcagtgttatttttttaggctgatagaagctacctaaaatggtggtgatggttgcatacatctgtgaacatactaaagaccactgaattgtatcctctaaatgggtgaattggagggaacatgagttttatctcaataagactgtcataagaagaaaggtaagactggaaaggtggagggaagaggtggccaggttctgctgggttttgcaggcttcatgggaaggttggctttacttcaggtaaatgggagaaggctggaggtttcagagcaggggagtgatgtaatatgatttatatatttttaaaaaatgtcttcttactccttgctcatattaacaatattattaccaatgttactgtcctcttgactttctggtttggatgaagtgagttcattgaatgcctgttctgtggcttccaggacaccagtggccactaagcacccagcagctgagagtccagtgccaagtatggctacagaagatcctgaataagtatttagtatcagccagggcctcatctggcttgctagatggtggatccaaatcgaatgcaccatctgctcagccttaatgcagttttaggggcaaagcagagaaaattgtgtagtaggagcatccctctaggaccctttctagcctgacttttgccatcagcatctctgtctgacgctgatcagggaagaaaaaacttctcgccccacctgagccactccccaagtcaaatcactccacagttgaagagcatgctgggtgagctcccatgagagtgtcctcaaaggctcctggaccctcaagaatgtgagcagtaattctcaaaatgaataaatagttctaaaggaacatctcctctgagtgtgtgcgagagagagacagagagagagagaacagagtctcaaacagctctttacatgtgaggctggcagctctgagcaaggaaggaagtaaatatctcattttgctgttgtctcattacatcatttgttggcagcctcggatgatgttagttctgggaactggccataggtttttgataagataaggactctttctccagatatattgatggcaatgagatcatgacttgagaaggtggggttgtaatggtaaaaccgagaatcaaaaatttagaccagaagtcagctacccagtcagagccagaatgttaacaatgtgtagccacttttcatcaatacaacagtgaacctctggttacctgataggctgtggctcaaatacattcaaaatttttttaaaatcctttaataattaaatctaaacccaactgttgaacccattggc

SEQ ID NO: 49153 - DNA, 1158 bp, Bovine  19866881781891
attttaattctaagtaagggtatctcaggcactcgcaggttacctggcacgatatacctggtatgtgttaagagaatattttatgagaaatttatttcaattactatggagtgtggccagatactgatcaatatctgatattgatatggtccaaacttcaagtaaggaaccaaaggcaatttcctcaaagcttgtaagtcctgaatactaagataaagaaagcagcatgctatccagggtttcttagctccgggcctctcactgtgttccggagggtcattaagtcctctgaaattacgagcaatgttgggtgtgtatattcatgtgcgctgggggtgtggtactggaggaagctcatggtttccatcagatgtgccacagagcctgcgccttcagaaggttaagaaacattattcaggtcacacagcagacacaaagagaagctttggtggcggtggcatttgagtagcacggtgaagcttggataacacaaaaggcactgcctccttccaggtgtaggagtttctaagaacatttatatccacccctccatttcaaccagctgttcaaatgcttgacattaataaactgtcttttgatatttttcaatgagttgaaaaatgtccattcgtgaccatgaactccctttggcaggaggtgatagcaggtagggttgtaatgagaagagtgcctcaggccagagagggtttacataaaaataagacctgcaccttaatatgatcataaacgtctctacaccattccacaatcagttaaacacacacacaacacaaagtcctctttgcgcttatgcacaactggtatgaatgatctctataataaaacatggctctgagaacccatgaataacccttcaacgcctcagaggatattagtaagaacaattctagagcgcaatacccaagccaaagagaagtctggtgaatggagctcattatttctgaaacttgtcatgccccacaataggaaaaaaaatcgtcattttctctgacttaaattagaactggtttcccactgaggagtttgttgaatctttggcagaataacagatgatgccttagacaattacacatccatcttaggatgagaatgaactcagaaggatttcgacacatctcaatttcaaaattatggaag

SEQ ID NO: 49154 - DNA, 1482 bp, Bovine  19866881864226
aagagtcccagaaacaccatgacacaaatggctgaagcactctcaatgctgtttgcagttcagctctgggtagcttgtactctctgattattagttcaagtctatggttctttcctggaatcacagtcatcttctcccttgagtgtgggctttttggatgttactctttaagggataagctaagctctggaatatagacttgaagggctagaagagaaattgttattgttgtttagttgcttggtcatgtctgactcttatgcaaccccgtggactgtagcccaccaggctcctctgtccataggatttctcaggcaagaatacttggattattatttccttctccagaggatcttcccaatctggggatccaaccccagtctcctgcactggcaggtgggttctttataactgagccagcagagaagccgtggaggagtaattaccactgataataacctcactgatcttatctgaagagcagcaaagctaagggccgcacaagctgtcaaggtagcacacaggagtattgtgtaaacactggaacaggtgcaaaggaagcctgagcaaggggagaaggcccagcgtccagaacaacactggctccctggagcatggtgtgtactctccagagtcagcagtcaggagttcagagtgggaggctggggggagaggagctagagttaaaggcagagtggaggggccattatgcaaacatgctgcttacctgaaccaggaagccatttacatgtgaccataataatcataagctagttattttaacagtggttttctgttgataggctctttcaccaccaattggaagaactcaaggctgttgtcctattaatgtagttcatgatgttatcttcaaagaaggtaggttagatcagactagagggtcagagttggtgcatccacattgggtaaaagtccttaacatcaacaataattatgagtgcaaaaccacctttaattcatttgaatactatttattcattcatctatcacttcatttattccaccagtattgttggacagaaccccataagaccggaatcattttggccctatagtctaaagacagaaacagctaaagtgcaccaagtatgcaaatagtggatgctttatgcagtttaaacttgctgctcactgacttgggaagtgaaaaaagtaaaaaacacagggaagagtgcaaaaaacacaggcgagctggcagatgcaacccatgtctcttttatctatgctgccaggcctaaaaactctttcctgagctgcagaaggtcaatagatggccaacaaaccaaccagaagagcaagttcagcttgaattcagctcattaggattctaggtcagcctttaggcaggaagcatgagcccacaggtcactggaaacagaggctgatgtgactgccctcaacattaagaccccaatggctcctgcttcagactggcaacgggcaaggaaaagcaatggtgca

SEQ ID NO: 49155 - DNA, 3204 bp, Bovine  19866880767469
gggcagatttgaccaaatagtatctgttgcgcctctcatcagcctcagaattacctagcctctactctgccatttaagcactagccctcagtaataatttggactatttcaccaaaggccttcaggtgacaaacttgctgactgtgagaaagactctgctttagacaaactcagagtcaggctcaccccttggctgggcttccctgataaacacagttggtaaagaatttgcctgcaatggaggagaccctagtttgactcctggaagatccactggagaagggataggctaaccactagagtcttctcgggtttcctttgtggctcagctggtaaagaatctgcttgcagtttgggagacctgggttcgatctctgggttggcaagagcccctggagaagagaaaggttacccactccagtattctgacctagagaattccatggactgtataggccatagggttgcagagagtaggacctgactttcactttcaccccgggctctgtccttggtccatttaattcagttttagcaagaatctgaactaaatctgttggtcagtttatagaaaatccttacccttttaataacactttgcatgatggtttaacataattcttaaaataattcttaaaataatcgtgtatgagaacacaattatgaccacctaccttgattgaaatggactgaataggatgtatttggcatagaatagaacgctggacaaaagtgaaaatggtgtctgctaatgttagcacactgatacaaattaattgccagtgaaaattaattttgaaatagacctttaaaaatgactctactctgactcaggcttaactaataaatgttaaagatcgaaattaaaattctttaaattcattttaattcccaagtgtgtgttaatcctcttattacattttataatagttcataaaatatatttccatgccacaaagctctaagtaaagggaagttaatataattaaatgatattgtagataaggttgaaaacaaaaagaaaataataaatatacattcataattaaaaaaaaaaacctcacgggtccatccagatttactgaagacagacacctaacatggaatatacagttacaaatttaaatgctggaattttttttctgaggggcgagggggcataggagacttgaatacaaaaataagagatacaatatctacctgaaactgatataaagatatcttgcagtaatcttaaatgtattgttagatacaatcaccacaactgtttttcatgggaagatatatggcaacatatttccagattaaaatgtgtgaatacatgagtttatatgtatgtgtgcaactgtgcatcatatgcgatacatccacacgtctaaatatgttagatgtttataaataaaacagagatttgtatatatatatatatatcagaatcaatttaaaaaatcagacatattttagattttttaaacaaaactgtagtattctaagtgaaattattgtaaactgattccagcactgtaaattagctgctgcagctgctatgtcgcttcagtcgtgtccaactctgtgcgaccacatagatggcagcccgccaggctcccctgtccctgggattctccaggcaagaacactggagtgggttgccatgctcttctccaatgcatgaaagtgaaaagtgaaagcgaggccgcttagtcgtgtctgactcgcagcgaccccagggactgcagcctaccaggctcctctgtccatgggatttgccaggcaagagtactggagtggggtgccattgccttctccgactgtaaattagagcttgttttaatatatagcctttggctagttatgttagccatagttgcatatacatgagtatatattttactttataatattaatataattttcaatacttcatacaaaataacaaaattaaatattttaaatggaaatgtatgcaatgagtgtgaggaaaatatagaagtatgactgagtttatgaagtgaatgctagaagaatttgtcaatgttcatatacatcttagactgacatttccacttattgttggtttttcagaactgcacaaaatgattgtatgaactcacttttaagattttttagttaatactttttacatttccttagtatttcctttcataataatattacatagatattgctggaaaaaacctattatggaatttactgaaacacacaccttataacccattagcattctcataggttctcttaatgatacaagacaataccaaaagcatggaaaacagaataaaaaaattaaaaaaataaatgttggcatcacttactttcataatgaatcttgaaaccattattagaacgactattgtctgttgtaaatagaaggtatataaaattactgctgctaaatagaaactggggcacctgtgtgccattgtaagatccaagcaagggtgacagaagatttggcccatcgtgaacttccagaacatcgtaattcaattcagtctgaaatctaagattaagagagagatgtgaaaatatatttattaggaaaaagcactttaggctgctatttaaattactatttataatttttactaattttatatataattttctttagctttgctaatatcttatacatcattttaggatccataatttaagaataccaaagttataagctcttattcctgtggacaattttcatgtaaatagtatgtatatatacttattgttcacaagaaagatttattcaaacgttacagactgtcttgaataaataaatggtcttttcgttaaccaaacatgttttatggagtagtcctttttttttttttttttgctttcttcatttctatggaaaactacatgactatataaaatttaccctcaatcagatcatcataatttcatctttagtatatgtatatatatttcaaatctgacctctgcttcatactgacctcttcttcatatctctgttttgttttttgacaaatctgtttggccattaaatttttgtatagtttttatttagatttttggctgttcttcctgattttactttcaattttttaaaagatataatttattataatctgtagccaaaacagagcttattttaacatgcataatacattattaataaaataaaatttgaattccttcttgcatgtcaggatattccacatt

SEQ ID NO: 49156 - DNA, 1729 bp, Bovine  19866880903761
tagcatctaggtttcctttagttttaatgctgataaaattatctggtctattgtaaccactggtgttagaaggcattgttaactgtgatttagtctacagtaaataaacattgaatcaaaatttaatttctgttacttcagttcataaatatttatttttattatcttggagtatttactaaaaactaactatcctctcagaaaactctttttattccttatgtttcctagagaaatgcacaagttcagaaacagctttctaaatttcagtttactccactatgtcaaaaggaattctgtgaagaatgacacctatccctttaggaatctaaaatataaataattttgtataattaacaaattgttttcttaaagcttagtaaaagagcaactgctaaacaattaattactcatgtttaatttataactgatttatgcaaatgttgcttgtaattagaaatatataagtatgtactttaaatgcaaatatgaaaggttgagctaaattcttttggggctggtattaattctcagatacaattatatacctttttcttctctagtgtttcaaaggatgaagtgaatttctagtattggaagaggtctttacacactcctattatttccaggaagtaacttaagcaaagataatcagactcctatttcaagagagatttgttcagcctttgcctctcttaacagtgatcatatgactatatttctttgtattttcagcattatgtggaggagatgttagagggcctagtggaacaatcttatcacctggttacccagaattttatccaaattctctgaattgtacatggactgttgatgtaacccatggaaaaggtaatttgtctcatgcaatgataatgggctatcttcttaattttcattgcatatatttttatttcattgtcctttacaatgtcattttgcatgagcaaaaacagatcagtactaaaatatgctaatacaaaattcaatttgaataactgcagcagaggattatatttacttttctgtagtattataacatacatgctcatatgattttttttcagaatggtaatatatatatatattaaactaatgtaatttgaaattttcataacaataaaatctcaaataggatgtcttttgtctctggcagagtgttaagaagttgatttcaaaaattcaaagggaaatagatattctgaagtactgaactgattgtaaagtaaacagtacatgtttatatacacttgttttaaaatggtttatttattataaataaatataatataaagaaatataaataaaatggttatttattataaccatataccctatataaatgtataattgtcctagaaatatttgtctcaaattttctgtcagaactgcagttggatctcacgcagttgagtgaaagtaaaaaattgcgctgtgcttatagtagagcttaataaatgtcctttgaacaaataaagaaagcccttgtagtactaaatgtgatttattcatgcaatacaaccaaaatattcaatgaatattagcaatataaatggtttaagataatagcttgacagtgggaaaatgggcattctaaatatcaaaacaaaaatggatgaaaattatttacctgaaagtatctatatgctattattttaaaaaataatttattcatgttaaaaactgcttattcttattggtttttactattacattgtacatgggcttc

SEQ ID NO: 49157 - DNA, 2089 bp, Bovine  19866880905887
taatgctgtcttttgagaaactccccagtccagtggaagagatcaaccacaagcagcacattgtcttttatcattttaaaaatgatatacaacatattttaatatctgtatgataaaataaatttgacatgcttatagctgaaatacacctgtagaaaaagttaggttaattttattagataaatgtgatgattagcagcacttattcttgatatcatggcaatatttaatacatataccttgtaaaatgtaataagtgtatcttttatggcatatatttgaaaattaacatctcactgatttatgatttagagcatatcttacaattggtacttgcagtatttgtcctttcagtttattaatattcaagaaaagatatgtgatatgctcttggtgttgaaattataaaattatctaaattatgagtttactgtttaacatatttaaaaattttggttaatttaaactttatattatatttctattcactcctttttatctcttaaaacgggtattctcctggcttttcatcttctgcatctgtgttacaactattattttactttttacttttcttcaataaaaattgataaatagatgcttttaaaaaataaggccaggtcccttcagaaccaggaagctatttaaaacttcttggtttgagatggcattttcttagctaggtattgtccctgacagccaaataatcaagtttaaatgtaagaacattacataaacctcatttctacacacatatacatgcacatacactcacacagagtagttttcataattcactatttctagtaactgagctctttgagcctctggacttttctttttcaactttcttctttgagtttacaatcttttcatgttttctttattctttaagaatttcagatatgtgctaaaaatactgtgaaattttgcaacccctctgtaatattaatttcataatgtagagaaaagtagaggtagaatttctgcttataattcatgtttagatcaggagaatctagaattatgcctcaaaatacaaaatgcaaattttgttaaaaataattttcagatagcaggaaaatttacaagcagcagaactaaatttaaagcaaccagccaaatacaacagtaggactaaacttcagcttaccttgggggttggggtgtgtaagaggattacaacaaaaaacataacctgagaaagatagagccattcttttactctaaataaagggcctcggataaagaatctcaaaattgtaaaacactcatctagtcatctagtcctaactacttattttaagagaaaagactgagataaaaaggcagattcttgtccaaaatcaatagctactaaagaatcagatcttttaaatcctacttcaaggatcattttcatcttttttttttttttaatattatgtatcagtagctcataactatatatttcagtaagccattgaattctgtctctacctttgtacttttaaagttagtgaccaggaaaaaaaaggaaaaaaccttcaaaatcaataaaatacccttcatttgaactaattgggtaaaatggcaagtaggaattagtgtaatgatcactttaaaccttcaaagagcaatcagttttactgttttcaaattcatggaatgaacaaaacctaattgccaaaatgtttcaggctatcatttctatctgtagtccccataaaaagcaatatgtaaagcaactcaaattataattgaggaagctaaatatatcccttgcattcttgttcctgtgtttttaaacacaataattgttatttaaatgtatcatttgatcagtttacataacatttttttaattagtgaggttttaattaaaatttctttgactttttttcacttggtgtcattaaaacttaaataaagtagaaagtagtcttctgaactagtttatcacttttataggagctgtagttaacaaaataatttacatttaaaggataatattttcatctaaaatactaaaatacttgaaaaaatgtttctaaaatgttccaagttactttgttgagtttatgtgtttctttaggcaaatccagtcata

SEQ ID NO: 49158 - DNA, 1881 bp, Bovine  19866881030597
tggaaaatcccatggatggaggagcctggtaggttacagtccatggggtcccaaagagtcagacatgactgagctttcacttttcatggcagaaaccaaccataaaattgtaaacactaactttcctccaattagctaactaaataaacaaattaaaataagccaataaatcattattatgtgactaaatactttgaaatgaactgtctaatgctttccaaacaggtaacccaatttgaggatttcctacttatatttcctatgtttggtttcatattctcaaatctaacaaaatgtgaaaatcatatattaaaattagaacactttaaaatatttgataccaacaagctccaagtttgcttttgataattgctgtaattgctcaattatgtcacttactgtttcaaataaaactcaaatatgggggtagaatctttatctgatatagtaagtgattgttttataaatagttttaaattcatttcatcagatcatttggaattgaataaaaataaataatgctaaaatacatatattcgctaaaaaagaataacatgtatttataagaattaatcttatttattatcaataaggcattttagaaatcagatgtggtgtcataaatgacttctttcaaaatttattatatgtatctataaactactattgattagtattgacaaatgcatagctctcttaaatgttttactgtatgtgtcatttatattcatataacaatgaatattctagtttgatgattcttaatctgacgcttatggatgaacttcagatgatctataaatccctgaatattaagcaaaactgtgtattggggcacacataaatatatgtaattcagttcatttcatgagatttttctaaaaaaaaaaattagttcatttacaaagttcttgacttaaaggatttctttaaattaactcaaactaaaatatcttttttcccgtaaatgaaaaattgctattaaaaattttcccttacaaaaataattatgttgaaatgtagatatgttcaaacagaaattcctacaagaaatcatcaatttaatggtttttactcattttttaatctcacatactagaattagaaaactagaatgttatcaacacgctagatcaaagagtttttgttttttacattttgaaacaatctgagctccaaagtttaccacattaacctaaaattcaatatgcatttaaatataagaaaatattgaataataaccatgcatgttatatagatattaatgcagttaatttgctaaatacacaaacgtttttataaaacacacaaacaacatagacaaccacaaacttcactcttgcactagagaaagaaacaaaaaaaggagtacactcacagatagaaaacttgttgctgttgtctttccctggaaacaatttaaatcctctagatttaaaatctatggcctttttcactagttaagaaaacaaacaaaaacatgtatcaggatacacaattccaaaatgaaattcaagttaacaaattttgttagcatggtattatgcaagttaagaaactgctttcttaagcctgatatagggtacccggaagaaagtaaaggaaaaaaatagcaatttgattactaagtagtaaaaataccaagcagtataaaaattttaaaggttccatagggagaatcctgcatacatatataggtacttttaaacactaatgagcttttgtagaagaggaaaaaaaaaaagaaaaattaactatcataagtcatttgaattcatctaattttatgaaaaattaaactagaaaaataaaaatactgatataaaagtgggaagaatttaacgaacctgcttttttaaataaactaatgtatttttaaag

SEQ ID NO: 49159 - DNA, 1970 bp, Bovine  19866881090361
ttggcaattggtggattattcaggtatgaacatgttcctgattctttcactgtgaattatgtccacaatacagtgcaagactctggtgttcatattgccaaaaaacaacgattacattacttcagacaaaagataaatattaaacacatggccatcagtattatcaatccatactgaaaacagaattgtacagaattgactaaaattgcagaatacaggtttaagaaaaatatgcattctttaaaatcaggaacgtgatgtaaattttgcttaaaagccttgaaagacaaaatgtactttagctggacatattattaacacacttccagagaaatatacttcaattaacaacaaaaaaaatttacagcagagaaacattcaaaaattatctgacctattttcatgcttttctaatatattacaaagtatttcctatatgacttttatttcccctctagtacctaggaaaagaatagtaggtgtgaatgtgtacttatgacttaaagggttaatgtggctctgtaaggtgaataaatggcctgaacaaatcgcctatagcattttcctaacatcaccagggcaacattctgcttcagtggtttaaatgtaccctagtggtttaaaacataattgcacttctctgaacacctaattgactacaagggactgacttaggtactttgaatacaattttattactttaattattgttcagtgaggtgttccaaagttttaaaacaaactgaaattttgttcctaagtaaagagaaaaacaatgctatctaagtttgcttttttaaaaataaaattccaactttacattagaacaagtggaaaattttaagtgaatttcagtgaactaatctttattgattggagaaggaaaaggcaacccactccagtgttcttgcctggagaatcccagggatgggggagcctggtgggctgccatctatggggtcacacagagtcggacacaactgaagtgacttagcagcaatctttatttaccaggcttatttagtgaatacaattctcattgtcaaaacaacaaatgtgagtatttggaaaactaaaaataatagtaacagctaaaatatactgagcgaaagtaggcccatgttgagctctcctgggcataatttcatattcccatcaggtgggcattcacattaagtttattttagagacaatgaaaatatagaaaatttaagtatgttgtctgaggccagacagctggaaagtggaggcaggattcgagccacgctgtttggatatagtgaaattgaccatcatattgtaaacagaatcaagactaagttatcaacactgcaatggcaacagcactttctgcttatcatgtgtgacatactctgataaatgttttatacagtagctaatccacattataaactatcctctctccacatttttacttaacttacattagagggatccccttctcctgatactttgaattagagtttgctagggtaccctcacaacataccacacactgaatgacttaaatgacataaattaattctcttacagttctgtaggatagaaatctaagatcaagacgtcatcagtattggttccttctgtgaaatgtcaaaaagaatctatcccatgcctctcccctatattctggtgatttcctagaaatttttagtgttccttggcatgtaaaggcatcaccacaatctttgccttcaggttcacagggcattctgcctgtgaatatctcttcccaaatttccactttttatataactttaacttgatcatctgtaaagatactattttcatccaaataaattcatattcacaggctctaggggttaggatttcaacaaataactttcaatgggatacaaatcaacccataacgcagatcttgtattccctaccatttattttcaggtctccagaaaaagaaaagtgctaataatatgagtggtaagact

SEQ ID NO: 49160 - DNA, 1499 bp, Bovine  19866881327376
tgtaagactgctattttctgatatgccgtgatacatcgccaaatcatcacttctgagaaaatggagctgccttccggatatatttataagtgtgtaatacatgtgagatgagcacactttttaaaaacacacaaaaaagtacttgtcgatttttaaatgcacaatttttacagtgtcatagtagtatactggtagtcacattttgtcactaatagtttatttcccattaaaattcatgagagaaataaaacatcagtgacattcttcccatcaaaatgcattaactgaccagcatttttaccatctgtttaaattgctattatctaagataagactagagttctttgaatggttttagaggcaatgataatgtttttattataagtctctggcacacagagttgagaaaaaaaaaaaaaaaaaaaggatactcaggattaaacacacaatactgcaggaggctcctgaattcaagatggtgttcaatttcctgaaatttatacacggtaactttttgagatctatgtcctctttaaactttcatcatttttcacttttcaaaaaagcatatactgaaacattaaaaattcagcttatgtgatctgcatagatgctcaatagtaatgtctgagttatgtatcgtattttctcatctgttaatagatgtgttaatttttggaggaaggctgtggaaagaaggaggttagaaaagttacagtatataagaaggactcagttactgcatttcgcctcaggatttccaaaaactaaggatgctacattatttttattattattgatttagactatttatatcatttataggaagattcatttacagttaaattgttgtttaaaggcacactcatgtatgtatgtcatgaacctcagtccatagttcatcaggcactctatctatcagatctagtcccttaaatctatttctcacttccactgtataatcataagggatttgatttaggtcatacctgaatggtctagtggttttccctactttcttcaatttcagtctgaatttggcaataaggagttcatggtctgagccacagtcagcttccagtcttgtttttgtggactgtatagagcttctccatctttgactgaaaagaatataatcaatctgattttggtgttgaccacctggtgatgtccatgtgtagagtcttctcttgtgtagttggaagagggtgttcgctgtgacaagtgcgttttcctggcaaaactctattagtctttgccctgcttcattccatattccaaggccaaattttccttggaaccccaggtgttccttgacttcctacttttgcattccagtcccctataatgaaaaggacatctttttggggtgttagttctaaaaggtcttgtaggtcttcatagaaccattcaacttcagcttcttcagcgttactggttggggcatagacttggattactgtgatatgaaggtttgcctggaaagaacggagatcatt

SEQ ID NO: 49161 - DNA, 1072 bp, Bovine  19866881419425
tcactcagttgtctccgactctttccgaccccatagactatacagtccatggaattctctaggccagaatactggagtgggtagcctttcccttctccaggggatcttccccaacccagggatctaacagaggtctcccacaatataggcagattctttaccagctaagccacaagggaaccccaaggaagcccataaattactcatccatagaaatttaagcaggacataaaattgggctaatgttaccaaaacatgtttgacaatattgttattaaattacttaaatcgttggaaattattcactaaatgtaactgatcatgaagaaatactttagtaaataaattaaaaaatgtggcctcagaattgttttctttcttttctaaagttctacataagtattgctaaagtaatttcttgatacagagattttaatttttaactttttccattgacctatagtattaactccacagctattaaattgcctttaataataaaaggtccttttcatgacattgttattttgtaaataaaagactcaatattttaagtcttcctgtgcattacattgttcagtaattcttctgttttctctcatgctttctctttggctgtagatgcccctgcaatactcttatcttcctgtgagaattctttctgtataatttgtgatgtattttcatgctagatttcgttgcttcttttgctacaggactgatttaatagcttagcataatgcattcccatttaattaaatgataagtaggactgtaggccaaaatcagtctgaatctgaatgggaccaatttgtttcatactctacaagaaaatttcattccttagggttttgttggtacttagagaataacacattttaaagtcatacaagttctattcttttaatagaaacttcacaaaaatgtctgtactcaagggcctctttaacccagatgatgtcaaacaaccaaaaagaaaaaaaaaaaaaaaaagtgatatccctttcaaaataagttatattgtgacagtgtattgctgtcattggtttttacggcttttgcaggggaatag

SEQ ID NO: 49162 - DNA, 648 bp, Bovine  19866881436136
atttttgtgaataatttcttttttgctactgttttaaggtcccctttaatatattactatcgtcaatcttcaaggcatttcaaactttccttaaaatttgttggcagatagcttttttgctttcacccttttttgtctcattttctctctctgtttgatcatgcataagctattttcacttttaaaactctggttttaaaacatattttcttaccagagaatgtaatattgaatccttcatatgatattgagaaatcagaaatgaagcgcaactgagccctgaaatttccatagagaccagcattgattgttgaaggaagttctgaaccagtcaagcgtgccagtggttgggtaaaactgccattctctgtgatcagtaagtagtcatgatggtcttccaaatgaaaggtgtggaagttgaactgtacacctaataaggaaaagaggaaaattagactcataaagtatattagtaaaacacacagagttaccaaactaacaaaaatcaggactcttataacagatttttgtgaaaatgaaaggcactggtataaaatattctgaatatatagtataactattatatctttcttttgagtttttctgtttgcttgtttcctttcgcttctctataaggtttataagagt

SEQ ID NO: 49163 - DNA, 1645 bp, Bovine  19866880443668
atgctataaaatatgtattatacatttgtacacatcatgtatattatatgtgtgcatttatgggtatataaaaatggcttttatatcatgccttgtctgagttgaaataaaagttctcccattcactgagctgatatctgtatacaaacatgagagaaaatggggattttcctctcttgggagatagtcagcatagtgttaaaaatgagaaaggaagaaatacttcttttttgggttatggtttgcattttaaatttcattgctgttcctctcaacttccatctgtgttggcatttgggaatcttgtcgttgctctttctcaagtggagtggaaaagcttagaacagaatttacacgtttaaatacaaccgaggctcgatcacatcatgattcattccaggtctgaatactttttcttaggcttaaaaaaaatccaacattttattgaataaaatatttctcaaacttgtaaagctactattattcattattagcagtcgattttgcactaatggaaagttcaggctgaaaatacaatgatagtattaaaattttaggcacttaatattttatgacatcaaaatgatgttttcatatagatatattgttaggtaattgcaatttattattgccattgtggttttattttactttactgtttgattaaggttcagttatgacctagtaacaatgagaataagccataaatagccatattgggttgctgtatgacttttgttgactctgtgctctatttttttttaactttctgaatcccagtctcttagcattttcttgtgtgtgtttgtgtgtgtgcatgtgtctgtgtgtgagaataattggctgaataattagtggcctggacctctattcagtgactagtcaggtttggctgataaattgctgccttggtcaatgtggactgctataacagagtactatagattgggtggcttaaacaggagaaatttatttctcacagttctggaggctggaaaggccaagatcaagtcactcttgctggtttggagctgtctgtcttctccttgtatcctcacctggcagtgagagaaggaaagaggaagcaagctctttttaatctcttcttataaggacagtaatcccattcatgagagctccactgtcttgatctaatcacatccctaaaactctacctcctgatactatcacattgggattagggttttaacatgtgaatttgaggggcacacaaacattgtctttaatgattctctaagattttttctagctctgtttgtgatggattcttttagaaaaaaaatagtttttagattttaaacaaattgtgtgtgtgtgtggatgtcttttccaacacttttaggcaatgtaatagaagttcattgtgatttcccaatgaagccatcagacttgtgatcgtttaatagtgaactcactttcaatgatgaggactgtatgattaaaattaggaagtagtagatttgggggggtgtcattaaatttaagtactgggaaaggtaaaatataaatagcacaggtttccccaaatttgttatcttcaaattggaaagacttgaaccattgaatgttccagggttcttgggaattaaggcagaggcctggttatagacatatgtaagtcatt

SEQ ID NO: 49164 - DNA, 1593 bp, Bovine  19866880456986
actgctttttacaattactatatgtaaaacacccaattattctaaaggaagttagggaggagtacgttcagcaacctcttaaggatgtcacactcacacacacacacacacacacacacacacagacacacaaaggtttttggtcactgaactagaaaagaaagattccaggaataaacgaatggatctaatttaagatctcaggaatccttacattctctcagcatatgaattcttcctggtggacacaagctcttgctttttgactctggatctctaccgcagaataaacagaaaagaaatgaagcttggctcaaaacagatgtgtatttaagtccaaggtccaaatctaacccatttattatcagttctttgcatgaacaaatctattagctgaacatttaaataatatttaaacaggtgaaaataaaagcctaagtcagcaatacatttatgtaaccaaaagaaaaagtagaaaatgttagtgaccattatataaccactacatatccaacagcatgcataagaggtatttccaattccattcagaaaaataactatttaaggattcaggaggttaaatatttttgtccaatttggaatattagcttttgataattgtctaagatataagaactcatgcaactcctgagtacctactatatattctcataactgtcttccctagatctttaaagatggattcatttaggcttccacttacagggttggtttctgactcattactctttctgaaatacttactccttagtataagctactatttactgaacgttaggtctgtgccaggtggtttacataaagcttcccattatttgtcagagcagcaaacagcactgccattttttatatctgggaaaattgagacctagaaattttcaggtatttgatttactgggcctagctattaaatgttgaaagctagttacagattaggtcttcttgagctcaaatccaaggtctacagtccttaaccaaaagttcttacgttttagcatgctttggaagtcttgttaaaatgcatattgatgaggcccacccctaaagtctctaattcaaagcttttgcatttctaacaagttctcagatgaaattgatgctgttgatcctggactacacattaaaagcattaccgtacactaaattctcctgaaatccctcttacacacggacacatgcacacacacacaccattgtagaacaattgttctcaataccaactatactttgaatcacctgcagaagattaccaaaacaagaacaaatacccatacttggacaccataccagacatataagctattttttatagcttatagacataagctatttttatttaggagattctaatggacatctcctattcgtggatcacaaccttgtggcaaagggacttgtgtaactcagtgaagctatgaatgatggtgcagggccagtcaagatggaaaggtcaaagtgaaattttgacaaaatgtggtccactggaggaggaaatggcaacccattccagtattcttgcctgaaagccctggagagctccagtattcttgcttggagaaaaggaaaaatata

SEQ ID NO: 49165 - DNA, 1179 bp, Bovine  19866880462168
ataatgatattccacatcactgtttatcatttatcataatcatcctttcccctctttaagttagtgatttattacacattagtttttttcactgtcttgtaactattaaagagaatgaacatcatttaatgaccaaagaaagtattaattttagaagaaggtgccagattccacctaggaagaaaatgcacacattccagcagtgttgttagctagaaaatcaatagacctctcatctcatgtcattgtgggaccttggctatgtatgtgactgcatgtggtttccgtagactgaatacttcgctgaagcctgagtgccacatatttaagatgacagtcctgtatttaccctgtcataaatttcaggttcaatatctggctcacttagtaacttcatattaccactcctatgatatgatagaaaactcaaaatggcatatggtagaacagttatgctttcttgaaggtatctggaaaataagatatatcaaaggagatgatatacaatagattgttttctgtgaaatgagttaccctaatgaaattttgacgactgtcatttgttaatactttccgataactgagtttatcaatgaaagcaaaatatatcagattaactagtgaaaaaaataaaattgaattttttaaagcagttttttctgtagcttcaaaattatattcctgcaaaacaataggggcagtaaatgcctctttctcctccaactttcagagctgaattcttcaatatatagttttaatttttttccagtgttttatggttgaataggaattttccatagacaagaaaaaaggaacatctttatttttttccctcccttgcaagactcttaaactgaaaattagaattaaattttagaagcaatccattaattgttaatcagcatatagattctaattccattgctaatcttccagggagatttctaatgattttacaagatcattaaaggtttatataagctttttttttttttaagttagcatttaaaactccacaatcatatcattaacatttagcccacctaaagagaacattttttaaaatcctatatatgacaagagattagagtaagagaatttacaaatcaaaagagtcagaaaatcttaaatagagactacttatagcatattaaactgggtccttaacaaagacttact

SEQ ID NO: 49166 - DNA, 2757 bp, Bovine  19866880480548
accctgttattgagtctgtgatgcctccaacctctcatcctctgtcatccccttctcctcctgccttcaatctttcccagcatcaggatcttttcaaatgagttagctcttcacatcaggtagccaaagtattggagtttcagcttcaagatcagtccttccaatgaaaacccaggactgatctcctttaggatggactggttggatctccttgcagtccaaaggactctcaagagtcttttccaacaccacagtttaaaagcatcaattcttcggtgctcagctttctttatagtccaactctcacatccatacatgaccactggaaaaaccatagccttgaccagacggacctttgttgacaaagtaatgtctctactttttaatatgctgtgatagattattatgcagtcattaataggtccagttaggcaaaatagacatctagaaacacagaaaatatttacaaagtgattcaactttgacaaaagcaatatatagatttgtatgcatacaatggttgaaattttaggaaaaactatgtatattcaaagaaaaagtgtgctaaaagtaggtgaaataaaaatgtgctaaagtaatgaattaatggagatttcagtccacttttctattattaaaatttctgtaatattacagtcttcttagtaagaaaagtcattaaaaaatgatcacagtatttaatttttccatgccaggaaactagcattcaggttaacttccaataagtattcaaaaaatgcattcttctagaatccgatttttgtaacttatgcaataatcaatattaaggaaatatgcctatagttatttctaacttgtattaactttcctacttctaacataatgtacagaatttaaagtaaaagaaagaactaagtacttaaataaatagatctcccagttaagctgatactctccagtgtttacaaagttttctcaagttaacatcaaaatggaaaatggaagtattcatatgtttcattgtggtacatggaagtttcattagacagggttgccccaggtcccacctctgtcctaatgctaaagagataaatagctctgcacactcaaaaactagtgatgagcttgcctttgcaacatgtcagaaaataagtagaagaaaatcatgagaacaaatttggtgggaaaatgtgtgggtgtttgtgtttggggtgtgtgtgtgtttgtgacagcaagagaaagtgtgcctttgcagttaagggggtgaatgggtggtggggatcacagaaattcacctttctgctgtgaccttccattactatcaaagtttgctttcagtgagtagttgtctcaagaatcttcccttccccaccagtcctgcccactggcaagatctctaaaagtccactgatggagttgaaatcaaagaaatgggcagcccctagttactcaggtaacacacatttacaaggttataatctctgtattttatttttctattcattccttaataaagttgtttgcagttaagaaatcactgttgagactcatatcttatatagtcataaatgagtttatgaccctttatttattggtgaacagagatttatttgcagaaaatgtatactagggattctccaaatgtagaaaatgataattaaaaagaaaaacaagcaatcttacttgtagcaatataaggagaaaaaaggcagcagaccagtggtttttaaatgtatagaaatatcagagcaaacatgtattttatctttttaccataataattatagatgtctgagagtatcagatttaattttagatgttttaagaatatgcctagacccctctctcatgctctctgtctttatttggttgctaaattaaaaacaatacttaaaagatctgatgcagcctaagagaagctgagaaatttattgacaacttattttatcaatttcttttggaatgtaaattactaattcagaaatattcaagcctttttaatacttgcaaattagaaaagctattgctatgaaacttactataacagagtaataattttcaaacttttctctgaagctgtgagcttcagagattctgtatatttttaatatgattttcatatatatatacttcctggctcagggatcgagcccaggcctcctgcattgaaggttgattctttacgtctgagctaccagggaagcccatatggctcagatagtaaataatccatatatatacatatatgtaggtgctcagatggtaaagaatccatatatatgtatgtatgtatgtatatatatgtatagatggtatatatataccatggtatatatatatgaagcccatatggctcagatagtaaataatccatatatatacatatatgtaggtgctcagatggtaaagaatccatgtatatgtatgtatgtatgtatgtatgtatccggtgttagatgataaactatacgtggttggaggaagagatggactgaagactttgaatactgtagaatgctacaaccctaaaacaaaaacttggaatgtgatgcctcctatgtctacacataggcatggccttggcgtggctgtactggaaggtcctatgtatgcagtaggaggacatgatggctggagctatctgaatacagtggagagatgggaccctcaggctcaccagtggaactttgtatatatatatatacatacatacacgtatatgggaagaaccgggagaaggcaatggcatcccactccagtactcttgcctggaaa

SEQ ID NO: 49167 - DNA, 2841 bp, Bovine  19866880569710
ttaaagttgtaaaaatttgtttgataagttattgagaccttaaaatataaacaagaaaaagtttgttgtaaaattgcagaaagcaaaagaaaatttgcaaatttgggaaatatgtataaataaatatagtcctgttggaataatggcaaacaggaagagtgtggggaaaaaaaaaacagtttaacaaatagattaatcagggaagataacattcaactaacaaaataaagaaagaaaaaaattaaaaataagcaaataatgcacccaaatactgaaaggactttccaattttaccaggaccacctagttcctagtggagtaggtagtctttcccttctcactacccactccagtattctgtcctggagaattccatagtctgtatagtccataggtcgaaaagaactggacacaagtgagagactttcactcacaccagggtcttagagagtgaagtatcagaaaatcaaaagagaaccaagtctaacagcaacaacaacaaaaaaagaagactccaactggtatcagatatgtttgtagttcatgtacaagaaactaaaatgataaattataaacttattgttggaaatagcttttagtaacatctaaacaagttcaatagctttctaagcagttgtcattaatatactgcagctaaatacgtctctataacacttggccatatctctcttcacttttcctcaatctgccttgcctgtgtctggttcccaacctgaatgttgcctcttgttaatcatcaagctctgtccctctcgacttgacattcatatgtgtttactcagcaggttccaggttactctcaaggactctggatcaatttctcacactgaccttccccactgtgaatcacctctgagggccccagcctctcatatcctgccagcccaataagcaggcaggcaacccttactttggagaggatggaaaaatcttaggattttttttgaaatagccaaattcattttaatccatcaggtgcatgtgacaaatttttgacgaggagcaggttcttattcttcttgctttgattttagtgtttcccctcggttattgaaatgatatatattttttcttgtagtatttctgtcaattttctttcagtcatccagagcttgctcactataaagtatgttcttgagccatctgcagctacaattcgcagcccatttatgtccagatcagcagaatgtatttcagtagacataagttgaatgatgatagagtcagaaatgacactaatggaaacactcaaaatacaagatttgttgcctgtcgcatggccaaaaattacagccatattgaaaattaggtatgcatgtggctgctgctgctgctaagtcgcttcagtcgtgtccgactctgtgcaaccccatagatggcagcccaccaggctcccccgcccctgggattctccaggcaagaacactggagtgggttgccatttccttctccaatgcatgaaagtgagaagtgaaagtgaagtcactcagtcgtgtccgactcttcgcgaccccatgaactgcagcctaccaggctcctccgcccatgggattttccaggcaagagtactggagtggggtgccactgccttctccatgtggcacaggtccttaaaacctgaaaaagtttctcatccttaaatgggttctaagaaaatgctacatgatttaaaaatgcaatcattcatgaacccaggcaagaaagtggtgtgacaactatcgtgtgcaattttatgtgtaatcatagcagtcacttcttactgaaggaatgaggtgatagagaccttcccaagaagagattcagaagtctaaaattagtgcttacccatgttttaaatagcactttgatttcaatatcgattgagtttattgaaagtctccactggccactttaaatatcaagttaaattgaaagctcccagtggtgttactgaaacctaccactagcaggcacctttggtttttcagagggccaatgaccctgactatcactggctacttaaaacctttggcaagcagccagaggatttctgaaattagctgcttttcttttagcctgttttcattgaataaaaaaaaaaaaaaaaaagctttatagaaagtaattacaaagtctttacattaattctagtaattaaatgtgatgacacctattattattggcttctgttcttttctgcattactagaggcaaagggaattcgacataagagtttacgcctggctgggcatgaattatttaaatcaaataaatggacatattacaaatgtattctatttgaataacttggaaaagtgagaagtattttgagtgtaaaaacttattaatatcataatgaaagtaaagtggtgtgaccaggccaaagaacactaaaatgaccaaatcccatttcctggttcaaggatttttttaaagataaaactagtatcaagaatatcaggaaatcagagactggtagaaatggattctctttcctaaaccatctatcttaatttggaaaacggcattctggaggaaaaaagtatgtgtcttccctttgctcttttcatatggtgtttattgcattttgactaatgtccatgtacttaacatcttccaggtattagcataagacgaatgaccaaaaacaagattcagaagacctctttataaggtcattttatgatagctgtatattgaattaatacctagaaagtagttgtttctatgacattcattaagtccagtatggagaagcaaaagcaatttatttaatactttaataattatttatttatcatttatctcatcttgactttaaactatttaaaattagagcat

SEQ ID NO: 49168 - DNA, 2346 bp, Bovine  19866880595451
ctttgtgtagcatcttttttgtatatttatacttaaattgaatttattataggcagaattgagttgggtctttttgtttcatccaatgtgacaatctctttttaactgaaatatgtgaacctattatatttgatatgattagtggtatggttagttttaagtctatttattatctcttatttgtttccttcttgctccttcctttctttgttcagcttccctctttttccacccacttttgaactgagtatctttttagcaattccatttcatctccttgttggattattcattataccttcttgctttgttattttgctaattatattaaggtttttgaatacatctttaacttatcactttatgtcaagtcattttatatcatgatatgtgagttgcagatagttggcttctgcttttacttcttaatttttataccatttttaactccttttacttgcatatgttataaaacacataatacattgtgattattttgtttcaacaatgatcttttgaataaaatttaaactataagaaaatttatttttgcccatacagttgttttttctgatgctcttaatttctttagatgaattattttcatctggcatcatttttcatctgcctgacaaattttaaatttcttgtattgtatgtcttttcaaaatgaattctttcatcttttgtatgtctgaactatcttttattgctttcatttttgaacaacatgttcactgaatattaaaccctaggttgtcaatcttcctttcacatctttaaagatatttctctactttttgagtttttccaatgagaaatatgctgtcttccttatttttgtttgttcacaatatgtctctttttcttgtggcagctttgaagatttttccttttatgactggtttaaagcaatttcattataaagggtgttggtgtagttttcatcacatttttttgtgcttaaggctcatttagcttcttagaatgtgcagttacttttcataaaattctgaaaattttggtcactatttcttcaaatattttgtttgttcctcctcttttcattacttcagcaatctagttacatacataaaaggttgcttgaagttgttccacagctcactgatgttctttgcaatcttttttaaaattattttttctgttttaaatttcacataatttttattgctatttcttcaataccttaaattttcattttagacaatgcattttttatctctagaagtttgatgtgggtctttctcatatcttcaatttttctatgtaactttttagacatatctattctaggcataataactgtgtttatctccttgagcctgttaattctaacacctgtgtcagttttaagtcagttttgattgattgattattctcaatatggatcatgtcttcttgttgctttgtatgtctgcaaatctttgactggatgccagaacttgggaattttacttgtcgagaggatgttttcttattcctatatacattcttaagcttccctcatacatgcagttaagtgacttggaaacagatccttagggtcttatttttaagagttgttagctgcatccagaaaattacgcagcatagagccaattaacccccattactgagacaaggccttctgagtactctacacaatgctacatgaattatgagtttttctagtctgactgatgggaaccagtatttttttggccctgtgtgaatgttaagcactgttctctttaattcttttgaatggttatttcacagcctctagccatttcttcaaatgaaaaaactgatcagtactctgtggaatattcagcagggaccatgttcataactctaggttatttctctgtgcatttctctcctttatggttgtgtcctgtgaattctagcctgcttgttctctctggacctcagcttccacttccccaggccagattctgcatgtgttcctcttccctgaactgtggcttgcaaattctctggtgacactaacctaggacatttacaaggctcaccttatttgttttctgtctctcagggatcactttctttggttgcctgatgtgtagcacctttatttgatatttttgttgtcgttgtttcatgcaggatagtaaatcccatccttgttactccatctgacctggagtctcagctgatcttaacaatggagacaggtgacaggaagattatgaaactctagtatagtttcaaagaaaacttaactacacatatataagttcagttcagtcactcagtcatgtctgactctttgcgaccccatggactgcagcatgccaggcttccctgtccagcaccaactcc

SEQ ID NO: 49169 - DNA, 1004 bp, Bovine  19866880626266
agagaaaagagaggaaaaaattatttattagaaacagtaggatagtaatatagaaatagaaacaggcaggaaaactcctgaaactagggggtaaagtggaaagaaaacatttaaccctcccccttccaagcttctgtatcactctctaacctttgacctctatgaggctgactcccaggcaacaggtattataccattgccttttgggatataggttaataactatccctactgcccagtccataaggggaggaaattcctcagttttattgatattggggtgatgattttctgttttgccaagctgaatctctgactttcattttttgttcctgaattcatttctgtcccaaaggaaacatcgtttttcaaggtgattcaattctacttgactgtacagattttgtagcattattggattaaattggccttatgggtttaccttgggaacccagccaccatttataacattttctatgggggaaatgcatttcaagctctaaactaccagatgtacaaaaagctcattagtaaaccagtaacgtcctttcttttctgtgccttgcctttgcctgtgagagaaacaaccacactggtatgaactaccttcttttaactaacttcttttctcagttggaatgcttttgtctgtaagtgatagaagacactgctaagtggggcttaaacaataagaacacttattatgacattcagcaagaagtccagagagaagcagatctaagaacaggctcagcagcctaacaatgccttaaagtacctaagctctttctaaccttcagctttgccatgctctacatgtcatcaatctccctcatccccagtccctaggcagcagcaactccatacattaaatcctcataactacatccaaagactggaaagcagaggggactgaggtgtttttctcctcatatatagttctttgatcaaaaagaaacctttcccagaagccttgcaatagactttctttcaggtcctattgg

SEQ ID NO: 49170 - DNA, 1758 bp, Bovine  19866880648152
agaggaaaactgggttccatcctactcactccggaaagtaatctgacatacactgagctacagaaagacttgatattacccatgtctaaaataaaggtacaacacttaaatacacagaactaaaagtcaggggtcttctagaaattttcctaagaatacaatgtggaccacagtagacaggataattcttccaaaactgtgtcactgcttgcaacttttgaccaggtctgggtgtgagagaggatataccttctgtatgtttctctcccctaaatttgaaacatgcagtcatgaaaaccatgtgccattatggctctctttgactcacctctcttcttttggggcttcaagatgagtgaagaatggattcccataattatttattgaatttcaaaaatttgttctcccaaacttcagttgggaagtgaaaataaaaggattgtcaaaaaaagatagtcttttcactttgtctgatcctagtgtgtgcctgaaagtgaagaaagcaattcttaaagaacatataacataccgtttctttttggacaaaacaaaaggaagaggaaaagacaataaggagaaggatacacttaaatgcacacaacgacacactttaaatgggaattaaatatttttaaactacagtgaaaacggtcatagaaatttcagtcactggcagttaatgcaattttaaaattagaaataaaaaagatgaggtaaccaaaaactgtacatcatctaaattttaatccctaacagctatattatttgcaatgaacatgataacacttcagtgtcctgtcaaatttgaattatgatctttatcaacttatcaacaattatttattggcgcttcagcactaggcttggctctgagttaagaaatataaagagcatgtaaaaaacaaagtctgcttcaaagagtttataccatagtttgagggactgttatacttgaaataatacagcataatataggtactatataagttaaatgctaaatttacacgcaatctaaaatgtgacacatattcatacatttctaacattttatttctcgtctgcttttcccttttgtacattcagttcctttccattaccttggctattgatctttttaatgtgggtgaagcgccaggcctaatgtactgtagattctgtttgaagcttgtgtttgtgacattctctgtctgtctttaaaaataaaactaagctgaggtattcctaaactttttagaacatgaataacttctgattgcttagaaattatttggagttacttctcaggaaagaacagacgtttgtaaagctgaagaactaattgggctttgcacagttctgtcaaacatgggaaagcttctgtctatccagacacctggcagaaaataacaaaaggttttcactgacatgcaaagcaagagttcactgaatttttcaaaattctattttcaacactatgttcattagttgagcttatctttcttgtccctaattatgttgttttagatgttggaagcgttactttttaaaaacatgtgtaaccaattacaaaattaataaatatctatgcttaattggaggatggatagaggtaacaattgtgatcctgaaaaaaacctcaacaaagtaactatgatattcaaatactttttaaaaaactatatatgctttaaaaagtgaagtatctagttataaattatttctttttcctttcaagaattaaccaactaaatacagcttttattaactcagttctacatt

SEQ ID NO: 49171 - DNA, 1003 bp, Bovine  19866880699100
cgtggaaaacagaagtctgaagctagaaggaaaacagtattccacagaaagaatctgaccgctcatgagggcagatactttcataaacaagaatgtttttagctactattacaaggatcactattaagtatgcaaagtgagtaggtacaaaatgagttaaaagtatgaaggctgaagaaactatcatctagaggaaatgaaagcaagctgtgaagaaaagtgcataaaacccaaaacatgtacgtgttcatgcacacaaacaccacaatgttgtcattactttgaaaagtgatcaaggagcaatccttccaaccctcttctcttctaagcagagaccaactcaggaataatgcaagtcataatgagtcactacacataagcaggattctcaggacaaggaaattaggaacagctgttacttgggctgagtcaaagtgaggctgcatatccccaaaggtctaggactattagagcacagaggagccacctgatctcagttacttcatcaagaagtaccagatttaccttggctgacccaggtttttgttctgtcttgtgtgtgtgtgtgtgtgtgtgtgttgtctgtcatgggacagaagtaatgcatataacatgtgaaaatatgatacaaataagcaatcacataaatgaaaagggcaaggtggacaagccatgccaaataatctgggggaaatatggctaaacaccctcagggtttagtattggcatatctccatgttaacatttaagccaccatccatttatcttttttcaagtattaaaaaaaaaaagttaccagtcaataatttctgactccgagtctcaggctaaatcaaaatctgtccgggtctacttgtttctgctaccatgaacacagggctgatcgcatctttctcccttcttaatcttccccttcagtgtctttatgggtcataccaactcttatcataaaaagctcctctttgaaataaacaacctaaggctgcattctataatatggcag

SEQ ID NO: 49172 - DNA, 851 bp, Bovine  19866880723095
acacttttgtgataaagattttctgtttcagtgcaatcacatttcttaacatttgtctctaggtagacgtatttgacgaagaaggcgatggcaccccactccagtactcttgcctggaaaatcccatagatggaggagcctggtaggctgcagtccatggggtcacacagagtcggactgagcgactgagcgacttcactttcatttttcactttgattcattggagaaggaaatgacaacccactccagtgttcttgcctggagaattccagggacgggggagcctgatgggctgccatctatggggtcgcacagagtcggacacgactgaagcgtcttagcagcagcagacgtatttgatgtttttaagctaaaaaaatagcacattctgtatatcatattaattattaaattataaaaattttagctgcacttttacattagaaacaacatatattacagaaatttgaggtcatctttaaaattcaagaggcttttcagaatggtaaaatgaataaaaactttaaaggaaatgtttttattctaagcaatcacagtacagaatgaaatagttaaggattacatattttgaaaattgaaaaacagaaaatattgctcttttagtgtgacattgacattggtatcaacctacaaagtgtgtcacatgttgatttttttcttctttttttaaattaaaaaatccagaattttataacattcaaaacaggttacttcatctctaaatcttttgcttatcatggctgggcaagagataaatcattttcctcattgagacaaaatgtgagttggtattataaagtaaaaacaaggcagtctgagagtgaggaag

SEQ ID NO: 49173 - DNA, 2472 bp, Bovine  19866880750010
ctctgggagattgtgaaggacaggaaagcccgatatactgcagtccaaggggttgcaaagagttggacacaacttagtgactgaacaatgacaaaatgtctattttgatgagatgtgtttattctccagttttcttataatacctttgtcctatttttgtatcaggttaaattctggcctcatagagttaagttaggaagcattctatcctctgcaattttctgcaagagtctgtttagaattgttttatttaattctttcttagatgtttatctcacagcatttgacaaaggtaaccacttggtattaatttacatattctaacagaaatcatgcttgtttttcttgccattatatctttagagtctaaaagaatgctgacttcatataagcaacccaggaaatatttatggattgtataaaagattaaaacaaacaaacatgactctcttaccatgttctttgctgctgatttaggaaacagaattttcatcttaatatcaattcaaaattctgttaccattaattaatttcaaaaaagtacacctgaggtcttattttatacatttatttactttttatagctggcataattttaataatttaatggtaaaattacacactgaaagtaattagcagtttaaatacgtagacattcaagtaaaatacctataatcttttctgcctttttcaaataacagcattagtctgattattgtatttatatcttactaaaaaggatataatatgtttaaatgcttacatattttccattgcacatgccaaagaacaagtggtttaatagtgttttctcagctccatgtttgtagttcaacaacatccaatgtttctgttcaatttcactactaagtataaatttgcaacttcaacctggtatttcctaattatccagcaccctgacatctaattttttaaaataatttgaatttctaaatcacttcaaaacctaatggaactcaaatgctattacagctgaaaccacttaatagagccctgttaataaagacaatctagttaaattaggcactttcagtgaatatattgtatcttggccacttaatgtaatccaaaataataataatggctaataagtacaacttgataatagcacattttctccattaaccatttgcctgggctgttgggatttttctgcttcagagttaataggagtcattgatttgagtgattcctttataaattctaatttgtagtttacagaacacaagtactcataattcagggatatcagtataatttaggtatgtatacaaaagcctgttcaataatatataactgtcataccccttcccagaaaactaacatagattgttcttgaaataagtcattgctatttttattttaattctattaggcatcagaattgaaatatcacaaactgtcattaatattatttcacatgggtgaaacattttgcaaactgcaatattatagctattaactttaagctatataagacaaaacacaaggttatagcacagctaacagttccaaaagttaaaacactgaaaaacaatgtgtcatagtagcgcagtttttctatctcttccatgtaatttagtcaaagattaagctgcttttgtaaacagtgtgacacttcactaaagcacattttgtatatcctgttaaagaaggataaaggagttacttcattcaaacaaaagttttgctgaatatcacacagccttttagttttcttattctaaaagttcttgaatctttaaactaatttgtataactatttccttaccagaactaatttttttctttaatttcctcaatatttatcaagtaccaactacatgttaaatattatgctatctttcattagcataaatatgaatattgcaaaattttccattgtctagttggcattattctgcctataatttgttctctcccataggggagaagttgagaactagctttatctgaattattttacactattattctgggttagatctgctagtgagaggctttctactgatatctttaagagaatactaaatcatttttctacagttgtgctgtgttcaggcagttaagatcttctacaatgtcttctcctagctttcaaggatccttctggaaatcactgttgtgagaatctaactaacatctccagtgtagacttctctaggattccaaactgataaggtggttactctggaaaatcactcactatgggggtttaggtggctgacaccactagaagaaacacgccagcaatttttgcactgaaggatatcttggaaaacacttttctgatcttagattccaaacctctgaaagattttataatttctaattcctgttttaaattattttcataattaaacttttagttaaaatagagcaacatgaattcaccctctcatctgaaattttaaaatgaggtaaactataaagcatgtttttcaaggactg

SEQ ID NO: 49174 - DNA, 2842 bp, Bovine  19866880772451
aagaaaagcaaaaggcaaaggagaaaaggaaagatatacccatttgaatgcagagttccaaagaatagcaaggagagataagaaagctttcctcagtgatgaatgcaaagaaatagaggaaaccaatagaatgggaaagactacagctctcttcaggaaaattagagataccaagggaatatttcatacagagatgggtacaataaaagacagaaatgttatggacctaacagaagcagaatatattaagaagaggtggcaagaatacacagaagaactgtacaaaaaagatcttcctgacacagaataaccagaatggtgtcatcactcacccagagccagacatcctggtaggtgaagtcaagtgagccttaggaaacatcattatgaacaaagccagaggaagtgatagaactccagttgagctatttcaaatcctaaaagatgatgcagtgaaagtgctgcactcaatatgccagcaaatttgtaaaacagcagtggccacaggactggaaaaggtcagttttattccaatccccccaaaaaaggcaatgcaaaagaatgttcaaactcacaattgcactcatctcacaggctagtaaagctcaaaattctccaagccaggccattaacagaacattaaccatgaacttccagatgttcaagctggatttagaaaaggcagaggaaccagagatcaaattgctagtatctgttggatcatagaaaaagcaagagagttcaaaaaaaaaaaacccatctacttctgctttactgactacgccaaagcctttgactgtgtggatcataacaaactgtgggaaattctgaaagagatgggaataccagaccacctgatctgcctcctgagaaatctctatgcagctcaagaagcaatagttagaactggacatggaacaacagactggttccaaatcgggaaaggaatacatcaaggctgtatatttttaccctgcttagttaacttatgtgcagaatacatcataagaaatgctaggctagatgaagcacaatttggaagcaagattactgggagaaatatcagtaacctcagatatgcagatgataccacccctatggcagaaagcgaagaactaaagagcctctcgatgaaagtgaaagaggagagcaaaaaatttggtttaaaactcaacattcagaaaacgaagatcatggcatccagtccaatcactgcatggcaaatagatggagaaacaatggaaacagtcagagactttatattttcgggctccaaaatcactgcagatggtgactgcagccatgaaattaaaagacacttgctccttggaagaaaagttatgataaacctagacagcgtattgtaaagcagagacattattttgccagtaaaggtccatctagtcaaagctatggtttttccagtggtcatgtatggatgtgagagagttggactgtaaagaaagctgagcgctgaagaattgatgcttttgaactgtggtgttggagaagactcttgagagttccttggactgcaaagagatccaaccagttcatcctaaaggaaatcagtcctgtatattcattggaaggactgatgctgaagctgaaactccaatactttgaccactggatgtgaagaactggctcattagaaaagagcctaatgctgggaaagattgagggcaggaggagaaggggatgacagagggcaggaggagaaggggacgacagaggatgagatggttagatggcatctccgactcaatggacatgagtttgagtaagctccagagttgtgatggacagggaagcctggagtgctgcagtccatggagtcacaaagagtcggatgcgactgagagactgaagtgaacttagtaaatgatggtttgaaatatccttatctttcatgtgctgactttacaaaatagttcttagatcccagaaatattaaattatattttgcataataatttcaaactctgtcttttgaaagtattggaaagacagaatgaaaggagactctttatggatagatagatttttttagtgttttgtattataatacaatataaaataagatatagaaataataattactatcttctggaacataacaaactaataattatttttattattaaataaaagagttaatgttttctaaatatctactcactatgtgccaggcacaattattataaaatctttatatgtattcactaattgtaatctcaccacaatcctctggtgtggattttattattattaatagcaattgatggatgaaaaacattaagacagtctgaattccagacttttgcattgacattctttttagaatatggtctttagagaaaagaaactgagttcgaaatcttactttgcatttgttgaaagtggcagccatttacaacaaactattgaacctctgtaaatatcaattttttcatttgcaaaattcacaaacttttgaaggcaaaaagcataaacaggaatggaaattacttggcacatgtaggtccaagaaatatcatctaatatgatcatcatcattgtcatcatcatcatcagatataaaggaaagaattgtgcatattctcaggaatattatagatacttaataaatactagtttcctttcttgtatttcttcaaaaaccataatagtttgaaaagataaaagactcttccacacgtgaaatggactctaactgggatggaatcccacaggggtatgagaactgtgtctgtgaatgaccttgaaatgaaacccagagactatttttaatcctatttctaaatttaactgtgtcatagtctcatattagtcctctcat

SEQ ID NO: 49175 - DNA, 901 bp, Bovine  19866880777523
aagaatggcctgaaccaacagaagaaattgaatggataaagcaaagatccacacttagtctgaaaattcaaataaaaaaaaaaataaacctcagttgcaatgaaattaaaatcaatgaattaatgccattttaggtaaaatttattttgaggacctggataaccctaagatccaaccatacaagttaatataatctgtgattaccacaaatgaatttaggattcattgagggagattagtatagaacaagataaggctatactatgatcatcatgaataaatttgggatgcattcctaaaaatacagtgtatcatgtataaaataaacttcttgtcttctgtgtgtccagtttttatgacattttaagggaatggaatcataggaaagattacttagtatgttgagagaaaggtaccacatgaaacattccaatgaaatatatattgaagcatagttaattgttgtatggaagaagtggcaaatatcaaggcttgagagattcgtgaataggacacagtcagtgactcactggggcctacgtatataaatgatgctggaaggaaactcggtgtatttgaaatccatgcccatcaaatgacaactttgctcaagaaatgtcttttagttacagatgttatcagttgagactaggctgcccagagggaacaacataattaaagtgacaataggtgagttgctgcagggaagccaagaattatcaataacataccttaaatgtcagaaatgatttttctgacaatttctaactgtggtagattacatattgctcccaattatcagaaaaatcatctctgacatttaaggtacatctctcacaggtagacacagcagtcacacagcaaccagtaaagatgtatagttccctcccctggagagtca

SEQ ID NO: 49176 - DNA, 2488 bp, Bovine  19866880895562
atgcatgttactggacctaattttctagtaataagtgaagtgaaaagtcactcagtcgtgtccgactctttgtcaccccatgaactatacatttcttggaattgtccaggccagaatactggagtaggtagcccttcccttctgcaggggaatcttcccaacccagggatcgaacagaagtctcccacattgcaagtggattctttaccaactgagccatcagacccacagaaagccatataaaatttttttcacatcactattatgcacatcaaactgccttaaatgtctactgatgtgtatattgctttttaaataaagttacttgaactcataatcaagatatttttgcctttttaaaaggatgaaaatgaccatatcaagaattcaattttgtttcaattttttgaaaatttaaatatatttatttttcataaaatcatatttatatcaggataatatcatgtaacaatacatctatctcccttcagaatatttttgtattaaaagtgacctcaggattctctgagacacatcagcattgagaaaacacttcagaaatgtccttctctaaaggaggccttcagtttctttttaagaacaatgatatgttcatttcaggacatgaagaggcagagatggctcaaagagttatatatagaagttgctaagcaaccttggggctttacatgagttatgtttcaagcttgtaccaacaagaggtattattccaagcatcccagcagtattccccagagctgatgatgctcacttagttttgggcaccaaagtgctgttgtgcagctaggatacttggctatgccttgataacttcagtgagaggtggcaagggagatgaaggggtatcagtggggggtttctggtccagaaatgatgcccatggtgatattcaaaccaaccaaattattaaactgaagcacttcaatgggaaggatacttggtattcttcagcaaaaacataaaaacacaaactctgcttaattcctgagcaaaatgcccttcaaatcggaattctgcaaatgtcacatgtctcttcctttggtgcaatatgtgtaacatctaaaggaaacctacagatcttatagttatttgagaacaaatgaaagtcagagattagtaatctattacaaaaaacagaaaaaaaatcattaattatgtagtgagtgttagaaaatctttaaactaatagatgggaatttgaccaaggaattcccataacgataaactactttttataatgtgttatcaatccatacatgtcaattttctacacttaaatgtttagctgtaaataattttttaatcacctgacattgaataatcactgcataatgtaaagccaagtatctccaatttagttcttcatttgatgagaaactttaacagtttttaagttaaagtacaaaacagaatatgaatgtcaatataaaatgagactcctagcaaaaatgggggggggggggcagggaagcaggcagtatatttttaagcttcttttggaagataaattcatgctgaataaattgaagtgacatttggtttctcataaattccagcctgtcctgatggcctccaaagtaacagattcttaaatgtatcctttttcactaaaactgacacctagccaagaattgtcaaagcataagattatttttaaagatgcttacagaataaacaatcatattaactagtcatacagaattatcaattaactttcgcggttaacacaaagttaacttagtagttaataaaaattagtttcctggcagtatctattttatttgtgtattagctgttagatcacaaacattataatacattgcaaatgagccaaatgatacaatattacaaagggggaaaaggaatgctatcaaatatactgaatttaaaatgtctcactaaggcaagaatctgtctcatataaaatatagaagcaacgacatcagtaatcctgaagacagttaaatacattcaaagtaattcaaactttgggaaaaatataaaatttaatattttataaagtaaaaactctataggtaggggtgaggaagaactataacaatgcaaagaaactgacttattccaactaatacattcatatactttctaattaccttggccacagacctacctcaacatagacagttcacaggaaaagtacaaatttatctcctccaatttttcctctaaatagcagaaacaggcatgtattaaaagaaactaaaagtagtaaatctggctagcagtgaattccccagtctcaagccaacacctttaggttagccagacattgcaatagaatctataatagaaatacatcctaattaattcttaatcatcaaaaaaaaaaaattaaaaagaagggagggaggaaagggaaagaggaaggaaggaaactaatactccaaagaaaaatgaacaatatgaaaaaccaatattatgaaataaattttaaaacaaatcacta

SEQ ID NO: 49177 - DNA, 1184 bp, Bovine  19866881090448
gagattctaccctgagaatgagactggagttatcattcagagagatttacacaagttttctccatattagactgattcctcatagaaatgagaaagcattttcttttctttgtccaactcatttgatcttacatatcttactttaaaaagcttcccaggaaatgtcttttattttttatttcttattatattttgttattttactataacaattgggtcatcttgaagatcatgaatgatttgaagaaacagttaaacactgagataaataatttttatccaacccttgtgtcccaggagtgggaggaaggacaacaaatcagaaaatagtttatattattattcagtgagaactaacgcaaattgagatccatttaatttaaaatactttcatgtgaaagataaactgagagatgaaagagtaattttacaaacactgatgacaaatggtgttgtaattagaaagaacatgtgtatcaaaaaatgtttcttctctaaatcattttgaatgtactaatgacattggaaccatgtattaaatactggaaaaaattggaaataattacatgaagagcaaaatgaggctgtatgtatacagggattcccccaccccccgccccccgccttttttttagttatttattttggtgacttaattttataagaatttaggagaggtaatgaaaagaaggagaactgagaatgttatttatatccattctaatgtatttaagttgataaattataaaaccatcacctgtttttaagtagcattctatccagacaaaaagaaaacaactgtgagtaatatgtaataagccatgtattacaagtatttgtccttatccacttgtgggaggtcgttaagccattccattcagggtcttgctcctcctcttgtgttgggcctgaagtcaacagagtcagcagtaggaaaaagaaagatggacatgcagacgaggaaaatgatgacaaactggaatttgcaagaatgaaatccaaaaggatgaactagaatctatatgcctctctcttacctcctgcaaccttgatgttatgggggatatgtagagtatgttattgccttttgtgaacagaattgtacatgtacctggcctaggatggatagaagaagggagaaaggaggaaaagaagaggaaatgcagcaggaactgccaaagctg

SEQ ID NO: 49178 - DNA, 2263 bp, Bovine  19866881204303
ttcataattttaataactttttcttcattgtactcttcttcaggcatgctgagtcttctttgggacattaaatttcacagattggtttatgttgtattattgcaaatatcattttgatttttcatgcattgcagacaggatatagaggtaaagtaagaaccatattgtatatttgatttccaatttacctgaacttattaaaagaactgttcagagtcaagtttttaaagtccttaaattgttttccaggtcatagatattctactcagcagtgaaattgtccttgctagtttctacaagatactgattacatttcttgtgagtattttaataggtttatgctcagaagtactaagcttcagattttttgaagtttttatagaaaaatgttttatatatttctagtattttttcaacaattcttaatatgaatcaatcaagaggaacatcagattttcttccattttctgttacttcctatattatctaattatatttatgtttattagattattcaaccaaagattagatctcttcaactttttattattcaaccattctagccctttgctcaattaaaagcaaagacacaacagttaatgagttttattaaagacaattacatcttaatggtacctgtcaaaccacacaaaattatactaaacagcacctgaattttgcataaaaatagtattaaaatgtggaatctgaaaaataatacaaatgactctatatacaaaataaaaacagacccacagacatagaaaacaaacttatggttaccagatgatacagggaaggggagaaggacaaatcaggagcatggggtaacagatacaaacgattaatattatatataaaatagatgaggaacaaagatttattgtatagcacagggaattgttggtttccttggtgactcaggtgctaaggaatctgcctgcaatgtgggagatccaggtttgatctctgggtcaggaagatattccctggaggaggaaatggcaacccactccagtattcttgcctggacaatccccacggcacagaggagccggtaggctgtattccctggggtcgcaaagagtcagacacgactgagagacttcacttctttcagatgtttcttgacttcttacttttgcattccagttccctataatgaaaagcacttcttttttaggtgttagttttaaaaagtcttgtaggtcttcataaaacttcaacttcagcttcttcagcgttattgatcagggcacagacttggattaccgtgatatggaatggtttgccttggaaacaaacagagatcattctgtcatttttgagatcgcatccaatccaacttggttgcttccaagttttgacaattataagtaaggcagacataaatatttaagtacaggttttccaaggttatttcctttgggtaagcaccaagaagcatggttgcttgtctgtaaggtaggaacatctttagttttgtaagaaactgccaaactgcattccaaaatgactgctcaattttgcattcccatcagcaatgtataagacttcttgttgtccgcatcttagccagcacttggtatcgtcagtgttccagactttgaccattctagtagatgcatttcattgttattttaaattgcatttccctgattatgcatgatgtggaacatcttttcatatgctgttttgccatctggatattttctttagtgaggtatctaagattatatgataatatttttctcctttcttggcatatcatttatactttttgatgttcttcctttctttatggtgatcttaagtttctgacacattttccttatcactagagaatttcatttaacatttctttcaaggcaggtctactggcaatacattcctctagttcttctgtgtctgagtctatatttacttcaattttaaaggataatatcacagaaaacagagaattctaggttgatagcgttgttctcacaataagtatttcacacctctctcttcttgcatgatttctgaggaatcaggtgtaattcttatctttgtttctctataagtaaagggttttttcccctcattctggcttattttgatttttttctttggctttgatttctacagttttaaagtaatattcctaggtgctgttattttttatgtttatcctgcttagtgttctctgagtttcctgaatctgtgaactggcatctgacattaatttggtgacattaaatttaattgggtcaattaaatt

SEQ ID NO: 49179 - DNA, 828 bp, Bovine  19866881294982
gagtgggttgccatttccttctccatgcatgaaagtgaaaaaataaagtgaagtcgctgtcatgttcgactcctagcgaccccatagactgcagcccaccaggcccctcctccgtccatgggattttccaggcaagagtactggagtgggttgccattgccttctccatatgcaaaatcatgttttaaagcagagaactggttttgatatgaaatattgacaagaacctttctaatcttactagctagcatagtctgattataaaaaagagcagtaaacttttctgtttttaaatattctcttgaagaaatagctagaaatatatttccttttttttcattctaggatagactctaattattggtgaaatgtaattgtcataaatgaataataagaaattctcacgtctggtgttagaggtgagccccagttaaatctacctttaatactgaagaaagttcttatttctcatgaaatagctgtaagaaggaagggaaggaaaggagaggagaggaaagatgaagagagagaaggagtaataggggaagagaagggaggaggtgaaagaagggaggggaggaaagaggcaaggaagaggcagggagaggtgaagccaagaggaaataaaaccaagcgccaacgtataacttatacaggggtgtccctttcaagacataatgacagaatttagaaatggtatattctttacaagcataaaactagtttccaatatctagtaaattttatgttaaaaaaaaatagcccacagagtaattttttctatgtatgagatccaagaacttctactccatttattctcccattttg

SEQ ID NO: 49180 - DNA, 962 bp, Bovine  19866881473784
tgtttgaaatcctgggattgaaaattgccttttatggaggatctatgcatggagtgtaaactcagcaagtttgatggtgagctgtgactgtcatacacatttgttctgatatacttgtccagatcacatcattttggcattctgattgctttagtttagcactttggttgctatgatactgttgcataatggaatgtgtcctttaatctatatttagtgcccagaatttttattaaaaaagacacagctacttatatgcataatagttaaatgtatagtgtgtcaaagaacaggaataatttaggaagaaaaaaaaaagagagagagaaagagatgctgttgttccataagaagcaaaaggtatttctgacaaatctatataccagaggacttgggaagctcagtgacttatatcccttgctaaatacagcagacaagcagttaaccataatatcaggagacaatagacaaaaggacaaagttttgacatttgtttttacacaaagttcttagtcttttttttttaaaggatagtttgattccctctgactcagagtgaatcatagggatagatactgttgagacattgtagctttcccctatagcatacttcatcaaaaaaaaaaaaaaaaacagaggaaggtatcacttaaaaacatttaaaacagaaactactggtaactattacgaaaataaataacaaactctcacaatttattcagaattttaacagtaaagtcatttcctacgaatatacttatgattgaaaatattcttatactaattaattttaactgaagaacaaacaataaaacttgtttggctctatcaccttattaagaggaatagctatagcaaaattctgaaaagcaccaactggccacataatctctcattttcatagaaaaggtaccattttaatgtcatatagtcagtttgaaacatgtaaattatcacatgtg

SEQ ID NO: 49181 - DNA, 1071 bp, Bovine  19866881480923
cttattaaaagagatttgcttgctgttttattatattttcaaatactgtttccacactactgccataacataaaattcttctctttttaacagaattaaatgttgtcaaattttgttaaatgttgaatatttttaccttacttttataatgaagtgattttaataacttttacctggccaagtccacggtccttaggcagacaaattctacaattcacattttattaatgaggcatttgagacccggatcatcaaagcgacttcctgaggccagaaatgttgctcaagctaggcagaaattagagctccagaaccctggcagatttctgttcttatggtaggctttttctactgcaattaggctccctgtctcttattaggcctgtcttctaagcctgctcccagataacctttgaatcagacttacacatgatgtaggcatatttgtaatgcttattttcacaaagtttaaattaatttgaagcttagttgaaccacactatcaagtatatgttggaggagtcccctacatttcattcggaatttcatcttctgttaggaggagaactataatcactccacggagatgagagtgggcacagaccaaggaggtgggcaaccattaaactgggaggtgtgagtgggcagaagcggtatgtttgagaatctctgaagcacctaacagagacaggaggccagcaaaagggagaagggaagtggtgaggtctggcgtcaggctgacagcagatatgtgaggtgaatctgttcaagtcagtgcgcaggctgaaggcagctggacgatgacagggaagccacaagggtcactgctcacacagcacttgtgcgtgactgagagagctgtggggcccggaagagagaaagcagctgtgctgtgaggtggatccaagtgctgaggcaggaagcaggtggtcacaggaggaggaaaagaggaggccagtgctgtggagcatctgccccctcaggttggctcctgtggaaaggctatatgaagattaacatgtaggggaaagagcatttatttgactatcatcctcaaaaacaattttacac

SEQ ID NO: 49182 - DNA, 1818 bp, Bovine  19866881487035
atagctaccagaatattttgaacccaatatcttatatctgaaagaataatttacaaagtgatttatgtaggtgctacagaatttattgttatgtttattatttatcagaaaaatatgatggattttctttatctgtatccaatgatatggaagttttttacatatttctaacaaatatgattaatgaataatttacaacccagaacaataacatgcatattttgttagcttttgtaaaaaataaagtcctctaaacacattttccaagtatctttttgacttttatacatgcctagtcttctagaaaaataagaagaaatattaaatcttaaagtctaatataagtccattatcataatgtaaatacagtgctttatgtcatttctaattaaaactacattatccatgttgataaattcttttggaagtgaatctgccctatctaaataagagtcattagtcagttagactagtttccttgtcaaaataatgttaatatagttttcatccttaattctgacttatatccaccctcaacctccataggaagtgtctaagcacctaatagctagtcacactctataactatagaatgtgaacttgaaaatccacataatactccttgtagcaaaaaaaaaaagaagaaaaaaaatttagagattgtattctattgtatgtagaggaattaaattttttatttaaataacctaaattgtatctgttttgaagaatattcatccatgtgtcatatcagtagagtgaattaaaatttttctctcaatttttggtttctatttaggtattaatagtcctgattaaatatatgagggctttcttctgccttcagatcttactttgagactgaaaaagtgaaatgattatcacttcctatgcttggaagaaaaaaaaaatgtttctcatctttcttgaaatctttagagttaattttttaggtctgggttcatgatcttgattttgagaaagaatagaatgaaactgaattttaaagatattttcagaatgataagccaaatctctgggatgatatgttgactgcaaggctctaagataacccatgatactgtgtgcatagcgacctcttagtgggccatcactgacctaaagtgaagatgaatcttactcacatgatgccacatttccctgaagaaagagagcttggaaaattaaggcggtagcagcatggtatttcagttctccattgtgttttgttactttattattaaacgtgaacaatttttttctactctgtaattttaatgtctaatgaatatgttataaataactttattccttcctctccaggtgtttaattatcacatagcataggggtcttttatactgccattttccttttatactttataatggtattaacctgccaggacaattattttagatattttcccaaaaaaatatatgtaactcattttaacttaaaattaggcttcctcacaattacctacctccccaacacaatctgtctttaaaaatttagcgtaggtgaaatctactgacatttaaattgtgattaatgctattcacatcccaggttagggttttgtctttctgctcgtcaaagtacacccttactgttaaacttgactgggattccttaccctgattcactttacctaatataattttattataatacagtgtgtgaaagcagtctagatctctgatatcattcccacgtatcatttccaaagaatgtggaattgttctcactgttcttcttctacaataaacttgtaaaagtagaaaacaactgtagattttttcaaaaaatttttaatg

SEQ ID NO: 49183 - DNA, 1201 bp, Bovine  19866881697115
aggattgatctagagctgagaaaaatgactgacagatggatcagttttgactctgtcagtttctattcacactgtctagatcagaccttcatctttcaactggattttgacaatgccacattttccccttatgccccttacttcattgttgctctcctctcatggattatgttgatagattactttttaataaaaagctgttaacatttcccctttgtttaaaataaattgttcatctcccatttcctaaaggagtgtttctcaatggatttttttagcctcagcacaaaagatatatggcattcataggagggacaaacaagcttgggcatagttagcttcaatctcattagctatttgctctgttttcttctttttttgctactcgctcaaaaagtcatattgaaatgcaagggactgaaagggattgtagaaggataaacttcttttattaaatagaatgatttttaacctcagttcattgctattattaaccagttactgacacgataatgtatcaaaaccctacaattaaaaatctattgaactgtaggataaatccaaactgctcaatttggtatccatagcttgagcaaatattttctgcttctgcctcagtcatagctgtctcagacagggaaatgatacaagttacactgatggggagcattttccaggatgggggaacactactaaggacaggagaggctagagaaaaacagactttatgaacttcatggtttacctgacactagtcttggatccatgaattttcccatgcaattttaggactatcttaacaggcactgttatattattagcagtcaggtctttagtttacaatttggatgaaataatagaagttaaattacatatctaggacataataaatcactaaacttcttagttaatctggagattagagcttcataattaaaatttcataatcctacattttttataaacattatgtgaacttttagaatggcagaaagtcacaatcaaatagctacattgtcattattaatgttacgtttgattaccttatatatttttattaaaaatcctatacctttgagatttacaaaaataagattaattattgcatctgtaggtagggtaattcatcagatcagatagttggtgaattactgtctctaaaatcatttattttttatcattctgttctaattgaatgagt

SEQ ID NO: 49184 - DNA, 1398 bp, Bovine  19866881701656
ctgtgtgtcaattcacatttgacacactaaaatacttttaaaaatattctgaattggccttttaaaaacaattcaggcattcaactttatgtattcacctctgttcctacttaaatatgaacatggggaaaagaggttcaccaggggatagataatatgcagcaatctgaagcaaggaaacatgacttgacatcttgtctggttgacagaaaaccaaataatagacagctcacaatagcaaaaactgatgctagaactgtttcagaggattatgtcttgaaagcataagtaaccctttgaatcaatttctgagactagatgcagcaacttaagcttgtgcttcacatccatcagagactagaaggaaaaatcatcatttttatactctttcatgagccataacctccataatggatatatgggagtactggcctccaagagataaaacatcctctagacttgctttaagcattgtactgtctttagcccccaggatgcctcactaagaatgaggtatctgcagtggtctttcatgagtagtctgcatgtatttatttcctagccagctggatgctttatcctgcctacccacataaggtaatacaactagaaaccggtttgaggggaatctcacaattagcatgcatatattctaacagtacaaaaattttaactcagagaatacgtgaacataatagaattcattcactcattacatagatactattaaggagcatctatgtcccgggtcttgaatctttagaattaaagactccctttcttttcctgcagcaaagatttatacagtggcagtgttatctgaaaagatggctcagcacattccttgttagatggtttactctcagaaaatatatctttatcatttagcagtaatgtggtaatctccccaacttgtagtaatcttcctcctattatttttatctgaagagacaataagattcgacttgaaactctcaagaatttgaaaattactactgtgtcatgactatacattttgaaattttggttctgtcttttattttaaggctgaacctccccagtttgtagtgataactttggttttgaaatgctttgcagacactttactaccctgattgcacctccggattcttctgatttatcagcatccttctttagggttattcagaaataaaagcagtgttccggatgtgccccagtccaaccatagagccattatcctgaatttagtttccacagttactattttaatgtgacataatagaacattagctttttgaatggttttatggtatttggactcccactgtggcaatgactaatgaaaattcttgcaaacaagaacatggttaaatctcttgttgagaatatcagcataatggcagcaaaggaatttta

SEQ ID NO: 49185 - DNA, 970 bp, Bovine  19866882149016
actttcacgttgtgcttccaaacttctaccaaggtcttgtcccctagtgtgtgaagctcaaaagcagcagtcaagtttctcttcaacatgagattaaatagaaaacatgattagcaataatgcattactctttcctgactcctcccaaacaacattatatctttcaggggtgtaatgccaggttcatgctgatgctaaaacagaatgtgttttgacattttaggtttaggtcaactaattccctctgaatatgagtggtggtaggaaaataattacatacctctgcagtagtagtgaggtacttgtttttatgactgataggcttggaatatgttttttctcacccaagtgtcaggatgtcactttgagactcatgtgcatactaaatcaactctgcatttcagcaagaatatatttcaaaaaattttttcccctagggaacaggaaagggatactttaaggtgaaaattcacagcacgatcttctggttatgcctaattttgtcaactactttcaatcatctaacaaaaaatttgtgaaagaaacaaaggaaccatataaaatggcatacaataacatatcagtagaatttgaaacaatcagacagaataagggatccccagaaagctagttggctgcttgactaattatgtgcattaatagatttccatcgggccctctggtttttaagagttcatttgattgcttgatcaaattaaagaggtatttctagactcttctcttctcatggccagggcatatgtgaaaaacataaaaatcaggaattgaaaaatttaaattcaaactcttacaatttctagtttcctctgaatactctgagcttcactactgaagctcatttcaacttcatttcacctataagatgaagatgataataatttaagtaaaaaaacttctaagaattatcataagaataatactaaaaatataaaattatataaatgcaaat

SEQ ID NO: 49186 - DNA, 1827 bp, Bovine  19866880462561
atattgcaaaaagggcttaggttcaggtaatagttgggattatggtttccaaacatatctgggaacatcacttgagattctcttttaaaaaaacacagatttccaaacccttcccctggggattcagtttcaatatgtatggaatgggaaccaagaatatatagagagagagaaagagagagagagaatttaaagtaatgtttatgtttgggcaattttggaaaaaaagttgtattaggcctttcaagacagacaaggctgatcacatgtcgacagaggagtggtatgaatgtgtacattaatctacatctgatttttcaaagagattttaaaacaccattagaaaaaactaaaaaaataacaaacttctgtttcttcaatagatggctttactaatatgcaaaatgagtttgtgtttagcaatgtcttattctttatacattaattctttctgtgctgtgctaagttgctttagtcttgtcttatcctccgtccatggggattctccaggcaagaatactggagagggttgtgtagggttgtgtaggcatagatggtattcacaggactttcatgaacatattctaacaatactattatcttcatacattttgtgccattctataccacccagtgaaaagaatcgggttcattatgtaccttatatgtttatgtgaaaatttccaacagaatcacagtaaaaaacacatctctgaaattcctggcatttgggcacccatgttggcaagatttggaagggctatacagtaagaatgattagttttcaattcatagacatccattatctatggaaaaagagccagaataaacccctcaaaccataggccttcttcatgtaagatcctcccagctgccagtttaggcactaatcacaagaacttcattagacagagtcaacccacgtctaatattttatagaaaattggtacagaaattaaatggtttgtcgcacaaaatgattagtgtatgtagtatttatgactcagagatactgagtttccaacaactacacactttctctttttgtaaaatctgccccacactgatagtgttggcctggacctctggaatgaatccaatcaatgcatttgatcttctaaagagtgaaaatttggtcttgtttccccaccagactttgcactttagaaagtatattgtgggattctcccacaatttcttctccctccactatagaagtttctttttcatcactctacttaaagggcctaatattattgcagtcttagcccttttggggggatgcagatttccaggttcagcaactatagattagatttgagagaggagattcaaatgcaatagtgctgcaagaagatagctcctatgctgatttagaatcagtaaaatgcaggacaggaaagactatgtgttggcaatagggcttgatacatgtttcaagagcaaaatggaaactgtcttcccatggtttgcaactatcaatcactaaaaagatcttataagcgaaaggctgcaggaggagaaggcctgcctcctccttcctcttctcccagggtggagacataggtttcaaaattagatgtgtcaaacctttcacaagtcattgctgaagtatgcctaaagctgtctcttatcgaaaaaatatattaattatatttctgcttttttgtcacgtaaatttagagttcataaaaggaaccagatggacagcgtttgggaagtgaatccttcttttgattagagacaggaataaagtttctacatgctctgtctgtgaaaagcttcctcctaaaacttttagcatcattaaaatggttggagattggg

SEQ ID NO: 49187 - DNA, 1703 bp, Bovine  19866880516973
ctttaagagtggacacagcaactgtgggttcggagtctgcaagacactgacatgtgttacgtttgcatttaggatttcttttaaatgaagggggaaaaaaacacaaggtcagcttcggaaatgatgaatgcctttttgctgaaagctgtactgaacgtccttgagtttaatcaaaactatttgtttttagtcagctttgctgttgtctcttttactcttgtccactgatagcttgacattaatgacatcataaatcatgtgaagtggcggcttgggtttggtagcatttcaagtgtttgttgagatgtcccggactatctgaggggctggcgcaaggttggctatcatcctgcactgaatctggagtttatggcatgattcagtcagtaaaagcacagagtgcagtattggtgtgatgggccttcattaaagaaggtctgactcctcattaaatgctgactttagaaagagattatggaggaagtggatttgcctttaattttatttcttcaaatttttaaaacctgattttcaaatctcctattaaaataaagatcgccttccgtgcttgtcaattcatgcggtcactcggtgcctgtaacataaagtgtgagagtccatttacactgttagcattcaccgtgtccagtcacttgagacttggacaggggtacagtttgagcgattctatcacctacacttcttaaaagattcttcttaagcataaatcaccatctgtctgttgaaaacctattctttgagacatgtctagcttttatcagttgttttttgtttcagaatgatttcactggatccttctatgttttatggcttgttatctgtgtgactgttcttagaacatgcttttcattatcactgtactctactgctaaggaaagaggagattacactttagctgttattttttaatggtattttgctatattgcaaatgtgaatataaatatgaataatttgtagatcatttacttccttcggtcaatatattaccaagtgaaagggagcaactttgttttcataaggctactgagaaaagagatgtcttttctttgtcatggaaaaggacatcttcttgcaatgtgcattacatattatgaaagagcgcttttcacagtgctgagacagttcagccaaaacatataaactctttttacagattttaacagaaaatgcagtttttcacctacatttcaaagtggaacaaaatcacatcactgctatataatagtaggccaaaaaactgaatagaatggcatcaaataaaaccaatcatttgacaactttgaccatttaattctttaaactgaacttgagaaggaaaaaaaatgctgggcatagacgtttagcctgaattctttaaacaatctccctaaatgcttattacctattttcatatgaatgctaagaggttatttcttcatgtagcaacaaagttttttaaaaaataattttgtgaaaagaacctaatgatatagaattaaaatactttttttccttttttgtcaacaagatacattgacaatttaaatgagcttgaacaacatttgactctctttaaatagaattggtgcctgttataaaaggatttctttaccccatgacaaatgatagcaaataattataacaataaagcaaatcatagggtgagttcaatataataagagtgatacaattcaattcatg

SEQ ID NO: 49188 - DNA, 2373 bp, Bovine  19866880672806
atccttggaatcgtcctaagagttaaccatgaggatcttagtcctcattaaatgatataaagtcaacaaaacgtaggagagagaattaaaaacagaggtgtctctgaaggcccagggctgctgccatacttagcatgttataaatgttctgaaaatagagcaagcaatgaaatcaggtaggtttagagaggatatttagctcctcagtgttctgacagaccaaactgatgagaacgagctctaccatagtgtgcctgacaagtggcagatgagattgccgggggccagtgtgagggtgaaaggaatcacaaatatcttcccacatagagctgagcctctggacttttggaaatgtccatttatggaaaatgaaatttctgtgatgggttatttcctgaatgcttcaactccacattggcttaacgtgaccttggaaataaaatgtggactagtctaaaaaataaaattagtaacaaaatagaaaataatactttggtcttttgtaaaacaacatgttgcttttatactaataaaactgtatcagctctacttaggcatttatttttgtatttgacaaatgctttatttactgcttattggtgcaaggactttctactaagtaaaagtatattttattgtgttatattatgcagttatataatataaatatgctcatgtactattgaataaattatgtattgtatttaattatattctattaattgtattatagttaattatatattatgttatttattatgtactattatttatataaaatatagtactacagaagttaagtactgctttaatcctcattttaaaaatgagggaaaagaagcaggaagaggttgaataaaacatgagatgaaatatccagaaaaatcataactaactatgatggtagaggagttttcaaatgcttatagattgaaatatatggtactccatgttaaaagggaaaacttagaaaaaatatggtaaaagaataatgacagactatgatgaaaattaaggctagtggtttccaaactattcttagtagggtgctaaggttttttggaggctcctagggagctgggagagcctagagcgagggtcattgttgtctgtctactttatatagtgggatctgctcagaaagaatgtactctgctgttaaaaggtttgaatgctgttggtatggatcagactcccctgtgtgtatttgatcatgctattaacatttttccaaaatgctgctatttagcgggggatgacactttgtgacataggactagaaaactaagtaatatgatgatgcatatttaccaaaatctctctttttttttggataaccaatataagctacaactgtaccccgagatatctagatactccaagaaataatgtatgctaagtatagaaataggttgtaagtggagcttccgttttttagataaatgcatagtcacgttagctgactgctaaagagcgctactgcaatgataaagctgtcatttatcatgtaatattaatgtaagtaatagtagtagctcactattcagaaaacaaagataaagctgggtgatagccaatagccaacgggcaatctttctctctatgtgaatatttaaagatgagatttaaagatttaaagatgagcttaaacagtctatttgtggatctattcagctccacatgtttaaaaaataaagcaaaaaccaaggacaaatgacagaaacctagtggaaaaaaaaggaatgccttcccctcatgctacccattttcaaatgctttctcagcttcagaatcaaaaaaaaaaaaatcataatatgataagcaatcatagttcgcagtggctccatttgataattaagtcatttaaaaataaacatttgaaaagaagctgaagtaggggcttttctctcataggcaataaggcagactcaccaatacagacaagcatttaattgaaaatacttttaattactgtgaattatctctttctttatgggcatacctccaggaaaggcagttgaaccaaattttcatcttatatttttgctgaggcaatctattcttgacttgttccacagttaaggaaggacccctagatgtagtaaaatgttttcctaaatgtatttttacaatatgaacaaaataacaccccccctcaaatcaaatgcctgtatttatttgtgaaaaacttgtgaagttatcatttcaccgaatatccagttgctaaaatcctatctcatataaaaagagttggatgaatttataattttctataatctgtagatttcaagtcatctttcatcttaatcttttggggtttcttagaaaaaataatttctctctttgactcagaaaggatgctggtaatttaca

SEQ ID NO: 49189 - DNA, 1506 bp, Bovine  19866880717765
ttttaaatctatagacccaataagaataaatcaacttaatgacttcaaaggagctaatgccattaacatgatggcctcttaaatttccatataatgctaatttatgcacttagtgatcttaattgtcaggaaatgtttcctcatttttaacctaaatcctgaatgctatagagaggttctcattcctcttgaactacccatggagattgttttccttagagtcttcattttctataaaattttctccatccttcccagaaggcccaaatttcattagatttttggaggacatggaatgtaagtttaacccttgcaatagcatcattttagtctattttgtcacctcaagtaaatacttcagaagaaaaccgaagttcttccccttcatttttcgtgactattttataatgggaggaaccatatggataataagcattgtggcaaaatcattctttggtaagggcagtttgaaaccatctatttagtgggatattttggaaaaaagaaaaagaaaagtcatgtcggcccaaattttgttttgggcatatttaggtgacaaagttattttataggaactggttttactttccttagtctttccttaatgtggttgcataattcatgttcatgttaagtgttattaaaataaatgtaactgttttaaatttgataagcacataaattcttttctttcagtggaagcatatatgccgtgaaaaatttcactgtcggacaattcatatcagtagagacagatctcataagatgtcttcttatttcagctacaaatcagaaaggctgcgtgctgtactcccgagaagacgtgtgcatgcattataaattctctttcacattctagaaattacaaccagggacttcaggtagtgttgaaagctctttcaaattattaaatgctggagaccagaacttttcaaattttaatgagtggaggagtcacccaggggatcttgttggaatgcagattctgatttagtagatttggggtggagcctggaagtcagcttttctaacaagtcgcaggtgatgctcacgctgctggtcctgggaaacatcaagattgtggacttaccttcctgtttgcgacttctacccatctcaggaactctacagggtattctgtacgccaaaagtagggggcaactgaagtcagtgagaagggatgataaaacaaataatcacataggtaaatacaagtctcacgataaatacttgagtcactatagtttgtggtctctcgggacagcaagtctgagtcagctcttctgcgttgtggttccattctcccaagattcattattcactattgtgattaccattactttgcctctgccatttctatgtttggtttctttcacaaagcctgggaagacaatgcaggctgcaagatccaaggaggttccgagctcagataaagatgtagccttcataggaaaaccagtatctgccctaaaatttggtggttttgtgtgtatgtgtcggggggag

SEQ ID NO: 49190 - DNA, 1471 bp, Bovine  19866880718248
ttttatgtgtcactttagagctaagagacccaacctcctggcagctttgctttgggtcttaattagccacttaactgcaaattggttggcaccctagtcctttcatcagttattatccaaatagcatcaccgactctagataaagaaaagaaaagatcccacatgtagcaggtctttccatcattattgccctttaatacaaagagggggttcccaactctaattaaggctacgcttttaataggcaattggcatcttatttaattcattctcagtgcggcgtcttaaaggaaaaacaatcacagtaatgtgtggatagtgctatagaatttacaaaatatttccatctactttactactcttacataatacatgttttagccatgtattaatcaatatgtttttactggttgtagtgatttaagatgtggatgttatttcagtatgtatccacttgcctgcatatccactaagctgtctaataaaattaattaagtcaatccccagtatataaagggagtcggcatctttattttttgttgcacttctgagaatgatgcacacactacatggagaggtacttctttgccgagcaaacctaagaggttagtaggcagaagaaacagttagctacaagcgaaaagagaagaatggagaaagagcaagaagacttggttctgtgaatataaaaagaagcacgggagggagaaagagccacagatatagggtggatccaaaaccttgccaaatgaacgtgataattcagagtgtgacttaattagtttagtgttttagcagaagaccctcagttgatgctttgcatgcaatatgatataacatcctttgtttctactagaaagaaaattaataattatggtgccttttttataagcaacacagtggtttttttaaacctatcttttcaaactggtttttattaatttctactacagcatctttttataaattctaaatgcaggtattctttatagtctattaagtcactagaaattatatatggtcattaaactcaaacttcctatctttctgaaaggcagtagctgagactctgcacaccccaaatttcctctgcccatcaagctcctggaaccgatagccaaacccacaggctgacccagagtgagagcctttcaggctatgtgtttttgaaaacttggaaatactgaattatgtttatgagattcatttcccaactgctccaaagcttataaaatattagtatttacaataccccggaacaacaaacacagcatgaaggcagctgcctcatcagagactgagccacaatgatctcagacatttgtctatttatcatgggttggatttccttggcaaagagttcaataaggatgatgagcaaacccatccaacactttgctcagccttgcaagtgaaaagttgtccctcacctcaccccaaacacttagaccttctgtttggtacggcccgt

SEQ ID NO: 49191 - DNA, 2063 bp, Bovine  19866880718684
tataatctagagattggtaactcatatgtcttaaggtgccagaaaggtaaagaaaatgagtaaaatggaatttgcgtgcaatggtagagaggaatacagaaattttaattaaccagactgagtgcacctcttttaaagacattcaaattcttttttaaaaaattgaactccatgtctatatgatcatttagtcatttctaatacatggtgtcaacctgtatacagttggtgtttaccaaaattaaacaatcatcagactcactgggaaatttactaaaacattcaccatttctaggttctgtcttaagagtcttgtttttctatgatttgttgtagtttgctttgttgtagattgtttgtctctttggtcaagcaaattactgatttaggtgcatttattcagcaaatggtttatctaatgtttagtttgcgaatactgtagtagatactaggaatatagttataaataagcctgttttcctaatctccttactcttacattctaacataacataatatttctattatcagtggcactctaataaactaaattatatttacttattagtcaaggattaattaagatttaaattaatcacaaagaaaagacctactgattcagctgtgagtaaaacaaaaccataaaatcatagtattattccacccttttattacttctaatatttagaaatggtaattctatttgatagtctatttacacaaatcagttctataactccagtttcataaaattattagggtagaatagctcacttaaggtttattcaattaatattaaattcttcatggactttttggtattagtcaaaacaggatataaaaacaggatagttaaaaataactaagagattagagtcatctattttgtttaccctatgaacttgactttaatacatatcttcttcctacagcacgtcagtgctatcttctattctgtctcaacttttaaaaactgctcataggaggtaggtttataatctagagtacaaaataagattagttgtttaagacaagtatttcatggccttctgccagaatagaatcttccccaagaatcttacatttttttccttttgaatcacatcaaatagtttctctacttctacccaccctggtctcattcactgggtggtcagcatactctctgcttaacaacagcttggggggggaaaccaccctgaataacatgcattttgatataaaaattacaacccccaagagtcttaaagcattgcggtcctgacttgctgacctcggccaactgttgtggccactcacaatgaactcaccaataaggaaattagaaaacctctggtatgtgttttttggccagaataaactcaatctagagagaggaaagagacactccattttatttttcagggtaatgtctatcacacggaggacttaatgaactctcagacacaccaggattttttattttttattacatttttggctgtacattcatttcaggtggacactcttttatccagggttctttgtgggcaagcagttgcactgtggaattactttagtggttaaaacaaaaataaaatgttccttttgaagtggttaaaacacgattctttagatatcaaagaaggaaccatgtagcattagctagaaatagtctcttattagactagttctatcttctcatctatttcattcattcagacattttattcagtacttactaggtgaaaggcacaaagtgaagtgcttcatttgtttgtttgatatagaaaaataaaatcctttgctagctgagtaattcacagtgattgcattatcatcaagctgcttctggattactgaatttttatttagggaagagaacttgttggataaattcaaatgcataatatacttaaaaacaggatactgtataatcacatatgggaggaaaaaagcttaagtgttgccagagttaataactcatatatttcacaggaacaaagtttgtttttagatagctaaagcataataattcctaatgatttttctttcaaatctctcttgtaagcatacatctgctc

SEQ ID NO: 49192 - DNA, 1122 bp, Bovine  19866880789159
tgacactacaggacgcttcagggatctaggatgctgtgattcttaagagtgcattctgctcactgaatttaagaatgttaaaaaacaaactccttcagtttatgaaattattcatgctggaggcaaacccctttgtatcttatgtcagagacctggtgggaatcttcaaatggaaatagtaagaagaaatgtctcctgattataacacattttttttttgaatgaaaacctaatgttttgtttacaaaaaggaatgtctcacatatcaagaagaaagtctgatcttaaacagagcccagtaatagctgtagcagatacaattagcaaaccatggaaaaaagccaggaaaaaacataaatttcttctctctctgtttgtgttacattcctgactctatctaaatccaaacaggcatgtttttccatcagtgttagtctatggagaatttagtagataaaagagaagcaacagccttgagacaatgaattttgacctcactaaacatctgctaaatagaaaactgtaacaataaatattaaattgaaaaagttgtcagactttaagacctggttccttttaggtttatttaaaacaaattgcttcttcccttttgtccttttcatgggaacttttttaacaactagatttttgcttatgattaaatgagaaggaagttagttataggtaaataaatatgtaaataaaactgaggtagtgtattaagtaaaccctaacacatgaaatgaaacagtttataatgaatagctaaatctatgaaatggttaggcaaaatatctttcaatgccccaaattcctaaatatgtcactaatcataggcacaaagcaaatttgaatttccatttgtctaggttctcaaaaattgattaataacataaaagaaacaagttttgagcatgtagaagaatgattaaaccaacgtagcagtttctgtgctagaggaaacttcctgaaagttctaattctttatggaacatggaagtatgtgttccattctgcttttatatgcataaagtaatctgattaaatgatctaaccaatcagaagaaatggttgatactctcacattttaaagaggggttgcttcatacccaaggagagcaa

SEQ ID NO: 49193 - DNA, 2456 bp, Bovine  19866880818151
gatagaataatagaatgtatttctgtggtggtttgtaattagaggtaaaatttgggtaaaccaatataaaaggttcggagtaaatagtatatccagcacagaaatccaaactctactcgatttaaaggattttttgtccaggagtaggaagagtgatttatcttgcgggagcattgtgtaaaataccttaagaaacagccctcactttggcttgtccctttcatgccgtttgccttctgtcttgatatgtggtttctgttccctttctttttcttctgtgaaatgcggaacaaaaaaatacctgaaggatagcacttagaagtcaaagagaaaaattcttaaaacatatacaaaaataaaaatagttttcttttctttgactgtgatagggacaaatggtaaacatatttgtggtgctgagaaaatacagcttcacctctcactttggcagttttgcttgttaacacaaaatagcacccataggagaacctaattactaatgctgagttccattaattactgagcaggagccattctttgggtctaaggatgagattgttggtatttctgatttttcactgagaaggacatcttctgtagactgtaaaagatcccttagatcaaaaggaaacacacaagaaagtatgggacagtatgagtctagtcaaatagcagtctaaaaatttctgtcagcattcgagtttaaggcatatatgcagtcagaattagagctgtcagtcacatgtttattttaaaagagaataacctaaaatatttgtgtctacccagatgtaagctctgctctttgcattaccaaaaagcccagcagcatcctgtcaatggaatatctgaaaacacatgggactccttgcaacgtttatttgtgttgaaagctgaactgatactgctggtaatgttaatgatagcaaattgggtttgaaaaaggttgtatttcagtgacttttgtcctggctgaaatgccagaagaggtaaaaaaattttttcagcatgaaatgatgatgtaccctttacaaattaaggtttgtgtgtctatgtgtgttagaactggagtaatgtccccaccaatttaatagcatcttctggctctgacctcgtcccctgactttcagtatttggggaggacaaaagaaggatttggaaagaatggaaagaaaaggacaggaggggaaacagtaagttcgggtcgagggtagaagtaagggagtgcggttaagtctccccgtacctccacaacctcctgctcaccacccaccacatcaaatgataatggtctgaagagaagaggctggggaaagaaataaaaaacccagacccagaaaggtcacacagaatgctgagtggcttatcggtattaggaataacctgaattttggttcctgtacaagtcagaaaagcacctataacccacaattctttacataaaattgcttggcagttgccactgcaaatctcctggtcttttcctgtctctaagaaacaatatgataaatgcaactgctgtcaatcatggaaggctgcctcaaggttattccaggtcagatctggaaacccaaggatcagtgagtgaggtgttgatggcagggtgggtggcaaagatgaacggagggagcctgaaatttacaaactgctgtcacaggaagattagggctaaaagaaggcttaagtttggaagtcagagttgaaggaagatcaggaagtgcaagactaaaggaaaaatgtgttgtagttttattagagaaaggttcattaatttcaacacttggctaaaagaggtttaactttatagtaagcacaattgttccatataacagaccaaattaatattctaccttcctatagtacttctcctttatcttatgcaacttggctgtttcatgacatccttgtagtttctctgagttatgttttctagtccatctcaacagtttcatactttgctgtttagaattaaattccctgttcatcacaacagattggatgttatttaaaaggatggcagttcagtcaggtaaataggtacttttaacagagagaagtgaattaggctgaacatagaagtagaagaaagagaggtcagccacatcttttagctttctgttttcccacatcccttcctgctcagaatatttcagcatatcatcatcaagtattgaaatgcttgtctcatacccatcttaaagtttttcaacatattttgacaaattaataagtttatactgaactgtcttgatttacttttatcttaatacaaggatgattctttttttttttttttggcccacaacttacaaagtacactacctgttctttcaaagtagtgaattagtatttctagtgattaaaagaagaggtatttatcatctcttttcctcctccatgaaacagtcatcagggttattcaatgacagttatgaatgggcggtgtataattggat

SEQ ID NO: 49194 - DNA, 896 bp, Bovine  19866880877415
aattctccgatcatacttgatgcttgtaagtcatcaaagagtgcttgctttcaaaagaattattacacttccagcttgcttgccttagggaatgtcaattaaatccaaattattttatgacagagattttgccatttttagagacagggtaagtgaactagaaatgacaaaaatcaaatgagaaatggaaaaataaagtttgatatttacctgtaaattgcttatctttcaattaagcactggtttactcttgccaagtgtccccatttgcagatgtctattaaaaataagctgttttcatttcctgctagtatacaatttagcttcttttaatgcatgcttgtgctcagggttttctgaagagccttgtattatctttgcatctagtccttataaagaatcactttcagtgtgtgtggcctggttcctaacagtctatcgattcattgaatttcctgaatttcagaaagacaccaattgattctttatgctgcctggcagagcagttctcaatttttgtctgtttcttcccaacaacagtcttaagaagaaaaggttttccttacaatgccttgaagggtttactgaatcatacatcaccaagaacattttaaagcattattttgtctgttatttaaagtggaaaatgctgtcccttaagacactggcattctgccatttgcctccagaatatttcatggttcactgtcaggactgctgcttttcctagaagaacatatgggccattttggagaaattttctgaaacattcagatgctgaacatataactgtatatacttggtttccaacaaatacttttttcctgaaattttaatgcctaatggagtttttgaaacttacgaaaagtgcagaaagcatggtaacaccaaaggag

SEQ ID NO: 49195 - DNA, 1220 bp, Bovine  19866880917032
ttggaggtgcaaggacacagattaaccttgggaggtgtattagagcatttattttttcaagaaaggaaagatttggtatttaaattctcactttcatgtgaggagaaaaaaatataaatcttgggatgtctgaaaaatattaaaatgttcacagaattaactgtcagtgataatagcaaatgtcacatttctacttcatcacatattgagagaaactgaaatatataaccaaatggtggcatactaggctcttctcctatgcatcgtggtgtgttaactttataccaaaatttctgggtgtaaataagagtatacaattttgttttgaatcttagatgatgtggtttgtaatttccagttgggtttaaaataaacaccaaggaattgaaatgtttttgtaacaaaattttaatagtatttatctttcagtgacatttgtttaccctcctaattttccatttttaattgctttttggtttacaaattatacatgttgagagagcaactatttgaatatatgtttccctgagtattatatattaaaatcagcaatgcttctagagcattagaattctgaaagagcagttgcatatctcatggtcttctttttccccccacaatttatataagtaggatgtactgttcctggggggaaagtagcaattatgaagacagatagtgatcttatctctaccctggcaaaaaagtcagaatccagttatttacatatgctacatttcccataaattggcacagagtgaccacaatcgaaattgagcttttaatgtaactgtatccagtattacttctctatcatgcttgcctgattcttttgctttctaattggtcttggggacttgactgttgcttttgaaccttgtgctaagtactgagccctttactttctcttttcctgtctgacacataggacagcctctcttcttgtttcacccacatttctacatttctcggaaggcaaaatgactaaaccttgttttctgtaaaaacattaaaaatgtttttaatgtttagtgaagagagggaaaagaatactggacctagaatgagatacgattagatgttatcaggcaatggcaccccactccagtactcttgcttggaaaatcccatgggcggaggagcctagaaggctggagtccatgggatcgctaagagttggacacgactgagcgacttcattttcccttttcactttcatg

SEQ ID NO: 49196 - DNA, 2441 bp, Bovine  19866880926400
gacctactatagcacaggaaaatctactcaatagtttgtaataacctgtatgggaatacagggcttctcaggtggtgtgcatggcaaagaacccacctgccagtgcaagagaccaaagagatgtaggttcaatccctgggatgggaagatcccctgtaggagggcatggtaactcattctggtattcttgcttggagaatcccatggacaggggagactggcagcctatggtccatggggttgcaaagagtcggacatgtttggagcaacttagcaggcagacaggcaagcatatgaaaaaagaatctgaaaaataatggatgtgtgtatgtgtatgtgtgtgtatggttatgtgtgtacatatgtgcgtgcttgcacgctaagttgcttcagtggtgtctgactctgtgatcctatggactgtagcctgtcaggttcctctgtccatgggattctccaagccagaatactgaagtgggttgtgggttaccatgccctgctccagtagacatgcccaaccgaaggactgaacccaaatctctaagtcagctgcattcgcaggcaggttctttatcattagcaccatctgggaagcttgtgtatataaatgtgtgtgtgtgtgtgtgtgtataggactgaatcacttagctgtacacatgaaacaaacacaacattgtaaatcaactgtccaatataaaataaaaattaaattgaaaaaaaagattgctaggcattatatgtaaaggtaagcatcttcaaactaaggagtactatgaagagggttaaaataagcctgtgtaaattaaaacttctttaatttctcatgttaaacttgtctttatttttcatctgaagcttagtgttaggccttgcatgtccaattctacttcaatgtaaatgaagaaagatttaactacttcaattaattgaaaaggaaatgatttctggtggcaatatttaaggacaaaaatgtacaggaggctgatagttttcaaatatatttcattataaaaatatagtattagaatgtaaaggaaatctcaaatatataattggatgcctttaaacaattgctcagctgattgaggaaaactgataagcattgttttctatacaggtgatttgcctttctgcaatgcaggtcaaattccgtaagaacatgttagtctaactgttgcacatgttagctttaatcttttttctccaggatttacttcactctttacatttttacaccatcttttgataaatctattttgcaatttcctcaagaatgcttgtttttactctttttgtatataccaaatatgtaacacagcaaaatatgttagtttttgatttacattttcctggctttatgtcatgtatagtatttgttgactattattcactttgaattatttagtttacaccagtgaatcaaatgagaaaaagtttatgcttgtgagtcatggatggatttaatatacaaacatgaagaagtatttgtttgaatttagaaatttagtattttatatatttcttaatcacttttaccatttgtaattattaatcactaaattttatatgcatattaatacctttatatttctgccaaatttccctaatttctgagcaaattactttaaatagtctttttaaaaatgactattatgtccttagcattgtggcagaccagtggtggaagcaatgacaattaatatgtgattattgccattaataagaattctcttttattattaaaacgggatttatacagacgaaataagagggatacaaaatatctgaaaaccatccaactgctggtttatttccacaaatgatgacatgtttagatacccagaagagaataatacaattgtgacatggacttgggcatcattatagatatactaccaagatagacagtggaatgtcaatgttatttggagggtaataagcagtagggaaggcaacacagagacagcatttgggcaccaaggtggagaaacccatggttatattgcgggatgtggaaggtgggacagtatagagccgagagtttgcactgggaaaaggtgagagtaaacgtgagtttggatgaaattgtcaaaggcgttaaagtcaagtttcagactatttcagaggcctgattagccctccaagggctctcccctccaattaatagcgagccattaatttatgccattcaagggcagctgaaagttccagttgggtcagtcctgctaatttaagagtgacagtctaactaagtccttcaagctcaccctgtaatatttacttccctgtgttctacaaattacccattaaataaattcacaggcatcttgatttaatctagaactagatggacctcaaataaagaattttccttccttcctaaatgttcatatctattttaaaagctttttcgaccattttgtttatttttcaaatgtttt

SEQ ID NO: 49197 - DNA, 984 bp, Bovine  19866881006114
aagtgatttgccccctttgggaatgtcatttggtgattttctaattaatgcactaccgtgagcgaaggtgacgggttaaccctagcaagaacgagaacaggctcagttttcactgaaactctcaaacgctgagtcacatgcagtttcatttattttgcatgtttggcaatctttcctccccaatggaacaataaacattaactcattactctgagagaagcttataaaaacatagttgacacaaagttactattaatttttttttccttttacaaagcctgtttccccttttgcaacatgataagagttgtgttttattttgaaaagagcatgttcaaacttccccacaaatatttcaaatttgtgatgggccactaaaatgccagatcttggatagttctgttaattcattttttttcccccaggatgatagatgagacatactggggagtgggatatattataatctggaatttattacttgaaaggagactttttaatggtactaagatgacttaagacaatcacagtgtgttttgttccaaatttgttttccgacaccaaactttctcagaaacacttaaattataaattcggtgtccttgtatttacaaccatgataattttaatatgggtagttcatgctacattttcccttttccagttgactgaaaatacagataagatcagtggacactctctgcaggctttttagaggcaaagctgacgtccgggaaggctttggtgggcgggttctgctgtcgagtcccccttgtgaaggaaccttctgtcctgcagtgggactgcagcttcttggaaaggggagccatttatcacagtcctaaatgaaagcattctttaaacacaaatgtctttttctccctttgtctaattactgagaggaaaagtgagaaggaaatgtcaaaacagagaaacagtggtgtatagagagagcagccactctggagctcaaccggcttttgt

SEQ ID NO: 49198 - DNA, 1808 bp, Bovine  19866881085537
tgcaaatggagagatgtgtttgtcaagaagtccacatttaaagaaatgcttgatgtagatttttgtgtgtgggtgaaactcacttaaccctccagagggctcacatttcagctgagagagatcagtggttagctgaattctacagaaggaatgagaaggcttataaattagcctctaaaagccaaatttactcaagaatgcacagtggtaataaacatttataaatgccaaaaaataaagcatttagtgagaaggctgatgttagattgcgcctatttgtcataggatttcactggaagcctttacgtaaattcctcgggttccaagggataatttgtacgttgacacaagtgctgtgatgtgttgcagatgcccggaagtgctctaacgctgcgagtgtgagcaagaccagcagttcaacccttacacactttagctgtaagcagataactaagctccatggggcacagagtgtaaaggttaaacctgtgggatggaaagcgaggagaccgattcatgaataaagtgagaaattggtctcactgctctagtcaaagcctttgaaagtgtgtgtgtgtgtgtgtgtgtgtgtgtatactcagttgtgtctgactctttgtgactccatggactgtagcccgccaggctcctcggtccatgggatttcccaggcaagaatactggaaaggctgccatttccttctctaggggatcttcgagagccaggatcaaactcgtgtctctcgtatctcctgcactggcaggtggatccttcaccactgcgccacctgggaagcccgtgcacagttaaccccaaacatattttaataatgactactatgaaatcaaacttagcccaggaggccacagtcaattcacgatagtatgttttcagtttttcagggaaacgaagagatatcctctgacagatacacaacctacctgcttgaggtggttcccagtttcaattaggttgtgttagattcattttgatgatgtcgtgtctttgtgaaactgaggatccagtaattgctatgagcaagtaccacatgaaagtcaacacagaatgtgggaccagaactgaggctaataatgtctaatctaattccaaagtttaagaagttgcacagtccaatacacacacgtatctcgtgtgtatgttatattaggtaaaaatgaactgaaattatgctttttctcccaatttatgtgtggcttttaaagggccactatgttgttaggacataaatacttactaaattgtttggacccagccacttaatgcaacagttatattatttcttttggctggggaatactatgaggaaaaactgctgagatactaagagcactgtgaatggaaaagttttgaaacctctgatgtaaagttttcgcagctgtttctcctccatccctccctttctttctcatgcacataggcagtacctgtttaaaggaatttgtcctccttccatcaatagataattattaacagacattattgagcatcagatacatgctaggcactgagctgtttgtttagttgcttacccatgtctggctcttgtgtgacatcatggactgtagcccgctaggcttctctgtccgtgggattctccaggcaagaatactggagtggtttgccatttccttctttagggaagtcttcctgacccagatggaacccatgtctcctgcgttttgagccactggcaggcaggttcttttaccactgagccaccatggaagccctgagttagaggctaggtatacagtgtgaatagacccaatagtctctgctatcagga

SEQ ID NO: 49199 - DNA, 1905 bp, Bovine  19866881090548
cactttcttctgctgatgacttgaatttctgtttgtctgctccaggctcctggagcatcttattaatccagagaactagaatctctgctcagcatctttcgagtacaatcatgatgctgattgctattcttagctcacaccacagtccgccttctgacacctactgtgctctagtgggcttgccctctgcgttcatggtctggtctgatctggaatcaagtgaagcctctgtagaagagattccaacaaacatacttgtcctgggaaggatggctccaggcctacagagaagtcaggaaagagagcaatcaggcacccagggacaggcctccaacagactgtttctaattcattacctttaaggtagtaagaggccatctcaaagggaggtctcatgtcccttctgagcatatgtacaattatcctaaaaggagtcaagcaaatttacctttagtgcaggccttaccttgtagaagcattcttgcctttcattttacagatgcttgaaattactttaatgggttacaatctttcattccataattagagacaaaaggcttaaaatacacaggcctgactatggttaggcatttacagaaactcattcacactcaagtgtcatcagtcaatcaatcagttagcatctataaatggcagacattagatctcttcctttttgatgagcatgtgtagggggaaagatagtagaaagacacttcgaaaaatcgatgcttctgcatatgtgggtggaattaccattgagacaaagaaagaggaacataaatggaaggttgagaacctcgaagacaacactgaagtcttcacatattcactcactttctcattgccagactgaaggcagaattcagtccagttcaattccacctttaggacataggtttcaaagaatataatctatagatgcttaatcagtgatgtgattacgtttgaagaacagagtgtcacactacagattttgtgtagaagagacaacagacatctttagcttactctttgacatctgaatgcacaggtgggaggcagcttttcatgtggtatggagtctgagggtgtcatgcactgaagaatggggttggacctatggttaccaggatctttgaatggctaccttcatacatcatttcctgctctcatctttacttttaatcttagggcaagcaaatttcgtagcaataaatgtaatcatagctaacattttttgttgttgttgtttgtttgtttgaacaaagtagtgggataaataagctacttggattgcagtactgaatcctcatagcaaccctaggagacaagtttgaggatcgaggttaggggattttactaagcttccaagagttatggaggctgatagtaccggggttctaatttcattccatcattgctcatggatattttcattgtccagtgctaagtaagagctccacttcatggtttcttctgtatgttttgtgttcatgtcactctgcctcaggactttgggttagaggaaatgttttgcaacagtaaagggatgactaaatgtcataatcacctatgatttaactgttcccaggataacatgtttccagctgatgtaaccgctcaataagtgaaataaaaataagtggcataaagctatccttaaagatggctaacaataaactaatatggtgagaaatggatttggctttctcatagtaatttaagtagggcaacatgcttgaaatgctactttgaaacatgcaaataagtttggtgtccatctgcttctcagaacttatctgcttacaggattttcttcttcctgaagtaaacaagctagaagtgctctgattaaagtagtttagacacatgctagaaggttgagagaagcagcatttttgctacaagatcctttactcctag

SEQ ID NO: 49200 - DNA, 1394 bp, Bovine  19866881125828
tgatcatatgccaaatcccgccatggtgaaaaattacttgaagttgatcctggtcagttgtttacaaatgttcccttgattcctgtgttgtccctacaagtttactcttgaacagatctcttattctattgacctgatcttatgctatatcaaatccaaaagtcatatattttaccctaattcacttagtaataatacagttttgtatcagacggcatgaaattttcttcctttctggtccttcacctgaatgtgggtctaatgtacttcgtgtactttgggttttgtgtttttttttttttttgtaatgtgtacctcatttggcacacgtagagataattcattcatttctccatttggggactttaaaaatcaggattaggctttgtctccttgttccattgtttcctggaatgcttaagcacctctagaaaactgggtcgcttgttagattgagttgaagagccttagggatccatttttcaaggaagtctattgggtctgcctcctctacccctttaggcagtccagtaattctgacatgctagttcaaaacagtatcttaaaactattatacctcttctggtacggtatatctttcattttgaacagttgctttatcgttagattaagcttaagtgtctgggagcattatttgatgttctttattttttgctttagagtcaaggtttactgcttgttaatttcaaataaaaaaggaaataaataccaaaataaaaaaaaaaacagcctgttgccacagatctagtatgtagtagatttattcttttctagagaagcttccttgaaaatgttagacaaatgtttgtgtctgtctttgccatttatttttacctcctatatcaggaaattctttctgtatcagatctttttcttgatgtttggtgttctacagaatcaattgtacctgtgcattttgcttaagcctttcaaatgtcgtgattccatagaaatatttagggcagcattaatgggctatcactgatacatcttttagctggctccaacctgtcttctctctcacctccatttgcagtgtttaggtacatggtcatagagatcacagagaaggcggtggcaccccactccagtactcttgcctggaaaatcccatggatggaggaacctggtaggctccagtccatggggtcgtgaagagttggacaggactgagcgacttcactttcacttttcactttcctgcattggagaaggaaatggcaagccactccagagttcttgcctggagaatcccagggatgtcagagcctggtgggctgctgtctatgggttcacacagagtcagacacaactaaagcgacttagcagcaacatagaggtcaagttgaccaagcataaatatttgctctaat

SEQ ID NO: 49201 - DNA, 837 bp, Bovine  19866881209896
ccgtctatggggtcgcacagagtcggacatgactgacaccgacttagcagcagtagcagcagcagcaacatcctttgatacactttatttattctttgtatcccttcttctatatcgaaatggggagttttctctccccaacatctgctgtctagctgtagcagattccctcatcctttctcatagaagcaatcggactgaaaatgtggcccatttctgagcttaccctctgaaatgtgaattcaaacagccacctctaatcacttgcacaagtggtttgggaaactgctcttttctgtctggaatcttgctttccctgtgtccagataaaatgcaagccataaccataatggtatttgatatacagataccttctgcagaactaagccatggacctatcattaaaaacacatttttaatttgtatttgatttttcaaatactttattttcaggtaagcaaaatcctttgcgtagaagaaacaaaagtaatagagctcacagatgaatacagtgatgaggtggcaggctatgcttagaaaatatttgttttctaatgttagctcaaattaatccatgaaatattttgcgtattgccacccaaaagatggaataatataagaagctaacaatgacccgcaaccagcagtatttctgcatttccattcattaaggcctcttggttatcaactaatgagaagttttctctcatgcaactcagtatattcttatttatttatttcataagaaagtgttggttagtcactcagttgtgtttgactctttgcgacccccatgaaccaggctcctctgtccatggaattctccaggcaagaata

SEQ ID NO: 49202 - DNA, 919 bp, Bovine  19866881232005
atagttgggtttttttttaataaagagttataccaaaattatgttttaggttatgaataaccataataaaattgttaaattgatattgtaagttgattcactcttttgggaaaaagtttgcaatttctattaaaaatgtttagaactatcatttatcacatgctcattatatgttaggcactgttctgagcatgtatagtcattcttaaaacaattccataaggtattaatatatttcactaaatcctaaaaagctactaattatgaagggtacctttacattatgtatatccaagaaaaaaaaaaaaactgtgaattgtacatatacaatttttgtatatgtacaaaattgtacatatacaatatacatgtacaatacaacattttcttgccatctataatttttatttttacttactcaaagagttcttttacatttagatctgtactttatcacatatcactccttggcatgaataacatcgaatatataaattaaatcaattggttgagattctttacacttgtggtccaattcttcttaaatactttttgacttagagttaacaatgtctgcatttttctgcaaaatattatccaatatcccattaagattgttggtgatacaatatagctttataaaaattctctgctaacctctagagttttcttacaggcttttgacacccattgggcaacttttattactggtattgttttttacttaaatgtagatttaaaaagattttcagacaacaaccatgtctcatatccatactgtcaagtccttaaatgacttgtttgggggttagaggtgtagtcaaggaacaactaataacaatctaggtgcacatatgttagcaatgacatctatatcatgtgctatccagctgacagtgacaaaaggcatcaatgtggg

SEQ ID NO: 49203 - DNA, 1103 bp, Bovine  19866881261662
tggtatttatatttgtcctggccttgaattcacgctgtgtgtctcataaagcaacctagcatgagacatgagacgaagggatactcctatcaaacaactggctcagagagaagtgcgtgtgatctcagtccagttcagagcagagagttgtccaccttgcaaaactctcccgctcagtggaaatgatcatcctatttgttgtcagtctcatccaagaagttcaatactgaatggacctatgaaccatattagtcctttaaaccttcaaagggcctcctgtgcatcaaagacaggcccttgtcacctgaccccaccagttcatgaatgatgatctttttaaggcccttaagtcagctttaaaagagagcgctaaagtaggatttcataaaacagaactgggaaaattggaaagaggaaaacattgagagggtctaacattgcagggcttgaaggcattattcttcttttgttgtattaagcaacccagttttaaatgaccaagtagagaccaaaacaatagcaacaaaataaggaatatttttaaggaatggtttactttagaagatattttaacatctttattaaaccaaaatagagtaattcaacaccaaaagaaatgtaatttgggttcttacagaatgtattatttatataaattgtagggacttgatatctgcttagtgataatgatgatactagtgatcatttttattatgaaataatataaaacaaaacactttaaaaggaagtttctcccttgagtataggagattaccctttttaattatcatttttaaaagttttaggattgttattaagaaatatatattaatttataacacaagaataaaattagctaaccatgtttatagaatcactgatataaagaaaaatgttggctgaggacttaaataattaccctaaatttagaagattaaagccaaagctaatttaatgtggtcatattatttcccatctgaatcttaaataaattatataacctattctaagacatattccatcctttgaaacaaattttgatgcaatcacttaaatagtaaaactccttttgccttctttgaaaaatgttgtgcatgtttctg

SEQ ID NO: 49204 - DNA, 1630 bp, Bovine  19866881270648
aatagtgcatgaagtgcactgttatccaaggggagaaatctcttaattcttgggtgtgttgtcacctgtctgtcatattgcctgagtgtgacacctagcccagaatggcaagatttttagaattattatatttcaacttgggacaatccagggttccatttaaatatagctgctctaatataagagcagaggcggggaagacagattctttctgggtgttagagagaaggtttgaagttgatgagaataagtggagagaactggagaagatgaaaatcattacatgaattatccatgtatcagggaatcatgatcgggggagagtagacaacttttaaaatcatagcactagcagcatctgagagtggggaagcccaggccatttataccttgctcttgtgatttatgatgtcaccattaaaccccttgatggcattatatccttgtcatttgcagttgctagcactttttctatatacaactcaataactcattgtgtagctattccacacacacataaacacacacattagtgtgaatatgtgtatgctgaatctgtcatcagtggaaaccatgatttttgatataataagttgggttaataaaaggcaagaaatcacagactgggtgtgtagtcaactgtaataccagctttattgtgaggcgccgcgaggaaacaccgctctgcacgttaggatacgcagatgtcgtttagatggtgtatatattctttttaagaattaaagaagcaaaactgtttgcagggtcagtcaaaagtcattatcaaaggaaacaggtgagatcgcacagagataaagaaggaaatgtattcaattcacctcaacattgtagtaataggattagaaaataacagggttagaaacattaagccttcagggctaaattctgctgcccccagagatgtagggttggatctcctttctgtccagggggagttgctgcttccttcccgagcgcctggttctggccagtgattgtgacaccatcagtctgggaaagagaaggttttggaaccttggctttaggaccataataccactagtcattagcatttctgcgggggtgagaggtagtgtttggacatctcttaaagttagcttttcagttgacttctgtaattattctccaacaaaaacatgaatgccagcgactttctggggagttatttttatttctatttgaatattttagctacaatgctggagatgcactgctggatctctgagaatgctgttctaaaatgctatatttataaaatgaccaaagagcgcatgctgcctggattaaatttatcccaagatgagaggttttatctctaatcatctgcttgttgactaatctgggcacatcttgtgcaggtttgatggttgaaatgtagcaggctaaagggatccagaccctaaaggggtatccctttgtctctgactttgttttcctgaaacctggagataatgaacactgctgcttcaaattatcatgccttagaggaaccactgaccgagactgctagtttgatatgagaaaaagtggggtgctctctttaaaggagtgtggtatatgagatcacaaaattattgcttcagaaaattattttttaaatataaaggat

SEQ ID NO: 49205 - DNA, 910 bp, Bovine  19866881293678
agcactttgcaagcctttgagttcttcagaagaaagtccccaaaaggaaaataatggggttcctaaaatgtaaagtattactattatcattgtggaaagaaaacctgaagaatgagaatgtgttttctggttgaggttaggaaaatcattttactgttttaggaaaagggcataaatatgaaaattacaaatttaatagaaaaaaaaataacttggctgtgagaagtctccatttgtagggaaagagttggaacttctaagtctttctgaggagacattcagtaggtagaatatactaatttctcagtattgagacatctacaactgctcctcagtttgtattaactgaggctttatttacagttaattttcccctcctcctatacagattgacagtctatattgaacaaatatacacctagacaaatgataaattttcacattacgctgagcctttgtttagcctatttttagttaccttaattgattggttgagtcacacctcttgttgggggggggaggtcacacacacacacacacacatgaaataagagtctagcacaatggttgcatggagggaaaaacagattttttgggtttttttgctacagacataatataaacttaatggctattttctatgtatttatatttttagaattaaaaaatgaggtttacttaagaaaataacagaattaccttaaaagtgagggtaaaaaagaaagaaaaatacaaatagatgagatggaaatgtggtttaaaaattaattcaaagattatatatttgctacagatatagttccaagttaactctgcatttctgtagtggacccaagaaaactgaaaacataaatttagttgcataagtcccatctctttaagataaaacacaaattgctcaagaacaaag

SEQ ID NO: 49206 - DNA, 1401 bp, Bovine  19866881301401
cagatcagtgtacacatcaaatgtgtgtctcaaaactctttgagcttattatgaatgctctttttcacatctccctttcacattttcaggattttattatccttgttatctttgtataaaaatatgataattagattttattttctttcagaagcaaagagctctgacataatttgctttgaacaagttcagatgataagtagtatctggtagtagagaaagcagtaagatctatagatctggaaaagaaatttagaacagtaatttcaataaaaagtgctacaaagtagaagtagaaataagtatgagatctagaaaggagaaaaaggaaaatggctatcagctcttgagttttctcaatatggttgataatcagttgaagcaaaaattagaatactatctaatgtgattctgagtgtgtacagaagatattgaggacaattatattacataggaaaataagagtggctaccttatatcagataaagtagacttcagaggaaataaatttactagagacaagagggatattacccagtgacaaaatgtcaatctaccaaaaagatgttacaattctaaatgtgtattcaccaaaaacagagctacagaaaatgtgaagcaaaaactggtggagctgaaagaagaaatggacaaatctacgaatatacctggatacttcaacacctctaatcacaatgggtacagaagaactcaacaatatcaacaaacaagatttaattgacatttgttgaacagtccacccaataacagctgaacacacgttcaaaaggctacagattatacacaaagatagaccatattctggcctataaaaaagacttccacaagttgaaaagtatggaagtcattttaaggtgtgttctttcactgtactggactcaaactagaaatcaaaacagaaacataacagaaaagtctgcaaacactttgaaactaaacaacacacttccaaataatgcatgagtcaagggaggcagtctcaagcgaaatcaaagtatacagtgaactgaatgatcatgaaaatacaatatatcaatatttgtgggacacagcttgaaaaaatagcactgagagggaaatttatagcattaaaattcatatatttgaaaagggtaaaagtctcaaataatcaaagctaccacatcaaaaacatagaaaaagaagagaaaaagtaaaatcgagcagaaaaaaggaaatggtaaagatatgaacagatggataaaattgaaaaggagaaaaagaaacaaaaccaatgaaataaagtcatttctttaaaagcatcaatgaagttgacaactctcaaaggaagacataaattaccaatatcagcaatggaacaggagatatcactacatattcaagacatcaaaaggggtagta

SEQ ID NO: 49207 - DNA, 1104 bp, Bovine  19866881391108
aatgtttaaattagattaattagtatgtatcgtgaaggctttcttactgtttagaattattgccttgctaacatagtaaatctagatgagctgagcattcaaatcattctaataacaacacttggcatttgtacagtgtgttatattttctaagtactttataattacagtattaattagttaagtgacagagtgatcttgtgaaaaagtctgcaccgttatcccttttcacaaatgaggaagcttaaaatgcaaaggacagtaattcacattgcaagcaaaatcaggttacaactaaaaaacattttaaatgacttgtgcatatctaatgctgcatgatttcttgttctttggatgaagaggtaaaagtttcatcccatatgcagattttcagaaagcccgcagactaaggaaagaatagaaaagagagttctttagttcccattgcattctgtctcctatactaaactttcattatatccttgaggctgagctgttgcacctagaaccatgaacttggtgaacttggtagcctcctggaggatccttagttgcctacagaggaagcattgtctgttctttaccgaagcatcagtagtgctccatgtagggcaaaggggaacaataatttcaaaggctaatgaggctgggaaattcacttgtctctttggtttataatctcaatgcaaattaagtaggatttccaaaatattatagaataatattagattatcttaagcaacttcaacaagcattaattaattgcttatttatgttctggcttctaaaggaataccctaaattagtagaacaaagtttctgtactaagtgacttatagtttagcagaaggatataaacatgtcaacaaattaaagcaatatgaaacaaatagttgttagccacttgccaaccattaggcataattttaaggccacaacagtgaataaaacaggtaaaaaccctggcctttatctagcagatattccagtgagttaataaaaaaactattaaaggtagtgtggtatcagagggatagagtgtgcatagatgagacatgcaagaaaaaggtagccagtactttacatatctgcaggacattgatg

SEQ ID NO: 49208 - DNA, 1050 bp, Bovine  19866881409721
aggttgtgtacgcatccctgagaatctgggacccagtcaagaaagccctcaactcgttgttgagctgagtgtaaaccaatccactcacagtagacgcaaatgtttcttgctcgtagaattagataatgttgagtgtagtaggaaccttcgagaaggatcgtggccaacccttcactttactaacgtgttttaaatgattgttttgacattctatgtacataacctttaaaattcaaatgacattggtccaggcatgagtttaattacaaaactcaaagcacatatggagtagagaatattttctagggaaacctagagaattgtttcatgggtttttttccttcacttattcttgagacccacaatatgaaaataggtttcctccttaaaatgtgttagaaagtgataagactaccgaggtacataaaatatacattttatatacaatttatgttgataaaaattctaaacctgcttcaacatatctctatgtgccaattttttctacaagccaacacttcataaatcatattcaaaacaaatactaaaaatacataacttacataattaaacacttatgtattaaatttatacacaggcataatctctccaatttaaagatatttatccatgccagggtctatgtattcagcaagaattggggaaagaaagaaaaatccttaaccagaagtccttcccttagtgagttcacaggttaaaagtttgaaaccaccaccctatgtccccttgggcaccctgcaagttagagacaggggctgaaggtggttctatttgttgatctttctcccttccagaagtctctgcttatcccacccatttataagccttagtctttgctccttgagtttcttctaactgctaaaatagaagatggcccatcaggtttggacagccattatcctgaccctccaacaaatattttcattttctatgtcactcattatcttctaagaagccaggttgatccttactgtaaaacaaggaagggaagtgcaaattcttggagatctctttcttcttttcctcaat

SEQ ID NO: 49209 - DNA, 1061 bp, Bovine  19866881642162
atcagaaaaaaaaatgcacatagaagattaaaagccaatacacgggaaaaaaagagacttagtaaatttatacacctttgaaatgaaaaaaacttaaattgttagactcagtaaaagaaaagaaccattctcctagcttacaaaatataatttggcatgatgttcctccaggacaaattggtgctatgtacaaaatgtctgaaaaacatgtacactttttgacacagtaagttaaattttaagaatgtgtttgaaagaaattttgaatgtgcacaaagacatattcaagtaagttcttcatagtagcgaaggagaagaaaatctgatgcccaactacagcggattaaattattcaatcttgatatttccatatagtaggataattaaaaacaggaaaatgtttataatatacaagttgtcaagcaagaacaccattgcagtcattttacttccttaaacagtcaattaatctattttcaaatattcttaattcagtttaatgaaaaacagacttttggcattatgtgtgtgtgtgtgtgcgtgcacgtgtgtgtgtgttaaattgttacttttaaaacactcctctgctggtgatgttgtaagagctcttcattctggataaagcattgcttctgttcatggacattttctcacagcaacaccgcacagtctgttctgcctaagccatgaggatacatgggaaccgtctttgccacccgcacagaactgcctgctttggtgggcacgttgcactgatttactttttcctcctgagagctgaggtttctactttctgagacattcagagtaggtgatttaaagcttgtgattatcacttcaggattgagtctgtttttaatgacaatttaaatcacagagaacaacactgctcaatctcctgatatcctttctataccagatgaccacttaaactctatcttcctgcagatctttgcaccttttcacatgtgttttcttttagttaaagctaagaatatgatttggattattcatttatttcagtgtgttaaaacttgagctccttcatcatatttcaggtt

SEQ ID NO: 49210 - DNA, 1162 bp, Bovine  19866881701984
tgatctggtcttgaagagacataaaatggaaaggtattcaatatttgcagacatagtgtattaaagacaggtatctatgttgtattaatattctgattaaaagccaaccctatttcaacttgaataatcttgttcctttagtcaaacaatgaatatggcataggagatatgaattatattttgatagtgggtatctaaaattagaacctgaaaccaaaagaagcctagagccctaggggtccaatcatggggaaatggctcctgcacacatgtgccaaccactgaatcatttcattacactttctgattcacagtggaaatggggaccagagtgaacatacgaccgtagaatataagtagaaaatatatagctgtgacagggcaaggaagtcagaaggcgaaggtgtgaaaaggttaagtgtgtaggtgacttcctcggcatgtcactccagttcctcatccagatatactgtactgcggaggcaaactgcagcgccaagtgagaattaagaggaaatgacaatctacatggacaagatagacccgcagaccaggagatgagtctcgtgccaggttcgcaggttttctacagccaccgtgacagacaacataagccagacaaaaggccaaccaaacacccagatgctgctgctggaaaattacatactggagctcagcatctgggtctcacagctgccaagtttaccccatgggtgcctacagtgttggctcagatactgggccacatagaagggggtgggcaccatggaacaagaccatcaccagagtaaaggaggaggaggtagaaagccaagtgtgtaataaaatagcaggaagctgccaatatggtttcaaaagcatgaaaccatacttcaggcctccagacatcgtggggacagcagtttttccctcattagtgtgtgctactcgctcagtcgtgcccgactctttgcgatcacgtggactttagcctgccaggctcctctgtccatgagattctctagtcaggaaaactggagtggagcgtgtttcccttctccagaggatacgcccaacccagggatcaaacccgggcctcccacactgcgggcagattctttactgtctgagccaccagggaagacttccctctttagtgtagagatataatttaaggggcgtt

SEQ ID NO: 49211 - DNA, 1466 bp, Bovine  19866881947773
tttccttgaaaactataaatatgccaataaatgaagttatctcaccccacctactgactctgttctaacaaatactgtctttttacaaaacaacgtactttcacaaatgaccactcgttggaaatggccacccctctacagctagaagcgagctaagaactggaagaaagagaatatacatcaggaaagtaaacctcaggaaaaaagaaactttgattgtattttcttctttgtctcttagttgccagacgcatcagggtaatttcaagtttctgaaccgccacaatgaaagaaaagcaagctctgtcacagtttcagtttacaaatgagatgtatttttgagattaaaaagcaatgtattggaaaatacggtacaaagggaaattactttttagtggaattaattgtagttcctaagtaatagaataaacatattgatataattctctttggaatattccataaccactgtgaaaataaaatattctgaaacaaatttacatttgtctttccctttccagcttctccctatacatttatcttctatctttttaacttaattacatgagtaagaacattaatttcaaatgcagttaaacactgaactcactgaatttcatttcaatattttatttactgttaaatacaaacatatatgatccttccaaatagcttcatgtcattcaaatgaccccttagacaaattttcagtgtgataaaaaacacatttagactacttgcattttttagcaacttgacatctccattgatggtcatataatttttataataaggggcatctgaggcagctaaggaagcatttatcatcaaatttaactactaagtttacacatattttaatagaaagcacaaattgcctttctacactaaaatacataattaaatattattagtttttctctatatatattttgtttctatggtgatggcctttgatgctatatagtaatatcttaatttacagatttcctatgagttgagcaattatataagaaatcaaaatgcaaaaaaaaaaaaaaaaagaaactgaaaaaaattattatgtcacgtaaatgttgctctttgtaattttacccatctgacaaaaacctctgagcacacattagttgagataaaaaagcaggttctaaggaagtcatgaggtctgataatttgtctccagtgcagagttctttacttgaagctttaactcacctattgatgacctttattttctcctgtgtttttaaaaattatattcccaattaaataaggagaaatttgattatttttcaagggttgtgttgattgggctcttaatgcaaagtgcttcttgtagaatgactaaattgatacccatcaggtacatgactcttcaacatcacagagggacctaggatcaggacttaacccacacagctttttcctgtcctatggtgatattctgagcattgttaagcaaaggg

SEQ ID NO: 49212 - DNA, 984 bp, Bovine  19866880398632
cccagagtgtaatatgagcacataggaaaggaggatgagcattgagtctacaccaaaggcagagacgacaatgaccaagccatacatgctgttgatggtggtatctccacagggcaggcggatcaggtctgggtgcaagcagtaggagtgggtcagtatgttgtctttacagaaaggcaatctcttcagaaggaaaggcagtgggaagaccatgcagaagctgcggatgatgatggatatgccggtgtgagccacacgggtatcagtgagcactgtagaataatgcaaggggttacagatggccacatagcggtcaaaactcatggccagcaagattccagactctgtccaggagaaaaagtgaatgaagaacatctgaatcaggcaggcatcaaaggcagtctctggtgcgtgaaagcacaaggtagccagtatagtgggcaaggtagaaaaagacacacccaggtcattgacagacagcagagataggaagtagtacattggctggtgcaagctctgctcctcctttatgatgaagagaatgaggctgttgcccagaatggagacagcatacagcagcaagaggagggctgctaaccaatgctccagtccctccatctctgagaagcctgttaaggtgaagctggtcacgctcaagatgttagtttcaaaacttcccatggagtccctgagtatcttttggaaaaacacaatcagagtaaagtgaggtcagacaatggaaagaatggtcactgtccagaatggaagggacaaggctacttagattgaacaccaaagatcatgaaaaattagaaggaagcaagctaggtatcattgctcacatctcaggccttctgccatctgatcatttctatagttgggtcatgggctccaattccttccccacaaaaatcctttgagtctattttgaacactgtatcatattcttcctgtttctgtattctttgcagaaatattaaaatc

SEQ ID NO: 49213 - DNA, 1499 bp, Bovine  19866880458329
aactgctaggtttccgatggataccattaagaaagatctatattcttatgcagatttatagcctatatttcatattcttatttaatttcattaaatatttttattactaaaaccagataaactttattaacatagataatctatattttatttaatttgtatagtttatttaagtacacacagtcacctaattagtgatataactttaatctattttcaatcatggattgataaaagtaagccaggttttaactcagagtttcttagaatcagctcaagctaaatcttttcactttagaatcagatctgagcttggggcttgggcatacttcagaacgtcacatctcttgtagacttttgttagtctcaaaagatccctgcctttacttctctcagatggcaatatcttcgttgtcactgttaatttgtctactatattctcccacactactcctgtttacttctccttccattctatcctgtttttctctagattcaagtccatatttgaaattatatggtatcaaactctcttctagcagaggagccactattctgatttattccaggtttcaagatatggcctgaaatagaagcatcgcctcgcaaacaggacatttcttcaggagaaacatctcaaggaataataatgaaaaactccattaagttggacatcaagtgtggagaagctttggaatttgagggcaggacacaagagcaacagaaaaaaactctcaggcaaatggtagcctcacagaagcaaaccatcagtagaactggagaccagacaagtcttgaattagggaaaggtttatttataaatacagttcttattagacaacaaaatgttcctacagaaaagagtacccagtatatattatactttggggagagattttaaacagaattttgatctaatgagatgtttccagatttacccaggagaaaaacctcatatttacaatgcatgtgaaaaaagcttcaatcagagtcttcatcttattgaacgccagagaattcatactggtgagaaaccttacaaatgtagtgagtgtgggaaaaccttcagccacagatcatcacttcttgcccatcagagaattcatactggagagaaaccttacaaatgtaatcaatgtgagaaagcatttagtagcagttcaacccttatcaaacatttgagagtgcatactggagagaaaccctatcagtgtaaggactgtggtaaagcttttagccagtgttcaaccctcactgtacatcagagaattcacactggagaaaaactctataaatgtggagaatgtgagaaggccttcaattgtagagcaaagcttcacagacaccaacaaatccatacaggtgagaaaccctataaatgtagtgaatgtgggaaaagttacagccagtttacatccctggctgaacatcagaggcttcacactggagaacaactgtgtaaatgctggaatggggagaaatttcactcgcatctcaac

SEQ ID NO: 49214 - DNA, 716 bp, Bovine  19866880550045
aactgattgagtttcttgtctacagtaggattttctatcttgagcatgtttttgtctttgtcaccatctcactatctttaaccaatactaaaatggtttgaatataactccttccttgtctggtgcttagctgcactccatggaccattctgggtgagggagaatgggagagatgggtgccattgtggaggaaaacatgggaagagcagagggtaaaaatggggaatgagtggaaaatagtgttgaggatggaggaggaccttacaaaggaaggatgtctcaggaaccaacatgttatcacacactcaaaatacatcttctttgctgaccatcagctgacctgactccacccctgagggacacagcctaatcttggccaatgacttctaagacaagggggagcaaggaagcagaatttcagcagtaaagaataaaaggccacagcatccagcagcagcacagacttgcttctgatgcttctgtaatcacctgtaagttccaaaacttgacatcatggtgcattttactgccgagaagaaggctgctatcactagcctatagggcaaagtgaatgtggaagaggctggaggcgaggctctgagcaggtaaggaagtggacttcatggggggagggatggtgctcaacaccactgcttcttgggttctgctaactggcttcccaggtatggagaaggcacatcactggatctccattc

SEQ ID NO: 49215 - DNA, 2419 bp, Bovine  19866880571606
cttttggactggactcctgctgattgtggtctcctatatgctgattctttacactgtgctgggcattgcttctggggagggacggtggaaggccctcaatacatgtgtgtcacacatctgtgcggtacttgtgtactatgtgcctatgattggtgtgtctgtgatgcatcgtactgccaagcatgcctcacctctggcccacacactcatgtccagcatctacctctttgtccctcctgtgctcaatcccatcatctacagtgtcaagaccaaaccaatccaacagggaattgtcaccgtgctttcctgcaagagagaattactttgagtcattccaaggggggagggactttgaatcagtccataaactctggtggtgtttcttctgtgggcaaagctccacaccaggatttctggggaagaataggagtgagaaattccaaacattgcctcgggcttgaatctggatcataggagttaccttgaccccttgccatctcacaagttatcaacagaggtgtgtctgtatgtgcccatgcatatgccatgtctgacagttatgatcaacttgagatcttgaatgccctttgcctatttttctcaaggctcacaccaaacagtctgacaaataggaagttacttgtagaggcttgagacttaatgatatttgaattgaaatataacaggttcttattttgatgggtcagacagatattaaaaatctgctcccaataaaagaccatcctagtaacatgactttgagcaagacaagtgtactttttgggttgtcccagatagtcgtgatttacacttatttttctcagcatcattattaatagcaatcccttttcctctcaaaagtatccttgtttaaacagtaaatttatggtaaaactacatataaaacaacttccttcgtgttatatacggaatcagactcttccccccagcttactatccagtggtgtctactctcagactattcagtctgtttagaatagcggctaccaaaattttatatgccaggagattctgaggatgaagaacagctgcgtaaatggcctcaacttaggtatcaagtaaaatatgaacaaccttacacaccaggtttcagatctgaaaaatcccaacagaaacaccaacagaattctgttttgatagagctttgggtcctgtttttctggtgtctggatatttacattcccttctcctcctatcctcaccatgccctgaagcaggtatgcttgtatctttccttctgctccacctcttctcttttactgtcagcagagttctagttggcacttcttgcttctgcctgtggttgtctatggtttcctggaaacctttggtgaaatgagagagtacatcttcacacctcctaaataatagaggtctgtgtatggtggattgataggcttgttctgcttgatcagtaactggcctcagatctcagcctctcaggcttcagggcttacaaatgcaagggaaatgtttttttttttttttttttttttaccgtatgctattcttcctgagctcgttcatgtcattagggtcacctttaaacagtgaactttttgaaatgcttggtctgtttaaaatagtggttaccaaatttttacattctctatgtaaaataattaataggaaaaaattaggtatccttttaggcattttcaggttaaaacctaaaattttatcatagatttacatagatgttgaacgcacattttggatatattgtaaatatactgaggcttccctcgtgactcagatgataaacaatctgcctgcatcccagagactcaggtttgatccctggattgggaagatcccctggagaagggaaaggcaacccactccaggattcttgactgaagaattccatgaacagaagagcctggcaggctgctacagtctatgggttcacaaagagttgggcataactgagagactaatgcttcactttcataaatatatcaagttaaaaataaattgttatatcacagtttaaaataacaaatgtaaactaaatgcatattttgatagcagacattatgaagttaaatatgcatgaagatattctttaacattccattcacatatttgtatgttagtcctttttctcctcaaactcgaatttttattttacctccaccatagagtttgtaatacatataatatatttttctctttggaaaaattttagtggtttctctttcacaatacttcccaatatatatatatatatatatttaaattttatgtttaaaatttagtcacacatagagtattgttctaaaaatgtattctttattgagtcatttttctgatattaatacataattgatcaaaacaacatgagcataatacaaatttttatatattaatactaaaatttgatttcaatccatct

SEQ ID NO: 49216 - DNA, 1321 bp, Bovine  19866880901244
tggagctgcctaggagaatgtgtggtggaggcaccaacaaaaggttttcattcacatttacttaaccaggcccactggagagaaaaatattcggaaaaaatttaaacagacctttactcagtcaatgatgcttatttcattggcagataaatgtgctagaatcagatcaaattggaaccacaactcttttggatagaatgtttgctgctagtttctcccagaacaaaaatctaattaaatccaagatcatgtcatactcccttaaaaatatgatggaattttttttacactctccatttaaaaaatttgactatactctccctgtagacctatcgactgcaatttctgtgtaattatgtgcattcagtacttcaccttaaatgcctgcttctttgagaaatgaggtgaaaaattccctggcggatctgcttagtctttacactgtaaatgatggggttcatcactggaggcgccaacaggtaaatattggccatgataacatgaactagaggtggggcatgcttggcaaatcgatgagttatagacaccccaaccatgggcacatagaggaccagaacagccagcatgtgggacagacagttattgagcgcctgcagtcgctcagcccatgaggctgtgtgcaagatacttttcaggatgaggatgtaggagagcacaatgagcagagggtctatcacaataatgagcaaaaccacagcaaaagcataccagttgttgattcggatgtcagcacagaccaggcgaatcatgtcctggtggaggcagtaggagtgagagagaaggtgggagcggcagaagggcaggcgcttgagtaggaaaagggagggaagaacggccagaacacagcggcaaaggatggctaaccccatcttgccaacgacactgttggtgaggatggtggcataatggagggggcggcagatggccacatagcggtcaaaggacatggccagcaggactgaagattccataaaagagaacgcatggaggaagaagaactgggcaaaacagccctcaaaactgatcttctgattgttaaaccagaggagctgcatgactgtgggcagcgtgctgagggtgagacccaggtcagtgagggccagcatggagaggaacaggtacatgggctggaggagggatggctctgtgcggatgacagtgagaatggtggtgtttcccatgatggagatggtgtagaggcagcagcaggggatggagatccagatgtggtaggcctcaaacccagggatgcccgtgaggagaagtagaaggggtcttgggtggtgttcatcacctcgga

SEQ ID NO: 49217 - DNA, 886 bp, Bovine  19866880927186
ctgacatgtgtctgtgctttgctagtttctgttctggttgctttctagtttattgctccttttaagtttttattcagttttctttagttttagtttttgcacaaggctcaagagggtcttccttggggcaatttttgatgttgccaaaacatctaggtcttatatatacatagaagaccattataatttaagcaagagaaaagtcggcattgctaactcataattcaagagagaaattaatccatacttaatttagggaagtgagtaaaaatcttgggaaacttaattggtactaaatgctgtaaatctttggtctgatttgagaccttcttcagggcacccagtggaatttttaggctcatgactcaacattggcctttctaagacccaggaacttgctgatggcatggcggatctccttggttttaatactgtatatgattggattaagcatgggaggcacaaagaggtagacattagccataaaaaggtggacagcaagtggggcatgtttcccaaagcgatgtatgagggacagccccaccatgggcacaaagaataccagcacagcacagaggtgtgaggtgcatgtttggaaggctcggagccgctcctctttggaggccagtcttgccactgtgtgcaggatgaccccgtaggacagtgcaatgagcaccaggtccagcaccacagttgacatcaccagtatcagcccgtacaggttgttgaaggtggtgtctgtgcaggccaagtgtatcacctcctggtgcaggcagaaagagtgggagaggactctagacccacagtaagggaaaagtcttcaggagaaaaacaatggggtacagtggctatagggccccgcaggatgacaaccaggcctgccctg

SEQ ID NO: 49218 - DNA, 1301 bp, Bovine  19866881054858
ttgaggcccaaaaaaaaaaagaaagttgaggacctgtgtgtcaggcactgaactcattcagtaataagaaaccagtctctgatctcatggagcttatatttccagtgggaggattcagacaattaaagcgttgcttagtcatgtctgattctttgtgccctcatgaactataacccaccagactcctctgtccatgggatttccaggcaagaacactgaagggggttgccatttccttctccaggggatcttcctgacccaggaacttgcatctccttcattggcaggcaggttctttatcactgagccaccagggaagccccccaaaagaaatgtgttaggtggtgataaaaagaaaaataaagtcattgagtatatggaaagtgatggtgtgggtggctgtgccttagctaggtttggcagaggaaacccttctggtaaggaaacacgtagggagaaagttgaaggaagtcagagagtcatgtggataccagggtgaaggggctcccttgcagtaggaacacgcacagtacaaacatcctgagggacgcacgcatgttctggtgcttggaacattgaggatgtgtgtttgtgggctgagaaaaggttaaacagactcacccaaaagccacttctctccaggatctcattgtccctttatccagtgagtaaaaagaaattgttttattgctataatgagggtacaaattgatgtcgaatgtgaggcaggggcaaagaacatgtttgaagttagaatgagaagttcccattaccccagtgcttgacctctttatccagaacagtcagcctccctttgtctccctcatttcttaccccaaatccttttgtgtttgcccgtctacccaggattccaaacacaagaagcaccttagaagtcagggctgggcaggcagaggccaggaaagtggctacaatgacttcagcagtcctggtggacatccaagatgaagtgacctgccccatctgcctggagctcctgaccgaacccctgagcatagactgtggacacagcttctgccaagcctgcatcactgcagacaacaaggagtccatgcctggccaggaggggcagagcaggtgtcctgtgtgccagaccagctactggcttgggaacctgcggcccaatcggcacctggccaacatagccgagaggctcagggaggttggtggtgggctcagggaagcagctgaaggtgattctttgtgcgcaccatggagagaaactccagcttttctgtgaggaggatgggaagctcatttgctggctttgcgagcggtct

SEQ ID NO: 49219 - DNA, 959 bp, Bovine  19866881090748
ttaatcctctattaatgtctgctatctctatcctgaacttcaataattccagatttactctcactggttttcctggcttagaagttgactatctctggctctccatcccttttgcctccatttatgctatggttttcctggggaactgcatggtgctccacgtgatcaggactgagccgagcctgcaccagcccatgttctacttcctggccatgctggccctcactgacctgtgtgtggggctgtccaccgtgcacacagtgctgggaatcttatggggggtcattgaagagatcagcctggattcctgcattgcccagtcctatttcatccatggtctgtccttcatggagtcctctgtcctccttactatggcttttgaccgctacattgccatttgcaacccactacgctattcctccatcctaactaatgacaaaatcatgaagattggggtggcaatcttatgtaggagttctatgctcatacctccagtcattattcgcctaaagttcttaaattattgtcacccccacatcctttctcactctttctgcctgcaccaagacttaattcgaatggcctgttcagacattcgcttcaatagcatctacggtctggccctggtgatcagcaacttgttgttggatgcagtgctcatcattatctcctatatcatgatcttgcatgcagtcttagcaattgcatcacgagaagagagaatcaagtctttgcagacctgtgtatctcacatctgtgctgttttggttttctacatcccaatcattggtctgaccatggttcatcgttttggcagacacctctcaccctgggttcatgttctcatgggcaatgtctatatccttttcccgcccttgatgaaccccattatttatagtatcaagactcagcaaatacgaagaagagtccagagattgttttacttaaaaaatgtaagt

SEQ ID NO: 49220 - DNA, 1490 bp, Bovine  19866881154138
atacaactctatcttgacccccaagaccatcatcaagattgtggtgggaatctcctttcgtagtttctgcatcatcctgcctgatgtattcttgctcatacgactgcctttctgtaggacacgcatcataccgcacacatactgtgagcacataggtgttgcctggctcgcctgtgcggacatctccatcaacatctggtatgccttttgcattcccatcatgacagtcatctcagatgtgatcctcattgccgtttcttacacactcatcctctgtgctgtcttccgcctcccctcctatgaagcccgccagaaggccctgggcacctgtggttcccatgtctgtgtcatcctcatgttttatacgcctgcctttttctccatccttgcccaccgctttggacacaatgtctcccgcactttccacatcatgtttgctaacctctacattgttatcccacctgcactcaaccccattgtttatggaatgaagaccaagcagatcagagagaaggtcatcattttcttttctatcaagggtacattatggaaatgttaggagacattggaaaagttaggagaagtttttaacatatattaatgtgcaagaatttttttaaaaggcaaatgttatttaaagtaagaatagtctacaagtgattttgtgttttatgaatatgtcatgatttatatgtaagaaagatttttgtatattaaaatactccttgatgacctgattatttttggaatatgatactgcacaggatacagtctggaagaaggaggggaaaacagagtgctgagttagtctaaatagaaaatatcaatagcaattcagaaattgaaatttgcagttatggagagagaaaaatatgtgaaatcagacaaagacttgaaagaaaagagattaaaactgaaaatattaaattagattattagatggatttaggaaattttaaataatatatattctaattattgtctatgttatgcttatgtatttcactttaaatgtccaatctttagacaccaaaagccttctagtacaagtctgttataaataatgagttctatcagcattgctataataggaataagagaatatacttatcaatgccatggtttttgggaagggagagtagcttttaggctccaggatatactgataaagtgaacttcagagatagtgctcaggaaaaatgaccccctacaatagctagagatctgagaagagggctggacttcctacaaccttcctacaatacataggtgagaactcaagccaatatgaaagtaaaacaaaacaaaaaaacaacaacattggctgcaagacttgtggagttcttatctacagagtctatttccttcattaaaagactcaattgcaaaatacatttcttcggtgaggtttggggatgaaaatgggaaaactacagtaaagtaatacattcaaggtaagatgcacccaaatgtcataagcattagaatcg

SEQ ID NO: 49221 - DNA, 1306 bp, Bovine  19866881252677
cctggactcagaggttctttgagtcctttggggacttgtcctctgccgatgccattttgggaaaccctaaaggtgaaggcccatggcaagaaggtgctggactccttctgtgagggcctgaagcaacttgatgacctcaagggtgcctttgcttcgctgagtgagctgcactgtgataagctgcacgtggatcctgagaacttcagggtgagtttgtggaatcctcaatattctctttttatggtcaagcttgtgtcatggggagagggctgactggcaggacgtagtttagaatggagaagatgtattctggttaaagtgctaaggactcctcagaaccatttagattcttttaacctctttgctcacaataatcatttcttctgattcattcttgttctctgttgtctgcaatgtcttctctttttaattatactctttgagtgttcaatttgaaaaaaagatttcttcatctactttaaacataatatctaatattttccccttatctgttcctttcaagggataaaatgttgtattgcttttcgaagtgattcaaaataataaaaatgataacaagttctggattaagatagaaagagagaaacatttctaaatataaattcagcctgctatgggtagcttcacatcagcagtagcatctatacttcagtcatctttgtgctaatatcctaggggcacagcttgggatgaatctaacctgggcacctgcactaaccctgcccttgcttaatgtcttttccacacagctcctgggcaacgtgctagtggttgtgctggctcgctgctttggcagtgaattctccccggagctgcaggctagctttcagaaggtggtgactggtgtggccaatgccctggcccacagatatcactaagctccccttcctgatttccaggaaaggccttttcatcctcagagcccaaaaactgaatatggaaaaattatgaagcattgtgtgcatctgcctaataaagacatttattttcattgcactggtgtatttaaattatttcactgtctcttactcagatgggcacacgggagggcaaagcactgaagacataaagaaatgaagggctaagttgagactttgagaaaatatatcagtatcttggaccccatgacaggagtggttgtaaacagctgatgttattggaaaacaggctctgttccttactcttactttcctttaaagaattcaagttgcagcttaatttgtgagttagatcattgctaagttttattaaaataaattatgttacttagctttttttttttttt

SEQ ID NO: 49222 - DNA, 1848 bp, Bovine  19866880296464
cttttaatttatggctgaaagcaccatcttcagtgattttggagcccagaaaaataaagtcagccactgtttccagtgtttccccatctatttgccatgaagtgatgggaccggaggccatgatcttcgttttctgaatgttgagctttaagccaactttttcactctcctctttcactttcatcaagaggctttttagttcctcttcactttctgccataagggtggtgtcatctgcatatctgaggttattgatgtttctcccaggaatcttgattctagcttgtgcttcctccagcccagcgtttctcatgatgtactctgcatagaatttaaataagcagggtgacaatatacaaccttgaggtactccttttcctatttggaaccagtgtgttgtttcatgtccagttctaactgttgcttcctgacctgcatacaggtttctcaagaggtaagtcaggtggtctggtattcatggcctagcttatttctttggcatgccatctttttgtttgtgaatcaacactatgaatttcctttcagtttatgttaaatgataaacatcaaaattagatcagattgaacttatttgtggccgtgtatttatcttttagggtaattgagtgattggaccaggaacagagaccagagatttctaagaaccattttttcccctgtgattaatgaagtcaaaatatgagctgacacttaactgctgctcaactgaattcagggattcaaattcatgataaaaacagaaatagatatgcccaaggatttgctcttaagaatgttcatggcagtattcattataattgggaaaaattaaaaattatctaaagactcactagcagagattgtttaataaattttgtatatcataggatgaagtcattaaaaatcctgttgtaaaagaatgtttacaacaaagttaaatatgtatacatataaatgacagaaaccagaatattcataatggtttatctgggtattgggggtgttttcttctttggggggtccttttctgttatttttcaaatgtttaaaaatgattgtcattgattttacaacttaaaatttacttatagtaatcaaaacaaaaattatgcacatcatattcttctgagtacagaattgttcagattatcactgttgggcagatatttaaatttaggatttatgttcttgtgccagctagatcttggtttgatcatacctcttttattttcattacagctttattaagttaaaattcacacatcatatagatcacttatttaaatttcacatatttaaaaatgcaatggttttaatatagaattatatatcattactatgatcaattttagaacatttttataattgttaaataaaataaaaatagaaacctatggccattagccactctgctttccccaatccctagccctaggaaaccactaacttcctactcctgtctctaaaagattacttattctgaacatttcatataaatgtaatcatacaatatgtggtatttgtgattggcttcttttctttagcataatgtttttaagattcatttgtgttgtatatgtgtcagtaattaattttttatagtctaataatattccattcttccattctatggatatgccatgttttagtctctaattagctgatgaatatttgggttgtttccactttttttggctgttatgaacaacacttctgtgaacatttgtgtataagtttttgcatggaaaaatcttttcagtactcttgggtatataacaaggactggaattcttttattgtagggtaattctgtgtaacctttgaagaactgctagactattttccaaa

SEQ ID NO: 49223 - DNA, 1730 bp, Bovine  19866880440784
aaacacatgcacaaggaagatcctttgattttaaagaatgtgggcaaattttgaaccacagcatatcccataacgaacaacagagaaactccattggagagagtcagtataaatgtcataagacctcccagagttcatcccttgctcaaaacatgagaaatcattctgaagagaagccctttgaatgtaatcagtgtggaaaatccttcagttggagctctcatcttgttgcacatcagagaactcatacaggggagaaaccttatgaatgtaatgaatgtgggaaatcattcagccgcagctctcaccttgtttcccatcaaagaactcatacctggagagaaaccttacagatgtaatcagtgtggtaaatcctttagccagagctatgtccttgttgtgcatcagagaactcatactggagagaagccttacgagtgcaatcagtgtggaaagtcattcagacagagctacaaacttatcgcacatcaaagaactcatactggagagaagccctacgaatgtaatcaatgtgggaaatcatttatccagagctataaacttattgcccatcaaagaattcatactggagaaaagccctatgaatgcaatcaatgtggaaagtcttttagtcaaagttacaaacttgttgcccaccagagaactcacacaggagaaaaaccctttgaatgtaatcagtgtggaaaatccttcagctggagctctcaacttgttgcacaccaaagaactcacactggagagaaaccctacgaatgtaatgagtgtgggaaatctttcaaccgcagttctcaccttgttatgcatcagagaactcacactggagaaaaaccctatgaatgtaaccagtgtgggaagtccttcagccagagttatgtccttgttgtacatcagagaactcacactggcgaaaagccctatgagtgcagtgagtgtggaaaatccttcaggcagagttcatgccttactcaacatcagagaactcatactggagagaaaccctatgaatgtaatcagtgtggaaaaacattcagcttgagtgctcgacttattgtacatcaaagaactcatactggagagaaaccctttacgtgtaatcaatgtgggaaagctttcattaatagttctaaacttattagacatcaggcaactcatacagaagagaaaccctatggatgtaactagcctggaaatctttcagcagaggatatcccttcctccttgcctccctttctccctcactctttccctttctcccttcagcccctcattcccttgttccctccttccattcctccaggattacatgtattggaaagaacaagcatgaaaatagtgtgtgtggaaaaaaagctttccattagctctctgttcaactgtgtatctgaaaactctttctggagaagaaagaaaaagtatgagtcatgtattttacttggcaattccatgttttaaaaaatcaaacttgacccttgttaaacattcccatgagcatgataactcttggcacttttccttgaagaaagcacttcgacctgaatttgagagaattattaaatggtcaatatgctgtggagtgattgccagtgaggtagacctctttttcaataaagaataaatgagaggggacatatatacacctatgactgattcatggtggatatatggcaaaactaacacaatattgtaaagcaattatcctgcaatttaaa

SEQ ID NO: 49224 - DNA, 1158 bp, Bovine  19866880481635
atctgctttccctaaattactatgctttcaccaaccaagccatatatcttctaacattttattttaaaatatcttgtattattccctcatggccagttcagcttaagtgaacagtaaacttctataggtaagggactcagaaaaacttgggtactaactctagctctggatgtactggccatgtaccttttgtttcttcatcagtaaaatggaataatgccacctattatggcagatctggaagttaaattagagaataatacatataaaacagctagcacagtgattggcactgagcaaacatttagtaggcttttttctgtcacccctcctctttcacttcctattgaagccagaatttcagaaaagagaggaattatccaaaaggaattccttatgtctctgtttctctttccttgactatttagactgaaggaatacctcatttatctagttctaaaggtaaggcaatttctggcagatattcatctccttttggcttattgaagaagcacacttcaggaagcctggggaggctcccacagggacttgctaaaattttctgaacatgttcaggcattagatctctattactggaaccccaaggagcaccaatcatcttatccaaagatttaggaagctaatagttcattatgaacatggctctggagagctgagctttcaaaagaatccatatcttctgtttcactgcctgaagactactataagactagtgaaatcttggaaagagtgattcttagaggccccatagcgccctgctatttgaggtccctgcttggctagagcaatatacatttccattatcactgcaggaaatctaaggaccatgtagaggtatttatgtgaaacagcactagacaatgaacagcaaggaaaagaacgtcaggagaaaataggaacttgcaaagtcagggaattcaaacattcttctcaaagtgttcattccagaggataacagaaaatactaaccagctgactgtgatgtattataagtataggataggactgccatttagtaagcacttgcttatagacaccaatgaggcacaatacatgcatgacctcatttaatgcacattggggatcccatataataaacatgatttgcattttgcagctgaagccaaaataatgcat

SEQ ID NO: 49225 - DNA, 1626 bp, Bovine  19866880708200
ttatttaataccagctatatagaatgttttgttcagcaaccattttaaagatggggagacttgaggctcagagaggttaaatagcttgcaggtaggacttagaagcagaagcaggaggtagaaaattcaaaatcaggtctgtctgcacttcaaggctcacaccctgctgttaaatttagtgaactatttaaattaaggttctttttagtcctggacaaacaatggccttggtatattcagtgctgaaggtactaaccctaactatcagggtcagattttccaggtgaagataccaaggccttgaatgtggaacagtattaaggagccagatagaagctggcaccctgcacagaggcacccgacatccacacactcagtgaaccaatagcagcgtaagccacatccatgggacatgcactccataattcattctggagaatggataattataggaggttgtcagattcaataggcaaatgctggggaaataaaaacaacaaattatgtgagagctgatatttgttcaggcagacatctgtcttctgttagaggatttagggatgtttttcaacacaaggttttaaatatggcttagaaaaacctctcctcagcatggtctgcaggagagagccaaattcctgctttctgtgggtcttctcacactcacagagggctggttcctacagctcctggcagggaggagagcaagacgcatattgaggccaactgaggctcaatccgcctttgcgtatgccgagcctccttcctcatgacctttgccatgggcggagttcctcacgctggatcccggctggcagccgatagtccctctaccagacaaaccaagctctcagaattcactttctgctcctgtgagaccatgagccacaccacctccacttgtgcccagctcattcccacctccacagccttgcacactctgttcccatggatgtcctcctccctcctccttgcctctgcaagctcatctttaaactcccaggtttttcagaaaccttccccaaatgctccatcccacactgctccctggcccacccccaaccccacttggtgtctgagctgcgtgatctagaacatctactgcaccttttcagtaagagaaaagaatagcacattcagttggaggaatggattctcaaccacagctctgctacttcctggctgtggggacttgagcaagtcataaatatctctctgagcctccgttacctccttcataaaataaaaatactaatacgtactcagaagactattgtacaggctaaatgaggtaatgcacttaaagcagcacccagatacacttttcaggttgtgtctagagctgtctactgacctcacatctaagtgtgtcttatcttcttggaagcaggcattatacctttcttctcccttccttggaataacaatctgcttcgttgtattttctctatattcatgcacacaagataagccagtcagaagctcaagaccactgagggcttttactcggtgccatattaaatttggtcttgcctgttctgttcaatggaagctagggagggactgcacaaagatgagaaataacagaagacaggagctgtgctttccctaggaggaaccaggaat

SEQ ID NO: 49226 - DNA, 1016 bp, Bovine  19866880779490
gtaatgtgtatattcttaaagctgaaccttgtaccaaaggatgcagggtcaaactcctgaatgtcccataatattctgtgactctgttgtctcatccaagtcacgtccatcacttcttccccacattccccttttcatctgtcctttttcgagcattaattgaacaagtataatataccaggcactgtgctatatgctgaggatggggacagaaaaaatttctattcttaaatgtgcatactcaatcgttcagttgtgtctgactctttgtgacgtcatggataatccaccagtctcctctgtccttggaattatccaggcaagaacactagagtgggttgccatttcctcctctggggtatcttcttgacctagggattgaactcatgtctcttatgattcctgcattaccaggctgattttttttttttttaaatcactgagccacctgggaaggactggggagactggtgtgctgcagtccttgggatcacaaagagtcagacacaacttagcaactgaacacaacaacaaaaatcttcagtggatctccccatcctgactttgaggcaagcagagagcagtgtgattgacgctatgatctagagaggtacagggacatttttttaagtctgtaggtagaatttaagtttctttctgccctgcatgatattaatatttattttttaaaccccatgtgagtaaaattttacactctttggcccaaatagcttcttggcatgtggccagatcagcatattgcttatctctaagatctccagggaatatttgaaatagggaacaggtgtacttacccccaagtctcacataaatctagttaacaaaaacagcattaatttggtgatttgtacataaaatttataccccctcctcccatccttgccaaatactcttcttctaaggacccagcctaggaaatgtgtgggaagcagctctaggtggcctttggttaatagcctttctgatgctcttgatgcaatccagaggattatctc

SEQ ID NO: 49227 - DNA, 1532 bp, Bovine  19866880897593
atcccttcctaagttataaatattttcctgaaaaatcccctcatgtaacacagtatttcagagaatgggctttgaagtcagacaggactaggtttaaattctgcctcagccatttagatatataactttaggtatcgtttttaaaatggatatagtacctattgtcaggtctaaagtaagtattaatttacattgtatatgtgtaaattttaatacaataacatacctattgaaggaactcaagagattccaatttttaattattttataaatattatttttcattttaacaatttttattataaatattgatcaagcatatatatcctcacttcaaataccctagactgatcttacatattattcctatctcttgactgttaaccatattttcaaattaccttaaatttacttaattttaactccccatgtgtcttatcatccttccaccttacaagttccaaccaaaatccatcttaaacagcatgcattttaattctcctacctcagtcttaaatatgttctatttccaatccctgtttcagtttaaataaccttcatcttaaataccatttgtagaggacatctgctgttttagtttgctagcgttctttcctcccttctcatcatggtatcttcttacctttgaagatagttctttgtttatgccttgtgattctgatgaggtcttaagttgtgatttcccatccttcccttcacagagactgaaatttgaccctggcctattacacgtcctcatccccttggccacagtgataagttcagagtgtgcaagggacgcatggtggaggggttggtaggtactttctgttctaaagctgagaggcagaagtccctctttctctttgaagtatatgccataaaggatagaaccctggagctgttggcagttctatgtcctttgtcatgaataagactgagagcctgagggtaatacagagatagcacatgagtagagacagaatctgaaagagctgagagagttctgagggcattgtttgtgtctctgatttagttcttcaacttgttcttcctaactttaagagccagtgaatattcttatcttgaaaactgggagtgggcttcagttatgtgcaaaagagacaggtctgaataatacgcatgtgttaatcttatagatattttctaaacttagatctcttatctgaggttttcttctggacctgaccttaagacattatgctaaatgataaagattatttaaaaccatgcttttagagcatatttaaaggaattcttagctgtgtcaattggaaacagagtagggattatttatgaatttcggacttctggtgtagtcatttttaggggcatagagatgcaggaatatctgatattacatcagttgtgaatataagccagaatgtcaggcagcttgcattccaggaccagctcaactccaatttgctctgggatttttagcaagtgctttccttccaggggtttcaaaataaagtgattgtactgattttctcttcagacctagtaga

SEQ ID NO: 49228 - DNA, 754 bp, Bovine  19866880975679
tggaggggattgctctgtaggtgttttaaagatatagggaaaacaatgtctgaggactatagagttggctggctgttgctaaattatattgatgccactcaaaaggataatgagaatttgtggtgtattaatgagtagttcagggtgaagtataacagccatagggtcctgcagtagaagagtagattcagtggagaggcagactcagaacttgatggttagaatagcacatgttcagaaatgtttaaatgcccagccaaagtaggtctgttatattaaggtcagatacctggttggaaagcttgagatcctgacatatgggacatggatatatggatgaatttctttgagaattggcttgtcagatcccttcaaaccctcaatgttacaacttccttagttctggaagatactgctgaggctgcacccctgcaagacaataggtgccttctgaggagctccctgcatctcttgtcctgattgccaagctataactcagtttggatcccagcatgctaggatttgatagacctgattaggagggaaagcaattatacaccaaaggagctacaacagttaattagcttatctgccaggaggttagattttgaggatagttgattaaggaggctgaaaaaagagtggctatgcaagaattaatttacttgtatgtacattcttaggacaaaggatttaacacccagacaaccatgtcacaggaatgggataagtactgtgaagtagctcttaaaag

SEQ ID NO: 49229 - DNA, 878 bp, Bovine  19866881067221
atggaatacctttgacattgtaaataggtaggaaaggaaacattaaaaatgctacccaatatgaatactagggtaagatgttgggttttttgactcttaagtccagacctaacgtggagtctaatgtactatttggtcaaaagatcctatcatcttcagcaaaattaacaacatatttttcttgagtctttactgcatttgtgacattgaggttgctgctgacagtgttgatacacaagagactctaccttaacttagttcatctcccaaggacttacttctttattttttttggcagctgggtgcctattttccactttgataagccaaaggaactcaattcaattttgttgaaggttttatcctcctatctgcccactacaggcaactcacagggctatgaccctttcatgggaaagttgtaagagtattttaaaatttcagtgtcatagaccatcagaactactagaggccttagaaatcatttagacatactccaatcaatgggaatgaggttacacagaaaagtagtggttaaataaatgaagtcccccgactctttgggactttcttccagatcccacaaccacagtcaccaggttttatggggagataggtggagaccctgttaactgcacagagttacataaatatgactggttttagagtcagactgaaatttgaatgctggatccatctctgtaagctctgtgacctcagaaatgtgacttgatgtctctattttctcaactgtgtaatagatatgctgatgtttacatagttgttaggaatgatgctgatgagcatagaatgcttaacacttagtaggcattaactactgtgtattgcagtaggtggatgtttgattttttcaggta

SEQ ID NO: 49230 - DNA, 1623 bp, Bovine  19866881082085
tagtgaaggggaattctcaagactgagggcaccttcaggccatatccctatgactactactatcgaagcactgtaaagaggctaagaactattgtaaataggaccctgtaaatatagatcaaaacatcctcattgactgtcaaaaataagatcgcagcagcattaaagcacccggatgaaacaccccagcacttatccacagtgaaatctataaagtgctttcaattgctcaggggatctttagctatagcataattttctctatcttatggatgacttggccacctccactatgaatttttcatgattcccctgacccagcagctcttgcctgtggagagaataatacagtattgatttcagagttaggtttctgcctttttcgccacaacaggatttttgtagcctagaaacctcaattccctattactcattagagaccagggcaacttttcttagatctggaattcagaaggcaagccatttagctgctagtgtcaaagacagtcattatagtggaattttaactgatctcagtaatgagagtagctgttattaaaaacttcctaactgaaccaacagaggtaggattatacagaatgccaagaagacaatagtctttgtctctctcacatttgggatattttcctaggcatagctttctgaatgaacctgttaaaaatataccagaggctaaaaacgaataaaaaagaaaggaaacataactaggaaatccagtccatcttttactattttttcttctgtgtaatttttggagtagatgtctaggtgattcttattttcagtggcccttgttcatataagagaaatgaaaagaggctatgctgttggtagtttttatttaaactgcttttaagaaatcaaaaaatccatatcttacatcctgtgaaaactcattcttggcattgccatggtaacaagacttttaaaagggagttaactgaaatttagctgcatatattatttctttgtgactcatacttcataaaaatgcaaatgtcacactaatacatgttttaccttaatgttttatatcaccatttagtcttaattgatctaatgttttccttaattaaattttgtgcttctttgaatggttttttactcacctcccccacagtcccctcttctgtggacccatcaaactatacattttcaactgggtgacatgcaatttaggaagctgtcacacaggagatcaatcatccagcctaagaactcaacaaaatatttgggggaaactgcttgtcctgcctagaaattcagccttatcctcctacttagaatttttgtatctccgtctctgtccttggccatcctctcactgagcctctccttgagattgagaagcagagtatgttggcaggaaaaatattttcagtatatctgagattaaggtgcagacttcggtattcctcgatagtgatagtgaaagtgaagtcgctcagtcgtgtccgactctttgcgacctcatggacagtagccaaccaggctcctccgtccatgggattttccaggcaagaatactggagtgggttgccatttccttccctatgcaagtcatatttctaacttttttgacccacaattttctaatagata

SEQ ID NO: 49231 - DNA, 1731 bp, Bovine  19866881092143
ctcctgcattgcagacagattctttactaattgaatcaccagggaagcccattgagtctgaatcctggaatataatggaatgattggaactggaaaagtatgcgacagtgggattggacagtttccctataggatgtccagggacaagaaaaagtcacattttggagctgcctagtctggcatctaatcaggtggcagtgccaggttctgttcaagtactcatgccttgtatccgctgtggtttctaaaattcagagcacagagtcgccccagcagcttcctcaccccctgtgctgtgagttctgcacagagccctaagaaagttgtcagccatgagattcttcccctccagtgcaaacacacatggctcaggcatatgattcccatctggatccacccccgacttccggccaggaggctgctgtgtaggcagaaccgtctgcctttgatttgccagcctaacctgatacctggagccagcccttccctagcagtaatgcacagacctggcaaaattcatgcttcttttccaggacctattcatctctacatttcccttgccctgtcagaagaggttgacctgcgccaggcactagtttgcacagaacaaacaaatgagtatttatttctggaagagaacaggtagtcttttctttaatccaaggaacagatgctggcccaggaggagaatgtgctcaaagtcccacctatcactctaaggccatagggccacaaattgttattcaaagcaacagaccccatactcccctccagttccctgatggcatcagtgcccagccactgcagaattattaccatcatcatctctgctggattctatgccccagtcaaattggcagtactccttctatttgcaaacagattgcaaaataagaaccccaggaaggatgcaggctggccaggttccaaagaccttcagcagtgatcatactaaatcagagttgcttcctactccctgaacagcagcaggtactggaactgcatcccaatggccctggatcactggaatgcccagcctcacctccctccctcttccttcctggaataaaagtatttttaaaaaagggaaagagagagagagtgtgtgtagaacttcctgggaaattataagaaaaaaactatcattggggtcccacactactcatgagtttcctgacagtagagctaggaacaaagcaccaatagaaactttccttgactcacttccctcaatattttaaacttatcacctctgctctgagttagtctgtcattcacggccctctacaatatagtcacttgtgtgcatatccagccttctcttgtaaactgatccctcctctcctgcccataacccttcattcagtcccttgttcactattatcaaacaaaagcaactggtaaaagagtaacagtggctcctgcaattgctatgtgcttattgtgttacagactccatggcaagtgctttacacatagttactagtttaattctaaaaaataaaactcaagaggtaagctctattattatctccatttcacatttgaataaactggagctcagagattgtaaacaccatgcctaagatcataaaactaatacggtaagatgtctggataaaaatagcactgctatctgaaataacttctctgaaatgttaatagatattactgattttgctgcaaaaaataaataaaataaaaaaataaaataatgtaaaaaaaatagat

SEQ ID NO: 49232 - DNA, 1775 bp, Bovine  19866881099312
tttgagcaaattctgggagatagtgaaagacagggagagcctggtatgctgcacttcatggtgtcacaaagattcaaacacaacttagcaactgaagaacaacatatttagtctgttgctgctggacattgggtatttttcagcttgaggccataataaatagtgcagctatgagcatatcttttggtccacataaaaatacatttttgttgagtatattctgggaacgtaatttctgggtcacaaggtatgcacatattcagctttagaattcattgtcaaagagttttccaaagtaattgcatcaacatagaacttctttaattcatgaagtatgttaagcttatagaaaatctctatgtaaatacaaagttctgttattaactcaatgcctcatttgcacaagatcatcttgttccatggcaattaaaaataacatctttgattagatgaaatcaaatatctactgggatttgcatttataatctagatgtgtcacactcttttctctaatcaaaattagattctgacatgctttcaaatgtgtcagtgaaagacaaacattggtacgctgtttctaaaagtatatttggtcatacatgtttggtgtcatgtcaacactttctttagaaatggccacgtttgtcaagtgattgaaaatgacatgcaaattcaatattttctacatccccagtgtacatttttcagtattcaatttttaaaaaatatcttatccattaatcctttgaatttatgtccttatgagggtccatggagtaaatggttcacttctttggattaattattttaaactttaaatttgttattatactaataatatccagtgtataaaaaatgagtggaaaaagagaaaaagtatatagcatagagaagataaaaatcactggtattcctacatttcttaaaaattgctaaaacttcagtatatgttcctccagattgttcctatatgttcccatagatatgtatgtattaaaaaaatcatattatacatatatattacctggttttaatttttatattctataaatctctccatatcagtgtacataaattttaatggtcaaacaaaattgcatagcatattaacaagtatttatcacttcaatcaaaagatcaattctaattctttcacaaatattatgaaagcacaaaatgcccacagcatttggttaggtactggcagcatgtctttgggaagaatatcactttaaagacaagttgatctgaatttgaatcctggaccaaccattatgtagctgtgttatctggaaccagttacttgatatatctaagcttaagtttactcatcaataaatagaatgaaaaatgtccttcagatatttgtcaagagaattggatgggataacgtataagaaaatacttgacatggtgactgacacataagaagtattcactaaatttgcttgaatctgaatctgtgggaagcacaactattaaaagaactttccactatcattcagaactcataatctgacagcagactggggtagttacacaaataagtaagaggaagaaatccattttcattgataaaatgcctactatgtgtcccagccatgctgtatactttcatttctactgtagaaggcattacttcataggaagaatgaaattatccctggagcaagatactcccatccctgtatgagacacttcgaagaagctttttcttatagagaatcctggaaagattgttgagtcagtagttaaaagatcttgctcaggatctg

SEQ ID NO: 49233 - DNA, 899 bp, Bovine  19866881188300
tttcctcatacaaatgagggaacttaccccacacaacataaaagatgatggatggtataacaatcatctcaatatagcaatgagttttgacacaattaaacttcctaaagtccaaacccattttgcttaatcagaaaagaaaaaaaacaatccagctgtgtctaacaaaagaaatgctgccttcttcctcctctgttaagggagttaggcaaacagtgtatttcttgtttgttattttggcatgattgggattcagactaggattcctgcaatgtggggactggtaagtatgcttctcatcaacacaggtgtgggattttaggtgaaagcatcttattttcatagaagagccattttggtgctatgtccctcattatagtaaactgttggcaatcactgatgtgattacagacaggttgctttctgtttaaggaaaatgttgggcagtttctggtagatttctgacacaccattacaaaattcttcctgttagcaggtagaagaaagagaagtggatgtgaacacattagtatcagaattgcgtgtcaaaaaatatacagcaaatttcaatttatttctacaataataagcaaggtagaaagtaacttgacaattatttctccttctattgcttgcttttttcagtgacaaacattccaatatgtagagtgatgacctatatgggaaaagaatctaaaaaagagtggatatatgtatatgtataactgattcactttgctatatagcagaaactaacacagcattgtaaatcaaatatagtataataaaattgtttttaaattaaaagaaaataaacttatttagatgccttttagtaaataacagcctgtgctcctcatgtcagttcagttgagttcagtcgtcttagtcgtgtccga

SEQ ID NO: 49234 - DNA, 1310 bp, Bovine  19866881212619
tacacattacttgcttacagctgcctcatgatgccttaatcaacaaagaatcttgggctgacctaggggagcatttctgatctctcctgtggattaggagtctcaggcctgccatcctccttgttggagactgtcactgagaggggagagggaaagacaaggctctacttgaaattcaactagtattgcataaagaatgatgcacatgaaaaattgatcatgacactggacccaggcaaatattattaataatgcagtatttaaacacataatatatccccattaatgatgaaaagaaactcaaagtcacagcaaataaaagtcatttcaaggagaccaaaaggaagagaaataatttctctgtgtggatcactccacaatatcttcctttatgccaccatcttataccaccatctatcagagtgagtagattttctatcaagagatggagcggagcctttcttaataggaatatttcaaaccactgcctagtggaacccagcaatactaaccttctttctcccaatctcatctataaaatggagatgatttcagtcagttcagtaacttacttatgtccgactctttgcaaccccatgaactgcagcatgccaggcttccctgtccatcaccaactcccagagctgctcaactcatgtccatcgagttggtgatgccatccaaccattgcatcctctgtcatccccttctcctcctgccttcaatcttttccagcatcagggtcttttccaaggagtcacttcttcccatcaggtggccaaagtattggagcttcaccttcagcatcagtcagaactgatttcctttagaattgactgatttgatctccttgcagtccaagggactctcaggagtcttctccaactctcacatccatacatgacttctggaaaaaccatagctttgactattataaggacctttgttggcaaagtgatgtgtatgctttttaacatactgtctaggtttgtcatagcttttcttccaaggggaaagtgtcttttaatttcatggctgcagtcacttgtctgcagtgattttggagcccaagaaaataaaatctgccactgtttctactttttccctatatatttgtcatgaagtgatgggattcgatgccatgatcttagttttttgaatgttgagttttaagccatctttttcaatctccttttccaccaccatcaagaggctcttttaatctatctgacagaaaccgaagttacatatagaactattgcattttcaaagatttattatatttatatatatttatatatatatatata

SEQ ID NO: 49235 - DNA, 1458 bp, Bovine  19866881498742
caataatgattcactgggctgcctgaggtatttctcacaattacttttccttagtcccccagtgaaattactggtaatttttggtttcctttttatatatcaggacaaagcagagcactctggatctgcctgaggcatgaataatggaaatctaggatttatcattctttaagtgaagaatttggccttatttaactgttttactttttctcataaaaatagacacaaactcaaatatgaagtttatatttcatgaactgctaaattgttaggaacaggttgggtatatatcttatgtagatcttgtttctcccagaatctttaaaaatggcattgtttgggtcatatctacctataagcagagtccaagcatttcagtctgggattcaggccctttggcaggccaaagaacactgttggggctgtatttcatactggtaccccctagggtatagaatagataagaaaaaagacagagaaaagatcttgagatgcagactggccttagccattaccaatactttacatattgaaagttatttctcattgacatcaggaattttgccaatctaattattttatttattaatgagctagagaacttggctatgagttttaatattgaattatgtttgaaatgagtatataagttaccctgataagttagtgtgggtatcttttctactaatttgattcctaatgtgaaagttgttgatcttcacataattcatggatattctgttccctcatcttctcatggttagcacattgtctttcaaacagtaataatataggaccatttgtgctgtgacagaagtcaacgcaaggattatgggaagaatatggattcttaacttagtcttgtagaatgtggatagaggtgggaatcaagaatggcttcctagaggatgtgccacttgaactgacttttgaagactatttaagtcaggtgaagaagaggagggtgaggtttgaagtaggtgagaggacatgagcaaaaacaggaagacatgaaatagcaaggtgtatgattagaggacttacaactcaaaagacttatatccagatcttacattttgatgagaggcacaagacttttgatcatctctcgttctgaggttagtagcagttctggatcacatggatacatcctaattcaattgttctgataaaatattcattgcccaattttcaaaatcaaagaagtatttttttgaagctagttgaaagtcaagcagccagaatgacctagttaagaactttattcaaaaaaagaaaaagaacttagaaataaatttccctgaaatcacatcttcatttatttgtgaagacactgaaaccacacattttatcatgtattttaaggatgtatagagagggacaatttggagcctttttccctttgaatgaaattgacagcaacattttctattgttacatccagggatgttttttcct

SEQ ID NO: 49236 - DNA, 1779 bp, Bovine  19866880375691
tgatatttcttatgcctgtttgccccatttgtcttgtttaatggcctcagaatttgagtagtatagagatatgatttttattcccacctccagcggcctcaatattgaatactgaacaattagtaaggataatacaagatctcagaacaaagaataatgactgtaaatcaaacaaatatttggagagtaggtagaacttaacctcagatttgaaagattaatgagacttagagttttagagctttaaacatttttcttatctctctttccctaagtaaaatcagcaacaacaacaaaaaattctgaaactatatcttcataatgaaataaagacaagagagatagggaaaagtcaatgagttaatacagagattctgacagtcttgaaatgttaagtcctgaaatgtaagtttccttgcttccctgtaatacaaaaccattatttttcttaatggcttaacaaggatgtgttgaatatatgccatatccatgcaaatacagacatattccattaaataatgtggccgttaagaggcctttaatgagatcctatatgccattatttgctggcaacatttttttttctaattttattttatttttaaactttacataattgtattagttttgccaaatatcaaaatgaatccgccacaggtatacatgtgttccccatcccgaaccctcctccctcctccctccccatacttaaaatgatgaaagaaaataacctacagcccagattattgtacccagcaaggatctcattcaagtatgaaggagaaatcaaaagcttttcagacaagcaaaagctgagagaattctgcaccaccaaaccagctctccaacaaatactaaacgatattctctagacaggaaacacaaaaacggtgtataaactcgaacccaaaacaataaagtaaatgctggcaacattttaagatactcaaatctgatccactgtaaggcttcttcttctgagtcctttttcttgtaagagcacaaatgaaactgaactttgtcagtttctttgaatgttatgttctgcattcactgtcacagcactcattccagtaggttttctacaaatcttcgtaaacgccaaggtaccatttttgaaaactattatcaggtaatcacctcactccatttggctgttgtgagtctataagtatgtcaagtttaatcataagtccaagcctacaagattccaaacttggtattctttacccttgtaagcattaaactgatgtttaccggggggaaatcaatgaatgaatgaatgaatctttttcttcaatgatagattctcatctaaacaagaagctgtaatttattgaaattccattaatgacattaaacttcaatatgtgtattatacaagagcaaattccttgaataaaggtttacacataatgatttccttcataataaaaataaataagttcaagaagcaaaataaattttgttgtataagcaggcactgtttagggtgatttttgtcctataagcaatttgtattaaggttaaatatatagaatatgtgctgctatttcataggactgattcaatattacataagaaaaaacaattacctcaggtctcaatgctgtgtctactttgcattattccccattccaatcttttgaatctatattaaaattattattatattcatttcttccatatgtattggtcaaaccgcaagtgacagaaagccaatttaaactagtataaataaaagaagagaaaaaagaaaaaggaagtcaggagactgga

SEQ ID NO: 49237 - DNA, 2866 bp, Bovine  19866880515831
gcatatgtagatatttacatgtcataatttttttagttaaaagaaaaagactatttttcttagagaaattatacctaatctgaaaatattaatagcttccattcctattaatgagtgtggatttgtttttgtctttgagaacttgaaaactatcctattttaagaataattccattataaccaaatggcaataagaatcctaaaattataactagtaggaagaaactcacgaaacccgaagggactgcagaaatatatgtttgagtatagcagttgttaaaccactattatgaaaaactctcctaacccttgcctttgtgtataggcagttattatctggggaaaacagaaaccaaacacaacatacgcagggctactgttttaccagtagagacaagaatggccacaacgggctgtttaaaatggacatctgttctgattactaagcttcatgctccagcggttgtgaaccttctacgacgtaacctttgctcgtatttgggcttcccaggtggagcggtggtaaagaatccgcctgccaatgcaggagacacaagagacgcagactcaatcccggggtgggaagatcccctggaataggaaatggcaacccaatccagtgttcttgcctggaaaattccatggaggagcctggtggcctatacagtccatggatcacaaagagtcggacacgactgagcacttagacacacgtacacacacacctgctcatattatattcactgaattactaatatataacatttcaatacttctcacactctaaagtgcattttacatatgtaaccatatataacttaatcatcgtaacaacttcccagtacaaaagggaatcattagaactcttatttcatgctcaaattcaaagcttcttctactaataacagtgaccctgaataaattcacctgaaaatgaacagtcacacaggatagatattattattgaaacgaaatcatcataccatttggtgatgccatagcactctttaataatatcctggagtatggcacgatagaagagggactcagtaggcagctgaaaaaaaaagcagatacatatgagcacaagaaacaagtaaaaaacaaaaattaaatcaatgcttgagagttgggaccataagtgaatgttagaaacctgagtttgctgttaacatagaggataatattataactcttctattctaaataaaatgtacctgggggctaattctcactgagaaaataaaagaaactataaaagaagtagtagtgaatgaagcagaaaaggaataatcaaagaaaaatgagctaacatcccaaatggagtgcttatcatttaaaaacgtagaaataaacgttcacaactgcgtcagcactgtaaagagagaagtaggatgtgtgcaaaagagcagagaatgtgggtctttcctcacagacgtggattagagatttaacctaggacgctgagccagagagaaaaggcactacactacataaggacattccaaaataggttcacttcctagggagaaagaagtgggaagtgaccgtgaaggtccaaaggtagggaagaaggccttagtgatgcacgttagcttcaaagaagtagaaggtaataaagtactatacagagaggaaaaatgcttcactgtggcaatgtaagaggtactcttatactgctgctgctgctgctgctaagtcgcttcagtcatgtccgactctgtgcgaccctagagatgacagcccaccaggctcccccgtccctgggatttccaggcaagaacactggagtgggttgccatttccttctccaatgcaggaaagtgaaaagtgaaagtgaagtcactcagttgtgtccgactcttagcgaccccatggactgcagcctaccaggctcctccgtccatgggattttccaggcaagagtactggagtggggtgccattgccttctccaatagtggccaaagaccttttaatactgatagtacaggaaaattcaatatcaggaacaataaccctgtttccatgtcaagttactgttgaaaaaaagaaaaatgaacaaggaaggaggtcaacaataattgaatacctctgagtagtcaaataaggtaaaaactgttttaaagacagagttcaatgaaacgtgcatatctaataagttatccttttgtaactttaattctccttctgagcctcacattgttactatcatttgttttcaactacaacacactggattcaagtggagtttagcagaaaataaacattttgcctgtgtgctcaggcgggaaacctattctactgccccacttcgccacttaacatcaagttcctacactgcgtgtcccagatgctgagactaaaaaaacatctcaagttggcagttgagggtcaaccattatttcctgggtctttacccaatggcattgccttcttaagtcactggagaacatctgacttgtagggtcttgagacagtactttgaacacaagttatatcctcactggatggtgggagcagtgagaagggcgattctagtaagaaatggtattagaaataccagtttccaacacaactcctaaatgactcactgaaaagcagacatacatatacttgagtgcccacactaaaatttataaacttcaaaaggcacactccttatacaaaatctctttccaaatacaactccttaagacaaaatctctgatttataaactttcatttcctgaagagttttccaaaaatttcattaagaatttcccatctctggatatattttctatttgataatttttgatcttcagttcagttcagttcagtcactcagtcgtgtctgactctttgcgaccccccgaatcgcaaca

SEQ ID NO: 49238 - DNA, 1636 bp, Bovine  19866880613638
tgtgacatgcattccgctttggaactacggtcagtgacccggatctcattgtatgtttctagcatccgtattttgatctctaatctacacacacatgtgcacatatgcacacaataaaggctctttgaaaggtagatgatgccaaattttagggcacaaaaaagaatctgtatgaacctgggccaatctatttgtactaattttataaataaggaaactgaactccaaaggatgttgctggacacaagcatgctttaaaaatgtcagcacaagtgctgaaataaagaaagggaaattaaagaggctcttactggccaagtttatttgcaaaggacagggaggcctggcgtgctgcaattcatggggtcgcaaagagtcagacatgactgagcgactgaactgaactgaactgaaaataagactaatgataatttttgtgactaaagttaactaaagaagttgactcttagaaagcctggaagttcctaataatactcaaacaagaaaagtttgtatgagatccccaaaaggtattacaatatagaagagtgtatctaatagaatatgcttcatattttattgatccaaatatataaggaattgctactatataaaaaaaattacctgaatatctatctataaagtttgggtatgtactttctttgatccagtgagtccataaggaagccaggttatcccagcaaaagtagattcagtagcaagagaaggaaagcctgatcagcacatgtaattgatcaaattcaaagggtgtctgcagctaatcagcttcactggtcacacacaataatcaagcaaaaggaggattcaacagagtgttctaaatgatgaattaaccaaatgtacaaaagagtaaagctgactatgcagacactatccctcatctcctaggagctgacaattcttgatggtccaactaattaaaataaaatactaataagaaatatatacgactttaatagtactgacaaaccacactaatatatcaatgtgacaaggcagtggataggataaaacttagaagaattccttacctctttgaaagctactgtgtctcaaaaaattaaaacttttatataaataaaacaaaaaagttaaaagcctcacaatgcaatgattagaattttactagaaaaagaaatttactactggttagcagcctagaaatcatcttagactgctcagtcagggccgtgtctcaactaagaattaaaacttttcatgaagtgaaagtattagtcactcagtcatgtccgacttgttatgacccatggactgtatgtagcccatcaggctcctctgtccatggaattctccaggcaagaatactggagtgggttgccattcctgtctccagagtatattcctgactcggggattgaacctgggtctcctgcattgtaggcagattctttaccgtctgagccactcaaaacctgctgctgctgctgctaagtcgcttcagtcatgtccgactctgtgtgaccccacagacggcagcccaccaggctcccctgtctctgggattctccaggcaagaacactggagtgggttgccatttccttctccaatgcatgaaagtgaaaagtgaaagtgaagtcactcagttgtgtctga

SEQ ID NO: 49239 - DNA, 2726 bp, Bovine  19866880679703
tttttttaaaaatcaaaagagaaaaaaaggaaagagctaatgaatagggagcaaatcaattaactggaggttgtcacaaggtctagtatacaagtcaacatcatttttattcactaacaagtcccagctcctagaatagtgcctggcacagagtaagtgtaatactacttgtatttgttaaataaatgatcatggcagagcagatgatctgctagtaaggaagatagaataattggaggtcgtggtcagagttgatgtttgaaaaggtgatggaggaggtgaagcattatggataatgcctcgtatgtctgacatgcacatgcaataggaaactggtttggggccttttatgggaaataagtatttttcaaaaaatttaaatagttatttctctacaaatgggtgaattgacatttcccaaataattatcatttaaagccactgaaaccatcaggggttttaattctacttcatatgggcagaataaacgaacaaaatactagtaggaatgatcttcccttccaaattagcctagtctagttcttaaagccagaagctcagagtacctctcatgatttctattttattctgtttatcataggtgtggacaattttaggttcacaatactgtatcacctttctaaagtatattgatcttttggtaggctttgaaagacctctttttttttttttttttgcttttagtatacaactgaaacagtgtcagactttattttctgggggggctccaaaatcactgcagatggtgattgcagccatgaaattaaaagacgcttactccttggaaggaaagttatgaccaacctagatagcatattaaaaagcagagatattactttgccaacaaaggtccatttagtcaaggctatggtttttccagtggtcatgtatggatgtgagagttggactgtgaagaaagctgagcaccgaagaattgatgcttttgaacatggagaagactcttgaaagtcccttggactggaggagatccaaccagtccatcctaaaggagatcagtcctgggtgttcattggaaggactgatgttgaagctgaaactccaatattttggccacctgatggggaagaggtgactcatttgaaaagaccctgatgttaggaaagattgaaggcaggaggagaaggggacaacagaggatgagatggttggatggcatcaccgactcaatggacatgagtttgggtaaactccgggagttggtgatggtcagggaggcctggcatgctgcggttcatggggtcgcaaagagtcagacacaactgagcgactgaactgaagaccatactgtgataaaaaaagaaactatcacaaaatacactataagtgacaatgcatcaaatttcatttgatgtaacatttctaaaattgtaagaatatcagatcttatttcaaatgctaattcaaaatgacaatactgtcaacaacaaaaaagagggagagagataaagcagtcattttgctcgaataaataaaatcatgagacatgaagaactttgtacctttatgtaggttttcaaactcttcagataagaggtgatagcagcaacccacactgcaaactcctttgacttcagacttggaagtgaatattcgcagagtatttggagcaagatcaccacaagtatgtagacctaccatcaaacaatccttaaaagataagaagaagaaatgctggaaattaaaaggaagggtaaaacacatttcaggtgaagactgtatatgtttatcagaatgcagagctttaaaaaaatgataaagttctaactagaaagtatcgtatgtcccattttcataacataattatttcctttataggtaaaatgattgtgatcttttatcaaaactgacatgcttctgagttgattttctaatgcttttggttacttgtcctttttacttttctctggtctcttttacaattaatatttgcttaacaactagtcaaaataaaggttgatttgaccaatcaaatgtaggtggtgttactaggacaaacttgtgatttgagatacattaatatcttaatagtcaatttttaaattgcacttcaccattcaaaacttataaaacctgccatacgaaagaaattcaaaagaaattaagccttgctaaattggcatttatactccaacatcaaaaaaagtttacttagttcactcattacaccaaatataacaatattaattccaaataaaaaatgttgctcttaattttataacatgaattatgtaaaattcctttgaaatgtttctcctaattacttaaggcctaatttaaatgcatacacagagtggttacactggctcacactcaaaagaatttcgatcagtatgctatttaactcttcagttgcataatttcctcatctgtaaaatgaggccaataatagtatcttatctcaatgggttgttgcaagactttaataagttaatacttgtacgtaatttagtataacctctggcacataataaaattcagtaaatgttatatatttttatcatcaatatcaggttattataaatatggatattataaatatttaaaataacggacattaagttgtgaatcaaatatataactattttaagaacaaatacaactacttcagttgagttattttacaaaaaataatactttaagttcatataatctaaatatgtgtgtgcctagttgctgcaatcatg

SEQ ID NO: 49240 - DNA, 1806 bp, Bovine  19866880686145
gcagctgctgtaggtaaaactgcaagttcatcctctgccaagggtcccatgacagggaccacaatgatgctgtccaacaggcatggcagaagagagactgtgtcctgaaaatcatttaaacagaaggaaaggaagcatagttaaaacaaaaccttcagaaatggtgctgtagggctgagacagagccaagctgagaaaactttgggatactttctttgctcttgagaacgattctaaggcttgaaaatcagccaggtggagaaaaagggagtaagttcacagcagacttcacagcagaaagagaaaagcacaaactcacaaatttggggaaagtgagcataacaatacagaaaagtattttaaaatccactcaaaaactgaccagagattctaagctatggctggatgtttgcaaacacaacagctgctgcattccacagtctagaagggaaataatggaaactttcttttctcttttccaacaagacacaacaaaagcagagctgatgtaattaatgaaaaaaagatggctatttaaaacagtgaaggcactgaacaacagaatggaatggaaatgaggcccacatttagggacagttcgttatttatctgctgttcttttaatgcacactgcgttctactaatattcccctctccagggagactaccaaaccaggttggttagcgatacaagcatgagaagttagatgctatgatataagcagcgggtggatggagttatttcttgaatattaattaaagtagtccatccaacttgaagactcttacaattgaatacttcaacttaatggatctgttttcaaattccctttaatggcccttctgtgaccataatatctacttttccagacatcctaagtagaaaccattatggacaatgtatgtaaaatcccccaaggatagcatatggaggagaaactgtggactgccaaattcagcagctctggagagagtgtttctgaattaaacttgagtctacagggattacagttcatttatgactggcaaaatatatcttcccaattccgaaagataaatcccactgatatatatgtggatttcacaagtgtttctcaagaaacacaagacaaaaaaatctttccacaaaatgtagaagttctatgatattttgacattatgataagtcacatgttacgttggctctcactgttaaatagagaattttgtaagtgctgtaccaactctgacctgaggaaacttggtttagaaatttcatgtgggagatgttacggtaaaatgactgttttgaaaaacttaaaaggactgacaaggcagtgactatagtctttggtgttttaaagataaatttaaaaacttcaaaagtttggagaggagggaaccagagtattgcaaactttttcttttgccaaataagaccagttttaattttattttttatgaaaaagataatagatattattgatagcacagacacagagtttaaagtgcagttctttaaattaatgtacttagcttcatgaaaaatcatcctggtttatcttcatgttctgatttcattgtggaccagggaaaatactgtggcaaaccagagctggtctgtgaagccacagctgaaaaccactagcttgattcacttcattagaatgagctggttctctaccctaagcaaccattaaaatctaattcaaaagctttcagcatccagcaaacttctgtaatttagcacaaagtgattaaatcttctagtgaatgtttacatttatggtgaatgatattttattctgtatccatgcaataaatttc

SEQ ID NO: 49241 - DNA, 872 bp, Bovine  19866881099369
ctctgtttgtgcctttacttatgtgactacatgtcatctcacttttctgagctgatccctttgtgtggtaacacatatacattttctagtacaggttctgacacagtaaacactcaataaatggtatgagaacaaatagataaattgcaattagagaaagaagttcacctttttatattgaaattttcactttatgctgagtatatttaatttggaactccttcatagattagatttatctagttttctctcttaacctcagaaagcatgatatctaatgctcaatgtaattatatgaaaatgacattcgtgtccaaatgagacagaacaatttagacgagcatttggtagcagtgttttccacagttcttaagaaatctgttgttgaaaaaatgtcagggcaaagtggaagtctaacaggagctgtgtaatcagcaattatttagatggattacttttcaaagaaacttactgtatacctgtggcggattcatttctatatttggcaaaaccaatacaatattgtaaagtttaaaaaaaaaaaaaaaagaaacttactgtaatggaacaaacagctgcctattaaaaataaagaccacagaaacagaatgacttgcctcttctgacttatttagccaaagtaggagtttgttcaaagtcagggttctacctgactttagatgagatttatatcatggaattccacatcaaaagctctcctgaactgttgacttcagttggcaaaggaagatgataattgtgcaattttgcagccagattcacattattaaatttttccactttctccaagttggtgagtctcggaaaccagatgtctctttcttatcagggaaactggattcctatcccaa

SEQ ID NO: 49242 - DNA, 945 bp, Bovine  19866881179835
aagaatctcaagtggtgactattatggaatgaatacccaaactcttccctcttcttctagattttataaatcatcctgttctttaataattttaagagaagaggaaatgtcttttggaaacagactaagttggaatttctactatctgggtaggcagctctgcttattgattccagttagttggaatagactaagagagaagcagatttcattcttaaccaagtaaaaaatcccagctatctatagcagctgtgaagcatccctgccatcttgaaaatttagtcactgtgtatgaagtcagaaaggaaagcttagttgacataaataatgacccatcctggaaaaagaaactctaagcgtgggtccttcaccctctgaatcaaaacagaagccacccaggtgaagtatagtctataactgaggcattcacctaggaagcagagcacagtgctacaaagaatatagagtttctttgaaagacaatttatcaggtagaaaagaatttatggacgtgatgtaagagaacacttgctgtagtacattttgaaacttttactctatttgtagtattcattatatgagagttaaattcaataggctttatatgaacaaattctttctgagtttttttttttttcaaagggcctattcaatgaagtattgctaatggccacttaatcattcaactaaggcatggatatagtactgtggaaagtaaaagggtttgctcaaggctactctattcatgaaaaaatggaaagcaagtgaaaatcttcagattctcagctctcatctttaccattattattgtggctctttgttttttctcccacaatttatactaacataagcacctttatcatttatggtcatttctgatgaagaggagaaacaaaattattctgcttaatgtacttatttctcccgttccggaatgttttcatc

SEQ ID NO: 49243 - DNA, 988 bp, Bovine  19866881259661
cccggactctgagccacatattataacccactggtttactctcctctctacattgtctttggttagcattttaattgtctgtcagtctagtcgtaagatggcttctatactcagaacttgatatatagcaaccctggcatgtgctaggatacattggtcatatctcttagtgagacagcactgagaaagggacaggaaggggaaaggttgctggcattccctcccatttaggcctgtcagatttagcaagtgagaatacaggacacctagttacatttgcatttcagataaacaataaatacttttttagtctaagtatgttccaggcaatatttgaaattcaaattttatctgaaattcaaattaaactgagtatcctgtatttgacctggcagcctttcccatttaccccacacacagctgtgaatagtaactatagctcaaattccaaatgaggcttttgaaaatacattagcattaatttttttaaaccataataagagatatcaggattgaggaacccaaaaccttggtagaaaaatattgttaaatggaaaaagattgcacaaaaatccaaaaatatatatattttttcaaaaatatatttttaaaagtacaaaaatatatttaaaaaataaactaagaaaatagcaataggatgttaagtatcttaactttttaacagtacatattagaaagttgctttctactcatgtctgttcttgagatttttatgagagaaagagatcagatgctattataataatagttataagagacaagaattacataaattaaattcccaaagtcaacttttgtttttgtgtttttagtaagcttctaactattggattttcttaaattaatatatagtggttcaagttattcaggaaatatacccctatattccatgccatcactcattttgctttttttttttttttttttttgagaaaacataaaatttagctaggtaccttttctaaag

SEQ ID NO: 49244 - DNA, 907 bp, Bovine  19866881292344
cttcgaagcacatgagcctgtgagatcccggagattatttagggccactcttttttaaagcacaatctgggcttggagtcaacaggattcaacacttattcatcccttaaaaaatgttcatactaaaacgcagccctaagcaggggttaatggatcttctaactggaatgtctttccaaacttacacagctgctctgagtgaaaacaccagactcccagatgccaagcttgtgtgacagagatctggcaccaactgagtttgctattcattattccattgtcttacaacacacccggaaaacaaagccctgtagatggttggtggttttcctggcttgtgaaaagagcaaagacccaaagaagaagaaatccacctgtgggtagggacttttaattgaaatctcaaatacactttaaagcttcagaatgccacttcttggagttatttctattcttccctactgggcatatctttgctctgacttcgtaaagatgggaagctgttccgtatatgctgcagcccagtaaatgtgactacagtgagacattaacaaatcctgcctttggaaaaagtgtttctgagcatggacacttgctccaagcccatctacttcagttagtgagatttcatttctcacttggtctatttttaacaagcagctaaaaaccatatataaatgaatatgaagaaagtttgcattctttgtagttggagtgtccattcaacaaatgtgatttcaaacaagtgagtatgtgtgtgtgtttgtacagaagatttcatcataaaggaatctgattctttagagtgtccttgacatttggggagagggatgttggaggttgagaggagagagaaagactacactggtcattgtgtctgtgatataagggagaaaggaaatttata

SEQ ID NO: 49245 - DNA, 1309 bp, Bovine  19866881384995
acatgactgagcgacttaaaactttccagaggagcgccatcaggctcctctgtccatggggttgcaaagagttggacacgactgagcaactacaatttcagtttcctctttgctaataagtgagccatccgcaggagtcctgacaacttctttgtgcaccacaggctttagcaaggtagaatattgttcttgaaatcagaagccactaatctagtggaaaggagagaatagttgcctactcttgattgatatagtttaagaattttcagtaatctactgtcccaaaagtgcttcccaggtggcactatggcaactcactccattattcttgcctggagaattctgatggacagaggagtttggcaggctatagtacatacggctgcagagttggacaagactgaagtgacttgacacacagccccaataatggctgaagctgggaaacagtagtaatttatgtaaagtatgataggaacaaatacacttgaatgatcaacttgcatatttataatttgacaaagggtgaaatctatgtttatagttgtgactacaaaattataattgttgggaattccctggcagttcaatgattaggactctgtgctaccaccgtgtgaggaacagcttccatccctatcagggaaccaagatcccacaagactcatggtgagcccactccccccaaaatctttttttctgttttgccactttaaaagaagctattaaagaattggagaactagcttgaatgcttagtctcgtgacattctgcagatgacaatttcaagttggttgctaatactgtgaaaatgggataaactgcttcaggattacatattgaaagagtaataaatactacttttaggccttaccaaaaatggctcaattaactgtactcaagtatatttcatttagattttatagaaaagaattccaaaaataatttagaatttatatgtgtgaatatataaagtaaaatactgcttaattatttattcaaggtcatagaacagtttggtttctaagctagtaacagaaactcaattttctaacatctaccccaaactgctgtacagataactctagaaattctatctgtgaaatttcaatcaagacagatatttaagccctttgaaaactttgcttgctctgtatttcatcagtttcagactgattactatacagtaatccatggtgagtttggttttttttttttggagagtacatgctggcacagcattttacaccccttggggtaaccatgacacaggcacattcaaataaattaatgtccagtccaactaact

SEQ ID NO: 49246 - DNA, 1544 bp, Bovine  19866881442736
ataggcaatatgtgttttacttcagatcatcagacttaaccctttgtgtgattgatatcatactcttatttatcatatattttttgaagagatagatttcagtattttatatttaaaagaactgttgactatcctactaagagaaaatatttctgaatgaaaatttataaatatataacacaaatcgtatctttcatcagtatatccaaatattgtttcatgtttattcatgcatgtgctcaagcagttggcacaattttggcagttctggtcaaattacttcatcttttcagaaatgtttaaactaaactgacaggtttggattatctgacagcctttattcacaattgtctaattttttcacaatatgaatcaaatgattttctcgtctataagattaacaaaaatagggttgtgtcccacaatcgttacttagtaacttgagaatatatgggaaatcacaattgcactcaggaatatgtgtagctgatatgaaatgttcctggaaaactcatattaagaacttcaggaactttctcttttatattctactttctctgctaagagtaatttacgtttcattctgaattcaaacagtttgtttgcttgatttgaacagtttttaaagcttttccttctatttctctgagtatcattatacagtctaataatttgttctctggcttatatgaattttaatattttaaattttagatgagagttgattatcatttggtactttatcagtcatttaaaaatcttttatcattgtttctgttttgacaaaaaatctttaataaacttacaacttatttgcatcggagtccactaagattaatgggattcaatttttcaactttgtgaaaaatatccaaatttcttaataccactataattctttaatattgtgatacagtttccaaatcagaataattttctgtatcagtatgttgtctgcagggaaaataaagtaagctccaccaatgtgagaaactagtatattctgttggtctctacattgcattttacttgatagagcaatactatggaattaattagtgttattgtcttaattaatatctattgattgcaaacagaaacaaacttgcatgaattttggaaaaacgggaactttaatgatagatacagtggaactcaagagcagctatggctctcaattccctatagtcaagatcgagaaagccatcgggtctctcatctataatttgttatttttcactgttttgctctaatatctgcctcacctactttcttcattcatagaccagcttctcctacctctccatgatcataatggaaaaaatggttgcttagaggtaccaagttaatatcaacattgcttcatctactttaattggggtgtctctgaccttcagttccaagttcttgacaaaaagctccctttttaaatctgcctttgacattgtggtagacttgtatgccatttcccaagtatttatgggtccttttctactttgcaagaatgtgataggatggcacttcctaactccatgctagctggg

SEQ ID NO: 49247 - DNA, 4356 bp, Bovine  19866880349438
gcacatatttggcagtctttattaatttccgcatatgttaggttttatatatacaggtattcttcatgtagctttcagggaatcagatattttcactgatgcatctgttttaatttgcctaaaataactggacatatctgtgattttaatatcaacatgaagtattctgggatttattaagcttcttgaaaaaccacaataatgttgtactgcattttggatatcttctaagaaaataaagaaatctgaaaggatttataatccatgaagattttataacatttgaactagaatatattgtaagaaatatcagaccatcctataaagaaaatagaaattttcagcacagatattacttgaaaagtgcatgaagaaagtatctctacatgcacaacttcttgataagagcctaaggtattacctatctcttttgcgaatcattttaagttaagcttcctttcagtgtaaggagatgaattagagaaattgaacatgacttctgtagtctgaaacattatccttctaatgtggtcctgaattcatggaaatactaaattcttaaaatagttccctggattcttgaaaatagccatttaagctagctgcacaatttactcatgttcaaagatagtaacatatatgttgccatgtatagcgaaaggaaaaccatgaaatgagtaactctgggagtttttatagataaaacatgtgtacccccccaaaaggctaaaattgccatcaaatgctttgtgttacaccatttgcacacagctctgatggtttgaggttgactttagggcaagcaactgctatgtttgtccttgagacactttgctatagtcagagacaaaactaggatttcaaagaatcactgaactgatgatccatgactttagatccattttatcctcaaacttaggtgaaataaaagttttaatttaatttatattgcatactttttagatatatcttataaaatgcaaaaaaaaggtagatttaagattcagtttcttcagttagcaagttttagaaaagattctattaatcatgttatctttattaatcatagttacttgaatatgtaattcaaaatgatagagaaagcaagggatttgtccttaatggtcaacagattctattgacttaattaataatcctgtcaatgataagggtttaaagtctacaattcttcatcttttcatacagggtttcgaaatgcagagcacacatctccttaaatgttaaatatcacttgtcaaatacttttctcttgtttcaattatacaaaaccaaatgtagcttcttgttgaaatctgcacaagaagatgaattgaattgggcacttccctcttgccaatccatgaactggacacagcagtaactatgtctcatcagccaaaaggtttataacaggagactggcatgtcaaaatctgttgcatgaaagtgatttttgtgtgtaataagtgacccacatgtaaccagtgcttgttacagtcttcaggttgtcaccaaaaagctctaaagcagagggaacatagtggcattgttgttcttcatggctgtcataataataccactgaaatatgcaggatacttagcattttaggttaggctttttatcaatgtctctccagtatatgacttaatgcatgaacgccttttaagaattcaacagtgagaactcaattagtgaggttaaataaaaatatcccactaaagaataggaactaaataagtaaggtgactatgttatgtatatatacatatacatagagagagagagaggaggagagaaagagagaaagaggagagaaaaagtttttcttctaaggctcaataaagcttttgctcatagtttaatttaaggaaacaatctagcttgctgttcatgaaaaacacagtcatctggtttaaaatgacaataattgaagtaaaaatgaggtaattatgttaatagcctattgaagatttcagtcaaaaagggaggacacaatttgggcaccttattaatcattttttcttggatttgtatgacttgtaagctgatctgttgggttaactcaattagaagtcgccaagatatcataaatctcttcattttaagtgcctcattaattttatgacaaaattaacccaacaccattagagcaacaggcaaatcttgacagctattttttttttttaactcttagactgttctagttgatatttgatgcagtccacaaataatgttatcagttcactagattctaactttgagcctgctacagctgatgggatcctcgggatccctggtgacctcattgtgggtgccctgtatgttcagtcactgaacaacatagctagctatgctacatgcaacctttccttaccactcagagccattcccgatatgttcactctaatagagcaagattactttcaactttctgcttgcagtattctgataaccttgtatacttaatcataattgagagtcaagtgacttccaaccaagtatgcattttaattagctatcaaataaatagggagactgtttgtctggattttctttctttgtgctaattaattgggaatcaagggtcaggatcttgtcttgcaaagtgcattgaagacattcatttcaaatatttatatacatccacttacaagcacgggattcagagttcattttacattctaatataggccaaaaagaagtatttaagtagatgtgcaggcatcatgctgaagtaataatgatggtaagataaatattcaacaagatttgtgttttctattgcagtttttaagctaaataaagtttgtcattttaacaatcattaagcaggcaggtgagaactctgtaggcatgattatatcttaatcaaatttgaacagaaattatatttttgaaaaaaaggcaaataattcaagctttgaggattctacagaaaacaaatggaatgtagaatggaggcagtgttttgactatctcatatacctttgtgttcaattatttaaaatgaaagcacttaggcaaagctatttaatttctaatttttgccttatacctagagttatagcattcccaagttgtgtataataacatcagccttgcaaataatttaattcctaaaactataaatagtttattattctatgaagtttttatttgctaaacatacagtgatcctccccatgccacggcaaaatgtgagatgaacatcaagtttcctgaacaagggtgaacgtagttctgagatcagtaatgaatgtatattgttcttcatgcataaaagacaaagtttgaaactttttctactgggaattgagaaaaaaaaaaaaaaaatgcatctaccagatcagcataggggcttctctggtgactcagcagtaaagaatgtgccggcaattcaagagacccagagaccttgaattcagtccctgggttgggaagattccctggaggaggaaatggcaacagactctagtatttttgctgggaaaatcccatggagagaggaacctagtgcgctgcagcccatagcttcgcaaagtcagaggtgactgagcacgaaagctccaggtcagtaggtgcacactcagtgccatagtctgcattaacatatccctgcaaagatatcgtatctggcaaaggatgtagttgggttgcaacttagttaagtttatagtagtccattgtcatctgccaaatagattcactcatttatttatttttgactaatggcttaagataggaaacagcaccaccatatcctttaaatcatgagtctccaacctccaggatctaatgcctgatgatctgggctggagcttatgtgacaataaaagaaataaagtgcacaataaatgtagtgctcttgaatcatccagaactaccccccctcccatccagtccctggaaaaattggttcctggtgccaaaaaatttagggaccactgctttagatctttaactggggccgtaatctttgaaattcttcagggaacacattactgcttctgttttactcttttgacttgaagataaagcagtttcaggagcttccacattcaatctttatcataactcactgttcctccacaaatcagcatgtgcatgtcagagtttggccaggtgctcagaaaatgcaccccagttgcatatagatgggccaggaaatggctcctggggacatccttgaatttactagatccattattagataaacctggaccagaactttactcattacttgacctccacaggctccctccaagtctccaaggggcatggtaatatttatggtacctcttattctcatcagtttggatactatattcaacaacattcaaaatttttgactattgc

SEQ ID NO: 49248 - DNA, 919 bp, Bovine  19866880506574
acttattaaaaattaaaataacactagtatgatcattgtcaggataatgataatttatataggcaaatatatatatgtagggttgcttactaagtgccatgcactgtatttagtccttgaatttttataacagacctatgagagaatgagagtagggttctctctaattatgcatctggctgtgtaagtcaaatttactggttcatttggaccatatggtgagagcaacactaaactatttagtgtcagaaggcttgagtcggcttacttgtattcatggaaaagacaaaaatgtttcaatctcatttccacaatgctctctgagaatgaactttccagaagtataaatagattgtgacctacaatttgaaacatgtcagaatatattaagtagtaactgggagggagctcaataaagcccagttctttcttttccttgtcaggctttgctgcatagttctctgtaacctttgtgatacttaagacaacccgacagctatagtcaacttgctaaaattatgtataaatgggcactcactttcagtccaagaaaacattatattaagtggaaaatagaatgtcaaacctctttatcaaaaagactagtgattttttaaagcattcaaaacttttattacttgaatctaactggaagtgaagacagatttcacaaaggagagtagtcttggggattagaggtcaggagataggctttctgattacattgcagtaagtaactgaataatgctatggtgatttatctctcagcttattattttattctgtgggaagaaataagaatgtagcttttgcccaaatagtaaagactttgcgagtaaagaataggtaccttttacatagtactttcagagaagaacattgaatgtaaatatgtttcaatatgttctgcagcttaaat

SEQ ID NO: 49249 - DNA, 2699 bp, Bovine  19866880766432
tacagatttctaagagtcggttaggtggtctggtattcccatctctttcgaattttccacagtttattgtgatccacacagtcaaaggctttggcatagtcaataaagcagaaatagatgtttttctggaactctcttgctttttcgatgatccagcagatgttggcaatttgatctctggttcctatgccttttctaaaaccagcttgaacatgtggagattcatggttcatgtattgctgaagcctggcttggagaattttgagcattactttactggcttttgacatgagtgcaattgtgtggtattttgagcattctttagcttcgtggtggctcagaggttaaagcgactgcctgcaatgcgggagaccaaggttcgatccctgggtcgggaagatcccctggagaaggaaatgacaaccaactccagtattcctgcctggagaatcccatggagagaggagactggtaggctacagtccatggggtcgcaaagagtcaaacaggactgagtgactgagcaactggttgtttaaaaaaaaaaaaaaattagtaaaaccagtaacctccagtcactgtttattgtaagtcaggagtgaaacttacttgatagctaattttttatttttataccatcaagaacacaaatgtataaattttacttgtatattatatttgcaaaattttaacctttatatattttacattttttataattttattaatgtggtacggagtctttcaccatcagtgcaaagttatttatttgcctttttctaaaaggatttgaagcagcttcattattattttattggtagtaattagatgtatcatgtaatctattcttgccatttgtttctctgttattagaactacccatgagtaacagtattcactaggaagaaaagtgaatagtagaatggtacattttctaaaatcccattatgactaactaaacgtcatgcttataaggttggaatatctgagccatgcgttttagcaccatgttccaaatcattaagcattccatataaattcttaccagtgcattatgtgtgtgtatatatatccttaaggctacactgataagggtaattattcaattttgattcctaaactaccttgtaaccctgatatctcaatattataaatatgaaataaatccattctcaccaccttaatttaatgatcagtgtgtgttctagaatgattagatggcttatctatggccatgcaacaaaaacatgacaaattttagacttaactttaaatacctgctacatctccattcatctgaaaactaagtagtgttttgaagtagaaaatttctaaagtcccttccaatagtaaatatgtgtggtttaaaataaaacatgtgacatagtttatgtttatccagctattacctagacaatttgtatgtatttctccgaaatccatgttgtatataaagaattgatttttacccccatgaatttccctgcaatgtatgatacttgctcttttaacagtcaccacatagtcatccattagtttaatgaagtgtaagtaagtgttagttgttcatcgtgtccaacccttagtgatcccatggattatagcccaccaggctcctatgtccatgaaattctccaggcaagaatactggagtgggttatgatttcctgcagtctatttcatcttctaagttttggcacaaatactacttacctgagaattccccactcctcagaaaatgaaacttaaagtttttccctgagctgaatatggtccattgatttctatctctgaatcaataggtgaaagaaagaatatgcaaatcaaactatggacactgtagttattactccattatcagtggcttcccatgtggattactagtaaagaatccacctgccaatacagaagatgcaggctgggaagatcccctggagtagaaaatggcaacccactccagtattcttgtctggaaaattcctttaacagagaaagcctggtgggctatagtctgtggggtcacaaagagccttacatgagagcacatgttcagtcgcaggagtgatccatgtgatgacaggatatcttgaaggtatattcaaagctacagaaaaaattggaatattttttatttcaggaaagggcagaaaatgtgttgtatcagaaatcagaaaaatattgctcaggcaactaaatgttaactgaagtccattctaaaggaaaataatttttaacatgatcttttttagaaatcatgaagggaattctcttctgtagtctgtgaaaatggttggaatagcaattaggattgcaaatttaaaattcagatgcagactaagttatttatagatagaaatgcctatgattttctaaccccctgagctatacaaaatggatagattttttttctttaagaaaattaaataatttaaaacttaaaagactgacatgattcaatctgtatgtaaagcataatgagatttctgaatttgaattttagtagtcagaagaggatacgatagcattattcaacaattgtacatactttctggcaatttattatttctagtatgaaatgcgagatacatgatagcaagcactataaagtaggtcagtgcttgaaaatgcaaataacttgaactctccacattagattttaccattaaagagctgtattcctgagcaaaacaaatggttca

SEQ ID NO: 49250 - DNA, 2551 bp, Bovine  19866880848424
tggtacaggattcagaattcacacagtagtgatgacacacatctagaaagaatgaacagtatagaaataaaattgtgttacaaagtatttttctttattttttttccccacactgtggaatttctacaatcaggggttgaacccacattccttgcacgggaagcgtagagtctggaccaccatggaaatcctacaagatattttttcctgagtcacaataaatgttaccattttacttaatattttaaaatggtcattggataagtagattaatttacaagagcaacttgtaattgcatgtaaccagatttctttaagaataccattgattcctctttttgcctgagtttgccatcatttcatcttgctaagagttatattgatatactatatcaatataaattgtattgatatattatattgacataatagatgtaatattagttatattgatataatactaattgacaaactctattagtcctgaattttaaaatttaagttctcaagtttcctcagctttccttctaagaagcaatatttctgttattctggaatgaacataaatcctcaagatttctttagatgtcatctatctctgttcctccttacatctcttttcatctgaagaacagagtaagtatgggactcttaagtccttcgatagcctttggtggagtggaaatacgcctctctctacatgagccaggagacccagattcaataccagggtaaggaagatcccctggaggaggatgacaacccactccagtactcttgcctggagaatcctatggacagaggagcctggtgggctacagtccatggggtcagcaaaagtcagacacgacttagagactaaaccatcaccaccaccacatgagccagaacagccagtatttccaaacacctgagcaggtaagcagatagaagttgtgcctctcatggagccccagtagaaacgtggaccggaagactaacagatccacatgggtagaaagtgataacagaagtctaggccatttccttctcccaggtgagaacctggagtctcatcagtcagagggaaaacctccatgcagtctgaaccctttgctttgtaaaatgtttcctactgagcacttcagacaattttctcaactacaaaggaagacttcttcaaatatttccatatctcttgaacatcagtaataaaaagaccatttaataagaacaacattgactttgcaattagacgttttgcctcagtcttctgaaaaacaaacaagtctatatgtatattgacacatcattattttttaatttaccacattcacaatattgaaatttatagtattaatacaagtaatcttaagcagaagaacttactgaattgatcacagacatagtgtttgaagttgcaatttccttatagttatctaattgtgaagcaatattaagtgtgattagatgatgtaaaaatcacaatttataaactttaatctgctataagatgattgttgtgggtaaaaaaagttaaaaaataatttataacttttatgcttgtatatttatctagccttttattaaatcagacagaaattaaatttattgacaggcttgcttcatatttatggaaatttatttcaagcattcttatgcttgctgttgcattatgccaagtaccctcattgagattcaaagcttaagtttattactaagggtcttggctatgtttaagaaaagaagcactttcaaagggtgagagacttaaagatctaaaaattaagtcaatgttaatgtctgtccattatgatgtctatttgtagttgttctaggcttggcaggtagataatgcacacaacacaaattctgtttgttttttttttaatatttgtgaagaatgtattaacagtagcctatataatcatctaataccatctgctatgcagaaatctctaaagagcaattttccttagtcagtttgctagatacaacttatcgacagagaactcttttaatattgtctctaattgctttaatttcatccattggtcctggttcattttttctgatgggatatagaaaacagctgatgtatctttccaagatcttcatattatgaggtttttttcacaatggataattcatcagaatcatgtaggtgactgacttgcaaatgcagattccagtttcttttcctttcatccactacccccactcctgaattctaaattctagatcagatttgaggcctgggtgaaacccatcagatcagatgactaaacagaatttggaaactagggaatgtaagaaatctgaaaataattttactgagtagcaagttgtctaagttgtaaatagatttgatttgattgaaatagcttatttcttgactaactttgggagccctaattaaaatgtaattttaacctaaaattttgaaccacgttgtttttaaaatcacttcattgagaagacctaagaagctaggaaaagttgagttaacatcctgagggttgatgattgccttataccatactgtagcaagtaacagtctgcttacacttat

SEQ ID NO: 49251 - DNA, 1825 bp, Bovine  19866880914035
ccagttgtttccatgcatataaactattttacaaaaaaaaaaaagagaaaaacttgccaaattgctaccctgcattatttatctactatattgaagattatcacagttaccttgataggttatatgaacatattagaacagtaggctgttaaacagagtgcttgtaatgtaaaggactggaagccatctgtcatggggaaaagaaaaacgaaaggtcttttaatcttttttttctagcatgcataattaacagcatttctacctaataggaataaaagaaacctatgtagtacaagtaaaatctaagtatctaaataatttgcaattgcttggaggagagagtaactttatgtaccttaaaaccaatattggtattttaaacctacaaatttaccacaaattttagcagaaaaaaaaaaaaaaagataaagtgaggatatttataaagccatgattaattaagtcaatttatgaagaaaccaagctgctcattggtatttaaaatttgtgaacaaatgttaattactatccaaggtgccagattctctacttctattaaatactaataattgcacgtgcatatagttcattttccccagtccaagaaggtaataaaatatcaacctcactcaattatatagtgctggtagcaacataaaaaaagaaaagaaaatgagtattacatttcagaaactgactaaagaaagaaagccatatttttccttacatgaaagagagagttagttatttgattatttcagacaagctatttttgaagtttcaaattgaaagattatcttatatatgtcctttctttaataaagaatttttggtattttagtaactgatctcaaatgctgggaaagattgaaggcgggaggagaaagggatgacagaggatcagatgattggatggtatcgctaacttaatggacatgagtttgagtaaactccgggagttggtgatggacagggaggcttggcgtgctgcagtccatggggtcgcaaagagttggccacgattgagagactgaactgaactgaactgaagcagctgtttattgtgcttaatatcaccattaattttttatcatagtacatgtatatgcagaggacaattcatatatttaataactcttaatgttttattcctgaaccattcaagatcctcacattaaaatttaactagtttgggtattgctttgtttctcattttagacaatgattaagctcatttggcagtttcagtcagatgcttttcccaaataagcaaaggctttatcttatgggtactagatatttgtctgttggaaatgtgggtattgggtacttgatagagctatttaatactctcctgttattaggcaatgcttgcattctgttttcttcctgcctaagtgacatatgaccctaggtgtatcttactatggatcacatcagtggcaaagaggtattgtcttctttaggaaaaaaacaaaaaagattgcttttcttgccaaaaaaactaagacccactttctatgaccacttttgaaaatctattccatagaacttttactccatgttgaaaatgagtgatacaacctaagctcattcttataaatgtatgggaaaaaagggaaagtagacatttacaacataagccaagcccccagatacggtttgttgaaactgttctggaactacaatttgagaaagaatcctctttgttcccctactttgtagaatcaagctaaaagccgtatgtggtaggtcttcatgtctctatttttatgggtggagagcatgagcctcaaattttaaataacttttctaaggtttcaat

SEQ ID NO: 49252 - DNA, 679 bp, Bovine  19866880993466
agtcagctgtttgcatcaagtgacaaaatactggagcttcagtttatatattgtagtatagtatataaactgaagctccagtatcttgtcacctaaacccctaatttatctttctccccatttcccctttggtaaccgtaagtttattttgtctgttggtcctgatttataaattctctatgaactattctttcaattaaatgaatatagaaatgcctagatatgatttggaaagcactttctaatgtctatgtaaatatttgtctttttggaacagtcagtgtttcagacctgaatactggccatgctagtctgaatattgctgtgtatagaaaacttacaggtgcagatatgtgcccatcctgatgcttaaccaattctgatcttttttccttgaaataatcatcagcatagtatatgcatggtagagctaacacatttaaaacccaatagaaatgagtctttttgcagtttttcaactcagaagtgcaggtctcaactgcataaaaatgtaaaatattgctttaaattacagccctattttattgttacacagcccaagtgctgttctgcacataaaagaaagtctataattattataactgcttgtcatcatcagatactttataatcattacttgctatatgaattataaacatgttgatgaacagaacagtca

SEQ ID NO: 49253 - DNA, 1078 bp, Bovine  19866881012735
tattatacttagggcagactttatagattttttatgaaggtgggaatatttgaccatgaatacgaatcagacagaactagaggttgagagggtgatgtcctcatattaaccttggaacgatatgtgtcagatcattggtaaagagcagcaaaagtgtgaatagaagaaggttttagcgaagtatatgttgttttaacctgattccagaactcatttgatacaattcttacctttccagatcatactgaatgaaattaaatcctttttattcaccataagggataattattaatagaagtaaatcttaaacaatattttgaagggtgaactgatacataaactcagatcacttgaatttcagctacattttatttctttgctcttcaatatttttatggctgtgcttgagacatatctttcaagataccaatgtcaaatatttctctctttttaggagagaaagtagcagtaaaaatcataaacaatcagagaaaatataattcttgggaacaatatcctcagatacctttaaagatgaaatgttagatctataattgttacttggttatcagtgagtgaaaaggctaatgataaatttccttacttgcatggtttaactatagacatatcaggttttattaagaatttagaaagaaaaacatagtatgagagaaatttttataacaaatttattctaattccaagaaaacacaaccaaatcctgaaattttcatatctgttatagcggaaatagaaacttttgcattatttatatcttgcctttgataatttgaaaagtctggtgcaatcaaaattaaagtgacttaacttactggagttaagccacgaaaagagttttgaatttaaaaattctttattttgagaatcataagaaagtaactttgccaagatagaaaatagtataaaatattatacttacaatctagttgtttatagcgatgagaaatcaaaacaccttttgttttgtcaacatttagagctaggtactctactgaaccaggccaaatttttgtactcgaaacacaccatttttaggacctgctccatatatataatc

SEQ ID NO: 49254 - DNA, 839 bp, Bovine  19866881269262
atccactgagcaactcagaaaggaatgtatattgaatagctgagaatactaaacctcacattataataaatgacttgtcccaaagcccacagctcttaaactgcaaaaccaggtcttgaattcatataatctcattaatacttatactataaaccatactgaaataatcccttcaagaaaagttctctactgcttccttctttcgccactttataccaaaatcttagttttatggactaaatgactaaaattgcatacatgtcaaaagttgggctaaagtgaactcaaggaaaacacagttgcctttataaaaccctgtagctgtagaaggtctaacctcagagggaaaaatattatattcatgtaaggagtgtaatttatactcagagataaatatggataaaaaattcaaagtcttcagtgaaaggatttgttatttctgaactgtgtgaacttaaaaaaaataatttggcatacattctaatttgaggaaaacaatttggcttattaaaaaaaatatgggggtctgtctctctctctctctcagtgcagaatgtgtcccttacttgacttacagttcaaccaggtgctatgtatcagtaaatgatcatatcagcctttatctcatcattcctcattggctgcctagtcagcaaggtattgatttgttttttaagattctgcttacagtacatgattgtttacttggcttactcccaaatgtctttaaaaaccttaatagtgcacttccatgttagatggctttattcaccttttaataagcctgcttgccttctatattaatactgcatctgcttccagatacatatttctcagag

SEQ ID NO: 49255 - DNA, 768 bp, Bovine  19866882021105
tcaccagttaattaaaggcacacatctgagaggcataattaaaattctgcatgtagaaatgagtttttcctcattccttaaggtttttgtaatgaagaaaactaaaactaaaaatatatgagttgtatccatataggaaggtactacaaaatgaaatagattgacattgactatatgaacaaaggtccatgtagttcatttctgtgacctgctcataggaagatacatttaagataaagtttgccttggcagagcaatggaaaatagagtaaagcattgacttattcagtcatttttttatggaaaatagagaataatttatgaaattatattttcaacactgctacaggagggtatttatattatgtgcacaattaatcttcatgtttatgaatattaattctctaagatatgttcacactatgtgatattttcttactgttacaggtctgttatttagattttgagtgtttatatcaaaatgaataaaggttttctacacagtcaatttagacgaatagagcaagaaattttgtaaatttggggcaatattctcaaatactcccactcataaaagtttagaattatgcctaaagggaggcaattctaatttggaaaatgtgaaaatgtataaaattggctagatgaagaggtaattgtgcaattttctatggtaagaaatacattggtattgagctatttaaatgaattcaacaagaagaatgcagaggccctctttgtggtgctctctgtcaccacatctatata

SEQ ID NO: 49256 - DNA, 1973 bp, Bovine  19866880663569
ggactgaggaatagatttggagagaactataggatttaaacataagattgaaagcagcattgggaaaaagcttatatattgcagagtgatagctagtgatgagagaaagccggagagaagcctcagggatttcttctgtttttttccttttctaaaatacatcattttccaaccacaaagtgtgtatgctgtgctcagtcactcagtcatgtccagctctttttgaccctttggattgtagccagccagcctccgtgtaagagtactggagtgggttgcaatttcctcctccaggggatccttctgacccagggattaaacctgcatgtcctgtatctcctgcgttgtaggtggattctttacctgatgagttatcggggaaggcccccaatcacaaagtagattttcttatcaccgtgatttgtaacttcattctgtgtttcagctgagaagtccgtttctcagaggttctgaggatgcttttatgagtattttttaatttacaaaacttcttcataaggacttccctggtggttcagtggtaaagaacctgcctaccaatgcaggggactcaggttcgatccctgtcgtaggaagactccacatggttcagagctgcaactactgggcctgtgcattctagggcctgtgctccataacaagagaagccaccacaatgagaagcctgcataccacagctagagagtagcccctgcttgccacagctagagcaatctgcccactcccagcaacaaagatctcaagtagaaaaaaaaaaaaaaaatacttcttcatagaaaaactagaaaataaagataagcgtaaaattaaaaccaaaaaaccatccatgatctagccggtattgttaatggtaaccagtgttaacacgtgaatgagtattcagcttttcaacctgtaagcatctcttccaaccccagcatgcacatggcttggattatgtattcaataaataataatggaaacagcattctccttggtattttctttgagtggctttaagtgctgtgctgaaatgtttaattctaattgtctaaactttcaataccaaagaataaatagcaattgccttctctgtagctctgtggcagcttgtcaaagccatgttgctgtgggtggtatgaaatgcagaactttcataggaaaatgatactgtttctcagaaaaactcatgacctgtgctatccttgtggtcatcgaggatgcggtgggtgtgtgactcatagatcaggccccagggtgggtttggcaaaggcccccttgccctctgccttgtgagtgacacttgcagagatctgtcctggtttttgtttggctgtagtatcgatacttcatttatcccgtctttagaggtgggaactcgaaattcctttcttcaagatacttcatgaaagaatgtctgcttcattgattctatacatgctgaggaaatgtgtgctctaactagaaattctgtttatctattgtttcctacttaggcagcaataaggaaagaactaaatgaatttaaaagcacagaaatggaagttcatgaagagagtcgacagtttaccaggtaggtgaacaagatgcagttgtgcaaattaaaaatgagtaagatggtaaattttatgttacatgtatttcatcacaatttaaattttttaaaaatatagtttagcacaacaccatctagtgaacatttctgaaattaagtccttttttgtttgtttgttttcttccaaagaagtctaagtcattctagagggctgtgttttggtttctttcttagttttatattctggtccaaaaaacaagcatcagcatcatttattctgctcttaaagagactcagttgaagttttatgcccagaacagatgctggtgaaagttagtgtgggcacagacatgtctactttggactcacagtagacatagcttagaaagggtagaagctcagtttttagaaggcatag

SEQ ID NO: 49257 - DNA, 2247 bp, Bovine  19866880691359
ctgatttcccaaacataacgctgcaactcaattgccttttgccaagtaacataacttgaagcacaagctggaatcaagattgctgggagaaatatcaacaacctcagatatgcagatgacaccacccttatggcagaaagtgaagaagaactgaagagcctcttgatgaaagtgaaaagaggaaagtgaaaaactaggcttaaaactcaacattcagaaaactaagattatggcatccggtcctatcacttcatggcaaatagatggggaaacaatggaaacagtgacagactttactttcttgggctccaaaatcactgcagatggtgactgtagccatagaattaaaagacgcttgctccttggaagaaaagttatgaccaacctagatagcatattcaaaagcagaggcattactttgccaacaaaggtctgtctagtcaaagctatggttttccagtagtcacgtattgatgtgagagttgggctataaagaaagctgagcgccaaagaattgatgcttttgaactgtggtgttggagaagactcttgagagtcccttggactgcaaggagatccaaccagtccatactaaaggaagtcagtcctcaatgttcattggaaggactgatgctgaagctgaaattccaatactttggccacctgatgtgaagaactgactcatttgaaaagaccctgatgctgggaaagattaaaggtgggagaaggggatgacagaggatgagatggttggatggcatcaccaatgcaatggacatgagtttgaataaactcggggagttggtgatggacagggaagcctggcatgctgcagttcatggtgtctcaaagagtcggacatgactgaactgaataaaagattggactagatgtagattaagcaacatctaactgtcatctgtgccctggttagccatgagtaagatggtgcccagaaaatagatatgaagtaactgtatgcagaagttcaaaacaatgagtggataacagtgatttatgatcttcctaggatttaagcaaccaattcagagaaaagttgtgccaataccagagatgaggacgttacctctggtttaggtaggaaaagactaattttgttttgaaatttgaagagtgggagttgtgagaccaggattgaatcctccaaacctcacttaactagtctcaggcagtcatgccatttaacctttcttagcttgtgtttgactaaaacatgctgacaactcatggagtcgataggattaagtgaagtgatatactagattaagttttgtgaagtattacagagaagttgcttttgacatgatggggatatacatgttcaaaattggtaactggagtataagtgagacaatgcagaatatggttgtgttagtagaactgccgtaacaaattaccacatattaccactgggtggcttaaaacaacggggatgtgttctgtcacaagaagtccgaaagcaagcttttggaaggttgttccttttcggggcctcaggaagaatctttttatgcctgtctcctaatttctggtagttgccagcaatccttagttttctgttgcctgtaggcatagcactccagtcttcctccatcttcatatgcctttctccctgtgtgtcttattgtctttgcgtggcctccttataaggacacaccatcatccagtatcatctcatgtcaactcattacatctatgaggaacctgtttccaaccaggtcactttctgaactggatggacgtgaattcggggggcacttcaactcttagtagttcaaaagtatttctaaataaatctaaccattgcataatttatttttcaagaccagtggaattaagttgccttcctcagtgtttgcatcagagtttgaggaagatgttggattgttaaataaagcagctcctgtttcaggtatgtataattttaacttcaggtggacagagctgtattttacaaaaagcaacatatagtaacgatacaaagtttttctgtacctgattaagtgttggaacaattgagatgtgtttgaattcagattagagatcattaaattaggaagggtaacagtgatcagtgtctctttattgtcatcaaattcttaatctttaaagttcctatttggagagaaaagtgggaagattatttttggtgatctagtaggggaattttagccttgacctaacctctcacaaaggaaacagggtaactcaggagccttacattcg

SEQ ID NO: 49258 - DNA, 1863 bp, Bovine  19866880697621
ctttaggtcctttgtttgttaacaaaccttacaatatagctggttaatggggaggaatgtgaacctctctaagtagctgtcctggcaatccacatgtgtggtccatccccagcccaacccgggcggggcttcagtgcgctggtctgtgctcctgttgccccgggggccaggcaccttccttacaataaggcccaatttcccgccacatgcttgctgctccttcccagtagcctagagcgatgcctcactgccctccctgcctgccgagcgaactgccccatccaggctgcctgggctttgtcccactcagctgcagagacacacagggcctaggctgttctccacctctgtcttcggcccatggactcaccacctaatacttggcagtcagattccaggatctagctggttatcatacagtctattgcaccatgaccagaagatataatggcaaggacctcacctccccgcccccgccccaccaactaatcagaactgcctttctcagttcccagtagatatgttagccacgttgggacggatttcaatttctcggccaataaatcaaaaattatttagtaagacaattctatttcaaacagaaccaaaataacctttagtaaaacaatattacattttcagttgaattcaaaatcctcttatgctcctttgtctactaatgtccatctaacagccctgtgagataggctagaaagacatctttatccccacttaataggtgcggaaactgaggtccagagactaaagttctttgtgcataggtactaagaaaaagatatgacagggaatgtactagaccaagcgaagtacccaatgcacagggttaacttcccttcacgtcatgactgctgacaacacggtgacaaaaggcctaacccgggtgttttgaactaagcggaacattccccacttccaccttgccgttgcccccggctaagctgtctacacagcctctgactctggcagtagcttttacagcagtatttcccaacaaagcctaggaagctggagctggagtccctagggcaacttgtacgtgactagcatctttcttaggcttatcagtcaacatcttccacagatgggaagcaacctttacacctcttcttagtgtacacaagtcgggagtagagatagggcagctttaaagcttttgaactgatgggttgacagcagaaaattccagagatttgcaggtattatcagggctgtgggtgggggacaacagaggatatgagaagttgctaattgcaggatctgattccctgaaacacagaggatcctaatgctttgtaaaaagaaaaggttaaaacaatgccattctaaggtacttcacagtttgagggggaaaggtatttagcctttttgaagtgccttgaacctcctgcacatccttgacttatttgactatgtgcttccaagcagttactaatacacagtctcagatagaaataatttttaaaagcaatcatggcttgcgtacctactcggtgacaggaaacgtcagctccaaggcagtcagggagtcctctcagaaggtttgaggcttcaaacctgtaagaagagatcttgcacaccttcagtgagtgaagcgagaaaaacaccccccacagccgccgccatgaggcaacttgagcgtgcttacttcaaaagcacacatgagtgcgcacacacaactgtgaatgtacagaggacattttccactgctttttaggtattttaatagatgatagatcaatttcaaattttaaaatcctagggtataatacttcaatagacccaccacccttaattttaaaatgtcgcagatacaccacatgggtaaaagtcttaaacattgag

SEQ ID NO: 49259 - DNA, 1819 bp, Bovine  19866880848087
ttgtttttagaaaaagtaaatgcttttctagctataattttaaatggataaaaaaagagacctttagtctctatgtttaatattcattaacagttctggtcataaatttttccacttctttttcttcctttaaaaggtgtccaaataaaggttaccaaaccagtgcagtggcccgtcccataatggtgatagcccaacactgagttttcagtgggacatgtaatttctctgccttttccaggaagataagagaggaggcagactttgatactgcaagtccaccttcaagcacaaaaatgttaaggatgtacattttttatttctaaaagccctaggcagaaaatgaatagcttcaaggctaacagaaaattaggggatacttaaaagttcattcacaaaatggagtgaaagtgaaagtcactcagttgtgtctgactctttgcaaccccatggtatagtccaaggaattctccaggccacaatactgcagtgggtagctgttcccttctccagggaatcttccaaacccaggaatcaaacccaggtctcccatattacaggcggattctttactgtccgagtccaaaatagagtgagagaggtataataagtaaaatgcctaaaattttgagggctcaagaaaaataccattatttattcaggacttccctgttttctttaaagcaggaataaaatagtaaagcatctcttagcttcttctagaatattcagatgttgaatatcatgtcatttggatttatgaatagtgaataccaaaagacattaagctctttgcaaggaacatattttaggaaaagaggagtactattgttttgattctaaattaatagcactttatttgtgcccacaaaagcacaataataatatttttacctcagtaagcattcaggggatgaggtgaggaaggcatgaggtaaaccaacatgttgcaacaaaaatttcatgagttttatagtagtgggagcaatgaagattattcactatttggagaaataaccaatcttggtatcttcttttgagggtctatctcagtttctatctaatccttgtctttttgagcaagattaccccttgggaggatagacggataaagggaagaagattagatgtaggggataaaatacttggaaataataattgttagtgacaaggtgagacagatttgaagaaatgaaaagagaacaaagctgggaaaattacttgagagatgcataaagcagactaacgtaatctgcccactcatgccttgttgaatgtacatgagtgtattatagagtataaaggacaagaggtccgtttatcgtgtcttttttcttttactggtagacttaagaaagaaaaaggcatgagttaaaacttagagctaaaactttgcatgtactcaaacaattgagttttcttgtagagacagactgaagttcaagaacagagcatgaatcaggtaaacatttgtatcttgtctgtatctcctgccacagagaagctctgttaggctttaggtttaggatgacatatggtgaaggactcaccaaaaaggtcattgaatttcttctttagaacaccttagatacccggcagcccacaaaggctgtctgaattaaagcaagattctcagattgtcataactttatctcccgaagaccatgatcatcttaaatttcaaaagaaaatgaaagaaagaaagatcaaagaatgaaggatcaaattactttaaatgtatgattaatttcctcaccttgatcaggcaattccttaagaactccccttcttatcagctcctctctactttgtcttgtag

SEQ ID NO: 49260 - DNA, 795 bp, Bovine  19866881017218
caagaccaaaaaagtatacaaaagaatgcatttttcaacatctacccatttcccattctcaataagtaacgattgctatgtgtatcttgtttatccttccagagattttaaaaatgaaagcacaaatatatatgatatacttatttaagtgcctacagatatatttgatatttaactccttataaaatttagatggtagtaaatgctcgctatagttctctgcttcgacttttttgtttactttttgttttattttcttagacatatcgtggtgatcatctcatatgaatacataaaaaacttcctcatccttttttatttttggtcttgttttaaacctgcataatatttcatcgtatgggtgtattatactctataaataagcatcctcttattgattatcaagtgtcttgtgtattcagagattatatttaagttttattactactgcagaaaaatacaaagttcaaattgaaattaactaaaatcacatctcctttggtgaaataattattttagatatcctttttctctaagcaaattttaaaatatcaaaaggattttctgtatgtccaggtgttgatatcatgtttcacactaggggtcgccaaaacagtattcaaagccaacaaacaagccagtagttcagttcagtcgatcagtgtgtctgactctttgcaaccccatggactgcagcacaccaggcctccctgcccatcaccaactcccggagcttgcccaaactcgtatccatcgagttggtgatgccatccaaccatcgtatcctctgtcgtc

SEQ ID NO: 49261 - DNA, 2098 bp, Bovine  19866881097604
tatttatattataatccttgtcctacttgtaagtggattagaaaaacccctgatgtttctccctgctttttgcaagtagagaaaacacatgaaattgcttacataaaatattcaaaagagcactcagaggaaatggcattttttttaaaccaacagtattagaataccataaaacaggtatgcaaatccatgcaataacagagcctaaagcaaattatgaattgaaaagagcaacaaccaataggtactcattttcaacaaaagcttcatataaaaagcttcctatcttcatacagatttatcaaatgtgcagggtgaaaaggctgaagtctgcaatttgcatacatgattcagtggttaccaaacccgactacgttagaattaccggggcaatcttttagaaatacacactcccaggccacagcacaaactaaacacaggctcacagcacctctggggccccgggaacttaggcttccgtgaagtctccagaaaaagtctacagccagcttcacaccacggtccctggtgagcactgggaaacaggtatctctgttccccaattaattataaaagtcggcttcttccagccaagactattccagccagttgatactcttaggggcaaagctttttgggattttctttaccagtacaaaggtaaacctattacgtaacagccaattatatctcacctacgggatttattcactgggttgcctgttttcttaatttgatcaaaaaggcaatgtccatttattatgagcaacctccttataagttacaaatggaaaaatgagggccattttcagacaacaaaagtctaaaaataagccaccacaatttagggaaaaagctagaggcgagtaggttctctgaatcatccagagtatttgtttcaaatgtattccttgctttgcatgtataaacatgtcacaaatcatcttcatggtccatctctcatctcaaaatgctcagcatttattgtggtggtttaattgggtggtctccaaaggcctatattaattattttaaaagcttgaaaacaacatgaaagcaagagagcagaattcttctggatgattcctcctttgctcctacccatctcacccacggacaatgccaatttatgaattcagagaggcaggggctctctccggcttcactagaaagggcgcccatgacacgaagtacgcaaaccaggcagcggagtagcttagctgcattgtcaaaatattcaaattatcactaaaagaaagcgattcctttctgaattcaacaatgccccccggcctccgagggctcacacaggagcttattcttaagctgttcaatgtaagtagcaccagtgaaagcggagaactctggcagggaggagatcaagtccctcggcctttcccccctgccatctcagaccgggtctaatgcttaaatagttaacaatgcaacagagaacccgaaagcatgcgttgccccggggaaaaaccatgtgcagtctacaacaatttaataaagcgcagcagagacaggaaaaatatcacgtagacatttgacagtacaccacttgcaggctggttctcacgtctgaattttagatgtcaaaaatcagagaaaaagcttctaataggtgggttctatttaaaataaaagaatacagtttttttaatgaaccggtaacataaaatatttctaagtatactcatttctgagctccagagaagcaggaaaaatcacatttttctagaaaatgggatggatgcacagtaaacagatcatgtatggtgaattgtcttaaataaaggggagatattcagggggaagtgatttgtttattcagcaatgacaaaaactaaagtttcctgaatctagagcgttcggatttctagaatgcatttttggctgtcacagtctgtttttctaggcattagctgctgagggctgcgtttgagaaacacggcttcttctctgttaatgaactggtttagctgcctgctgagcattcactgaaacccgaattgaacaaagggatttccctccagtttcagctcattcacttcaagctactcccgatttcacttaagtaaattcttcaaacgac

SEQ ID NO: 49262 - DNA, 1149 bp, Bovine  19866881280037
agcttattgagagggagaataaaaagggaggtgttgtctcagtttggaagggctgttaacagcacagctgaaatgtgtttctattttaaacataatcagctttaaaaaatgtgttatacccttaaccagaagagacccggatgggttctctgaaaatagctttctttgtttgcctggggatgagctgcatgccatcccctcgcagcaggccctgcccaagtgaggattctcacttggaggaacaggttatctttgtaccggagttgccatggaaatgtggagggatctgtggcaaggtaaaagggagggcacaaaggaactcccaaggaacctttcggtccttcttccgtgttaatatggctcttctgctaccgccactcagtagggtgggcagtggcgtggggatgttggagttccatgtttaaaacatttggtgcctgccagtgcctgtttttcttctctgtgcatgtatttaaaaacaaaatcatcttcgagtataatgaaaagcccaaatgttccataactatccttattgacattaagtgatttcttatgtctccacataactgatcgaacaggattaacacatcaccactcccccaaagggcttgattgtggaacaaaagccccaaaacccagacatggttttgagccccagcaggaaggacaggagccaggttactgaggtgcagggtgtgtgggtccccctcccctgggcgtcacaggtcctggacatgaccaccctgctgctggtgcatgggaggccacattacctcctgtatgcttcccgagctgacagagctcttccctttctccctcccccatcccccacctccccgctggtctccctctccctctgtctccttctccagggtagagctcaaatgagtccaaaaaaggaactgactgtaaccagtgctgtgggagctctgctacagaacagggccctggaggccagtgcagcgccaaccaggccaggtgagttggaatgagcatctcaactatcgaatgacggggtcagaggagaccactgttggcttcgggatttgctggcggtcagcaaaaactatgacatccaaagttgctttgggatataaagatatgtgagtttgtttgagatttagagcttattggcaggaaaggatattt

SEQ ID NO: 49263 - DNA, 884 bp, Bovine  19866881340447
catgttgcctgtggaacatttgtaaaggaaatgcctgggaggtgtttgaaaattcaggtatagaaagtacatttggagtccccagcaggaagtgaagagaagccaaagctaatagtgactacatgatggtgttttccattttgtaatgacaaatcaggtgtaaccaaatcctttatgaaacatctcactttgttcaatataggttagaacatgaccctcaagatagtgatgttttgtgtattgattgctctgtatctcagatgataaaaccagcatcttttgcagagctgtctctgttttcccacatgacatttataacgattttctgttaaagcagtaatttattaagagaacagtaattcagttggggatgctagagctgcctttgatcataaaaatgactgtaccatattcacgtcactgaatagagttgtgtttctctaccacatcacagagtttctgttttgtatttcaggtttcatcgtccataatgaagcatgagactcttgggaaacagactgatcatcttgaggggaagcctcgcttcctgaaaacctgatattgcactgggatttgaatgtgtgtgtttctgtttaacttgtggtgaaggaagcatgtggaaagtactccccacttgtacagcccgggtgggccagcaagcaaaggggatggttcagcatcccggctgttcagcgaccctgctgtccagcatgtggactgatggtaagggacaccatgtttatgccagttattcttcatcaggagttttaatcaaagaagatgagcagaagacaatcgctgttgccagaaagccacatttgagagtgtgggttaaagaatggggaatggaatttctgagcactggaaagggttgcgggggtggg

SEQ ID NO: 49264 - DNA, 1349 bp, Bovine  19866881573676
acattcaaaaaaaaaaattctagcaaaatctaaagttgccagaatcgcttctatatgtcatttgtgtagcttcatgatatgtgtaagaccagttcatgctaggtccagttgtaattgttttctccagttaaacgtgacattgccgttaaaagcccagctaataataatatgctgcttaagaatttagaagtctttagactacatgacatacaaaactttgaagcaggagagaaataattagaaatttcttttacaagaacatgttagaaaagaattgtgtcatggtggtccaaatcaaagaaagattattgaactgaatcaaaaccttacattcttgctgtttagacgtattgtatcctgacacagattattaatatttcctaattgtgagcgtatccagtgtgtaaaagcactcgtgatgcttattaacagggcacatctactttgtacataaacttcagactctgccccagtcaccgtgcctctgtgtgtgcatctgtaacgcatcgtctcgtaacagctctgccaggtagagagatgtcagcataaagagaagttagggaacttgcctgaggttacatacctggcaagtagcagagccagagtttggacccagagccatctgattccatagccagtcttttctgcacccaccaatccatcgttcctagactgtctagaaatactatcatttggttcatgttttttaactaactgtaggaaccacaacctgtattaggtagagtatgcttttagtaaaagaataagggagaggaaaactcatcgtcatacaccacgtttaggtaaggaaagttgctgtctaagaaatagtattaactttttattttttttttttcactttcttgactccccaaaaagaaagtagtcaaggcctgaggggagctgagggcaggggcataatataggagagtattaaatattattgttaaaacgaataaataaagcacatttctctatcagtgtgtttaaaatagagctagcagttatgtgtgtttatactataacaaagtgtactttatttggggaataacttaattgatccattatgtggcattaccaaggtaattttttcctttttgtttgagcacaggaattaaaagtgattcataaaaacacacacacttacaaccagcatgtaaattagaaccacattagggtgatcatcatcttttgttgttttcctaaaatggttccagtttgccctgtatattcaacttaaagtacgcaaaagtgttgcaagttccgactcaggagagatttagagctccctgtgaacacccagttttacagagaagcttcagtgttcaattactgcagttagtcttttt

SEQ ID NO: 49265 - DNA, 803 bp, Bovine  19866882075622
acagaaggggcgggggtgggaggtgctggagtaccgggggcggagggactgaggacttgggtttgcctgtggtctgctcctcggtcccagggacagtctgctcgggtgtgagactctccaccctggtctccgaaggctcccctttaaggtcagatgtgccagaagtggttgcctctgaggacagtcgagacattggctgcttgccagttttcttcttgccctttatgactcccactgtcccagttttgctagaaactgtctccttggaagctttgggacgagatgaggtggaggaagtagacggtgaagctgatgctttggagccagttgtttttcttgaatgagaggaaccagctgaagcagagagattttgcattaagagtccaagaagaaaacacattttaaaaacaaataaccaagttgcaattgccagtgacactgttccctttaaactctaaaactctgaataaatgcattaaggaaaataggtaaatgataatggtcttgttttctgccccctccctgccccaacctagaaggcagcaagtcatgcttgaggccaaaccctaaggtacaaggtcttctccctcctccagtctttagctgagccaaagagaatgcctcacctctttgccctatggtcacctgaaaaagtctctgtatgctccaaagaagggacattatagtgtggagaggacaagacaccagcagctacccgggtatagtacaagcttcctctcatcacaaactatacacattttatgatgcctttctgggaacagagcagcacacactcagaagag

SEQ ID NO: 49266 - DNA, 1259 bp, Bovine  19866880067208
cattcagttcagttcagttcagttcagtcgctcagtcatgtctgactctttgtgaccccatgaatcacagcatgccaggcctccctgttcatcatcaacacccggagttcactgagactcatgtccatcaagtcagtgatgccatccagccatctcatcctctgtcgtccccttctcctcctgcccccaatccctcccagcatcagagtcttttccaacgagtcaactcttcgcatgaggtggccaaagtactggagtttcagctttagcaacattccctccaaagaaatcccagggctgatctccttcagaatggactggttggatctccttgcagtccaagggactctcaagagtctcctccaacaccacagttcaaaagcatcaattcttcggcgttcagccttcttcacagtccaactctcacatccatacatgaccacaggaaaaaccatagccttgactagacgaaactttgttggcaaagtaatgtctctgtttttgaatatgctatctagattggtcacaactttccttccaaggagtaagcatcttttaatttcatggcttcagtcaaaaaaaggtgtcgtttttgaactatattatttatcatatacacgtagaaaaggaaaacatacttctgttcagagctaaaaaaattccaatttcataaaaaaggaaacttacatatacattttatattaaatttacaaacattgtttcattatttattacattcttcccactaaattggcctgctaacttgtgaattccaaagaacaattattttaacattagcaaacatgcaaaactttattataaaggggaaaaaaaacaagaataaatgtagtaaatttatattagtgaattttttaatatgaacaatgtggcatctgtaaaattattttttaaaaatcaagtaagagatgttttttgggctgatgtacttcagcccaagtgtatctcaattttattactatccttacatactactatatatttcccaagagttgaaatcatttcagtatttaattgcctgacaattatttctgttacatcaattttgtggttaaactaattatttatattatcaaaacaaatcagcactcaaggctaattaaactggagaaaccaacctcccaatgtttcccagcctacatattaatcaggtttaggttaacactaactttagaagaaatgaacatatctttcaggtgataattttataggcagaacttagaaatttaaacaagatttaa

SEQ ID NO: 49267 - DNA, 1584 bp, Bovine  19866880728914
taggagaagattaaggtgtttaagaggcaaaaatgttattacggaataagtaataatatgaggaacacttttgaaaagaaatcaatatatcaccctcagcctgttggaaatgcaaagaacttcagaagggaatattaggaatctttttatcattgtgcactttctccatctcttcttaaaattagtaaaacctgtcacttagtaacattcacttgctacacaatttacaaaaattggataagataatatggagaaggaaaatgcaaaatgatacaagatgataacaactcagataaaaacatatgtatcagaaaggaggcaactaacatagggatacatgtagcacatgcctctttcacctacgttgccctgctctaagaattcttcctagggatttgtggcatggaaaatcgctagaatccccttgatgtcctctattaaaaaaaaaattaaaatcaaaaactttctgtcaatgaaatctaccatccaggtatcacatcaggtatattcatattgtatgtagttgttcaaaggaaaacaaagagataaacaatttaaaaactgtaatcactaccaaagcagtgcatttgtgattagagactataccactgaggaaagcatttatacacagcagaaaatacaattttaaatgtgtagactgttaattggctaagattttctccattgctgacaaatgatataaatagatttttggagaattaagtgttaggaaacaaatgctttaccttactcaagattgatcacctgtgaaaaagacagtcaatacctctgagttactcaactccactttgaagtacttaatggccaaaaaaaaaaaaaaaaaaatcattttgaagctgtggatcaggctttcaagttcatcctatcaaaacttttggactcccagttttagatttttgaaatttatggagtaggccaacataaatctccctgtaaaaaaattaacccccagatcatgcttttaagcagttgaggtttggttgattataaattgtcctgactgagacaacaatctcagttctttagattccattaatacatgtctgacactttctataaactcagttttgttcagacctgaattgactgaaggagacaagtcgaacaacagtaatgtcaagcactgacaaacaggactgggctggtggaagagagagaagtgtgacatagctgagaagtccctgctgtctccaagcacaaactgagcatctccaaactccgatgtctaattgtcccaattactggtttgcacatgcagaaatattctatgttaaagaagagtaaaaataaatctgaaaaacatgaacgtgtcacagcttgatggacaagtcattattcaaaagttttattaccctagaagaagtggagatgctattaaaataagacaacatcttctagtaaataacagctatttacacttttctgtgtcttcatctcataaatatcattccactctaagataacaatagtctactgctttctactgtgataatagacaatatttgaggacttacaagttttctgaattcttcatttggtagcatagaaaattctcagtcaatt

SEQ ID NO: 49268 - DNA, 1668 bp, Bovine  19866880763116
agatatcatttagcagatgggaatcggagtaattgctaccagaatcatcatcagctatagcccctacagtctaagatctgtgaccagaattctttctggctgaataaattaacatgctattttcttttcctttaaagctaggatgacatttcaactaaactatactgaaaatgactttccaaatcaagcgatctccccacatatatatattctttttatcatgacctgaaagcagattgatagccataaatcagattgcttttctaccagggtttggtatggcttaactgaaataaatgtattcaaaagtaaaattgaccacttcatagagacaagcagaaaaatctattatttttaaatgatcattttaatcctgggctttatgtatttttcaaataggtcagtaggattgagtattaatttgcatttctcttccactacttagttatgtgctttgagaaagtaagtaatggaagttaaataatgaaaacaggtatgctaaaattgggcaagaaagtgttatagtactgtaagtagtatgccaattacgaaattgttttattttcttgagatgaaatgatggtctattagatttaataattcaagggaattttttttaattgaatctcttctaaaattataatcctgtcttagttttctattatatatatatatatatatatttaatatattctataattaacgactgtcatagtcacttaagttcactgaaataggggtttcccaatatattaatactatatatacctgagatgccaatacaatcaatctgcagtaggatctaggaatccaggaatctgagttttgaaaatgctctccagctgtttcttatgaaggtagctgaatgcctattaatagactgatagtggaaccactattttaccagactgtggtaaaagttctaacagacatttctgatagggcataaaataaagagctaagatactacaggattcttagaagattttgcattatgtaattttcagatgttcattttctgcttgatctacttaacttccctcaagtgtcattctagtatcctctacctgtgcaggtgaatttgcctgccccccaagttttcctcagtaaaaagattaaatagaagttggctgaagtagacatattctgagtcaaaattttaaaacaaattaaactctacctctgttttgtgaactttttatcaggattatattgcactatcaaaactcttaatatgtagaactcaattcattataaatcttagctattgttgaaacatgtcctttctggcagggtgctgaggaaaagaacaatgcctgactttaccaataaggataggaatgtacctgggtgtctgaaagatatatactattaattttagacttaaaaacaccattttaagttaatttaatatgtaaagttatcctctttttttttggcctgcaagcatggatatgtgactttacttgcatatttgcaatgttaagattatatggttttgtgattttatatggatgcatattcagtcctttcaaacgtaaaagtgggaactttttttttaattttttttaaattttattttatttttaaactttacataattgtattagttttgccaaatatcaaaatgaatccgccacaggtatacatgtgttccccatcctgaac

SEQ ID NO: 49269 - DNA, 1007 bp, Bovine  19866880767195
tgacctatatcattttataaagagaaaatacaaattttatgtatcatttctaaatgggagttaccatgggcataacatttgatttaaaaatactacttcttggacacagaagttgctcattggtcagaatatttaggctctattgcactcttacaaccaaagctattgacatgtttgtgtttttatatgctacagcaatttttaagattgtcaagagttgaaaaatgatacttttccaaatgcatgactctttcagagatattgatgttcttttaactgatctgtgagtaagtctggaaaagaaattggtttcccttaaattccatttttaatggttaaggcagctacccagcgcttctcacagttccaaggttttgaacattagctatctatctgctgatagaattttgtacttcagttaactgtgtttaagccagcatgagagtaggacaaaggagcgatagggatagttgaaaagcagatttgagaagagtgtttaaatggtagaatatttattataaaatctgtctccatttatcatagttctgagagtccttgattgtcatcattctgccattacgtatccttctatctctgaaagaaattccaattctaagcctccattcaagaaaaaccatattttgtacctaacctttagtaaccttagtgtttttctctgcacgaatcttgtccatatactgttatttaagagtgattcttgtgaatgatttacagattaaaacatgatttctgtgcatactctgtatttacatgtttccttaaatctatgccagatacatctgacattatgggatgttatatgggatatgctgtatggggtttatatttttttctccttaattttaggtttggaaaaggcttcttgataaattctgaaatatgatttttggaataaaatctctctaaaggtcattcagaataaagttactacatgcagaagatagattttgagaaccaaggtaataagactaagtcgaattcaaaat

SEQ ID NO: 49270 - DNA, 1179 bp, Bovine  19866880776634
gctgtgacctttcccttgttatttgtcactaacaagcttaacagcggtgaggatgttagtgacaaatgtaagaaaataggtcatctttgctcattttgaatatagtaggtgcctcttttcttatatggttgtcaaattaaccgtgggaatatttttcaggtgtcaagtttacattgttaaattttgatgtatgcttgtttggctttatttagatgccaacgaacttagtgtttcttaaatttatttgtctctcttccaccagctttcattcaattaaattttagtatagagacatttaacgaagaatatactatagtctttgctgtcttttgtgaaatgtatgttatgtgttttctaaaatagccatcttttctatctttatgcagattatctcttttactgcctcactctcatttttttttctcacacatgtgcatgtacacacaaacccacacttgtgttatgatagaaaattgcaaatactcttcaacattaggacttttgaaattgatcttgaggatgtacatacattttctttatccttcatctcttctgtgaggatggtattatcttcattgtactatggcaaaaagatattttgtgagagaaatgggtttgattcctttttcttgatgaataagttttggagccaggatttgaatcttagttcctctggatccgcaggccatactcatcctattttcctccctacagaggtaaagggataagaaaaaatataatgggattaattttaaagaaatcattactagagaggctggttgctgagtattattcaaaattcaaaattttgagttacacatggagaatttattttaaaatatattggacacatcccagtaaaaccattttttttcctaattttatcagtgcttcctttatgacttaaggttgttctcctatttcaaagacacagaaagcagttgaaagtatatttcaaagaacctctggagtggaccagtaaaaggagaaactaaaatttttgcatttactcttaaaatgaaaggcacaagctttcttcactacatattcctcttctgatggcccccgatcccagctccctcgctttccaaagctaacacccttgattaagaggacatctgtgccaaagactgcttggaacttttccaatcacaaaattcacaggctctggctgctttt

SEQ ID NO: 49271 - DNA, 2146 bp, Bovine  19866880787105
atgtgttctgtggtagttagattctgatttaaaatgctcttgggggaataaagtcctggagagttaggtattgtatttgcactccactggtaaggatattgttcagtcacagtgactgcagtgaccgcagttgaaggatctctgaaaataaaaacgatgtttttaactcccttttttcttcctttggccactgctggtgccaccactagcatcctgctctttgtgcttgttgccttgcttatttgatagtagtggaagggcaagttttcttttgtgtcagacaggattttagtgtattagatgaagatagaactacaatttattacctactaattagaaagaaaccagaactgctgatacagtctggaaacaatgctttggctcccctttgagtggggcattcttgaaacctggaaagttcccaaagtgaaaattctcggtagagaaactttttgtgaactcattctttcgaaaatctttgagcaatttaggtgattttaggcactaaaaaggattcaaacagctgtcctccttaatccttattattactatttgatttgatttgccatttttcaagccagcaatgcccatagtgtaaataaatgtatttcacatacatgcaaatttttctcgaaatgtatttatatgtgtgtcagtcctattaaatattttattaactcaaataccacatttttatgcctaaaaaaaatgtgagggtaactgtagagaggggctttactttttaaaaatattttgacacaagggcttttccacaacttttctctcaaacacacttgtttgtacttgtcataatttacgtagtataaatttgaaagcgtataattacatggcaggaaatgatacgattattttagagggtctgcatgcattatagtggtacaactttaaagtcaatctctagactttaatttgggcctgaatgtctacttgaaaaacactgtcattatctctttccaagtgtctttatgaattagttgactaaattaagaaatgaaagcagcaataatcagtactatcaaactttctaaatatgttttattttctaataatttgaatatatatcacaaatatttcttatcgttagtgagactatgtatatgttaaatgtatcttaaagaaagtgaaagtattagtcactcagtgtccgactctttgtgaccccatggactgtaaccctccaggctcctctgtccatggaattctccagataagaatactggagtgagtagccattccctcctccaggggatcttcccaacccaggcatcaaacccaggtctcccgcacagcatgcaggcggaattttactgtctgagctaccagagtagtctttaaaaatgtggtagtgatagttatcaaaaataagcttgtattttagtactgccgatgcattaaaaattatttcaaacaacaccctttgccaaaagaaaatccttactgctttttgaagggtatttcagtaccattatttttgaagtgtgtttgtttaatgctgtaaagatatataaaagattactttgggaaagttcatggtattataaaacaagttatgttttcggtatagtgatctttctgaatagcacccctgtagatcagagtcgttttgtatttgtatgtgtgttttaaataactcaagaattctgtcattggtacgccaaataaccgtacaacaaatctgggtacacccctgggagtttccctcccatgtctacttccgttgcctcaaattgactcttcaacatctacccgtacaactggcttttgttcatggaggtgagtatacaaacattttaatatgaccttttctatgcaaaattatgaaaaagtggaagcagacaatgaaagatggggaagcttaatagtattttaagttgctctgagaaagtggaatggtattgaagtaatcgaaggtgatgcttcattatgaacatgtgttttggtgaaagtggtagtagtctgtaacgactgtaataactatgttattaaagatttgtgtttttctaatccttaagaaacacttaaacccagaggtgacttgggatgtaaaactgtgggtatttccaactaagtaggtaaataagccacgtggtgtgttgaaagagaattaatgtatatttgttttctt

SEQ ID NO: 49272 - DNA, 1443 bp, Bovine  19866880857844
atgcgctattcagacaacttgtctttcctttggcattttcctatacctatatcagaggtgataacaaactttgccctaatatctacttgaaatccaaagtctccaaacattttgtaaaaaaattattagtagtaaataacacagctatattgttttataattgacatataatttgcattaaaatttgcttttaaatgaatgaaaacatatctaaccaaccaagttttctaaaaccaggtgcctcatattgctcccggaagctccgcatgccacaaatacttcatcagaaggaagaattaaagttttgtgctcatgatagaaattactggcaagccggatgttttctctttgtaattagaagtatggtaatttatgaattctgtaaaacaggaaactatcatgtgaactgttttgtctaacctccagtaaatatttgaaatgcccctgaaactgacttgagaaatgccagatatttgagtacgtacatcttttcagttcccaggtgttcctgaaagagatttcccctgatgatacctggtaacttaagtagttattacttggcagcagacagtgcattaggaacaatgattggaatgctctaaccctggcaaaaataccctgagagcagtggctgtggtgaaattgagccctaggttaaatcttgaattgttactcaaaaaactacaagccaacttagagcccagtacataagatgctttattatgcaccatatcaattcgtgaaacatgtaaagatgaaaatcttaaggattttttttaagtatttaaaagtttgtagctggttaacagttttatttatatggcctttttattagctagactgtataacttagaaagttttgatgttatttggttcgtatatatttgggtagatctctaagtaattcacaaaactatggctctcttctttttatttttaaaaatggaaaaaagttgaagtagtggtatgaatttacctcttccaggtaaatgtggatgccagtccttgataagaaatctcttagtaacatattggctttcttaaacaaggcaacatgccacctgcattgtgtacacatgaccggaaaacattcagcgtacttctgtgtaataatgttctttaatgtatacttgcctgggagttttaaaagatatccatttggcaaaacatgcataatgcatacaacattgatttctttatatctcttttttaaaaaaatggattctgattcaattattggggagactattgcaaggctacaccttctagagatatctgttgcatattgcatatctgcataaattgcatatctgttgattgtaatttgaagtaattactaatgcaaatggtcacccaacagcaaagtatttaataattacttgtgtgaagaaatagagtcttggggagatgtttagcattggcaggatcagtaaactatttcaa

SEQ ID NO: 49273 - DNA, 3765 bp, Bovine  19866880885593
actgatgctgtagctgaagctccaatcctttggccacctgatgcgaagagctgactcactagaaaagaccctgatggtaagaaagactgagagcaataacagtggattagatggttggatggcatcaccgactcaatggacatgagtttgagcctactctgagaaatagtgaaggacagggaaggctggtgtgctacagtccatggggttgcaaagggtcagagacgactgagcaactgaaaaacaacagcattgtagacagaataaatatgtgtggaatgaaggaacaaatgaggtgaataaatgcttggcttgtctgtctcacttttcactgagttcttctgaactattattgtattggacacgtggtgggaattcaacaaattttgggtcaattaaaaattttgctaatttattgagactacttttccctgtcttaacttttcctttacattaaaaaaaattaaagttatagatatttagtgatttatacgtactgaaatagttttgcccctttatgtgatttctttctaaaattctgacctgaccctgacaaatttcacgtttctacttttttataagccttgaagcctccctgattaacacatagacagaaggctctgactgcaaacagatgtaagagaaattatcataaaatttgagatgtttccttattttgttcttctttattattttaaaagatatgttatccaatttataggattttagaaataaagtaatgggactaaaagtatgttgtttggccaggcataatattaagcactttataatgttccgaaataatttttaatcctccctttttataatacaggaaaataagtgtctgaaaatatcggtaatttgtctaaggtgaagtcatcagtatgttttacatctaagaaatttacttaagtctatttgattcctctaacagatgagttatttctttctgtgtaataactctagtgccttagaacagtcaacattcgatactttctacaattccatcatatgtgtcactgatggttctttcagtctaggctggattctagattctagctcatctctattgtcagttggtggcttgcctgactccgcacagcatagtataaacctcactcacaggcccagccgttggccatcgaccacagtgcgtcagttctttcttttttacatggactttccatcaggctggctcaggctgttcatgtgattatatcagaattccaagttcaaaaagagagcaagccccagtacatgcttttcaacttctgcctgcatcatgtttgagatctcattgacataaagaacacattaaactcggaatgattgtaattatgtcatatggcagagcctagaaaagaaaggagacactttctagtttttagaataaggtctgaattgtgtttttatccaaataatttcaattgcacatactcaagatacaattaaattcctggatgtataactgagaagacatccaatatactcatggaaggagactaaattttgataattatttgtttggagacatatataattactcaaaaatatgtttaatctattcatttacattttaataaaaatttacaaaacttatgctgacatactttcttagttaaatgatttggaccctaatttatttttctataatattgtatacttcattttcataaggattgtcatatgtttccaaaagtttatgaaaaatagtaattggggagtgaaaaccattctatagtcaaaacagttgttgattaaaatatatcccctatataaacgttttggttggtggtcagtcagtatgcttgagaacatagtataacatgaaaacctttcagtgctttatttctgatgtatacaatgtatttttgctataccaagtacagtaagagtagagttagaacaccatatattaaatagagcatcacttggccagtcaaatcaatgtttgaaagcagaacacaacttgatgtgaagaagacataaaagtcttagtacagcattatggagaaggaagacaaatgcttatttactgaaacttggaaacagattaccttattagtgaatagcatcacattatcagataactgttatattcacacaggtatattatctgtttctacttttactttttatattgttgatttatttggctttgctgggtcttagttgtcacatttgggctctttagtcacagcatgcaaaatcccctgacaagggatagaacccaggacccctaaattgggagcatagagtcttagccactggaccaccggggaagcacctgtttctacttttatattcaccatgcaactctttttgtatttaacaatgattgctttataattactgttaacttgtttcaactcattttaagcctgttaattttttctagtgagtctccaaaaattccagatctagaatgtgctttgaacttagaaagattaataaacatctttctatctggatctaaaaggataaattaggtaatgatcatttaatttacatatctctttgtcacaatattctttccaatagccatcctctgtcatattaaaatataaattggtttataaatgatgatttatacacttgcctaaagagtaatacaacttattgacatgaagactgaattgcaaacctcattaaatatcaatccatttttctcaaataggtgcagtgataattggataatatattatgatttttttctaaaatggtttatatgatatggtaactttgataatcaaggtagatgctatatcacaaaatatttatttcaactataacttggtctacagtacaatattgtttgaataattttacataaccacaggctgtgtcttttctaaataaagcacatatttgatagtacatcttcttgccagatcagatgacaagcaatattcaaatcacaaaatcctcttatataaacaggctgttactgtagtgccagattatgacttttcagttaccatatgtttctaaatgtttatttaggattttagaaacagtgtagccttttcctgaaagcaatcaaataaaataaacctttattttggtaatatttgaaagcacaaatgctagaaagtagatgaaaaatgatctttaaatctcagcttgatagaatagaattatagtattttgaccagagaaaaatgaaatgtacttgaaaaaacatttaggcacacaattaatataaaaaaataaaggtagtaagaacagtgtcaccagaagaacatttctgtttcttttatgaaagtgtcagtgtacagcaacgatactggaagcttcaaactgctttcattaaaaaaaacagttttcagagggctttcttttttctcaatgcataatataaaattgtcagagatatcttaagatctatgccatgttttctacaatgaaattaattaaaggaatagatcccagtgctcatgacagtgacctctttgaatcagggttatattcctattttgatcatatccgaagtacagaattctggaatagtataatctaactgtacttaagtttgaagcttgtttatgtacttggctttcttcttccatattgtatctagtactcagtagtttccatcattgttccttaaaaagaactccttacattttttttcttgcctaaattgtgaaacagttttatcaccattaatcactgtatcttaaagtggaaaagaaaaaatgtttaaatattcatatattatttcatatatctaatagccatagatatgggataaggaggggaatg

SEQ ID NO: 49274 - DNA, 1024 bp, Bovine  19866880894049
ttaacttctataagcaattatcagcttataatttgtaagaaagcacagtttcaaaaaagcacagtatgaccatgtagaagtattttcaagatgaccaattcaaaatattgtccttattaaagagaagaaggaatacttccattctcttacctccatctctgcctattcatgccctgacaagttcccatggggagagaagacgttaatcttattgatcagaatgtaaaatggtttaattgctccttgttaggatgaagggctccccaggtggttcagctgtaaagaagctgcctgccaatgcaggtagatgtgggttcaatacctgggtcaggaagatcccctgggaaaggaaatggaaacccactccagtatccttgctttggaaatcccatggacagaggagcctggtggattacagtccatgggttctcaaagagtcggacatgacttagtaactacacaagatggaagctccttgtgagggcagggatctttgtaggttgaatttactgatatgtgtttaaaccctagaactgtgcctggtatataacaggtgcttataaatatgtattgaacaaataaaaaggcactgacaatggcggctatgatgcatttttaactcgttctttacatccatcaggctgagcactttttgaaggtaggaactatttaattgacttttataaacatatagacgcattgtgaaatgtttaatattttgaaatgactggacatcagaaaaaaaaaattaatgagtagccccacaagctacatgaaaagggcaaatgtcttggcatttcaaatagaataaacgtaagtaaacaagctatcaaacatttaaagggagtcaaataagttttgaccttttcgatttcatccatcctttaacacaaaggcattattagacctaaactacaatgcttgtataaatgaatttcagttgaactagttatctttgggagaaaataaatatatccagccagttgatctaattatatagtagaaaataagaatttgtcacaaa

SEQ ID NO: 49275 - DNA, 3245 bp, Bovine  19866880920854
ttttccttggatctcctatctagtcctcccctggctttctctaattcaatctcatgaagcttatttctattttcctatctttccccctttatcacaagaggaaaaagtgttcttcacactcattaaaactgccttttcttcctaaattcttatttttatcatttctcattccagaactttgcttccaaatttattctcttcctgtctagcacacccttcctcttcaactatactccttttcctctgcctgcaaatattcacagggcttaaatattctgaaaaacaaaaccaaaggagcaaaagttattttaaattttatcctactatactgctttccaatctgtttcccccccccccccgtttgtacaatggacacacctcataccatcatgttaatcaattcccagaatcaaaagtgttttaactctttgttttctttaccatattgggcaagatgacaaattctcaaatttttacttataatatttctgttgggttagggaagctaaggaacaggtccagtatgggactgaaagcagaaccagaaagcccctctccaaccccaaaagatagaatatcttgactgcaaaaagtggcttcaggggactctgtgatggtctttataaggcagtgggaaatattttagtaaagtttcattatttttggtttatagttaactacatgttggtaacaagagttaatactttctattactcacttttctaaaggttaggattctttctcctttagtatcaatctgaacacactgattatcattttatagattggtggttcagttgctaaatagtgtctggctcttgtgatcccatggactgtagcccgccaggttcctctgtacacaggatatcccaggcaagaatactggagtggtttgccaattccttttccaggggatctttctgacccagggactgaacctgggtctcctgcactgccagcagattttttaccaactgagctaccagaggaagcccattattttacagataaccaatgcttatttgtaagaactcccttaacttactgcttccaagattgcaaatttacctgcatctgcttacattcttttcatttccttctttattacaatggaagatataattgtattttctcaagactaaggtcaatttttatacctggacttaaaatcgttatctccccctactcaaacagttcatcctgggcaggattttaataaactttagattgcacagtatttaatacaaacaaaaatatataatacaaacaaaaaaacaaacacagagacacctcttcccagataccacatttctatctatcatttcctttcatacaataaacttttatgaggttaatatatattcacatttcaacttagatcttttcctattcatgggttttctcattcatggcttcctttttccgatgtttcagagacttttcttcttcctatctaccaatagacagtattattgatggttctacaaggagcccacttctttcctctgacaacattccctggttaatcttgtctcttcttacatccagatgtagattctttcattcaacaaatgtatattaagtccagatacttctctaattactagtgatatgagtaaacaaactatagtaaatatagatggtgaaatgcataggaagaggggcagaaattgtcttctgtgaggaatatctgtactgaaggagcagctagggcaaaaaccctgagatgtataaacacttggtatgttcttaggcaaacaaacgaacaaaaaacacctggagtagtgtttgactctcaagaaagaaagaaggtatgagatgacgtaagagatctagacagaaggttagaccacagagaaggttttgcagaactccaggtaaggaaaaatgatgactttacttcctgaatatttctagctttatgcttgacttactttctggctcatattgccagctccttagtggctacctcatgtgagtagtgttcagataaagccacagagtcagaaactgagtacatcatcttaactcctaaatatactgctttccatcttccttacttagtacatgaaaccccaaagcattttgctgcttcagccacagacttgcaagtcttccatcatttgtttgtactccttccccacccatcttccccaacactaaatcaaccataaatactatcaaagacacttcctagatatcttggtccacttatcagtctcatttctactgcaacaacacctgagacaaaatctcttacttcaatcatttcaaaattgctcaactggtcttgctcacttcgaaccaactcaccacattgttagaatgatcctttaaaaacaaaatatgatcctataataacaaccttgtacaaaataccttaactatttgctatccatggtttaatcctgcttatgtattccttaatttcaacctaaatgtactacagttccatgaaaaagattataaataatttattaaaatattaaaaattatttaatatatattaaaataatagatatatatttcaccttttttcctagtttgaatattcttttaaaactcaatttccaaattggacagaaactcaaattagacagataattctgataacttttattctgtaccattttacaaaagtgtaacagtcaaggattaaaatattttcttgtaaagaagccagatgaagacaaacggaaattgtagatttccattttctccagaaaatatttcccaagtgaaaaaaagaaaggttaaatctacagtgaaaaacttgacagaagatagaacctcaatgaaatgaatagaaaagatatccatagggaggcaaagtaatactctatattttcaccattgacaaggtgacctgggcttttgaatacctcacaaaagctctgagttaccaatatgtaagagttatgatattaccttgtgaatatttaacaattgtaatgattgtgtcctggagtttattcctgtaaaaaagggtaagcaggggtgtatatagttaaatttctgatgcacaataatattgtaatttcaaagttgataggaaatatgtgtgtacatatatataaatgtacatacatacatatattgaatacataccaacctttatcaaaagaaactatttaaaatgaattttatctagaattttattctatctacttggttgatgttttatttaaactacatttgaatctatgaatattacttaagggggaaaattgtggaatcaatttagt

SEQ ID NO: 49276 - DNA, 1094 bp, Bovine  19866881103966
aatgagagaaaagaagatacccaaaaagtagttgatctatggcatttatggaatataactaggcagatattgtgaagtctcactttctggagaaaaaataaagattctcagttaggcaccattatagtcccttggaagaatgcctgtgttaagaagatcaaattccctgaaggttgtttcatcttatccttcgtggtcatatctgaagtagctattgaagaatatgtctttcttggctgcatataacatacaaaaaccccacctcacactcacggaaatatagatgtctaaaagtcattttaaggattgcagagtcaaagactttttaacatggacttgtggttgtttagccatatgactattttaaaaacttgcaaactatttactttcagtcagtttcaaacacaggaagcaagaactgccagactttgttcccaaatacctttcctttatttggtatcttgcttatcatcgctctctccatcttaacttaaattcggataatcttgaacctgtcaagcttgaattgtcagaacatgtccttcatttgatctttggcacaaatctgagtcactctgtgtggctgagaaatctcactgggtcttagttcttcaaagtcttttacataccatctcttctttttctaaactttccttttccctttcaattctactttaaacttgcaaattattttctcagcttacatctttcttataatactttgctaaaaccatccacaataatacatacataccgctaatatttattttccaaacacatctagaactacaagctcagtgagctttggactgtcttctaaactatcataggtgacagcttttaaatgccttttcactgtaatcaccaattaaccaacctgttttattctactattaaataaagatgcccactcctaagccagtgtcacatattctagtttttgtttatcagcatctcacttgaagggactttttttttttttatattagtcattgtaattagtactatctgctgcaataagtaatctcagtccctttgtgctattctctcttgcaaagcccagtgtgaatgttcctgattgcacagctttccta

SEQ ID NO: 49277 - DNA, 858 bp, Bovine  19866881119159
ccaagctcctctgcccatggagttttccagacaagaatactggagtgggttgccatttcctatgctaagggtatgtttcagcaattagggggtccaagagtgaatgggctggctagtaccagcaccatccagtccaggggaccagcttgagtataagatgctatgagacatcagggcaatgatgtcatccagctgtgttatggttgctccctgaagcaaagacagtgctgtttagtactatttcattctgtgaaaagtattggaaaagaaagttcaggctaaccagaaggattcaacattatctttttctctgaggggtgaatttgaactgcgtatggacaataagaaaattctcataaaatacattacatatttcatgttacccagggaaagctaaaccaaataaatctttcctcacagaaccaatttctccttcataacttgtttatatagttctaggttcatttttcctttgatttctctaagaggttttcaatgaaagtatcttcaatggaaatttaatatagggctttattttgcctggagttaagttaaatttgttgttttatttctaaaagctgaacataagatgtacacagagaaagaaaatggaacttacaaaatttattattacaaaatgcagttaaatatatttaaaaaaataatttggttgtggcatctagtagcagttatttgaaaatatagctgtaaaaaggcatgttaaactataaaatgtcagattgctatgtctcttacatatatgaaacactcctcaattatcttgttgaaaattcactcctgacaaggtggtttattccagtgttattcattagaaaagacatacatattttcagccaa

SEQ ID NO: 49278 - DNA, 1420 bp, Bovine  19866881148747
cctaatgcacacatctcccctacactgttatcatcgaattgtatattaacatttctcaatcaaatgacactgtttagaaatattaccatggacaatcaaactaagtattggattactattttgagtaaaaatgtattttgagagatgcaaataaatgtgatatgcttataattgtgtaaaatgctggagctcattgtgaccaatttctactttcagatgtatattatttttaaaaagaaacaataacatttaaaaaataagacagctaattaaactatccttaaataattgttctattgtgggccttactgcttgaggtataataataattacacaacacacatcagcatttcttaaattatatcctcctagtgcagtaaattgaagagaaagtcatattgttttagtgatctgcagaatatataaatgttcacatataataaatttagctgcccaatataaaagttgctgatacagagtaaaactcagtgttgtagtattaaaaatcactattaagtgaggggtagcaggaagctcttctaagaaatatggggaatcctgtttaggttattctctccctggtactaagcgaccacagtgatcacaatttatcccagcctaaactggaagtctcccgcagaacattaatgcttgctttaatgtagattttggtagataacatttttctctgtgatagtttcatattcaaaattgtatatgcatggttctgtatgcatataattttatgattaagtttaaagtataatgaccataattttatacctggaaaagtcatcaatgatgctaataactttagcaaattgaatcattgctgttgctaagtcgcttcagtcatgtccgactctgtgcgaccccatggactgcagcctaccaggttcctccgtccatgggattttccaggcaagggtactggagtgggttgccattacagtaattgaatcattacaattgattattaaaagatatggtggaatacattgagtcagaacacctgggtttaaaattctatcagcttcactagagatgatctcattttcatttgctttatcactactaatctaagaagaaaatcaaataaatcctaaaaatatgatctgtagaatagatggagggtgaccattttttgcccagagctgaaaaattaaggtatgcccttagcaaacttaaaagatgtagagacaactgacagactccataaatcaaaatttcagtggatggtaaattttgtgttgcagatataagctctaactaagtgttctggttgaatatggatttgctatatgtaactacctcatgaaaacagtttattatgtctctgctgctgctgctactaagttgcttcagtcgtgtctgactactgtgcaaccccatagaggcagcccacgaggcttccctgtcc

SEQ ID NO: 49279 - DNA, 1448 bp, Bovine  19866881167419
ctttgatgctcctatgacactattctggagaaggaaatggcaagccactccagtgttcttgcctggagaatcccagggatgggggagcctggtgggctgccatctatggggtcgcacagagtcagacacgactgaggcgacttagcagcagcagcagcagcagcagcagcaagatgacaactattaatgtgtggaatagatttgtggtctcacaatactataattgccaatatttattagtaccatcatagttgctgttccattggacactaacctgaagtataataaagagagagtggtatttgaatattttcacctgtgatgtatacatatatatttacgcatttctatttactgtaatttctattttctttcttgctttgcttgtgtatgtgtgtgtttatgtgttagctttattgcttttgttaaatagaggatatgaagtatttggagctattcaattttgtgatatgaagttactaagttaataacagtgttaggctagagtaacagttagatcctaaaaggtaatggcttagcacagtagaaaattttctaactcatatgacataagtttaattacaatagctatttctttctacatttcagatcagtaaggcaagtgttccctcttggaaaatgagcctgctgaatgtctgcagtcttataaataacctgaacagccaagctgaggaaacaggagagtttcatgaggaggagctcattacaagaaggaaatttcctgctgccttagatggttttagcttggaagcaatgttgacgatataccagctccgaaaaatctgtcacagcagggcctttcaacactgggaggtaaaacaaaagaaaaatatgaatatgattatggttatactagttaactctcatttacactgattgttttaatcctgataattatcataacaggaagatttacaaatattaaggaagaataaaccatgtgttgaggttaacattccttcagatctttaaagtgttttgcaaatatttgaagtttagcaaaatatctttcctttggtctctaaagggggatctgtcttcaggcagatttgatccacaggcttttattgtggatggcgtgcttaggcaacttttggtgctggtggtggtagtggcatgctgaagaaatttaggaaactcaaaatgttttcttagaaacactaaatcctgtgtgtttgtttataaataaacacagaacacaaaaggcttcatttgtatttgaaaatatcaggtaaataaaactggaatgataagaatatatatatttccacttaccacttctacttctattttaattgagtgtgtggatggtggatttcaatcatccttagaagctgaattagattcagctaattttattggctaataaagccaaatatagaactatacagaactacaagaaggaaggatgtatattatacaccata

SEQ ID NO: 49280 - DNA, 791 bp, Bovine  19866881215162
tagtttttacctataacccttttgtaatgttggaattaaaaaaatacatgtacctttaaaattgaaagttatagcttaatttaattcagtttaatatacgttaactgatatggacatgagtctaggccctagaaatatagtgaaagagcttcttttgaatcgtttgacctccagtaacacatgttctacttggagagacaaggagaaaatcttttaatcaatgaagaaagggaggagaactgagatcctgttattaaaacaaaataagggggaaagaagtacaggaccgtgttgtacatctggatctcccactgttttaactgcacctcacctgaagcatttatactttatttttttcactttgtaagagattaagtaacattttccccactgctttctacataagggtgttctaactattaataaaattatttttatggaaattcttgaacttcatttgagaaaggtctgaaataaatacaaataggtaataatattaatgtccattaaaaaatacttctatgaaacatgctcaaatgtggaaggaaggaaaagaaggagagagggaagaggaaaaggaaagaaaagggatataagccttcttatattaacttctttagacttttacctgctctctgaaatttctgtgtaatttggcattttatagcaaatgtagtcatgttccttccctcacaggcttccaagaaagcagttttcatgttttaaaggccggttttattgagacatacagaaagtgatgattttgggacaattaccttgcagtcattcca

SEQ ID NO: 49281 - DNA, 846 bp, Bovine  19866881249747
ccctctgtgtatgagggccatttcaaaccaacagttacattgatatagaagcatcattttggggaaaaattataagtaaagaaaactaaggatgtgaattgattttcccaaagtgataggcaactcaagattaatagacccaggcctttagccatgtcatgtagatgcttattgaagaatgactgtatgcctaacaccgtactttgcatgcacacttgagggaaactttccatcaagtatgaatcactctgctgagtcagcatgctgttgtggtttaagtatcattctaaatgcaaaataggtaccaatctgtgtctggtaaacagtagtgtaagcataagtcccagtttgtgctgacagttcttggataataagtcagaattcttgacaaatacatacatcagtccagagttcttggccgacaccagttgtcccctctacttaatgccctctccttctctcttcatattagtagcttgagttttgtctcccccaatttacttctagttcgttcctaaacccaagctaatttgcattcttccctcacttctccactaaatctgctattcccaaggtcaccaatgacctcctttttgctaaaactgatggacacttgtcagtttattattttcccctcacattaactagtactatactcacactattgcctcctcccacctgcatgaaatatttctttctcttaactccttttgtctaacttttctcttagatttttttttgtctcattctttgagctatttatttccttctgcctttcctaagtgttgatattttttaaggaccattccttaattcttttctgcttaaaaaaggctcctctcacat

SEQ ID NO: 49282 - DNA, 1105 bp, Bovine  19866881560054
attgtatttagcatcagaactcattttttattttttctaacatacaagaaaacttacattaagcatgagaaataagaacttaaaatatcatgtattatagaccctcccactgataaatcatatcacagctatacttctattttcctttctataattgctcataaaataagaaggggggctcagcagtgcttgaggagagatataaaaattgaacattaattttattcagatgagatgatttgtatgcaagctgatcaggctacaagtttatctcattacaagctcaaggctgtaagcatttcatcatttcttgggtgccattaactttaataatatgactgcctgcattgtgtgttaaaatgtgtggctgttctgcgattctgtatgatgatgaagtgtttgtgaatatttattacttcagtctttagtgctctcaactttatactaaatagcaaagttaattgcctgtactgctctaattgcattgtttagagaataccatccttttcctcttcagttgcagagatattagtaatatgcagatttttgaagtgctataatttgcaccccaaaatgaagcacagtaggtccacttagtctccggcagagtcaattaactccttgcccttttctctggtaatgcaacttctgctgatttgaagcagttactgggatgctgatttgcatatacaatttgttttaagaaattttgataagagcacaaattttttagttccaaaaaaggtgtgtttgcaagaagcctttaaaaaacatactgtttaattagcattcactctatcattctcttccaaattggtagttcatatgaaatgcttcaaaatgcattttattgtcattatttactgttttttttttttttgccttggttcttcaaatgtttctcttccttttttgctctcactggaacccagtaactattctgtttagaaataaaactctgaaatccagagatatgagatttagcctttaattttgtttcttaagtcttgtcatacagacaccactttagttttctatttgtgcttctacatagtccaaataaagagtaccccacctatatgttacaatccatgcttctttctcc

SEQ ID NO: 49283 - DNA, 1281 bp, Bovine  19866881661497
ttcttgattctgaaacattaccagagacagtggctctccatttatattttggcatttttatgaaaaagaagacactttatggagccaaatgtattaatccatttagtaattcatccatgaatccaagcatccgtccatccattcagtatcattccaaaaatatgtgttgtaggcactggttaagcactagagaaacatttgcttttcacaatttggtcttaagggcagatatctcaggaattcatctattttcaaggataatgtataaatttgttgttcatatttcctttacatatttacttatttatactgtaagaacttttatctgttatattgtgaagcttggactccaatatcaaagtcccaaatgtaaaacataaattgcatgcgtagaagtatgtgaatattttctgacgttggaacttcatttctgtcaaatatctctttagttcttggaaatactttggttccacagaaataggaaatttcttcattctcccgatgtaaactgcttcatttgcatgaccatttgaatatgaatatatatatatatggttttctttgtacaatttagtaagtctggaccattttaaaagatggaatggcttcagtaggtggtgaagagcctgttaaaaatatttttattttatacaggtgtaacacaggtggtacaccctttcctctctgccccatagggtgtagctctaactaccctctagggaagagaaggttgggtgaacagccttactatttctccagctcagtaattacctacaggtacattctcttcattgcccaggaattcttaagggaaatgaaggctagtgcatacaaaatgcacttgcttcacggttcttctgtgagtcatttcagcccaaatcttatatgtatttatagctgattgtttcctgtcttttttattttaattgaaggattcatctcactctcatgaaattgttcattttttgatggagaagcctcagatgtgcagccttgacttaattactttgttcttaaagatgcaagttttcccatatagaatctcagagatttcctacaaagatacacagtcatccacatttacagattaacaactggctttgttatgctcagaaaatcctgtttcataataaagctacatcaaaatagttaaaaatacaagatgaagatgtctaaatcgcttctgattttttacctaattttaagaaattaggcagctgggcgggtaattcacacccagagggttacttcaatccattgtaccaccccatggagagggca

SEQ ID NO: 49284 - DNA, 734 bp, Bovine  19866881767162
ctgccaggttcctctgtccatggaattctccattcaagaatactgtagtgtgagccattcccttctccaggggatcttcctgacccagggatggaacctgggtctcttgcatagcaaggcagattctttaccgcctgaaccaccagggaagcccaaataatgcatgtgatattaaattaagctaagctaagatagatgaactgttgagtacagattagttttgattttcttgaacagaacaaccttatcaacttcttcaaacaactttagtaccatagaatccaagtgaccatacatctaaaagtctgtgagccccttgacatgttaaactacacttcagccaatctgcaatctcatgatccaagactttcctcttaagaggaatttttgaaattttgtagcagttcaattttctcacattcttctttacagagaatggtgttaactcttaggcagagattgattttcaagtccacttatatattctgccctgacatgtttggaggcaaacaactgaccccaatgttatttttcaccttaatataataaaatgactccagcaagtctgggtatataatatggatggaggatagctaagcattcttatgtaaatacaggttttgcttctcatttagtccctgaaaagtcacatttggaatataccatttgaaactctgccaaggaattcttacataattcaataaacttttttatgtcattatttggtgcaaaac

SEQ ID NO: 49285 - DNA, 1476 bp, Bovine  19866881906198
agcctgtctttgaattttgattttgtcacttaccatctgaatgaatttttaaaatttcctgagtctgtctgtgcctcagtttccttatctatcatggggagagatgattaataaatgaatttagcacaaaaagttgtgtaagaatttggtaagtttacaaaaaagtaaagtaataacaattgtacctaagaatttacctaagtaaatgttaaagttatttctttaaaaagcacttagaaatgaaaatagtgcactagcgttttttctaacagtttgtggcaaaacaaaatttctgtatccaaatatgtgtttctgtgataagctgccaacttggtctggcaaatccgttagcgatgcatgcatgtgtgcatgctaagtcgcttcagttgtgtcgcactctatgcaactctgtggactgtatcctgccaggctcccctgtccatgagattctctaggcaagaatactggagtgagttgacatgccctcctccaggggatcttccctaatccagggattgaacctggtgtctcataggtctcctgcattggcaggtaggttctttaccactagcacctcctgggaagcccccctttagttgtatatgatcataaagttttaaagaagcctatttttgtgatcctgatgtaaaaaccaaaggaaacgtgtgtaactgaaatgggtttgttgagtgtcagtagaaactctcccacctattgcaagataaatgtaaagagtctcagtataaaatgttctttggaaattttgaaaagaagtctttgagaaaggtgtttttcctacatatttttcagttcaccctagggatacagtatatgatatccattggttccatagtaactgaatttaagtgatttttaaagtgaccagatatgacccatacaagacataagaatttcagctgttaaaactgaggtgaagcatggttttagctgaattggaaactgaattactgcttactgtcaggcaaaacagttatttttaatgcgttggggttaaagtcattgggaagacaagaatcacagggttatgtcatatcacagtgagctgtctcgattgtagcaagtgaacagttccattttttactatcttttatatttttaaagcaaaatacatacactaaaaagaataatcctgatatttaaaatattaagctgtatgcaggtatcaaatttgtaggcagcactgtaaattattctaatagcatgggagaacaaagggttccaatgatgaaccttgagaaaaagtggatggagtacatgcaaatccaggtccctgtacttacagacatgcatactatttaaaagcgcctcttcagtatgtttagcctgctggatttcattgcaggcatttaattaaaacataatttttttgtttaaatttcaaattatctccattacagcagtttttccccttgcttggggcaaatatacattagtacagtgcacaaaatacatttt

SEQ ID NO: 49286 - DNA, 2253 bp, Bovine  19866880654494
gctttgtttgtagtgatgcttcctaaggacttcaagtaaaattaagagataccaaggaaacatttcatgcaaagatgggcacaataagggacagaaacggcatgaacctaacaggagaagatattaagaagaggtggcaacaatacacggaagaactgtacaaaaaagatcttcgtgacccagataaccacgatggtgtgatcactcacctagagccagacgtcctggagtccaaagccagcaggtggaccttaggaagcatcagcaccaggctgttcctaaaagctaagcccaccctgtgccccgggggcccgcgtgttagtttcctgtgtgcacagtcaccacagatgcaatgacttcaggcaacaaccatctcgatctctcagcttcctccagtcaggtgctggcctggctcagcttattctctgccagagggcttcccaggcggatcaaggtgccagccaggctggggtcctcctctgggttcaccactgctggctgctgtggacggaggccctggctcctttctggctgtccatgggggcctccctcatggccccactttctcacagcccaggaacacaccctcctgctgctgtgaccaggtctgatcagagaagtgattgccccaccacccctctgccatgtaatacaaccccatcaagggagcagcttccctgttgaaccacaggctctgcccattttcaagggaaggagatcacctgggctgtgtgcccctggggacagccgtcccgagacgtctcagaattctgcccgctgtagcctgcaggtgtctcggcattcctgagggcttccgatcaacagccctgaactcttcattaattatgaattttgcctagcaaccattgccaagcaacaactcttcagaaagaaatgttcaaagaatttgttggttgctgcgtggtggagatgaggaaatgagtgtcagcgggtgctgggctggccagcatgtgggcagccctctggccaggctgggcaagcttgagaaagtcccattaccccctctggatgtcaggttctcacctgtcaaactgggattacatctaaactctctgacttgaaagatgagcagatccaaggctgcaggtgggagagatcctgggggggggttccccaagtgcatcaggagaatgactgatcccagcagacatgttcttccttccacactcactcagcgcctgctttgtgcagggcccagggacccctcatcttctcattcaccccctccctcagggactcacaaccaagcacctgctgtgtgtccagcattgggacagtcgcattcaggagatgggaaagaatgaacaaaataaacgaggagttatacagcatgtcagctagtgatggttcagggacgataaataaacctggaagtgggcagagggcgtgatcagggggacgcgggctgtaattttaaacagagtgctaagggaaggtctcgctggaagaggaatctctgagtaaagaccagacaaaggtgagggagcaaagaaggtagtgtgagtgcctggggccagtgtcaggtggggctccagcaggtacagaggccctgaggcacagcggtcctgcctgagtggccggaggcaagctgggaggcagacccgtccggaacacgctgtgacaaggcgtctgaagcagcagccccggcaaaccccacaggagtgaggagggggcaggtgcacctcccctttggggcagcctcccctcccaccacaacaaccctgaggaggattctgccaaaggacggcaggccgggaaggaacgttgttccctgagagcagaagagcacccagaaacagccccacacgtccgcagcaactccgtttataaccaggcgatgctgcaggtcagcaggacaggacggtatttaagtgtagacacattgtacacacacgttgatgtcatatcacgtaagttcataacagaaagcaaacgagactgcagcgtgcatttgctatcatacagcttgagaatacacaggagaagaatgttgtgaggcttcctcatgttggtcactcactggtgacacccacccagccctctggtcctcctccagatgaagcccgcagctgccactggccactgagggtggcggcctaggacacgtcacgcctgcgggcacacttgctcccgcctcaccaggagggccagtgtgtgtgctcctacagcgccgccagcaccagcagcgggaagggagcccggacggcagggcgtcgcagagcaggaggcggg

SEQ ID NO: 49287 - DNA, 1424 bp, Bovine  19866880671932
cctctcccggtggccccgcgtctgggggcttctccatcctgctgtacgggtgatggggggccgacgctcccccagtcactcagccacaggccggagcccctgcctgccttgctcctgcagcagcctgagtctgaccgcaaggcccgtgtgtcctcccgcggacgcttgttactttgttccgccccttcccggtaccccaggctgctttccttagattcaagtgtatcttgtctgtcctgtctctctctggacgcgttctctgtttctggtagaacttgcttctgagtctgaaacatctgtcttccttagtggccacttgttgggcttagggcctactattgcctaaggtgcttgtaagcattaaaatttagatgatgcttgtgtgctgtgcttaatcagtcatgtccgactctttgtagcccgccagactcctctgtccatggggattctccaggcaagaatgctggagtgggttgccctgcccttctccaggtgattttcccaactcagggactgaacccaggtctcccttactgcaggcagattctttaccatctgagcccccagggaagcccagataacacttacatgactaaacatttccacggactctgtcaagtcctatcacagtgcactccaagcacagagcgggaaaaagctcctgcagttccctctttctcgcatcattgaatatccgtctggaaaagagaatgtggaggccctttcacccgccttcctcacttttcagatgagactgaggtctgaagacttacagcaagttagtgatacttctgtagttagtatacatcataaaaccagcaaatagggctgcttcctgttcgtaatgaatggaagtgagagagacgggaaaaagaagatcccctttattttactgttttttgttttgtaaattaggatagagggtccagggttccagtctgggatgaatttgacctgtgaccacctcacttggtcttaaacaccctgtgttgctgaaacgcagatcgagttcttgatgcagtttgggaaagtgtgcggcctgggataggagcctggggagcagggtgtgtgcagggtccaggaaagcggggccccttctgacccgcagccttgggtgtcaggagtgtccgcgaagcccccgccctcgccctgggcccttgatcctcgcaggcaggtctccaccctgcgccctcttccccgtaacccccagctctcctgtctgcgcaggagcgtccctgggtgtgcgtgcagctgggtccgaggagcccggctcagagggcctcccctccacctccctgctggacctcctgctgcccacgggcctggagccgctggactcggaggagccgagcgaggccgtgggcctgggcgctggcctgggagcccccggctcaggcttccccagcgaggagagcgaagagtcc

SEQ ID NO: 49288 - DNA, 1005 bp, Bovine  19866880769117
tctgtgaggtgaagccctttatccacctactgagagagacattacttcagtgttttagaagagcaatagactctcttaagaatccttggaattttaccctccacgaaaccaccagaggaccaaacgtgctgtgcctctccacaacctgagagctgcctctccgaggctaagggaggtgagggagaaggagtctcggccacacagtcctcagtcctgccaccaggaacctgtgtctgtcctgctgacttcttgcctctggggatgaatctttagcccgtgaagctctccatgcagagcgctgtggtctgaggaatctgctagggtctatcgtgaccattcccctgactgagggggccccattctcccagcctctcccctccatctgtcacctgcggagaaaccacagttcgtcctggtctatctttcccaacactctgataggaataaaaagtgtgtacgagactgccgctgcttcagtcgtgtcggactctacgcgaccccatggatggtagcctgccaggctcctctgtccatagaatttttcaggcaagagtgccatttccttctccaggggatctttccaacccagggactggatccacatctcctgcatttcctgccttgcagacaaattcttttaccactgagccactaagagattctgatcatgtttctgaaaagctgtgtttgaaaaggaggaatctggcttttgatttcttctgcagtaaacagtttctttttcttgaagctatttttctgcacaatggttatttttcctttataaagaccttgatattttcaaaagcttggcagtgggtaattacgagatgttacttattttcaaacttgcccaccaaaatactagctgagacctacccattccctgtataactacttttgcacttaataattaatctgcctaagactaccggattttaacttccagatacacactgatctttttttttcctctagcacctgcaatcttctgttacctccatcact

SEQ ID NO: 49289 - DNA, 1569 bp, Bovine  19866881014550
aacggtacggaggggaccacgatggaccgcgcacaggtctacccaccgggggtggcactggagacgcccggttaggatcccaccttcaccatctccggacgaccctggcgggctcctctgagctgtagtgatgcatgttcaaagtgggaacaaggggcttccctggggtccagtgggtaggacgccacgctcccgacacgggggcctgggtgccatccctggtcagggaaccagagcccacgggtcacaaccaagagtctgcacggagcagcgaagggcccgccctccgcaacggagccccggcagccacacgataaacgaaaggagcaacggagccccggcagccacatgataaacgaaaggaagtatttttacaagtgggaatgagagtgttatcataacggccacctcccagggctctgggaggacttgaggagaaagggaaaaagtgaaagtcgctcagttgtgtccgactctttacgaccccatggagtgtatagtctatggaattctccaggccagaacactggagtgggtagcctttcacttctccagaggatctccccaacccagggatcgaacccagggttcgagctgagccaccaggttaccagctgagccaccagggaagcccccccgtcagaggccagctcaacctggggagcaaagtgtgaaccgtctcagaaaggaacctcttgggacttgtgttagccatagagacacgttgccagccgtcactacacacacctgactggtgccgacccccccacctgcagcccgggcaacccctcggtggaggggacccacgaaaagccaaaagacctcctatggcctcacacaccaccgacagcggggtctttggggagctgggagccctggaccaatgcatgtgactgtcttcctggagcctggcagtttggggacctgcgggtcttgggagccctgctcctccgctcagagacccagcagggcaggtgagcgtggggccgggacccagacagccgaacccagggacagcgaagggggggtgtcctgcccagccgcgcaaggccgggttcccgcccccaggcagccgcccgccctgctcctctgggcactgggcacggggagctgacgccaccgctggtctcgcagcccctgcctcgcgcgagctgttcactgggcttccctgccctcagcctcctccgtgctcccctggggatcttgacggtagataaagtgacaagtctttgagcttaattaagatacattgtcccaccaattgggaagcgggaaatggctgggctgttttacaaatagaaacaattcttgttcattatcccttaattgaggcaacaaagggccctggaaaacatccatcagaagcacattcatgttcgtcatcacagaggattggtttaggaccacacaaaggcagcagcgagcgttccaatcaggagttacacagacaaagggaaacagaggccccgaacacaaacacggcagaattagcccaattacgcggttgatgctgcgggaacaagtttccggctgcgggccagctctcctctcagccccttcctgcccctc

SEQ ID NO: 49290 - DNA, 980 bp, Bovine  19866881119645
ttaaacaaacaaagaaaagacatgtaactgtaatagcaagaagaatgaaataagtatagtgatactaaacaaatgaacataaagtgataatatagagacatagaaactcaatataattctctatattagggtctattttacaaaagatttggcatttgagcagggcataaatagaatgttgtctgtgatatagtaatgaaattattttgtacctgggacagaattattattatttatttttatgtacaaagttttcatttttaatatctggttaaaatatgtattttgtaagcaaacccattacaggccaacaaaaaggaataaaagcaagaagaataaaaagcctacaattaccccttactgagcataaaggtcaggcctgcttctttccttaaaggcagtgtctttttgccctaaagtatcagcttaggtctctgctcctaagcaccagaattgcatatgaacagagaaaccagccctgaaatgtgtgtctttgcatagcccattggctcatggactccaagtgcaaagggactcctttgaagcaccgtctgcacaggcccaagcagactcgtggtgaaatgttttctcttcctcctcccaggaaatggtttacattactgacagtgccaatggacccaaggtcctgcttggttgcacaatttgtaataacaaaggcacagagaaatccaactggatggcaagttggttaaagggttgctttccaatgaaactggaagactgtgttgcatgtaggatagaccaggatggagaagcaaccccagggatctaagtttcagaccgcttttatcataatttgctccaggtcagtgtcacttcagagtatatgcagaagaggctatagaaacagattgactgggattttagattcccatactatattatcttgaataagggaaaggtcttccaccttagtttcacagtttcttacggtttttctaaatgagacccgctctttt

SEQ ID NO: 49291 - DNA, 2011 bp, Bovine  19866881250437
atacgctgatggaaggtaaagatattgcccaagataggaaaaaaaaaaaaaagctggaaagtggtggaagtgtatgttacaggctggaagactcaccaaaatatctatatactccactatgtttcactacctactttctgcatgcttgctaagtctcttggctaagttgctaggtcgcttgtgtcctactctttgcaaccctatggactgtagcccacagagcagggctcctctgtccatgggattctccaggcaagaatactggagtgggttgccatgccctcctccagcagatcttcccgactcagggattgaacacgcatctcttatgtctcctgctttgcaggaggattctttaccactagcaccacctaagaaacctgcctacaccgtagttaggttatataacgaattctggtctgtggcccttggaaggctgtgacgtatggtcacctcctgtctatgttactcacaatcagttgtgaattattttttctctatctttgtccatcttggagtccctggaagcctagtgttgaggtgcagccacaaatagaacctggaaaaatccatgatctattgctgggaagtgagctgccctggaaagtatctcaacttgcagagggtttgtgagaagggataataaattttatgtgtagagtgactgagattcttgtggttgatttttattgccaaactcataccgggtgggattcgaatctagccaatctattttactagaagtattacacttttctcaccacagtatgttggcataaaacaaagtggaaggctctgaggtagaatgagtctcagctttgtcatctcaaaaaatggggaaacatcttacaggagtgttataaaagctaaatgaagtaactgttttaaatgtaggttttatttttattcatatatggtagggccagcagatcaggagaggactgccgttggaaagatagtttgttacttacagttctaaagaaaatcaggggaaccacaccatgaaggctatagggagaagcaccaggttggtcaggcagcagagggagagagggaaaaatgtgggtgagagcctttactgttgtttcagtcatgaagacagggcaggggagagtaagcaggctttagactggctattcatcaggctctggggtatgggaactgtctttagttgtactctcctggggtgattagggcagtgcaatggcagactggcaaaggaggtggttgggtcaggggctctcagttgattgatttgcatatgaaagatgaatcatttatgatctctaggaatttgatagccctagaaggggcttcaggtgtcaaagtattgggatagaaaaacatgattaataaaatcacataagaaaatacctaagtgagtttctgggcattgggatagaaaaacatgattaataaaatcacataagaaaatacctaagtgagtttctggcccagagtagcagtgtgaagatgaattcaaaaggaggtcgaaggggagcaagtcagagatttaggagaacaggtagaaggcatttatataaattcttcaaaaatgtgttaatcatgtcacttctctttttttaataccataaattcatactcttcttgttttcggcacttgaagctccacatttgttagcgtcgatcctattttttaagtcttataagtgacatttcttctgagacaaattcccttagtcccacccatcccatcctcatcctgtgaccttttatccacagtaatacataaatgaggcagcttgggccataggtgattcatagagaggacctcgaggtgggcagtcagcagtcttcatgcccagaagctggggtgatgggagccagagggcaaagggactgccatagcactgactgcatacatagttcccagaacttaggcagttctaataagcatcttcaattctatctctaggatttgtaaatgttgccctgcagattgctcaaagaaacataattttttgatgcaagaagctagatgtgcctagga

SEQ ID NO: 49292 - DNA, 1614 bp, Bovine  19866881322368
acaccccccagcggtagctgagcacgggctgcagtctgtgctctccacagaatggggtgcagcactgcagggtcaaagcagacacacacttagaacagagggcgggagacctgtgagatggaatatacattatttagcgagacacgaacccatgcaggcagggaacaaggatgtgccgggaaaagagaagcgcagaactcagggcagtggtttctgctgaggctggggcaggagggtgggggagagactgggggcttgtggtgaggcccgctgctttaaatcacacacacatgtacacatgcacgcacacgcacacgtgtgcacactcactcatgtgcgcgcacacgtgcacacacacacgtgcatgcacacactgcacacgtgcacacacacgagcacacacacatgtgtgcacacacggtagcacacaggcagaatgctgacaaagcgtgtgttatccaccagggttcatcattttactttcaatatgttttgtgtgcttgccacatttatgatctaaaacattaagtccactgtgagtgtgcatgggacccgggggctgaagtgtcaggacactgggatgagatatccgagagaggacgcctgcacctcgtgtgctggcaggtccaggactgagcgcgtcctgcctcccaagggcgctgcagtgtcactggacgaaaggcagctgggggccgtacgctgaagcagcccatcaacactgggcgttcctagctgcaggacttctcagagccttcaacaagccaacatagaagtgactctccaagaactggacccacttctgcagaacagtgtggaaaacaccagtccaccaacaaggtgtttgcacatctgctggacacgcagcctcccgtttgctggattcctgcatcaaagcccacggcggtcaggtttctgtctggccgcttcacatcactgacctcacccctgctgagacatgacctgcagactgggctccctgacagcatgaggcagtgtatccagacccacagccctacgtggaggcttcaggggatgagagtccttatgctggacgcctgccaggcctctggaggctgactgatgcccaggccccagaccccactcagagtgggctaaccccacccaggcaggcccacagagctcacctaactccatgtggggacacaacccccgtccaggtcagcccccagacccccagaatcaggtggtcagaagagcagcccgtgtgcgcctttcctggacacacccaggtctggacagatgtcactgagccggctgcgtggctgagggagagatttggtcttccctggcggactgacgtcctcggggaattaagtgcaagatgcgcttaataaagccattatcctgccacccagctgtgccagatgggaagatgacagtcagaggagggggattacaccgggaggcctccagagcagatagagacgcagccacttaattgccagactgcagactcgccaaagccccacacagaacggggcctgggcctgcagaaggggggctgcagagcataggactcatcaaatggggcggggatagaaaatgaggaacccggcaggtccccctgacactccctgcccaacacagatcgat

SEQ ID NO: 49293 - DNA, 760 bp, Bovine  19866881385777
acgctgcctcggctgctggccacgcgcgccccacgaaggatgataaaatgatggctgttatcctgggacgcgagctgggggcgaggggcttgcgtgtggtcacacagcacaccacgctgggtggacaggcctgagggcgacgtggtgcagagtcgacaggtactcctgacgccacgggggtggcgtgggcaggacctgggtccccccagcctgacggtgtcaggaggcaggctggtggcaccatccatggggtcagagtgtagccctggccagtgggcaatgcccaaagagaggagaccctggctcacgccccccacccctgtgaggacacgcgctcccagcctccaggcccgtcagaggcacacacctgccctgcaagctgcccagtctgtggcatctctgtgacatcagggatggctcagggctcacaagtagaggaaaagcagctgggggcgcctggatccagccgtgcctgacgtctgatctgcacttctcagctttatgaaccagtcagctccttttcctcactaacgccagtctgtgtgagcttctactaagtgcaaccaaaaaaaaaaggaaagagcaattacacctgtaatgagatggaaaatcttttcatcccagaattcctcttggggacagcgctgtgtctgtttggaagaaatatgtttaacagcttgacgcctgaagcgaagagtccaggggacctgagtgtggggagacagagggagaggagctggtgtggactctccgggggtgt

SEQ ID NO: 49294 - DNA, 789 bp, Bovine  19866880286791
aaaaatggttttatattttaaatggttggaaaaaatcaaaagaagaatatttcatgacaagtccaaattgtacaaaatacaaatttcagggcctgcccatggagtttaattagaacatgggcaagctcatttgtttccatcttgtctggaaaagtttcgactgagcctggacagcccacagaacctcaacaattcactctctgtcccctttggcagcctctgagtctgaaagtaggaaaacagagaaaagtaaagcagcaagacggtcaatacactactgggtaacaccagtattacaagtcaccaacattatcaccatgataaccttgaagtctactttctgaaaaacttcacataaggtgaaaatgtccaacagacagttggcaatagaggactggagagaggaatgaggtcagagctcgccttccattggttcccttagggtccagctctgtcccctgccctgcctctgaaggtaccacggatcccagtggcctgggctgggccgaggccccgccccgccgcaggccccgcccctctgcaggccccgccccgccgcgggccggctctcagtcgatgagccccactcttcctcttcagcttcagggagccgtcttggttgcctcctgtgtccagatgctggtgggcttctcaggcctcattggcttcctcatgcgcttcatcggccccttgaccattgctcccacaatctccctgatggccctgcctctcttcgattccgcgggtgacaacgccgggatccactgggggattgctgccacgtaagta

SEQ ID NO: 49295 - DNA, 1245 bp, Bovine  19866880565031
tgaatgttctgtcctttcctcactgataggcaatcccagacttgccctatcaggcttatataaaggatttgtttcattgtgtgtgtgtgatatggggtcagaggtgaaggtgagggggcacccaagaattctgtggaatcacccaggctattctcaacccctttccccccatgtagtttaattttgacttgaaaatgctacaaaaaagccatttggggattttgattcgaattgtgttgattctctaagatgtgttcagtgacaggatctttacagtgtagagtgtagggagggttcctttctcccacaccctctccagcatttatgatgtgtgctgctgctgctgctaagtcgcttcagtcgtgtcggactctgtgcgaccccatagacggcagcccaccaggctccccatccctgggattctccaggcaagaacactggagtaggttgccatttccttctccagtgcatgaaagtgaaaagtgaaagtaaagtcgctcagtcatatccgactcctagcaaccccatggactgcagcctaccaggcctctccatccatgggattttccaggcaagagtactggagtgaattgccattgccttctctgttatgatgtgtagtctttgtgataggagcatttcagactggcgtgaggtgattacctcgttgtggttttgatttgcgtttctctgataattagccacgttaagcaccttttcatgtacctgttggccacccgtatgtcttcttggaaacctctgtcttttacctgtgcaaccattgatgttaaaagtgattattgatgatatacctggattagtgcctaccacattcattactgttttctattgttgtccttgatctgccttcctgtttatcttctactctttttctaccttttgtggttttaattgaccatttattaaggttctattttctttcctttcttggcatatcagttatacttcttttttatttttttgagtggttggtttgtcttagatttgcagtatacatgtgtaactaatccattttgaaatataccataccattcatgaatattgtaggtatcttataataacaaaataaccctaattccttcctccctgtatctttgttgtcattaatttcacttatatataagcatacacaagcatatacatatatacacacatacacacacacacgcacacacacacacatacacacacatagggcaggagggaagcacacataactaagta

SEQ ID NO: 49296 - DNA, 1305 bp, Bovine  19866880579399
agcacagcaaaggcggggaggtgccacaggctcccccaacgaacaagcacagatttctcattgtaatcttgttacactgctttgattgttgtgccatgtgaatatattaaccattcaagacaaaacaatatatatatatatgattttattaagatgcacacttatacacatacatacataatcccttgtacagcaatattcaaaacaaacaagtggtccagatgtgctacagagcaaaggctttggagctgagctgcttggagttgactacagcccttccacttagcaacaatgtggtcttgagtaaattccttaacctttccaaacctcattgtactaatctgtataaaagggattcaatctccacctctggattatgggacacattaataagatgattagtgtaaaggcctttgcccttcacaagcatccagtgaattattgggtcactacttcctcacctgtctctgtggtcctttgcttatttcaagtgtatcactacacatatcttttcctatctgtctctgtcaccctcattcccttcagttctttaaaataaaactgaagcatactttgtgtcatttattatgtgtagttaatagactgctctttttcctgctcttaattttaataagctaacaagaacgttctgatttctagaagcaaacaagctggctgcattaaattgctttttacttctttggatttccaattgatttcaggagcgcaggtcactgacttttaagagcaaaactgatcactactagctctggtgcagagaccaaggacacccacccactcacacacacacacacacacaagatgtgcactggtaagaatgggcctttcctattaagcactctgcaaactacaatggtggatgaagaggcccggagagattgaaatgtttctgttgagtttcatttctttgaatatttctgcagcaactcttaacagaagtcagtaaatctcagtttaaccgccactattgaaagggaaggacacaagcaaaggggcaaaagggttttggcggcttccgaagtgtccattatagacggcctgagagacatgacgaatttgttttctagtttgcagacgcacgcacaacttcatcaccctctctctctccatcatccagggctgctttctaaagatagacagacatttcctgcaggacactccttcttcactcattaacggtgatcagtaaaccctgtggcgttcattaaaatgtttctctcctgctcagaaacaacattttttttttctttaaaggcaagtttagctgctgcgaggtcaaagaaa

SEQ ID NO: 49297 - DNA, 1249 bp, Bovine  19866880619996
ctacttacggggccccagaacacttgtgatgagaagcagcagctcacaattgtatcaaaaataagccttgttctttggaatctcagcatcactcgaagcactgaagctttgtcgattccatgccttgagacctcttcttcccaaagaagacgaagccttgaaaagaagaaaatggaagcaaatgaaatctctttggttgtatcacccaactcctccagttcttgctggtctaggaacttggttacagaaattgtcaaagataacacaaagagagagaacagtacagggcatttagattgcatgcatgccccagctccaagaattaccaacatttgacatttttgtttaatctctcctccccttccattatttttctttttgcaagaatatttcaagcaaatcccaaagatattgtttcatctataaatgcttcagtatgcatctcttccagataaagccctaaaaagccacagagtaaccataaaaatggttatgaattaatgcctattcattattaactattaataataggcatatattaatagcatagtaagaatggcatttaattcaactttctctaattatttcaaaaatatgttcttacaagttagtttgcctaaatcaagatccaaacaggtcccactcattggagttaaagacaaatctgacagacctcttgcatctcattttatctgtaataatttccaatcctctgcattttctgccatttactttataaagaatctgaatgatttatcctgttgagttttccacattctggatttgactgattgcacccctgtggggctcatataagtttctatgccatgtatttcctattaagctgttagctagatctgctgctaagtcacttcagttgtgtccgactctgtgcgaccccatagacggcagcccaccaggctcccccgtccctgggattctccaggcaagaacaccggagagggctgccatttccttctccagtgcaagaaagtgaaaagtgaaagtgaagttgctcagtcgtgtccgactcttagcgaccccatgaactgcagcctaccaggctcctccatccatgggattttccaggcaagagtactggagtggggtgagaggcataataaaattcagaattcaagtcagctggcaaaaatacttaatagatgatatagtatatgttccttttatcacatcagaaagacgtacaaagtgtgctatcccacttttgggatatgttaagcctggatca

SEQ ID NO: 49298 - DNA, 1099 bp, Bovine  19866880649553
catagcatcatagcttctttctttatactttacttctccccactttaaatcaacagaaagttttaaatatgttaagattttataatgacattcaaggaatttttataacatcaccacagttacaccaccatcgtgcaaaaggcaaggggagctttatcaacagccccactgaatatcacagttaccgaaagtttgcctggagcttgatctgtcttaactccaggctataccctggaactctttttttttttttaagtcattcagtcagtgctcagattttaactaatcctgtgttctactaaaaacagtatttcagctactgattggttaacataatcagccatgttaaatttccagaatttgataattacactctgtaagagaatacgtatccttattcttaagaacaaggtcatgatgtctgcagtttattctgacatgtttagcaatatttgtgtgttgtgtgtgtgtgtgtagagttggggagagagaaagcagatgtggcaaagtgttaaccgatgatgaatttagggggagtttattaggggaaggagtttctttatactactgtaacttttctataaattttacttttttaaaataaaatcactgatttacaaacacttttataaacattattattacccacttttgagccatttttgcttttcattccaactgacattttaactatacttctcttttcctttgagtcctgtaaaaatgcctggaccctaataatcagtgattgttcggaagcaaggactttctttgtgacccaaacttaaacctgtatgacaatttgattttttaaaatcacaaataatgcccaattttattaaaaaggacttttttttctccctttgtagttggttgaaatgttggatatgtctgtccctgcagttgctaaattgagacgtcttttagatagtcttccaagggaagctttaccagacattctgacatcaattatccgaacaagcaacaaagagaagctccaggtcagtgttcccctccggaatgccacgctgctttgtcacttcttattcagatctaggtagtaagtttgactttcaggtaagagatacggagacccaca

SEQ ID NO: 49299 - DNA, 1018 bp, Bovine  19866880670054
agatatttgtctttaactagcctgggagccatgggattcaataagcatcttctctcctttagggttcaaggtaataaagcatgcatctgcattgttaccatggctccacggcttggttggctttctatgagagcatttccaacatcacaccccttgttgtatttaaaagttgttctattatctactcaggagctggagaagagggcatggctgggcatggaaagtctcagtgaatggaaatgaacagattggggacactgatccgaggccaccatgcacagctcgtttggtttacactatttctgatcactgatttcttacggactgcccaatcaatacataggtctctttcataggtcaatacaagtgaggcccaaagctgaggttcatttcttgcagaaatggaggagcagggtctcagttaagacttttgattgaaagtaatgtaaaccactcaagccagcttaaacagaaaaaggaatttgctagaagggtagtagggcttctcatggaatcctagaaagacagaaaagtctcatctctagaaaaaggtggagcaggacatcttcgttgacactgaatgttgttggttttgactgttcaacattcatctctctttccaccatcactccaatttccttttgaaaaaacataatttctcttttgagtacagcctggtggaattataaattagggtcctacctgggcttcccaggtgatgctagtggtaaagaacccacctatcagtgcagagacttcatagacccgggttcaatccctgggttgggtagatccctcagagaagggcatggcaaccaactccagtaatcttgcctggagaatctcatgaacagaggaacctggcaggctacatgtccatagggttgcaaagagtcagaaacaacccgaagtggcttagcacatactgccttagcaaattgggaagccacagaatccaagacaggccaattagatgttcgctcccaggaatctgaatcttgataagaaatttaaagag

SEQ ID NO: 49300 - DNA, 988 bp, Bovine  19866880682384
aattagtgaattgttctcacagtgagtcaggcatatagaacctgcttttattaacccctccccacttccagtctgtttaccatgtatgatctcctccaggcccatctgattggttctgcctgtttgcaatgactgacaggccacttattactcctgcctgcccctgcctggcacctcaggaggcttttattagccctttacctgggtgagtttgggcttggaaaacacctctccttaaggcaatctcaagattatgttttctcacctgaaataaccagcacatttattgtttttgaaggaaagcaaaatctcataattgaagtaaaaagatgaatatgcttctggtttttcaaaagtgtatctcaaaacaggagagtgttcactcacctcggggactgtacactgagtaagagagaggagttctatagctgtaactcactcctggaggactctctcaccacagcccccatttgttaaaacatccacctaatggttatggacgatgcacttgcaaattgctaaccattgggttgaaaagcacttaaaattctggaccatcatcaaaatccctcacttataaggcaataacacttacctggaaaaaccatcatccatgagccccttcactacaatgaagaaagtcggatgaagatggttttcagcaaattgacaaactgagctaaactttatttaatttcagaaaggatggatctggaaataacattgctggtttcacgtgctggaaaaatcgatgctatgattttttatcttcttcctttctactcccttgccaggggctggtataataagtcatttggactggccaaacaaataaccagcccgagaccccagggactcatcttcgccaccctccagggctccagtgatggacaggccagaggactccagctcttccttcaggcactcctgttcgcatttggcagggctttcccccacaaaggaaatattaacagcatggtatctgctt

SEQ ID NO: 49301 - DNA, 894 bp, Bovine  19866880688896
atgctccaaatcctccctaagacccctacgctcaggtggcaaagggaacctgctggcttttggtgactcttaaaaccaggaacctttgctggggctgcagtaatttgatttatctcagaaacaagccaatgttacaaggctgggcttgcaatttcaatatgcagagattaatttacatgcagagctaattaagcaactgaaacacccactaattgattattacatgaaaaagaacacatcaatttggacaaatacactctataaggttgtacaatatttgcaaacttaattgccaagtggaaattccttttctagtggctgataaatttaaccaattaacctttgctgggatggtctttaattcttggagtccagaggcactcatcaggaaagcttcagtctctgctttttcaagctctcagtcagaaaagtcagtggctctgggctgtttctgtgcttgacacaggcctggttcatagtaagagctcatagtaagtgctgtgaataagggcccaaagagtctatagcaattatttcccttttattctttttttaacatttatttatttacttttgactgtactgggtcttcattgttgcacatggactttctctagttgtggcgagccagggctactctctagcctgtggtacatggcttctcattgaggtgacttctcttggaatgaacaggctctagagtgcatgggcttcacaggcttagctgttctgcagcacgtgggatcttcctggatcagggatggaacccatgttccctgcattggcaggtggattcttaaccactggatcaccagggaagtcccccacccccatttatttttttattatgagaattattctagatcatccttctggaaagcatattaatacaat

SEQ ID NO: 49302 - DNA, 1158 bp, Bovine  19866880699191
ttgcttctgtaaatgttcctcttctactggctgaccatgaacagtcactgacctgctgaaaggaaagtcttcaggtcactctaatctatgttctacacaatgatcaataacacaaggagagtcacaccctcacccagaaatgtgtaactcaatcaacactgtgaaggtgggagcagaatttgcccctgcaagcctgctgtgaacagcagaaagtgtgggtgatttcattatctgagattgctttgtcatatttctgctgaaccaaaggataactgaaatgaacattaataattcaggaccatggccagggttgcagaacttctgggccctgcccttcccagctttgggttcctcctgggtttggctctagaaacaacctggatcccatggctgtgaggagccccagaggccaggtctatgccatttctcaaggttagtcaaatctgagggctttcctggtcctcaaaggagacggagtccttatggaagagagatgagttgatccccagacccagcctgtggtcagttctcctgagcagtggaggtctcccacaggccagagttttcttctttcctctgatgctgtttccttcaaaggtagccatggttttgtgttttctgtttgtttgtttgctttttttgaccgaagggacatgttggcgtaaaccttgaatggaactttccttcctaggtgacctctctctccacttcactgttctcctcctccctcaccttctcctgtttcttctctctttcttcccctccctctgccctttttcttctctttcactccatttattttccctcttgctttaatagaattctagcatgacaaagccaaaatgctcccagaggagtcaggtccagaggtaacaaacccagatgtccttgggggccagcagttcacttaagcgtgtaaaacaagcattgagtactggggcaagcctctcctgtggacagctgggcagtgtgtgtgccctgcctaaagacatgcaagtttcatattttttgaaatccagtgctggccaaaaaaacacattcgggacctgaaggggtaatctagtctaggctggctcgcttctctgcagaggttgaaactaaggatcagagaaagggaagtgattggcccagggtcacagggagaaagggactctcagc

SEQ ID NO: 49303 - DNA, 1215 bp, Bovine  19866880757586
gtgaccttgccagcttgtggggaagaggaaatgaggtcatgtgtacaaaactcctagcccaacgcctggaacacaacagacttgtctatagtcatcacaggctgagggaggaaacctcgtttcttttttccgttctttgggaagtgaatgaagctgttcggttttccttttgtttctctgcctgaaaactagttcgtttgaatgaaatcctgggcctagaagccaacaagcagggaaggagtgcttcaggagaatgagacactgctggggaaatggaaaatgataaaatctcaacctactacttggaaatgcaaatatgtttcatgtattcatggtcactgatgtctttattggagctggaacatctaacacatccaaacagcacatgattagtctccataataggaacaaaacaagctcctggtgaactaatcagctgatcacgttgcagcgggtgttcagtgcttttccacaacaaatgtggcactcggttggtcccctggtgcctccgctaatgcgcacgtggggcatcatctgtcccagcacctgctgacttcagatgcgtcagcatcctcagtcaccgcagcctgacacctccaggtactgggctcagctccaggcccttgggggatcagacctagttcctgacgaggagagatcgtggtgagactaaagagcattggctgcttgtttatttgattaaaggaagaaaaaactccactgttacagaacaaagagtgcaaagcaagtcccttggcctggacctgttcctggctccgttatttcacttacatatgttagaaagcttggccaatatggaaaattgcactattgcttagcaacccaaattatagagagaattagatctgaaagattcatgacaataagcagaattctaacgggaaatacagtaaagagaaaggtccaggaagactaagctcaaagttggctcccctctgagtctccacttggtgcctaataataatcatagttagtgtgaattaagcacgctgtgggcaaggctctatgcaaagtgttatacattcattgtctcatttattcctcacaacaggaataaatttctccattgaggtgagtataatgattatctcctctttctcacaaggaaacagagatatagagaaaaacgttttagtcagaaagaagaatccagaatttgaatatcagactcccggattttggcatcatgcatac

SEQ ID NO: 49304 - DNA, 1945 bp, Bovine  19866880759407
attctgcacactcccatgcagggggaccaggtttgactcctggtcggtaactagatcccgcatgccacaactaagacccagtgcagccaaataaataaataaatacattttttaaggaacagtcatgacaagaatccaatgctaacaatcatgacaggaagccaatactcctcactttcaagacatgacttactcttaggacaaagaccaaaatcttaaaggacatggcccagcccacatctcaaacttcctctcataccctccagccacacttgcttccacctgacctggggactttgcacctgatgcttcattgtcctggatatcttctcctactctgtcttccttctaggttgacatccttctaggttctgattagactctcatcttaatcatcacctcctctgtaacgtttcccctagtgtctctaaccagtcagatttctcttcacattcaggaatttccctcagtggcatgtgtcatagtttataattatataattgtgcactatttccttaatgttcttctagcctgtgacagactggaatattggtcctaattactcaaccctccctgtgtatgcatgttttgttacataatttcacagtctcatttcctgacttcgggctcagccacatgatctatttaggcaaatggagtgaagtgatgatgactcagttttgaggctagaccttgaaatattttgtgcttctgccatcagcatgtgaagaacatgcccagtgagcccactagcacaaggagggtgggagtcatgaggattagaccgacttgacctgcaactgagaacttccctgaggagcccagctagatcagccaaacttgaaatcaacccatagacacagagcaaaataaatgcttattgctgcatgccactgaaatgccatggttgtttgttacactgcactagcagactgatataccctactatatgctaagctccatttaatcatagatcacatttttgctcaacactgcatcactatcacatgacacatagtggacccttaataagcatttgctaaatggatggatattagtggaccagtcctacattaccaggaggctttcacaaagcacagtgcagctccagccagtatggcccaagcttctgggagattagcaaagaaaaactgggtagactgagaccctatctgtgcctgctcttctccaagccctctgccgccagaacatcaaggattggagaaaaggcttacaacagaatgggttcatatacccttagaaaattaagacattcctgcagtcatcaaaatctacttatcaatcagcagcctgagtctgacatggtacctacaagtatctcccaagctgcttgtcattatttggatcaacttagagagaccatgaataaatggataatgatgatgactatctttagtaaaatactaataagtgtgggttagcccctgtgttcctttaattcgttgccataattaagtggggtttgtcctattttacagatgagaaatctgagcttcagagaggtttgttaacttaccccagagcacacagctaacaaaattctgggagaattccaaactgagtcatctatgtccctaaccacagagctatgctgcctgcgcaatgattcaggaatcccaaaatagttccaactccagcccatatcatccacaccatccatgtgggcttaggcaaggctcttcctttctctgagcatggattctttctcaattaagaagtctgaaggactttcccaatccagctgcccttggccatggtctgaacaactgttcttccaccctagctgccatctcccaaaagtatcctattaggaggaacaggactccaccttctcagacactgctgctggcaattggcacaacttttcctggagacaaatgaggcaatgtatatcaaaataccttaaaaattctactagtatttt

SEQ ID NO: 49305 - DNA, 2693 bp, Bovine  19866880799476
actaaagtttaatgcaaatacatcagttctagtagatgatttgaccttgagcttcctggaacccacagtgaaaaaggaaaacccttagagttttctctaaggagacagggttttcattgtttatagctgaattacaatctggctgagcaccaaagaagcatactttcagactgtggtgctagagaagactcttgagagtcctttggacaataagattaacccaagcaatcctaaaagaaatcaatcctgaatattcattggaaggactgatgttgaagctgaagctgaagctccaatattttggccacctgatatgaagagccaactcattagaaaagaccctgatgctgagaaaaactgaaggccagaggataaggggacaacagaggatgagatggttgagggcattactgatttaacggacatgagtttgagcaagctccaggagatagtgaaggacagggaagcctggcatcctgcagcccatggggtcgcaaagagtcagacaggactgagtgactgaacaacacagcaaaaggattcttagataggaactatttagtaggagaaggtgcttagtcctagaaggtatgtgaaggcttctacctgtaaaggtagctgcctattataccaaccctttctaaaagccaaggcatctggttgagcacaagtcaggaaagtgatccagaaagtggttgagctaaggtggtccaggtttgaaggtctctgatggctcaaaaataatcccaacaatctgaggcaggggtgcacctcatggaacagttacaacctatggtttaagggcctggcagcctgcctgctcctctctggctgcccccatagcccgaagttttccatggagccacaaaatctctggagtgatttctgtcctgcctgaggacagacataggcctttggaagcctgactggcacttccctagcctggaggggcaccctgaactttagggtaggtgcccaccagcactgctccatcccaccctgtataccagagcccaggtcccaggtgggcaaaagtgggcactccctggtccctttgcctgtggtggggggagtggctgactgctcagctaggaaccatctgatttcattcttattagtttctcaacaggactttcactggcttttcttttaaacaatttcttgggtttctttcaaggtcgaggagaaggaggccactgagggaggggggagagccccaccctaatcaaatctgagcagagacaggataaaaattgaccttcatttaaatatgtaaacaaacactgccttggtaacttccaagacgtccttggcttgggtcgctgaggagcagcccaaagtgattcatctgccaggtctcttcaagggaggaaaaactttattcttaaaggctttttacacttgaataagtgctaaataataataataggccaagactgaaagaaactcttttccctggaagggtgtcatcagaggcaggatgaagaactgaagaactccagtttgggagggggtgacaaaatctgggttgatgaatgctgacattctgaataaaatcactccgtgccttcacctaggtcaagaaacgacattgttttcctgagctgcggcgacagcgaggtgacagagattaatagcttggtattgactgagcaacttctagttccttatctctgtcaagtcaaggctgtgtccaagggctgaaagtgttattagacttataattgcaaagacatttaaagggtttccccttaagggactatgaaatccaataaacctttcacaaaacctccagctccagagtacgaaacccgtctggaagagaggcgcgctcccagccgagcaccgggaaaccttgaagccgccagcattgaataatgtttgatttatgaagttggttttgaatttgtatcagttgttttattaaaaatatatgaaaggaagttttaaatatgagcaaggcctgtaggcactcctctgcaccgggagccgccgtctggcccagcctcttgttgcctcctggctgggtccctccatccaggagggctaatttgcggggttcatttggcctgctggggttgtctcaatttctcacctgggtttagaggctgacgacgggagaggccgcaggtgtggagtcagtgggtttcagatgctatctataaaggtggtcccgagacaccgctcagctgggttgcatttccttgtccatagcagcagcattgacctctttaagagctgtccctgcttcctttcaggaaggctgtggcatcaggggatgcaggcatggcgaaggtttgtaggaaacccgtttgggatgctggatgtagggacgggggactaaggggcaggttaggactctgggcctccgtttttccatctgtcaaatgacagagttgaacaagacccgcccccctccaccaatcccccatccctgcccatttaccgcccaagggtcaccactggtcctaatgtctcttggagctgtgagaggagcccactcaacagggtaggaccttcaagcccaacccctcgtcattccatgaccagaggagtaccccagagagaagagtgctcatgaggacaggggttagggcagcagcccagtgggcagggcaggctgctagtatcaggaatgaggtgtggattgtcgaaccatgttgtttaaaaaaaaaaaaaactgcttccagggc

SEQ ID NO: 49306 - DNA, 1646 bp, Bovine  19866880840042
ccatctttggagcacagagatcatcagtgactgccgcatgatgttctctagagcagggcacgcatgcttcatgctttcattctagttcatcacggttagagaaaagcctaccgcctgcagggtccagcacacaagacccatgtgcattacatgtcactgtgatgaagctcctccttgcaccctgtggcctggatgctcagctcccctgcagggctccctcctcagagcaggtccaaccatcctcctgcctccacgtggttcactgacctgggtggggccattccaggttgtggcaaagaaggctgcttgttcacatgatatatattctcccttcttccttagtaacagactccaagattattctggacttgacacgcccagccaagaggccactgtccctagcctcctgcagcatggtgtggcagggggctgtatgcagacatgtcaggtaggaagtcaagaggtatgcacttgagcaggtggcagatgatgtgtgccctttgatcatttcttccctcctgcttcctggctggtatgtggctatgactacgggagcccaaggcccttcaggaccaaggacagctgcaatgatggtggcatgaaatagtggagcagaaagaaaagagcctgggaccctgataatggtgtaactgccactccagctctagactgcccacatccaggcttcctgcactgcagggagaaactcccaccttgcttaagaactgtatttctggcctctgttactgttagcagttctcagcagttacacgtctcagaaaactccacgcagaccctagcttagtcagtaatgaagcgagacccatcttcatgtctatgatttgccctcatgtacacagctccctcttataggaacctcaaagagaagaagactaggctgggggataaaggcgcctccagctctccacctatctctaaagagcatagatatagtctagagaatcttgttcaccaggggaaatggaatgagaagacagtctcaaagaggagtcagatacacatacacagcctcactttcttttgtgatgttagttgctgttctaataatattttcaaatgttaatttggtgtaagtcttgctggcacattcagtaaaaataggcttgtccagctcacagctaccgaccaattaatctagacagacaggaggttgagtctttaagaggggactgtcagaccctatgaaagcaacaccacagcaaccaggatgcgccaagacacccccttcctcatctgcaaagtccatcgcagctgacagagctgcaattatcagccagtggcctttgtaaaactctggagctctgaacacagctaagagatggtttctgggagatcacagggccctgaaaacttgccactgaagcctgcctctctgagatcgtaataaataataattcccaggatcttcatgaaatttctattctcaaatatcccttctcactctattctttgcctaaaagaaaaataatctctgtttctcagtcttccttctcaagacccagctcaaatgctacctttgaaatcctttcctgactctcccaaacagaaagattgactcatctgccccaccacccactaaagagcactgacatcaatcatttcacatcaattatttcatcttgcct

SEQ ID NO: 49307 - DNA, 747 bp, Bovine  19866880873460
ctcaataaagctgggaaagtaaaagaaataaaaacatgctactttcataagaaaaataaataaaaaaccaactttatcatttcagttcagttcagtggctcagtcatgtcagactttttgcgagcccatggactgcaggcacgccaggcctccctgtccatcatcaactccctgagtttactcaaactcatgtccatcgagtcagtgataccatccaaccatctcatcctctgtcgtccccttctcctcttgcattcaatctttccaagcatcaaggtcttttcaagtgagtcatttcaaattttatcatttcaaacttcatttcaaattttttcattaaagcttcataattggttgcaactgtcactatttgtattaaagccctccttgagtcactattctgagttcagtccgatcacccacagagttttcccagaaaacgttactgttcacactgcatcccccagaactggaaactttttcctagccctagctgccctggagctccccagatatcaaggtaccagctcaccttctaaaaccagtatggctggctctgttgggagcctcatggctacgtcctactcatttttggagaatttgattatttcattgtggccatctagagcattcagcttcagctgggtcagaatattaaagactggtggctgagcttccagaatactagattttcctgtccattgaaagtttttcattagtaaggcttacattgggcatcatacccag

SEQ ID NO: 49308 - DNA, 1345 bp, Bovine  19866880885653
accgcatgtatgtttgtgcgtgggacacagaactggcagggctcccgccaggaaagagccgtcaaaaggtttaactaggaaatccttcacatccatgatatgttcattttcctgctttattttattttatttttgagtctaccatccctgcttcagtgatctctaatagcttaatacgattagagatttcctctaatcgctgctcaatgtgtttcagctctattaaagatttatatgaaagctttatggaacacaccctttttagaattcagaaggattttgcaggttattattcataacatctgccacttactgaaaagagccttaaaacacccctttaatgtgtatttaatgcttctgatacaatataatatcaaataagacgtgctttattgtggcgcctgtgtttgtgtagccgcactgaagctccaccaccgttgtcggcctgaggtggagggtttataacagccataaaaacctgcacagagctcagcttggcatttaaggacacacagagagaaacggtgttttgttttttcttcttttacttgacttggtgcaacgtggagagaagcagtttgacaatttaaagagccactgaacataatctagacataaaacagtggtccttggagaagtattaaggtcaactattgtttgaaagtggatctcgccggcctgcacgcgtagatctgagtggtagctggtctggccaacaaaggttatgggcttctgctgattcatccactactttctctgatcaggagactgtaacacaccttctattatcctttatccgttaacccgacatttttactaagcagcatttattaacaactcattttcacattttaatttatgaaggatgtacatgtatgtatgtctttaactaaaaatgagtgatacgtagttatcaagatgccaacaggagttgtgttagggttgctggcttgattttttgtggagttggaggtcatgtagcagagaagaaagaatacaactctggactggaatcatagctcatttcctaaccagttggagggccttgggcaaggtattaacttctccaaaccctgctttgctcatctgtgatgtggggatgatgcctatgaatgaaggctgtttagttaaatgaagtaatacattcagagagcttagcaatgactggggcacattgcaggtgttcaatattgtgtcctatttttggaaagcatcaatagcatttatttatttatatttatttttggctgtgctgggactttgttgctgtgccctggcttctctagctacagtgagtgggggctgctctctagctgcagtgtgcgggcttctcaggcagaggctt

SEQ ID NO: 49309 - DNA, 1153 bp, Bovine  19866880905540
tagaaggaaagcaaggggatcactacctatatcatactgtcaagatctaggtaccaaatagccaattagtacaaaagacccttccggagcaaggagagaatgagcaaggcctgcccgggcagaagcaggatagcttcattacagtgactccctaattaaaatgtaagggttgctgaccattgcataattaaataaggtggaaggcggtaggagtcagctctccagtagtttctgggctcatgttactaaagccaccttcatgggcacctccaaggacctcccacaggccgttctggagctgtccatggtcctgacaaatgtctgactttttacaggcctgttagaacgaaactgcttccaggagacttttctcctcactgccctgagacccctttagctgtcctgagaatcactccaattttctttgtaatccattttcaaactattcaggaaaaagaagttggaaggtaggagtggaaaagacatcaagcctaattaactcccagctactgctttctcgatgtaaagttgctgaagctcaggttgactcctgctgatgtaacctttatcctttgtctgttttacctgccaggaggaaacttccttaagagcttactgggagctaatctcaggtttgacacaaaaaccaaggctactgagcacaatagctattcaggaatatttgcaggtgtgagagggtaacgacctggtgcactagatatgcagtcacataccaggaaagaaccctctttcagtatcagaagttgagtgtgatgagttcctggcaaagtcatcctgggagagccttatcttcttgaacctttaggaataacaattcttccccctcagggtttttaatctactctttcccatctctttatcctcacctgtttcctctctcctcttgattctgtgtcctttcttccatgtcttctctctcatatttctatttcctcttctctttcttcctcccatctctcttctttctttgtgtctatttctcccttattccatgcccgtgtcccactatcacatcaccactaaactagtacaaatattaaatggttcatctactcactcttttatttttatcggtagtctccttggcttaactcgtttttattacatctgtagcctcctggcttaactcatt

SEQ ID NO: 49310 - DNA, 1800 bp, Bovine  19866880925321
tctgtgatatgggaaaaatcttgatgtattaaaggaatagaatgaaggcctgtggggcttgaaggtagtggtggaaaaggcaatgagagagaaggtagccaggccagggcttatagggccttacatgttgcagtgaggagtttgggttttattctaaaggtgatgagaagtcatcagagggagtcacagagaggaatgaaaggatccaatttacattttaaaaagatcactctggctactctgaattcaatttcatcaggaagacaagactaactgacacggaaaattagagaataacctcaaagcaatatgattctgtgtctataaagggaatgcctcaagctctttaacatgagtgtctctcatattcattgaatactcattgaacaataataatagttgaacaactattacataccagatactgtacttggttcagagatacaaaaaataaacaatataaataatatcctgaacctcatggacatagtgaacaaacttgtattcatagtgaacaaacttgaataaagtgcttaattgggtgacacggagatcaagcaagtcactgggaatgccatataagggaagacttcatggagaagatgtgacttggattaggtggggaaatgagtagggagcacccaggacagatagaacaaactaatatgacagcagtggtgagcatgataacagtatcaacagttgccacctattgagtacttactatatgccaggcatcatgttaagaatttagcatcttttatttatttattggctgcagagtaaggcatgcagaatcttagttccctgcccaaggatggaacccatgtcccttgcattggaatcatggagtcttacccagtggaccaccaaggaaacctctagtcttttatattgtgtaaggaataccatatggagtaagccaatatctttctcctgttttacagatgatgaaactgagactcctggaaatgtttgttcaaggtcacatacttataaagaggccgatctgtatttcacttcatgtctgattaattctaaaactgaatgctatgctcttgagagaatcctaattgagcaaaagtgggcctctggttatacattttctggtgtatacctctggttagtaacaccacccttttcaggatgagttctgtggcaagacttgcttctcttctgttgtgtggatatagctcttgactcagtgtttccttttctgcctatgactctttccttacctcctattctgtctctcatttggcagagactgctaaatggtcacacatatctgttttcttctctttatggcacatggtttaatgtatttcccaacatctcttacagttataggtagtaatgtgactgaattctggccaatggagcatgaatggaagtgacgtgtggcactcccaggtctgccttccaaacctccctctcctacttcttacttgtttctctttctggatgtcttgggagccactcattgaagatatcaaagccactctcagcttgtgtctttgaataactgtgagtagaagagcctactccctgacctagattgcagtgttttatttatctgaaataaaataggccacttatttctattttatctagtagaaataaaattctattgtgttcaatcatggcatgattataacatatttgttactgccgccacacccacactaacacacacctgctttctgtcattgcttctgaggatctaaatttcctttcaaagatcattccagcctccccctgccctgcaagctttggctattctaaggtaatttgggccat

SEQ ID NO: 49311 - DNA, 1458 bp, Bovine  19866880999929
aaggaatcttcaagggcattacctttgtctccttatatttttaggagagagtaggctgaggctcagagaggaggactgactatacccaggacacacaacaaaacaggaatcctgcctctccatctccctgtgttgagggtccctttcttcctctgtccctttctttccctttttggacagatgccctttcttctctcctgaaaggtggacagagcctgagcttttctttggggctggcactttcggagactgtgaaaacctacaactgggtcacttctatagcattcaggacggcatgtggcctgtcttgcacttagggcagaaagttgtcacctaagggtgtgcagccacaccatttggaactgctgaaaacaaacagctccatcggaagatcaagaactcccccatgactgccccccaccacgccctcaggtgagccctgtgctcttagcagcccatgcctcaaacctttaaaaaccaatcaaaatctcgaagtgccacttttccctggctttgtggttgtttttcctcctcctcctcctctctctctctcttttcagctgccttcaaaacagagaggagaagcctctatttggctctgacaataagatctcctggtgcatttttcgccttgtgttttacttctgtcattgatcaatagacttaaatgccaggcctccatcacagccgcagactttgattgcccaaactgtcttggcccagcggagcttgtctgcttgagttctgatgctgagaaatgtcacagtagggaggggttaggagcctctgtcagtgtgcaagggaggggggccagtgacagctcattcagggcctctccaggcatcccacctgccccaagggttaccactggctggaattcattccagtatggggctgtttgcagccacaggtaaaatctgtcacagcataagcactgagtgggggaagcatcggctgtacccatggcaaccaagcctcattaatctgcttgttttgaaatctgcaaggaaaacagacaaccgagagaagaccctgaatcctggtctcggctgggacacacaccagcagtgtgacctttgtcctgtcactcagcttacctgtgcctcaatttccacagctcctatgcagctccccaccctccccacagtatgagaaataaagccaacagacatgaaagcgctctgggaagtgtagagtgctatagcaaggggaagcatatcattcttatccctgtcgaaatctagtgaaacaagtgcttttgtaaacctgcgtccactgaattgtgtctcgctgcagaagtcaatcaggggctgtgctgtttacagaacaattctcaagcactaatgagaaaattaaaattgtaggtaggtgtgggagaagggagaactaggcagttgctaaactatttgcaaacgctctagttcaacagttccgtttcaggatcctcacctccatctg

SEQ ID NO: 49312 - DNA, 1467 bp, Bovine  19866881029696
ctggccaatttgctgaacacttgactttcaacagccctcattacagacccacagccgtctactttctgacgggtttggagtaaatatgtaatcggggagtttttaagtcgtgttctgtaaagtgccgtctgcgtctgctgtttggttattttatatggtcatcaaagctgttctagaggtgggggcaggaatgcaatacaggatgagtgtggggtagacaacaatacaggatgctggcagcctgttctgcagagttcagtcaccaacgtggtcatgaacgtgcagaccctgatggtctgcagagcactcattcacattctaaaggttacatatcctttctatactcctggaggactcagaggcatcaaggtcacctggaaagtcaatggcagttctggaattttttctttttctaaaaatgttttagtgttcttttattgccaacattttattatgaaaatattcaaagatacagtaaagttaaaggaattttacagtgaaccaaggtatctagaatctatcattaacattttactatgcttgctttatcacttctctatctactcattaatccaccttatttggtacttcaaagtaaatggaagatatcatatattccctgcttgatagttcagcatggatttcattaattagagttcagtatttgtttacagtttctttgttttgatgtaaaatttacacataaatgaagtgcacagatctaaagtgcattccaggagttttaacacatgtacacctgtgcaacccagacccccctccatgacgttgccgtcactaccagaaattgccctctttcgtcttccaagtaaagtcttgcctccactccccaacaggcaaccactgttctgattttccccccctgtagattagttttgtctgctctataatttcatatgaataattctagtacccacacattcatgtaagacttgttgcactcagaataatatttttgagatccatccatgttgttgcatgtgtttggaaattacttcctttttattgctgagtaatatagcagtgaacgactggaccagtttgtttatccattctcctgctggtgggccaaccgggttctttccagttataacttttatgaatagagctgccgtgagcatcgtgtacacatctttttatggatttacttttttatttattgtgggacaatacttagaagtgaaatcactgggtcataggttatgtttagttgtgtaagaaacttgtcagcctgtttgaaaaataattgggtcattttatattcccaccaacaatatatgagggttcaagttgctccgcaacctttataatatttgacgttgtcattctttttaattttagctattctgataaatgtgaagaggtgcctcattatgggtttgatttgcatttccctgatgactaatgatggtggccattttttcatgcatttattggccattcatatat

SEQ ID NO: 49313 - DNA, 3498 bp, Bovine  19866881070501
ttggctggagaatccccatggacagaggagcctggcagactacagtccatgggttgcaaagagtcggatatgactgagcaactaagcacagtacaaagtagatgaggtgccaatcctcatgaagctgtaagtctagtgaatttgaaaaaaagatatgctagtgctcatgagccatggttgaaggacagcaaggttagtggattcagagggaaacagagaaagattatgttgctagaaggaaatttgtaagtgaatgggaatattagtcaaggctctctttggctgcaaattacagaaacacaactcaagtcaggttatgcaaaagaaggacatcactggctcatgtaactgaaagttcagggctgtaaaatgttactcaatatatttcatcagccacctagctcacgtctccaccccactttcctctgtgtgactatcttcagacttcatgcttacctcccaacagcaagagaacttgccaacctttccagaaaccacagggctgatcttcatgcccacatctctggacaaattccagaagcatggagatcatggtgggttgaacgaccagaccaggccatatgtcccctcctaggcccagaagttgcatgctgtgagtgctcagtcatgactgactctttgccaccccatggacttgagctgccaggctcctctatccatggaattttccaggcaagaacactggagtgggttgccatttcctactccaggggatcttccctacccggcgatcgaacctgagtcccttgcatcttatgcattggcgggtgaattcttgaccactgcactacctgaggagcccagacccagaagctagagtcatatatcaaccaaaatcaagattttgtacttgactgaaaaagaaatgactgacagcaggcaatgcaatggaaatagagttcttctagaatggagttaatatggaaggtaacctcagctcatttcagatccactaaaaatactccagaaagaccctaaatatctatttcagaaaccaccttgcacaggtgttcctattatggaaactttttactctcacatttatcccagactgtaactcacttcagagtttcaatctttactgttgggtctcagaacttcagagttgagatctttcatgggtgatgattggaaaggagggtcatggtccagagaaaatgctcatgaacttggagacagatgacttacacatgaatcctgagtatcctcacttccctgacactcagcccctcactatgaaaatgcaattcatatgagaattgaatgagataataggtgaaaaagcactttagtgtttcaagtaaaattctaatgggagacattattgttggtggcttcttataagttggtcttgcattactagctctattaaacactcctgaaggaaaaaggatgatatctcatcctgtttggtattccaaaaggccaaccacaagcctggaaaaatagtagtatcttcctaatttcttatcaagtagctcagtgagtaggtgaaggaaggaatgaatgactttgggcttagattccaatacaaattccttagaatgatttgtttaatcatgatcaaattttttaacatcaataggtaaagataaaagtctgattctctgatctctgaaaatattgtgtgcagttctgggcatacctttaaaagacataaagaagctggaggaagtgaggaggacatagaaaatgatcaaggaggtgggggcaggaatgccatccaaggatagatcaaaatgggctgctttgttctggaaatataaaggctgagaaggaaatgatcaaagtttttgaaatcctgggaggtggggagagggatgggttggagatttacccagcccccaatgtctttaatacctacatcacacacagagtggaggggtcaacccaatgtggtatttctcatgattttaagatggtctgtagattaaggctcacttttgaatgaatcattttcaaattcacatcaggaatgaagtcatttaagctacttgggttcccagaattcatggaagatgaacctgaagaggtgcttgttctaaaagcaattcatctaggaatgtggaacttctgcagacgagttgatggagagggccaatcaggaaataaaaactgatggcatcctaaaatcgtagattgtcagtgaacaaacacatctgaactttcacaaacagaattagggagctgcccttacagacttctctggctgaactgtaggccccatttctttagagagccttctaatgccataaagtttacctactctgtgctgaagagcaagtacagggctctgatatcagaacagagttgaactactggtttcatgactacattaagtaggtgtcattttgttgcaagtgatttatgatcaaattcaaattgccttcgacacagaaataatttggggttcaagttcattcaatcatagagactaagcagggatcaaccaatatcattaaattacagtacaactcttgggacttccctggtggttcagtagctaagactttgagctcccagtacaaaggacctgggtctgatccctggtcaggtaacaaacccccacataccacaactaagacccagcacatccaaataaaataaataaagataaagatttaaaaatacattaaaaaaatacaactctctctgccttactctctccctgcctctttttaactcccatcctgagctaagctctgagtgatggttgcttttatgtgtcaacttgactgggctaagggatgcccaaatagctaataaaacattatttctgggtatgtctgtgagggtatttccagaagataatagcatttgaattggtggactgagtaaagcagatgatccttcccaatatgagtggcatcatccagtccaccaggggaccaaacagaacaaaaaggtgaaagggcaaattcagtctcgcttaagagacattcatctactcccgccctcagaaatcagcactcctggtccccaggctttcagactcagttcaggacacacactggaaagcctccgatttccaggcctttggaccactgatttttctggccctccatcttgcagatggcagatcgtgagtcttcttggctgtgagccaccccttgggagagcaaagcagtaaattcccaaggaggttgcagctgaaggccaatgcagatgacatttagaggctccataatgatgtgagccagctcctattacaaatttcctctgatatgtctgtatctatatacatgtatgcttgctcagttacttcagttgtgtccaactctttgcgaccctatggactgtagcccacaagggtccgctgtccatgggattctcgaggcaaggatactggagtgggttcccacgccctcctccaggagatttttgcaacccagggattgaaccgatgtctcctgtatctcctgcattgcaggtggagtctttactgctgcaacactggggaagccccctatatctata

SEQ ID NO: 49314 - DNA, 817 bp, Bovine  19866881113106
ctttagtattcttgcctggagaattccatggacagaggagcctggcaggctacagtccacaggatcacaaagagttggacatgactgagagactaacaagcatccttcctggtatcactctggtaccccggtacttccagaaacccttcctgaagctgctgccctagaggcctgctgtggcaatgatgacgtttttcctttgggccttagagtgcctgccactttattttggggaaaacttgctcttttttaagtggaaaaaaaaaaaaggactagattcctggctacagcttgcctacaataattttacagaaaagaaaaatcagagctccagttattgtttttttttttttctttgtttcgggaggaaagctttcttgttcaaatttgggcacatgggtaacacagtttcatttcacaattcgcaataaagatacctgaactctgatggtatcagcaacctccggctacttccccaacacgcgccctgtaatataagctgtaattttcactgtgcagcaggggcaggctttatgggctgggggatggagcagagtctcatgtcaccgcatgcttgccacaggctaatcgtgtggaacagagctcaccctccaaatgtcacagagaatgaaggaacagctcccaccccccccccactccactggccctttggatgagagaagcaagtggtctctgggccctcctggccatgagctgtctaccaggctcatctcaggttcatttcaacttcctgctccagggcagtcagtggctcctccacagagccactgcaccccagctctgttccactgggtct

SEQ ID NO: 49315 - DNA, 2133 bp, Bovine  19866881120082
atagtgggaattagtcgtgagcatgggggcagctgtgttcattttcgaacccaagaggagggcactttatcccttctgatactgagaggacatccccaaagggagctgaagtggattttgattgcaaattcatttacccattctgtgtttattgagtgtcaactctgtgcttggtgctggtgatgtaatggcaaaaaaaggccagtttcctgctccagtggaatatgtgttcaagtggagagacagacagcatgctacccaacaaacacacagaatgagtagattgcaattatccccctgaagaaaacgcatgatgctgtgacagtgaatattggggtggtggatattttacatgtggagtctgggaggcctccccggggtgggaccatgaaaactataagaaagctgggacgaaacaggagaaaataatctcaggcagtgggaactgcaaggatagagcatgtggtgggattatgctcagggtgtcccagcagcagatagaaggtgttgggagcactggtatctcacactgccaggctatgacatgtaaagaagctttcaccagagtgtacagtaatgcgctgcttccttcatcgagagagtcttgttatgaagaaagtgtcagtggagcccagcagtgtgcttaatgatgtagttgaccaacgtcctggcccaagttcctcctcttatcacagacaggttgtattttgaggatggttagctggtcctgggaccacacactgagtagtcctgcagaagcagatgctgatggctttccaactagatccgtcactctatccatgcaggcacggtcctgtgttctcttacttaagagtgttcccagccctggagggacactctgccagagcactgggaattaatgtccctagaatgatgctcagcagtgagggatgggacagggaggattaactccccagcttccttactctatgttgggaccactctgagatatgtctacacagagggtccccaggagacccgagcccctgttgtccacagaggtgatccacttattaatgtatcctgttacacttttcccactccctcacaatgcttctgggatcatctagagatgatccccttgaactcgactccttgtctcaaggtctgcttctgggagaacttccacagagagtgtggccagactgggatgcacgcagggcgaatggtgcctgtggaggtcagatagctgtgagggccagatcacacagggccttgttgaccatggcaggaaacttggactttattctaagcgtggggaaccactgaagatcttaagcaggggaggagtattacatgatccagtttgtaatttaaaaatctctttaggttgtgatttgtggagtgggttggatgggagcaggaatagaagcgggggaccagttagaagttgttgacagcagttcagggaggagctgatggtggctagggggtgtggtacagatggagtggtttagtcacaagtcatgtctgactcttgtgacctcatggactgtagcctgccaggctcttctatccatgggattctccaggcaagactactggagtgggttgccatttccttctccaggggatctttcctgacccaggaatcaaacgcaggtctcctgcattgcaggcagattctttaccgactgagctatgagggaagatacagatggaagcacatgcatagatgtaagatacatttaggaagatgaatcaaaggacttgatggtgggtgggccatggcaggagagcgagggaggaggatcgagaatgatgccttgatttcctgattcccagtgtggacggagggagctgagtggtattctgccatagaaggcattcagaaagtcagtgatcagaacgagcttctctgctttgatagtgctccacatttaagccatgctagctgatctaggagtccactgcacacaatgaataaatatgtcctgtgtgtatctgggtagaatccctgagagaatattgaaaccactattacagccacaaggagaagctgttccctctatttcaccaagcacaggggcattaaacttaacaggctaaaaaatgaagtggaaggccagcccagtgaccgcgacagctgctgacgagctcacacagagagga

SEQ ID NO: 49316 - DNA, 1375 bp, Bovine  19866881148504
ggatgggaaactgtggttctttttattctcttttacttgcttatttacaattgcttatgcattgaagaaaaatcatttcaagattttcataaacaagccaataaggactgcagattaggtcaaggaatcgatcgggggttggtctttctggcaatttccaatcatgtttttgttgcctagattttcttattctctcatgtgccactagaggctgtagttcgcttttgtaaagaaattggcatcgtggacctatcctagagaagctagatctgtggcccgagtcttcagattgtacgtacagagctttagggaggtgttctccatgcaagagacttgattcctgcactctgaattgtcttcatttatttcttccttttatctgtggcacattattgtgtgagtatttgatgaaatttagagagtgagtttgtggagttactgttataagattaatgtcttgggcacatgacatgtaggtatttgtccttatttctttctacattcgtcttgattatttagtaaggcttggtgcccagcacacactgaacattcaataaaaattacctttcgttattttaattttcagttctcaggaggacatgtttagatttataagcttcagtatgactttttataaaattcaatctgattcttaaattgtacctaaaatatcctgtttggaacattatgtaatttgtgtggcagaattgtggaaaatgtatccttacgatgcctgttggtgcatatatgcatgctgagtcgcttcagttgtgtccaactctttgcaactctgtggactgtagcccgccaggctcctctgtccatgggctgctccaggcaagaatactgaagtgggttgccacgcccttcaggacccagggattgtggtcttcctgacacagggatcaaacctgcatgtcttacacatcttgcgcattggcaagcgggttctttaccactatcgccacctgggaaatctggttggtaggcaatatataaggtcataatcctcaccacttattatgagcattgttgggtttaaacagatccctgttttaaatctttactgaaactgatagaaagatttgttttcttttttcaagtgagtatacatttgtgtgtgtgactgttaagagaactgaacctaaagaaaatgaagtttttttttttttatggatcttttgtgaaagaatcttgtgtattgtgtataagcttttttatggtgcatgttgaggttatgatcactgacaaataaaaggtatgcgggtttgtctgtgaatcattctattaagcctgatttttccgtacaccttgctggtaacatgtacttcctagccatcactgtaccagctgttttgctaacactgcggccata

SEQ ID NO: 49317 - DNA, 897 bp, Bovine  19866881150075
tctctgcagcaactaaggaaaaagtaaagatgagtggcggagaagtacagtccaggggttttaataaataccttcacgcttggcctctggagctaacagttctcaacagcatgtttaaaaagagggtagcaatttcatgattgcctgaaataaagtttggcaccaagtgcttttaaatatgcagcctaataaaaatactgaggtaaataaaatgattgtgtttgttccttgaaaattagggcatgtggtgcttaagcatcgaagtcattcatacatactttaaggtaaaactgtttctgataaatgccaaacctcctgatttggcagaaagcctgtgtgactccaaattgagggcagtaataagttctttgaggtgcagcgtacgctcaggtcctctgagggggagcctgcctttgtgattaggtcagcctgaaaagcatttggctcttgttgaccttactgttcattttccttccttctcccgaggtgtctgagcgtttgagtcaaccaggagtggcgatcggtttggcttggactcccttaggtggggaaatcatgttcgtggaggcaagtcggatggatggcgaaggccaattaactctgaccggccaactggggaatgtcatgaaggagtctgcccacctcgctatcagctggctccgcagcaatgccaagaaataccatctgaccaatggtgagtggcccgccccagggtgggggcaggggtggggggcatgctcaaagctgtgggtaaagaagagccttgggatcatgacccaggaggtatcccccagttctgaaacagagataaaggagagctttaagtgaccacttacaccttaaagcacagacctttgcttttgaactgcagtggaagttctagttcccagctgagga

SEQ ID NO: 49318 - DNA, 970 bp, Bovine  19866881250756
tctgatttcgattgaattgtggatgcacagggccacggccccagagagggtaatgactcactgagagttgcacagcgagcaagtagaagttccttggctccctctctctgcagtggcctctctcttgggtggaacagggactctcctaaacaatgtgaaaagccctccctgacctcaggtggcacgaaaattctacaaaagttaagtcatggcctgaagagtcctgggaggagatgctatagggtctaaatcctcagcatgcgtggttgctgctgcctaactatttcagcaggcaggaataaagtcctggggagaatgaactgagatggttgagctttgatggggctggagggagagagaagagaggcaggatctgcccggttggagcatcaacccgtgtttcacagaaggtctttggttgaaggtgaggaaacaggagcagaggagctgaaaagcaccgaggcacactcacctacttcccaatttgcctgagcaggtcctggcatggggttaattgcccacttttcctaccctgtacctggaaaccttcccagtctgcacatctgtcagggctgggcagcgcccctcccctgcaggacacatccaagggagggcaggggacgaccagcagactccctctcaccgctctcccgccgcaacaaacacctgcccccgcccccgcccctgcttgtgaaccatctggcccaggaccatctgctggggcagtggggtgttctgaacagctccacagccctttgtcagtttggatgtttaactctccacttggctcagctaataggctcccaaagatccagggcttccccatcgaggcaggaggagctggctcaagtttcccaggatgaaggatttaggagaaaaacaagcttgttcaagctgggcccgctccactttctgcagcgatttcagtgttttcatacctttgtcttttcacctaactcctcaaatagcc

SEQ ID NO: 49319 - DNA, 957 bp, Bovine  19866881326962
atgcaggacttgaattcctgcaggcctttcagactcatctgtgtgtctcaaagcatgtgtgtgtatgcccaggatgcaggacttgaattcctacaggccatttcacctccccaagaggcagactccaccaaggtgacttggccaccagaatggcacccgagatggactgcctccctccatccagtgaccagagtagagggcttgtgacctgggtcaaggtggtcagcccgctggccagagggaggctgtggaaggaagctgcctcccccattcctgagacctggggcccgtgtccagcctggttcctgtgggaggtgctgggaacacattgttgttttttgttttttttttttaagttgaccagcactgtagaagcgctgtctggagtacgcctctgtgtgcgtcataccctcctttcttttcctttacggggacgcagagcagtagaatgacctttgatggtttttgaaactgaaagcagccttttttatagctcgggttccagtctcgtgtcatatgtggttccagggctggtgacagtcatcggggaaacagagcctgggcaggcagggggtttgcccataaactggtcatcagcgcgcagagtaagccctggagctgcagcacccgagccccagggcttctggaatcacccccctgccacctcctcccacaagactccgcgccgcagacggtggcctctggggctttccttctcactccttccactggtccccagcaagcccgacttggcctcgaagcctgaaacccagtctggggtcaggcctgggcaggccctgccctctcccctcgcggctctcagagagagggggagggggcctcccctgaaaagaatgcgcttgtctgcccgcctgtctggctccgggatcagtctagggtttcagccaccaaaaaaggctgcaggaaggagagggcctcctgcggcggccgggagaa

SEQ ID NO: 49320 - DNA, 1103 bp, Bovine  19866881408220
catctctccactataaaatcttcaaagatagttacttcatccttatacttatttattcactcacttgtttagagacagcatagtataatgtttaagagcatgagcgatggatttagagacagcatggatttaaaggctagcctgtgacaccttactggttatgtaatttacagtgagtgaccttatcctctttaaatcctatttcttatatgtaagaaagatacaacagtactattcatcttctagggttgttgaaaaaattaagtgcatatattatttcttgggtacttattacatgctgataatagtaattattatgattatttattcaacaaacatttattgtacaaatactgggtgcctgatattcttctaggtgccacttacaagatctaaccagatgtttagtacagagtttgggctcagctaatgttcactgaatgaataaagactgaacaagtcatctatatttagtttttaaatctgtgtattagtcgggcaggctggataatggtatgtaataaacaccaccatcatcccaaatcttagtagcttaattgaacaaattgttccttttatacattcagtgtgggctggctgagatgatctgttcatcaggggtcagaaaaccaggctgaccatggtcccatctcaacagatgcttctatgatctctgtagcagaaggaagagaacgatgggttctctctcagaggttccacttgaaagcagcacacgtcatctctgcttgcattgtcttggctagagcaagtaacaaggccctgcatgactttaaagggcagagagaattgcagttgcagtcctatcctttgccccaaaggagaagaatcagaatatttgtgaatatccttcaggactatcataggctggaagctgatggtacagtcttctcactaacacacagccatctttggcttacaaagaacccccagttcaaggtcagtatcagtagttacccccaagcttccagtttagaattaaattttcaaattaggtctttctttcttctcacttccccgttcaattatattttaagcagatgggtgatcctgtcagctttaaaacaacagagaaaaaaaaccca

SEQ ID NO: 49321 - DNA, 764 bp, Bovine  19866881472082
tatgactgtgcataggaaatctgctgatgtggaggctgggggatcatgctaggatacacagtattttctgaatgtatttgacatttgtgtcttttttccaaggaccatcttgcagatttacgtctagcaaaacacattgaaaaactgtgccacacaacacagcccatgccaagagaccaggctggggttctggaaatacaaaccttaaagaagggaagtcgcagcataaaacaaatccaaaccaacaaatgctctttcgttcaccttatcttagttccagaactccgcatttaatgaaacatttcaggatggaagaggtgaggacaggaagcgtctgccctgctcctgagactctctgagccacacttcaacccagatcaaattaaagcacaggctccttagacagaagtcctgtgatgagagcagagagcaagctggagggttcggggctgagccctggccaactgcaataataaaacagtgcatggacatggaggctttggaacaaaaataccttgtagctattattttcctgagtctctacccaagcacacaccccctctcccattcttttaatctggagctactgagaagcggtatttttctcacctttgcaatatgagaaacaagttaattaaaaattgctcccaactccagtctcagagcgtccctgctttggctgcagatctatcaacagtgtgttttgatagcagtgcacgaagcggttattcggagacactataatgcattaatttaggaggcat

SEQ ID NO: 49322 - DNA, 1168 bp, Bovine  19866881648583
aggtgagacagaggagcaccgccctggccccacagttgccatgactacgctggatctttgggcactgagtatctcatgctccctgccagactagtccaactctgaataactcctactaccatggacagcacttatttcctgccctctgctctgcccttcagcctagcaattcctttaagctgtaaacacacaggacaaacctaggacagggacttgtggggtgctgttctgggaagaaagacaatgcccaagtacaggacagtttttctcccagtgttattcactccacccagtaggcctggctgagttgtctttaggctggaaggtttagtgctgagcaaaaaaaaaaagcaactcattattgtacattcaaatccagggggctcatttttactatcattacagaaatttaatcttaagaatgcttcttctctgtaaagcacagaacattctgattaacaaagtcacaggaaaggcccacagggtgtgaatcctctccagagctggcgtctcacaccagtgtggaccacctgccccggctgtccccaccttcatcgtctgcttaactgaatcatgaatctccacttgtgtaagacttgaggctgtaggtcttctattctggctgccctcattcagcaaaggagggtaaaaatagttctttgcatatggaaatcacttcacagcttacaaattgctttcacagccttaatttcatttgatcctcaaaacagccctgtgatgagaaaactgaggtccagacgggttatgtgacaagcctaagggcaagtggaaataggaaaagcaaggactaggacagggtcttcttactaagatcctgtgctctttgcacagcaccaaactgtatcttcttacctaccatcacccgccaggcgacaggtgaccactgccaacaacatcaccatgtcaccacccactccaaatccttaacaaccaggagaacacacttgtcagctccccatatgggtgctgacactttggttctcccacctccaccactcgtcaagcccctaaatcgcccaaacccaccaggagagtgagcctggctcagttcctttctgcacagggagtcagtgcaggagactggagtgagcatgtgctcacgagccaggcagacaagcacaaaccttggttctgccacttcctaatt

SEQ ID NO: 49323 - DNA, 1728 bp, Bovine  19866881726888
gcaccctactccgtactcttgcctggaaaatccctggacggaggagcctggaaggctgcagtccatggggtcgctgagggtcggacatgactgagtgacttcactttcacttttcactttcatgcattggggaaggaaatggcaactcactccagtgcttttgcctggaggatcccagggatgggggagcctggtgggctgccatctatggggtcacacagagtcggacacgactgaagtgacttagcagcagctataagggaaaagaatctgaaagaaaatagatacatatgtataactgaatcactttgttgtacatctgaaactaacagaacattgtcaatcaactatatttcaataagaaaaagtctaaaccaattgatgtcactctcctgcttaacaactttcaatagctccctggtcacaatcaattaaatctcctaaagtgggcttacttaatcactctctgttaacctcttgggcttatctcagagcctgttcttcctcactctgaaaactccaagcacactccacactagatacttctgtttctgccagaccttgtccacctcagggcctttgctcttgtgctgtgctctgcctgcaacaatcccctgtctggctcccacatcactagccatctcattaatcgtgtctcagttcaaatgctcactctctaccttaggagggttcccctgagcaatctgtgctaattcatcacccctcctcaccacagccattctgttacctttctctattgtacacaataacagacacccctcactttctacaactatcctatttatactgttcttaaaaattaacttataaactaccttctcccattgaagattgaaactctccaaaaccagggatctcttgttcactgctatatcccagatgcctagaaaaataactggactcagagactttatcacacaaatgcacaaatggattgtttctactgctgtttagccccatgaagtggtgggtttctaacacttgagcatatcagagcagactgagtgagtttgtatcagagatggatttctgcattgcatggggagcacttcccagagctcccggatgcaaggaacctgtgatgtgcccacaacaagtaaatgacagcaaccttagatgtgattcctctgctttagccacttgctaaaaggaaatttcttctagtttcatacctttggttctgggtgttttttaattaaagacactctttgaagaaatgggctaatcccgccagtacctgactttctaattccctctttctcactgtgaaaggaaggcatattggccactctggccccaactgagttgttttcccagagaactttcaatccttctatgcacaataatgaaatatgataccaaacaggcctgtgtcaataaatctacaggagaaaggtcaggtttacatcactggatgggattggcaaatacatttgttcctgcaacgtctgtgttttaaatgccaccctccgatgaacctggtgctgaaacacactttggagtttgatgagatgtcagttttgctcagccctgatcaaataagatgaatgaaagtgaaacaagaacaaaaatattacttctgtcacttttataatgcattacaggaattggggtcagtcggggagatttctcttaaacaaataccaatccctgcacaatgtcacccatgggatctggtagcaagtggacaatgatcactttttgcat

SEQ ID NO: 49324 - DNA, 1508 bp, Bovine  19866880410031
gagaacctcacgattacctcgttattgcttctcttactactgcagtggattttacactggagtctgcattgcaatttattgtgacctgtagacctagcagagcacatacactttttaactgtcatttacaaaatgaaaacaaattactttttacatactagattttaaaatgtatcttaaagaccatagaattattaggaattcacaaggtgtgctttattgcaaatatttaaaacacaaaaaaagagggatggagatagcagaagagagagagacagatttgaatgcttttcattgaacgataaatctaatctggtctcttccatatttcattctcaccagcgtaaggccagtcaatcactatctaatctgattagctaacccaagattttccttgccgcctgaatgccagctcatctcattcttatttcctgcaaatgtgggtattgatcatactataagctaggactcaatattagctgcttggattatcagagtttaattttggcagcaacaatataattgattcaagctgaatactgctttgcattataggtccgtatctacttcactatggaaggactgaaggtgtcttcaaccttgagttcactcttagacattgaatgactatgaaacatttacataagagggagtacatggaagatactaataatacagtgatggtcctgatgattagccacagagtttctcagcctcagtagtacagatattttagactgagaaatttgttcggggtgggaagctgtgcattttaagatgtttagcaacacctaaggcctttacccaggagaaggcaatggcacccaactccagtactcttgcctggaaaatcccatggacagaggagcctggtaggctgcagtccatggggtcgctaagagttggacacgactgagcaacttccctttttactttcatgcattggagaaggaaatggcaacccactccagtgttcttgcttggagaatcccagggacaggggagcctggtgggctgctatctatggggttgcacagagtcggacacgactgaagcaacttagcagcagcagcagcaaagcctttacccaatagccagtcctagccctcttctcccaagatgtaacaatacaaaaaatgtctcaagacattgtcaaatgtttttcggttggcaaaactgtttccagttgagaacaactgatcttatcttggctaccatgtatggtattcctggcacaacagtatgggcttatttgtgttttctttccttccttccttccttctttatttcttgccttcctgctttccttttcttttgagaaaggtagtatattttttctagtttaaaaaacacgtgattgtaattattgtatttccttgtggcatactcatatagagaaaattttattggacattggctggagaaaacaatgtgtccccatttaattccacctttaggagacagtcaggatgttatttttaaaacagcattctttattggatactatt

SEQ ID NO: 49325 - DNA, 1842 bp, Bovine  19866880475893
tttatgccaaaaatcttacagtaaactattacaaaaattaattttaattatctatcagataataactgaattaactcctcttttcacctcttcaataaatgttctttaaaaccttgaagctgcaaatttagtttatttagtttacttaaatggcttgccatataatctaattggaaaggctaattttattgtcaaattcattagtcccatatgatatactttctgccagaaaatggctaacttgttatttctattcagataagcatatattttctcttgacaatgacccactgctgatgaactaattctaaaatagataaggcagaggccctcaccaagaatttgtcatttagattatttgggtcacatagcacggagcatttcttaccaaagttttctttgcgttccttttactgtgttctcaaccaggagcaatgcattttctgacagtagtcaaggaatggaacagaccgagctttgaatcaattcaaaatcatcactcttattgtctcaccctgtgctatcttaatccggaacatcctgataacagaccaaagtacacgatttctcatatcactcttcatccttgaaatctaggacatcctgctatgggtttggttgttttgtaaaacggaggttttgttgatatccaagtgtccatttgtttggagacctctagtttaacacatacatatatgtgtgtaatatatacatatatgtattatatacattatactgaaggtacattatatactattgcacatatacatgtatgtggctgtgccaggtcttaggtgaggcactcagggtcttcgatcttcgttgcagaatgctggttctttagttgaggcgtgcaggatcttttggtttcagcaggtgaactcttagttgcggcatgtgggatctagtcacctgactatgcaaacgagggactgaatcatggccccctgctttgggagctcagagtcttggctactggcccaccaaggaagtccctggagacccctagatctttttacataagtgcatgagtgctcagttgtgtctgactctttgcaacctcagggactgtagtccaccgggcacctctgtcctcagagttctctggggaagaatacaggagtgggttgtcactgcctcctccaggaaatcttcccaacccagtgatcaaacccacctgtcctgcgtctcctgcattggccggcagattctttaccactgagctaccagggaagcccctagatctttttatatccaggagcaaagcaccaaagtaagatttaggatgctttatctttgtaagtgtgggaaaaagcaatcatgaaaagagaggtaggaaagctattaatacaacatatcaacttcaggaaagtcctttgataagttttagtgaagaatatatatgaaagatgggatattagacattaatttccttaaaaacatttcatttcatgcctgcctcttagagttttcatgtgccctgtgtggtactcatctggggatctacatccagtttacagctcactgcaccagagaacagcaagagaccggagaactctactggagatcatgatagtatacaagcttacctttatcttggggagaaaagaaaggcaaaacaggtgaaaactgagtactcaaaaatgaactaagttattctgggagggatcaaattctaaaatgaatggcaagactttccctggtggtccagtggctaggactccatgctcccaatgcagggggtctggattccagccctggacaggggaactagatcctgcatgcttcaactaagacctgacacagccaattaataaataaaataaagtgaatgacaccgta

SEQ ID NO: 49326 - DNA, 1020 bp, Bovine  19866880520918
gtaaaattactatgctccatcctccggctttatctaataattttaaaactaatcattccctctcccttgtactttttcttcataacagttaagatgctttgtgattatacatgcagattccatgtcatggtaaagtctgactttgccttccagttccttagctttcccctctgttctgagttcttcacttcttggttcagggtctatcatacaaagacatggactttgcttacataaaccccagtgaagcaattttgaaaaccaaaactttatttgttagccccagaaatgcgtatgtaactcattgttgcattgttctgaattgagtattatgtgcctatcatctctctcccagtctgcctgtgggggaaaatgccattttctgctccaatgatgtgctctctccacttgaaagtgtgaaagggattctaaaggccctctggtgggaacagtccattcctgcctggagactcaaggaggcacagattctccatttgggcaatagccatgatactttctgcatagcatcattaaaacttcccaaggcaacggtagctgggagactttctgtttaatcactttatacccaataaagtgtggattacataatattttcataatgccatggtaacctaatgagtcatcctccattataggcaagtgtacttgtgtctatgatcagggcagagtgtcatcaaagccaggagggaggcatactgacagattcttaacaactttctttttttaaacattatgataactgctcaaaacctttgccagagtccctgaagcagcaaacttaatccttgcaaaataccttcattatgtatttcatattttgaaattcatgtctctgatgatattgtgaaagttcttaatcttatcaataaaatatttccaatttctgctgaaaaatggtgacttctgggtaattttcctgcctgtggtgattggattagctgaaatcccagctaatgcccttttgtgacatgatttcctgttgacttcctgatctgtttg

SEQ ID NO: 49327 - DNA, 713 bp, Bovine  19866880664182
atttctatcattttctcctgactatgttgtcccccccacccatggcttacctgtagtgtcgggaaatctcttcttccacctgggtaatgaaatcacatttggtacatgagtgttctttgctttccttgacagccggctgcccgtctggtccttgcaggtgactgccttcttgcttgacatccgatgcctgggactcgtgcgcgctctcataatgaaagaggagcacatccacgtcgggggtggagaacgagcactggtggcactggtgtttgactctcgagctcccggccgccccaggagacaagtgcaaaagcaagagcgcacagtgggaacaattgctttttctacaagcgaatggataagtgatttctccaaggtgcttttctgggctgcaaaggcctctgggacagaatggacagtgtttaatggtacacttatgaatgttgtggagctgttgataatgacgaagaagcggccccaccacaatgacgtcggggccatggctcttggaatatcgaaagtcacagaactgacagttgtagctcgtgaccatgttatcctctgctcccttgctggagaagtccttcttcttcaccccactagagcccttgtctgccttggtcattggctccccttctgcgcttttggctagatcattctgattaatgacagagcccctggaaagcttatcattcaattcggattaaggccgc

SEQ ID NO: 49328 - DNA, 1929 bp, Bovine  19866880768713
agtaatcccatgatattgatgatgcctggaagagactggtggctataactacagccaagagaggagttaggaattcactgttccaggtcacagggctccttacatgctgtacctctgactctgtgaaaaagagcaatggaagaaatcactccattgctagatctttacgcacactggggggatgtttggttcacatgcttgaagtttgggattctctgtcattgtcaggaacgcatgcatgactgaactatattggcattaaatccaagttcattatatgtttatattcaagttagctgaataccgacaacctctttctatgtttttcccacgtgaaatgatcaagtggcagaaatgttttttaaaagtatggtttttatttctacagaaattatttgaaggtacaaacatttagcatgaagattcttacagaattcattaaggaggtattaataatagtatgttagttgctgttgcactagaggaggtggctagctgagacaaatctgattagtcagaaccctgccctgtttggtaatgacagaaggatggcattgaacttaagtaacttaaggaataaatcccgcattttccgaaagcctttcatgtttaacccagtgtcacaaataacgccacatggtatcccacctccctatattcagcccaactgtatgaaaatatctttatactgcatagtcagttatgttgctcagacttagaaaacaaactcaataatttattttaatctgtgttcattaagttttgtttaacctacaagaataatgaagcagcatttcttctgcccccaggaaatagtatggaaacacttcagacagaccgactccattactaaagaaaactgtgtttcgggagacaccccctaacttatggttttgattaaaggttcttcttgcattcttattgcttttaacttttctgttgtttgttgtaaaacctgatctataaaagatctcaatttgaaaatcttagacttttaaaacctagaaaattttgcctacacaaaacagcaaatattctcttgagggtaaagagcacacaaacagaaaaatgaaggaaagaaaaagaaaagacaagaaacctagtattaaaacactggaaagctgctggccctggttaatcttatttttgtgtattattaataaaaccaaaaattattttggttttccaaagaagcaggacatattgattcatcagtagtacatacatgtcactagcatagagcaccttccatttgctggaaatttttgttctgctgctgctgctgctgctaagtcacttcagtcgtgtccgactctgtgcaaccccatagacggcagcccaccaggctcggccgcccaccaggctcccccgtccctgggattctccaggcaagaacactggagtaatcttcaaatgggcttccctggtggctcagaggttaaagtgtctgcctgcaatgtgggagacctgggttcaatccctgtgtcaggaatatcccttggagaaggaaatgacaacccaaagtgaccacaattttattgggagataaattgtaataaatttgagtcaattgccatttgttattgatcaacataatttcagagtttagggaataaccaagaagtgtgtcatctctgaacctgcataatacttatgccaaagtagatcttcatccattcctgaatttattcctctattaaataaaaatgggaataataataattatatcacagattctgcttgagacataagaatattgttaagtgcaaaaaaatatgtaatttctgagggctttgtcatttttggatataaaggtacttcattttccaaaaaacttgaatatcataataactaggctaaacggatgagtaaacatttctagtttatggtatttatcctgaggtctgccacactgccaggtggtaaata

SEQ ID NO: 49329 - DNA, 1669 bp, Bovine  19866880813492
ctacattttcttccagaggcctcatgcatggaagaagaaccggaaaagagggtagttttccatatgttgtccatttggctgtcagcgcttgttctgacgaaaaaggaacaaggtcttgagtgactgctagtctgtcttaaagtatggtaatgaggctaattaggagagatgagcgcccagctagatttgtgaaggcaattatccatctagcttttgtgccatgctttatctttatcagatccctcttctctaattttgtcatttctcaaacatcacaagaatagtgaaaatgtctaaagcaatatgatcagtatggttggtagaaaagaataaaatatactaatgaaattctgtgaacctgctttatatttggactcttccaaaataaagattgggaacatagctaagatagttcttgcttgtagtgttgttctttagtttacagaaatgaaaattaattggactttattattatgagtctatatatcttctttggtaagtgaacagtattttgcttggtccttttatgttagtcatcatggcaagttagtaatttagtgtagttaaaaggaaaagacatcagaggcttgcaaagcaagcataaaatgtattctcttttatgtgatttagaaagttgagacattttagtctctgttttcaaaggtttaatacattttaactttgacaacaattatgaaagtaaactaatggactcagatctctacatagcgatttcatagcagatgacattgaacatacgtttcatttgttctaagtatttaatcacagaagttaacagttaaaacacttgtttttacaaaaaaaaaacaaaaactgccaatttatttctgaatagcgctattgacatttcttctgagatatataaaatatggccttctaagagcatcacattagttctaaagtgtaactaattttagccccctcgcctcaaaagaagaaacctagagttattgaagattatgctaaatgtttaaaagtttacaaactcatagaaaaagagatgagacttgggtttaccagaggcgagaaagggagaattgcaggagggtggtccaaaggtacaaactgccagttttaagataagtaagaactagggatgcttggagaaggcaatggcaccccactccagtactgttgcttggaaaatcccatggacggaggagcctggtaggctgcagtccgtggggtcgctaagagtcagacacgactgagtgacttcactttcacctttcactttcatgcattggagaaggaaatggcaacccactctggtgttcttgcctggagaatcccagggagggctgagcctggcgggctgccgtctatggggtcgcacagagtcggactgaagcgacttagcagcggcagcagcagcagcagggatgcttacaacaggatgcttccagtgaacactgctgcctggtgaagggataggaaaattgttaagagagtcagtgagaattttcatcacaggagatcttttttttcttttttctgtttttgtttttattgaatctatatgaaatgatggatagttagaggaaccttttgtaggaatcatttcacaatatatgtaaaccaaaccatcatgctctgtgccttaaacttacacagtgatgtatgtcaattacttctcaatacagttggg

SEQ ID NO: 49330 - DNA, 2782 bp, Bovine  19866880851821
tgggtgcttaaagggggtacgacaaaatagataaaatggggacattattcaaatgcagcaagattaatacctgctgctctttgggggtttagtagtagataagggattccgaattaagcatgacattctttttaccaattcacatcttcagatactctcattgttaaataaaattctctcaatatgaagttactgaatcgagagaggggttgtttttttctttttttcttttcgtgaacttctaaagatcaataatgcataacagaagaccaagacagaatttgaagtatagtaggtgctaaaaactaaagaaacatttcttagccatttgaacttcattttcttcagtggggtgactttggcgtgtttttcctctagtaaaagtcagtttaagctaattttgtgctacaagaaaaaacatctttccttctccaaactacaaaatgattaaaattagagttttagagaggtatggctcatgaatctgtgagctgaagatgaagtaatttcctccaaaatatttttcactaaatgattctcgcatcttctcagagaaaagatgagcatattttcaaaacatattattatcagaagtgaaaaaaccaatcattttttaaaagtatgtgctctttagaactttttctgtaaggtcttcatttctgcttaatacagctagtcagacagataacatgaatccattttgtaacacttttgttccacaattgtgtcccatacactctatgagtagataaacaacagcacttttgcagtagaaactagtcaggtaaaagagtcaaaacacagttctacaatgaagtaaacagtgtatccctagagtagtgagaagacaatgaatctcgtatgcatgggagctgttcatatgttatcatcaatttaaacggatttggaaaaagagttagatttatatatggtcttgcttgcaaggaaaattcatatcaaactcttcagtaaatctcatagtcacctactaatgaccacctgcatatttccacactagagtcatttaatactgtccaccaccaatttccactgtaaaaaatattcatatattaaatatagaattttattttcttttttaagccataaattagcttaccaacttttatggaaatatgcactggcacagtgagaagcatttttattcaggggaaaaaaaaaggatctgagtgaaacattctttagccgtgactaactaaaaatattagatagaataaattttgaaatatgtatctaaatagtaaaaccatttgtatttaaagggttaataccacctaaaactgctgaggctggtttggaactgataaaaagctgaggctatagcatcctaccagcaaagttaaatagtacaatccatcacaagtattagttcctaatctccttctgctccccaagacttaaatggtgttttaaaaggggacgtgatcttcctctctgtcaccctcaaatctaaggcaatcgtcaagagtgtaaatttactcatatgaaacaatcattgattaaattggttaaaaaataaaataaaattacatgcttttgcaagcacaaaacccttaagatggctggtgtttttccacctgtaataataaaatatttgaccattaagtgtaccccaaattatatattatataaaaagttaaagccgaaggtctgagggtgaattatgtcctttaattgaaaggataaagttacatttcaggtactaagccaacaaattcatggtcacttaaaaatgtaatgaatgaagtttcacggactcaattttgctggtttgcctgagaaatgaagaatctcttcatgttctttttagtatttcgagttggaatatacagcaaatcaaaatgctgtctgtatcaatccatttatattaaccacaaaagatctgtagagaacttaataaaagcacaaatattttttgtaaactttttcaagcaaattacttatttatttatgaaataatttatgaagaaaatttttacctcatggtttagatatattacatatgctcttgattgacacaatatgtttaagctcaaaggccctcgaagcattagcattttttaattctagtaggaatatttcaaaacaaccagctaatacatgaggtcataattgtttgacagttgtttttaatatataaaataagttatgtatattgttttccttcaaatgtttgttgatttgtttttatagtcctggcatttgcatggcacaaactgaattaaaggaaatattaaagatttatttacatttattatcttctgctgtcaaacatatgcaaagctcttaaaaccattctcttcttttacttttatatgcaatgcatttctaaacgatggagcctggatgttaaaatgacaaccttgctttttgaagggtgcaccagaaaataaagaagaaattaagagaaattttaaaaagcaaacaaaaggaataacttccaactaaaataacttttttatgatcttccttaattctttgaattctggaattttctctcaaggctggaccactgatgaaacaattccttgagttgtattaatgcttatttatttaccaaaatcacatagtacacttttttattttaaacattcctttcccaccttttcttgtagtttattcatcagagatgcaaacagggattagtagttaagcacaaacatacttgtcttacattttcaaccttttagcacataacttacttacagtccccgtgcctgtaatcacaagattttacctgaggaacacgtatttcagaaatgaa

SEQ ID NO: 49331 - DNA, 1406 bp, Bovine  19866880878005
cttcgatctttcccagcatcagggtcttttcaaatgagtcagttcttaacatcaggtggccgaagtactggagtttcagcttcagtattcagtccttccaatgaatattcaggactcatttcctttaggatggactggttagatctccttgctgtccaagggattctcaagagtcttctccaacaccacaattcaaaagcatcaattcttcggcattcagctttctttatagtccaactctcacatccatacatgactactggaaaaatcatagctttaatgagatggaccttttttgaccaagtaatgtctctgctttttaatatgctgactagattggtcataacttttcttccaaggagcaagtgtcttttaatttcatggctgcaatcaccatctgcagtgattttggagccctaaaatgtgtctttcactgtttcccttgtttccctatctatttgccatatgtatatatatataaaaccacgtgtgctcagtcacttcagttatgtctgattctttgtgaccctatggactgttgcccactgggctcctctgtccgtgggattctccaggaaataataatggaatgggttgccatttccttctccaggggatcttcctgacccagggatcaaacccagggacccagggatccctgcatctcctgcattgaaggcagattagattactaataaggacctaccatataacacagaaaactctactcaatacactgtaatgacctatacaggaaaagaatctaaaaaggagtggatatatgtatatgtataattgacttactttgttgtatacctgaaaccaatacaacattataaatcaactgtagtccagtaaaaattttttgaaagaaaaaaatctatttttcatatagcaatgccattattctgaatactgagctggcttgcacacagggagctgacagtatctatatatgggtcagtattttctgtgaagcactatttggaactggtgaaaatgtgtgccatataggtaggaagaataaagagttaaccctaatgtcccttatgaaaatccctgtgtgagaaattgagcctacgttgctggggtaaaaccaacacgttttaggctggaatgtgtatgcacaagaggctttattgatatttcatggcaatttaacgcagcataacttgcaatctctagtacagtgctgcccccatacataattttcattgacttcttaacatttaaactagacacaatttaaatctttctaagcaggtcagcgtaaggaaaagccttattgcctacaaggtagtttcatggtggggataaactttaattgcctctctgtcggtgaataattagtagtattgcatgttatgtgcaaagaaaaattataaccaacagtaacctgttaaaaa

SEQ ID NO: 49332 - DNA, 829 bp, Bovine  19866881008569
tgtttaaaataaaatgaaaattgtggaaagctaatacccttgggatatacctacctttttgtaatctttctttcataaatgaaatattccaaggagggcctgatgattatgaagagtcaagagtcttttaacttcaaaccagttctcactgggcttctaatatatgtatttaaatctttgaaaaaaaaatactgagaaataaatttttaaaattgggggaaggaggctggattagtcaggaattacttcagagactatggatcttaaagaaaatattgactttaggtagaaaaaaaggtggagggggcggcaagggaactcctaaaaagggactttgctaagcaaagaggtgagaatgctcatgaaatacatttgggaggtaatcgggacaataactagatacattttcacaagtaactagagagccatataaattagcaggaagagcccaagtttcattgctagaatatctaagcatcttgtgaggaataggaaccgctgaatttttgaggaaataattgtatttactgaatgccaagcaccaggcatcactaaatttatcatttttatttaatttaatccatgaatctctatgggggtaggtgctcttgccatcctattttatagatgaggaaactaagacttgaacaattaattgacccaaagtcacactgaagagtaagtggcagaaacatgattgggacctacatctttctgaaaagtaaatgaatcaaacagtattataaaggtgaaaaaaatggaacagaagtagttttgaggaaaggaggggtaagatataaaaaagggaagccggttaagaccacaagct

SEQ ID NO: 49333 - DNA, 1178 bp, Bovine  19866881121382
tgatttgcctaaaccccacaggaagccccagtatacaggaatagaatcaaaagtttctgattcctttcctttgctgatgccactaaatgtgtcaaaacacttcaaggtccttctttcaaagtagacggaaaacgtttcatcaaagtctgtgtttctgaaattcaccttctaaaggaagaatattttgaaaagagttgctagaaaacaaatattgcagttatatgttttccaaagctactctttggaaatactagcttctatctctctttttctatccctttcgtttactgccttccgttggggcagggcttccatggtggcacagtggtaaagaacccgtctgccaatgcaggagatgcaggagacgtgggtacgattcctgagtcaggaagatcccgtggaaataggaatggcaagccactccagtatcacatggagaatcccatggacagaggagcctggcaggctacagtctaagaatcggacatgtacagagcacgcacacttggggcagggtcgagagggagccattccaaaggagagatctgtgggtccttctgggaaggtgctatgtctgcccacctgacccagtgccaggatataggaggcacttgagacatggtcatttaataaataagtgaataagaaaaaagatgcattaaaaagtattaatatggagagtgactgctttcacagggtacaagatttccctttgggctactgaaaaagttttacaaatagatgctggtgatgtttgctcaacattgcagtattcactgcgatagtcattgtgatacttaatgcttttaaattatatacattaaaatgattacaatggtaacttttatgttatgtgtattttattatgataaaaatgttaaaatatttttaaagttaaaaggttgccttgctgattaccccttagctgagaaattttatctgctaataggcatcctttttgagtatcagcgattagttcaggtgaatttgcaaatgaagacatctgaagtaaattgaagtaaattaaaataagcatctcattctcagttgtaaagctttatgaatacagttggtgcttcatattcataggttctgaatccacagattcaaccatttttttgtagattgaaaatatatatatatatatatatatatatatatatatataattccagaaa

SEQ ID NO: 49334 - DNA, 924 bp, Bovine  19866881196056
gatcattattttccccttataacaggtgagaggcaaatgtattaaaatctctgatttgaataagatcacaatttcactaaacaaattaagaaacattactattcattgcccatacatatgtcattcttccttttgttttcctctccaagaaaaaaaaaaattaaaaagcatctacaatgacaactgttgattcaaacaggccaatctgactttgcatgtttgcctgagccaggctcaactttatcctttcttctttgttaaactgagactgtttcaactggtccaagggcaaagacccaaacatagcacttcagttcaaaaagaacagctcatggaaaagtatgcatgcatctctttatctagacggttatgagagaaattgacatttcatttgtatgtaaattggatttctactgataacaaaaataacgagtgctgtgctctgtaggaatgcctttgactttcttcctagcgtttgccaaaatacatctttgtatattaaaggtagtttacttttaatatacaatgttgctttgtctgttttccaatctgttattcaattgaaaagaaagtctcaattacctcaatccagctctgtaactggcgaacagctgtctcagtcctcccataagaaatctgtgtcagtcactacaaatccatttggtaaattaacatgcatgtacaatatggtgaatctaacggatgcatgccatgacaattcaataagaatgctcaccatcttcacataactgcttaaccaagtgtattaggcaaagttttggctcattttttaaaattcatttgtttttggctgtgctgggtcttcattgctatgcacggggttttctttagttgaggagagccagggctactcttcattgtattttcttcatttttttttttagagtacaaaaccagatacaa

SEQ ID NO: 49335 - DNA, 715 bp, Bovine  19866881378055
tttaactgtgcctccaaaaagcccccctttttttcccttttcagtgtcagattttggcactggcatagaagaaagtccctgttgaaacactcttgaccattgttgtaactgaaggaaaggtgaaaatggatctgtggtggcagaaatagaagcagtaagaggcttgagcagttcttttgacaatagtgactttcacgtggaatgaaaagaccgtgtagatataaatcttcagctatattttcagctgtccaaatacatattgctgtaaaggcaggacattgttacagaaacagcatgggttagaactctaaagatctgagtttttctagttctagtctgttaagtaatttgtgtatgacatcacatgtttgctttgctcattttccaaatatggagtaagtctaagtatggagatgggggtccttcagacctatgtagtagattatatcatctgtatgataaatttctaaaatcagaagatttgaagaatccatacgcataatttaaaatgtgggatttccccggggaactctcattttctgcaatcccgtgccgcgagtcaccaattgcatctcagaagaaatggagctaatctgttttaacatgtcctgatatattgggcaactccagcgtggtgacgtgtcagtggaaaagtcttgggcacattcatacctgggtacaatgtatgattgctagaatatgaattgcctcatgt

SEQ ID NO: 49336 - DNA, 847 bp, Bovine  19866881383467
acatacgcaataactttttatctggagaatgcataaatcaaaagtctgttcttcagtgagctattacaaaataaaaatacaccctgtataatgatctctcatgtcaaccaagagacactgctgatgccctccaggtccctcctgttctgttctcttcccttcaccagaagttcatcactcttcctgactgctcacactttagattgattttgtgtgttttgagacattgcatgcattaacgcccagcattcataatgcagtaaaagtatgcatctttttatgtctgacttctcatgctcaacattcccattagtgaaattcatccatgttgttgtatgcagtttatttatttttattgcagtataatatcttattgtatgaccatacattccactgtagttggaatttttgaaccagttcttttgatgtacacctgagctggttccagttttgacagttcagataaatgttgtcagttcagatgttgtgagtattcctgtgaatgtgtgtgtgtgtgcacatgtgtgcatcctcacatttttaaattgaacttctggttttatgtcattccagatgctttaagttgctaggagtctgatccagatgtttgagactttactgtattcttttatgttccaccttattcctttaaaagacaaacgtgtatctatttttatacactacgctattaatagagactattttagattttggaatattagaggatacgtggtaaaaatttgtgaataaaatatatatgtataaatgcatgtagttgtggtaaatattagtatattaatatatcataaatacattaagtaccatatgatattcacatataggacaa

SEQ ID NO: 49337 - DNA, 1225 bp, Bovine  19866881407216
tggaaaaaggcttgattaatgctcgattagactggctatttagcagttgctagggctgagtcaactttattaaagttcctgcagagcagtcactggagtgcatctgcttcttcccactgtcagattctgtccttcttactgtcgtcccatataatattttcccctcccctttgtggtatttccctggcaacccaggattctatttgccaaactgtggatgcagcatctccactcacctttccttgttggcaggataaaccacttatttttttttggtaattaattccatggctgaaaattagcatgtttttttcctttcctttgaagccttcagaattcctgtctctttccacccccctcaatttttacaggaagcttttaatcttgaggagttctaaatgtatcttctgaatttcttggagatttctgggaacaccagaaatagaaagctcttgagtacagagcatcaacaagtcatatgactccaaaatacacctttacaaatgaaagcgcaaaatgacaattgcctttgtccctgtcaggtaaatggctcattgtacatcaagtcgtgataaaggcaaaacaaaaactcacagtgctgttgacataggagcctatctggggttgctctttgactatcagggactttgtacaggttcagtggcatttcaacacttgcctgttctttaaacaacatcatcttctagccagaatataaatgtgtgatgaaaatttctacatattttacacagtcagcctcttggtgtagtatttcctgataacagaaagttggttggcaaagaggaagttatctgaatcattgaagtagctctcctggttgagataaacccgtgttcagcaacttgttttcgatttgtaaaaacaagccagataagcctctcttgccggggttatctcggctctttcagaggattccagactaatcgtgcacccatgcagtctgttgccaaggcttatttagtgacaatcttctgccttgcaaatgaggcatgaaaatttaggcaaatatgcctggaaacctccagattaaaacaggaaaagataagacaactggtttgttgaactagataagatatgagaatgaagcctcaagggatcatatttcagaagattgatgaagaaaattctcaaaggtaatgagccaaaaattcaatagcttcttgagagagaaggaagagttttatttgtctcttccttaaacaca

SEQ ID NO: 49338 - DNA, 1092 bp, Bovine  19866881469239
ctcaattatgtttttaatgctatatacgatgttttagaaaatagatacaagtctattcaaaagcactttgaaaaaatattatgcgagtaatcatttcattcattttactggaagcatcataataatcaaaatctgctttgcttctttgaactctcaataccctgcatataaagcatgtgagttatccagctttgacgataaaggttttagcagcatacatttgtcacatttactttgcagagatggacatatttaatgtatatttaacatgaaccaaagcacatgtatgtgagcttttgctccagagaagcctagaagaaaagacaatatatatactaggtatagattttaaacttaatcacaacttgagcgaagctatgggtttttttctggaacaacccatattttccagcactggaattgtatgggaacttgaattgtgaagccatgaaaagtttttgttcctcttcttttgaaacttgccttagataggctcagtttttgcaaccccatcatggaatcatggaatccttgcatactttggaaaattaggacagataatttgttgaacattttttttttccttctgtaatctggttttgaaaacaaaaatatcttggattggtgaactagcctttttgcttccagtgttgtatctatgatatctatccttcatacttcagctggagggatgtacctgtctttttacaagtcttcagaattaaggctggagtccccttagcacagaggtcacctgtattttgtatccttaggattcagtcttgaggagactgtttgtgaaccctgaagttcatggagcatgtatcactgaaaaatcatcttagaatgaaattctctgtgtttctctctcctccagttgaggagcagggactgattcttgttaatgttttttgcattaacagtggttgaagcacagtacaagttggttaaacttagtctaggtgcaaaagagaccttcaggaatagttacagatttccaagaataccaagggctttagaaatcaagtagaacaacctcctccccagtgccaagaattccttacatgatgttctttaacagatccttactag

SEQ ID NO: 49339 - DNA, 1347 bp, Bovine  19866881940221
ttgaaatcctcatccataacattaaggccaaagctgaaatatatgtgttccttaaacttctgtaaaatactttataaaaagattgctattttaatttatagaaaggaaaatagctacatagaatatcagatttaaattttttttcaatatttaactcaaatataataaataagaacagtgttaaagtaaaactcagaaaataaaagaaattttcttaagaaaaacttgagattcaaagtaagcaaaacccactggcacttaatgaatgtatttttttttttaagatgtcagaaatttaaaatattatcaaatattagaattccattctgcccattattttatgacatttttattaacaatttcttttctgtgtaagataataaaattagagataggaaatttttgtaatattggaatcacataaagttgaaccaacagcttttccatttccaatttttagacaagtaataattgcacatggtagaaataaaattttgcagaggatttataatgcatcttatgcctcacaaacccagggctgctttccctgtagcaactactttcaactgtctctgtttttaatttcttttggtagttagctccttaactctaataatcaatatagattttaatggtctccctttgtcatttaattttttaagtttttattagcatatttttaatttttattggagtagagttgattttcaatgttgtgttagtttcaggtatacagcaaagtgaatcggttacacatatacatatatctaaccttatgttttacactttattggtttaacttttattttgtattggagtaaagctgattaacagtgttgtgacagtttcaggtgaacagcagaaggactcatctattcatatacacgtatccattcaccaaactgccctcccgtgcaggctgccacgtaacttgaacagatttccatgtgctgtacagtaggtccttgtcgattatccactttaaatgtaacactgtatacatgtccatcccaaatatccactcttttctagattcttttcccatgtaggatattatagagaacctactgtagagcacagggatctctacttgatgttatttttttttttttaaggatttaactcatacaatctcttctcccttcccaatgctggcattttaaattccagtgcttgtcctatcagttctacctaatcttttgtttagctgatttctgtgtttaattatgaaaattataatgctccgctcctttgacatattttacttttactatcccacttgtcatattttagttgaacctttacatttaaaatgctataattgacagataacatttacattctctt

SEQ ID NO: 49340 - DNA, 1560 bp, Bovine  19866880122732
tttgggctccaaaatcactgtagatggtgactgcagccatgtaattaaaagacgcttactccttggaaggaaagttatgaccaacctggatagcatattcaaaagcagagacattactttgccaacaaaggtccgtctagtcaaggctatggtttttcctgtggtcatgtatggatgtgagagttggactgtgaagaaggctgagcgccgaagaactgatgcttttgaagtgtggtgttggagaagactcttgagagtcccttggactgcaaggagatccaaccagtccattctgaaggagatcagccctgggatttctttggaaggaatgatgctaaagctgaaactccagtactttggccacctcatgtgaagagttgactcattggaaaagactctgatgctgggagggattgggggcaggagaagaaggggacgacagaggatgagatggctggatggcatcactgactcaatggacgtgagtctgagtgaactccgggagttagtgatggacagggaggcctggcgtgctgcaattcatgggattgcaaagagtcggacacgactgagcgactgaactgaactgaactgaatgaaaaatttaattttgctagttcagcatggaaacgtgtgctaagtcacttcagtcatgtccaactctgcaatcctatggactgtagcccaccaggctcctctgtttatgagattctccaggcaaggatactggagtgggttgccatgctgtcctctaggagatcttcctgatccagggatagaatccgcatctcctgcattaggaggtgggttctttaccactagcaccacctgggaagcccattaattcagaataaacctcatcaaatcaggattttaaaaatgttacttcaaagtaaattcattcagtttagacttcccttaaatttcaattttgcttaagtggcatcttttagggaggtgctggggattattaactgcgggttgtatgcatgtttccttcatcagagaaaggaagcagcaaggtataaagttttagaacaatagtaatttacaaagtcaattactaatagttttactatcttacaggatgtaaaccagcttgtccggaaatgtgcattttcagttaggtgccaaaactgtatcgaattacctccaagaaagaccctgacacagtgccaacagaaggcattgtgaatttggcagtgactgctgtagctgtgaggcaaaggaggtctttgacactagatcaaaagagggactctaataagctgtaggttttgggtgctttccttataattaaagctattgtagaatcagaattttgcttagaagctcctctataccaatcaaaaaagatagtacatttgacattaggaaatcgattgcccatttgttctaagatggacaattttgaaaattttcaaaaattttttgagttcatctaaagtggccactgtgactccaaattattctgggtgaaatagtgccatttcacccacacatttgtgagatgtgtgtaagaatttgagtaacaatgatactatacataaaaaaatagat

SEQ ID NO: 49341 - DNA, 809 bp, Bovine  19866880395167
gaatgtgttattctgtggtaagatcacccacctctttgattctggctggaaacagaagttgaaacttgccactggttgcataagcgattccttccatgcagtttgtctaattagaaatttttaagtatagtgatcattagcttctgggtggagaatttggtgtttaatttaaatagaatcctggtaatgttcactctcaagatatacctattctcctcccaaagagtgtgattaggtgcacccttggtttttgatgctcggtgcaagtagggggcatactgttatatgacagtatgacacatattatatgataagtgctggaatggaatttcctgcactttgctgtgaggctgtttgttgaggtgtgtcagtgtgctgactttgcatctgtgaacacatgaactgggggcatgtggaactggtgtggtgagagtcccatgcccggcccaggctggggttggtcttggcgggagctactgctacttgcaagctggaagggactatctctagattactcagagccactttctacactgcttggggtgttgagaagatttatttgcaaattcctgcttgagtttggacttatcactgaacaggcctccgctgatttttcgctggagaagccttttctgaatctaaatacctgtgcattatacttcacttgcccgtggctggatgtgagggcctgtggtgttcctaatgagtaaaatttcaaaataatgggtgactctccttcagaagtgccttttaacccaatttaaaatttgtttttgattaactttttaaaatgagggatcagtttagcc

SEQ ID NO: 49342 - DNA, 1596 bp, Bovine  19866880444212
attattatcatttattgcttttcatcaactatttaattgagaagattctcccagtgatttatacccatcataaaatacttggtcttatttctattaattatgatttggaagatgtagtaaatataatgttaatgaatgtgttgaatgatgttggattaattggaatgacaaaaaccgccttaagcaaagaatgatagtttgagactgttggcaaattcaaagatagaactgtatttactttgtgtcctgccccatccttagaaatctgacttgttcggagcaagaaggtagtcaaatatacagattcagagcaagaagttacgttcaattttcagttgtcattcctggtatttggaaaaaatttgtttttcttaattgtggaaattagaaacagaacaataattccaagtgcaattcacccagctctgacaattgttaactcatgaccagtcttggtcgatatattccctttcctctcaacttgaatggcattggattattttaaagacaaccccagacatcatatcacttcatctctggttttaacaagtcttttcttgggggtgggtgttggttggcttgtggctttctatttagtactgtagtaggagtgtgtattagtcacttagtcctgtctaactctttgcagccccatggactgcaaagcccaccaggctcttctgtccatggaattctccaggcaagaatactagagtgggttgccattcccttctccagagaatcttcccaacccagggattgaagctgggtctcccacattgcagacagattctttactagctgagccaccagggaaggagcataaacacatgattcatgtttcccaagaatgcctgttattggtgtgccatggtgttgcaagttgtccctttctttcgggaagactcatgttaacccaggttttaatttgatatatgttttagaaagtcaaaccatccattcattatgagaagtttggcattaagaacctgaatagtgattccttctttccttgttgtgatcaagccttaaggaaagtaaagtattacttcattaaaaaatttttttgtagggcagaatctaaaacgtaggatttagagaaattggatcactagcagcatcagggtaagttagcccgaaacattcaagctataataggaataactttgtgaatgggaccagaagtagcctgtggccacacattttgcatccaactccaccgtaaggatggattttcagtgggactggaaatgctcacactcaaaatctgatggtggagaatacctgtcccagattgcttggatggactctgccactgtggcttctgtgcaacgaaccccttttcagacggactaaactttcctagagcaattctctcttttatttaggtgactgcataactctgccctcattcttcacttgttttttttcccataacttcaaaggtctagaaggcacttttctatagaaccccaggtgactctaaacctttcccctcaaccttctcttctgtagtgagagcaggacaggtcttataaagagggctgatgaccatctgatgtggtttaaggggttcctgaacatcctccagtgcaa

SEQ ID NO: 49343 - DNA, 1224 bp, Bovine  19866880494298
ctgagctttcttcacagtccaactctcacatccatacatgaccactggaaaaaccatagccttgactaggcagacctttgttggcaaagtaatgtctctgcttttcaatatgctatctaggttggtcataactttccttccaaggagtaggcgtcttttaatttcatggctgcagtcaccatctgcagtgattttggagccccccaaaataaagtctgacactgtttccactgtttccccatctatttcccatgaagtgatgggaccagatgccatgatcttcgttttctgaatgttgagctttaagccaactttttcactctcctctttcaccttcatcaatgtaatacattaattaacttaaaaagaaaaagcaaattggctttgagagacgacctgaggggctcatcaaaaagggaagtacatggatttttgacatttgttttggctgttaagaaactctttattctttttggctatattctggagagttactgtcttagataaataatgccatccgtttgaatgagttgtttaccatacaagcattttaattgtccttttagttaacaaatacagaaggactgaataaacctctctccgtttgtgtgtatgtttaagttcaatatttttggatgatcatagtgttattgcagttcacaaagttactttagtttctggctaagggagaacgaagtgaggagtggggatgacaatgaagaaatctactagtaatgaggaagaatgatagaatgaagataaatgatggtgaagataaatgatgataaaaaatggtgaactctttaacagctcgtgtgtgtgtgtgtgtgtgtgtgtgtttcaaaaagagacttgtaaaatcttttggtgcagagtgtagagatgaagatacttatgtaaacatccagacatgccagtaactttccacttgatagaatgctcttgtgatatgccaacacccagcaaaatgttctttcatactttcagaattgctgtgaaaatattaccttatgccctttttataaagaatctacatatttgaaggggaaaatgtctatgtaactttgaaatgttttactaaagcattcaaatgcctgtagcaaaaaatatatatatcatttcttaagggtaagctgatcccttacagaatacttacactccacttgcaaaattaaaaaaacatgctctgctggattcttctgtagtaaattcaattttcagctt

SEQ ID NO: 49344 - DNA, 2956 bp, Bovine  19866880567090
tgaaaaagaaggtaaacaagccctcataaactctacttcatcaacagggataagatgcaaccagtgacctgagtggtttgtgggtctcagttttggagaccttctttaaaaaaagaagattaaaaaaaaagaatcatcttcagggcttcacaggtgcctatgcaagtgagaggccctgactcaagcttttttgatatgaggtaaatctgccttcaggggcagtctgacctactgccaggaggaactgttttgttgggtagggggctgtcactgcttctctgaaagaaataagtaagtgaaaaaaaatgaggaaaagaagaagaaatgagaatgaggtggcgtattgcccagcctcacttgagaggacgccacatctccacagtgggtcttctacacctcagggctggtgcatggacctcaggtgcaactcctttagtcagtttttgcgaggcctcactgaaactagtggtgctggctttgctgagcccttttctttcttccaagtggactattgtaagagtactggtgaggagaccatctacttcacgagttctctgaagtctgggagtggcttctcttcctgccacgggccctaatttgttgagagggagactgcatgtggaggatctataactggaaacaaaatccatgtcaagtgctttgctattgtgtgggacaggagaagaatgtagatcatggagaataaatgaatgaatgaatgaatgaatggatgcattcatcaggaataaatgagaatgtttcacaaactgaggggtggaattaagtcaacctctgctttatttgagaagaccattcccttaaaaaacctgtgcttaagaaccagttgaaagtttactttttatttctagtgtacttctgtttcattgaaaagccaaaaagaacttttaaattttcacaacttttaattatctctaatttgctgttccatctctcaaattatgcacataattgaaggtggagtgattccaactctgttctctttcttccttttgcttttattcctcagtttttctgtttctttctttcctttttaaaaactctgcctttgtgaagtctgattttgacttgcctggggtaaccagctatagtctataatgaggtacctgaaaagctaacaacctccttttctcagctctaaccagagcttaaatctttctggcaaaagggctaatcaatgaacttaccaattcagcatatttcttgaataaaaaatcaaacttttcctcaggagtttgcaacttgttcagattttgcattagcaggttggcttctttgccttaaaagaaaacaaaaaccataaagacattttaaaaattaagagttgaacttgaagtcagatgataagggctggaatctcaggtggtctacttgtgctaagttgctttggtcatgtccgactctttgtgaccctatggactatagacttccaaggctcctctatccatggggttcttaaggcaagaatagcagaatgagttgctatgcccttcttcatgggatcttcccaacccagggattgaacccacatctacttgttagctgcttgctatccagccttgggcaagtcacttaacctgtctgagatgcagatgtaaatttttttttttccctttgaaaaggaatgacacctactttgcaaaataagtgattaattgagaagtttataaaaatgtgtggtacagtgtcaggctcatggtagattttcaataaatgttgactataagagtagtccctaaatttccatcctaagaattcgttcttagttacttccccttatactctaaatattccagggaattgtgaacattctgaaaatattcagaagactaaaaaaccacagactttatggaagagtaaatcatccacttccccatgttaattgttaaaaaaaaaaaagaagaagaagaagcaaaccagcctatatctgactactataaagcagccggcattaatacctggagctgtaaaaaaattccagcccaaagcagagaaacttgatagtttagtctgcccatgtttttggttttgttcctttagtgcctctttcttttttggggacggaaaccaagtgtcttgtttctgtgtgtgagcccatttcatgcagtttttgtgggaatgactctgatcgtatttcctatcagagaataaagtcaatatatagagaaaatggacccaagacacttttccccaggcctttttgtgtctctttggttacaagtttagcctccccgggtcttcccttctcccacctagaccttaatctctgttggcagtttcattttctgttcccagttggagtttgtgttatgtttaaaaactcatcagtttatgattatttgatagtgagcctttgattctttcttttctttccccattgttcttcctttttgtcttttgagctcaacctcccagatagccttcctgagatgactggatctttggtatccacagggatacctgtagatctttcagtatccacagggttgagggttgcaggcaggagctggaccctgaggctcacacacatgtaccactgcactgtctttgccaacagttgggtcaaggtggggcagcttccccatcctcacctacctgttatacctgccctgtctatctgaatagagaggttaagccacccagtggagcctacatttcctgatataaatctgcttgagaatgttaacaattttgacaacctctcccacaagaacaggcgtttctcctttgctggaatttttattttcatcttggagaggcaaatatatcatggaattagggtttccaggtgaaatataggacatgggacactcttatactaaaaaacaatggtgtctctgaaatttaatgttccttgggtggcttgtattttcacacttgctaaatctggtaactctaatggcatcaaagaattttaggtttagaaggaacttcaaag

SEQ ID NO: 49345 - DNA, 575 bp, Bovine  19866880607079
tattgattcttactaagcatttttttttttttttcgattcttactaagcattttatgcaaccagtaggtggtctgaggccagtgagaaattgagaagcattgatctagggaatagaaaccctctaaaagcagcaacagcaggtattttactcactgatgtcccttctattatctgctcttttaggggttcctctgtttaaagactggcttatgagcacaatattggaagattcccagcagaaaattagagaagcccttgaaaactgaccggcaagacctctggatgtttctcggcttcatcatcttgttcttcatttacatttgatgcagcaaatacttcaaattggctgaaatctgcaaaatttggttgttctggtatctgctgaggtgaggtactagtgtgagttattaggccatcggcatccactgggcgatgcacaacgggaccaggagcctacaggagggtttaggatacaggaaggagcaaatcattttactgatctagtgtcacagagtagctttccttttctttgaaaatttattataaggatgctctgatttattagctgaaaatt

SEQ ID NO: 49346 - DNA, 1063 bp, Bovine  19866880624730
gaagagggatgttctgagaaaccctggaagggagaccccttcctgaagcaacttcatgaggtacagtatcccactgtgtgctgaggggtaaaggaagacacctctactttacatatttaccccacattcctggagctttgtgtcccgtcaccttatgcagatgtgtttcagttaagtaaattatatgatcattaaaaaatgccgaacaaagctaaggaaataggtcctcaagtccagtcttctttccttctgtgcctatcatgccagagttcctagcactatagaaagggcctttaaaaatagttactaatcattgcatagtatagggaaacaaagactggccagatgtttcaaacacagtgtttattttaatttagtcaaaataaatctgggcaccgttatcttctcttaactccaagtgcataatcaacacatgtggcaagatagtgcctgtattacaatgatcaaatggacaatttacactgttagtattcaattaacatccccaaatgtttattaaatgctgacatattgatggagctatgattagactctacataaaataaattaatcagacaggtaactgctcaggcaccatttactattcaaagtaaataacacagctaataagacacacgaaacaatgacattagtctgataagcatgcattttcagaaatgactgggctcattccattttaccaccaacttctgtggaaatagtaacttcatcaaagctatgttggctataactggattggatttttaacaatatttgtataaaatacatatataaataagtatttttctatatttgcatagagactgtaagcatttttaattcccatttttcagaaaagaataaaataattgttaaatcaagttttatgaatcctctaattctctttgtttctgtttttttttttttcagtaagagaggagtggaaccaggaaagcctttgagagggatataagttgagtgttaaaagaagagtatatgcttgctatgatgacatgaattatgaaggttttttttaaaaagtttattggcgtataggaatgaa

SEQ ID NO: 49347 - DNA, 1169 bp, Bovine  19866880670234
aaagccagctgctgcagaagagcagataaaaaagcagcagaccaaggagggaagttggggagtcagaggtgggtagaagtgggagtcaggaacccccttctaggaagagatggctcttaacccctttaccgagtcttgaagaagagaggagtatgtcaagtgccacattcctttcatcaaaaggagcaataacggcagagcctagggctctccacctgaggaaggagatgtgggtagaggcaaagaaggggatctttttcccttttgaatcttatctctacctccctccagtcttactgactctgaaggtgtggcctggatgtgggccttacccccaggggaatgtcctttgcctggacacgggagctacctgtcccagaggctgggacatgatggctcccatagctgtccaagtgctctggactccaaggcaaatgtatttcctggggccctttgcaaacaaacaaacaaattagagattagtggttttgatggatgtggaggcagggaagtaagtgcagaaggtatataatttaatttctatgtatacctcatgtaataggtatagttagttagtgttacttgctcaggcatgtctgactctttgcagtcccatggactgtagcccagtgggctcctctgtttatgggatttcccaggcaagaatactagagtggttgccatttcctcctccagaggatcttctcaacccagagattgaacccaggtcttcactgcaagcagtttgtcccagagaagccctgtaacaggtttaaacgggtttatttaatgagtttaacccaaaaatctgctgtaaaaaaattgtaaccccaacctcaagttcattccaatgagtcagcactttaaaactatatactggaaggaaaactggacttttgactcagataaggttgttttccttcaaccttcttccacacttctgtctttcttgggttgagttcaacagtggctcagaatcagccttcctgccttaatccaaaatggtctggatggtgttcgaaaacatgtctatgtcatgattcaacataacagctcttaatgccactctgtttgccacgttcagaagaaataggacaggattgcttaactgctccttcctgaaacgtggagggaagggatgcaggcactgggtagtcagaaaggcaaga

SEQ ID NO: 49348 - DNA, 1069 bp, Bovine  19866880696286
aattttttctaaatcacatatagtatgtgcctcaaaagtcaaaccaagataaaaaaaatgttataagactgagtggatttagtatttcctttaatagcattttgctataataatgtaaaagagaagaattcacctttttaactttggtcgctgtgaagttgactgggatgcaggatttgaaaaccccgtgcttttactaactggaatggcattttttttggtattaacaacctgagtagagtgggcactaaaggacttaggacttctcctcttcactttgcgctcctccattgttttaagttccttattgcacccaggccagcttcttatgacctaaggaaatacagcagatttatacacatatgctgtaagatgccaaaatgaaaggggttcaaagacccactttatgggttgaaagatgatcaagaatttcagaggtcattaaagaaagttagaacaaggatccttgagcttaatttactgtacgaaatacacagaagccctaaccaaaactgcctgttagacaagaaattttgttcatcattttactaattcatcccataaatatttactctcttccacatgtcagacactatgttgggcattggtgagacagttctgagcaacacaaagtccttgccctcaaaaaacctatatcgttatagaaagggtatgacacctaaacaccaaacaaatcattcagcctgactcaagccttaggtagtctttaggtttcccttctaaaatgtattctttgaaaaaagaactagatttaaacagatgtataactgacatcagttcagttcagtcgctcagtcgtgtccaactctttgcaaccccatgaatcacagcacgccaggcctccctgtccgtcaccaactcctggagttcacttaaactcatgtccatcgagtcagtgatgccatccagccatctcatcctctgtagtccccttctcctcctgcccacaatccctcccagctgacataggtacctggcattttaactagcaaccagaaaccttatttcaactatcacatagaaattcagtttctcccaagacataata

SEQ ID NO: 49349 - DNA, 1208 bp, Bovine  19866880698451
gaattaatatgtgtgaagcccttagatatgtgtctaaccatagtaaacagtcaacagtgttataagctgttagtaaaaaaatagtaaaaagagacaagaaggagtggatttgaaagtatttatactatattgtatatgcttagtcgtgcccgactctttgcaaccccgtgaactgtagccagccaggctcttctgtccatggaattctccaggcaagaatactggaatgggttgccattcccttctccaggggatcttcctaatccaaggatcgtacccaggtctcctgcagtgcaggcagattctttaccgactgagccatcagggaagccaattctctattattatgtcatatttatgttggagttattttctgctatctgcctattatatataattctgtcatttagtaagcaaagcaagaaatcaaactgttgctatagcacttattatatattattttttgtgactgctttcttctagaatgtctcagactttgagataatatatgaggtcaccttttacatatgttagttttaaaaaggagcctgaaaatgttatagagctatttgaattatatggttggagtcaattataactgataatttatcatctatatctgtctatctacctatctatgtacctatcatctatccatctatgagacataaatgtatttacttaattatacttttttacattgcttctaaccaaatgagaagttaaagatcctcagatcctttgcagatataactatgtaacttcacaaccccttcaaggcagagaaaactatattaattaaagcttagaataataatcctaaccaatccctacactgcttccctcccaccccccattttgctctagttctactgttgaaatcataatcattgctgcagaaatagagggagttcctctcctggagatgttacccagaagcggtgacgggggctggagaaggccagctcccattgctctggaccctgcgttgggtcccctccttggagatattgggaaaaggcactgggcacagcaaggctggcacaagaagatgaagaggcagctctctttgtttaagaccaggaaaagagggaaataaggggtgataaacaattcgcctttactgtttcctgtgcagtctgtctcaagtggacttatctagggtctagaccacactggaaatctgaaggtcaagataacagagatat

SEQ ID NO: 49350 - DNA, 1004 bp, Bovine  19866880739302
ttgtaaataaatgtttaagaactctggaagtgtgtgctgctgctgctaagtcgcttcagtcgtgttcgactctgtgcgacccgatagacggcagcccaccaggctcccccgtccctgggattctccaggcaagaacactggagtgggttgccatttccttcccctatgcaggaaagtgaagagtgaaagtgaagtcgctcagtcgttcctgactcgcagcgaccccatggaccgcagcccaccaggctcctccgtccatgggattttccaggcaagcgtactggagtgggttgccattgccttctccgggaagtatgtgaacaaatgttaaatggtttgctctggtagtactttaaaaaaatccaactttaagtaaaaattttctacagtaaacatgtgtgttaagtcgcttcagttgtgtctgactctatgagaccctatggactgtagcccaccaggctcctcagtccaagggattctccaggcaaggatactgaagtgggttaccatttccttctccagccgccaagagattgaacctttgtctcttgcatctcctgcttctctaggaccgcctgcattggcagcccaggttctttaccactagcgccacctgggaaagtaaatactaacatctgtataataaattttattataattaggttttgttctaatccaagtacctcatgtttttttcctgttgtcttttaacatgtttaagttgtgtgaaaggatacaaattagataaactaaaaatctgtcacctgagacccacatggagttccttgacacaaaggaccaatgaaccaactgaacaaacaaggtcaatctactgctctgtcactaagccacaggaaacagctttttctttactctgtctcaggactcatccaagaaaaacatgtcaaatgacagagtttccttttgctctgtcagacctaggatgctcttgcccctggaatccctatccgctaatcccaacagaaaagtttgaaggtgcattt

SEQ ID NO: 49351 - DNA, 915 bp, Bovine  19866880759668
agtcggacaaaacttggcaactgcgcaactgtggggaaaatagaccaaatgatgaccatctctggaaggagaaattcaggagtttttctttctttctttccttttttctttgtctattatcacaaatctttaagactttaaaaatgataaaaaaatttctttaatcagaaacaaacatgcaaatataatcttttacttccttacattttcacttgtgattttcattgcttcctctttattttccccaagtttaaacttcaggacacaattctttgaggcgaactgcctagatagtcccttgagaggacacagataacattcactatttcaaagttgagcaaagttagtggttgcagtgacggtgataatgacaagagagggcctgacacatccctgaggtttttggcaatttttgcccttctttctttacgtcccttgtatcgtttgctctaagtggtagtttgagaatgtatgtcactaaagttcactgaaatcgaaacacctccatgaaaaagggaaaaaaacatcacagagatacttctacttcaccaaaagagagacacattcatcagagtggcaaatgctaggtggagcttctttttgatggaaatttgaaatttcagtttgagagtttttcttggtaaggaaaaaaaaatccacccaatggagacaaaaattaagttggaaaagttacaggtatttggaaagccttagttgttggctttcgatgtgtaatatttactacctccctgggcctctagagtttccattaaaatgctttttccacatcttgtcaatgcataacctattgggcacaaagaaaatgttctcactgttagcaaatactgaagaaccttgaacaaactccatcgtttctttaattttattgctgcttgaattgcatgattatttatt

SEQ ID NO: 49352 - DNA, 1866 bp, Bovine  19866880815101
agaaaagcaaacacttcaggaagaggaagttttcacagaatattgtagatctggtgtgagtggatgaaactaatattttccttcctttagcagattcatcgtggcaatcacagttacaactattatcatttagtgacactaagcttattcgttgccattgtgataagtttcctagttaatcctatgactccaagtctcccatttcttcaacacattctacaaactacagctatagtgatttttctgtcaaaaatcatatcatgttactccttgaaatgaaagaagtaaaagtgttagtgcctcagtcgtgtccaactctgcgaccctgtggactacagctcttcaggctcctctgtccatggaattctccaggcaggcatactggaatgggtaaccattcccttctccaggggatcttctgggcccagagatggaacctgcatctcctgcgttgccggcaggttctctatgtgactccttactctccacttaaaatccttcaaggacccacagaaggcaatgctacctttttagtttagcagagaaattcttcagtacctagcccctgccatcccgcccaaatgtactctcctacaatcagtatactttctttctttcttttagttgcggcatgtcaacacttagttggggaatgcgggatctagttccctgactagggatcaaacctgggccccctgcattggaagcgtggagtcttagccattgggccaccagggaagaatccagtatactttttaaaagcaatagagaactagcacctgtaaacagtaattattacgtaccaagcttggagctaaatgctttgtgtgtcctttgaccctcttaatgactccacaaattagatgttcctactttacagagaaactagagacttaggttaagtaactgggggaagtcatcagcttctgagtggtggagggcgggccccggggtctgttgtcacagtctgggtttagccagtgtcctgtactgtactccgtacactgtggagccagtgcaccatgttgtttctcctgctgaattgctggctgtttctttcccatgggctcagttgagactcctctggaagccttcccaggctccccagggcagagttgggaaatgatgcctctacaagtatggcaccaaggtagtgtgtgccgtggaaccctcattaaattgtattgggtttatttgcatctctgtttccctgactagaccgtgaacttttgggggacaagaaatttagtctttgtattgtcagtgtctacttcagtgcctgatgcatgactagctggtgtgcactgagttcttgtcaaatagaatggatctataggaattagggaatatgatgcttatcaggtttgcatattctcaatcaccctttgaaagtctattctctggcccacaagttccctgtcaaaaggtttctacatccctcagggtccttgaagattttaatgaacttcttgaggtattttcaatatttcaaaaatgctaacagaaatcattttgctaacctgagataaatccctgtgggctaaataaaatgtcaggtttctttgcttttggctaaaatcatatcaacttggtatgataacagagattttttttttcctaacgatcagaaactttgattggcaggaaagtcttatgtgtgatgaataaaacaataagaaaataagttttctgtgattaaaataatgcttgtttagtgaaagaagtttctcaaaaattaaagtcatattggggaaaactaataaaagtgactcttaatggggattctctgtgatcttttggaatccttcacaaatagtgggaaatctgccttaattaatggacacatatagcctgcaatcttcttat

SEQ ID NO: 49353 - DNA, 742 bp, Bovine  19866880853265
tttcattataagactctaactcagaaaaatcaaccctaattcattcatgtaaaaatgcagctagtcagtcacataaaactaagctacaaactagaatctattttggaacataatagttttatgcagatcaaacaactttgacctgttagttgtgcaacactttattcactgatgcagtaacacatctagggagatacagggaggttaccctgagtcactaatagatccaggacacacatgacacttcctatccctcaatacactgatccttcttctaaactctcctttgccgagacactatcatttggttcacttctaacgtttctttcaaaaaacaacccaaatcattattggaattcttatcctctaagaaaagacctggcttctccgaattaaatatgcattaagaatgacagttaggcaattcccgattttcaaactaattctagaatagaatcaaagacctaacagataaactgaccaaggggactataataactgatgcttactaataaagacctaggagaattacctgtgagggctgtggtcttggaggcactgcaggaggttgggcaacaactccagcctgttgctgtcctgtgtgaatacacaagtcttcttttggtaaatatatataattactttgctagtacagcagataggctgaatgaatgtgatcaaatgataaagatttcaaacgccaatgtatagaactggaagccaagtccatctcgtcaaactg

SEQ ID NO: 49354 - DNA, 1739 bp, Bovine  19866880863979
tgcatacaaatagaaattgttttaaaaatatttttattatgcagctattgtacttttctgtaatataaattttcaattatccatataccttgaatatttcttcatctcatgaaatattatataaaatgacttcactgtactcatatacatgaaccatcattaattacaaccattttgtataggagtgagcagtcaggtggtgtttggttttctttcttttttgctgctataaataacactgtaaagaacagcctggaatttgcatcattgtgtaaatctctggtaatttcctttagatagattttttaaagattatctggttgaaatatatgcatattttaaaggttcatgatttatattgctacagtttgtaccaatcatacttctaccaattaagatgttccatttcttcccattctagtttgagaaagctaaaagtggaacgagctccattagaaggaagagattgccatgtccctggaggcattttagtaggtgctggaatgtcctctggatgggatgttatcctgagaaatttagttgagcatttgaagtgtcagtggagttttaggattcctttccaatttaagaatgggagtagagagaaagaaagagggaggaatgttgaataatttggttgcctgtactctgttctatatatagatgtatcagttgattttggtgataattcacataaagcaattaaaagcacacacacacagcaaaagaaacagtgggggtacatgtaagcaattttctacaacttgttggaggttgaatttagcaaaggccaagtaggataacagaggttggagatatgctttagtttatgagcattcaatttaaaataaaatttatataatttaagaaaagtgaagtattcattgttcttagactttctcttgtacaaagcataacaacacataattcaaatattgtcacatctattattcatttaacagtttatgcactaatgaaaatattttccatataacacagggagcccagttcggtgctttgtgatgacctagaggagtaggatggggaggtgggagagagggtcaagagggagggggacatatgtatgcttatgactgattttcattgttgtgtggcagaaaccagcacaacattgtaaagcaattatcctccataaaaaaagaaaaatgtataaaacactaatcctaagttgtctgctgggctctggagttacaacaccaaatagaacatgattcctgcctttcgtagttttacagcttacaaggggagacaggtgagcaattccaataatttcagtttgatgaatgctaggaccaatacttcacaacacgcatagcattccatggcatacggtgcagaggtatcatcacaccaatgtatgtgggggcaagtatgcccagtttcaggagaaaaaatcactggactgaaatttaggtttgtgttctcttgtaggtattatctggctggatgaggttgggtaactcatttaaccacatctaaaatatttggggaaaataatgtttacctaatattggttttgtaaaaagtaaatagaacagcatgtgaaatcagctagcacgagaggcatgtactgtgagtaaatgttagtgaatcattcaatagatgcatcgtttgatagaatacaccttcccaaggaattttatgaacagcccaccagaaaagcacagtgagactagttattgcgattagagataggctttttttttttttgctatgca

SEQ ID NO: 49355 - DNA, 935 bp, Bovine  19866880866096
ccccttaaccttattccctggtttaaacctagaagcaatagtctttcatcattaaaatattgtccttaccatttaaaaataccctccatataaagtcttggcttcaaattagatcttatcactgacctgtccactccgaagagtcaaggccatgcataagtggctaaatgctaagcttggctcatactgatccacttaatcctcagtccagaggattgttcaggaagagtgatccttttatggagataaactcagtcaaggcattttattggtcaaatatatccattctaactcttgataaacagtgcgggttctgaagacagggaaacccacaaggactttcttgtgtgtccttatctttcactgagatgctgacctaacttttaaaagctatctccatggaaaattctgggctccactccaaaaccaaccagtaggaggtggctctcttaatcagtggctgtgttccgtctttatataaacaggttaagccagctaccagagcctcagcaaccaactccagctcacattaccctgagctggaaagatgggcctgaaccaaagctactttggggaagcagaacactctcgcctctcccaggttatagcaaagaacctggtgaccatatagggtaccagagccatcagcagtcttatttttgttccctgagattgttggggtgggacttgattgactgaagaggcatcctcccaccagctaatccacaaagggctctcattgcccaggatgaaactcagaatgtcagtctgtagaatcaacaggcatgactcatactgaaaagacaccactgacaaaatctgttactttctccagcatccacttctgtactttgagcctgaggatgttcctcaaaatgatgttaccccaaagtagcaacaagccacgtaaataaaacctaaataaccagaataac

SEQ ID NO: 49356 - DNA, 944 bp, Bovine  19866880873915
tggcaagcagctcaattctaggtcagattgaacagtacatggatgaagaccactggtactggcctctgtccctcaaccttttcactgttcctagggctgaccaacgtccattactttccttctttacatgaaaaattttcatcatataacagataattctgcagtcattcaaacacttgaagaaagaggaattcattttttttttttcctaccccagcacacctgaaaggaatgacacattatcaccaaataactggctaaatgatagtggtgaatctaggcgggagtgacttaaaagacaagatgattctattatgatttctttgtggtcaggaaataagcccactactgctacccttttaagaattgctgtttaaggttaaggtatatatttctaacgtaattcattaaatatgtttagaagttcaattgtcaaagtcattttcttatattcaaattgtcatttccctctgttcatttttgcttccaaatcttgcctgcctgcaaaaacatgggaatcttggacttgagtttggaaatttattttcttccatcaaactggattacaaaatggttgggtgtgctagctttagaggcagaaatcagtcaactgatccatcgcaagagcttctgattatcttttccactaattgatttacacataaccatacaggtgtctgtgtgtgtatgcttttataactcacctattttgtggtcttgggaactacttcattttctcttgccctttttactagaagacagaccagccactatacttcctccagtttctaaccagagtttagagccatctaattctccatgttttctggaatttccatttatcacacttggcatttcttttccacttctcaactgaaagtcaagcatcagctttccctgaccttatacatttttaagagttactggtatctttcaaacattcg

SEQ ID NO: 49357 - DNA, 832 bp, Bovine  19866880894236
acagggacacagctttactgaaatgatgggatccatgttttacatgggggaaagtatactgaaataaacactgaaataaaaaataagcctggtattaagagggtggcttaaagagtattcccccacaatgctgctatgaagaaaagtaagcatgccatttagatcatgactagaatattgaattgctaccactggcttttcacaatttggataaaatattaatatatgaccaaatcctaacactcattatgaaaacacatatggaaaatccttttcattcagagcagacaaccaggaagcactgtcttagccacaagaatgtgtccctattaaggcaccagaaccctagccttcagtgctgctgtaatttgccacacaagagctattattttgcttcacatttctcacaggactcgagtttgaagctctgaggcaacaagtgatgtgacaacagtattgtcttcataaagatttcaaatatgtggaggttcccactgtttgacctatttttgccactcatgcattatatactgagaaagtttcatgcatacagtgaactcattcatgcttaatggttcttatctctgtgcgcttttatgtgtaagtatatagacatacataaattttttgtgtccaaatcctagatgataggatgaataatctaaatattatcaattatttcagcattttgatataaaattatagtcagatgtcttaaataatttgcttttttttctagaattttttattggagtagagctgatttacaatgttgtattagttttcaggggtacaccacaatggaatcagttctacatatatccattctttt

SEQ ID NO: 49358 - DNA, 776 bp, Bovine  19866880981641
gttgactctggacatgcattatcatgaaggccgccgcgaggattttgcacagccttgtgaacgttgttggcttcctctgcgtcagcctcttcattcacagaggtgtttggctcgtcatcagaggtgtgctgaccttgatcatccttttcaggcatttttgcttctctgatttttttatagagttcatttctctcttcttgtaaagctcgacagaggttctctaaccttccaattttcatcacgaagcactcatattctttagctctcaatgctttctgtgatttaaatacacacacacaaacaaaagggtaggaaaagtaaaactgccaggttttactggagtaaagtaaaatgctctctggagacaatcaaaatcattaatccaggaatttgtctgttaggctctgaccacagggtggtggctgaacagatccttggtcagggacatcacttctatttttgcattatgttggagactttgatagaattttaatccacttttttttttttttaaggaaagaaagatagcaaagcttctttctgcttcagtctaaggcttctaaaaatcttaaaatagatgcattttctgcttctaagacttagaaggaataagcagaggcttgcggcaaaatgactgagatggactgggatttggcggtcagcaacgccttatctgtcctatagataaactgctatatgctaatccagcaactggttgatttctgtttatgaataataagcacatctctttggaattggttgtagtttgggatgaa

SEQ ID NO: 49359 - DNA, 677 bp, Bovine  19866880990818
accctggcaaagtaaggagggcccaagatctcactcacaggccgaaagttccaggcatttgggatacagtgatccttcagggaggctggcaggacacctggagacccaacagcatctcttagaggaggctgtccttggaacaactctcctctgcctaatttttctccacagttcaattccttctccatgtttattctttttattgccattcacatttattcttgatagcacaccttcttactacagcctgcttcccctgcttcgtgacatctactgtatgtttatttccatagtgctctgtgtttgctaacatagttgcaagcctcagatttacattgcccgtgagagagtatccaatgggacctagtttaaggcacctggttagggcagatgttcagtgttggtcccgcatgagctgatggccagtctggagccagttgcccttgactcaggaactgacttctgcctactaatttatggtcaggttgtgatgatacctagcatttgatatataagaagctttccgcaggaagttctgggcatatcaggcactctgagaatctgagaagggtgtagtgaaactgtcagacaagttgcatagctttcccagtataaaaatattattgatttatttctacattaaatgcctatgtgacccaagtcagtgatttgtgagg

SEQ ID NO: 49360 - DNA, 1700 bp, Bovine  19866881078977
tttctcctgacagctcctgtctttttatgtgagatattttcctttttatcaatgaacatagtattttgagcctcaaattataccaaaagacccaccttgtaagaaattagtgtctcaggcaatataattttagtaaagaaataagcagggtttgttatcagaatatcactgaattttaatgtggaaaagactataggatccaagctattcatatgtctgcatgtaaattaatgaaatctgttgactcattataaacatttacagaatacctatggattgtgtgccaggcacagcactggttttaagaggcacagtgatttctgaaaagttgttttcttagttatttcagattttgtccctcaatcttctttttgcattattaattttcactttgaattttgtgtatgataaagaaaattctacctcagacactgcccaaatgattgtgttttatttattagcagaatcaaattttatgatttcagtagacttatttttctctcattgaaaaacagtgtaatgtacaatgcaagatgccattctatgggccaggattgggtgctattatggtttgacatgtgttaaatgccatgttaacagctataccctctttttctagccagtggccagtgaaaaactcagacttgctgggtagcatgggatggtcccttcatttactcattcattcatggatggaatagttataaaagcaaataatatccaaatcatggactataattctaactaggagattgttgacttctaagttaatcaggaacaataaggacagaatcactatcatatgtatattcaacaactctttaacagatggctgtaatcatttttagtgaaatatatatagtaagtgttagcattcaaagttcaaggaaataacatctctgatacttaatttctccagattaggaagtgtagatttcttctaaatttctttctaagaaatttcctaagacatatacctcagaaagagaagaagcactaaagagcctcttgatgaaagtgaaagaggagagtgaaaaagttggcttaaaacccaacattcaaaaaactaagatcatggcgtccggtcccatgacttatagcaaatagatgggaaaacaatggaaatagtgacagattttattttcttgggctccaaaatcaccacagatggtgactgcagccatgaaatcaaaagacatttgcttcttggaagaaaagctatgacaaacctaggcagcatattaaaaagcagagacattactttgtcaacaaaggtctgtctagtcaaagctatggtttttccagtaatcatgaatggatgtgagagtggaccataaagaaagctgagcaccgaagaattgatgcttttgaactgtggtgttgggagaagactcttgagagtcccctggacttcaaggagatcaaaccagtcaatcctaaaggaaatcagtcctgaatattcattggagggactgatgctgaagctgaagcccaatactttgaccacctgatatgaagagctgactcatttgaaaagacccagatgctgggaaagattgagggcaagaggagaaggggacagcaaagatgagatggttggatggcatcactgactcgacggatgtgagtttgagcaagctccaagagttggagatggacagggaagcctggcatgctgcagtccatgcgatcttaaagag

SEQ ID NO: 49361 - DNA, 728 bp, Bovine  19866881099766
acagagagtgtaaatatttgagagtgttatttatgaggttggaagaatgaacttaatctgtaagaaaatagaacagaacctgatcaaattattttcaagaatgttacatagtcacctatgtctttgcaagtgcatgtaccagaaatatgttgtgaatggtcattttttgatatttgcttacagatagggaaatctcagcagccaacacttatgggcattttgacgttgaagtggaacattgactgacatgattgcagcccttggaggattgactcaactggctcaggtctatagcacacccccagacttacagttagattagagaaagaacagtaagaaatgatattttgaaggagttttatataatattttactccaatattttactttccaaagggagaaaatgataggaatgggtttatgtttccttcatgaagatttgaatataggatgtattaattaaacatacaccttcatttcactgatggagaaacttgagccaatagtgattgaattacccagctctttggttgcagagctaaggctacaactcaatggtttttactcttgacctgttatttttttaagtctaactattaatgggaagagttctccattttcggtaaaagaccaaagcagaaggaattgggcttatacctatatcaaaaaagtttagatagattgagggagattaactgtaaagtaactaaatactgtattttctttat

SEQ ID NO: 49362 - DNA, 2606 bp, Bovine  19866881101239
ccatttggctcattgacttgcaaataaaagccctaacgcgggcctgggccactacccagtcggagctctcttgctttctcaaatggggaagccgaattgtttccccaacaccgtgatgaggttgcttggagcttttaaattgctctttatgtggtaaaaatgagtttagcgctccgaataaggacttctgttcagagttgtttcttcataactagatatccattgacgacttcctgctgtgaagagcaagttccccccccccaccccaccccgcttttttttttctctctgcatcttgctcacaggactttttaaggccctttttgaagactggaaattctgatacatttcccctttcaagaatttgcagaagagagcaaatcctgattatttgaatttattacccctctgtcttcctttagttatatatgtgtagaatagttaatatatggatttaaacattgttactgtcttcctctctttccttttccacaccctccatcatttataaccgtgcgtgcaataatttttaaacctcaaaaaatgtttgcacaggagcatattgcagtttgggttgcaagaatcccctgatctcttgtccacccacgacttatacctgtaggtcatgggcttgcagttacagaatcagaggcttgagaaaacaacaacaacaaacttgatacttcctatcaaaaaaatagactcaaaaatactggtcaactttccccgccccagccccctccccctcaaaaattgccagatagattgtttacttcccttccttgtactgcagtgtcttgcgacacaaggactggctcttgaatgtctaatctaaattccccttgaaaccattaaagaaaggtgcagctccatcctgctccagtggttccacaaactattgagaaatcccttgaaaggtcacctccccatcccccaacccttagaggaaaaaaaaaaaattccttctgggaccagctggtgagaacatggtgtgctttgttcatttattcatccatccagtgaatatttaccaagtgccgggcacttttcctagctcctggagagacaaccaggacaagaactcacggtcaagagtggagatggacaaacaagccttggacacactttgataagtgtcacagcagcactaagcacagggacttctggagcacataggagggacaacctggacttccagccttgggaaggcttcccagtaggagtggtgataaatggaggccaggagggggacacaggtgggagaaacaaggttggagaggtgaacaggctggatcctacaggcattggtccccaagatgagaaattagggttgtgtcttgaaggtaaagagaagtgagtgaaggcttgtgaaccagtgagatgatcaaattttcattttaaagcgatcaggacaatactgtggagaatggattgagaaagtaagactgggagtggggaatccagttggtgggctactacagtcatccaggagtatgcaaaacccaatgtaagcaggggcttatcctgtgaactggggtgaggcagtgcagctgtatgtggccctgaaggtggtatatggttgtatttctttcctagggcgctcaggcttaaacaacagaaaattattgtctcacagttctggagtctagaagtccaagatgaaggtgttggcagagttggtttggagcgcccgtgagggaaaatctgttccatgcccctcttctagatgtggtgatttgctggccatctttgatgtttcttggcttgtatgtgtatcgccccaatctctgtcttaatcctcgcatggcatttcttccctgtgtgtatgtccaaatttccccattttataaggactccagtcattggactgggacctatcctaatgacctccttttaacttgattatctccgtaaagaccctatctctaaataaaattcttcctaaggtcctggggattaagagtccaacatttttggagagccattattcaacccataacagtggtagagaaactgagtaacacgggatccccaccatcatggaagaaagatgtaggctggaactctcttcccagctctcctgctggtctgcacttacattccttcatgtgagtgctcagcctgaggtcttcctgactgtcttccacaactagcacagtttgcctacactgttttgtttttcctcatggtatttatccctacctgatttgttgcatattcagttttcactgtcttcccccgctggaatgaaagctccaggagagagcagggacttcgcctgtttattctgtgtctaaaacaagtctttcactgattagattaatgagggaatggatggatggaatgaatatagcagaagtactaagggaacccaaataaagggcttaaggagggggtggtcagggaagatttttctggagaaggttactttccaggttggcagcagagaaatctagcagaaaggagaacagcagcttaccactgtctgcattgtggcttggcatggacttgaggaaaactcatctgtttgtgaggatcgttgattgctaagtagggagggaggaccctattggagtgaacttttgattgaaacaaaacttttaaag

SEQ ID NO: 49363 - DNA, 996 bp, Bovine  19866881111553
ctgctttttctgaagcaaacagtgtgcactgcatggaatggggaggcatttctgtagtggttggttaggcgatcatgatggggccattgaagagaatagtaaacaggaggtggaagaaaaagccatgcctgctgcagagtagtttccccttcttactcatgtagcagaaatatgagaccacagttgataactcagtgacctcatattttgagtcatggtttcaccctatttttgggaattttccttcccacatacccacagcaaactcctcccacccttctctgtgagctaaaatgaacacaagtggcaaacatatatttattttcacccaatacagactctaacagaacttcattaaacaaacatttattgagcacttattgagcatttactatgttgtaaggaatggttgagtgtaaagtagcacaagctatggtctttaattttggggaaacttcattcttataagcacatagaaaaccatactgaaggtggcaaaaatataaataaaaatgaagatcataaaagaggaataaagtgggagactaagatagagggaggcctcatggaggagctggaatttcatcttgattctaaatgaaattggtggtggttcagtagttacaaatccacctgccaagaaggagattcgaggttcaatccttgggtcaggaagatctcttggagaaggaaatagcaacccactccaggattcttgcctgggaaatcccacagacagaggagcctggtacgctacagtctatggggttgcaaataattggacatgacttaacaactaaacaacaacaacagaaaagcaaatatagagaaaagaaaatgcaaaaatattcatatttataaagtgagtggtgggaaggcaatggaattgaaaagacatttcaggtcctttcaggatggcatgctgggctctgtactattcaggctgaactttattctgtagggagaagacaatcactgatgggctttaaataggca

SEQ ID NO: 49364 - DNA, 1494 bp, Bovine  19866881121594
tggaagagggggaaattagatgtttcattttagagttaaggaagatttgaaacgtcatattgctttcagatttaaaatttacactgaatatttcaattactctgtgtgactcatgggatgattgttccttcaaaaaatacgcagcatattttctaaaattttttgatacttttgaattgctgtaattaatatatggctatcttagttttcttttcaaaagcttttggatgacatttatttttaataagaaaaaatatatattgtaatcacttatagttacaaaacttggggaatacaatgccatcatttttacagaggaacataagatctgctgttcctctttctgtaccaaactaagggaacacgtgatctatcccatcaatcagtaagactgagtatcctttttcctaggctacaaccaagagatagaaccttcaggctgcatgtctgttaggaaacactgcagtttatttactcagcagaggacctgttgactttaaaacaagtttatttatcgccagctatcaaattcaaggcccttgctgcacctgctctgagtgaccgtgtactcacagttgaaacctttgctcaaacatttatgttggggctgagcaatgttacctctagggaactgaggaaatacatcctacttagcctgcacactattctccctttatcgaccaaactctgagttctgtaaacctagggacttataaaccagcataacgagagcgtgcattctctctacaggaagaaacccttcagcgggcacgtgaggaagaagagaaaaggaaggagatcacaagtcatttccagaacaccctgacggatatccaggcccagattgagcagcagagtgagcgaaacatgaagctctgtcaggagaacacagagctcgcagagaaactaaaaagcatcattgatcagtatgagctcagagaggaggtgagaaccacatcagacaatttacaaatactgcatatagatctgggtctggtttgtgaaggttgggaggtcggttaataacaaagttatgatcagccttatcaactgattaatatttaggtttggacttcttttactagccaaaataaaaacaaatgatattacaaaatacctggctgaaagtcacagaggatttcttcaaaactagaatcactgcaaagcagaggcaataaacaaggggtacaacatgaatggatttatccttgaaaataaaaaataatatttctcagccttttttaaactctctctacagaaccaagaaatacttcatgcatgccctcttaagaattagcatgtcatcgaaattaaaagtctgcattgtatatactgcacaaataataatatatgtactattatatagtatatatataatatactatatattactatacatatactatattactaatatatatactattatatagtatatatataataatatagtaataatggtattgttatttatacttagtttgtgccaaacaa

SEQ ID NO: 49365 - DNA, 2211 bp, Bovine  19866881129305
tttgtatggattttataatacttagaggttataacattcgagtgaggctgttatttataagcatactccaaaaaagggtttttgaagaggtttttgttgttattgttgtttgtttgttttgactatggggacatcaaggggagggaagctgaatgataagtgaaatggcctgaaaccatgagtcaaggtaaaaaaaaaaaataataaatcaaagggaagtcattgaacactggtgaatatgaaaaaagaaattaaatcagactatggagcaaaatgcataaatttagtatccagaaatactcttcatgggaggttctattagtttgtctactaatagaggtcggtgaagtaatagtctccaaaaggtggggccattaactctgcaggcatttagaaccggtctgaacaaagcacctacaagctttaggtagggaataatattgtagacaagctgaataagcaagtgtaaagactctgactccctcagacttccagctcatcatgtataggcagttcaaaaatcctgccgcctcattcctgccaacttggatgcaaattctccttggccagaaaactgatcattagatatgaaagcctcttttttgttgttgttgttggctccccaagttcctcacatatcacctggcattctgctcaacaaatagttacaactttaaatgcaatgtgtaatgtcagaggtttacagacgctatctcatacttgaagatcactgcagtctcctgtcttacataggaggcaaacggtgctcagacaccaggctggtgagttggatttctaaccctgggatacctcccgtgaaagagaaagagagcctgggtttaggtgaaagcaaacttaggtgtgatatcaggcttaaattccctttactctgccaaagcctccaccagtttgtaccataaccttctttatccttgcagtggaattatttgaaattcttatttgcaactctgtctagcagtttgcacagttcactccatcattgtctgaatgagaccatccagagcgtggttcctcttcctagtaggaactgaggctttttagtggatgtaatcctcatgacccagataatcacgatggtgtgatcactcacctagagctggatatcctggaatgcgaagtcaagtgggctttaggaagcatcactacgaacaaagctagtggaggtgatgtaattccagttgagctatttcaaatcctaaaagatgatgctgttaaagtgctgcacccaatatgccagaaaatttggaagactcaacagtggctgcaggactggaaaaggtcagttttaattccaattgcaaagaaaggcaatgccaaagaatgctcaaactagtgcacagttgcactcatctcacacgttagcaaagtaatgctcaaaattctccaagccaggcctcaacagtgaagcctgaactgtgttcaggcaaaccataaacttccagatcttcaagctggatttagaaaaggcagaggaaccaaagatcaagttgccaacatccactggatcatcaaaaaagcaagagagttccagaaaaagttctacttctgctttattgactatgccaaagcctttgactgtgtggatcacaacaaactgtggaaaattcttaaggagatggcaatatcagaccacctgacctgcctcttgagaaatctgtatgcaggtcaagaagcaagagttagaactggacatggaacaatagactggttccaaataggtaaaggagtacatcaaggctgtatattgtcaccctgcttatttaacttatatgcagagtacatcatgagaaacgctgggctggatgaagtattagctggaatcaagactgctgggagaaatatcaataccttagatgtgcagatgacaccatccttacagcagaaagtgaagaagaacttaagagcctcttgatgaaagtgaaagaggagagtgaaaaagttgccttaaagctcaacattcagaaaactatgatcatggcatctggtcccatcacttcatggcagatagatggggaaacaatggaaatagtggctgactttattttttggggctccaaaatcactgcagatggtgatggcagccatgaaattaaaagacgcttgctccttggaaggaaagttatgaccaacttagacagcatattaaaaagcaaagacattactttgccaataaaagtccggctagtcaag

SEQ ID NO: 49366 - DNA, 1460 bp, Bovine  19866881152136
aatactggagtgggttgccatttccttctccaggggatcttcctgacccagggatcaaaaccccaggtctcccacattgtaggcagatgcttttaccgtctgagccaccattaggttgaactaatttgaaagattagtgagacagggcaggatttggggtgaggacggtgcctcacaggatttttggaatttctccatggcctcaccattgtactccaccctgaaatccttcccttccctctcaagtagaggggttccttgattacattttgagttgctgaacaaagcagacaaggaattctggctccaaagtagcctgtggcaagaccaagttggtatgctgcgctttgcaggagatacgcaaataggtgagtggcttttaaaagttaatagtgctaaaagaatcctgtcaatccattctgaaggctggttgggaagccagcttttggcctgagttaaagtcaaactagcataaaatcagaaaaagctgtcaaggacggccaactccaggttgtgatattagtttgtgaacacttgtaggagacagtacgcagagaaaggaaatgtaatcagggctgttgaagccttttccctttctgtctccctagcatgaatgttgcatgctcagttgcttcagttgtgtctggctctttgggaccccatgaactgtacagccctccaggttcctctgtccctggggggatccaggcaaaaatacagacctcctccaggggatcttcctgacccagggattgaacacaaatctcctggatctcctgcattgcaggtgggttcttaaccgttgagtcacccgggaagcccatatctccctagggggactagtataaaatacggccctgtgttcctctatgcagcgtggcccacgggaattttttaaatttctagtaagcaacctcttaaaataattttcttcccttggctttctgacacttaatatctccatgttgacaaaacacatagtgctaaaattgtgcacgaaaatcataggccaccttgtacatattgtcccgttacatttatttggaatgactctttgaaggaggataagcaggatgatggctagttccatatttcttctctttacacaatgtgtttagcaaatatatggatgatgaggccaggaggtaaaaagtgcctgaattgctgtactcctagtattttaggtaaactaaatatacaaatctttcttaggttcctctatctgataacatattttagagtaatgactctcagctggatagggccacccctctaggaggcagatcagaatggaagagggtaaaagagggcagtaatttggaaaaaagagcatattccatactattgtatattggggaaaatgcttaaatacattatacttccagtaaaacataatgtagaagactttgaaaactcttcttaactaatggggcacggattttaacaatagtagaaacact

SEQ ID NO: 49367 - DNA, 1435 bp, Bovine  19866881277645
tatgactcaaagagcaagggtaatttttgttagctcactttctatggtggttagacatacttggtgaacagacggaaattatacatgtatctggaactaacaagatgcacacatagaaagaaggttgcaccgtaattaaaaccacatatatattttagatttctgttatagtgggtagaaaaaaatggggctttctttaatgttcctattccagcctttcctattataggcccaggacctgaaatacttagaaatccagcaactgagcaaacttgcaccctggagaacacacatgctctgtttttctccactgcccatatcctttcagcttgctggtagggagagtaaatctcaacatttgctgcaatcactcttcgtgtgtaagcatacagatttaactttcaaggcaaccatttgccattcaaataataattgaagtgcttattatttgcatatgttctagaatttcccaagtgttttgcacttgttatcttgttgaattgtcacttctgtgaagccagcatagatagatgttatcgcccttattctagtgataagaggactgattgagaggttgataaaagggctcagggaaatatatttgaagttgactgtcaccaggtggaaggcaagatgatgttttttaactgagatttctatgatggacacaaatgggccaaattcaaggaaactttatatatctatatagtaaagtgcattttgaacaacttttaaatagcataaagttaaatttttcataagaaatctatatctatttatcaccatttaatctaaacttagtcttccccccagacttgattaggcaggtttttaaatccatgctgtatccactgccttaaagtcagaatccacctaggtctaaccccaggtgcacctctctctctatctgtatgtggtctcttttcccttcttagctttctagaaacaattagatacacagctttcatttcctttctggcctgtgccctagctgcagggctctgctctgtctagaactgtctgtccccacatgaatgaaacagagttgattgctgacatttacagcatccctctatttctgcagactaaccctgcccctccaactatttccagttcaagaaagctttctcctggcattgttcttttcagagtataggaggaagctttccctctttttcttaattctgtctttgattagcagctgcaagccaggtatcttaactgcaaaacatctctgaaatctgttgctaccagtaacacaacatacaactttcaaacaactctgtctgatacaaactgttctagccagagagttcctctgaacttatttctaaaatgggtgatcttcttccagaacataacattttatgctagattttttttcaacagtgatttaaaacattgcatgacccatttatccttaaaagctcaactt

SEQ ID NO: 49368 - DNA, 834 bp, Bovine  19866881284773
aactaggaagattcttgtatatggtattctgagtccattgcaacactgtcctagacttccctagtggtccagtgggtaagaatctgcctgccaacgcaggagtcctggacttgattcctgacttgggaagatcccacttgtcacggagcaactaagcccatgcaccataactactgagcccacgtgctgcaactcctgaagtccacgtacctagagcccgggctctgcgagagcagaagcagtgttcgttacacttgttggggaataccagagtaaaacctgttatgaatacaagggtttgtttggggagacggtatgttacttgaccaagtgaacgagctagagcttcatagtattatgccccataccagagaggaacaagactaggcagagaaaaatctggctcataggatttaatcatgaggaattttgctgtctgctgagcatgaaaatattcagtggcttaaaaataatcttcagaattattttttaaatgttagggagggtatgctatttaccacaccaatcattatgtttttctagcttttatttaaaatttatactttggaaaatgttttaaaacttcatatagactttgaatgcacaatagcttgataaaaggttctagtagtaattgttcttttaaagattataagcaatgtacccattaatgaatctgagaaaatcttgtagttcatttgtattgagcaatatcttggtagaacatttgaataacacatttgtttagtgaagtagaagtgataataatgaaacatgagccattttctttttctttttgaaatttgttcaattatatgatctactcattagtaa

SEQ ID NO: 49369 - DNA, 2429 bp, Bovine  19866881307618
aagtgcccaaagctgaatccagcaagagcagcaggagcagatagctctaatctctagggctgccatgaatttcctcccagaagaggggtcatcccatgtgggtcttggaaagactgcaggtttttgagaagagatgggctctccaggcccaatccaaaaagaggcagctcagagagggaagaacagggtgtggcaaggagctgggctcagcttagccatggcagtagctgagccaagtggggtgggggactgagaagacttaaacatgcaggaagattggctttgactccctgggctttttgaacatggcagatgtgcttttcaaaggaaaagctatagaacaggtgtcaagaatgaactagagagagcttccctggtggtccagtcgctaagactccttgctcctaatgctggagacctaggttcaatccctagtcagggaactagatcccacatggtacaaccaagaattcgcatgccacaattaaagatcctgagtgccacagctgagacctggcacagccagataaataatttttcctttttaaagaatgaattggagtcagagagagagctgaaatgggtacctttgcgtacgtacttttttcttctattttttgccacttgaaacatgcaatcacacatgcaaatcaacaatttgtatccaggaaggacttatacctgagcatatattgactctccacagcagtgattctccactgtaggggatccatccagccctgctggacacattccattagacttagaggccaagggtgatacctctgtgcccaagggcactgggataaccttatggagttctctcacctccagtccaaacaagttcatgttctttgctgtgcccagctcactgtatgtgaagtagagtaagacctttgatgtgatgaaaaaaaggtgatgtgatgaaaaaaggtgatgtgatgaaggcgaagaaaacataaactgtctatggcttcacagggccctatcagaccagatcagcttttgtcttagggattttctttcacttgttcatgagccctggaaagctaaccttcaatgtgcaagggtcattattcccactgcaagtgcatgagtcctcacaattattttttatttggtttctgtttggtttttgtttggtttactgggtttcctctatgtatttttgatgcaaatggaatttaaagaataattctatagggatgttattaagtacttagctttttcttctatatcataaaaacacaatcccataccttgttgctcaaatggaaactattttggtgacaatttaaacatgaaatatccagcagagacaaatcatgattatttacaaaaggctttatgaaggaattatttacttctttgggcaatttccactttgcttgtgatttcagtcctaagagtatattcatctagttcttcacaccaaattaatgggagctgtttcttattattgtttttgatagtacagcatgttgaatccaactcccatcttacttttcctaattatttgtaagctttcctcacctctgtttttctttcatggagctgttctaaatttcattaaggaggcaatgtgtggagtatcagatgtggttttggaattgttctctaatgctggagcccttgttctggagcagatgctgagcactcagattacaagaatgagaagagcaatttgtacttgtcacgtggagaagctcttgtccagcaataccaagtactgtcctttgcacctgattcagagcaaagacacggcatctctgtgtcttggtaggtccaaaatttctgtcccaaatttcccctagttttccaaactgtggctctgtctccttggtaaggaagtgctcttaccagtcaccagattaagagagaaccacttgattatcacctgggtcattgaccagaaactcactctgtggtggtgatggcgaagaaatttctggcacagaagtccatactgaagaagagctttatgagaggtgaagccagaagagaatgcactgtttacccagcacaacttgcaagttaggtgaacggagctgatcacataattcccaaaccagtggattttaaagggcagtcacacctcaagactgaaagagatcagcctcaaggaaggttctgtcactttcagccatcagtttaaatgagtgtgtcttgtaatcaacacagaggtaaagagaatacatttcccaccacaccgcacgtggggagcccacacctgtaagacgcaccgcaaacccattcatattatatgaagtcctaatagacaataaaactgtcacataaaaacgtcattcccaggaaagctttattatcaaactaagggggagagggtagaaagatggaaactaacattttcctgagtatgttctatctaaatgccaggcactttctttgttgtcccatcccttttatcc

SEQ ID NO: 49370 - DNA, 2051 bp, Bovine  19866881314855
atattttttctttgttggaatgtctttgcagaaatatataactgcaccagtctatagattctttctggtttctgctgctttataacctctgacaggaaggtttataaccttgctttataaccttgcttccaggagtgccatgtattagtggatttctcagaattcttaaaatgccataagaaggcaatagcatcctaaaggcaactgaattctgctaaattgatttttgtcaagtgtgagggttttttaatgtatttctttaagggacaagattggcagcaaagctatcgggacctggatgtgctcagatgacagggcaggggatgtgcttcttcaaggaaggactgaattcataaggtattttattaaactcattgcaagtaaacctatgactttgcatatttgtctgtgagctgattcatttgttccaatatatgtttcagactttctgagaagaatagttccaagaatacccaggagaattcaaagtgcgaataatcccagactgcgctatctcctttgaaactaaaagatttagatcctaaatggcaaattaaacaaatcacatttgatgatttaatgtaagcttccacaaattgattagtttgtggcaagttctgacttgagacattaaaaaaaaaaaaagaaaatctaccctgactttgaagaagatggtgtaagtaaacggaaagcagaatttagctcagtgtttggctttggtttctttttcctgtgctatctttataaaggctgtaagtagcagcttagaaatgctggagagatttttttttctttctttctttcgtttttttttttttttaaacaggatttggccagagactttgttatttgcatagagtaggatcttgacatatcctatgctttatcttgtccacattgtaaaacctgactatggactttaaaatttaaaacaaatcagcaattaccaaacactgcattgaaaatgtattcattccaaactgaattatcactggtgacgttctcctctctcaactttaaaaagctgaaaaatggtaatacaaaccacatggttggttcgtttcacccccactcttggcagggccagtggcgcctggcaacctcgctgtcagctgggcctgtgatactgacagcagtattgccctgaagttaagtccaacactttctttctgagaacccattagtagatgcttttcctcttatcggtcttctcagtaatgttcgaaaagggcttttgtggatgaggagaacctgtccttacagagagactggctgaaatagtaaaaaaaaaaaaaaagaaagaaagaaaaaaagaaaaaataaagtattctagcgactttgggaaaagaaaaaacaagcccacaaggacagcctctgtgttgctttggattttggtggctacttggatccagcctgactacttgctgggctcctatttcttccttaggctttgagtctccctccttaaggaaactcaaaaaaagcaaggatccagtggttggaattaagaaattgagatctgaagacttagaatacaaatgtggtcatcttggatttggctctggaaacaatggaactatttaattccaacatatttaggggggaaatatgtatttggaacaaaactgatgatgccaacatcccttcaggtaagcctgattataactgagatgacacaaacttgctatgatagttaagcatgtgaaaagtgaaacttccagaagacatcaccagagcagtcaccacaatagagatggtgtctaaggcaacgtgaaagccaatgggaaattggattcactggcagaattttactttactttatagccaaattgcataaacaaagacagaattcaactcttcctactccttttaattagacaaaaatgataacatataaagggactggtagagttcctgcatattgctggcacttaataaatgtgagtttgttcctctccattcaagcaaatttcctttgagatctctgggtccagggccccttacatgcatatgatgctcactgggcttccacaggacttctttctttgagt

SEQ ID NO: 49371 - DNA, 1196 bp, Bovine  19866881315284
aatgatagatattattgctataatatgtttaataatcctttgtttctttctcgaaggtcctatgtcacagaagatgcattttgacttctattttactcagaaatgatataaaagaatgtgagccaggtttccagttgagtcatagtagtgtaggaggttttcttttttctctaaactaacaaggttacccacaaacaattcacatcagaaacaaaacacatgatcaatggaaagtgaattcatgggactggtcactatttttagttatttatatcatacttcattgcaattcagttatacaaaatccccattctaaagtttcagctcctctcacaagtgcaatgttagttgcaacatggccgataggaaaattgaaccttcaaaaattttgaatgtgccagagaaaaagcataaaaaaaagcaatcaaggaaataagataaattattagccattattttaagcaggtctgtttttttcctctcacagctgtatttcactgcttaacagcaatcattaaaataatctaaaatatagttctatgtgagccaaaggtttccacaacagagtagaagcatgagataatcatttcttgtgttgacttaaaacataaaagggtgattattcttaaaagatattttctccttcacgtaaaacaaggaaatatacaaaaaaatactgcctgttcttggtaagtagattttaatttgtatctacactggtgttcttctcacttcattaggcttagaatttgtgactgaacatcactgtctgggcagcctgctgcctggttggagatgtcagaagcaattattttcacagatttaagattttattatcacacatacactgtctttagctatctgaatggacagcccaatcaagaatgatatgtatttcatcatctcttccttgttgttgtgtgattttaataacagttccagtagaatcccatgttgcacaccaagcatgctatgcagcagctggatggatggttaaatagagccatccgaagttagaagattactttttcccccctctaatatcaaaatctttctgaggagtcaatgagctttattagacttagtaataaagaacttcccaaaagccacacctcattttcagtgatgttggaaataactccaaaaaaaaaaaaaaatgtatctacgggtaggttgttgaaataacttcaacttca

SEQ ID NO: 49372 - DNA, 957 bp, Bovine  19866881349456
gcagacattaggatggccaaaagatctatcattggtgcttcggatgaaaaatatattgcacgaaacataatttattccttttaacttattagaagctatttcaaaactgatagcaaagtttatttcttaccaaaatgtaaggggaggccgcagataaaatcgagtctttctccccaatgcctgggcatcccacatgttgagataacagctggcataggatattaatagatagccattgtcctggcacctggctggggaatcacagtctgagactataaccagggcagctgcaggttcttgtcagttttttctgagccacagaaatgagaaaaataatcgttttagaaatatataacatactggccctcatgaaatacttccaatactcaggaaaaataaatgaagtacattttaaaattattttgaacagtctctaaactatttagtctatttttctactggtggctcagtcggtaaggaacctgcctgcaattcaggagattccgttggatccctggatcaggaggctcccctggagaaggaaacagcaacccattccaatattcttgcctggaaaattccatcaacagaagagcttggcaggctacacacagtccatggggtcgcaagagtggtcatgacttagtgactaaaccacacccaccctactatcttaagagtaaagaatattgattgtaaagaaaatcaaactagaagaggtattggagtaagaggaaaatatggggctaaacactgatatttgaatatgtataaacgttgtgtggtttaccaattccaaataaaatagggatgcagttatgaaaaaaagaaaaagtatgaaaaagcttgttttgagaagaaaattaaactagtattgaagacctgttatacaccccagataaaaagatgctactgaatttcttccacacccttccttctctctcctttcattttatt

SEQ ID NO: 49373 - DNA, 696 bp, Bovine  19866881364332
gaaacagcaacccattccgtattcttgcttggaaaatcccatgggcagaggatcctgacaagctacagtccatggggtcgcaaagagtcagacgtgactgagtgtacatgcatacagggacaaccaggcacataaagatatttagagcaggaaagggatcttaaagatcagacaggaagacagacaaactcagttactggtctgttgtggggaaaaaaaagcctaggcatctgtgcactacagaagggagataagaaggagacacaataaagaggattagaaaataaaggaacagaggtttaaccatttgctcactccctcctattctgctgaccacctctgccttctcagggtttgtgatatcccagattctatcaaaatcacatccaatttttgtggagaaaaaaatgacacagaatttaaaaataggtccatactctttgataagaactgcattgcaaaaaaaaaaaaaaagaactgcattgcaagaaggaaggaaaagagtacttaatggattgtaacgaggtgaccaccacactcctgttttttaacacatcaaaatgacaggctttccttaaaacataatttcaaccttagaccccttcttagaaaggctttgtgattagcagcgaaagtcaggcctacactcaggtaggggaaaggagaactcatgacccttggggaagaaaatcaaaa

SEQ ID NO: 49374 - DNA, 1321 bp, Bovine  19866881568905
tcttgtctttttttgtgtgcttgctatttttgggttgagtaccaaatatttcatataaaaaactgatacaataatttgagtctccagatgatgttatcttccttcagagagaacttgcttctagcatttggttaggctaggaatagcttatttaaatccagtcagagaatgagatatttcaaagctagtttcaacctatttctttgtcattcttactgaaaaggatctcagctaaaagccaggtgtcgttaccaaggctattcccctttgtgagctctgaatgtttcctctcttccttgcaagaatccttacatcttaagatgttaagaagttcttaacctcttctaaatctttcagtcataacttcctgctctgcttctcagccttagttttgctttggaactgtcaagtgtcttgaagtgaaaagtgagaccgatcaggatattacttttctgggtttccctcctctaaggtcttggttttacaagtccttattgaattggtagcttaagtaattgttttatagtattttgtctatatatttgattagataaaaccacgtgaaatttgctgttttcatatctcaaaactggttgcatattggcattattatatgggtcaattaaagttgttcccagtgcaaaggttggtgttaaacaaataaccataccatcgctagaagcagaattctcagaatctggtgcatatgctatgggagcattgaataagtgtacaaagatgactaatacatatattcatataaaatatacatattcatcaaataatatttttcctgtggagtaaggtatgcatcttatttctcagaatcaagtttagatggcaagtcaactgcactaaaaatctcaatgtaataagaaaaaattatctatgtgcctaaaaagattattactaggaaatggcccttgcaactcatctttctcatttctttttctgaaggattgcttatggatgcccaaatgcattaagtttggatggtttctgccctatacaccaacagataatgagtacggtgcttggaaacaccattacattgcttgtgtgtccaacttagattggctaacccctagggaagctgctgctgtttatgggactctgaatgaacccaaaacagaagatgaagagctacaggagaggcaaagagaaaggtgcctaaggaaaataatttgggagaaaattgcactacataagagtgagtggcattttacaactttatgtcttagccgagtattgtagaaaccaatggatttacatacaaattcccacagaagaggatggcactgtcttcttgaaatagcctata

SEQ ID NO: 49375 - DNA, 800 bp, Bovine  19866881745838
tatgttttaagtagttaggtctctattctacttcagagtacaaataaatgcctgacttagggtgtaagccaaattccaaaatgtagcaaaaacagtgcctgcatatttggcaggaattgaaaccagttcaggtcagtgtctgtttctgtccaaagaagagtttctgcatttacactgggctaggaaaacaacacaggaagacctggggaacaacaagtaatactgtcagctccagtgccgggctggccagaggagaatgtggagaacaagtctggaatcacggcttaagctccaggttgggttggcataaggtttggggtatggggtggggggcagtgagcaagagaaagagaggggctggatgcattgttgtagcaaaattgccttctcccatctcaggctctcaccttgcaaatcaccctcacttagcaaaagcacatcttacttgttaactcctcccctgctcgctaaccttttcaatcatcccccttcttcatttcagaatggccttcggaacaaagcagcgttttaaagcctttcccactaaaagttcgcccctccccccctttaaagaggcagtgtgggggtgattttcttttctgtctttttttttgttgttttaatttgtttttctgcagtctcctctcctgaagctgtcattgtttggaagttgatggatatttcttcagagataccatcatatcgcttgttattgtaacacttattggtgataaagttcagcctaaaaattaagcagctgcaatgtagcagcacaaattagtttaatgtaagcagtcagg

SEQ ID NO: 49376 - DNA, 1117 bp, Bovine  19866881896566
cttgatattatttctaagcatgactccatatctgttgcagtgtgacagaaaacagaagtccccagattattcaccacgactctgattgagtcatttgatttccctgaacctcatttcagctgttaaaaaaaaaaaaggagagggtgcaagaaggagagtttgggagctagtaatgtcttttttatagaattgtgagagagaatcaaatgtgacaagctaagtgaaagtattttgtaaaatgaaacacctcatataagtattagttaatagcagtgataagactgtcttgtcttcttgatttgtctactgcagaagggataagtatgttttctatgtctttatccagcttatggattcaaatgttaagcagactaagaccaaactactaatcaacatgccttagatttattttcaacctgttgtaaatatatgatgtaaagatatgatgacccaacctatacatgcttagttcaacttcaccttaaaaatctcatgagcccagctgtgtgtcaacaccaaatggtactgtagttacttaccaccaacggctttgacaaatctggctttgacttcagctcaatcactcgctagcaatgtgactaattacttgctctcactgaacttctgtctttcctgaaataagggagacagcaagacagctacatattaggaccactgtggaactaaatgaaactcagttcaatctctgggtccagaagatcccctggagaaggaatggttacccattccagtattcctgcctagggaatccccatggacagaggagcctggcgggctacagtccagtgctgcgaagagtcagacacggctgagcaactaagcacagtgggactaaatgaaataaggcgacaggacctggcatatggctagatttcaacaagcggttgctatttttatgatattgtgaaaattaaattttcctaatcaatcctctgatctcatagtagctctgtttcaaaagtaaaaaataaagcaagcataaaatggtattccttataaacctacatttcacttcctagtaaccactacattcctttgttaatactcacaaaccatcaacttgaaaatccattcttgactctttctggaatcacct

SEQ ID NO: 49377 - DNA, 779 bp, Bovine  19866882089373
atcactatatgccccaagtgatcatctccatggctggatcagtaaaggagcctgacatcttaatttgtaacatttcttgatagatccctcctgactcaccccacatcccccactttatttttggtagtaggaaagaatttataataaaaaaaataatttcaatagttttaaaaattagacaactccctcaagtatagttttaaaaacaatgcttttttcataattgaactgagttctattcaacacttacatcttttgggatatgattattcagtaatgagacttattttataaaaaatatatatatatttcaaattctttttatttcatagactctatcagaagcaaacagatatttgattagggttcaagatgtggcccaacttcactgctgtgatgaggacataagtttctatttaaggtaaacattcaactatcctatggctatgagtgtgtcttaattattttgtacccagaatccagtacaatgtttgtcatattgtaaatatacaataaatctttgtgttgatctgaaaagttacgtatacacccctctgagacgatgtaaggtgtttatcaccttactcagattccaggcagctccttcatagaatggaagaaacccaactgtcactgcctgggccactaactcgagacatgggatttctggtttggtcactttcctactgagaggagagctgatgtgagatatcacatggatgatctgctcaactctaagaaagagaagaccagttaattatctgcagttagttactgag

SEQ ID NO: 49378 - DNA, 826 bp, Bovine  19866880339720
catatacacatacatgtacatacatgtgtacatatgttgttattgtttagtcactaagtcgtgtctgactctttgacaacccccatggatggtagcccaccaggctcctctgtccatgggatttcccagccaagaatattggagcagattgccatttcttgtacatagtctataaacatacatatacacacacatacacctataatagaggctaatatttatcagccatcccctataaaccaagcatttctaaattctttaaacacattaatttatttaatcctcgtaactttagttcacattagcgtccgtgtttacacagacaaggaaattgaaacaaaagaaatttagttattgtgcaacatctcctgcagaacctatttggaagacaagcagtttgactccagaatccatgttcttacccaacagtaaaaacagatacatacaaattcacatttataaaacaagtttacctgcttcaacctgagcactttcttgtctaaattaaccactgagcaagccttttattatacactgaaaaattgaaacaactgcaataattgttcaaataaaacaattggaaaaaactgttccaaactgaaactgtttggaaaatctggagcaagctaatccactgaggtttgaacatactgtattaaagaattttcttcctcttgtctttaacgctgtttggagttttcatgagctgtgaagactcaagggaacaagtcaaagtatccttgcagaaattctgaacaccagtaaaactagctgtcaagcataaatcggtgtctagctattttccaacctatttataaaagtgcag

SEQ ID NO: 49379 - DNA, 3965 bp, Bovine  19866880408402
tgtttataacattttatttctacttctatatacattacagcatgctaaccacctaaaatttactttccatctaatgtaaatgttaatgtaacttccatgtaaagtaatcaagtcaaggtagaagaggaacctccacatctgaacttcacttttgcatagcaccgtatccagaaagtcaatcgtctgatttattttttaatcattttaaatcatttatgcaaaaaagtactcaaaattactagcttttaaaaattaaatagaaaataaagaaatcccactaataacattcacatattagactgtcagtttaggaagacaaattcattttttaaaagtttttgacatcaagagcctgaatttacataaaatgtttctcaatacatctatttaaagttagtttaatttttttatccatcaataatataaatctaccttacttgcattataattgtttgagtaagagtacaattctaattgaaaatgtaaaactcttggattatttccatattttcctgaaatttgtttctttaattactttgcctacccaatccttcttttacattgactgtagtgcaaactcttcttgtagctcaagatctaaacaggaaaaattaaattaaatgtataaaactattaaaatgtataaaatatgcaaaatataatttaagtaaatataatacatatgacttaaataaatatagataaatggaatactaataaaataaaaatctaaatcaatccatatttaagacatttttaaaagagcccaggcctattttacctgcatctttgaatattcaaaattaaatctatatattagtatatgtaagggtttttttatgtgtattggaacctatcttaaaacattattcatacctccgaatattttggctctagaattttagtctagttgaaagatctacttaacatattgtgtataaaatcttttaaaataattttttgaagcactcagtcatgtgttggttaattatttgaggtcaaaaatcagatagaaaccaataaggacctactgtagagcacagggatctatactcaaaatcttgtagtaacctataaggaaaaagaatctgaaaaaaatatacgtatacatataacagaatcactttgctgtacacctgaaactgacacaaccttgaagattaactatacttcaatttaaaaaagaatcaaaaaagataaacactttcctttaccttctaaataaatgttgggaatttatgtggctgttgtattatcccattatctttcccatgaactaaagctaatcaaatgtaccctcagatcaacaaactactcaaacagacacatagaatttatgcagttttttcattcaatcattcagttcaacaaagatttattgactaagtattatatgccaggctatgtggaagacatagcaagtccaatcaaaagcaagatagacctagtccctgtcctcatgaaagttatgagtttaacattgaacataggcaaaaaaaaaacaacactatgaattaatgcatatatacatgcataatttaaatattaatgtattattataggaaacaattacaaggcagagatggagaataagatgggaaaaactagtttagatgaagtggctagtcaaggactctctgagtgatatttaggctgactttgaggatgaaaaagccaagcacaaaattactggaaaggagcaagttgctctgaagtggagaagacatgtgtcctgaggaaccacaatgggcacctgatgaaatcagatagacaagcagaggataaggagtttaaaattctactctaattgatgtgggacaccactagaagatttaggggagtatcatgatgtgatgttcctttttgcccttctctggatatttcctgtttgttgctcattcaagcaatgctccatcttgcccaggtgtccgtcgtgttgtgcaagagtgtctccaaggttcctacctaggagaggaacagtggggcattttatggacatgcattaactttactcattaagtcaaattccatttcaaagtactgtgtcattgatgctaccaccagcagttattctgcttcatcaacattgccattatctaaattttcatttttttctaatctggagggtgtgaaatggcatttcaaaataaacggttttaatgtgcatgtctcttattaagacaagagaagcatcttttcagtatgtttattggtcattttcatttcctcgtcttttcaactactgtttatgaatttatgaccctttggggaagcagaaatggagagagattactaatttttccttatttttagatagcttttgaaatactcccaatactgatcttttgttagctttgtatgttgcaaatgttttattccagcatatgacttgtctgttcaagttgcctattatgtctgagctcttatttttaacttattagtttgctttttttaaattgaggtatagttgacttacaacatttcaggtgtacaacatggtaattcaatacttttatagactgtactccatacaaagttactataaaatattgactatattccctgtgctaaacattacatccttgtcaattatttattttgtacctagtagcttgtaccttttaatcaccttgacctattttgtccctgaccctaccactctcctctctggtaatcactggtttgttctctatatctgtgagtctattactgttttgttatattttttcatttgtttcttagatttcacatataagtgaaatcatacattctctttctctgacttatttgatttatttcactaaaaataatgtcctgcaggtccattcctgttgatgacaaaatttcaatctttttatagtatatgagtaatattctgttgtatatatataccaaacatttatccattcttctgttgatggacacttaggttgcttccatatcttgacttttataaataatactgctatgaacactgaagtgcatacatctatttgaattagtgtttttattttctttgtattaatacccaggagtaaaaatactgaattgtatgatagttctatttttaagtttgtgaagtacctccatacagtttttcatagtggctgtaccaatttacattcccaccaacagtgcatgaagtttcccttttttccatagcctcaccaatgctagttatttgttgtctttttgataatagctattctgactggttgtaaggcaatatctcattttcttaataatttgcactttctgtaatttaagaactccttccactctgaggttataagaatgtgcttgtgtattttcctctaaaaatatgttttcttttcaaactaggatcctttatgtatttggaatatatttttgtttctggtgtgaattaaggcatcatctaatcatttatagggataatgaattcttccctgatggcttagaccataaagaacccatctgcaaggcaggaggcctgggtttgatccctgggttaggaagatcccctggagcagagcgtggcagtccactccagtattcctgcctggagaattctatggacagaggagcctggcaggccacagtccagggggtcacaaagagttggacatgactaagccactaagcacagtacagcacatgtatttggaattatttttgttactgctgtgaattaaggaatcatctaatcatttatatggataatgaatcctcccaccttatttatcgaacagtctttccttccccattaatctgcaatgcagctctatcacacgttgctgtcttcattactgtcacttacaaggaaagttttttatctgataagacaagacttcttacctacttcagaagtgatttgctacttttgaccctttgctcttccatttaaattttagaatgtggcttgtcaagtaaagatttattttaaaagttgaaattgcagaaaatctattgctcaatttgagaaa

SEQ ID NO: 49380 - DNA, 1674 bp, Bovine  19866880608696
cactctcagagtaactgactcatttagcggtgcttggcatcctgtgcgtgtcagcggcaggtgacatttagcccaggctttatctcagttgtggtaattacggggctgacatgagctctcacacacagcacagattgttttcagcagatgtaaccaagcaactctgctttctcttgagcagtttatctggctttcaaattgtggcattccataaagacacacacacacacacgcatgcacacacacacaaatggtttaatgtcatttttgtggaaatactcactctttgttgctctgactatattgatttatgccatgaggtggtggaatgggatatcttcattgtatgcaacttctgcattacatgctggtagtgaatcctattaacagaaaggttattgttattgtaatgtatctcagcagtgcaccaaatgctactttaatgatgtaattaatatgcttggatttaccatttgatgttcttaggcaccaattgtgttactgatgggatagcaatgatttttttttttttaattcctgagagcagtatatttttcttagagaagttggaatggaaataaaatgttctaataaaggaagtcacagtccctaccaacagttaattatttgtgccagacatatctcagtgatgtagcaactttcaagataattcttaagttcaaacaacttatttatatttaatcaaattatttatcctgaataccatgatatgaggaaaaaaagataaaagaatcacttggctctttattttttcagttttaattggcattctcctatttccagtttctgagattactctggtcagtgagcaactactttacagaaaatacataatcatccagaaccataattcaaaacatgtcagttatattatctttactataagttgtgactatataaatgttcaaattttcatttaactgaattgtatggctagacatcatgctgtctaatggatagggacaagtaatagaattactactaataaattactacattgtagatcatgaaatatatgcaagtttcagcccaagggttctgagcaaagtgctggactgatggcagtaagtttgaaagaggcttaggtcaggtcaggtatgaagggaaatgatgagtgagaatctagctaaacagaggagaattgcccactgccattatagaaacaggaaaagagagagaaagcaaagggggaggtgggaacaaacttggccactactacttatgaaaagcaatccatttgtttaaaaaaagaggaaaaaatatctcagaggtatttctagacctttaaatgttataataaatattggatgaattgaggttgagtcagattgtaattatgcaaaataaagctttctgttaagtagaatttccataagaaatgttaacctctggcatttaaataagaaggcaagggatgaggtgccatcatgaataaacgttaaacctgagcaagatatggacttatcaaaaaaactgaaaagaattttctagcctgtcctcaaattccatcaagaaattaaatgtattgtatgaagtatctgccacttgatatgccgaatatggatttgaaataaaaatactaagtgacagttaacatcacagtacttttacttcattatgagggaagctatcttttgacagaatttacctaca

SEQ ID NO: 49381 - DNA, 1625 bp, Bovine  19866880695599
ttgcctccttgttctgctggcctggctgaactgtgtgatgtgacgtcatagctcaaagggaaagaatgtcagtgggaaggaataagctttttcctttcttacatcaaactccccaagggccttgttttaaaaggcggtgccctgggaaaactaccaactccttcaggctcttctccttaatggctcaggtatcatgggactctgctcccccaaatctgtatttagtgagaaggaaaagatgtcagtccgcgtctactggagattgtatgtgattcccagaccaggaccaaaaagctccaaagcctgctcattttgtattagtgacaaagggagctctaataagtagcttatttataggcctgtttacctagatttctcctggtaactgtgtgaatatggtgtaaaatttttttttttaaagaactgttttgggtttaatgtatgtctttgaaacaaattctccatatgaagaactttgagtgtgctggtgacatcttggtaaaaaggatttaaggcaggattttaggagggatatatgtatgcaaggaaaagaatgaaaagagtgtaagttagggaaaaagagaagtttgtgtcatctagaggcatttagggggcttcccaggtggctctagtagtaaagaacccgcctgccaatgcagaagacggaagagacactggttctatccctgggttgggaatatccttttgagaagggcatggcaacctactccattattcttgcctggagaatccatggacagaagagcctggcaggctatagtccatggggtcacaaggagtcagacacgactgaagagacttagcactcatgcagaggcatttagaacctgtagtatttgggactacagtaaaggaaacttggtataaaggtatcataatgacacaaatatttataaacattgttacatttaacaattaatactaacaatatgtaagaaaatgcagggttagttttcttttttaaaaaatactaaccttagtgtcttttccaaagaccttggaatgaaaacaaatccagttttctgatacaaagagcttcccttggtataatatttctttctgtagagcacacgtaaaacctgggaagatatacacaggtataacatcatttacaatttccatttaagatgaaaattgtatatatctgttgatgactcagggatgggcagataacacactcatgctcaaaagatctctcccctgcttttccgtcatctttagtggaatgaagctaggagatgagagtttgttttttaattccaagtcttacaaacttcagtataaacatcacaacagaaaggcaagtctgtcattgaagatgagggttcagaatggtgcttcaaaaatctccgtttggggacgtgtgtcacccttgtgctaatgttgacactgctgcctgcccctccttccctgggatggtcataatgactcttttgaaatagatggtctcattgtgggaagagcgcatgacccacaccttcctgtgtggagacaatggcaggaacccagcacgctgccttagcccttgtgtactgagggaggctggaatggaaccctgggtccctctgctcccaggaggagacaagcaggtgctgaatggcgtg

SEQ ID NO: 49382 - DNA, 3467 bp, Bovine  19866880701065
gaaaatctgtattatcgtcggccacttgaaataaagctagttattttgatccagaattcttagatctaaagatttatgccttgagcaccctttatgatattctctttaatgaacttaaaaatactttgtaaaatgtggatttttcagtgggagaagatgagtattctgattcagaaatcgtcatgcccactgcagaaataatgtattttagtgagagaaaaatgagtgacactttccatttcttgtgtgagattaaccaagggtatatgaacaattgttctgagaagtattttcatgggaggcagaacaacttagtttctgaatattcaaggtgatatgctgcaaagaaaaaaaaaaatctaccatttcagaggaaatgtgtatgaggtcattcttttacccttgatgaactccagcatatcaggggcaatgtaataattaaaaactcatttcacagcagctgattaagctttgattcacaattacactgtctttcaaaagtcttctctatctgagcattttgaaaatatgatggcttcattatttgttatatttccaaagttagagcttcaaaggagctgcaaaaactttctcaatcatctagaaagacatgaataaaacatgcatacccagaattttaaattaaagtaattaggccacattagaatcttaaaaaaaagatttaacatccatgtcaatgtagagaaagatgcccttcattaaattatatcttcatgtccaacaatttaagctcctacttttagtgtaacattagaaaaaataattactttgattgagataattttaaaaagtaaatgttagaaaattcagaccacaacagtttcagagtatcattccaatagaagtttttttcctatagattattttaaattaataaagcaatattctaaaatgtataccaactttctggacccaaaataatgagtgtaagcaagagtctgatacttaactgaagactgaatggttttcccataggcagcaagtaagtatggacttcaaactagcacttgttagattgtgagataaaaatagttaaggatagagtgttgaaacagtatagctgtaaataaggtgggaagctaaatttgagacctcacggtgctccttcaagaaacctccaaatttagggaaaatgctagcaaaccaagaaagatcaagttgggttcagtgaaggaaaatggagataggtagagaggaaattgtgccttaaacatcacagtcatgtttctattttaattaagcatcttccagatatgtagtcactatattaaatatttcttgcccagactctcttcttggatcatttccccatggacaagagcctaaatatgagtcaccacccagggcttagcagtccacgtgtaaaatggagatagtaacatgggttgctctgatgatcaaatgacaacgtacggagaactaacagttcccggaacagttcccacttaatgaagggcatttttaaaattctgtataacagacagctgaagcaatgtaaagcatatctcatgactttatataatagagtcaaataagagacctaggaaaccttaccaatatggggaggtttaaggataaaagaggtgatatccctttgagaaggctatggatgatgtattatttgggaggtatcttcaaagatgagtagaatcatgacaggcaaagaatggaggaaagggtttcagttatagaggacaataagacacgatagaggctggggagcatgaacagcgtccaggactgtagaaatcaggtggtttggctggaacacatgatcaaagtgggaagtttaatatcaagctgaaggatttctgaatttagtacacaactgagaattgttttttgttgttgttgttttggttttcacttttagcagtaaaagaatacaataaggggggaaaaaaaacacagaaggaataactctgaaagaatttataggcattttccttcaagttaatactgattccaagaataggtgccaaatgttttccaagtgattttcaaagtagaaagaaatgcccttgagaagctgtgttattaaatatgtgcttacaaatatgggaatcaaggacactctattcttctctctttagtaatcactggaaggtcttatgctcctaaaatagctatcaacttgtgagatgtcagtcaatcatttgaatggtattcatgcaatttcagctatgtgcccaggagcacatcattcagtgaagacagaaaacaatgcataaaaggcacatttcttgcccacaaataatctagtcccgttggggaggaaaaattgacccacatgtacaaattatcacgtggatcccagcagaacagtgtgtgaccaatcaagtgattcactttcagatcttacaaaaccaggtaaattctagtactaagacctataattactctgctttcttcattcctctgcctcagttgtatacctagcatttgactaagcacatataatggaatgcaaattgctcacagagtaaatacatcaggatgcctttatttttgattacaaatacataaatcacaagatacctcttaaagttcatcttgaggaacaatataacacagtctgtgagtaattcagagtgattcacaatcatcctctcatttaaaggcagatctactctaagagaagtaaaaaatagctttttgggggcaggggaattgaaatgagctatttgcttttttaaaaataactaactcaggtggttaatttgtagtgttgaaagctcgcttcttgccaatcaacttaaaaatgttaaacagggatataaaattcagtttacttaaaactaatctaagaaaagagggaatacacttttcatactactttttgaaataatttaattcagagaaagtttttagagcttttcaaagcatttaaaacagaaatctttaggaaaacatttctaatagtttctaataattaggaaagtgaagtctgtgcaaagtgcttcaagtcaattattgataaatttcatagcgtcagccgaagtatatgaatctgtatctgccctcaagaagttttcaataaagttgtgatgacttatatgcataaaaattgaatattaggcagcctctagatagtgctcaatatttgggaaagaagttaaaggtgttaagaaagcttgttagtgtatgtcttaatattgaattcaaatggtaccttagatctaacatacacgagtcataagttatcaaatttccatttttggtagagttaatgaagactagcagagaaagaaatcctttcatgggtataatgaatgttaggtatttttattgaaagaacttggatacatttcaattaggaaaatgtttcactccaaacagaactaaactctactagagccacatgaacaaagaaagattgtgtgtgtgtgtgtgtgtgtgtgcataaaaagagatccaaagaccagtccaggtatctacaatattac

SEQ ID NO: 49383 - DNA, 1548 bp, Bovine  19866880830341
atgagaggttggtggtttaaatgtctttgtgaaataagtgtcatgtttttctatatctcaaggtgaaaattacagaaatgtgctgacttgcagcagaatttatggataaactggttccatattaattttgtttttactggaacttataaagtatttgtagggaactagcagtaattacacctattctgaagtcccacgaacctgaatttctcctggaaaaactatagcacaagcttagcctgcaggtagattccatattgtggcaaggactcctttcctgggcagccagcatcctgctccatagttgtctgctggggctccagccaaatggaacatggaaacgtggatctggttgttcttgcagccagtagacccaaatcaccccctcatcccttttaaaaacatcattgcataaagcaaaataatacttgctcaatgttccctgtctctttctgttactctgtctctttctgtaagtggtagagtgttctgaaatgatcttgcttcattaactactctggaaacgtactttcatggattagaactaatttgacattttaattatttccctttctgttgtttagaattcagtcagctgcagggaccttgcaaaacacacatatggaacattcatatgtgctgtttgatactgtatgccaccctcatattttgagacttgtacatacaagtcagcttgaatttgataatatcctgtcaaataaactaaaccttgtgttcaaagccaaataacacaagtgccccgggcatctgcaaaaaaaaaaaaaaaaaaacccaaccaggcacaccggctcaagtggatagttaggtgtgcaattacttgatttatacacatgtgtgtttctgaaattacagctgcagggttttgtggtctctgtgggggtgtgaacagttttgctggcaagcccggtatgccttactttggaaatttggctcccaagacaaattcccctcccatcactgatggggaacaaagtctatttgtcacttttccatttgccttccacagtgattcagaaagaaaacagttttattttgctgctctaattgggaattgctgattcatctcacaagtgtaatcatctttgctattcattatacaaacaccagctaatgggactatgattgtggtagaaattggtatgggaagggctttccacccccattactgacccaaacacatgtaaatttgcttgagaaaacacagttttttccactgaactctcctacttcaacttaagcttttgaaacgaaagcattcattcaaaagaaggtccggttattctcttggttttgcagctatttaaaaacaatgcttgccttgaagttctatgtatacttttaacctcttggcttagctgtagaaaagcttattattgcaagcaaactcaaatcactcatgatagtacaacactctggagatcttatccttgcatcatctacttgagtaattaaatgcaggataaatttagtaattcagtggactcactcaggtagggggcagctatgtcctgtttccctttgaatctt

SEQ ID NO: 49384 - DNA, 1594 bp, Bovine  19866880918609
tcaactttatttcttatttactctttctgggaagttctgagtcaagacaactagcctttggtgaaatttgatcagtggccattcttaatgttcaatgctatgttatttcccctgctggttgattccaaaaaggattctccagggttctttctttcattgtacatagttttactgaaaattttgcaagtaacttgggatttcggaatacgttggaaggtaaagaagtaagcagtctagatgtaccatggtgatcactttgtaatgtatagaaatatcaaatcactatgttgtgtgtctggaactaacatagtgttgtaggtcaagtatatttcaattaaaaaatatgtagacattgggaggaagtgtataaaaatgctaatgatggttatctctagagggtaaggattatggatgtttgctattttttactttatgcttttatgtatttctagtttctatattgaagatatattgcttgtaaaattataaagaaaataagaaatgtcattaaaaaaaagaaatcaccagggcaaaacagatacaaatgtaacaggatgtcaaatgagatttctcctactatttcatagttttgatctaagagcccaaagctgaaggcagttggccctgatgtagtccaatgttccgcagagggtgacagaatggccagagttccaccactataatgaagatcagagttgcatctatttgcattgagctatcctatccatccaaactgctgatctggatggggcaaagagagagtcagagcaatggccagatttctccattcttagaaaaccatctcaaatggaattagagaagtcattaaggaagagatccatggctgttgtagcacacctggtttattggggtatatttacgctccctaaactgacatacctgctgtctacttaaataggatccacaagatggggaccatataatctaatgcaagagacttcatggccttggctccttagaatgtcagtgtgatttgggatgctggtctcatggaatggctgctggacttttaagaaccaaaattaatatgatggtagctgattgtacttaatgaatttactaggtagttactttgtgccaggcactgttccaagcacttaacatgtacaaacttatttagtgctcagaaagaattcatgatttaagtattttccccacattaactgagaaaatgatgactccaccaagattacgcaactggcaggcagttgagtttctcacctggatgccattctacctcttgtgtgaagagcattctgattgcctcaaccgtacactctgcatcagagcaatgacccagtccctgggtgctggaccccacctgacaaaaggcctactgcctcctgtcattgaggagcaatgacttcaaggtcacagctgtctctccagggcccctgaggtgggggaagggaatgagagtgcctaaacttcataattgagaacaggagacctggcccttgcccatctttgctgggatactggacttcgtaaccttgcttgcatccactgttcatgggaccatgtagcatgctctcctttggaaaattactaaacataggattagcagcacctg

SEQ ID NO: 49385 - DNA, 747 bp, Bovine  19866880969919
tggggcctttctgcctcactccccaaggcgagtgcaggctcactatgactttgcttgtccgggtctctgacagtgacactaaagaaacatcagaccttcagttttttttttttttcctctaaattgtgttccttttttattaggatcagtgttacgtgatcttccaaaactaatagctctgattactgtgcatgtcctatgtcttcttttgtcccatgaatctgcagttactgaaaataagttgaatcattagaagagacacaaagggcatatccacaggggctaaatgatctgtgaggataagagtcctgagccactgcgcaatgtacctgtttatatcatcattttgttgtcaaaactgctttttttgctttctttttcttgttcctgcttcaagcttatttttggagtgttttagtgaccttgaatgggaaatgaaatggtgatgccacttctaaagggaaatatgtttaagatgtgctggttcataaaagagaatcatcagtcagagttcccctcgggcttaaccttcatctgcttttcaaagagaaaatctgcttccttccactcatgcagagagctttgtccgcttcctttccctgtcttcttcttagctgtcctgtatcagtagatttttaatctttggagtcttgttgaggatgcaccatctgtagttcaaaactgtgacaactttctctttcttttggttcaattttctctctggatctccctgccacttcactaatt

SEQ ID NO: 49386 - DNA, 802 bp, Bovine  19866881018219
atttattatggttatataaaaagaaaagaagcttaatcttctaccttcacttatttgggcccttccaaggccctgggaatgtccctagcaagatattcatgtagttgtacattttaataaacttttcagataatattttaactacaattataattgccttctcttcattccaattttctctctgttacatgtcccctccagtcaggtagccaagggcatttttggcactgtgaactaaggggaagttgtttggagatacatttaattagagataggggagtatatttatgtgatttgccatcatttctatgtgctaagttatcactagtcctcctagcttccaggaatactccactaagcaaattcaccttgcttggtgacacagaagtgcaggaacagggactacgctggtggtccagtggctaaaactctgtgctcccaatgcagggagcccaggcttgaatccttgtcagggaactagatcccacatgccacaactaagagttcacatgccacagtgaagatcccgcatgctgaaactaaaacctgtgatggccaaataaataaataaatgttagagggggaaaaggtgcaggacccaagatgattccatcatataaacatgtcctacaagtgccatgcatcagaagcacgtaggtaatagaagagaaattaagttgggaaacgtacaaagccaaaggttgtctccggcaaggtcttcccatcatcacacatgtaaattgtaacttctgggttctgttctcactaacaccaagtcaaaccagaaattctctctcctgtt

SEQ ID NO: 49387 - DNA, 2145 bp, Bovine  19866881121860
attctgaagttggggaataatgatgaaagtaattgaaagtactcctctgagaaagggactattcaaccataatagaactcccatgatgctgcaaatataaaaaaaatatcttcagattccaccatcatatcaatctgtgtcatcattataccttcccaggaccgcaaatcatcacaaattctatggaagagaagctggcacatgatagagttgacagctgcttttcagtcacagctagaaaaaaactgatttttatgtttagttaaactcactgcaattgttcaccattccatttacttaaaaactgtttatgcaatgtcaactatgagcctgacagtccttgagactccctcataacacagttagtaaagaatctgcctgcaacgcaggagacaagggtttgattcctgggctgagacgatcccccggagaaggacatggcaaccaacttcagtattcttgcctggagaatctcatggacagagaaacctggcgggctacggtcccatggggtcgcaagagtcagatgtgacttagcaactaaagagagagagagagcaccctgatagagaatgccaagactagaatggatgtgggggaagacacataggaagctagtgtcttaaccctaacaggtttcccaacttttcaagcccattcaatttaattatacaagggaaaacaaagaacttatttacaaaaaaaaacaaaacaaaaaaaaagaactgaatttcacacaccataaattttcctgatactattaaacagcatgacattatatacatatcttctacttaaaaaaaaaggatgtttatatttccatatgtattgaataccaaaattatacaggggtatatctacaatcatttggatgggtatgctttaggttaaagaaaataagtcccccatcccactgctttctcatcctttctgcttattcccaaaatgaaatcttaataaaaattattttgtgccacttggcttatgtccttttaactttgaaatcctcctagcaagtaaacatctgaaaaaggtcataacatagcataggacatctcctgaaagtgaacccccagacatctgtgcacaagatgtgcataaaattttatctttattgtcaagttcttccttttttgaacaccttgcctaattcacaaataaagtttgtgggaaatattgaaagatagcacttagtctgtccccatttctgtagattattaaatttcagagtttaaaaggatactctgactttctataaatgtggaattagatggtgtcaacaatcttacaatgtcagatcttatgttaaacatttgtgtgaaaattaaatatgatttaaattctagcttttaagatttgtttctccctgctattattattatacaaaacctatattaatatgctgtgaaatgagacatctacatcactagtcaaagcctttaagtggtaatccttctgaatcctttcttgtaagagctgaacatttgctgtacaaaaccagcggaattcacacgtgctgctacagagtactagagcgattattacagcattttttccccaaagtaccttaggctttagatgattagagaacaggcttatgttttaaacgtcttgccaacaatgtggctttttagttgcattggactgaggacaaattgtagtataatgtatgttgacagtttaataacatgggttactatccttggtgtactttatgatgtaatacatccttagaggtgtctccagagaattgtgctatgatttttgaggtacagaaaattcagtaaactaaaacagtctgagtaagatttctgccttctgtatactttggacattttcctaaaaaatatataggtgctacccttctaaaatatttttctgacatgacatttctgtttttcttctcaagctgtagtttttaaaattggaatggtacaattcttattaaattttactttaaaaatataaaagtctctttttttatataataaacagtcttttttcaggtgtcagaggtaaagttccttttctataaaaagctgtaattgtggtttttaacaatctcattaaatatttagatcttttaaagcacaagtgttttctgttgaggtttaaacacatttagactaattatttctaatgttt

SEQ ID NO: 49388 - DNA, 1145 bp, Bovine  19866881147211
taggtgctcccagggtgttctggtggagtgctccctgctggccagaggagctagcgggcgggcagcctcgcttgcccttggaggtctcagactcaggaaaggggggaatggggaataattctggttcctgtgcaataaaagttgaccttgactctctgaggaagttttcagcgctggtgcctgaagaaaacacccgtctctggaggtctcagaagggcccggcggacacttggatgattgtggttcggcaggttattgtgactgtgtcagcaaacatattccactccagccttttcagtcctacccatcagccttttctctcatgtatccacccccgccttagccagccttcaacggaagggataaatcatgtgccaacaaactcgatacagttccttaaagaatttgccatgactttccaaaagggcaaaaaaaaaaaactctcatggacaaacttgcttcaaacaagtagcatttgagttttggggttttttccctttctgatgttatgttctggtttaagttacgtgtgtatcttaacgtctcagctgcgtattggcaagaaaatcaggcaaagctgattaaacgatcccattttatgttttgttttgttcctctcgttaatacttagtaggattaattctcacccaccccaagtcaagaatctgtgagacttgagactaaagtactaaatatatactgactctgaaaccaaaactaatctttaaaccaaaaaatataatagtgatttgatactggatggaagatactgcatttttaagattgtaggtggactgtgtttgttttgaaacaggatgtctataattaatggtgaaacccatcagcatgatgataacatgctttactcttttgctgactaaaatatataactggtagtttgctaacttctatttaccatatggattggctggtttttattaataattatttaggtaccctaagatttgttaatataaaagatattctgtttatctataatgcattttataatcatttctatgaaatgtattttgtttaatcagataagctaataagtgaattggttacatcatttgtatttgttagcctagtggacaggacttgtgcctggtgcgcccctggcttttaataaatactcattggtt

SEQ ID NO: 49389 - DNA, 3195 bp, Bovine  19866881180480
ctgagtttccaaatttgctgacatattgagtgcagcacttttcacagcatcatctttcaggatttgaaatagctcaactggaattccatcacctccactagctttgtttgtagtgatgcttcctaaggcccacttgacttcagattccaggatgtctggctctaggtgaggtgacatggaggctataaaggaggatcttaagaggagtgggaatttaccaggtagaaaaagtggggaaggacattctaggtagcaggaaaagcacagaagcttggatttccatgcagtgattaggaaatgatgtttgttatgttaggggctgtgagaaatgggaggctgggaatggagcaggaaacctaggctagagccaggtttgagaagagcttgtatgccctggaaggagtttcgagcagtagagcaaagagcagtagaaggattataaaaaggggagaagcatggtctttcctgtattttaggaagataagatcagcaattataaggatagtgagttaaagaggggagaacaacttcttggaaggcagaattcatccttgatttaaatgttattgcatacagatggtgaaatactagaaaagtatggcaacaacagtgttgatctagcttaatgatatagaaagatgtccgaaagatatttttgaataaaaaagttttaaaaatgtagtcagtaagattctgaacctatctatccttctacatagaaaaattagtgagggacttccctagtggcccagtggttaagagtctgctcttccactgcaggaggtgggtgttcaagccctgattgagaaagttccacatgccgaaaggcacagtcaaaaagaaaagaaaaatgagtgaaagagtacactaagatgttaacaatactgtttacttgctagtaggcgtcaagtaatttgggaaaaagcaactcagaggcccagttaagaatttagtatgtagaagctcagaaaaatgttgttttttgttgaaatctagtagatggtttgacatttcaagatgagagagggatatgcaaaaccaagaagagtataaagaagggtcaaaagataacaaatagaaataaaaaatagaaatcatgaggacagaatatagaaatggaaactgagaagagaaggcaggggaacaattttatttaaaatgtgtgttaaagtttctctggatgcgtttcaaactgtttcttactgtcaggagtgtaggatgttgctctttgaagatggtgttggtggtttagaatggtctcttaaggaccctctagctctataatcctcatatcatctgattccactgtaccagtgtatggagggaacacatagtttaaaatgatctcttgtattcttgtaaatattctttccagacattttccatgagacagaattggccacagatgcaagactgaattgatgcttttggataatataagtgaaagtgaagtcgctcagttgtgtccgactctttgcgaccccatggacagtagcctaccaggctccacgatccatgggattttccaggcaagaatactggaatgggctgccatttccttctccaggggatcttcccaacccagggatcaaacctgggtctcctgcattgcagacagatgctttactgtctgaaccactagggaagcccatattatatatataatgtacatgcaattgtgtgggaccaaactggttttactagttcagaataaaacctcatggaagggttgggatttgaagaggtagcccaggaaaggagaagtttagaactgaaagagaagaaaaggaaaagaatcacttaggttaatttgtaggaaggtaaatgtatttatgatgaaggaggtcaacagtcatggtactgtttgctatttcacctattttaagaaaatgaggttcaaaggaagaggaccaatgttaagtcaatcagctcagtccctcttgggtttgtactatgcccttatgaggatcacctcttgaaagtgctcatcttcctgggtcctagcaccatccaagctcaccttcttttcttctttaaaccccaagcattgattgcttgctttacatactgatttctaccactcattctttcacccatgcttctctctagttatttaacttctttttgcttcttttccttcttcttcttcttttttcttttactgtgccacttggcatgtgggatcttcccccgaccaggaccaggactcaaacctgcgccccctacagtgggagcttagagtcttaaccattggaatgccacagaagtcctccttcatttttaaaggaatataattatcttagattgttgaaaatatttaaaaaccatgaatgtctttgagcagatgcacttggagcttttctggctgaacttggggttgaaaggcagagtcccatctggctcttcttactccccccagagctctctaaagaggcatcacagagtctggtttgaaaaccactcgacctaaatctgtacttcccagagtcagtagaggttactcaggcctggaatgtgctgaagacaataaagattcttgttgagatggtaatttactttttccatgtaacattttcaactgggtttcttgaaaagagcaatttgtattactgtggtaatctaacggttaggcctccgggatcaatatttgtgttaagagaaaatgaaatgtagttatcagaatcaggaagatgtttccttatttgccactgtcttgctgaatggccttttgaaaattgctcgggattacccttcatgtccccctcacttttccataaaggtgctgtgaagatctctgactgagatgtgttcactaaggttcagggagaaaagagggagctggtataagtcttccaaagaagtgctgcctttatacctgattgagtgcaggagatttgaactcttctggaccttgatgtctcagagtatttccttgtctggtagaaaactcttagccacttcccttctaagggcttgagtaaagggaattgttattgcatcttttgttgaaagcattttctgctgccattttggtcttcccctctgaacatattgaatgaaaggagtgtagaagcatcctcctttgcaggaaaaaaaaaaaaaaaaatcatctcattgttcggttgctgtctcagaggtgaaagtcatttccaacagatggcccttcctgaccccccaaggctgcggttagcacag

SEQ ID NO: 49390 - DNA, 2924 bp, Bovine  19866880428399
cctggtgtgctgcagtcatggggtcgcaaagagtcggacacgactgagccactgaactgaactgctcccactttagagatgaggaaaagtcagtgacctgtccaaagtgaaagggtgccttaaatatttgtatcagggtttgaactggttggtctgaccccagcctggacttgtggctgcagtgcccggttgcgtgcccactccatgcccacaagtaagccatggctctttagacttcagcttccccgtcttgtaaactgaggctaacaggctcatgctatttgtgatctttccctccctctcatagttctgaaccccctgggggacttgttacaactcagattgccggccacaccctctatgttttcgattcagtgggtctggcttggggcccaataattcgcctttcccacaagttcttagatgctgctgctgctgccggtctggggaccacactttgaggcctctccccttgccccgctgcttcccagcctctggaattggctctggggtccagcatgagtcctctgtcatccaggcctgctcaggcaggcagccctggtggcggttgcctggtgggcctcgtgttgggctctctggacccgtctcttgcctgcctggccatcttgcaggtcccttggctgggacatcaccagtgttttctacacctcagctgtggctcctcatcaggtgacagatgtgtgaaacaggagggggtctgcaagggaggggaggcacagaagagccgagatgagatagtgagatgccctcagcccccgccttttgtgtttacacagagtagccgcgcagcagtgggcataattactcctgacggccttcattaaaagctctggagcaatttacagtcaattaaggagcaggaaactgcttccttctcaggtgctcccacctgcttgggaatgagtcctgcccaagaaaatgtggagctggcttgggggcagggtgtgtttgagggtctgtcagggagggtggggtggcttctgaagtgatgaacctgccggcctcgccgtcagcagcctggccgtccatcaccaactcctagctatgcactcccaagatggtgtgatagtctgtgaggtatggagggagctctgaggccggacttcggcccctgcccgtgctgaggcctcaggcagatccttccagccctgggagcctcagtttttctcatctataaaatggggttgatcccatgcacttcgcagagctattttgactcttgaatgaaataatgaatgcggtgggcacagggtctggcccccactgggtgtgcagtggcagggatggtcattcctgtcccacctggggatctgcccctgcctgtacagatgctttcaaaaagcaaaaaaaaaaaaaagctgatcagatgctgacattctgaggtgtccctgagcccggttcagtgcctgccctcactctccagacaggaaaccagaagacatgtgtggggagtgggcttatggtgcctgctcctctgggtgggaccttcaaacttagcaggcctcagatccaagggagaatgcttcctcttttgcctgaaggtcaacttaggaaaattaaaatgttccccagctgcatttctttggctcagttggtgaagagtctgcttgcaatgcaggagacccaagtttgatccctgggtggggaagattcccctggagaagaaaatggcaactcactccagtattcttgcctggaaaattccatggacagagaagcctggtgggctacagtccatgtggtcacaaagagtcggacgcaactgaatgactaacactttcaaaataaaaatagcttcattgagtgccatggttgaaggtaggggaggagaatgaatatttttacagcttaaattacctactttactgactagaaacatgtcaatgagaaaagttgcactgccttttagctccaaatatataaataaatctgagtttatttgagaagtggcagttatgaaactgcattctgaaattagaccaggggccacattgagaagacaggctgcctgggagcctgggtgcttgtccctgctccagcctggaaccctcatttggtgagatgacatatgagttgtgacataggacttgtgacaaatgcccagcaccacgcctggcacaccatcaaggctcattaatcccagcctgcgcacacccggttggcaggaagtgttgtcttttccttcccagttactttctgtgccatcgatgccattaaaagaataatgagggctgaggacagggtcaccctccccctcctctatccctcggtctcccgtctgggctttagaagaggtgagtgagtgacaggggaggctggacggatggtggaggggattagcattctcttactggctggctctctggccagagttttctcatccataaatcaggacgttgactctctcatgacaaagtatcagtgggtgtaaagacctcagggtgtctgagagccaggccccttgaggtcaaaacatcttcttgttggaactgatctgttttattgaagttctgctgtttctcattctctgcccttttgcttcacccagggcagtgtcctgccatcaacatgtcaattcccaggcctgctggaatttcttacattggctgcttccttatgaggaacatacagatgttgtccacccaccactctatctttggaggcctcattagaatatctagtttcagcaacacgtgtagtactttttctgtgtcagtagctgctgtaagctcctttaaagtgaggaagggttactatcttttccattttatagatggagaaactgaggcaaatggttttagtgacttgcccaagatcatatagctggtgagtgggggtggagccaggattgaacttgggggtcctgctccaacaacggcttgttaaccagtgtgttctgctac

SEQ ID NO: 49391 - DNA, 959 bp, Bovine  19866880455097
atttatttataaggtattcacagcaaaatgaatgacaaaaagttaggagctaattaaagctggcacagattggcacatgggggcatgaattatgcattggtgcagaatggcagttggtggcaagaccggcaccatgtgccctgggcactagtaggaagtgggcatggggtcccctgctctgccagggtcccctgccctgcctcttggagggggcccccatccaggcccctctgtatttctctgggggcagctggagctgcatccaccacccccaaccatgggcaatttctcttcctacagcccagcatgtcatggctgtgagcggcatcaacaccacgatcagaggctggactcaacccacagaagcaggtccctggttctcctggcatgtgcttgctgcagcctccaggcaaaatgggcagggctgggcttctcaaagagtgggggaggcagcaaaggcttgagaccagccaactaacattgatatgagcacattggagctggaagacgcctttaagaccaggcagtccacacctcgaggtgccttcacagatggaaaacctgaagggagaagggtaagctttctacgaagctacacagagaataatagtaataataccattaatttaaaacagattttgtgccagacactgttccaagtactttgcatggattatctcattcaatcctcacatgaaaaagtgaaccaatctgacagatgaaaaaactgaggcagcacagaaatgaaaaggcaggttgcccaaggtcacggggagcaaggtctgaattaaatgaaatccaagcagtcagatcccaagctctgcccatgtgtgggcccagacagtggttctcaaccctgactgcacttcagaagctcctggaaggagggctaagagtgtaaaatcaggatcagagatttggatttgattgattctggctgagaactgcacagggcattt

SEQ ID NO: 49392 - DNA, 1197 bp, Bovine  19866880458772
cttagcactttttaggtgcccagcactctgctcagtgcctcacagacagatcacagcttttattccatttagcagactttgaaagggtggcactgctcaccccattttaaggatgagaaagctgagactcagaaaatgtttcctttaagcggaaaaagccagattgaaatccagacctgtttggctcttcagtgagagttatcccctgaaattacaaagggaaacaatcaccattcctgagggcttctgatgtgtcaggggacgggcacttgatgtacttcattttacttaatctccaaccaataatgccagttaggcccactcacccagctttacagatgaggaaaccgaggatccaggagggtaacagaagccctgtgctggctgacgccatgggagtcggacagattacagtaatcagctaatgcctgagcggctctgaagatgcaaagccctgtattgaaagcctaaggatgatgattaagtcagaaggtggaattagctgcagtagagggagcaggctgctgccatgaggagagattagtgacttgctgcccgattaagctgaaggcgggttgggagggaaagaaactgagaggtttacggtgtcgttcatgtcagagagagtttgtaactgttgacctccaaggcagcgatcacaacgatcacaccgcagtgctgaaaggatggagcagcatccatagaaagcaggctgggtccccagcacctcttgcctttctccctttcatccatccatccatccatccgtgaaacaaataccaagagtgtgctagctctcaggcactacggatacagccaggaacaaggttctcgtgaagccccccgccgggtgacagacatttaacaataatcacagagcaaggaattctcatttttaagtgtaatcatggcactgtggttatatttcataaaagagccctaatcattcagagacacacaccaagatatttacagatgaaatgatgtgatgcctcagattagtacaggagggggtagtgagtccagatagaggtgaaaaaagactgaccctgagctggcaattgttgaagctgggtgatgggtacatgagggcaatgtattactctgttttcttctgtaattgttctcaaatttccatttaaaaaacatctaaaaaaaaggcaagtaagtaattacaattcttgataactgccacaa

SEQ ID NO: 49393 - DNA, 1862 bp, Bovine  19866880485734
cttactctattgcacatagaagtttcttatcctatcaggacacctccaattctgggaagtaggagtgtagctaggagaggacaggagacagtactgcctgaactggcatgagaaacagctgggagcggtggctgggttgttggaaactaagaagagtcaggccacagaaagtgttagaagcaggtaaacatggtgtgttgggcaggagggaactatgtagggtcttctagaagtgaaatgccgacttggtatcttacagtgcttgttcagcccgcgccatggcctgcccctcagcccagggccaccccctcccacccccacccctgccactgcccaaggctccctccctcacaggttggggacattcggctgctgaggtcaggtctttgtttgaaggacggataattaatcccacaaagtaatcccagcactccctggcagatttatggagatcgcctctgtcccaggaactctgccttatcatctttcatttcccaggcaaagcgagtgacttgttatatcacaggcctcacgccaataggaatttcatttaggggtgttctccaggtggagggagattgataacgcaggcctgggcaagagcctgtagcggtgctggggtcagggagggagggcgcaggataggcaccttcgtgccttcacctgttcccttgccaatctccaactttctcccaatgccaggggcctggcttcagggggctcacctgtcacacaccccagggacccatatgtcaaccagtccaaccgtcccaagtcacagatgagaaaaccaaggccacagcagtgagggagggacctgattcccaggctcactctttcagctactctgacctactcttcatccttgttacttctgccccctcccaagtcccctcctgctccgccctgaagctgcctcaggtacaggaagctgtcaaggtccatcactgggaggactcctcaaaacctcacaacagtccttggagcctgcccccctaggaggctctcatggtaaggcagggagcagagcttggcagaccaggcagctcatcccctacacagagctggtcagctgagcagggaaaggtggcctggtcgtggagggcaggggccacctctggtctgttggctctgcttctagttgctgggcagtgcagaggtcctcgtccctttttgtaacacaaagaattggggctagtttgatgattattcatgaatgtttattattatgtgaatatcgaatacctctcttatatcagctctggggacacagccatgaacaagagagagaatgctgctgtcctcatggatcttatagtctggtgagaaattcggaatataactattgaacagatgaatgaataaggtaattttagagagtgacagggacttacaagaaaataaaacagggtgtgaggtatgatggagagtgagcttcagccacttagctggggtagtgaccgctttgatatggtgacatttgcgaggacactgaacaaaggtagaggagacagctgtgcggaggtttggggataaaagagttcttggcagaggaaacagtgtgtataaatgccccgagacagcaaatagctgggtatatttaagaaagagaaaattgggaaaagaggtttcctgagactcaggtgtggtggggagtagagaattgggagtaggaagtgaggcgagagagccgaacagagactgatcatttaggggctttcacactagggtgaggattcagggttgtttcgtttgcactgggaagacactgcagtggagtaactggatctgcatcaggcttttgaaagatctgggcggagagtgagctggcaagagggctagaggagaagcagggccaccag

SEQ ID NO: 49394 - DNA, 1015 bp, Bovine  19866880488258
cccccccacccctcacctcccgtggcagcagtgtatcttaaagaaacaccagacagattctacttcatgcctttggacctctttcatctcctcgggcctcagtttacacaccaatgcagtggcgttaatatttaaccttagctctagctagcttcctaactagtcatcattgttgtaaagcacatgagccaatgggtatggcatgacttgaagactagaccccaggtccccaggttgtggcccggctgaattaggccattgtgtcgtggcactcagaggggtctgggtagcatccctgccccaaaaggaggaagtaggacgagtgttgtgacgtgcagaccacgctggggcacggcactgcctgctgcccctctggacgtgggcctcagcattctgtcccaggcctcgttgttgtttaggcccagtggttgacgagcagaagccgggcatgtgttgtcggtaaattggggccctggacttcaaggtcctctctgggtagctggtaccttgggaccattcccttcccatagtctcacctgggggccgttaggcaggcagggccgtcccttctgcacggctggccttgcagccggcctgtggcagacacggcttttttgtttttggttaaaaagcctcatcggagcgttatgatattggaatgtgaagggtaattgagctgaaagctattctcttcctgcgaacagtgcgaaaggagtgattgaggctcacaggcctgtgtaccagcctgggaaccctgatgaaatcaggcctgtgcagagatggggggtgatagatgaagtggatccaggccccccaaacccttgttccccacccgaggggcacaggcctcctgccctgaaatgtgctcccctgggactctgagctgccaggccaggcctccacccacctggagcagatagccgggtccccgctatgttggggctaggaggaggggcctggacgctggactgaaacaagcggaacaggctcgcactgcgtcctctgcgcccttctc

SEQ ID NO: 49395 - DNA, 718 bp, Bovine  19866880512413
actttctccttaactcagtcagagagcctcgaggaagacggaacaggcagaatgttctcagcttgtgattcagtgtcgtctgctgcctgggctgtgtgctctgttgtatcccagggttcttttcattgctcctggaaccagcatcgactttaagttactgattagtccttgagccccagaaaggaatcccagcgccagccccctgtccacctgccctgggccccagtcacaccctgaattcttctctctcacagggaataccaacagcatctttgccctggactacatcagtggggcactgaccttgaatggcctgctggaccgggagaaccccctgtatagccatggcttcatcctgaccgtgaaggtgagagccggacacctccatcctgggtataggggatgcccatgccttggtgccagcctccagtggtgcccaaggtggaggctccaggaggcacatcactgctattcccataccggggcttgtgcccaggcccctgccaggaaggaccagcgcttgtcacacgtgggccttgtcagggaccctgctggccatctcagagcccttactgatgaccacagagaactgtggctttcttccgcatctcaggggatgaggaggcccggagtgggtgggcatcctcttgtcctttctgttaccccatgatttcaagttctcttatagccaacttggattcttagagttaccccattt

SEQ ID NO: 49396 - DNA, 1205 bp, Bovine  19866880543839
tccatctgtctgtccagctgctcacagctttccccatgctaccctagcttctttggcagcctttctctttcaggagagcctggtcattgtcctgggcacccctgggcctcgcctacggttccctgccccagctcctccctcctgcatctccccacgcctctcaagacaaagctgtctcatgggccagcctcagagccactctgcgcacattccccactgcatctacattccttcaccccactgtcagagcacatatggaggcaccctggaagggaaggaagagtctggtcaccacccagacgacgggggacagtgtggcaagcgtgcaggaccgccctcgccaacttggcagtcccttgtcaacaggaactgagcctggtggggctggctccttcctgaggctcacacccggctctcggtaattaaagccataagtcatcttcggacaggggagctgcaggctggggctgctgcagctggcaatgcttggggcttagtgctggagggagagtgggcacatctgggcagaagttggagggggcaaaaaatcaaagactgccctcagtctggcctgggtgaaagggtgtttggggtctgaggaatcgatcagtgccatcggtggtgccaggagcttcctccacaaacaaagggtttccttcctcttttccatgggcgctgagagtctcaggcttgtgaaacatccccgcagatgccatctgtttccagctggatcctttgcttcccctcccctgcagaagcatacattcacagagcttggagtagggggaccatagggtgtccgcctgtcccttcagctgtgttgggagtatcccagagaaacagccctcctgccgagggagtaggggtctgtagcccaggccagctcctgtaattgagaaggatcccaggccacatgtcctgagggtggtccagtgggaaacaccttgaactctgacctttctctttcaacaaagtggtcagaggtcttgcagagattttggtgactgaccgtcctgcctgaacaaaaaggcaaggacatctctctttttcctatttcttgcttgctcagcagaagttcctgcctgtctgagccaaggggacggaaatgtctcgggacacccctccctgtctggctgggctcactcagcaagcattctgaacacccacttggtgtggggcaccgggccagggcccagggacatgat

SEQ ID NO: 49397 - DNA, 894 bp, Bovine  19866880556032
aaaatatgcagactccagctgcctggggttgtgatgcaaagccagcttcttacatccaaggatgtacttacatccaagtacagccaatgtactgagcaactactgtgagcctggctcagcctgaggcatggcatacagcaacgaacaaaacccacatgacttctgccctcagagggatcacacgccaatggggagatgtgcagtaaaccaggaaccaaacacgagctctacctagaggagagaagagtgcaggtagacaggataaaggtcgaaggacgccacacaggatcatatgctaccacttattatgtggagtctaagaaaaggctaccaacggacttcctacacaactgaaatagagttacatatgtagaaaatagcagttactgaggggcaaggtgaggggagggagaaattgtgagactgacaagcacacactaccatatgtgaatagataactaacaaagacctactgtacagcacagggaactcaactcaatactctgtaatggcttacaaggaggcgaatccagaagaagccgactcactgccaggagcgcgtgtgggcctcacctggcatagtccagccgcggcagcagcaggtagagcccaatgcagagcgccaggaagatgtctgccgtcaggaagaaggccagggtgctgtctgtcacgtcactggcccccccccccgtccaccagcgaggccacggcactgagggtgccccccatggctcctcctgcggagagcgcgggacatcatggggaaggtcagggcgggcgcatcctccctgcctctcaggcctgcccgttctctgctccggcttaacgttctccctggtgagagagatgcttcagttctcacaggaccctgaggcctggcagacaaggagggcc

SEQ ID NO: 49398 - DNA, 687 bp, Bovine  19866880570172
cctcgccctctgtttgctttgaatttgactctatgaaagctcttagcaacgtcctatcagggttatttgtggtaactccccattggtggttcgtttttgcttatgaccttaattaatatcgacattgcaattcattatcattttggtatttatgtataatgtaagattgtagaacaatactattagctagcgtttattgactgccagcctccagccacggcctctgttgagcatttgaaacgtgggctcctgtcgacctcacagtgagtctcagagaggtgtcatcgtgtccactgtacagccgagagcaagctgagtgtcctggcacatgtcctcggtgccaagcacagtgctttgtgtaaagtgggccttaacagatgctggtcggatgagtagagggatgaaggaaggatggaagggtgagtggatgtgaatgtcttgccgattcccctcctgttggctccagtccctccatgtgttgccaaggttggcgcacacggagccaacttccccaggcagacctcccccccacctctcagacctccagagtgtcctgagccacaattcaggtgataatgcccacgctaatcacctacacgactaaattagtcttgtcaggagccattaaggtaggagctcgggattcattaggatggattgggcccaggcagcgcctggcactgctgc

SEQ ID NO: 49399 - DNA, 1183 bp, Bovine  19866880804403
ccaggccagctgggtgacacctactaccctcgcagtgaatggtggctggtccagctgggcagagtggtcgccctgctctaaccgctgtggccgcggctggcagaagcgcacgcggacctgcaccaaccctgccccgctcaacggaggtgccttctgcgagggccaggccttccagaagactgcctgcaccaccgtgtgcccaggtaaggccacaagccaggtggcaccgcactcgcgcccagccctgccttctgtgctgtggggtcacagagtcaggaccactgacttctcccccttctgggcttgtcctgggacccacggctggctgaccctgctggactaggtgctgtgacctctgacctcttgttctgccctgtgctgtgggagagacggaggcagaggctcttgggggtaggctccctgccctctgggctgagggttctccgtgtcagcccccaggccagggtcccagaggcacccggcgtcagagtgcctgtgctcctgcccttgactgctcggcacacctggccgctgaccgccgtcttgctgcagtcctcttttccttgtgtctcgctctgtatccccatcagtgggtctgtgctctctctctctctggtggcatgtttatgtgaatgtgtggtgtttttcgcctgggtttgtgcctctgctgaaccctgtgcgagtctgcgccggtgatcttatgtgtgtgtctggagctacctttgcccacctgagctccctgactctcatctggcccgtggtgtgatttctccggacggcctgtgtatgtcttggactcctcttcccctgctgtactctgtgtgtgcatgctctgctgtgttgtgcacatgtaatcgtgtgtgcaggcgcccgtgcgtgcccacgtccccatggaccacacgctgtgtccccacagtcgacggcgggtggacggagtggagcaagtggtcagcctgtagcaccgagtgtgcgcactggcgcagccgcgagtgcatggcacccccaccccagaacggaggccgggactgcagcgggaccctgctcgactccaagaactgcactgatgggctgtgcgtacaaagtgagtcttcagagggcggggcccaaggtggtggctctggagccagagaagccccccgcccagcccccaccgcctggcctgcagtgaaagcagtccccttgg

SEQ ID NO: 49400 - DNA, 995 bp, Bovine  19866880833096
ctgtgtgcccaggtgagctggcctccccttcgctgactctcaggagagactcaccatcttcctggccaatgataagtgggtcatggaaagcctaggtgatggagggggtccacatttcctacctcaagggtactcaccttcaggccagccaagtaacccaggagtccagagcagcctgaaacacggagggagcctgggggttagtctctgtggagtgaggagagggaagcctcagatccccccaaaaggctttgtgattaaagctatgaggatggtggagggaaggtgaattctgagtcagacagacttgggttcaaatccttgctctgccaccttgggtaggttattttacccctaggagcctcagtattcatatctgtgtagtggagatgctaacccctctctgtggggtttgtgagaaatggatgacagagaatgaacggaaaccactgagcatagtgcctggaaaatagtaggtgctaaattaatgctcatttccttctcccaggcagttcatatcatctgtgccaagtagactgagctgtaggaaagaaaggatgtgaagagggcctgtgggctttggtgtccgaggtacttcctttaccggacaaacgtgttctgatgagtgtaaggacattggccagtgcagggctggcttgagagcaggcccgcctcacatctcacgctggtgtaaggtggggcccaggaccacaagataacccccaaacgaagttggctcccctgaggtcaaaccgagttcaggacccctgcgagttagagggaaggagcctgatagacgcaggagagcggggaggggaaaacctaagacaaatgagattatccccaggaatcaaggcacttaactgacctgtctgatcccagagcagagacaaatgagattacaggctccaaggccagcccagtctcggggagggggggtgctcattccatgggagacagagagggcaggagcccctggctctgcagatatcaag

SEQ ID NO: 49401 - DNA, 1391 bp, Bovine  19866880858493
cccgcctcggggtggcatggaggtctctcggcttattcaggcctgagaggcagccccacgcagccagagtaccttgagagccacagattaagtgccgctgcagggcatacgtgctgtgttgacgtctcttgtctctggggtgtgctggcacatctgtgcgtgtatgcatgtgcttctatctgtgggcacatcagcgtgcctctccgggaacgtgcccccacccgtgtgtgcgtgtgtgccctactcgaagtccactgggccgcctggaggttgccctctgagtacacagggtcagtcggtgtctcttctacgtgcctctcctctgccttctctcgcagggttctgggctccagaggggccctcccctctcctggatgctccagggccctctggtctccttcccccagcaaccaggcagctgagccagttcccgtaacaggccctctggggagaggtgaccaggagcctgggtgcagggagcagctctcctgcgggccaagggctgtaccacccgcctgggcagtggacatggttatatgcccgagggctgccgggctggccccagtcccacctctgtttattctgtactacaacctgtaaataacatttagcattcctattgtaacaaaattaatttttatgaaataaattatatttcctagtctaataaaaaattcaggttgtagtctgctgtctttttgactgcctttctgtcagcagttgggaatgatcttcctgcttttctcaaaattccatgagtttggggtcaaggggtcattgccagagctctctgagctcctggaaatgatcaagtgcaactgcctaattttatacaagggaaaagcggcccagagaggactgagagcttccccgtggtcacgcagcaagctggaggccatgctgactctgatcgcagcccctgctccccagccagtgctctcagtgtgtaagcatttgtgggatgtgctcagggtcagtcttgtgagcctgtcgtgggctaggtgatgagtgggaggaataacagaggtgaagccctcagtgtccttgtctgcctgtgaggcattcagacgcgtgttttccaactgggcccgaggtcagttgagagcactcacctgagacaaaatcctgccagcagaaagggaatgatgggcaggctgggccttatgtgactttggacccatggctgccatgatggttgggcagcttacatactgaacaagaaagccatatctaagggggaaggtggtgcctttcccactcagattgaagatttatgtatttattatactatgagatatttccagcagagggcagtaaagggcattgttctaataacatcaatttgttggtattagttttcctatagatgaaaaaaaaaatgggcttccctg

SEQ ID NO: 49402 - DNA, 1697 bp, Bovine  19866880898788
tagctgtgttttgcagcaggtggagggccactattccaaccctgtgacacacagatattcattttcttttcattcctctgtatggaataaaatagcataaaaaaatagcctacaaaataaaatttaaaaagaatgtgaggtgaaaaagctgagctgggagataaggggccagagaggagaaagagcaaggaacccagaaggattcctaaaaatgccctaccccaatagccaggaagcctgtcagctgtcagttagcacagagggccaggaccgtgttgatgatcaaccagccagcttgctgtcagagctgggctctaccaggcagcagcacagttgtcgagctgggggtcaggccatcagggcagcgagtcaggctggctgtcactgagtgagtctgcctgctttaaagtcagccagcgaatcgagcgttagtcattgtcatcccgtcaggcagtcagtcagtcatgacttggtcagcctgactgtccatcagtccgttgtctgctgcctgttgctgtgaaggttagtgtgaaaggcccgtaggggcatggagtggccaggcaccagcaagtcgattgttaaatcggtttagttggtcaatcataatatccaatgagtgagagttagtcagtgataagatgatcagcccggcaaacagtctgtcagataggcattctttgtcagccagttagctggggagacagtgtttagtcagggaatccccgagtctgtcaggcagatgagtcaggtggtcagtttgtcagtgcagagagtcagtcaggcaacccatgagtgtatcagttagaggtcgtatcagtcagtcaattaactgctcagccacccagtcagtgagtccctgagacaggcttccatcagtcagtcgggatgtgtgtccttcattcactatcagctaaccctcgagtctgccagccggacactcactgtgtctgcccatcactgcccgtgttggtgggcgggtggggtcactgtggacaggcggcaggccagcaaggccacagcaggacagctgcccctctctgcctcaagccagctgcatgaaaagccacgcaggcttgggaagaactcggaggctctgcccaaaggcgagtttttgttactattattatccgagaaacctcccaaggctccggaaagtggaaaaggccgtcaattgcctaccctctccttcccctcccctcctctctctccattaatgaggttcctgccacagagaaggggcgcttcccggaggccggaattggaggagggggcaggcggttggtgagctgttccagtcagctctgggcctgctgctcagtcattcctgttatgatcacccgatgaggggtggaaagtgtgagggggggtgtcctaaccagcggacctcttcccttgacctggccctgcccttcccctgaggattccacatcctcccacccagacccagaagtcggagctgcccctctggatgagcagggaggtgcaggggcaagggtcacagtaggcctgagggaccacagacttcatgtcagcttttgctgttatctgctgtggcccaaaaagaaaagaaaaaatatcgtctctgaatctcgtttcactttcatggaagtgtcatgtgcattgtctcatgtaaccctctcaaccatcccgcacggcagcattatccctttatagatgcgggcatgaggctggaagaa

SEQ ID NO: 49403 - DNA, 1262 bp, Bovine  19866881025559
ttttttttttttttttgcttcaaggcttgatgtttctaagagtccatcatcttggtagcttccatgtgtggcagtaacagttctgtgctctctgtacaatgaccccattgcttctgaaggcctccttaggtgggaactctgtctccatcttcagagaagcagagtcatctcatactccggcagcacacctgcagaccccacccccataatcaccacactcccgccgttgcctccactctgcctggctgccttctacagctctcaaagcctatgtcttggaactctggggagaggtttcccaggcctccccaagaagcctgaggggtcacagatgcccaagggactccctagagagacttaccaaccgcatggcagcagtgagaggtcccgccacatatcctccacgttgccttggctcgttgcaaaggcttttgaagccttgctcaaagccttcctcagatattccacatctgtactgcagctcagccctctggagtcagagaaccagctctgtcatggaacctggtggctaaccacgaccaaggttcgtgctggccccagtgacctgatctgtgcaggaaatgagccagaggccacagagagcatgtgagccctagagatgcccttgagggtggccttgctgtccttccccgtcctgaccgcctcctgctgagcaccttgcagggaaccccatattatctgagtgggggaaggccgggaaagaggggaagtgtgcttattgggtatatctggctttgtcccttgaacatggcctggacttgaatggtaacagtagtaactggcaccaagccagaggcccatcttcttcttagcctggcacctccccaggagatctctatctttaaatcacaggctttcagagctggaaggaacctcccattaccattgcccaagtccaggcccagagtcttcaagtgccgaccaaggacacaacatcatcatggtgctcctggagtgggttaaagccaggttagtcttaatagcaaacttctaacaatgggcataatcagagcccaggccactgctgtgttatcctgtacctcacctccagtgagattacagcccagagagaatgtggggctggcctgggttacagcccagagaggagtgccccgggagtccctggcactagtggaatgctcacaggggctctggtgctccaggaggctgcagagaagcccatcacgcttatctgcttcgctgaggtctcaagcaccttcttcctggactaaccacagcca

SEQ ID NO: 49404 - DNA, 1129 bp, Bovine  19866881092285
aacaaagagatgcatgcaaaccaagagaagaaagcttcaaagacactggctacctgtggaggaagatggtgtgacaggctgaattatgccccctgtctcaagatatccacactttaacttctagaatctgtgaatgttaccttatatgataaaggatgggaggctttccggatgtgattaaatcaaggatcttgagatggagtgatcatcttggattatctgggtaggctccagggagatttgacacagacggaagagaaggcaacatgagcagagagactgagcttgtaatgacatgccataagccaggcaaggccagtagccaccagaagctagaagaggcaagggagaacctctcccctagaggctccaatgggaatatggtcctgttaacatcttgattttggtccagtgaaattgatttcagacttctgacctccagaactgtgggaggataaatctctgtcattttaagccaccaagctggtagtcatttttcacagcagctacaggaaactcatacagatttggatagaaaagtgatcacagaatttagaaacatggaagtcgttggggattgaatgcagggaatgaaggaaagggaggaatcaagatacctgagtttggggtttaaataagcaaatagatgatggtgacacttactgagatgcagaacaggttttgggaagcagcatcaaaaattctcttatagccaattaggtctgagaaggatgtaaacatcactgcagttaaggacactacagccaagtgaactacaatcccaactgctcctgcaggaccttgcaaaaaccatggggacaatgctttccagtttacacatggaatgagaactagaaaagatactttagctagcccttatccagtgcatactgagtgagcatgtatgtgcccagagaattctttgctgtgccagagtgagtgccagttcatgccaggggtgtccccaggcattccagaaatagtagttagtgccagaggggtcatgatgaatgcaaagcaagttaacttgatgctgcagatgtagaaatgcatgccagaagagagatatattggctggggagattaacaacatgttccaaaggggtaatattaatacaccgaggaaggg

SEQ ID NO: 49405 - DNA, 1035 bp, Bovine  19866881121890
tccaaagaatctaggcaggaatgagcttctctctactcccctatgtacgcagtgagtgtccccacctgaaactgttctcacgggggaggcataacccagggtctacaccacgagtcctgcatgctcagtgaattcccggtgagcacacacgttccacaccttggagggctccagaacagtgcccagagaagaaggctggtccccgctcccaaacagctgtgctttatctccctggccagctcagtgctaatggccttgatggccacgtccctcccaatgtcctcctggcctcctgttggctgtggccaatttgctcgtgatttaccactccggggcgctgacccgtgagggagacacacgggacagaaggaggcagagcggacgtcatgcctgatgcgtgtgcacacgtgcatgtccgggcgcaagggtggggaggcgtctctccaggaatgcgctacccagccaggctctctaggactgggagcagggtctggcacccccaccctttcgctatcccatgctgattatggcactaggcactgtgctagagagaggaaggccaagggagaccttgagggctgccaggagccacaggctggaagtcaggcccaggagcagccctctcacaatggtctggagccttctgggtcctctgagaatccaggcatgcgcacaggacacacctcccagccgtgaacacatccacggccctgcccctgaccacagtcaacagaggcagcacaagcgtggtggggccctggaggtgcacccgctgggttcacatcccagctcagcaactgacaacctttgtgagccttaaaataatgaggataatcccaacacctacaccagagatgggcaatgaaaagtaccaggtgaatgcatgtacagtctcaattattgttatggatgtggttattcagtgctttcctcatgccagtacccatggcccttacgggtcaaggaattataagacacagattccatctttaatcagctcacacaccttggaacttgggaccaggaggacccatg

SEQ ID NO: 49406 - DNA, 1223 bp, Bovine  19866881299810
atgtgctgaggaatcctagtatctttttgtgtatgcattcgtcatcaatcagatgataatgttttgataaactctattaatattcccattgtacagatgaggagactgaggcacggacagaagtaacctgctcaaggtcagctgagacctgaaccaggctggctgtgagactgtgactaagatttctccctctctttctccagagtgcctggcccatagcaggcacataataaatactgatgacatggagatgctgacaggaacataggtgcagatgttaacatttttgttcccccaggaaatcatgaatcagagccctacagggacgggaggtggctgatgggctgagccagtagaactccatctgctttgctcaccctctctgcagggcaccccaggctgtctccctcttttggaacccaccccatcactgagcctagaaaggggagggtacagccgtgtgaggctgtgggtgacttcgggcttaatatctttgtaaccatattgcaaaggggcatgcctaagacggcgccttacacttaatctttctcttattgctttttctcttgtatgatttaaccttgcaccaggtatcaagctagataaataaaaacttttatttcagattagccccggctgggggctgccttgaaagcggagcagtcatccagggagtgagatgaaaaagggagcggggaatgtgagctgctgagaggggctcattgtatctcccaaaagatatttgagaccttttttgaggagggagggatgagatctcctgccaagcccacagcctggggaggctgagacgggcggctgacatccccctagtccagccttcctgaccccctcttcctgagtggctcttcaccccagttaccttctcacactagtatttcctgctcagtgcttaatatggccaggagacactgcctttgctgatatttagttatgtcttccccactagaatgtgagctctgtgggctcagtgacagcaacttcccttcacaattggtccccagggtctggcatggagcctggcacacagtaggaactcaattaatattggctggttaaccgaatgaatgaatcctggggttctagttcggtacatagaccgggggttgacatgaatcatttggtttcccaggcagaatagtaaaagatggtaaaaaggatgtgggttttgggaagcaagaaaagctgggtttgaatcctgtgcc

SEQ ID NO: 49407 - DNA, 708 bp, Bovine  19866881317767
acatgaagaaaggtgtggagtcagaaaaaggccagggttgcttggggagctgtgagaagaaatgctggaataggccccatggacataagataaaaacgtatgttgattacagcctcaatataaaggaccccaggtatcccagtaagtagattttcttctcttagacagtgaagaggggtggaggccagggaaggatgcagtcatagctgagcttttgggaagggtctgtcatggctgcagaaaggatggatgggtgaggcagagcgcactgtgcaagtattctttctctgagcccccccgcccacccattaccaccacagactgtctaaacctataactccctgttccagaaaaggcatcttgtcccacttctcgtttccctgcattgttttttcctgaggtttcagaaagcgtctcctttgaggctccccccggcccccgcgccccatgcccagccaggctctgaattttaaccattctattttctctaccgattttatgataaacagcccgtgttttctgatgcctttcctaagtgtgtcaggctgtccctcgaggcgctgctgcgtcccttcactgagatgcccagtctcatccccacccggctgtgtgattatccccacttaccactggttccttctaagtggccagcacacctccggccaccccagatccataaaatttgggggcaagtgtccatcatctcag

SEQ ID NO: 49408 - DNA, 793 bp, Bovine  19866881321548
ggctttctgagactcagtttcctcacctgtaaaatggaaccattcacatctccctcactgggctgctgcgagatatacattaatcaatagagatgaagaacacagttgtagcttggattaaatggtggcttgaattactgtcaccataagaggccaccttgggatctgatccaggaatgtctggctctgatgctcaggttctttcttctgtacatgctcctggccccccatcgatggctagagcaggtcctagagatgggctcccaggcaccctccaggagatgtgtgagtgttgtgtgcctttcaggaaagagcagaaagctgagagaggagcggagctcctatggaactgtgctcctgtcaggcatgtttctctgtgccattctctcaggggtaagggccacgcccagagatggccagggaccatgcctcaaccacacagcagtcttctagggcccagctgggcccttccaggggtgccaccttccagacgagcagaagtctcatgtctgctgctccataaccactggccacgccatgtgcttgtccatctgggttggacacaaagtccgcagggcatgaaattcattttctttatgtctgatggagtattgactgcttggatgaaatccaacaaatcatagtgattgcagaaacaagcacagccgcagccctggtgtctgtgtgacacacacttacacacagtcacacacagcctcgcacactcacatacatacactgacatatacacataccgatgcagtcttacctgctcatgcagtactcacactag

SEQ ID NO: 49409 - DNA, 1103 bp, Bovine  19866881329037
cccagttaggaaaggtagccctctcccagcactgaggaggtgggcatggctgagatggacgtctcctccccgcctggctggtccctgtctttttgccttcagtgtcaaccaaaaagacacgtgaactctgtgcggctctttccttcctccctgccccccactttctcagggaaagagcaaagtcatctccagggaaaccagcttggagaattacagtctagagacaggggaatcctcagaccctggactcccgagatcggggacacccgcagctccatgccagtggccttgcattttccaggcgtaggtcctggctcttgtcctcatcacccgtgcgcttttgatggttccttagaggcctctggggtgacgtgtgctgccctccatgcttttctccccaaggggaggctcctggggccaggccaggcagagtacacagctgacagtcccacctccctcccagcctctgggagccccaggctcctggcaagaacctctctcgactatccccagccccctgccaccacccgagctatccacagactttagtgtcatgtcacactttcatacctttgcccccagctgtctctgtgaggtggcccacagagatgtgcccattttacagatcaacaagcgtgtggccccaggaaatgagctggtggccagccctggtctgtcctagtgttttcattcaacagagccatgcttccatcctttctcttttcccctctcagactacttcatcccccttgagacatccctggaaaacagtgacaagttgagtgcctgtccagactcagagacacgggaccccctccctcccttgaagtgacacagtaacaaagttgggttgacccagatcctgtttacctctgaaccatgctcttttccatgctgttcttctagcttttcctcctccttccctctctggggcacagagggcacccagaggcgcccctccctagagaagggccctttcgtggtgcatgcagctgtaacctcacaccctttctctggctccgaaagccgaggtgagcaggctgagccgtgagccaaggaggcccagcaattacatcagcaggtgcaaacaagcaggcaggggc

SEQ ID NO: 49410 - DNA, 823 bp, Bovine  19866881351253
aagactctaatgctggtagggattgggggcgagaggagaaggggatgacagaggatgagatggctggatggcatcactgactcaatggacgtgagtctaggtgaactccgggagttgctgatggacagggaggcctggcgtgctgcgattcatggggtcgcaaagagtcggacatgactgagcgactgaactgaactgaactgaaatagtgtgtccatcttggaacataagaattgaagggctgtggacttgtgttcatctgagccacatggagaacactttctctaagttaaaagaggataggtggaagtcacagaacaaggtgaatgatagttccctgttaaacactgtgacaagtgaccagggcagaggcagggagcctggggtggagccaaagatgcaaaggggtcctgcagcagtcagtgacctgctggtggtctactgggcgactgctccccccaggaactcagctacctgagtaaggtgctcaagaatggactaacctcctgtttttgtcctctgctgtcccctgtgggtacttcaggttcctctgtgacccagttgctggctcgagacatggacaatgaccccctggtgtttggcgtgtctggggaggaggcctcccgcttctttgctgtggagcctgacacaggcgtggtgtggctccggcagccgctggacagagaggtatgacccgcctcgacctccgccccagtccttccctgggaaggcaggggcacaggctagaggaaaatggtatatcgtcttctcacccttaagcagaatcttcctgcctgaatggtgtcctcttccagggccagtg

SEQ ID NO: 49411 - DNA, 1016 bp, Bovine  19866881385407
tggcagcctgcctctccctagtggataccatctcccatcctcaccctttactgctgctgtccaacccagagcccctagggcaggcctgagggacacccagttagcagctctttatccgccaccttcaaggtctttgaatcactaactgccagcccaaaagcctgccatcagccaccagggagagggacagcaagcaatgagaacccaggggccagcagccagcttataatcgaaccgtccgtaatgcaataatttgtacttctcaattaccagcaatggctcggttttacactcatgcactcatgcaaatacactcagagtacacaaacaacccagaggagccaacggccagcaagccagcggggcgagcgtggggttggagaaagaaagcccctcccagtcactgcacgtgccctgcatcctggggggactgttctggccaaagctgggaggcctggggttttaagtctgccaccccacctgtccaaggcccacacgctgtgaatggaaaaaatgaggtacaacctgcctctcccaacctctgtcctgtccctgactctggccagagtttggggatttatccagggccctctctcaggcatgaggctgccaccaacctgctctctgcaaccagcagacaagccccctcagaggtactggcttggtcaccagtgtgcccagagcagatgcccgggctgacgagagggcaggagagaaggagctggagctgtgcttcccccagcatcagtctacacccaggtggccccagagcagcagaccccaaatgtccctcgagtgtgatcccaggggcacctacctcagggatgcggacactgtagggctgattatgaaacgtgggcgcgttgtcattcacgtccccgacctggatgttcaccttccttgtaatcacctggcaagacaagcgtggtgagttaatgtcggcctcagcctctggcctctttccacccgaaggcccagggaccctgcctaccctgggcagcaggggtctcggggga

SEQ ID NO: 49412 - DNA, 899 bp, Bovine  19866881583728
ctgctgacctgctctagaatctgcacaagggcccactcacaagggcccaagtcacaccagtacaggcttgggtctcagatttccccaagacacaggcttgcggggcttctacgctactctacagccactccccaggcctggctcagcaaggtcttcatttctgtttcagagtcaattaaattttggtgcctagaggcaaagggtggggccagatgacccatgagatcttcctccccagaaagacgcttggtctaagccacaggaagatcctaaattagaggaaagggctgttggggagtgaagaaagaagacttaacctgccaaagcctcaataaggctagaaaaacaagactcttgccagaaaaggtttttctgtcctgagggaattgcataacagcagggtaatttatatatacaaatatatgtatgaatatatgtgcgtacacacacacacacatatatgctttgtgatatttgtgcagacttaacacacagcatgaaagcttaaagccgacaagtgaaattgagttagcacggcatcccttattctcaatttattacttcaccagggactcatgcaggctgcaggactggagaagtgatggcgcagagagagccagcaacccaggcaccggttgaattatgcgtcacaatttataaaccattacatgctgtggattttaatgatatttatttacacctgacccctctcatttcaaaacttggtttcatacatggggaggagaaagggaccttaaaaatgtgttttcgagctagggctcacctcagctgcagagggtggtcagcctgcacacctgggaatacattacaccctctccctggcctttcctttcacatacctcagggcccgacagagaaccctaggaagctcagtccat

SEQ ID NO: 49413 - DNA, 884 bp, Bovine  19866881121998
tttttttactggggattgttagtttccctgtattaccaaaagtccccacagaagactgagaaatgctggaatcttattccaactcagtcagtatccaattctgtcatccctttggacctcagcttctccttttgtcatatgaggagttacttataatatctaaaatcccattaatctcgtagattctggatttaaatagcaaaaatgattaagcttgagaacctatattttgttattcccccattagagaggtataagataaaagaggattagaaactcatttctaaactacattaagaaactgagaacaaaagagatttttttttcactaatttcaaaagttaatgaaataagtttcaagcatgattatttctatcttctgaggaaatgtttcctgtaactgcctatgcagtgacacatgataattatttgaaaaccataataatgcggtttcattattctaactatcttctttcttaaagggccagcactggcttgacagaagtgctcctaaagcctgtggtgccctcttctgacccttcactcaatagggtgagtcaaagcttttgtttctgtaaaaaatatgtaaaaattcgtatctgacacaggttctatgaaagaaatctgactacagctccatggtgtatacttaacaaattcttccaggtttcagttttgaaatttgagaattgttccagagaaaaaataatactgaaatttgaaatgtgatagcaatttcactcaagcaacatgcctgtgtaagaaaatcttaggaaaagaagtgaaaatattatgctaaaatatctaaatgaattacaaaagataactactgaattaaaattcaaacttcatgccataactgtgcgccttaggcagagaagcaa

SEQ ID NO: 49414 - DNA, 2086 bp, Bovine  19866880492288
ttagtaatttctggagccttccatgtgttttctgatagctctttcttattctccacttacctggccacaggacattctctttcttgtcttaaggtactcaaaccctgactctttcacctcccttttggcttcaaaattctcagaaacatatcctgatttcaagtagattttatgttctttactgcataacagtgttgttgtactatgaacctctttatctggaaacaccactatacaggtctctaacttatttctacttttggtgataatgactcaaaccagtagtgtaacagtggaatgcactctctttgttaagatatttctgtgcccttaactaatcatttgctacttgtttcatgtttatgtgctttattgccctttatatattgatttgacctatctcagaccaattgaagagagaaagtctgatgcaattcctgtcttgctgtatgctggaagaaaatgaattgtgataatggtggtgatagactttctctgaagctcttggtcactagacttaccatcatttagggtctaactaaaatatgcccaactcttctttccagtaccaattacagaatgaagcagaagtaaacccaaaagggcataaactgtgttggagattatttttagtttgtgaacttaagctaattaacatttgaatggcccaaccctgatcatcttaaagacaaataaaaaggagagactgaggcacaccatctggctgccaggaggccactgttatcatggtcaggagaatgcacacataggggctctgatgttctgtttgcatgtcaatggaatcaacaccaaccactcttttccacctgcattcagaatctattgagaaagacactcacccatagaagtcaggcagttggagctggagagcaaaatgtcacccttatcgccaaggctgctgctggggtacctcacgcttagtctgccagggaggccggcttgctaataacctcagagcctctgtcagctctgcttgactgcagcccctcctttctggggcccacctgagtaacacttacacagcagagcagggcaggctgacagattttgaaggaagagcatactcagacccttctctcaaacccaccaacagaatactcactcctcttcccaaggcaggaagctgaatggggccatagctagggcgaagcaagtgagggcagagttgtttttatggaagatttttatattttgttcctcttggattttttgcatttattttgatttttaaaaatattgcattaaatattatttttctcaattattgagtttttgagtgcatccttaaatttcttaattgaggtgagtgcctcagtagccttgtctgagtctgagccttgcaagaagataaaagggtaaatggatagagacccttccagatagaaatatcaggagtagggactgtattcctatctggtcggatgtttaggagcttgatcaactctattatcaactctactgtaattgtgcagatactcatagtcacagaaactcttttttctttagtaaatatgttggatctctgttgttataaaaggagaagcaaaataagacaggtatcggagatactagaagatgattataatgttcagtaaagctaccaaataacattggttctaatgggcttcagaaccaagttgccctttaaaacaaatacttgatatgtcttgctttttccctaattagtattcagaaaatatttgagtgtgtatccgaacattatgaaaaatgtaaacacagatttgaacttgtggaatttaatgcatgaatgtgtccaactaagtcttcaggctctgaccatcagaggaacggcctgttctgtgacaagtgtgtgcctgcctctggaactcacagcacattccaggaaaatcatatcctaactagtttgggttgtttactccaaagagggcatttttgcacttcatttttcaactctagtttgtttatattgagacaaaacattctcacacaggaagacactagacactctttctcagtggagggagcattctcttttcggggtcaggaactttatgtctgcaaagttaattatcacgagactgta

SEQ ID NO: 49415 - DNA, 1132 bp, Bovine  19866880524938
atttggctagttggccgtaatgccccacaccctgtctaacattctgctttcctgctttatttacctccataacacttaatgccatctgccatacagtgtattcacttgtttattttatgtctcctctaattagggtataagctgcattgtctctttcctttaagcagtatgtccagtatctagaaacctttcctgttacatgttgtactgagctgtgcttagttgctcagtcatatctgactctgtgtggaccccatggactagaagtccaccagtctcctccattcatggaattctcaggcaagaatactagaatgggttgccatgccctccttcaggggatcttcccaacccagggatcaaacccaggtctccggcattgcaggtggattctttgccacctgagccaccagggaagtccttcttgtacacgataggcatttaataaatagttgttaatgaatgaggaaagatgaagatgcagccatgcaggagatcactggtccactagccggtagatcactgtacacgcacaaagagaagcaaaacacacaggcccctgtgtatgttgtgaggccccatctcatcatacccagcaaatctttctaaactctaccatctacacttcttaatcatgagggttactgtaaccaggataacagaaggatttcttacattttggtaacaccgtagtttttcaaaatgactctcaatggctattatttcatttcatctggacaaaaatcttataaggagtcagagaaaaatgttaatatccacagttactaattaaaaagacaagacagagagattaaataactttccaatggtcagaactggtgaggccttcacagaaacaagcctagaactgagtgatcactttgccctgatgcatttttctcctctcatacatttgattcaaggtagtccaggtttcatgcttcataataaaagagaatatattctgggaggtgggagatgagaagaactttgatccctgagatactttggcaaagttgtgggagacagcaaggcaattaaattcacccatccttgaaaataataatcctctaggtcttaataaaagaattattgggtgataaatgaaaattgggtagtaagaatgaagaat

SEQ ID NO: 49416 - DNA, 1073 bp, Bovine  19866880550876
cagcaaatgttagatggagcccaccgctgccttcccccaccagcaacctgctgcctgtctgctccagcctgagagttggggggccagggatctggacccagcttgaccttgctttcctaaagacctggaggttttcttcccctgcatagaaggaggccttccttctttctgccctgccccagggagtctggaaggtcaggcaagggtgagtgacaagaacagattagatctgccagaggaacgtgaattttccttctatcccagatagattagtggcttgttggtctaggggtatgattctcgcttagggtgagagaggtcctggcttcaaatcccagacgagccctactttggacttccctggtggctcagatggtaaagcgtctgcatacaatgcaggagacatgggttcaatccctgggtcggtaagatcccctggagaaggaaacggcaacccactccagtactcttgcctggaaaatcccatggacggagaagcctggtaggctacagtccatggggtcacaaagagtcggacatgactgagtgagttcactttcactttctatagcttaaatgcatgtaaataagtgtatctttagaaaatttgtgtacaaatacaaatacagtaatatcttacaaattcagataaaagttcagctgaataagtgaacacattgtaaatagtattataaaagttatttgatatttaagttaaatgtttattactttaatttatattgaataattctgaatgtctataaaatttgccaagtaaaaaactttggactctgcttttagatacgaatactctgtccttttgattttgtaattatttatattcaaattatttctgtgctggtaaagtgttttacaaaggcccagagattccttttctcttacaagggctaaacatttatctcacaagctgatacaccattctttggaaactctttcttgtcagtgcaaaattaaacatcaacctttatgtgtctgagtatcacaaatgtagttaaaatgaaagtggttttattgtaacatggtattactcctgaagagataaatatattctg

SEQ ID NO: 49417 - DNA, 1978 bp, Bovine  19866880559192
ttcttatccattcatctgctgatggacatctagggtgcttccatgtcctggctgttgtaaacagtgctgcgatgaacattaggggtacacgtgtctctttcaattctggtttcctcggtgtgtatgcccaggagtggggttgctgggtcgtatggcagttctatttccagttttttaagaaatctcccacattgttctccatagtgggtgtactagtttgcattcccaccaacagtgtaagagggttcccttttctccataccctctccagcatttatggcttgtagacttttgaatagcagccattctgactggcgtgagatggtacctcattgtggttttgatttgcatttctctgaaaatgagtgatgttgagcatcttttcatgtttgttagccatctgtatgtcttctttggagaaatgtctgtttagttcttcggcccattttttgactgagtcatttatttttctggaattgagctgcaggagctgcttgaacatttttgacatgaattctttgtcagttgctttgcttgctatcattttctcccattctgaaggctggcttttctctccctatatttgtattcttttcattagaagggaaaagatatctgcaattttgagttgacaaaattcatgttgttataatgtggtgtcttgagagtatctcataataagcaaaaaactattattatattttagacgttgtttttttaataataatttgatatttatttgattcattcaatttaatgggagaaaacagtgaaaaattatttgacaccagataggtaaatattattatgtctgtatctttcaacttatttttttaagttgttaatgagtcttgagaatgactctgaaacacattaagatgtagtttatgtcactgtataaatatatatgttacatcatatattatttaaatttgaattatatattatgtatcacatataactattatagtgagtgactatgcatggggtaaaataggaagttgagaacattgattttcattgccaccatatccacacttatagaaacaagcaactgtactttgaaatgatcactttatcagaacacccatcagacaaatgccaatcttcagatcaatttggggaacattcctctttggttgggcctcatgaaccacacaagaaactgcttcagtactttataattgtgttttatgatgataatttttattattataaactgtgttacccactttgatcactcactttaataatactaacatcttgtaggtacctgaaaatgtgttcagttaacttgtaaagtataattttattcactgtgcttttcagttcagttcacttcagtcactcagtcgtgtctgactctttgcaaccccatgaatcacagcacgccaggctccctgtccatcaccaactccccggagttccacctatacccatgtccattgagtcggtgatgccatccaaccatctcatcctctgttgtccccttctcctgccctcaatctttcccagcatcagggtctttttgaatgagtcatcccttcgcgtcaggtggccaaagtattgggagtttcatcttcaacatcagtccttccagtgaatattcaggactgatttcctttgggatggacaagttggatatccttgcagtccaagggactctcaagagtcttctccaacgccatagttcaaaagcaccaattctttggcgctcagttttctttatagtccaactctgacatccatacatgctgctgctgctaagcgcttcagtcgtgtccgactctgtgcgactccatagaaggcagcccaccaggctccctggtccttgggattctccaggcaagaatactggagtgggttgctatttccttttccaatgcatgaaagtaaaaagtgaaaatgaagtagctcagtctgactcctagtgaccccatggactgaagcctaccaggctcctccatccatgggattt

SEQ ID NO: 49418 - DNA, 995 bp, Bovine  19866880696016
ggtttaaacattacatgttcttgagtaggaatgaagtgccatgtagcctttcacacagttctgagtgtttgacctaccctaggaatatctccctactccaaaggaaagggtggtcaagatattaaatttattctttagagggttagttgaggtttattctctatcttttcctcccatgaaaatctctggtgtctgctaccccatgctggggaccagtagacaaaagcctggtggtgaatcaaaagttgcaattcaagccctgagagagaatttctattaaaatggacaacagatgtgaacaaaggaaagaaatagatcaaagatgtgaactccatccatgagattatttgcaaacacaaagcatgtagggtttttgttatttttaacttttatcaatgcaaacttctgggtggaggaggaaataacaccaaaaaaaaaaataataataataatgaagggaataagcaaccatagaatagaaagaatcatgtctgtggaaaagaatggaatttaaaagaaaacattttttgagcaccttgtttatgtaggcactggaggggatgctgagtagagacgcttatagcttgacatgagctctgctttggaaaatccagagtccagtggagaagtcaaaattaaaaaatagctttaatgtaagagaaatgcaagaatcccagaggatgcaaagtcaaattattcattatatatgttcatataaaactttggtatccttttaagaattctgaattgttttcataattaaataatgacccagcaatggttagcccttgcataagaattgaaacaatttggaaacaactcaagtaattgttggcttttatgacttattcttgtgctggagagtctgaagcagttctgtagaagaaacagtggaggcagaggatagtgaattctaagccagtgactttcagcaccttaccagactgctacttacacttagtcatttcctataacttcaaacttcacgcatctct

SEQ ID NO: 49419 - DNA, 949 bp, Bovine  19866880769871
tggcaaaagtttttccttgagattaacctggggattctttaagatgtagagtcttgggttctttggaatttaacattttatagctggagcaaagaggaaataaaggaacatagaaataaatacctagtctagtccaagggtgccttttctcccagataactctgagtaaatttatttaccatatagaaatgcctcctgccattatacattttaatttgatgataattattatttatttgcatatcaatttctcaatatcttctttcttatgtaagggttgacatttgtgtgcctttgctttctttcaatctatgagaagcttcagtaaatacagtacagtgtatacccagagataaaggtattctatttctaggcatttgaatggcagcaacttcctattttaaaacaaaagagctgactttttttcaaatgccccatgatgccagtgctactgatctcccattgccctgacttttcgatgcctaggttgagtgagcaaatgcagtgaagcatctatgcaggctggccaacatgtctctgctactgctcccttcatagttatgaaattggaagaaacttagtgtgtagatctgttgtttttactgctttgtatccattctttcttcttctgttagccacatccagattattctggggcgaggtcaccattgtcccggaacatgttgttcagatagaggcgactttactccttggtatcaaggcaagttgggtctgtgtctcagatccgaccatcctgtgtggtttatctgcttggctgtggtgatttctccaaggatgggcatgtgatccaagatactctgtatgtctatggggtctgtaggtcatttactgatactattgggaatgagacatccattctgctggttgctaagctagcatagtgggttataaatttaacactgttaggacaatctaataccacaaaagg

SEQ ID NO: 49420 - DNA, 1200 bp, Bovine  19866880797244
cagacaggatggaagatcatttaagacccccatttaatagctgaagatcagagaaagtattgtattgcatatttaggaagcggtgataaaattacgattagaacttgaaatagtctatatctctgattccaaatattcatttccctttcatatgaaaggtttaattaattccacccattgcaatataacatgcattggcctggtacagaagtatatacctctactccgttgacattgggcttgaccgtgtgctttggccgctggcatgaaaaggaacattgcatatgccatgggcaaacagaaactttaaaagtcaccatgtgatgttgccagctccctattcttttccctctgccacagactcacatgtcctagaagagacagcctcttcagcctggaatgaagaggacactggaaacagacatgcatatgatccagcttctcatatgtcaagaacatgaaaaactgtttatgttctattgttgtaagccattgagttgtatagttgttcattcctagagcaaagatgaataatttagaacacagaacaaaaagggtacgtgatttgctcaagtttacacaattaagcagctaaatgacagaatcagaattgaatctcacttcttttaacatccagtccagtcttctcttcatatttcagaactccttaaatgaccgatgtaaatatctacacagaatactttactgagatatttagaacatctgaaaaagcaatttactccaagacaatggctttgaccaattaattgttccttacatgcaactaacagggctactagcaatccatgaaactctcatttgtggtcactagtgaccataccaaccaggagctacccctcttgatgtgaactgggtggtgtggagttggggactgagtaaggtttgcccctttacatttgttcttattagccaggtcatcttcaagtgcctgttatctgtggtaagatactggattccagcaacagctccagtgtatcagtatagtcttatcttaggaacatatggactctttcatacttggtttccctaagtaggcttttaaaagtgatggcaaattctgtcaacaactcacacctgttttgtgtccgctccagtaaaaaaatctgtctgggcacttcaagaagctccttttactatgaggccactttgtaccctgttccatttactcctgtcgccatt

SEQ ID NO: 49421 - DNA, 712 bp, Bovine  19866880843010
cttgaacagagatgctggctgctaaatggcaataacagagtttgtgcctggggatcccactggaaaatggtaatttcaattcaatattttttaatttccagggaaccatctgaatatagacctctgggcaagcacaaccacatgcactggaaagaaacatgatcgcaacactgacaagtgcagcaaaatccggtcagagcattctttcctctaatacaactccacattcagcagtgtgctgcttaatggactcggggctgtatttgtttatctatttttgatttgacaacgtatatcattgtttgcaattgaagacaatctccccccttccaaaccaattttactgcacaaatctgaattaaaataggggcagacattcttgtctttgtaagctactgctcactcataagtattttccctgttatttcagcatgttgtgcttacataccaagaaagacttgttcaagtccactatagtcaactaagttaaaaaaaatcaaagttctagagacagaaataactaaggatatgattaaccaaggaggaaggatatttgggccagagtgacccaagaagcatatgaagcatagtatgggggtcaacatataggattctagctcacagtagctatgtttgtggcaaaccatcctgacaagaagtcaaatttgcccagtactatattttacatattcatatgtatcatatcagcaga

SEQ ID NO: 49422 - DNA, 1348 bp, Bovine  19866880895238
gtctggaaacctgaccccctcgtcctaaaaaggcttttgtctggtaacctaacccaagtgattcattaataggcgattgaaagatttttttttttttttggtcaggaactctccttttccccccttttatagaaatgaacaatttgaaacacaactaaagtataagattgtatcaaccccacttcaaaatagttctatctgctatacaaaaagatatttatttcttatgatgaaatatttgttagctcttgcataagtatcccctgaattaaatataccatttgctttgtcaaaagtgcagtacaaaaagttctttacaaaatatttttgtgcatccaaaaatagtagttcagttagttaaaaaaaattttttaactctaattctgtgtttctagtagatgaataattatatgcttcaggtcagatggtgttgtgatttcatttattgatgttcaaaataaattagtaactcaacttgggatttttgtcatttattctttagtgcttactaaagataagtactagcattttttaaaaagtgcttccttatgtgtgggttacatttcacttctatagtattcttcccaaggatcatatgttatgtttgaccttttaataactgacttcaaataagaaaaagtaatggcattaaactacattcaacatttattaatatagcatttaaactcaaggaaaatgccagactccaacattctgacaatgaaaattcatcctaatcagcctttgtctctaccctttgtaagaaaagcaagaaactgggacacgttctatgctactctgaatcacagcaagtaccacccacttgtgaagttaaaagtcttttcatcatatttactttgtatttaaaaaataggtataggttctctccaattgcctctccaagttgtggcctgaaagaatcaatagacaaaaacatgaatcatcaccaagggcttgatcccattcacaaggaaatataagataggttatatttagtggtggtggtgatatttataactgccctcaaagtcactcaggtagaatccccacaaacattttaatattaaatttcaactctctttataattgcttatatgcctttaagactctacctcacttggtaaacacaagacttaagccttcaaccttctcaaagtagcctgggcaagccattcagatgaaggtcttgattaacacactctctctccaggtctgctctaacaaaaaaagcatttcctggaaacccgcccacagattgtgggactatttttagtagctcacctcccagtaaaggcagctattagatatcctgcccctctcaggtgcagtaaaatagaacataaaagag

SEQ ID NO: 49423 - DNA, 1574 bp, Bovine  19866880970193
cgcattgatagtatttggctagaagaaagggatagaattccatagtgggaagtgggtgagcatttacagaggcaccaactccaaaaggaaaaaaacttttaaggagaatgataagtagaccgggcattttaaggtagatttatggagggaaagcttgaaaacacttgaaggtaaatcgcagaaaatttccaatgccaaactaaggaaacagaacttaccctctgtgtaagtggttctcaacacccactgccccccagaagcatctggcaatctctagagacacttggttatcacaactagaaaatgaatggctgcaatcagtagcaagagggtagaggtcagagatgttgctcagtattctatggagcacagcccaccatccaagcaaagaactacctggcccaaaatgtcagtagtgccatggttgagaaacccggttctaggtaatagggagcaattccagatcagtgactcagtcagcagattgcctctcttctgtcctcagccatgtgtagtaggtatctatgctatgcactttaacctagagagctgaacaatgtacactctgtcccctcatcttacacagaccatggttacaaatgtgcctattttaaataaaaataatcattacagtaccaggggatttacactgcagatactttttaagttgatgctttacggaactatatttagccttggaactggaccagcagttagtgggctggaccaacctgttctaattaaatagaaagttaatttagaagtgacctgaaagtgaacctttttgaaagtcaggaatgtgtttgcactaatttgggacttttttttcaatttctctctgttagaagagagagtgaaatggtgagagccagaaattatcttcactgaatatccatctggaggaataaaatgatagatatattggaataactccagcccaatttttcaaaattcaacaggagagctgtggaatggattattgtttgtaaaactcctggaatccagtaggttttaactaaatggaacttctcctactcttgtttacctattctgagaaaaagtgcacctgggacaagttatcctaccctcttggagaggggaatggcaacacacgccagtattcttgcccagaaaatcccaaggacagaggagactagtgggctatagtccatggcgtcacaaagagttggacacaaccgagaaactgagcatcatgcacgctggaagcagacatacatcttgcaggatttttgcttttcaaagctaagctcaatgtatcatttttaaatttcgaatgtttccctttcctacttcctttaagctaaatgtagcttgaggacaatgacttgtagagctatcaagaaatacacaggcaccacactctgtacccaaacagttttcccttatctttccagcaaatacagagtctgtctgggcactaatggccaaagcacagcagagcagtaaagccaaggaagtgattttgctttgtcctatggcaccgatcaaccactatacagtgataactgtgagactgttttatccccaacactgccctctcctcagaattccag

SEQ ID NO: 49424 - DNA, 1506 bp, Bovine  19866880982849
atttctagggtcatccctgcataagacatttatgggttgagtagcttttataactgacttctttatcagaaagacttcataggcagctgcatattttattgcctttccccattctagttaacaagagagaataatccattgagaaatgcataaatacatattcagcttatactgtgacaatttaaaaagtgtttctggaaatgccatgaacattttatggattgtgaactctttcaatttccaaatttataacataaccgtaaaagctttgaagacctttagggggggaaataaaagctcacttcttccttaaaacttatgtctgaaactgattagtctcatgaaatgcccctttatgtaggagaaaactttagaaaacctaggacttaccattgagtcaagaccatttatatcttaagctatgtttgtttatacctggcacagtcaccctggcttagacatctcttttatgatccctggttttaagtggttagtgtacagagctgcgtgtataggagagcattcagtgtttatgtttgtcctggcatgtcacttcagtgaattctcccagggtaagtggggagaaggacctgaggcctttacctgatgtataactaacctgatcccagagcagacagggcgccttttaaggcaactgctgagatgtatcctatcaactcttaccacagctcagtactgcttgttagtttccagtattattcgtttgatataatgcaatgatattcctattttactgcttcctggagctattccaagcaatagcttaatttgcataacaagtatactgtttcatctttatgtgacttttctttccctttgtgaggtccttcacatacatagtgtgcttgaagattaaaaatctcttggcacagcaaagccattgctgtctatttactttaaacagaagctcaagaaaaatattgattaactacagtgggactgtcttcctattttagcatgactactaatatgactattaatgttaatagagagttccagaaaaacatctacttctgttttactgactatgccaaagcctttgactgtgtggatcgcaacaaactggaaaattcttaaagagatgagaataccagaccaccttatctacctcctgagaaatctgtatgcaggtaaagaaacaacagttagaattggacatggaacaacagactggttccaaatcaggaaaggagtacatcaaggctgtatattgtcacccttcttatttaacttatatgcagagtacaacatgtaaaatgccgggctggatgaagcacaagctggaataaagattgccgggagaaatatcaataacctcagatatgcagatgataccacctttatggcagaaagcatagaagaactaaagagcctcttgatgaaagtgaaagaggagagtgaaaaagttggcttaaagctcaacattcagaaaactaagatcatggcatctggtcccatcacttcatggcaaatagatggagaaaa

SEQ ID NO: 49425 - DNA, 856 bp, Bovine  19866881039755
gggcaggagaaggaagagtttacaccagtgcgtgaggaatcataggattatattcattatcttgactgtagtgatggtttcacaggtgaacatatatggtaaaactcactgtttgttaaagataaccaaaaaggctgttcttttaaaaaaaaagataagaaaacaaaattacacacccaagtccctcatgaacatagattaaacaagaaccagatctcaagttccttcacccagaaatttgaatttaattggtatatgatatgacctagattcaagattttaagttccctacataattttgatacacagaataatataagaggcacagttctatttatgaccctaaactgcaacccctaccatgaaaaacccttacttaaatgaatgcccatagttgccagggaaccatgttggaaaaatacaagtgggcaatataaatccatcatcactttcagaaaacaacctgaaatatctaatattgctggctaatcagtaatatcgtcttagtaaagtgaagggtaactttattttaaaaataaacaaaaaacagaagtgggatgctaagagatcagtgcaaggtgctaacaactgaaaaacatgtaaccacagctgcagcatgtaaggaataagtaacagtaaaggaagctttctgaaatgtcctggtaacagggaaaggtgaaaggtacaagataagcttaaggaaaaaatgggtaagttctgggtaaggggtcaggaaagaaaggaagtcaacaacttgaatcatcactcttaaaatcactctctgtcaacagaagcttatatttactttcttttatttggtgccttcaatattttttctattgtatagtatttaaca

SEQ ID NO: 49426 - DNA, 1854 bp, Bovine  19866881047813
aataaagtttctaagagtatttagaacatgctataattaattattagttctcactgggggcattttgctaaaaacgctcttagaaaaagacttagatggtaacaggctcaacattgaaatattttcaataaactaaggaaagacttgcattttaaaatagaatggagaactcacatgacaagaatgttgtttcaaagatctggttatcatgattttgaggggaaaagttaatgatttttcaccctggctatagtctggcaaaactaaatcagaacaatttatgaatacacaaaattaaaatgtaaaactaaagtaatagaaaagtggcaagcagaaatgtaaagatggggagaaaaagaatgctaaacttttattcctaaatatttcaggaactcattaggaagcaaatattgggaagtactgaagattttaaagcaaaagtagtaaatagaatatgagaataaagaaaaccattgttggtggtgggatatgtctatattgttggtagtgggatgtggatgtgtgtgtgtgtgtgtgtgcgcgcgcacgtgcatgtgtgagagacagagagacagagaaactcagtccccaaaggataacaaccaacagggttttgtggctagatttaaaataaccacaggttgatctattaagcttggtggtaagacaaccatgtagctttaaaacaacacccatactctgtaaggtcatgtactttctttcaggtattaacatgcataattgtggattagtagtgttcttaagatttggcatagcatggctcattatgacagaatcatcaaatcatgggtcaaatcacatatctagtttaataagtctaatatttatattgtgtgatatatgaaatgtagctacactttgggatactaagatatccagagacacctttcaaactacactaagaaaacacaccgcactgtagttttataaatcctacatgctcacttggaatagtgagactaaaaagaaatttgaaaatggaggaaaaaatataaaaaccctttggattcaataaagtgattctgatgtaagaagataatttaaaaagtgggattgaaagagaggatatgtagaggtaggtagacttccaagaacactgaaaggtcagacttttaagtgtgcaaccatggaatatttgtaatgagcctgaaatatcaccatgaacatagagtgtgcatgtggattcaagtggatctttgagaacgtagaaaacaatatgctatcctgtatcagcatcattcatgcatttcttaagattcattgatctctgtctctttgcttgctaattgtgaaaaaagaagatgcagaaacagatgaaaaagagttccaagaaagtataattactcatttccctcctttttttgcctcttatattatggatggtttaaagatgaccaaccaagtgagagactggggaaacaggagggtgcaaaaccgtatctgttataaaggaaaaacaaagaaaaagaaatgtgtctcaactactggtgaccagattgcttcaaaatataattcaattttatgatagaagacaaaatttgaactttgacgtcttgagacacttttcaaaggattattcttgacttttgcctgtacctgtatagactcaagtactcctgagatcatgcctgcctatgaataaatagcattgaaacaagagtttactgatatcctacttctactatgttaatgcagttataaacaagaaaaaatctcagggtcagtatttttacatgttgtagaaaatcaggcaaacctgagtctagacaggtaactactatatttcccagtttcaaatactgactcttccaattcagtggagtagcaggttat

SEQ ID NO: 49427 - DNA, 736 bp, Bovine  19866881068844
ccaaggtattttgatcagatgggcttttccatccatctcagatataacccagtacactgggtctatgctggaggctgtcaccatctgtctttcccttggaattagaatcttccattttgggtggatgccactgagatgaatgatacagtaggccttaccttcagactcagtctgcttgacctgaagatggtcatttagaaaattcctttcactggagaaacagcaaaggcatttgtagtgcatgtgtccacatccttcactgtttatgagtagtgatggaagattaaaaaggttctttttaatttatttatttggctgtacagggtcttagctgtggcatgcaggatccagttccctgaccagggatcaaactcattgcattgagaacacagagtcttagccactggaccagggaattctcagattaaaagttttctaaatccactgcactgagaaaacaccactttagtgttttaaaggttaagagatttagctatggtcaactggtcaactaatggccaaaagagctagaaatttaaacacccagttattcaaatcctcgaatcactgcctaggctttaatctcctcatctgtttgctattgttgagatgccaagaaaaggattatataactttcaaggtccttcctaggtctatgacactattttacagcagagaaagtctcatcaagatagtgacaaattagccagcacttgccccacctaaggatgaaaag

SEQ ID NO: 49428 - DNA, 1521 bp, Bovine  19866881074815
tacttttaaggcaatcctcgtgttacagatcttcttaatcagattatatctgtacacagaaaggaaaaggggaaactgagcttaatattattaggtttaaacttgtttttggctggtgatataaagataattgatgccagggtaatattcataggtctcagttttctagcttattctctcatttctgcatttcagtttgaccactgtgatacactctgtctcaggaaataggatggaaagtacagtccttattctaggcatattgtgggaaatctaggggattcttagagtgtgcatatgcactttataaaaactattaaaaggaaacactttttaaaaattatgactatctgtccaggatttcccctcaggtttgctgccttcattattctgcttgccgaataagacctataagaactttgaacatttgtgtgtagaaattgacttgagcgagtatattttctattttatttagcattcacaaccaaaacaaggctatttttgaagactacaatcaactgccttcatgctcaagtctaagcttcctaaatcagaaagtgccagaaattacactttgaacctccaaatagtgtgagttgaacagaagtgtatttttggataccaaatgtgctctcatatccttccaactctgcaaaatcaaagaagcaggaatttcattatctgggcgttcagccttgatccctcacaactggccctgtcttcctgtgaccctgttcccctgcatcagacagagccataactgtgtctcagtgttcatttccagcctaccactacccctccctccacctcctctcctctccccctcctcttccagcagggaaacgcttcaacagagagagagaaaactcaaagaatccccctttactaactagaactaagatgaattgtgtcagagttcagagcccccttgttgctttggcatgaaatcactgcccttggtttctgccaaggcgggtgtcagctggtgaattataacactggcagacaggactgagataagcaaaaaatacaatgacagctgctacacagaactattctttctggcctagtgaatacaaaaatacattgtgtaaataaagacagacagcttcattatgcaattgtctgctactatgtcactactaaagagcaagtattgattctgaaaaatatacccagactcttcaagctaatatggtcttactctgggcatgcaggaacactaaggaaagttgtcatctaatcaaacttcttaacttcagagctgaaccaatatagatatttattataagatcccatcactttagttgtttgaaatttaactttaaaaaacttcttttgcattcaagtcctcaatatttatatgacaacagacatatttgaagtaaaattctggggctttgactagcttttatgaattataaagtaagtgtgtatgttagtctgctcaggttgccataacaaaataccgtacaccagataccaaataccataggacaaaataccataaagtactggtgc

SEQ ID NO: 49429 - DNA, 1578 bp, Bovine  19866881122333
agataggaaaaagaatgagtaatgatgatgaaagcctcagaccttgtcaaatcagctgatgagtcaaaaagatgaggaccgagaatggaagctggatttagctctgtggggtgattgctgaccctgataaacgtagttttaaaagagtgtgggggtgacaatcttggcactggtttattcattcactaattcattcaaaagtacttattgagcatgagcatcttctttgagccagtcactgagaatttgaggtgaacatgaaagacattgccctgacatctccaagttaagaggattctactgtaattacaggctatgatatcaggcagggatcaatttcaaaacagacctttactacatgtgtgcgtgctcagaggcatacacacccttgaagactgaagagagcaagaaagacacaggttaagggaagtttactgtaagcctgtaggatgtatgagaacactccctgcctctatgggctaggacttgttaactactgtttatcttgtgagtggctgcatctggcatctttaaaaggggattatcgactctctttttgtttttattttgggaagtatttgaccgggtgccataatttgattttaatctgattttatctctgtagtgcttagatagtttaattgctggtttgatcaggcacctagaatgtgaattgttggaaaaataacatgctgcattcttatagtcaggactgtttccatggattctttttcctgaatacaagcagttattcatgactctccagggactaaaacttgcaaaatagtattttgttcatctaaatattgtttaatagaaatcctgtaaagcaatatctgaaatcctaatattttcttaggtaagttttggcatgaggtcctatgcaatagaataattgaaattgaaacaaaacttaaatggtagacatcctaatatgtttcattataatatggcccttaaatattaatctcctgtaatttttaatagcaaagtaatcactaggatataataaaaatgttaatatagcttgaaagttatttctctgtagataggagacctctgtaaagaacagagaaatatcattcttgcaaatataaagcacattagtattttgggttttctgtttgaattctgtaaacactagtaataacctataaacaaatgctcttgggccacgagaatatcaaactgtgataaagtgtgtatattttgttcattcaggcaatgagattgatctccaaagaacttgccttaacaagcatcagtatgacccattttaaactcgttcctggtgtcctagcaagcagctgaatacaacatacttctacattcagaaacctgaaacacaaatgatttgtatcttaaacatatttatttcaagaaagggattctttcgctgggaatttttatcaggaagtgggtgaatagatgagaaactatggcactgttgtaaaaaaatcagttacatatttttaaaaaactgtccataatcaaatgacttattctattttataacatatctaaagtaaactataagctccaagtgataagagcacacacattaaaaatcagaaagtt

SEQ ID NO: 49430 - DNA, 1434 bp, Bovine  19866881144562
gtatagttatagatccttgcaactacccttctaatggaaaaacagcttcaaatatacagcgtcaaggtatatctaaagaagaacatttattctcaataaaagagaatttaatcttaaattagtatatttaccaatatccagatgtgtggcaacaaatactagcatttgaactgcgcgtgctgttttcttccctatattagacacctcagagttggctggagtgacattagaagtgctgatgggcactgaagaggcttggtttcttcttgtctctccctatccctccatgtaccttcagcgggtcatttgtgacttcctttttctcagcctgtaaaaggaaagcctagatctgaatgatctcttctgagagcctttcagatctgaaaacattctgtaatattaaaggcttattgtcatgtgggttatgagccttagctgaagcttctttagttgtttggctatctgtggattgtgtattcacaggcattccatttaaatctcatgctctgagctcatttacttgtacttttatagtaatacttaagcatttatatattgcttttcatcttcaaagcacttaacatacttaagaatccttccagcaacactttgaggtagctaagtattattaaaatagaaagaggaagaggacaagggagaaagaaggaaggagagggagagagagagaattttaagtcctttaatgatttgtctctggctcaaggaagagaatataccaagggggcacaattagaaattttaaaaaaatagtttttttaaaaacaggggtggggggaggaagaatataccagggccagaattaaaactacttccctgttgtgtgttagacttgctatcaagcttttgtccttccaaacgttcttaagggtttagaatcctccctgtactgctccaggatttccttgaatctttgtaggctgaaggcattttgatattgtctaccttcttggagggcagaaacacatctagcacaagtacagtgctcagtttataacagaagtttgctgttggtgatggtgttatggatcctttcctgttttaagctgatgtaaccaaaagcagaagggaaaagtgaagatttctactgcagcaaattcatggagtagatggtttgggctgctagcttgcgggtttgcaatcttaaatttccctgtagcttactagagaccaacgccttttagaaataatgccaaacacatgttgaactttagtaacctttactctgtaatgaaaatgtaactctgagcagggtgtataatcaaaaacctaatgatgaaattattgcttagaaatttaaagtttggtttgaggattcttaatgctgacatggaaagaacagtgtgaatggagaaagaggttgtgcggagggatggcagggagaaaaggacaaatagagggaaaggaagatgggtt

SEQ ID NO: 49431 - DNA, 1447 bp, Bovine  19866881189325
acttgttctatgaaaaacacattttactcaaaattttcataaaatgacaatgtctgccaaatgtacagcttgttacatccagtttaaggacttgaattctgtttatattgagtattcaaacatcacaaaacattgtgttaagcaacatttataaattattgtaatatgctgagtattggccttccaaaaacaagtcctcacgcttggatatttaaatgttacctttaaaaaaaaaaaaaaactttgcaaatataattaagaatcttgagatgaattcagaagtgccctaaatgccatcacaaagacatacacagagaagtcagtgtgaaaatggaggcacatattacagtgttggagccacaagccaaggactgtcagttcagttcagttgagtcactcagttgtgtcggactctttgcgaccccgtggactgcagcacgccaggcctccctgtcaccaactactaaaaccaggaggagaagcatggaattctccctcagaatctccagaaggagtcaaccctgtcaactccttgatttcaaacttttggtccccagaactgagagagaagaaatttctgttgttttaagtcaagtttgtggcgatttgttacagcagccctaagaaatgaatacagctattacagcacatattgtgaattcttaagctagtgattcttcatatcgatatatgaacttttgtcattagaaaagtgttagttgcttagttgtgtctgactctttgagaccctatggactgtatagcccaccaggttcctctgtccatgtaattctccagacaagaatactagggtgggttgccatttccttctccaggggaatcttcctgacccagggatcgaacccaggtctcccacattgcaggtggattctttaccatctcagccaccaggaaagactttgtcattagaatatcatgtctacagtatttactaccccgtattataagggaaaaaaaaaaaaggaaggggaagttagatacggagagcaggaaattataaagtttcagggaacaaaatataaagatctggaagaaaaaaagtaaaaattaatgaagattttttaaaccatagttcttaatgaaagtagaaattagttgttttgtcatttcctccagtcttccctgagactgcctttcaaatttatttaactgatccaccatgaaagaaggttcaatttagtattttttactttacagatgaatggcatgcttttacttcaaaagccaaattttgtgtagctcctaaatggaaagataaattagatttagatttcaagagtcaatatctttagaaatttgttcttttcctgtcctagaagaaatttaaaaaaagaaagaaacagaagagagggaacaagagaagaactagagtgtgttaatattcaggctgccaaaaaaatcactctctaatcagatttctcctctg

SEQ ID NO: 49432 - DNA, 991 bp, Bovine  19866881189614
gcatgcatatttattgaagcttttgagcaataccaacgacaatagctccactgtgattgatttctgaatactgaatgaggcaaagagaattttaaaagatttggactcactgtaacctctactcactgaagttcagattccattgctcaaagggcagatgagttcctacttaccagatgtcagcccaagcatgggatttctctctctctctcttttttttaagcttaaaggcaactccctctaaattttctttatcagcaatgaagctcaaaggaaatggctctctgtaaactatgatagtttctttatatgggatagttgtatatattcaaatctgattatctcaaaacttatctgtaaaaagtagttaactttagttcacaattcttttcaaagcaggaataatacaaatagctttatcagaaatatgcacagaatattaaaagatgaatattatttcagaaattttatgaccaataccaagataggtggtcatgaatatccaattaatcatttcaggctgtctttgtgaaggcagttatatagccttctccatgaacttctaattatgaggcgtagatattttctgaggtaagtagaaagagaaaagcccattaaaaaccttttagtatatttagtaactctattctttgattcacttcacagagtatatcttctgaatagtcttttttttttttaataagtctgaatttgtgtttctatgttcctgttaaagtctgctcagcaggatagagttctgagttaaaattttaaagagagagaaaaaatattcttgtcagcaaaattctttccacaaacaacttttaggaatctggtacaagctgttagagtattaaactacatagctttttctcttgagaacttttaagaatagctttaactcatttcaggaagagggatatcaaagcagtgaaatgtttctgcatcacttcccttggaccttcagtttacttctgaatttctgttaata

SEQ ID NO: 49433 - DNA, 1324 bp, Bovine  19866881222730
actgcagtgaacctgaaccctccatcccaccctttaacacccatgagaagctgtaagactgaatggcaatgcatgttctctatgaagtattttctaggcaccttgccctcttctcctttggaattaattgttctttatactatgttcccgttgcattttgcttttcctccacaaaaacttagttttcaaagtgtgaactgagatgtatctgattatctttccctagattggcagtattttgaagagtgatattatctcagatattcttagagccaccagtgcccaaagtagtgctttgcttgaatatagcagacccaaagtaagtggttttgtttggttgcttgactgttttgaaataaaataaattcttttttttttttaagttaaattttaccattgttgaaaaatcattagcaatgtgaactttagcatcaagaaagttcctagagacaaaaaactgtaaaatgttcttcctgttttattttttacttccgatcattttgtcattaactcatagactatgaggaaacatcagaggaaatacggcatggactatgttgctcattaggaaacccacaagagccttctcatgaactattaataacaatccagttcgattatgaggcaattttagcaattatggagagaacatgaagactaggaggaaatccctcatagagcctttagcatcagtcttttttgaaatcttgagttatagacaagtcccatgggcatctaaggcaagcctggggaaaatacaattattttaactagtaataattaaattagcaagagtgtaggcatttacttttgtcaaatcttgttcaaactttagagactttgcaagagatttaaatatatgaaaggatctttcttatctgtttgtaatctgaaattagttgcttatttaaaaaacagttgaagttgggatatatgtgattcttgaacaatcagcataatgggagcctagttatttgtttattataaattatcaaatctacatggcaagtttaaagcataaatacattgcctcatacgttttagcttttaaaaagaggaggtataaacagtgaagtgtctcacagtaagtacaggaataaatacatagaaatataggaaggggaaaggtttgtcaaacctgtaaccattttggttttacttcagccatattttaactctagatattccctgagaaaattatttaaagcaggagtcagcctattttttctacaaagagccagatagtagataaaggctttgcaggctcctacagtctttacaacaactatttaactctgccatcgcagggggaaaaacagccacg

SEQ ID NO: 49434 - DNA, 3701 bp, Bovine  19866881583150
aaatgtaatagcttgttatataggctgattatttaggccacccaagataggtgttttctttctctctgtacaccccttgctcacccagtgcctgcttcacctacacttgctcctgccccagctgatgattattttaatccatcagaacatctccacctgatagcttttcaaaggggtggtgaggggcccccctgctagtttccctggtaacccatgagccaagctgacgtcagttccccctataagtggtgatctccactctccttccggaatcaaagactgccgccatgtcctgcctcgttctgctgtgtgctgcccactgccagctgcacatggtgtggtatccctctaggactttgatttagacatgttagctactcttatgaaaccactgatgtctctgtcactgattccaggctctaaatttggtcctgaacctgggtgaacacaggcctggcagtgcaggccaacacagtccaaactgagttcaattaacataggttttttctttccttgtagctagtcgactacattttagacaaggagttaggttcagaaactttgctggggggacagggtaaactgtatacctgcaatgtttttccatttggagaagacacagagaaacgtctgtttactcaaaggaccaagagagtcacacaaacttcactaaggagcctaagtagatgtatcttctcaaacgagccactcttgagctgataatcacacacagaaggtgcctcagctcaccaccttaattacagtaacttcaacagcatcacacctctccttctccacctccctcccctgtgccctcttcagattttagatttgccttcgttttattgggagggacatcttgacttttgtcagtgaatagtactttggaagccagtcattctggaaacagcaagcaagaaagtcctaatggaaatggagatgtccttctggggttaaccatggaaacaggcatttcttttctttgcttgtggggagagagatttggcttctgtgtgtgtgtatgtgtgtgaagtcatcaaggtaacagcacattccattccagggattttaaaataatatatggctgtgaaatggaaaatggaggtaattctatacttggtaatttggtcaactttcttttgaattgtacagataatatttatttttcttgcctaatttttgccaacatggtttgtctatacaatacaaataaccagaacaaatctaaagaatgccatgagtggggccatctcttgttgtgttatgttcataatggcctttaaagttggctttagaattttaagatatatttgcagagtgtgtatttctcaaaacaacttcactgtatataaactgggtttgttttgaaggacattggacattctgcctgcttgaaatgcctcttctagaccacacatcaccttggttggaaattcctttcattagtagccagtctgatccccagagactaatttgctaagtaaacttctatatcatttaagctgtcttagactcaatttccttatttgtaaaataagaggttgaagagtctatttctctagtctattttttccgttttcttctctttcccaattgctcccttttgtgtttagtgtttttctgtattcagtttgcaaagtgttaagataattttaattatactacaatcaaaatgtcaacttctaatcttaagaaaacagattctaaagaactaggattgcccttaagcactttcttatcaagggagtgttctctctgcaaatccctgataacctttctctataaagactcaaagaagttcttaacctccacttgaactgcctttcttagacctttccatcatcttcattaccttctatgtttccactagtgggctaatggctaccagtagttgatgtagagaaagcctcaggtttatcaggtcttactgttttttggaatagcaggcagtgtaagtacagttatcttcactttcttataagcttttaaactgagaggcacacatttctgttgtgagagagagacttaattttatatacatgccacatcatctttattcattcatacatcaagggatacttaaggttatttccatatcttggctattgttaacactgttggaaaaaacatgggagtggggagggagcacaaggaaggcatatatctttttgaactagtgtttttcttttcatcagataagtacccagaagtggaattgctggatcatatggtatttgcatttttaattttttgaggagcctctatgctactttccatagtggttgcactaatttatagtcccaccagcaatgcacttggagcttccttggtggctcagtagtaaagaatccacttgcaaatgcaggagacagattagatccctggtccgggaagatcccacataccatgaagcaactaagcccatgcaccacaactactgagcctgtgctctgcagcaagagaagccactgcaatgagaagcccgcacaccacaactagagaataaaccctgctcaccctgactagagaaagcccatgtagcaacaaagacccagcacgggcaataaataaataaaataaataaataaaattctcttaaaaaactgtatgtgggttcccttttctccacatcctcatcaactcttgattatttcttgtctttttggtaatgaccaaatagcaaggtaatatttcataggttttgatttacatttccctgatgattagttatactaaggatcttttcatgcaactattgcatatctttttgtcttctttggaaaaaaaatgactattctagatcctctgctcatttttgttctcctctcatttttaaatttattattattttgctattgatttgcatgaattctttatatatttcaaaaatattttctcccattcagtaggttgcctttagttttgttgatggtttctttttagatttctacagtcccacttgtttattttttattttgttgcctctacttttggtgtcaaatccaaaaaactattgccaagatggatgttaagaagctcattatctatgttttcttttaaaagttttatgatttcaggtcttacatacaaatctttactgcatttgagttatctttcgtgtataatgtaagacagtggtctaatttcattcttttgcatgtggctgtccaatattcccagcacccatttattgaagagactgtcctttccctcattgtatattctcgttgcctttgttataaattaattgaccatacatgtgtgggtttatttctgggctctctattctgttccatcgatttatttgtttttataggaataccatactgttttgattaccatagctttgtaatatagtttgaaatcagggcatgtgatgcttctagatttgtgtttctttctcaagattgccttggctattcaggtgagattgtcagcttttcctgaaaaaacacattccaccttatagttaggtatatttccacatggtacaagacatcttatgagtatccattatgtgttagccatcaggctgggttccaggtgggaaatatagaaagctaaactgtatgcttgtttctagcaactcagcttctagcaatggagctcctcttgctcctgatacacctaataatttatgtaccattaaatgtatagtgcaggtaaaattgccatgttagtcttaataacacctattccac

SEQ ID NO: 49435 - DNA, 1305 bp, Bovine  19866881599425
gaaaaaaagagaaagtaatttatatctgtaactgtatgtgccatcagagattacccttttgaacattgcgggaaaacatttctaatatattcatattgatttacaatttttgtcacttatccatccctttggaacgttaataatgaaagaagctgcaaaaaaaaaaaaaattcagggcaccgtcattactaattttaaaacccacattggcagctggtggcacagtgtgggccctacaaatattttttaaagtatgagctccctctagtggccaaaatagtccttatcacctgatcaaatctgtgccacctattcatatttaactaattttaatggtaaaaaagtttaacttctagaactgaatttgtactttaaaatatttctttgccatctgaatatgcccaataatattcacagtaaatttaaacatctactattattgttatgatttgtaattatcagttttcaataacgtgtttattgagtttcagatcacaccaaaatgcaattatcacttaattaatgtacaagctaatttcctagatatatccccaagaagtgaggtcatcatttgtcactctataaaatgtcctcatcgatgaacctatatcctcttaaaactagttcagtttgaaactattccaaaaatatacatttcccaaccaaatcccatcatcccttgcagtgagggatcactctgagtggattccattgaatcacttctccccgcgggacagagtcagacaaaagcgggatttggaggagttaggggagtgaacgcaagactaatactgtctactgtgtctactgtacgtcaggtgttaggttttatgctttacatccattatctcatttgaagctctagagggatgatattcggttcctctactatttaacacaaattttccagactcttacaagtcataataaggcttagaagaaaagtagccatcttctttgcatctctgggttagggtacacagagccaagtggggagaccaataaggacgcagatgagtgtcctcactgggcaggtggaaacccaggcgctgggaaacccccaggaggggctcttcagcccaactgcagaggaggagggtggcaagcagcagggagagttgccttgaagagcaggggatataagtggagtgtttaaggatgctgaggagttggcctggcagagggacagtatgtgcaaaggcctggatggagtcagaagagagcgttaatgcatgttggctgacacttagggaagggtgaatggttaacattccattgtcaagagaccaagtcgacaccagagaa

SEQ ID NO: 49436 - DNA, 874 bp, Bovine  19866881735013
tcttgtaatatttgctgatggttcccagatgaggacgatgtctcttatacaagcatcagtgaacaagccctgtcaagacaagcccagggctggcattatttgcatttgttgatcagcgactctggagagctgtaaagactctgacccaaacagtgactcagaaaaccaggggcccatgtcattatgctctagactcggccttgcagcattgcagtcttgtgactcgacagtcctgcagcttgcttgcctgtcattttcattgactgatggtgctgagtgaaactctcaacaattcagtgttcacacaccagcttctcagcttttcctcctgtagtgcttgcttgatcagaggccgaggacaacagtttaatgattcataggctttcttggcaagtaatcattttctcacagtgctcatatactctgggagaggggtaaggaatgttgatttgctttttaaaaaatttttttaatttaaactttctattaacatgaggttgacagggttactttgtctccatttgcaagtccttctaaaaaatatttaaaaacatttttgtttatgtagcttgggacccttaaacgtatgttatccattgagaacagaatatgataatcccattacgttctttattttttaagaaaagaaaaattattttgtaagttccttccttattttggtacatgaggactaggtatgcttcataaaagtttaaagcagagaggtccccccaccacaactccattttatagatgagaaaactgccccagagaaattgtatgatatttctattgccatagaactggtcagtggcagagatagatcagggctgaaatcagccaatttgaggctactggcttatctgatgttagg

SEQ ID NO: 49437 - DNA, 1406 bp, Bovine  19866881881597
acagttgaaaagatgtcattgtaagttaatacaacaaacagaatctggaaaaaattcttcccaaatgtatttggccatgaagaaggaagtgggtcagaaaattatgacccctgcatatttagcctaacatacatcctcattccagacaactaattgtgagctattgaaaagggaagcctaaagagagtatcataaaaagacattctcatagcttcttctctgaagattctataaatagactggaaataatctccaggggacttttgcaacagcttgtggactggtagcagtaattaacagaatccaaataaaatgcaatctcccacttaaacactgttacaatttcttatttttctttaaaattgtgattatttgttgctagcttccttggctcaaaaggtgtatttaaattgccctacttctgctccctgtatatcaaagagtgggaaaaaaatacaatctagtgagccagaaaggaaaacatttctataagcatataattttactttaaaactggcgaagcaaatagaaataactaaaaatattatatctttgatttccatattcattacctccatgagattatatgtagtagtttcagtaactggctttttatttctaactaactgtatgtaaaaaagttcaagcataaatcccaaaaagggggaattttacttagctattagaaagaatagtcttcctttaggggactctaaaatactggaagaaaaaaacaaggaagttacagaatcttattttatgagattataaagaagaaagtcacaatttgaaggatagtttatcaatatttcccaaagaaagatatgaattctcttatatttcataaattcactaatggcatgacactgtacattttaagagggtgatgggaccactctgttgcagaaaatttttgcctagtaatggttcataaatgctctaaatttctaattttctttgtgcttttgagtagcaagatgatcctgaaaatcataatcaataaatgaggttactgaataaatgagattcataataaaataagacacagaaagcaattaggtttccaagctactagtgaatatgtgtataaagtgcaaattctgtggggtctcctttaaggcatttttttgtttcactctgagatcttaaaaactacatatgtaattttagaatctttgtgcatgtgaatgtgtgtgttcaaaaccaaaactgaaattaataatgggattttatctacacatagatacactaataggtatctgcattagtttaataggcaaggtaccacaagctgggtggcttatacaaaaaaaccaatacaatattgaaaagtaaaaaaattaattaattaaaaaaaaagaaatttattatctcacagttgaggctggaaggccagtattaaggtg

SEQ ID NO: 49438 - DNA, 968 bp, Bovine  19866881933728
tgagatataaattataagtagttcagaaaagagaaagcaagctagagcgaaatataatacggagctaagaacaaaccaagtataaaaacacattccataaaagcctacatagtacctacaaaaggaccatgaatctgatactaattggcatcctagcagccaagaaaaaaacactgcttgatcaattatataacttagagagtccttgacataaaaagagactaattggacagaaaaaaaccttaactattgctggtaataaggacagacaggaatttctcctgagggtgtaacgttatgaacaaaaaaacccaataaaccacctcttagtagacacaagaatattttgtgtggggctatttcatccagcaattcttggtgtgagcagatggcatcttgccaaaactctggttggtaacaacaatttgatgagcgctagtcactgcttagcctcttacaatgtgctccgtggaaaagtgtgccttacaaagctcaggagaggagagaaggcaatcagtgtagacagcctagttggaggagaggccgacacttacatccccatctacatggaatgtaagctgacggagccatattcctcccagagaggaagtgaatactgcctagaaaattcagttccagagaagataaattgtgctagcatgtttttcatatacaatctttaattagcattagcacactagggcagtaaacaattccccaagtccagttggtcttcctgtggcgcagaaaggccaggtccagcctaaagcatactgcgtggtaacgttctaattctggacctgaaagtggtaggaatagacaactactgttgccctacatttgggtctaaagaatatactttaaatttaataacatcaagaagactttccaagaagtacttttttcgatggcagctgttatacaagagtcagtttctaaaatattttagatgttttgtaaatctctgt

SEQ ID NO: 49439 - DNA, 837 bp, Bovine  19866881948497
ctgaggctatgaaaatgttggacttacttctgcatttaagggattgtggaacagccgaatttagggtggctgtcattagaatgatttccaaacaaaactctaaatgaggtcgctccccccttgagagatcttattcaccacttgcccccaacatccgcagctcagatcagtaggccttccaaacgagtttccccctttcatcctctcccctccaccatgtctcccatcagtaacatttcagatcctcttagcacttttattagtccgctgggcctcttcctgaaggtcacattaagatgttaatagtggtttagtgggtttccctgcccaggagtctttaaaaaaacaaacatataaacttttcaatgagaaatgaagctaactaccagtgctctccttctaagcaggggaattttgtgcctctcgaaggagagtgaatgtgagggtttagtgctttcctatactcatccaataccccagacacaacccccatgtttactttaaaaaaaaaaaaaaactggttgtgccagatattttatttgtgcttccaatggcactctgaatctgaacactcaaataatccccatgcccaatttagaaggcttgagtctgttcagccctctctcttcccccaggactccccagacatcaatttgaatttcgaagacacagcccttgaccctgcattgcataactaccctggagggagagatgatctctccccttcacataaccttgttctcttctagagaaacagctctgcaagattaaatactcttgagggagagtgacattactgaggagaggatagttaaattgttccctcaaaatccaatg

SEQ ID NO: 49440 - DNA, 734 bp, Bovine  19866881968189
aatacctttgatacagtatttgtgtgccaagcactgtgctgaattctttgcagtaatcattccttctaatcctttaccaccaggtaagtactgttatatatattttataggtaaggaaacacaggtcacattgcattattatttatgttagattacatcgcctctccccacctacctgtaatcctctcaagaactgcaaacaggttgcctgtctcttggtatcctagtttccccacacatagtagtaactcaaaggagcaaattgttgatgttaatggccagtattactttctgtctgctccacaagatggaattttaagcatgaatacagagttgtgctctataggccatctttaaagccctggaaacctcacatcaggccagggaaatgtagtgtgaagagaaggaataatgcacatgtgagacttgccattttgagagtccatggatgttggttttgaaacacggaaagctttgcttcaacatttgtttcaaagaggaagaaaatgttgaaagtttttttaaatgttaggcacattgtgattatttgaatattctctcgtgttgatttcctgcattacatctttgaaagtgtcctgattttcgtaagtattccagtgctgagtggtatttcctgtctcagcataaaaaatgggttttaacttgcaaccagaagtgtcagaatcagttgcagtgatggagatgttgaggcagtgatgagcacgtgaaataca

SEQ ID NO: 49441 - DNA, 812 bp, Bovine  19866882113716
gtttaaaagagctattgagaatcgcctggatggtggtttttgaataaccagtttgcttttcgagttggaactccgctattacaagggattcgtatccatcgcggcagctggggtcctgggtcaggccagcgggctcccttaagggtgataacatgtttggcaagatacacctcgacggaaacgccttaacgtcggctctggggagtatgacttcgtgatggaataatgatgcatctgaagtagtggacagtgagaagactaagcttgtaaagatctgcaacttggtgactttcaaagcaatacttgaacaaagagttattggcttgaaccaaccgtctttttcactccagagtgtgacccatttccctacaatgagcagaaaaataaaactgtttgagaattcagagccagcaccaggagaaatgaaccattctttcgactgcttctcacctccataaacgaaaggttattcttttcaggatcactaaatgtaaacgaaaaaaggtagtctgatttggacacgagtgaaaactttgggagcaaaaatgtaggtggtaggagaatgcttataagagtatgtgtaagtgtgtgtatccttgatttttgcccctaccttctccccctccattatttaaatcagcgcgctgtctttcacgcacaaatagcgtctggtatttccgcgacaagagatgcagttggagataccctgggtttccttatagaagctttttctctaacccaagttaggcttgggagcgttcatggatcttgggtatttctcaatatgtaatttctccttaaaaattggaata

SEQ ID NO: 49442 - DNA, 877 bp, Bovine  19866880353904
tattcttgcctggaaaatccccatggacagaggagcctggcaggctataccccttggggtcccaaagagttgaacacgactgagcaatcacctttacctcatacatcatttatatgtttcttcctctatattagtttttcttttttaaattaaagagttagtatcttatctatccttgtctcttcttgaaatatagtagtatttgaagtagtcaatagtttttaaatgggtcattcattttggctgctgctgacataattaaattcatttttttaaaggaactaccaggtgctgttaattttgttgatcattggtatttattagataaaagtggctgtctttctgtataattcagaaacctgtggattaagatgtacagaaagtaactgatattttcagtctggaatagatatgagtgatttcagtgaagaattgataagacccacgacagaggatgaacagggagaaccgtgtgtgcgctctggttcaggaatgtgtttcccttggctccagaagcatatagaatccataggtaagtaaaataacgtataaccatttcagctttaatgaagtagatgataagattcaatatggatacaaaatcagatagccaagctggttcaattttcaagataagaatatatgaggattttttttaaggcagttaataaaaaagacacaggaaaaaaatattatttttttctcatagaattctttgaattaataacagtctgtattgtggtcgataccctttttttttttcttccagtaactcttctgagcattttactatatccctggcattggcttaatactggggacagatttgttgaagaagataagatctctgctattgaggaatacataccagaaattt

SEQ ID NO: 49443 - DNA, 1401 bp, Bovine  19866880383108
ataaaattttagtgatctttaagtaaacatttttagcgtaacagcctttgcgaccagatattttttaaaaatcaagcttataaataccattgctctatattcaactggtgtacactaaaaataggataataaatggaaatacatgttcttatagcatttccataggaaatgttcatacttttcacaacattctaaatcatttagcagtaacatatgctacatgaactaaaacacaggtatttttttattgcacatttcaaagttgtaaggaggctccagcttacaagatggttttttattttaggggggaaatgatatttttttaattgtttggctcaaaaatgcacactgccagggcagcttagatttaaaaacaaaccttttaaaatcagcttttggattttgaagccaatgaaaaccttaactgtaacgaatagtgcacagtctactttctctcagactgaatgtccaaggtcagttatgggctctgttttaaagccggtgagcagtcctggctagcgccctgagaggcaggcgggggctcatctctggagccggagggcggtaagtctctggcagcagaggaaggtggataatcctggggcccatgattgggggggtggtaatcgggtaccaggaaaaaagtactctcttgggccaagagagcctaaaggtctaaaaggtgcatgtcctggtggtaaaaattctcgagggtcgagaggcaggtcccgttttcccggtggaacacctggtgcatattctcttaagcctagcggtggacgcataccaggacctgaaaaaattaaaattaagtcatgtaaatacatacgaacacacttaaatttagacagttcccggtatgttaatcaatttcttatacccctggaagtcaggtggtggctcccgactttactgatgaggcaaacaggctcagcaagtttaagttacatgcctgtggccagccagtcacaaagcaacagaggctggacttcaatatcgctctacctagctggtgggttttgtcaactatacaattctgctgtctgtatcttgtaagagcttgatttgtactcagaaatactatgcatcataccaagatgacagattatgaaataagggtttcactgtaagtaaattttgataaaggaaatcccatagttactgtgtcaattaaaaatgcacacaggagctcagcatggacctacacatgccatcaaaatcaaggtgtctgccctgctgggaaaggcctgccagctccacctagttgaattcagcaactttcgacctattagctgttacatttctaccttcaacacttccttcctatttattcccaaggtgggtagtgatggcttcatctttccttttatactctgtgacccattgcttatgcttctatta

SEQ ID NO: 49444 - DNA, 4137 bp, Bovine  19866880428362
tgaatgggtggggaggagagaagctccctaagtgatgtgcttctcatacagacacacacacacacacacacacacacatatacacacatgcacacgcacgcacgcacacacacattccagcttggaaacccagggcagagggcccagaagcccttcaaaaaggacaacatttttttctaagtttggcccagccaattccaatttaaaactcttctgagttccaaaacaatggtatgatggagttggggtggccagagctccaggccgtgccttctgacctcagagggataacagagccctgagcctgccatgtagagccaattctggaggtgctcaaccccgagggggtggaggtccccacacctctgagattctacagaagtatcactggaagggtgacaggtctacttgttgtgttgtattttctttcaattttaaaatcaaatagtagttgcgcatgtatccatgttagtgggtgtttgtgtgggatggagtaaaagacatgtcagagtcactcagaaagctttgtcaaaatcaacagctaacctttcccctaccagcccctaagatgccaggattctgattcaatcattctggggtggcatctggacatagtcctttgatttaaaaaagccaggtaactctgacaccacccttccagttgagagtaccagtgataaaatatccgtgggaccctatctatctattcacaagtcgtttgtttaaagcaactcagaactcttccaggcatggcaggaacattcagtccacaagaggcatccatgtcacctgttaatagttttctaccaaagcctgttctttagtcttgcttgctgcccctgctttgctttaatccttgctctgttttattcattgcctttctccctcttctctttcttattagctgctgtggatgattcaggactcatcagcataacattcaggaagtcctcatttgccgctgccttattttaatgccccccgacccgcccacaaacatgcctctctaggacctttagctctttcactgtgattctctggctgcctgtgtttcccacagcggtgcagggaaggggcttggctgagggtgtcctctccttgtcagccacactctgtcctgcctgggctgttccctgcccctccctggtgtcctcgtcatctcctcactgggtgtctctgcttttctaggcaccactgcagagagcagtggttctcacacttttctttttttttttttggttctcagacttaaacttcatcagaattccctaaaggaattgttagaacagactcctgggcccccacctctggattttctgatttctaagtctggggtggagcccaagaattggctttcctaacaatttcccatacgatgcaaatgccactggtctggggaccacactttgaaaaccactggtgaagaagcaaggacaggtttagagagcagctcagttggctacactttccattaaaaaggtagcccctggccactgagtgacccagacaacttatttgccttctgagagactcagttttctcagctatagaaataagacaataatagcctcacagaactgttttagggattaaataagatactgtttcctggcttctgttaaaagcagaatttttattttattttttacatatatattcttttccattatggtttatcagaggatattgaatctagctccctgtgctatacagcaggacctttatccattctatatataatagtgtgactctgataatcccaaactcccatacttcccttccctgccaccagcccaggcaaccacaagtctgttctccatgactgtgattctgtttctgtttcacaaataacttcatttgtgttgtatttgagattcaacatgcaagtgatatcatatggtatttgtctttctctttctgacttacttcacttagtataatcatctctagatccatccatgttgctgcaaatggcactatttcattctttttacggctgagtagtattccattgtgtacatgtaccacatctttttatcccttcttctgtcaatggacatttagatggagaaacagaatctattaaatgagattagaagactgagcactctttgccagtcattagtagccatgcaaggagcactgcccaccaatgccattgtcgtttggcaatctggaatgagtggccttggctcatgtgggaaaccacttaaatgtacagagtggcaggattgggtcaccttcccctgacacttaggctctccagaatgtactgtctagggacttccctggtggtccagtggttaagactctgtgctccccctaaggcaggggtcatgggttcaatccttgatcagggaaccaagatcctgcatgccacactgcactaccaaaataaataaaataaaataaatagatgttatctgcttgaaggaaaaattatgatgtacaaagagaaaaatttatgtgctgtctaaatagagaaggaaagaaaaaccactttcatcttcctggttctcattcccctccctcccttactcatgccattcaatctgaaatcccatggctaattccaagaggtacattttgtccttagaaggaatgtacagggcttgcattcctgtgctcataagagagtgtggtctaatgggtaagtagtgggagtggcagggaggtgggttctatttaaagcctccccactgactcactgaggcatcctagagaaacggcttcattcctctgggccttgggtttcctctcattaaagggaggagagctaactccttagcagggcatgcctgaggacggggtagtcaatgtgagaagcacttggaggaggagaggcatgtggtcatagcaaatacggaatctggagagggacactctttctccaccttctcctaagtattacaaaatgcctacctccatccagtgaggctggccaaggctctatcctgacccatctgaagccctgaccttcggaaacagtgcaaataatgagaattttgtgagccctcctgctgaaacagcattgccctctccttctcctctctgaggtttgggggaggcagactgggggaccaggagagccccggcccaagagactgaaataagatatctgcacatgcctctgtctgtctccaccttggacctggggccagagcctgcctgactcaagagtttaaaatgctaatgatatccaacaccccttccaactctttgacacccccataactctgaaccatgaggtctttcccaacatggtcaagaattcaaggaagagaacaatagctctgttcccactcagagacacagcacctgcactcagtcctttctgccttcccctggagagagtctctgtattgtcctctcactgcttcacccagtggtttttgagtccctgcttgcctccgtctggcgactagcctagacctgggaattggagtccacaagttctgccttcaaagctcttacctcaagcaaaagaaatcaggaagagctcttccttctactcagggggtgtagttttagaagagtccggaaaaacttaaataaagtttaaatttatgtgcctaatggctgcacaggagcacagtgaacccttctgaggagtttggaaagacctttggagaacagaagggaagaaaaaagaagctctctctaataaggcagcagaaaggaaaaatggtcgcgggggtttattgattcatcttgccaggtaccaagtgagttgcttcacatacatctgcttaccctctatcaatttcatgaagtagatttttttttcacaagttaaagttaactacagttgtgcataataaatttccttatgctcccagagctagttcgtgggagggccagtgctccaatcaatgtggttcagactctaatgcaatgcctcccaaagacagaacatctgatctggtctcaaatagtcactaagattttccctggaagagaatgggcagtttccccagatccagagaggaggctaaatcaacaaagtcccagaggtaagatttggtgagcagccaggatttaagaactgatgcaggcagtgtcaggaaatgacataaaaagggcaccggggagggggcacagccaaagctcctgtgtgtccctccaggccatgaggtg

SEQ ID NO: 49445 - DNA, 2183 bp, Bovine  19866880441842
ctgtttgaaaagatgaaaagatgaatctccttatgtttgtactcagaatctctagttaggggcaagattattcacaggctaattttgtgtaggaatcacgttttgacagcatatcgatatcagtagatgtgtttgctctgggaaggaagaaaaaaaaagcacatcttgcagatcaggagaaaacacgagttgcttcttctcaagtgtatcactgtaatgtttttacataggtcaaaaggttatatgcgggcttccctgtggctcagaggttaaagcgtctgccttcaatgtgggagactcgggttcgatccctgggccgggaagatcccctggagaaggaaatggcaccccactccagaattcttgcctccgtggacggagaagcctagtaggctgcagtccatggggtcgcaaagagtcggacacgactgagcgacttcactttccctcatagttcagttggtaaataattcgcctgtaatgcgggagacctgagtttgatccctgggttgggaggattccctggagaagggaatggaaacccagaggagcctggtgggctacagtccatggtatcgcagagtcagacataactagcaactatacatttttttcttttttcttttcttttactataactggacaagttgatactaaaatccatatggagaaagtaaacatatagtaatagttataacaatattgtaaaagaaagaccatggggagggagaactagttttttttttttagtttcttttttaactttatttttaattggaggataattgccttacaatattgtgttggcttctgccatacaacaatgtgaatcagccataagtatacatatgtctactccttcttgaacctctcccccactatccacccaatcttacccctctagattgtaacagaacaccaggttgagttcccattatagatagcaatccccattagctatatattgtatgtatggtaatgtatatgtgttgatgctactctctaaatttattccaccctctctttcccctactgtgttgaaaatttgctctctatatctgcctctctatttctgtcttgtaaataggttcattagcaccattttttctagattccatatatatataagtatatatatactcacacacatatatgtgtgtgtgttaatatatgatatttgtttttctttttctgactcttcactctgtataactggctctaggttcatccacctcactagaacagactcaaatgtgttcctttttgtgtctgagtaatattccatcattcacatgtactgtaaattgatacagcccctatggagaaaagtatggagactccttaaagaactaggaataaaaccaccatatgaccccactacagggcttatatgctgagaaaaccataactgaaaaagacgtatgtaccgacaatgttcatagcagcactgtttacaatagctaggacatggaagcaacctcgatgtccattgacagatgaatggataaagaagttgtgggacaactgaaacatgcagccatgcctactaacaatactaatgtatgaatagacagaatgccaatggaatgaaacaagtctagaaacacattgaattatatatgaaaacttagtatataaaaaggcagtatctcatattaatggggaaagaagtttttaatagattgtatcaaaataactgaatatccttttgaaaagtataaattatatcattttctcacatcatatttaagagtaaattcctattagaacaaacaaatgtaccaaatatatgactatccaagtattagaagaaaattcttttataaccctgagtataaggaaaggctgtccatgacaataaatcatcactatttttttaaagataaatttgctattaaaattttttaaatgtgaaaaatcatggtaaataaaataaagtcacaagaaaacaaatggattgggagaaaaaaattgtagtggtgtattctagatgactagtaacactgaaacacaaagactttgtttcttttttaatgtaatcattacatataaagactttattttttaaattttttaatataaatttatttatcttaattggaggctaattacttgtgaggcaaaaaacccaaaattgcaagatacatgaaaaaagcccaaaaatatactaacggcttttaaag

SEQ ID NO: 49446 - DNA, 1434 bp, Bovine  19866880460064
aataaagtgataagattgatgatgaaggcctctgtgctgagaatggcagaacacagaaatggaaagagctggatccttgaggatatcattgtgcctcctgatctcaggaggcaagttaactgatcttaggaacatcaagacactgttattaatgggtcaatatttattaattgattatttgttaacttgcaactgaaaatgctctaaaatatggtgacgcatacaagagatagtagacagagctctagagatgtagtttaaagtaagtgagaggtaaagtgcatgtgactagagctaagaatataaaagttggaaagagttgagtatgagtggtatattagtagcctcatagtgtcataagctaggggtggttggtataactgcagtgattagaaccaggcatctttagcaagagaatacgtcacagaggatatgattttatttctcctctgttctaggcttctaaacttggtgactgctttttaaaagcttgtcatttccactttgggtgtttttcattaccattattctgttaccaaggatgggaaatggggagcagagagagctggcaggggacaagattcactgttaacaagtaaaagactttcagatgttcctgagtgcagaaaatgttccattatgtcacagaatcattgtatcccaagaatccattgctttcagaccttgttaagatgatgacttcctgcagtgacacacacagccctaaggcactgtcagctctgccaggtggtgacgggaattattttctttagcaaggagccccacatacctcatcccacctttgctttagtgacttttattcgccagggttttcaggaaaagaatggatctgcaactcaccagagcccagaaggactgagctcttgaaccaaggaaggatggatttttcctttacccaggcatacttcttctggtcttctagagttgtgtttttaatttgcaggtcatgaaaccaatttatgagggtgagatcagtatttagaaaagacaaacagaatgcaataacatccattagaaaaaatagaaaagaatataattgaatagagcaaagtatcagagaatgcaaaaaatatgttcagagcatcaaaataaaaggtttacttaaaggtttactttagttttagatgtattctcaaaaatacattttcaactttaactttttttgtttcattacctctgattggaggtggcaaatattgaaagaaataaaaaatatatctttcaaaattcacaaaactgaataataaatatataataaattcaaataaacgttcaaatgatgctattctgtctggagcattcatttttctgaagttattagagcttgaaatggcagtcggacatttgaagctatctatattggtttgtgaaagttggtttcagttttgagtttgtgtggtgtgttggtaaaaa

SEQ ID NO: 49447 - DNA, 1592 bp, Bovine  19866880465321
ggaacctatgaagcagaacgactataaaataaacagtatcccagaaatttaatatgcttggttcatttattcatcacacaccagaggaagtcaaaagatagctactttctcttctgatcattatttttttgttgtcatttgcaagcaaacctacaatactcaaaacaaaaattatctcctaataaatattctctctctgaaatcagcttttttaaaaaaattatttatcagagtatagttgttttataatattgcgctagcttctgttatacaatgaagtgaatcagctatgtatatacctatatccccttcctcttagatattcttccctaccatcacaaccatctgtcactggagagcaccaagctgagctccttgtgctatatagcaggttcccactagctatctactttacacagggtagtgtataaatgtcaatccccatctcccaattcatcccacccccttgtcccatcttcatgtccatgcatccattctctacatctgcttctctattcctaccctgaaaataggttcacctgtaccatttttctagatcccatatacatgtgttaatatatgatatttgttttactctttctgacatcactctgtatgacagactaggtccatccacatctctaaccaatgagtcaactgtgcaaccaaaatatccactgataaatggataaagaagatgtggtacttatattcaatggaatattattcagctataaaatgaaatcagcttttgatgaatgttcctaaccctgctcagtttagtggatgaagtgggtcacgtgatccagtcttgccacttgcttagatcagagtttgatctacatgactcacatctcatctagttttacatcacccattcccatagctccggatactcaggaagcatactcattggagagggtcatggaaaataatagcaattgtcttgcctccactatctacaatgactggtgagccattaggtgagatttgttttcataagccaggctcttgggacactagaactgcattgcttctatgcagagtcacaaacactctgagttgtgccagacaccggcgagtaagtctggatggatggatcagtgagtatgaaccccctgtattctccatattccccatgcaatccatcctcacccccagtacagagaaaacaattcacagcgcttgccctggtcacagctgggatgcagaaacagattccacaatcctgccttacagacataatgtaactggcaaaatatggtaccccttctaaacaaacaaggctgtgggtgaggagagctgtcttcttctatggaagtgagcacttcgtcatgactcctgcagacctcgatgaagtcagagggatggaggatgagttttcactgcaggccagctcccgtccaagagcaaattcttccttaagagagctaatgccctgttcattacccttgtaacctgagagaaaaccaacaccccaacagcctacgatcttactagcaaatctactgattcattagtaggatatggaccacttcttataccaaatgccttacctctctgtagccattttcactgaaacaatcatgatt

SEQ ID NO: 49448 - DNA, 1542 bp, Bovine  19866880486068
catccaggcagcttgttaacaatgcagaatcaggctactccccaaagcccctatagaatctgaattttcacaagatcccaggtgatgcatatgcttattacgagtttcataatcaatgctgtgaacaaactctcccgacaaaacgtagaaactctgccccaggatgacgcagagtgtatccagtcaatcaatcagccaaatactgcctgacagtctgctctgggcatgatcccaatgaggtggccaaagcagaatctgaacactagaatactaacacaacagaatgagagtttggcagtagttccctggaagacatgggacacaccacaaaggggccaatgagagaggaaacttgggccacaatgagatttgtctctaaaggagccctgggagtcagaaatatattagtaaagcaatgattatgccttcagcctctgcagaccttcccaaagtgcttcccctaataagggagcaggcagatctgaatgaagatgttaaattagagattacatgaaataagctagcagtgcatgagagtggagcaaaaacaagagaaaacaggagacagaggcctgtccctagccatgactttagtaaccagtctcagggctgccagaggcaatcttcatcaacagtcgtgagtgagtgaatgagtggcttctgccgcccttgtgattctgctccagctgcagtcctaatgcctcttgggatttagtcttaaagtcaaagaaagaaacatcctgaatgaaacaaaaatttgttccctggcctctaagttcagcaatggctgatagacaggagacaggagtaagacagcaagttacttccttcaccccgcaccactcccactccttgctctgggtctggcaggaggctgaatcggtccctgggggatatttggccaagtgcagagacatttgggtttcataactagttgcgtggttactactggcacatccttggtagaagccaggtgtgctgcacaaggagttcagcccagtgctctgcgatgacctagaggggtgggaggggatgaggggaggttcgagaggaagggaatatatatgcgtatgtagctgattcacttcattgtacagcagaaactaacacaacttgtaaagcaattacagtccaatttttttttttttttttaaagatcctacaatggacaagatagcctccacaacacagaattctctgacccgaaatgctgacactgccaaggatgagacactcggctctatggcaacagccctgtgggggcgcttcctgcaagactgtcttcaggtgacagattcctgctgttgttcttcctatgggcctcaactttgggggtttctttaatctactggccccctgaagtcagcaccaacattcagttcagttcagttcagtcgctcagttgtgtccgactctttgtgaccccaggaattgcagcacgccaggccttcctgtccatcaccaactcttggagttcacccaaactcacgtccatggagtcggtgatgccatccagccacctcatcctctgtgtccccttct

SEQ ID NO: 49449 - DNA, 1225 bp, Bovine  19866880534992
ttaggttgaggccgccccgctcccccaattggctgccattgctactaaggaattcttcctcggcttaggaggctcggccagccatgctctttgtctctagaggagaccgcagctcacgaggaaagactgtggaggaatatctttaaaagggctgaggaacgaagtgttttaagggggctgcgacaacgcggcagcctccactaccgaggcggcggagcgcgccgagcctcggtagttgtcatggccgccatgggcacgtgaccgcggctcgcgcaggcttcgttccgtcgctctggttcggtagtcccggcttgccgactccctccctttctcgtttgaggagtcggacattgcctttcttccctcaggaggactgctgtacagactccgaggaatctggtaagtatgttatgaggctgaacctgtcgtctccctacagtgccgagcaatagggtcaagcctttttacaccggttccatagactcccggataagtggtctacaaaagtttcctcctagtgcctccaaacaaatgaaagaaaatccacgttagccccacgaatcaatggtggtaacaagctaggttcgctgaatccccttgcccgcgtctccactagcagtcggggtgtctcataagctatacgtaggggtttgtttaggcacctctgtccgcctctcccagttggatagtatcggctttccacaaaaatgtctgtttaggaggggctcgctaggatatgcgcctgcgcaaggtcacggcgttcaactggtctgggcaccggaggaagaggctgggtggtaaacaggaagtggaccttcggagctctggtggcggtaggtgactcggggacccagggtctccagagtgggggaccgttgtcggtagtcagacttttcttgtggcagccggtttaggcggcaggctcgatccgactgttgtgctgcgtggttttaaagacacccttccttgcatctgcaggtggggtgtgtcagtgtttttaccccaccctttcgaattcttgaaaacccggagtgcgagtctctccccggacagatcggccaggggcaaaggacagagtatttaccctacttcgttcctaagtaaaaagtgtacggaacttaaaacatttcagccactaagtgggagggcgagctaaaatagtatttgtggaaaatttaaactcacaatcagagtattgtgtgccacaatttctaggaggcttggt

SEQ ID NO: 49450 - DNA, 844 bp, Bovine  19866880589580
acccagtgcagtcaaacacagtaatacaatttttaaaaaattaaaaaaaaaaatttcaaggaaggggctatgtctgtaaagtaattcctatcccttttcttcacagacctcttgtcttttggtagccaaacctcaaaatttccacttaatctaccattttatttagcacactaagatatacttaagatataaatgaataaaagaaatcttattttgcccctggatgatctcacagaatgttgaaattaggtcaaatcttcaaatagcatgcgctatgctaaatcaaaaccacactgcaatagcacgatgaacactggatgaggcatccttttaacacctgtcttcccacactcctaagaaaggctctgaccaactgtaaaatggcgaggtaatgtgttgaaaacatatcagtcaactatgtaagaaatcagaagacaactgaggcctagaggtttatctgtgagagagttctacaatagattttacacaaagcgctgtgattagctaatgtaacatttagacaaacctatctatttagagaacaacatcagactgtgaagtctgaattctcttaaaatgctgtcaatgaacggaaacaatccatctcttacactgtcatccttgggtcttttggtgagatcaaaagcagccaatgtttctggtgtccagtgcgcacttggaggaggaaattcgaaaggtacaggttctacgagaccataatttgctttgagttccagttgtggggcttctgttggaactttttgaaagtaactgcaaaaaaaatataaacagcaattcattcattcattttttaactatttgagtgtctacctgtgtccaagag

SEQ ID NO: 49451 - DNA, 798 bp, Bovine  19866880667907
ttttaatggattctactactatatatggaatgaaaacatgtaataaatgcacagtgcttctgtaaaatgcagtaaatactggtattaacatttaatcaattggcaacttcaacataagcagatagtaaatattccgttgactcagcaaacgtgacactttttgactaaactatcccattttatatatatgtatatatatatactgtcctttgaaaatggtgttggaaatttggggaagttaacaaatgtaatgaagttgcatgaacgtcttagagagatgtaactgtttgtgttaactgttgcacacttagtttaaaccagataatgacagctaacatcctgctaaaggtgttaatacactgaattatctttttatttatgaaaataaaagtgattttacttacaatttcattggaattttttgtttttcaataaatgtttttcatgtttattaagctggtaacaaggttcatacaatgtaaaatcataattctttacagttatattttaaaatgacagatgcatttgtatctattgctcttccatgctacatgaattcattaaaatattcaatgctccttgaccttttcagtttttctttggcttactggtacttatcttttcatttcaaagcaaggtttcaaatcagcctgcatatagtctttttattttttaatatttatttatttatttggttgcaaaagaccctgatgctgggagggattgggggcaggaggagaaggggacgacagaggatgagatggctggatggcatcaatgagtcaatggacatgagtt

SEQ ID NO: 49452 - DNA, 3016 bp, Bovine  19866880675831
agaaacgtgaaaggaagagtcatctagagggcaaactgcattgctgtcttagtttaagaagttgtcacagctactccaaccttcagcaaccagcaccctgatgtcagcagccatcaacacaagaccctctaacagcaagaaagttgtgactagctaaagcctcagatgatgattagcattttttagcaataaagtattttttatagcacagggaactagtcaatatcttgtaataacctataatggaaaataatctgaaaaataatatatgtgcatcactttgctgtgtacctgaagcactgtaaatcaactatacttcaataaaaaatatatacaatgaaatacaaaaaaattttttagacataatgcttatcacacacttaacagactactgtatatgtaacttttacatgcactgggaaaccaaaaaattcgtgtgacttgctttcttgcaatattcactttattgtcatctggaactgaacctgtagtatttaccaaggtctgcctgtacttttgttaccaagaaagttatcaggataacacataaattgtatctagctgtattttaaagcttttggagtctattataaaatacatcacaatatatcagcatattacactaaagtgaactaattgaccagaaatgaaaactgtgtgctgtgtaagaacagaacagaggaaaacagtgatgggagaaataagaaatttatccagtgtgcctgcttaggttattgacaggcagggaagatcaactataaataaaaagcctcaccattatttactttctttaaaacagatgggaagaaaaaggcatttgctcagtagccattctccctgggtccagtttttaacaaccaaatttgatagtgaaccaaaaaagagttaacacagcaggtctgagacggtcactcttagaaaggcctgactacaagggcagcccctgactagcatctgggaatctggattttgggagggttgctactacctctgataagaatggtcactgggtctacattcttcttacaaacgatatggtttatgctgaattatctgcttgctttctgggagtctggaattttggtcagtgctaggcagaaggtgtctatgtaacagctctgggcagagagtcccttatgtgcctcccacttcaagggacacttcacaagtgtcattagaatttgtcactagaggaatcaagtacaagctgtgtgactccactgggagaggactcctggaagcttgcacctggtttcctctggactttgctcacatacattttcccttggctggttttgtgcctgtaattctttttctgggataaagcacagctgttggttacagcaacatgctgagtgagtccccctagtgaacttggaacctgagtgtgctctttcggatcccaacacagatagtaagataattccaggctatacctataaaacagttactgccgataacatgaccgtcaaattttgcctaaaatggacatgcaccctggaaaggttttactcccactagcaaatgctaaagtaggttccaaaaactttgactgtgaattaagctatggatatttttcacaattgatacttaccgggaactctggcaggaaaggaatcaggagatcctgctccagcaccaccctcttcttcatcttcttcaaattccaaattctcttcttcaccaggtgctaaaattcttctacatgcaaaaggacagaaaaaacagtgagctacaaaaccaaatatacaagagaagccaaatagctactcatttcccaggtaaaatgttgatataaaaaatgctgacataaaatgctaatatgttggattaatgatatcaatgatactaacattgatatgatacatccagaaatatctgaaaaataggtataaaataagatgataaaataagaagacaaatactggtgctaatttattttaccttaaagggacaggctgaacatcaaatgggaattctttattatatgtaagaatattctttaggactagaataaaaagagaaagacacatgaattatgtcatgaatcagaataaaaaaatttattgtaagtgactgattttagccaattttaccatgcctattaataatgtatgtatacgtgtgtgtgtgtgtgtgtgtgtgtgtgtgtgtgtgtgtgtgttcaattgctcagtcgtgtctgattctttgtgaccctatggaccacagcccaccaggctcctctgtccatgggttttccccagcaagaatattggagtgggttgccatttcctcttccagaggatcttccagaccccgggatcgaacccgtgtctcctgcactgcaggcagattctttactgctgagccactggggtgtctattaatactttaaatattcccaatcttatcatccaaagccacaatgcacttgtccattgaatatcttagcaaaatgaaaatattcacacttcagagtactgtcagaactccaaggaaggtaacttccagagtctcagagcgcttagggaaagtgaactccaaaatagttctaagtacaaaatccaaggtgagacatggggcacctgagaaagacaatatctccttcctagagtactttaattaaaagactggtgtcaaagatgaccaatgagagggatatgagcctatcttattctatgtcttgattagtcttcccctcaactccacaaaactggtaaagtttatagtagtgaggttataattctcatatacctttaccatagtttattatacatatgtaatgtatacatacatatatgtacatatatgcttacatacaggctcatgcatgctcagtcacgtctgactttttgtgaccccatggatactgtagcctgccaggctcctctgttcatgggattctccaggcaagaaaactggagtgggttgccatttccttctccatatatatgcacacacaaacacaaagagggatttatcctcaagagaagtctttaaacaatctcttgtattacaacctcctgtattatgt

SEQ ID NO: 49453 - DNA, 1759 bp, Bovine  19866880739696
acagctctaagacaggcagagagagagaattctctctcctccgtattttgttctacccaggccttcagtgggttgcatgaggcccacccacattgaggagggcaatatgctttactcagtctactaatctcatcctgaaacaccctcacagacatacccagcaaaatggttaaccaaacacctaggtaccatatgatcaagttaagttgacacataaaattaaccatcacaggatacggggaaaatgaagccagcagtatgttagtatggtttctgtccctcctttctgtttcctcccggcttcttcctgctgaccaagtgttgtcttaactgaatgaagtggggagaggtaggaggaaccagcaagaaaatggacaggatggatgaaacaaagagaatttctcttatttttccaaagagaatgtctaaatgagtttggggccaaagcacttttggaataagagttaatttgaagtaatctaccagtttatagaggggcatttttaatagtccttctgtattggcctatatctctagtatgataatgcatcaaatgggactgtaatatcttagtcgggatttgaaaagaattaacaaaaccaagaagagatttttttaaaaaaagaaagaaagaaagaaaaagaaaggtgttagggacttccctgatgacccagtggctaagactttgcgctcccaatggcggggacccgggttccatccttgatcaggaaactagatcccatatgccgcaactaagagttcgcatgtcacaactaaagaacctgaatgctgcaacaaagattgaagattctgcaatgccacaactaagacctggtggagccaaataaataaataaatattttttaaaaaaagagagagagagagaagcatttgtaagctcccgcaatgtccctgactttgtctcgtgcccaagagctctttgaggtaggcattgttatcctcctattacagatgtggaagggcttcctggggggcactagtggtaaggaacctgcctgtcaatgcaggagacttaagagatgcagctttgagccctggatcaggaagatcccctggaagaggaaatggcaacccagtgcagtattcttgcccggagaatcccatggacagagaaacctagagggctacagtctatacggtcacaaagagatggacacgactgaagcaactttgcacgcatgcacagatgtgaaaattgaggtagagacccgttctgccaagatggcacagtgaggaccgaccagggttagctgtctttcctggtctgccgctcttcacacctcacactcagcagctgacctgctgttaattagcaaagaatgcctccctcctttctccccatgtgcatatctctggagaacatttttctctcattagtatcaaaacgaactggagtttttagcacccaagctctagaatcaattaagcattttaatcagagatgagagttacaagaagctgtcagtagactcattcccaggcaaatactcttgcctatggctcatcacttctaataagacaataataacacttttaatcctgcactccacagttagtgagtcattcctaattacccacatctacgagagaaatctctttattaggccctgagctaatgctgtcctagaaccccttccgtgatatcaccaattctcttggacaaggtctgtcaagatgagagaaaacagggaaatatatattcatccctgagcagagagcttgcagaatacatcatatt

SEQ ID NO: 49454 - DNA, 1014 bp, Bovine  19866880755176
atggcatcaccgactcgatggacatgggtttgtgtgggctccgggagttggtgacggacagggaggcctggcgtgctgtggttcatggggtcgcaaagagtcggacatgactgagagactgaactgaactgaaaaagcaaaccaggtacttagagctggcctgaataaaacttggaaaatctaaattgatttcttggtgagcaaagaattaagagaaaaagtcagtggtatggtttcaatgtttaacagcatctggcaatagcaaccaaagcatttggaaaagattaaatttccttagcaaaagaagctttctcacagactgctataaacaccaaagagtgaactacaggaacaaacacaaatagcaactgccaccaataagctacttgtatagagagttcaggtatttttgtgaagaaaattttaaatgaactacaaaagtatatctttcaaaagatacctaactcctaatttgagatgtctatttcaaaagattaatacctaaatacaccaaacaggtatttctaaattcaaaactcccaataaccttgccatatttacgtattatatatgtatactctgaatattttaccgtattaagttcaaaaacttacaatattgtcagtaactaaatattctttttaaagtataatgattctaccaaaaatcatgtcttataaatccctcaggatttttaaaggctataagaactagaacaaatgtaagacaaataagaaggatgtaagtgacaacaacaaagaacactggaatgagcggtggagctgcagaagggtgcagattatcaaagaagcactttcagaacagcacctgttagtaccaataactaccacccttcaggtaaattacaggcaataatttctgacaattagtcaaaatggaaaaaaaatgcaagttatgggaaacagggtagaaaaggaagaagcctttatctatactaagtatagatagaaaatacaataaacaatctttaaaaaagacaagattatctacagt

SEQ ID NO: 49455 - DNA, 1252 bp, Bovine  19866880833449
tgaaacaatgaagaagtttcaaagtgaactgaagttccaggtttcactattggtaactaccagtttgttttctgcatctgtgagactgcttctgttttgttatattcatttgtcttactctttagcttccacttataagtggaagtatttgtacgtacagtatttgtaacatacagtatttgtctttgccgtaattcactaacacgacaccctccaatccacccatgttgcaaacagcaagactgcagtcttttaatgaatgaacaatactctattgcgactcaacggacatgagtttgagtaaactccaggagttggcgatggacagggaggcctggagagctgcaatccatggggttgcaagagtcagacacgactgagagactgaacctaactgaaatgaactgaatactctactgtgtgtatgtatatatatatatatatatatatatatatacacaccacgtccttatttgctacatatggagtactcgtggcttgtaaggcctgactctgaggagcagcacctggaagcagttcacttctgttggagacccccttctgtgccaggcctgatgccagcaggggacatagaacgagcccctttttccacagtcaagcagaggggacaagttaactccatcaagaccccaagaaactgtagctacttaaatctacagtgcttaaacaagtcaataaaaaggcagaaaattatgtcaaatttttacttacacttccagcccaaacttcaggtgatccccctgccagtttatagtagacatatacagtgtctccttttttaaaattcacaaaacgacaatccgggcctgtaaaatcttctagagcctcaccccggtacattagcactgtatagaaagagcggggagggaaaaagcgggtatcaggattcaactttcaaatactgatttatcaggaaacataacaatccactgtaaacaacaatcaagcttctccagtactctctgaaaccagtcagcctcagctcatatgctcagagcatctatagagctgtatcgttataaatcaagacatccccttgcaagtagccaggagagaggtaaacttgccttgtttttcctatggataatgcaaacaaaaagcaatgtgtccactgccacacatggctggtctcgagtgaaactcttggttccctctctaaccatccagctttcagtctttggtgtttcataattataaaaagcttcattttgcagtgggtaattcaagcaca

SEQ ID NO: 49456 - DNA, 1116 bp, Bovine  19866881069241
atgtccatgtcagctgtggaaaaatgtctgtttcctccccctccatccctctgatccttttctatgtttttaatttaatgtccacatccaagtgcatctcaatttttgacctgatgctggtgaatcctcttcctcttcctctcttcctctccaacattagcttttgggtttgtgaatatcctgcgggggctgctttctgtctcatctgtgacaatggagcagctcctgacacttggcacttgaggcttcatgtcactgctcccatacaatttgcctttggagttattcctgccctgttggtaagtgtgtctgagcataaaaatatgagcatgtgttcattcagtgtttactcaacagatgtttgtgaaacattgccagaggcttggcaacttacttgtccttaagggaacagagatggatgaggcatgaagtttataagctaaaattaagtcactaacatttattgagcatttatttattttcatccccattcatagctgagaaagagaagcacttgttaagttcacaccccttggaggtgggattgctggggctgtgacctaagtgatctgacctcaggtccctgctaccaacaagagctcagctctgaccccagaatgcagtgtgactcggggcatgttttcctgattctggtgtgtatcccaagttcagtagctttcctggaaatgaaaaggggttcttggaaagtaggacaaagagaaccagttgctgtcatatgcatcgctttgaagagtcaaaatttctgcatttcttttggaaagcagtctggcaggacacatcaagatactttaaaactttcaatttaattgtagctcttctgggaatttactctgaggaaggaactgaaaatatgggaaaagctttactcctggagatgatcattaaaacactacaaagacaggtagaaaatattcttacactgtattcagatgtacagaggaaactttcctttatgttttcctgtaattaacctaatccttcccaggacactcatctaactattcccaccatccccatcccctccacccacgggaaatcttcagtcgtgttggactgtttgcaaccctatggaccgtagcccaccaggctcctctg

SEQ ID NO: 49457 - DNA, 1728 bp, Bovine  19866881122751
cttgcaaatgttgtagttatatattggacagatggtttgaattccttgaggaaccagtgatgactataaaagccgacactgattcattgaatacatgtcatgctaaccttgcttcattttgggatgggatcactaaactgatagaccaggcattgatgcttgctttaattcaattttctgctgaatagcctgtgaatggaaaggggaaacagtatcttgagcattagtttcactctgaactgatcccagcaagaaattgctcaggctgagtaatgtaacagattgggtaataacaataattgtaataaaatgcactttcagagcctaaaatttagtcaataatgacatgctttacagattactgaaaaaaacagaaaagcctgattttccagacccacaagatagcctaatgcctgctaggcttttgacaaagttcttttcatgtctaagttgaagaaatagaataataaagctaactgaagtcattactggttgaaaccctgtgctgcactgcaagaatgttgacttgtgaccaggctggtcactaatgtggggtcctagaggacactgtcttcatgctctgtcctgcttgacatctatcagtgtcttcaatgagatggagaagctggcttattatattttccataagtctctagtaccaggttacatgtggaaaaatgcttgtaatttaataatatgtcatccttctttaggtttaattttgttgccataaaaataaattggaaccgtatgtctataagacacaagtgtactggctcagatgtttggaatggcggtcatgctcattacccgccttggagaaaagtcattgcaaatgatttgtaccacacgtcctgtccctggactttgtggattggttcccgactcaagggtcacctggtgactgtcgggagagttcttccactgaacttgctttgtattagacaatgactaagagaccccgaatgggtcttttatggctatttttatgtgagaaacagatgatacacagagtggcagcatatggtaagagagcacagagagggcggtgaatgaacttaagggaggaaaattgagggaacatgttggagaccagagaaagggggagttaacagaaagaaaagaatgaaagggaaagaagcctgtaggagaggtgagatagatgttggcgttattgttgggacataagcagtactcttctgtcctgaacaattttccacaaagtctgtttttttttttttttttgttcacatgccatttcttacctttagcaaaacaccttgttgtttgaggtaacccaagtgttttcttgaaaatctgaaaaagtctgaagacttaaaatgaggggatgatgtggattggtgggccaccttccagggttttagacccgtaagggattcccaggtggcacagtggtgaagaattcttctgccaaagcaggagacacaggtttgatccctggtctgggaagatcccttggagaaggaaatgacatcccactccagtattcttgcctggaaaaccccagggacagaagagcctggtgggctctctggggttgcaaagagttggatatgactgagtgagagtttacatcaaagccccaaatgggtcttgaagagatcagtccttttggtaacaaaatgaatcaaacaatgatcccatctcatccaggaagctatcactctgtttcaaccaccataaaccatttgcattttttatgtgttt

SEQ ID NO: 49458 - DNA, 656 bp, Bovine  19866881151117
gatcttgagaaagtattgtctgtaggaagaccacatgcacagttaacagtgaaaacttcccagggtatcagaggacacacacttcttccttgagggggaggagagtgaccaggaacattaatgttctgatccaattgtggaagggtgttctaggaggagggaagaatgtgtgcaatagcttgatggcctgtcattccgtcagaggggagtatgtggctcgaactgcaaataaaactgtgcttttcaaaattggacccaagtctggctggctgactccagttcacatctgtttattataccaggctgagacatggtttggataccaggtagagggtggtgcctggggtcggatggaggactcttaaggcccacgggcatgctggctcttgtttggctaggaaaagaacatccattctacagccacatttcactaaagaaagtagggctcagagagacaaagtcacttattcaagattacacaccttgtaagaggtcggctgtcacagttcagtttgttaagggtggtataaaaaagcaaaaggaagtgtcattttacatcaaactgaattgggaaaatactcatgacttcttaactttttttttccccttgcaccttgtgacatgcaggatcttagtttcttgaccagggatcaagc

SEQ ID NO: 49459 - DNA, 2016 bp, Bovine  19866881152811
aaattacaaattatactttcaaagaaagaaagtgaagtggctcagttgtgtccaactctttgcgaccccatggactgtagcctagctggctcctctgtccatccatgggattttccaggcaagagtactggagtgggttgccatttccttctccaatactttcaaaagtgttttacaaaatggcagaaatgattggcaccagaaggtcaaagggcaaagatgcccccatttgcccaggggcccatttctgagctcagggactgtagccccatattcacaccccaccctcttccctgccatacccagtgggaggcaaagggtggtctccatcttccctaagacagtgctatcctatccccaacctcaggaagccatcccaaagcacattccgccttcccacaatgaaaatctcagctcttgagacttccctcgtggtccagtggtcaagaatccaccttccaatgcagagaactcggattcgatctctagttgggggctaatatcccacatgccaaggcaactgaggccacttgccacaactgaccccgtgcactctggagccctcaagccttaagtagagaaaccggcaagctgcaaagacctcacatagccaaaaaaaaaaatcccacattacttaaaaataaagagacataaagagacaaaaatccagctttcaacatcatttccttcatcccttgagggggtgggtagcagctaaaaggggtactctatgaaaaagacaatttctattccaagtgcttattatttacctccagactcttcttttttgctttgtttttcgctttctcagtttgtttgctgagtgtgcttttgaaaaagcaagcagtacaaagaggaagagaaaggatttgtgtgattgatgactccacctgataaacaccctgccctcatgattcaatggtgccaagagcgaattgaattattctaattccaggctgtggaaccactttcctttgccaaagcataatagggagcaaatcgttggaggcacctgggccccttcctgcctttcagacagccaggtggtcatcaccactaccattctgccatgcggagacagatcgtcaaccacacagagtcttggtaacctggaattctgctttatataggaatttctcacccttctcacagggatggggaccagagtttaactcagtgttgctagctggctacacccacatgacgcatctgccttctgtccacagcatccacactccccactgatggccatggtcactccctcagctcccctacccacccaattcccccaagtagagacagatgacttgtaagagaaaaggaagcaaacaagagacctctcctgtggtctcaccatctctcctaccctgaaaggagaagcacatatccaccagcccatcatcagaagccagcagcatctctgttgttactgtaacctctgaactcttgaaacctcaggcttgagggtagggaaaaaatgcaggttttctcctcaaacctacagttgtgcaggaggacctgaaagggtaggacagcccagaaaaagagagggagggaaggaggagaaaaagaaaaagattggctggtaagaccctgcagtttgggatcaagaccccagcaagtcttcttcctacaagttcatgagcactatcctccatcatagcctttctaagggtttgagaaagagcccctagaaagagcccctgcatggggctctctggaagcccactccttctcaccccctgagccacacagcctggcctcagtctcacctgggacatatgcgtcctctcctccatgcccctctcctctctccaaggccccttggtacccacatagccttccccctcctgccttttgcttataggcccatatgctctttgcttctgttcacccagctatatcccagtcccatctatcagaaacaagtcctgacccagctggtcctcaaagaggaccagaagagctgaagaacctcaaagcagagcacaagaaggaacccagaagccacagagc

SEQ ID NO: 49460 - DNA, 694 bp, Bovine  19866881259525
tgtgtacagtgccttcctcctcccctgtgtaggacaggagggaacgggtggcgattgaagggagggggtgcccccggcaagcatcgagaccggaggtctcatcagacgaaagaaaggtcccctctcgcgccccttctccacccctctttctgagtagccttgttttcccaattcacctcgaatccgtttcggtttctaggactgttatttgctaggctgggtgagtcccacccgcccctcgctccgttgctctgggtggagtccgcgcaggatgtgaacagaagagagcaaaatgtgaattaatagaccacgcacaggagccaccactccctcttcgggtccctcctccttttcctgtgtataatgtatagccgccgggtacaagtgagcaccaggttctttgatctccccaagtccagttttctttccttttctggtttcctcccaaaacttcagggatgtttttaaaattataaggctaggtttgcgtatatataaaaccttgcttggtttcttgcacattttactgaactgcctgctaaaatgctattgtttgcaaactgttgacattaattacttcttggtttaaagtaagttattgttttgaaaccatgtgttagtaaaacatttttttttttccttctcaaacgtcttttgcaaagaatacaggattggtccttgaaagatctaaatc

SEQ ID NO: 49461 - DNA, 1470 bp, Bovine  19866881404171
tggccctttccccaaacacaatcataacgtcagattgacttagtaggacgagagtctaccattagtcatgccctataactggaacactgtctaccaataatctagacaaagaacagtacttgtcaccactccagaccccacctcttttcacagagggtttcctcttgagtctttatctccttccatgacacctaaccttggtcagtatcatttcagttcattctacctcatttttatatcactgaaccttggagaaggagttccaatctgagtcactttcctcccaggagtcatctctaccttttgtagattgatggatgctaaagagtatgtgcccagctctatctggcagctcccaagatccaaagatacgttgggaaagggctaactaacttcccttccaatgatgtttaaacccaagatccttgccagccaaaagtatccccaactaaccagttaagtagcaaaagtttgttgatttaatcgatcaactaaattttaatgatcattctgatttcttaatgttttaggttactgccaccacacttcattgggtgtagtacaggcaaatcaaagttcattttattatctttcttttctaatgatggagtcaccctaaaccttaaccttgagagtggaaattcaagaagtctgaagtgatgagagaagctgtctggcaaatgcacgcaggcgtctaccctttatctccataccgccaaacatcatttgagcatcttaccctggatgaacagcctgccaagaattgcttgggtctttttcatctttgcaggcttgtgggagatgatacccttcaattattcctgtaaaagtttctgtcttctgccaaactgccccatctccaaccacaagatataattatttattatacctacagcaaaatgaaggcaaccacacctttaaccattctgtttctcaggcaacttatgcaggcttgccaagagctagcaaacacagttatcagcttttcaggcacaagaggaaaaagaatgttgaaatctctttagggaaaatcttctgtatatgatttcatttatgttggggacaaagtgggagtgacatcagtctgaatttaatttgagtggacaggatttatactgagaaaaagaagattaaggttccccaacaaatcatttgaaaggaagtggacacaatttacctgacacatttactttgtcatcttcaagacggcctcaggccaacaagctgtataaatcagggcaaagtagtagaaacaaaattctatttagaattgagtggatttctgtataaaatgtcttctaagataaatgtttcctgatggtctttagcggtcttggggaaaaagtttcagtaacagagaaaaatgactcccaagaacaaaatgtctcccaagaatgccttgatggtggggaacatacatcttcaagttcaatgaaaggtagttcttgaaactttatttctgtttattta

SEQ ID NO: 49462 - DNA, 881 bp, Bovine  19866881595572
aagctgcaacttgctcagtgtcacagggaccggggctgcatcaaacttttgcctaatagttctctttgagtcaaaaattggaaagtcttaactatatatatacacacacatatatttatgtgtgtgtgtatgtgtgtgtgtattatctccccatgtgattcttggttgtcagttgagatccactctcagtagactatctcgggccatctcctccagttctgagatgttttattttatttagaatacgtaacctgagatccactctcttaaaaagtttaagtgtgcagtacagtatagtacagtattgttaattgtggggaaaatatagagtgggtctgtggtacttactggagaaggcaatggcaccccactccagtactcttgcctggaaaatcccatgggcagaggagcctggtgggctgcagtccatggggtcactgggagtcggacacgactgagcgacttcactttcacttttcactttcatgcactggagaaggaaatggcaacccactccagtgttcttgcctggagaatcccaaggacgggagagcctggtgggctgctgtctctggggtcacacagagtcggacacaactgaagcgacttagcagcagcagcagcagcagcatcatgtgacctagcaatctcacatcttcatatttctcctgttcctgtttctggccttcttcctttcagaagttccctgctggggaaagtgttaaaggatcgatgtgaatggggccggctcaggtggcaagcggtaccgagtgcccatggacaatccatttgtttctgagccaggggcccatcccgccatctacgcctacgggatcagaaacatgtggcgctgtgccgtggaccgaggggaccctatcacg

SEQ ID NO: 49463 - DNA, 1353 bp, Bovine  19866881978744
ttttcacacagatgcagacagtcaagactcaaaccagccatgactaggcaatgctgtgtttgttttaataactgctctcagtcattaagatgcctctgttggatttatcaccaatgattggatcgattactcggtgctcaactgcaatctgagcctttctgtgcttctacttcagtcatttcattacgatggataggctggtaatgccaccctcatgggaggttgggctggagggttctgtgtgaatggagccttcaagataaaaatacaccaggcatatgaggagcaaaggatcagagaactaggatgctttcctcctaccccctggtgcccggggatccacccagactggcgaacagtccgtctgcagctggtggtaatagctcacagaaggggaccaagggcgccgacaaggatgcccccttagaggtgtttgtcttggccagacgtgaacacaggttcatggagctcttcagggttctcttttccaggcctggcctacccatcccatgcaaaaagaggtcttagctactgggtctctgtcaattccaggagatctcctaggtcatgactgggagcagactttgttggagaaactaagatgtccttcaggccttggagattgcccataggtcctggtgggtctcctgaagcacctacgacaacacaaaacaaaagtgcaaggaataaaccgtttctggtctatttgctactgattgaaattcaccagcctggtcttctagagaggtccttgtcaactgcccattttgtgatgctctaactccaccctgtagagccaacctgctcacctgggacatcccacagaccctactgcccaccagctcatgtcagcactgccctcaccctgcaggacatcggggcccccagaaactccatgctcccaaatcaaacatggtcccagctttgtgtgcattccatgtgacactgagtgtgccctgcacgggcacctatttcatatctcctatctacctgttggcacttttggggggcttggctgccagaaggagattcaagtagagcttggagttggtgcaaacgtttcctgctgctgcttctcaggccttcttctcactcaagggcagccccgtgtccttagctccattctgggccttcactccacatcacccttcttgacctgtgctgcgctctgcaaggtcagcgcggccggtcatctggaattttgaatctggaggcagacttttattcacaatatcatttcaaacttcctctgcattttatatttccctttcctcttcactgggctccatatgttggcaactccaggtaaataatctgcttggacctgccaggtacccaaggtgttatccctgc

SEQ ID NO: 49464 - DNA, 1833 bp, Bovine  19866880346230
agatctgactcttgcggaaggtggtcagtggctgcagtgaagaactagcaaaggaagtagtcatggattagcttctggacctctgctaggattcaagagtagggacccacatgtgtacctacttcctctgccaagcttttttttttcttctgaaaatatttttctaacactttcttggcatgaccatttcttatcaactactccttaggataagggccaaattgatctaatatttttcaagtgggtgattcagtgctgggggtgaggggagcagagatcctctaaattagttgctgttactggctatgcctttcagctttggttgcactagtttgcttgatggtattatataggatcttggtaagaaggaacttcatccctgataaaactagatttttaaagccccgagcagtgtcagggttgctaacatgatagctgcagtgaatatttgttctttctttcaagaagttcatggctttaatgaacattgtcacccccatcctctctgtgctccctgtggtaggtagaggtcagagaaaaatgtcatcactgtatttttagatatgggaactgagacatggaagagtattaaatgtctaggcattgctgccttggcaaagtacatgggcatcattaatgagaaatccacatttccaacccactttcttagtctaagtcaaaagcaaatcaaaataaatatgatttgtgtatatatccatgaaatatacacttgtatgtaaatgttgttgcattacatagagccacgaaaggttattattcagaggggctttggtctaatagatgaagaaaatgtggtccattgagttttactcatgccatactaattgataagagcttagatgttgtgtgctctatgtatatatttattaagaggtattttgtaaaaggcatactgtgaaaggttaatagcactgcattttcaagttcccttaactagtggatgacccaggaccagaactcagttttgttgattctgcatctacttcatccattcgtattgttttcattagcaaggtggataaggtgtcatttcttttaatatttgaatgctgatagcatttacaggtctctgtttggatggcatctccaaggtaacttcctaatacattttagtcttttatttaagatgtaaacataaggacaactctttccaatcatgtaagcttgttcctcggtcttttctttctctttaggactagtctcttgcccgggcaagcttcagcattttgcctggattagttgcctgagagttgatatttgtacattgtgttatggtactaatggataatttctttttaaatgtcctattcactctaggctgttagaatgccatgggaattcctagaacagtattttaacaaccttcctccttctggccccatcaaggagaggccaagttcaattcaacaagtgtttattgatcatccacttttgccaggcaaacatgaatgttgtttaatcagtgcaatgtgatacatgcaatatcagaaggtatcagaggctcccagtttattcagaggaaaacatcagagaaaggattctggtggtgaccttgaatagggatttgaagatgaatagatctttgggcaagccaagtgggaagcaatattccaggcaaggggaagcaggatacacaggcaggaacacaaatggcagcacggtgtactcctagagagacgaggctgaggcagtgtgtgtgtgactggaacatacagctcagctgtggaatgtaggggagaggacctgaggagccagcaaggccagcgtataaagggatatggggccacactaagtgttatgctgccgagtaaa

SEQ ID NO: 49465 - DNA, 1492 bp, Bovine  19866880504664
aatggcttcagtactaatgggaacatcccaacccaggcttcccccctgatgggtgtatgtatatgacctgggctttagttgtgggagcttgtggtggtgggaaccctcatgttctaatcctgaaatgcttaggcttttgctataaaagaacaaagaaagaatggctactacgtaccagcttgggctttcctgttggcccagtggtgaagaatctgcctgccaatacaggaaacatgggttcgattcctgattcaggaagatcccatatgccacagagcaactaagcctgtgcaccacaactactgagcctgtgctctagagtctgggagctacaactactgaagcccacgtactgaacccatgctccccaaagacaaaagccactgcaacaagaatctcacgctgggaaactagagagtagccccaccccctctccaggattagagaaaagcccgcacagcaaagaggaccctgcacagccataaattaataaaactataaaagcactactgtgacaataacgttaaaaaatgaaccaactccagtttgtgctgtgagtcctgttggtgtgtctggagaaagtcaaggcaggcagcgttgctcctcacaggtcagaatgcctgacgcctgctgctgggtgctcctcacagacctgccagccccgggctggcccagcctccaaaaggaaataaaagccctgagtcctgacagagacatcagtggtctaatgcagaggtccccagccttttttggcactgggtactggtttcacggaagacaatttttccacagacaagggggcacaggtgggatacagttttggttttgccactcacctcctgtgcagtgccccagttcctaaccagtcctggaccagtactggtccgtggcctgagggtctaatggatgggggcacttacgtatctgaagcaaggtcctggagcgacatccctccacctgcagtgcagaaggcaggtggcaggggcagcagcatatggcaacagtcttcgtgatgcgggaggggtaggttaccagttcctgggggaactgacttctggtcttcttgttggttaccagggaaactagcagggtggcacacccctcaccgcccctatgatatctaccaggtgatctaattagaacgataactaggctgggactggaggcaagtacctaggtgtgttgattcagctgcatgatgaggagggaagaccagttaggagaggagggtagagctaaggcagggactggtcgagcagtggaggtacagagaacaagggaacaaccttcttgggtggcctgatcagacacccactcaacagggaaggacaagctggctgaagggtccaccacattgttatctttagcagctgactctccccactccccaccacacgtgcgatgtctgtcaacacaggtgtcacaaatcactggtgaagccctgcgcttacagaggcagaaatctagaacaattgtgtgacgcaaagaagga

SEQ ID NO: 49466 - DNA, 1587 bp, Bovine  19866880577026
catacatacaaaactggaatgttatatatattgttttgcatcctgttttctcccttaatattatctatgagctcacatagtattaaaattcgtccttaaaaacccctcctctttgtcacgtggggtcatgacagctctatgatgacacattagattgggagatcatggtcacccttgctgcctaatgaggataaagcagtccgtgaagctgggtgtggattctcttcccagcatggaagggaagtggaggaagtcagtgaaaaaaagggaccacatgactaaatatgataatgaaagggcattccctagggtagcactaagagaacgttgtgtgttgatggaaatgacctatatatctcactgtccaatacagcagctgcataacatgccttatagctactgtactggacagcacaactccagggcaagctgcactctcaggtttaacagactttgttttaggaatgtttctgattacattcttagaggaaaaaacccatgacccaccaagagcttaaataaaagccagataatgattcttagactcctggtcttcaggatagaaagtatattagagctttattacatttatcttttccttacaaatttacactttagtcattgtggaaggaaccagaatataaatacttcaatgaataaataatggtcacccagctcccaaccctcctgagggctgatgagcattgttctaagttaaacttctagggcatttcagctctcctgcaaaaatcactttcctttctggaagtaagagaaggaaaaggaaacatctcacccactttctgcagactacgggcctagctcactgtgtgtgtgggaggcaacaccataggtgggtctccaatctcactaccagttgaggatggaataaagtaccgaggctttcagtaccgaggctctatcttacactcacggatggagatgaataccaccagcccaaactttgtcaaggtgctatgtccgcagctgtgcctccagtgggtttgtttatatagcaaatagttttgtaaaacaaactcttcttctcctttatggtgaggctgagaaccaccaccaaactccaggtgccaggaaaagatggacaacattcagaagactgaatcttctctgctgtaggttctgcccgaccttgatgccaacttgcagacagcccacgtgtggagtccatcacaggcatcaggaaaggggtctcagaactaatttctcaaccagagtgtggcctgatcaggctgggaagaaccctttgtgaagctacttggaaagaatgctcagagcagttgcttcctgacacccctcaatatcttcagatgggaaagcccttcaactcctgtgtgatcagagtgcatcatttcaagcatccaagccaaacattgttattttcagatgttgcccaaatctcaagagtcatctgttcacttgacctttcagaagaaacactgactaagagtctgtatttttgctattggatatttgtaaaatggggcattcacagtatctacttcataaggcaactgtaaagggtaaagaggattaaggggatgatccatgtaaagagctgagcatgtg

SEQ ID NO: 49467 - DNA, 2009 bp, Bovine  19866880587687
tgtatcaactctcacagtctctcttcataacaagtcttagcaagccatcttattctgttgacacaactgtggtcctcgtgtgtctcatagtgttcttatttaatcactgacaagcgcaaaggaaggtaacgagcagtttggggttgggatgcctgtgtgccgctttgtggcccagctgctcagatttatcaattgtgctctgggtcagaattgacttcctctttatttccatggtcttgactgccttttcaacagtgttaccttatatattttgtattataagtcttcccctcattttatttggaaagagtgccatggaatagagtgaataggtccattttggtcaccaaatgactcaaagcagtacttcccttctctgaggctcagtttgcaaacgtgtaaagaggattgaattggaatttgtagcctcatccagctcttacattctaccactagatgatttttgcattttaaaggagagcatgaaagtaatatagatcaaatgccttgaatagcaaggcatttcattttttttcctgtttttatgactatctgggggcaggaggaagggtatacggagccactgtcaatttttaaataggagctatgcaaccctggaagaattctgcaaactgaatctacttctcattatggctgaattatggtttatttttgaactttcaaaggatgcagtttggtttattcagagggtacaagtaagaaagaattcatctggctccaaagcttcatgctaaagacatttaaggatatcacagaaaaattgagataaataccttgagctgctcaaaaagaggtcttcagtccagtccattagggtttccaagatccgtgggacccttgtccttcatgccagggccaaatcttcatcaaaaacttcccctatttacttgttcaatggggctgaaaaagtctcacagagtaatgttaacttgtccttctgttggccacctctggcccttgagcaacccagatacagatgaaagggagtcataatgcacttgctttccaagcatgcaattcagttcatggatccagaaaacagtagttttctaagccttgcattttccaactttaaaaaacggaatcaaaggttattaagacaaaataattaattagatatcatgtttcatcttcctcctttttaatagatgcttttagtagaaaaggcattttcattatgcgtctaactttcttgttgcagtgcgttggtagaggtctataaagagaaacagctctgtgctaagtagtaggggtgggcctggcgtggtggggggaaggaattgcaagccacatttcctgatgcacaagtggaaagaagtcagtagttcttaagtgtacagtgtacattttaagagtcaacaagtagacaaagaaaatccagacctttgatgacccctggtgaataaagtaagcactgcattgaaatgcagttagagccgcagacttcccttgcaggccagtcccctggattgctcctctctctcaagtaaggcaaaggattttttccccctaagtgcctgttttgtttgcattacagacatgcattactgacttgaagtatccgtatctctctaaacaaacctgattttgttggtctctgttggtagattaagaaatatgtgtgcatacactatctgtgctgtgatcctgttagacacaaacagtgttatttgggaatttaagcaaggtcttaactttctttcagattaggtatatacttagtattgttttatggaagagttatgaagaacaaataagccttcttatataacccaaatttaaaatcagaatttatcttgtctataaactctgagtagcagctaaaatactctcctatgcagcaaaagtctgccttttcataaagtgctttttgtgaccagcatgtggtacatgtgagccagaaggtaggctttgttttgtcagcttgcaggaaaggagagagacttgctactgtcaaagatggggggtgggggtgggcaggcagggga

SEQ ID NO: 49468 - DNA, 1263 bp, Bovine  19866880600544
attcaagctgtgtatggaaaagtgtgaataacctcccaggagggcagaacaaagcagcattatggagctcagggtggataagaaatccattgcctctcccctctacctgatagcagtaatcacatgaaccccctatcctcaacaaaacttgggcctgtggtattattttttaccttcttctgtcagtacatttcttctcaagctttagttatgtgtttacgcaaccaagaaatattccttgagtgcctactatgtgtaaagaaatgaatgtgtgaaaaagaccaacagaacactctctttccgaggggggttcccaactctgacaaggagctcttctaatgtgggggagacccaggtcctctgaagccaccctcatctgtgggcggaaggcaaacaacagaagttctggctttgtagaatacagaatagatcattgattctaagacacgcagtttttaccttcatattttaacactgctaaaatctgaatatatctcagtcagtggcatcgtgtaattggcagtgatttttctttctggtgttgtatagaataatggagcatttcacagtcagtggtgtcatagttccaatgaaatgcaatatcacacactttgattacaactgtgaagcatattttaaaatttcaaaaattaacctgcttgtagaaaaaaaaaaatggaaggaaattctccaaaacattaacagttttgtttttttttttaaatcgtggtggtaggataataggtagtttcctgtctttttttttttttttttctgctttctaaagaaattctaaaaaagattttggaattagaccaattggaatgcaaataccaatctactcagctgtgtgactctggacaaattattgagcttgagttctctttcattaaatgagggcagtcttaacctatcttctctcatctgctgttataaggattcaacaaggaaagcacttggtgcagtgtaggagcttaattaattaatgttcttccttctactcccttttctttatcagactatttgagaatagcaataatatttgtagccttagggtaagcataatacttgatccagaatagacatttagtaagtatttactgaaaaagggattgacactctctcattcaccaaacaaataatgaaacaagatacaaataatggatttaccctctcattttgtcctgcctcttaacaaaagactcttctgccatatttctcatttttagttgaataatgaattttcacaagtttagttgaaat

SEQ ID NO: 49469 - DNA, 1248 bp, Bovine  19866880605624
cagcaacatacctggcaagtcccaggaatggagcagaggccaggggggttaagaaaagatgagcctgaggaacttgacagggcaagaggtcagaggtaacaatggtcagggcacaaagggctttgcatacactgaagaacctggattgcactcaaagtgaaatgagagctgaggaaaggcttcaggtagaagattgacacaatctggcttatgtttttaaaggatggctctggaagctgtgttgcaaatagactgaagaagggcaaaggcggacccagggagactagttaaggagctgctgcagcattcaggtgaatgggaatgttgctcagatcaaggtaaaagcagtgaggtggaacagcaagtgtaattgggtcatgtgctcagtgtggagaagcaaaaggaaaaaaacgtagtttctcaccctccataccaaataacaagatgtttgctttttcgtttagagataagctttatccaacatttaaaatctaggagtgagttatccagtatatctttctgtagagttcctggaacaagataatgggaagtatctttaggctgataggggcaggggtggagggagtacatttaacaaggacccaggagtccaaaagaaactccagggtgccactatactggatatcaatccaaattttaagatcttttaggcagactgcccttgctgagtggggtgccagaaaaattgttgcttttgtgtttatacgaaccaggctcactctccggaggtattttctggggctccttagtgatagttacttttaggatgctaaacatccttccaattattaaaggctaatatatgaagtgaaattgtaatcctgaagttgtttttaagggatagcatgagagatgtgacacaattcaagagcagggttcagagaatcaaaagaacagagtgaactgtgtctgagctgtgtggccatcctcccttgaatgacttttgccatgtcctggacctgtgaggcaagcagttagaatcagggttgggtgtgtgcacactcagtcgtgtccgactctttggaaccctgtggacagtagcctgccaggctcctctgtccatgggatttcccaggcaagaatactggaataggttcccattccctcctccaggggatattcccaacccaggggtcaaacccgcatcttcagtgtcttctgcattagcaggcagattctttacctctgcgccacataagttttgtgtttgatcatttattaaaggat

SEQ ID NO: 49470 - DNA, 2454 bp, Bovine  19866880625928
ctcagctcagctacttattaactgtgtgaccttgggcaaatgatttaaaatctctgagagtgttttctcatagatagaagagagataatatcaccctacttctcaggatgttgtgagactttgagaaaaatattagaagagactggcattgttgatgcctatagttgttactattataatttaaatgaagaggaagaatccaccttatttttttctatccctcactactaaaattcttgcagcaaaaaacccaaatacacaccaaaaagcaggtggaaccaatatctccatattcttgccaccctctcattcattaatactttactttaaaaaaattgacaccttaggttaatacaagttatatgtcaataaagtagggcaaaaacaaccagaaaagtatgattgcatcagagtataccttgaaatgctgtgtcttcaaggaaaactcatgaaggggtctatctccttcgctctgtgagaggaggaggagaaggagatggagtagttgacagctgagggcatttttcttttctgagttttacttgaatgggctcaaggtatcttgcagtcatcaagtctttttactcccataaactagccctataaattcagagttgccacaaccctgtttatcaagtaagcaaaaatgaaagcactagatgaaatacaaatgagaaaaagccagaagtcatagctggataaggaagtcccatctcttctgtgagtcagcaaatcctaacttctgccaaggttgactcaggaatccctagtaagtctccaaagactaccacatgagaaacacaagcctttgtttgtttttgtttttttataaaatctgagcatgaaggaaatcctaaaccaaatatgagaagatatgggttaacaccacaattacgatacatgtgagttagttaacctccatgagactattttcttactagagaaaaatgaaaataatagtatctctctctgtgatgatccaatgagatatcactggaaacagccattttagaaatttactgtacaaaattggtggaattcaacagttgcaggggctttgtttcaccacaatgatcttgggtgcctgtgatatggggagcatttgactggtggggatcagagatgccacatatcctgcaatgtgcaaacagtcttgtacaaggaaaaactgttctgcctttaatcaattttctaatgtcacagacttcaatttgagaagtcagacatttgtgtaagtgaaaaagttgtttataataatccgagtgtagatccttacttaaattaatacataaacaccaaggagttttgcatggttggaatatgcaccaaattttccagatgaaaattgccatttaaattgaagaaatacagaattcagttttgtttagaacctatctagcaaaagcagcattgagtcacaaatataacacatgtgttttagttttcatttgtaactgtagtgtttatggcaattcacacatacatacatatatataaacacacacacatatatacatgtatacacacacatacacatttatgttgttgtttagtcactaagtcgtgtcttactcttttgcgaccccatggattgtacagcccgctaggctccttccgtccatgggatttcccaggcaagaataatggagtgggttgccattttgtactccaggggagcttcctaacccagggatcaaacccaaatctcctgcattggcaggtgggtcccttaccactaagccaccatgggagcctatatgcatttatagacatacacatatatgtacttacaaaacatttatttttcaaatgtgaaaaaagtttaaacaggaagacattagttgaatattatcttaatttcgaatctgtgaattttatgtatgtgcaagcatttgactactccttgattctcttaggtgaggtgttcctcagtatttacatattgagacacatattaattgattatacattacttttgcatcattgccttttatactacagtgaggacattttattgaagtttttgaaattatgcttgtagataagctattttatctatgaatttaatttcaaaatagtaaagggcagcagagaatatgtgctttataaagtaagagctggaactgagaaggttgaggactacatgaaagaaatgtaaatgattgctgtttgtccttggttttgcacaagagactgactagattcaaattagccagggagagatgggtctctgctctttatgatgtcaaggctgctacagtaaacatctccctactggcttcttttgtcctttggtgtgtgtgtgttacttacggtttgctaaggttttccatggacagatcatagacagttttctgaaagaaaagtcaactctgggtgtgagaggtaatcctaaggaacaatgactgctggcataactgcacccttaatttgatgtctatatgtgtgtggatg

SEQ ID NO: 49471 - DNA, 1925 bp, Bovine  19866880647526
aaatggcaacccactccagtatttttgcctagagagtcccatggacagaggagtctggcaggctacagtccatagggtcgcaaagagtcagacacaactgagcgactgagcatgcatgcatgcacacacataaattaagaggcattcagctgcaagaaattgaaacccatggcaattgactttcagaccggtgattatcaaagtgttatccctggaccaataacatcagcatctcctgggaacttgttagaaatgcaaattctccacttctaccccgggtatactgtcagaaagtctgggggtgggctgagaaatccatgctgttaaggctcagggggtattctgactaaggttaaagtttgagaactttgagaactgttttagacaataaagaaattacgttcttcactaagcaggaggtacaaagacagagcatctctgggtacaacaggatcagggccaggttctatttctctgtttctctttcattttcctcaagctgactccccttcatggcctcaatacctagaggcagaaaatgagccattacttcatttttgaagaaagaaaagagtggatacaccctttgagaagtctccacaagaggtttgccctcatgtttcaaaggccagaattctgtcacctagcaacacctttagccaattactggcaacttgaatggcaccaatgtaattggctgaaaccaatcaagaccccaccccctgccatatggccataccaaggaggaagcatacctgaataaaaatgaagcaaggaggtgatctatgggaatagataccgtatagtgtcaactacggtcacaaacgtggttgattcacactgccgctaattcttactacagaagaacttcaactcgtaatctgtacatttgcttcaataatctgactaatttgttagccttttagaatttcaggtctaaagcagcaaccgacagatcacttttatattttggtgattaaagtctgacatttagaatgtggcatcattttgagatctgttttatctattttagctaaatattctatatttttatatcaagctcgagataactataattaaaaggacaaaaaattatgattaaagtatgtattttccctctacagtatttgtgcttcttcaaatgacaggtgtttcttcagaaaggaaattctactcattgctatctttgttatctttcctatagcaaaaaatgaattttaaataatgacttttcagaagagagaaaatctgaaatgatgagcagattgctttgatcactgctttgttgaacaaaacagacagttgtttggagacaggttgcaatacaacaaacatttaatttttgcttgattcacacatgaaactatcagttgggaaggttagtaattaccaaatcctcaattcaatcagacatgaatgccacacagccctgtgcttgtttagctgtaatatggaattgatctcagcagatgtagtaaaatagttcatatccataacgcctgaaaaaattcacacagcctgcatttcattgttgctctgtactacagccctccccaactctcccatttcttgagtttttcaattaagtgctttccttatttatattctacatctgatcaaacaccaaaaaatgtggattagtcacattcctaaataaattgaaacattatgtaacaagtgtcccagcagtttgagaaggaacctcaaagtggcatgttggaaagagccctggactggctttttctggcttctcatcccagctctaccatccacatatatgatgatctggagtgatttaattcacacctcaggcctcagatttcagcggtaaaattagaagattggcattggctatctctcagttctactacagttagaactgcctggactgaagaaagatcaaaggagaggcagcttgccacagt

SEQ ID NO: 49472 - DNA, 1375 bp, Bovine  19866880734254
cattgactttttgcaggacaaatgttttcaagggtacctacctccaccactgcctttctcaaccattttctaaggtaaaaaaatttgagaggtcattagtttaaagttggtggtcactactgtacacagtgtgctggcatctctcccctcagactcttcctctgccatcagtactgaccagaagttataatttttggtatttgtcataaactaatcttcataaaatgttttaaagaaaaatacatttatagacatctatgtatacatattctcttatactaaaaagatatcattttgagtcctttgtaggaatattactttaaaagagtaggagctagttagtatttattgagagttccacattctggtatatttttattgtatagaaaaaaatctcagaactcatttctcagtgttccattctttggcatatgtggaggtgatgatttagaggagttatgcaattcaagactggacagggcagttttcacaggacagtgctggcttgcctacgtgataaatccagtagctctactcagcgccatgccaaagttacagttttcagaaacttctgcaaaaggatctaaacagtttttgccttgccaccaaaatgtgtgttcatttttctacacctccacacctggcagtgtttcagcccaacatttgctacagtattttgagttcatcttgtttattttctgctttattttttctcctgatgtacatttcatgtgcaaagcctaccatttcccatatatactgctactgttcagcccggctcctaaaccacactctattcttaaataagatacacttcaaagtaacatggacttcagactttagaatttttatttctactcagcttttgtccctcatatccagagtggcatttgttatatagaacaaaaattgcaaaggtataccagaagtggcttcccacgtggctcagatggtaaagaagtggcctgcaatgcgggataccctgagttcaatccctgggttaggaagatcccctggaaaagggcatggcaacccactccagtattcttttttggagatttccatggacagaggagcctggagagctacagtccatgggatcacagagagtcagacacgactgagtgactaacacatacacacatacttaaagcttatatgtgacatgaaatgttatttcttggaaaatcatacttcagaatattgatgagatgtcagtaatatgtgatgacagggaatgaaggctttttggcatgttgttaaagggatgcaatataggggggatgtaaagaggtccagaaagagaggatctagatctttctctcaaaggttgatgctcctagatcaggagcatcagcaccacctggaaacgtgt

SEQ ID NO: 49473 - DNA, 951 bp, Bovine  19866880793985
cacatccaagacagcatgctaatgagaattattattaagcgatgtagagttggcaccagtctcttgcaatctgctccacagcagaagcaggaagggcagagacagagagtcagaaaagcagctttactgaatactcttctggacccaattagttttggtcactttcaacaccaggcaaagccaagcagaattgtaagctttcacaggcaaagccattctgcttccccactgtaatgtatctagcctgtcaaaaagtcttctagattttactgttgctttaaaaacattcttcgctttaagaactgcaaaatcaagagtttctgtaaattcaataaccaggataccagaaagactgatttgctctgcattgcaggatttctttcattttggtacgctattcaaactgactcatctaactctcagaataggaattatgtttcaggactttttctggcataattttcagagtaagctgtgacatcttggtcagatggagaatttggaccaccaatcaatgtgaaacagaggggcccaaaattagagctattatgagtgcttttcaagcagttagaccagagcccctttgtgaagatgaagtgtgatgcaagcaacttggagataagccacacaaccaaaataaaaggtcattttcacgtttatatttatttactcttaaagacactttatcagacaggcttttactgaaatgtaataatgtgagatgatctttttaaaaattaattaatttttaattggagcataattgttttacaatgctgtgttgctttctgccatacatcaacatgaatcagccataggtgtacacattcccctccctcccaccgcccaccccgtcccatccctctatgttgtcacagagcaccgggctgagctccctgagctatacagcaacttcccattagctattttacacgggtaatgtatatgttt

SEQ ID NO: 49474 - DNA, 1525 bp, Bovine  19866880828992
agagagcaggtagcatcttccctccctagtctccatgtgttaatcccagggaagacctctgattgggccaggagtatggggcctggcctgggtcatgtgaccactccatgaagaaggggtagatgacagctcttggactgcagagtgtattttcagagtaagggtcatggaagaaatagttaggaagacaaaaaccaactgactcagactgcctcaggaaccatctggctctctgatatagtgcctgagaggacacttgagtatgggtaccactgccacttcccgtggctcatatgcgtacagaaaagaatttaaaatactcatatgtaagaacatacaagatggctttctaagcacaaaacccaagctataaatacagcattcattttgttttggttgaatccagcaagtaattagcttatccttggttaatgaacaaaaatctagataagaaatgaaacccacaaccctgagattgtaaggagcaagcagatgtgcctgccttcaaggatctcatcatcgagggagctaagcaacccagcatatttgtagcgcatgccacgttttctcatggcagtgttcactgaggaaaggacaagtgaacagcttgtgattctacatgggcattacatagctgcaaatctctctgaaatgcaggcaacaaatagtcacatcatgtctctgttcttgcaaatgcaatgttttttctttcactaggatttgttctttattccttagatcgaaaatgcctaccattttccccaaactatctgtaatatgagactacagcctcttaaaccaatacacccatggaccaatagtgtagtgtaaatttatggctgagagatgcagagtttgaaaagtcaagcactccctaagagccagggtgacaacaacttatgaatttatatgttgtgatggattaaagtaattatttagaccagctcagagaaacccaacataatccccacccttaaaacaagctatggattgcaatttcatcttgaaagccctggttagatgggtacatcttatcaataattttgaaaactatatttccactgagaaattataaaagaaataactgccattcaatttcttgatgttttgcattctttcagagtcggcaaacataaaaaagtcagcaggtggagctcctattcccttggcaggcctgatagaagtctttctcttgtaagaactttcaattacagactgtctctccggcagccagttctaggctccctacagacagcatcagaataatacatgaaaatgtgagactgtgaaacattccagagtgtgtcataggtcaggaaagagaagagagaaagaagagccagaaatcttttattttattatttttttggctatttcccccaaattatatttcttttaaattagtaaagaatgtgccatccttcatgggtggacctggcaggatatactaattcactggttttctgggacactgcagttctcttctcctgtttgcattctggtcaccctttcacagcgtggcatt

SEQ ID NO: 49475 - DNA, 1866 bp, Bovine  19866880888527
cattcttccttctttgggaggtctataaccctcatggaagaaagaaggtggggagggggcgaactatccaagcacaatattaatctagttgatcatgtaaacaccttcttttcaaagtgttaacccccaaagcagtgctaaaacacacagccccacgttgcttgccagcactgattgcatatacaatacaaatgaggaaaagtgaggcatgcttatgacatgtgcttggtttgcaacacagcctattaataaaatttgtttgaagaaacacaattgttaattgacacatagaaatattttggatttatacataagggagggtgtaactgaaaggagctatccagttggaaagattaaaggtataagcctggcttgggcacaaagatccccattttagaaccgagcaaactgggaaacacatagtcagatttcttaaaggcagtagcttactgatgcccgccccccgcccatcctcatcacctggcggtgaggaacaaaacctcagaggcccgcaggagtcctcttccatgctcccttttctctctgctttgctttgcatctctgttaaaaaacatcttaccttattgggataaagtggtatctggagaactaactgcgtgactttggcaaaccatttcatgtctctgggccagatatgatggtgcaccaatgtccttcacctcaaatattctataggtgtatggatttgtgggctcagaataacttgttggaaaagctggaaaaccacaactaagtgctcatagaactagaaaattaaccagatgagtaaatgcctcactttctttgagcctctttccatattgaaatagtcaagggagaaaagagtcctaagtttttttttttgttttttttttgagcttaatagatattctaacacaatgctattgtgttagacaatgcttaagcattgggtatattttaaatcagatagcttaaatgtaccctctgttcagagaagtcattccataaacatgtattgatcatcaaaaatgtatcaaacattcattgtttaaaggactttgatacctaatgtaaaattgttcgtagttaccctcccatccctcaccttccttttttgtttttctctgtactactcctttcttctagctcaatacacagtttgtggatttaaacgcgttcattgcctgtctcctctcaccacagtagagcttccataaactcagtgtcgtttgttactgtatctctagtgcaccttccctgatagctcagttggtacggaatccacctgcaatgcaggagaccccagttcaattcctgggttgggaagatccgctggagaagggataggctacccactccagtattcttgcacttcccttgtggctcagctggtggagaatccacctgcgctgtgggagacctgggttcgatccctgggttgggaacatccctggagaagagaaaggctacccactctagtattctggcctagggaattctatggactatatagttcatggggttgcaaagagtcggacccaacggtatgaatttcactcactcagtgcacccgaagaacttagttggtgctcaataaatacctcatgaatgaatgaataaatatgttatctcagattttatgaccccccagcaagagttgagagtattttgcacttgaaattgaggctgagagaagtcagggaatttattcaagactagctagctattacagtaaggggtagagccacactccaagctcagaggatctgacttctcgtgcatctgtcttctatgacatccatctgcttttcctgccatttgcaatttctctgcacatgaatttcaccagttctacatggtttcagttggggcctattgttctat

SEQ ID NO: 49476 - DNA, 1347 bp, Bovine  19866880946296
ttctgggaataccctattcctaagcctttgtggcaggggaagcagaatccctggagtgaagaaaaataggataaaagatactgggcaggtgccaagtatggaatatcatgaggcagctgggtactgaggggcaagtgaattagaagacttgaaactgatctctgactccatcactgattcgctgtgagaatcctggcagagtatttgacttctctcgttttaggtttccttgtttgtgaaatgtgtggactaggcttggaacagtcatttgtaagcatctttaacttcaagattctcaatttgaacaaactgttgtacagaacacacaggaccttagcgaagccagctggagaggtgctggggggcaggggcatgcctggagccccacctgctctgctccaccttctgtcctcctgatggggctgcgtgaaactcctgcagctgctcagaacacagtctgagaaaccttgaggtatctgatctcctacgcctcttctagcctggaatttggggaagtctacgtagactgtgaaatcctctttaatctagtttttctcactttccctctatttatttttgggctaaaatcatgcatgttggctatgtgtgagagaccacttaggaaaaataatcatttattcaaatatccagccaatttactttggcctatttggagcttgtttttcctgatggggagggaataaatttccaaagcccacttttaagatcagcctagaaaaggtgagtgtacaagtgaggaaaaataggcagtggaagctgccaagctgagctggaagcagtaaattcaaaccactcccatctcccccacacgtgtgccctgctgggcactcaaggccaagtgcacggtctggaacagatggcagaggaggatgatgtagattttggcttcaccacttgtgaaaacttactttggggagacaccttcacctctaatctgagtgtgtttgattgaaatagagcattgggcaagaggaagggaatggccagggacgtggccttcctgcagccagcaggcaagggggaggagggcatccttggtccagcggcaccaggagtgagaaattcgtgctgcggtgatttcaaaggaagtcagagcctttgtgttcctttttcttgcgactgtttagaaaacaatcatagagtggctaggagacgtcagccagccctttggggaacagatatggataagcagtagtctctagtctcctctcttaaaatcaagagaggagacaggcaaaccagtgcaggacactgtatgggaagctgatacccagctgttccgcacaagctgcttgcagcttggtgtctctaatctgatagatctgt

SEQ ID NO: 49477 - DNA, 1860 bp, Bovine  19866880985462
tggaaggtggtatagcaggatgggccctgggcagcaactccagaagcagctcggaattgcctcctctgaggctctgtcctgaaaattcagccttgcctctcaggttcagaaaacctatgggaagtaaagggtttgtatgtgacactcctaaagcagtgcttgtcagcgatgcctctttctggagggtatctgtgaatgactcatatttcatccgtcaggtgcgctctggcccatccatctctcagtctctccctctgttgccagataattagttggtattcaataatgctgcctttgttaaatgcctgctgaatgaggtaaggttctaggatgaaagccaatgcctctacacacacatatgcacacacacagcatgtcttctcagccatgagggtcattatttctttattttttaaaaaactacagcaacaagattgtgtaagaaaaggttgctttcctctttgcagcatctgccgtgctgccccatgtcagcacaaccagtgtcgtccctgctgcctgcccatgctcccaccagggctcccctgggctttccttctcctcacgtgtgacagcaagagccaggatttgccactgggcagtgctagctctgccactgattagataattgatatgagacaagaatgtagatccagtcaaggagggtagattcccccatgtaatgggagatgagattacagaattcactagggttctcagcaccaccttcaggagcaaaaatctgaaggtgagacttagaggagggacctgagggaagagtgttttgggtacagggctcagctggagcgaaggtcctgagacaggagtgtgccaggtgagtctgaggaataagaaggaagctggagtggtcagaggagagtgagcaatgtggggagaagttagagaggtgatcgagaggtgatggcagggtggcattatcaggacattgctttactttagtgacaggggagccactgcaggattttaagcagagaaaaggttaggtgatctgacctgggttctaggtgaatgacccaggatgctgtacagagagccgtctgtagggggcagaattagggagcgaggtggtaggctgggccaggctggcagcggtgaagggggaaaggtggttgaatactgtatgttttgaaggtagaggactgacgtgatatcttgatagattggctatggggtgtgagagagaggggggatgtcttcaaagcttttggcctgagcagctaggagaatgtgactgccatctgcagagctgcagctgttttgtaacagttaaattggatgcccatcccatggagggtggcatgtagcagtcacccacgaagtgtcccttcctctccaacagcctctaggtcgctctactccttcctcctcacattgcctcccagtgggctaatggcagcatctttaagcttcagtctcctcatctgtaacttgggatcagcagagccgggaatgtacggaggattatgtaagaggaagcattttgcaagggctcaacgcagagtaagcactcagcaaatgttggcttttactaaacagaaagaaaaacctagccagctgttgggcacttgagcagaagtgattctgtctggccttcccacctcccagacctgcagtttcactggggccccgatgaagcttctcaaacactggcctgatcacagcacccagcctctcacatgcagtggctcacagttgcacccatgagcaaggtcaggcttttaagcagtgtctgtaggcctgttgcactccactttcacctcctcaacagctgttctccaacaacttatgctcagttcaccagcctacttgttcagcttcccaacctctgtgcacatattcagg

SEQ ID NO: 49478 - DNA, 1440 bp, Bovine  19866881048325
tgtcttggacctagtctttgcttgcttgtgtattactgtggaacttagattttggaacatggaaaggcacctttgagctctttcaataaaatgaagatgactgcaaaaggctgtgagaatcagatgagatcattaacactgaggtggacatgtgtaattcactctagctcccttgtatctaaagctctatctacgtcagaaactctccacttagtaagtcttggttgaggataaagactttcttccattagaaatacccaaaatgccacatactcatcttcccagactccttagcagccaccagtcagatgattcacagtacactctgtcttgggagtcagtgacacaacagccaaggctgggtagcacacttactctctctctctttcatggccacggcaataacaatgaaacaagataaaattttcagcagagaaacagcaatggtgcaaactgtaggtgttgtgtgtggagagggacagcagcaggggcttcttcattagaataatgctcatgattttggacattgtttctggcagcttaacctcaagcctcattcttcagctatcctgacaactctgaattactcaaaatccaatgaataaagtcattttctggttaaattagccaggaacattttctattgcttgtaattaggaacattgtctgccacatatgcataactgtaaaacaccatatgaacacaagggacaccacagatgcttttgttcctctccagcagccagtcttccctctcccttgctcacaggtggacctttgacccagtttcagcagagatgttacaaaggatgggcttcttgagacttctgagaaagagttctccttcctttctaataagagaaaggtatataaagagaaacttctgccactcccctcagcctttctgccccagctttctccttgggatactctcatgtaagaatgagtagcttggagatctagcaacccttttctgaccacgcggagagatgctgcctgcataggggattaatagagttcaagaatgtaaagagccttggtccttaatgacacaactgaatttccaaaacaagcttagtttgcctacttccagactctctgttaatgaaaagtaatcatgatttaagatgctgaaaataagagtctattacttgcagccaaacataccctgaataggtacaaaatatttgattatcattatagcagctgtgagaggctaggttgatgggtttgagttttcaggatctcaactatctgactctatttccagttaaaatattaccccaaattgataaggtgtaatactgaccaccagtattatccctgatgacatctgatagtttaagtccaaagcaaacatttggatagttcagtttaagtatctggctttaaaaaataccaatgcctgggtcccagccccaaagattctggtgtaatggg

SEQ ID NO: 49479 - DNA, 774 bp, Bovine  19866881705035
gagacagaaatgaatgactcttgccaaatctgactaccccttgagcttgtctcgttctttagaaaattgttttcctctgaatgcttctcagttatgtccatgacttttcagaaacaatatatttttaaatcagttctcccctaggtaagtgaaaacaatgttctgctggtgggatcatctcagcaaattgcagtgggaatacagctctgaaaacaatctggttttgtccctctaggttgccaaatcctgggtctggtggcagtggtgataggccttgcagacctccaaccagggagagaaaattgactaaggccccagctgggacactgtgaagcccaacagcacatttatgattggggatacgcttgccacactgctctcagccaacggctgagtgggcagggatgctaaggcaggctattcctgggagaaccagggaccctctgacaacttcaggactccttgactgtcttgagtcctgcgatgcttctattcaatcttttctttttctctcttccacttagcatcagatttcaatcaggtctgaaaactttttctagctcgctccccattttctctcacaaaggcggttaccctaagaaaacctctgcctgtttaatcctgtcttggcatctgcttcttggaggaccaggactaaaaacatactgtttaattttaaaggtaggttatgttaccttaaggaaatattaatacatcgtcacagagtcaagagctgcagctctaaattagtcttctgctgcaaaaagatgtatt

SEQ ID NO: 49480 - DNA, 3358 bp, Bovine  19866880340538
cacctcacaccagtcagaatggccctcatcaaaaagtctacaaacaataaatgctggagagggtgtggagagaagggaacacttttgcactgttggtgggaatgtaaattgatatacagctactatggaagatggtatggagattcctttaaaaactaggaataaaatcaccatatgacccagcaatcccactcctaggcatacaccttaaggaaaccaaaactgaaaaagacatgtatcccattgttcattgtagcactatttacaatactagaacatggaagcaacctagatgtccattgacagatgaatggataaagaagttgtggtacatatacacaatggaatattactcagccataaaaaggaactcatttgattcagttctgatgaggtggatgaacctagaacctattatacaaagtgaagtgagtcagaaagaaaaagataaatatcatattctaacacatatatacagaatctagaaaaatggtactgaagaatttatttatagggcagcaatggagaaacagacatagagaatagacttatggacatggggagagaggaggagagggtgagatgtatggaaagagtaacatggaaacttacattaccatatgtaaaatagccaacaggaatttgctgtatggctcaggaaactcaaacaggggctctgtatcaacctagaggggttgcatggggagggagatgggagggaggttcaaaagggggggaatatatgtatacctatggctgattcatgttgaggtttgacagaaaacaacaaaattctataaagcaattatccctcaataaaaaataaatacattttttaaaaaatcagttgttttcaatacattagcaatgaacaatccaaagatgaaaataagaaaacaacttaatttgccaaagcaccaataattacaaaacacatagaaatatatttaacaaaagaaatccaaaacttcactctggaaactataaaatattgtttggagaaattaaagggaaaaataaatggaaatcatctcatgttcatggatttggaagatgtaatgttgttaaaatgacaatacccccaaattaatctgcagactcaatacaatccctaccaaaatctcagcagcttccttttttaaaaaagaaattgactagctgattctgaagttcaaatggagatttagggacccagaatagtcaaaatagtcttgaaaataaatattcaaaaattattataaagcagtggaaatcaagacagtttggtgctatctacagataaatcatcataatagaattgagagtctataaataaacccatgtacctatgatcaattgattttccacaaagataccaaatcaatggagcaaagaatactctttcaccaaatggtgccaggaaaactgtatggccacatgaagaagaatgaatttgagtccttaccttacatcgtacgtatagggtaactcacagtgatggaattatacccttgcttttgaccaaggaggtcctgatttctttggcaatgaggcagctattgacctcctgaaaggagtgtcaggctttggctgtttaaaagactgggaagaaagagcccccacttttcctgctgtcctgcctttgacatgatatctacaatatcccaggactgactctgaccaccctaagttttagaatgtcacacttaatgctgagacagtaagctgagatactccatggtaaactgatgtgatcggcttcctgtctgagttcacataatcacaaccttctattactaagacccctgtcctactctcaacacattatatcctcaaaccacagttgcattaagagattaggtgcacatggcttaatattctcactacttccactggacatttgacagcatcccctaggtaactctggatgttttataccaactgtacccatcaacggttacctaagtcataacctcaattgtgactatagcttcaaattcttggtagcattagaacaacctattcacaattaaaaagactattgatctagaggagcttggactttcagaagagaccaggaaggtacagtcaggtggtaggcagatgttatgtggtaggcagatgttacaggataagcagatgttatgcggtaggcagatgttatatgaatatgagcaacctgcagaggagttggcacactctgatttcctctctcttccctggacctaccttgtcactgaagatggcagagttcttacccctgacttaggccacagaaccgctgctttctgcactttactctgggatgtggtgggagaccatcaaccctcattgcttttggctcagccctgactcatcatctcactggttcataatgtagtcatgctcccaagtaagaaaagctgttactgactcaggaatgcggaactgagctgaacgatcgctgagtagatcagagcagaaatgaaagtacccctcctaatttcaccttctctcatcaacatacaaagcccttctcttaaccctatctattctttgagactacatggtccccacttttataggaaatgtagtagggattaccatatatgtaaatatcagagagagatcattaagtggaatttctttattgttaggttattttagcaaaaaatctagggatgataaaacattgagaaactgtgaagcaaagctgactagtcagaaggaagcttgtacaactgttacaacaagttcattgtgaaccattaaaatagaattgctagggatgggaagtggggttgaaggaatgtcagggggctggaagaaagtgatcataaacaatagagatctttatgcccaccctgctaggtttccaagcttggctaaaactaaccttcctactatagtgttgatatagaagtaaagaatattcaaactagaagatcttttagaaagtacccagtctagaatgtatgtggatagttttgaaagccccatttagctctaaaaataatctgtttttgtttgtttgtttagttcagaatcatttttaaaaagaaatgtaacttgaagctcaataattaacaaagaccacttcagttcagttcagttcagtcactcagtcatgtctgactctttgcaaccccatgaatcgcagcacgccaggcctccctgtccatcaccatctcccagagttcactcagactcacgtccatcgagtcagtgattccatccaaccatctcatcctctgtcatccccttttcctcctgcccccaatccctcccaggatcaaagtcttttccaatgagtcaactcttcgcatgaggtggccaaagtactggagtttcagctttagcatcattccttccaaagaaatcccagggcgatctccttcag

SEQ ID NO: 49481 - DNA, 1107 bp, Bovine  19866880456391
tcacctccactgtggcctccaggccctcaccaccctcctgaaaccaccgggggttcccctggctccttcttccagaaataggaaaccaagtcattacccacccaccaggtctttagttacctgcttcacagtttcctctgtgatttgcatggccctttgtcccctagttcagagaacacagcagcagtgtacaactgctgccaacctaacacacacctcaactgtacaacttcacacaccccacctaacacaccctcaaaaacccctctcccctggggcagcctctgcatttgcctacatacattccagaatcgtgacttgctcacacccactccaggcccagccaaaagactcctgggaacctttctactgccctgacaagccctcgctccctgctagagaagggtcctgtgtgttcactgcccaaggtaattcagctcccactgtagagaaataaaagccgactggtcagctatggtgtctctatatcacaggaaggaagtgagctgtcagaccaggtagttctgggctttccaggggccctccatgcaaccacatagcacacaggtaatgctcatctaggtgacccactcccgtggacaggctggggcaggagcacaggtaagactggccacaagcaagtcctggcgcatcagctgggacctgccatccagggtgctgtgactcaggttggaacgccctcttcaggcaaacataatgagctgcccttggttggggcctttcgtgcccacccacaccaggcgttccgcaaggctcatctccctcttttggctaccttctccgtgccccttcaccccaccctgacctgatctccccattcacccccaccttctctttgcttcttttccttcccagggtcacagcctctaaccctcctggaacatagacttaaaggagggcaccctaagaaggcaaactccagccccacggagctggacttggggccctggccaggaagctggaaggcacatagcccctctgtccgtttacttccacgaggctccatttctgggttcccctttcttgtcctgggcctccagcacagtcacccgctggcctgcctgcagactcacttcatggctgctt

SEQ ID NO: 49482 - DNA, 1971 bp, Bovine  19866880572721
tctcctcccaagttcaatctttcccagcatcagggtcttttccagtgagtcagttcttctcatcaggtggccaaagtattggagtgtcagcttcaggatcagttcttccaatgaatattcaggactgatttcctttaggatggactggttggatctccttgcagtccaagggactctcaagagtccaacaccacagttcaaaagcatcaattctttggcacttagatttctttatagtccaactctcacatccatacatgactactggaaaaaccatagctttggctagatggacctttgtcagcaaagtaatgtctctgctttttaatatgctgtctagtttggtcataacttttcttccaaggagcaagtgtcttttaatttcatggctgcagtcaccatttgcagtgatttttggagccttccaaaataaagtctgtcattttttccactgtttccccatctatttgccatgaagtgatgggactggatgccatgatcttagttttctgaatgttgagctttaagccaaccttttcactctcctctttcactttcatcaagaggctctttagttctttttcggtttttgccataaggatggtatcatctgcatatctgaggttattgttatttctcccagcagtcttgattccagcttgtggttcatccagttcagcatttctcatgatgtacactgcatgtaagttaaataagcagagtgacaatatacagccttgacgtattcttttcctgatttggaaccaatctgttgttccatgtccagttctaactgctgcttcttgacctgcatacagatttctcaggaggcaggtcaggtggtctggtattcccatctcttgaagaattttccacagttatgatccatacagtcaaaggttttggcgtagtcaataccacagatatagatgtttttcagaactctcttgctttttcgatgatccaacagatgatggcaatttgaatctggttcctctgccttttctaaatccagcttgaaaacatctggaatttctcagttcatgtactattgaagcctggcttggataattttgaacattactttgctagcgtgtgagatgagtgcaattgtgtcgtagtttgggcattctttagcattgcctttctttggggttggatagctttaaaaaagtcacctttcttagagctgtagtctttggccattaaatgggaggtagggatagatgacatctaagggccttcctattctgaactgaacaagcctgtagtgggaaggaagcacattgagggccattgaggagatgagttcctgctctgaagagctaccaaagagttggcaagcaaaaactgtcactaccccacaaagcaacttggctatgtttgtttggtttctttttggcatatttcaccattgagattcctgctattctgagtaggaggtgtactattacttactgaatacttttttttgatgctgacttatttctaaaactcaaatacatttatttttaaagaaaattttgtattattgtcactactgcacatggaaaaccagtgtcaccagccataaatagaaggtaaccatgaacacagagcaatgttaataaattctagctagactttgttgccttccaagttctaagcctgaagtctgctttcattttactgaaaagtaagattagcaagttccagggagaacttaatggtgttctaacattcagtaggaccttctccatattttaaaagatcaaaagaaaattgaaaagggtaaaaataattcctacactgttattaagtgtagtgttactgaagtgtttaaaataattccttattatacctttggtgtctcagccctaggccacactaatggaacacacagctgtcgtgcaaagaacctggcctttggagccatgtggacctggattccagtcctgattctgcccttaacagagtgctgcaggtaatata

SEQ ID NO: 49483 - DNA, 1024 bp, Bovine  19866880579315
tttcagttacttgatcacttaactaaatgggaaacattccctttaatggctattttggaatcagtttgtctaagagagtcaccatattggagaaatgcagccctagcttccttcctctgccttctttggatcatgtaaacagtagctgcagaatgggaaaaaggaaatgtcatatttatgtgatggctaaagcctgagattggatcctctagagtaacaacatcattcagaaacccccaagaactccctggtgcttctgctgtcaaatccctgctcatacttagaaagtccctaggggatcatcaagttccttccccctgccatgggtggggagcctgaagctcagcagagggaagctgcttgccaaatgacacagtcaacttgtgacagagctgggatttgaaacctgttggcaggaaatctttcgtaattatgtgaaatcagtttatctttatatcaggttcttggtttgtgctttttatgtatccattggctctcagttcctatcccaccttcttatccctgctctgtgatgctggggctaggagtctgcaaactacattgcctggataccttgttgggtatcttgatgttttcctctgacagcagtggacagtcatggctgtatctccagcaacctttgctgccgctactgctgctaagtcgcttcagtcgtgtccgactctgtgcgaccccatagagggcagcccaccaggctctgctgcccctgggattctccaggcaagaacactggagtgggttgccatttccttctccagtgcatgaaagtgaaaagtgaaagtgaagtcactcagtcgtgtctgactcttagcgaccccatggactgcagcccaccaggctcctccatccatgggattttccaggcaagagtactggagtggggtgccactgccttctccagcaaccttcagcacgtcctgtatctatcacccctggtgttctccaaatcagaggtccaagctacagccacagagattaagccatgcctgacaccctcctctaa

SEQ ID NO: 49484 - DNA, 994 bp, Bovine  19866880589334
aatttgtgagtaaagctctttcccaaatgctaccaaggaagtttaaaactgctagagctaaacaacatactggaaagggaggggtgactgcccctcagaagttagaacaggagcacaacagttgaacacagcaggagacaaattgcagtgtccggttcctcctggctcttccttgctccctgtcattccttagtccacgcttctctctctgatagtactgctgggggtaacccgggttccaattccctttctgcggtcatctagttttctacaggattgcaaaatcttccaacttttctggcttcaattccttccttagttgtcaagaagattggacaaaatgatttaaagtatctctcccatcaaaaactgcttctgtctctgtgtgttcttttctgtgcctctctctttccctccaccttttcttttctcctctaactggtcccacttttaaactagactgtgctgcctgttatcagatttattagtctctcttaaaagcagataatggcatgattcttctttcataaataacacaacctaagtcaaatgttctctctactgatgtggcaccggcacacattttttttcctctcctgagggtcacttgattttgtgggtaaaagtgttcccacattctaactgagtcatctttaaagcaatctttaaaagatattatagaagcacctatgtaatgctggggtataattaaaagagtgacagaactggcatggagatagtataacaactgtgaataactggctagaggtgtaataaaaacagtggagcttctgtcttaacagtgaaacatcaagcagagaatcaactggttcagcaatgagctttccgtagcccagggccccagaaaacaatcgagtgaggcagctggcatgagccgcccagctcccaaagtacccatagtgtgttaacaggtattcgctaaagacgcaggaggagactcaagtgaggatccaggcatttcacaggtagaaag

SEQ ID NO: 49485 - DNA, 903 bp, Bovine  19866880621002
aaatcaggctttgggggaggtaaaaaggcacctaatttctttccctcaatagcaaccacccattacttagctaaatatttatttgtgtgtgtgtgtgtgtgtgtgtgtgtgtgtgtctacatatgtgtatatgtgtatttgggcttccctggtggctcagacattaaagaatcttcctgcaatgcagcagacccaggttttatccctgggtcgggaagatcctctggagaagggaatagctacccactctggtattcttgcctgggaaatcccatgaacagaggagcctagagggctacagtgaatggagacacaattgagtgactaacacttccactttttttcatatgtgtatttatgcatatataatggcctaagaataatgatggcgggtactagagtgcagatcaggaaaccaagaagagtcatcctgagtttctggcagatgataaggaagctgtgattgctgtccccaggccagggggtgtcagccttgagcagcttccctggcgtgggcaggtacagcctgacaggtgtgcgttgcgggtaccctgggacaggcaggctctgcaggtgccagcagctgtggagaacagaggcaggcaccctctgggaacctcacagatggccctgccctggccacaatttccggaatcagcaggtcagtaaaacagtctgtcatcccaagacgatattgtaaaacctttgctgcaacggaaagtcctccagagcctccctctgccaggctcctcagcatgtactgtggtcagagtgaagctggcaacacagttcataccgctttctccagcaacatgttgtcaggacatgtgtcagaaccacatgctcttggccagacagactgctcttgcctggcagccagctgccacgctacagcgacagcag

SEQ ID NO: 49486 - DNA, 841 bp, Bovine  19866880636275
ttgctgttctgtgttttatgtaaatatgcctttcatagcagacccctggagaatttcctacatataatgagagtttcctctactatcccggatggcagttttgtttctgctttaatgtctccaagaacagggaactcattacctttcagacgactcttataattgttagaaagttctagccctcaaactgggtcaaaaatctgttgcccaaatgtgttcatgcactgggaccagatttgccctttggtttacaaagactgaatctgcttccctcttactcagcaagacttttggatatttgaagacgatgtttttattttataccagcattctccaaagtgtgctgagcggagtaagtttgcacagtgttaataggtgtcctctataaaacaaacatatcaaaacaaacagacaaaagcccataaatagcattctgtgggcatgctaggttaaatcaggtcaaccagatatgtttcctgcaaggctgctcagaatgtttactatgctgatgcagagtatggattccaaaatggaaatactgggcatgcaatatttcccaaactcttaacctcctgattttttttttttaatctcaaaatctttttttcccctcctagtatatacttttactattttccatatatgcttttagaaacactggaaaatgcttccctacacaggtcgagattcttactattgtctctgagctaaaaaccagtctccttcaactattcattttgagacagggtgttgggtttctttacattcttccctctggttctataacagggccgtcagtttaaaatacagggtgcccagttaaacgaatttcagataacta

SEQ ID NO: 49487 - DNA, 5876 bp, Bovine  19866880646805
attcttgcctggaaaatctcatggacgggggtggggaggcagctacaacccatggggttgcaaagagttggacacaactgaagaagcaagggaagtacagtaatgaccctcagtactctctacccaccagctaataccagttataagaaccacactatcaaagggacaggaattggcatctggccagaggacagtaataggtcagtggggaaaaggggaaaaggagagggtctgtaacctgagacaggtggggaatggttcatggcttggatcccaaagatcccagagaagcaagtcttctccaactacaagattcgtaaccattctggaatgcatgtgcctcccagcaatgttgttgaaaggcttctgcatgggaggttagactcaacttcaacatccctcccttggggtctttatggtttgtgttgggggcaaaaccacatccatcttacatggcagtggactaggtcacttcatttccttcctgaagaagaatactctagagtagagagcattttaacaaccaatcaagctcctaagagaaaataagatgtaccagtatgtgcacaatattcctgactagaagatgcagtgctgactcaattcaccacctctatcctacccttccacaccaccaatcatccggttgccccaagaagctagaaagaaagggcagagcatcttacagtaaatctaagccgtctgtgatcagatggtgagacctgtagctagatcttgtatgtttccacatttcagaacaatagtgaaccaccagcatctggggtatttcagatgctcattaaaaatccatgttcctggggtatctcccagacctactgaatcaaaattattggggtaaggaccagaaagttcattttctgcaagtttctcaggtaactccttttcacattctctgagaaccatggttccagagcactgcttctcatgctttagtgtgcattagaatcacctggaaaacagggtaaagccagggctccttggccccagagactgtgcttcagatgtcttaggtagagccctgatattcacatttcatacaatctcatggatgacgctgatgttgctggtccagtcagtgggccatacttggagttcactgccttagaaaattcctgattctgtcatcaaagaactcagatactgtggtagccccaaatgactccccaccttctggaatccacatccttggtaaatccttcccttttgtgtgggctggacctagtgattcacatatattttgaataaaattcacatattttgaatacaatatgcaaaactagtcataactggtgactagttatgccaagacagtgactacccactatcacccttgctcttattcttctcacatgctcactgatgaagaggctgccatgctatgaactgcccgatggcaagtcccacaaggcaagaacctgtgagcagcctctggccaatagcaagcaaggcactaactcctactaatagcaatgtgagtgagtttggaaacatatccttccctagatgagcctgagaagactataggtatggctgatgccttgatggaagacctgtgagctactctgagccagaggacccagagaagtcaagcttggattcctgccttctcacagaagctgtgaaacaatcagtgatccaagtcactagatgtgttatgcaatgatagataatagagatactttgtacatgagcaaccctggaatcgatatgaccccttggtatttaacccatccttcaagtctctcatctcatcttccgtattattaaggagacaaatgtgtgaataaacataaatgagcaatgtttaataatacacactatttacacgtgatttatgtcataatgttcttattgctcaatttttaagctatgaccctggggaggcttcccctgggttttagggaggttgtgggggagcagagcttcagggcaggatggggatggtgcatccacatcagacctcaccctctgtgcactccacctggccattctgaggctgtgtcttttgcactaagagcatggtgaattctcacccgccagtccttgtgacaggaggagtagcacctccattggctgaagaaagagaagaaagaaatgactagtttcgctgctggcaaggggaggggtctttccctgagaaaagtcagtaaagggaacaaaatccgatctgcttgccttctctccagtgcagtgcctgacttcttcactgagggaaggggacagcttttctaggggcaaaagttctcattttctctagaactgtgtgtctagaaagtacatttcaggggctgcatgtgtggaagggccacagtctactgaaaaggctctagacacaaagccaggaccctaatccctgctccaccatccattccttgtgtgactgagttgagcccattccctctggactgtgctcttcccattctgagatgagacgatgggccaggacatggcttgaactccccagattagtgtctaagaggctaagaagagaggtagcttctgaccatggcaactggttggagatgggacagctgtcctcagagggccaggcccccaccactcagccagcgtgccctctctgaggagcgcccagaaggacagctatgccacagggggctctggcagatgttgtccagcctggtcctaatgatgtcctgcagctcctcgtcaccaagcaggaccgctgctgccagggccagccagaagtactcggtggcatcgtgcgcatcctaacccccagcatgagggcagaaaagagacagtattagcagacatttccaggacaggcttggaggcaatgccgggaaatctaagaaaactagcttttgcctgtttgacatcctttcccacccctttctcctggttccttgggggagttccctcaccaagtccatggcagttctgtggcattgctaacctcggtggccctcctccccaggcacagagatggcattttacccagacacagacaatcataaagcagcatcatcctgggcacagaactttaggtatatgaatatgactcaagctgacttgtcccaagtcactccctgggacttttcaagtgtgacctaagagagaaaatggtccctcacccttttagatgggggcttgaagttgccaataatagaaggaaaaaaggccaagtaatagagagaagtagaaacattctacggagaaggcaatggcaccccactccagtactcttgcctggaaaatcccatggacggaggagcctggtaggctgcagtccatagggtcgctaagagttggacacgactgagcgacttcactttgaactttcactttcatgcattggagaaggaaatggcaacccactccagtgttcttgcctggagaatcccatggacagaggagcctggtgggctgccgtctatggggtcgcacagagtcagacacgactgaagccacttagcagcagcagcagcagaaacattctaagccaagaagtacagagagaggtccccacgtctctctcagatccatgatggcatctgactaccagcttccagaactacctgaaattaaacttatacctgaacttcccagttccttgagccaataaatctccttatttgcttaagctagtttgagttgagctctttcccttgcaatgcctagagtccttggttgatggaatcaaatcatacacattttgtcccacttcctgggagctgtggatcaaaggcaagatcactgaggggagtccttcactaccccatccttcctccctccatggttgggatgcagaacatatggttcttccggtgagactcaaaaagatatgtctggttctcattaaccctcgtaagtcaataataaattcagaccagaaacactctggcaaataagaaaaagacagcagagctgccctaagggtctgcaaacagaagccactgtttctgtgtgaagagagtaagggttgtgctgaagcagacagagacatctggtaagggaagccagtgcctagggacaaagttcaagggccagaatgcaactgagaattatagaccacacacacagttctattaatagaagtcactggaaaaataagaagttctggattcaactccagcagagcaaacaggagatcagggctaagatcttctcaggacctaggcatgcttacactctaagaccctgcatgttattatctcaaacgtgccaacatgtacctagatttcatctaaaatatcatttataaaacctcataagaagtgagtttcaactgagtagttcatctataacattttttagacatacagttaggaattaattttaattttgaagcttatagttcttttgtttgggggtctcgtgtattgtttaggtctcatatattttcacaggtcctgtggaggagatcacaggcactagaacatgtgcccatagtatctgataaatgaaatgggcccagaaatcccagcggggcaaagaaagagaggaacatgtctcctcagcagagatgggagcctctttgaggtctccaaggggggcttaagtggagactgtcattgtgttcccagaggagccactccccaccctatgagacaacactccccaatttacttctctctactttaccatgaaggctcagggtaagggaagaatataactggacagcagctctcagacagcctcacaagcctggttcttaccttcagttggtagaaggtgagtcggcccagacgataatacaccttggcatagtataaggcctccttggggctctgcaggcagggtggacagagggacagagtcttcaggtagcagtcctcagccatctcatacatgtgcagggaatagtacacagtggccagacggtggaaggccaccagctcctgccgctgatctcctagaaattgaaagactgagagagatatcctacagccaacaccttgcatcattagttcacttattcattctgtacagtttagagaccctttcacttttaactcatgctttagaatcttggggtctaatgggtctatgactggttttgtctttggtgtatttactgtttcaataactaattcttttagcacaaaacagacttttaaagagaacaaaggcttccaattgtattttttggaatatttacaaggtggctgtttgatgcaatctaaaaacatcacttttaagcttcaaagagccaaaagccaaagctaaaagagaaaaatccaactgtctgatatggaaatatccagtcatgcggaatagcatgaaagggtgaatatatcctcctttcagcttccgttcaaggaaggataagaatgctccagagggagctgcctgggctctcaaggccttcctaagaccagcagacagttgcacaaataaggttttctgcagtaaaggaagagttaggaaaagaaaagagactctgaagtgcaattaaacacaataaagttcagtaccatccacatctcatgcccttgagaatgcccagaagtcccttctagaatcatcacagaagactccatttgcccttacatctaatcaagcatcctttaataaaacctgcttttcctcaagcatcaatatttgagatgagtttatctttttatattctgcattttttttctattttaatgacttacattgtttctcattagcttctgttgtaaatgcaagctatttcagctactgagtgagttatgagaatctgactttcatttatatttcaataccataggaaaatatgcacttgattaataatcaactaattaaaaaggttaaggcacagtgcttttgtaataaggccattagtgcataggataggataggataaaataccatttaccctggactcagaataataccaccgatactaa

SEQ ID NO: 49488 - DNA, 1076 bp, Bovine  19866880713195
atggggggaaaaaaaaaaaaagaacccttcttctactctgtggtcccagttgattgctagaatctgcatttacccagtaaggaagttagtaatcagaaactagccctcatctgcatttccgtttcctccactcccctgtgttcagtctgggtccacatctggtcattcctacctcccaaatgtgacccaaactcttccttcctcagctgccatcactgcccagtgtccccagcaccagccatggcagccactggagtaaatggttgggggaggggtgggttgagctcaagttcagtcgcaggcgtcagagccatgtgggctgctggacagtgtgattccaggctgcaaggggcaggaggggtcatagtgctgctctgcagaaccctgattaggctgtgtctgagcattgtatccagggtggagcatgcccagcaatggtggagggacttgaaacaccctgaggagagggccctgaaggagcagcggggatcctccagagtcagccccacacattggttctgtgtcccccagagagtatagatgatcccttggtgatttcacatgatgctactggattgtggcctgcaatccagaagtgttagccttctttctgagtgcctcgccagccagacaagaggtccagacaggctccactttgccgtcctattgctccctgtgctgtggttactgctgtgtgctcgtgccacagccccaccccccttctctggcagaattccactctctactgcctgtatcatttcaaaagctttttcctcggatctgcttgattttgtgcaaggcacaggtctttctccatgggctgttatctcttgccctcacccgcaccagcagggccaatgaaaggactgccttgcaatggtctaatgacacagttgatctattttaagcacctgaagcacactccaccaagtgccaatcttcccgcagcaagctgctctcagcgtgcggggccagggccagctcgaggtctgctgctgctttttgaaatctggggaagcagcccagggatccagaccctgcccgtccaaggacgatctaaagcaaccgtaaaatta

SEQ ID NO: 49489 - DNA, 1945 bp, Bovine  19866880742383
ggtgtaaacttgtctaaataactcaatttccctttgatatcaggcataagagagtaccatcacaaattgtttgagatcagcctttctgccaacctcaaggcttctggggaaaatcataaagtatgatcccttcctttctgctttttttgtaaccataaagtagaggtcatggccagaacatctatctaagcatcaaagcactctcatcaggctcaagagaaaggcattagtttttaccaatggcaaaaggtggtgtgactctcttggcaagaatggtcctatgttctgtaacatttaatgtatctcaattgtggatgtatgtatgtcagtggatgaaaatttaagggtttatttctcactgacaagtgaagagattgtgctttcattctctgtaagttcctttctggtgctaacatttaagaaatcagtatccctctaccaaagaaggcctattatggtaacagaggcactaagatagtaataatcccctgagtgactcatggaattcccagtggcccagtgtgaattgacattttaatggtgcagagtttgggcatcttaaaatgtcagttctggaatagcatcggtcatcatcattcactatgggtgcattgaggagtctgggacctgaaggttatggatatccattcactggttcctttaacagaagtttgttgtgcctgtgctatgtgccaagcactgtactagaccctagggtacagaaaccaataaaacagatgaggtatctttactcaaatatgctagtggggcaggaggtgtgataacaaggaaactaaaacacaagcaagataattacagtttgtaataactgtttgaaagttagtaaaaatatatcatggattcattcattttatttaatggctattgaataatttgggatgggggagtgactctttgcagaagcagcaagtaaggtagaatctgaaacttgagaagaaagcagctgtagaaaccaggaggtaaaaaagctgtaggcagaaggaatagtgtgtgcaaaggccctgaggcaggaaagactcaggagaaggctttaaggagcggaaaggggaccagtatggctggaaggtaataagggaaaagtaatatgaggagtgtctgggaccatgttggtctcatgggcccttgtaaggcccttgtaatggcatcaccgactcgatggacattagtttgagtaagctccaggagctggtgatggacagagaagcctggcatgctacagtcccatggggtcacaaagagtcagacacgactgagtgactgaactgaaggctcttaagcgagtaagcaacttgatctccaatttctgtttcttaaagacccctctgactgcaggaaggagaatgtattgtaaaaggcaaaatgaggccatttaaacagcccagatcaaaaataaataaataaataaatttatagacaaaactagtaaaaatggagatggaaagaagtggaaggatttggagtatgtctaaacatagatcctgttaagacttgctgatggcctggatatggaaactaagatcagaggacccaaaggaaatgtctaggcttttcagcaactgggtgaattgatgttctcttattgatgtagtaaaggaacattagaggtggttgggactagagagacctatttactgcaaaaggaaatggagctctaggttggagagtgtataggtatatggatggcacaagaattggaatattagcaaatgtcatctatgccttaagagaaagtgagaccttgaattactttatagcagtgatagtcaatgggtgtgatttttgcctctaagggacatttgcaatgcctggaaagacttatggttttcataatttggattgggggagcagcagattgaggtccttctggcatttaatgggtagaggtcatggatgctgctaaacacgtttcaaagcacaagacagc

SEQ ID NO: 49490 - DNA, 2149 bp, Bovine  19866880754719
ttaaaagatgcttactccttggaaggaaagttatgaccaaccttagatggtatattgaaaagcagggatattactttgccaacaaaggtccgtctagtcaaggctatggtttttcctgtggtcacgtatggatgtgagagttggactgtgaagaaagctgagcgccaaagaattgatgcttttgaactgtggtgttggagaagactcttgagagtcccttggactgcaaggagatccaaccagtccatcctaaagaagatcagtactggatgttcattggaaggactgatgctgaagctgaaactctagtactttggccacctcatgcgaagagctgactcactggaaaagaccctgatgctgggagggactgggggcaggaggagaaggggacgacagaggatgagatggttggatggcatcactgactcgatggacatgagtctgagtgaactccgggagttggtgatggacagggaggcctgacatgctgcgattcatggggtcgcaaagagtcggacacgactgagcgactgaactgactgactgactgatggttttatttttaggaaaaaaactgatttttgtatattgttattttattctgcaaacttactaaacttgtttattagttctaatagtttttatttttaaattagactccttatgattttctacttagaagtttatttcacctgagactatagttttatttcctatccaacctgaatgccttttattttattcgacttcactcatcacctgggggtgaaatagtccagtgttagctctgtatcctcaggtgccctctccccttctgctgtccctctcagtctgggctgtagcctccggccttgaaggcgagtgggctaatagctcaggtgagagcagggaggaagaggcggcagagaggacgcgggcgcctgggtccatccgctcctgggacgtgactgcccggcagaagcggggccggcatcgcctgttggcgcgcaccccgactattgcagctcagcggctcgggagcccaaagggggtgtggaccacagggcggcagggcgggggcagcgcgctgggcgccgggctctgctgggcagcgcgtccccgcccggcgtccacgagcggcgacccgccccgggacccacctctcggccagcgtcgggagccagaggcccctgcccgggcccctgagaccagttcatgaatcctggtcctcgtctggggtctcgaattctgaggcgagcaaagagaaattggagagctcgacacccatgatgcgggctcgccgggtggctgcgcggggggcgcggctgctcgctgctgccacctgctggacgcgccggcgcgtgtccaggccccgccccgcccgggcttctctctgggtcctgggctgtgaagagtaatggatgggatcctgtgtcctggggcgaacgagggggtgcttgagccctgcttccctccctcgatactcgggtctaagaactagacaatgacaggaaaatagaccctccatgagaggggctgtgaagaaaggattggctttgcaggaagccagtgttcacttccaactctgcttctgacgagctgggtgtagtctggtcttgagcaggtcgctgctggctttgcctcgtgtttctcaagtgtagaaggtgggggctggacaagtggataagagattatcggttcctccagccttctaactgtgttcctacctccccttcataccccttatcactgactcatttgttacaattatttatcatcattaactccatgaaagaatagaggggtctgctgactttacccctgtacctactttccttcctaaacttgtatcagtgaaggcctgtcccacagttggtgcttaatcagtatttgtttaatgaagcccccaggtcatcgtcaatatttcttccactctccatacttcaaggttctataaatgtcggttgcattattctttgccaaagcattaattaggacaactttatggtgttctagtcaagagcccccagttgggtgagctcagcttaatgaaacacacccagtgcttcccagcacctcacaactaacaaaatgctttcaaggatctttctgattttcatcctcccaactactctgtaaagcccacaaggcagggattacatctgaa

SEQ ID NO: 49491 - DNA, 759 bp, Bovine  19866880774781
gggcaatttcatccctcaaggtaggggtatctggcagtgagtggagacatttctggttgtcacagctcagggaatgctcctggcatctcgtgggtagagaccagggctgctgctaaacatccgacaatgtggaggacagtcttccacagtggagaattctctggctgaaaatgttaaaagtatgaggttgagaaatcttgatttgtcctgaagtgactagagtcacagggagagggggcaaaaaaggacagcggttcaaaaggaggagggttcaaaccctgtttctagatcatgaggttttcaccagtgacatgttttccagcttttctccctataacccatgactttttcatttcccttggaatttcagggctatgtttgagcaactttttcacaagaacttccttatcctcaaaatgccaagccctgatgcactatgatctctactatgagaaaagacaaagataaaaatataagcagctgcaaaacaagtagaactggaaggtgggcagcagaggcacatggaagcacacaacagatgcccataactccagttctatgagtcagtgtttctgatgttacaacataggaataatactcgtaagaagagcaagatgagctatgctgggtgagcacacagtgaaagaactgatgtgagagcagcagcgttagaagagacgcaggtttgcagtggcagattcaaaggcaaacgaaagggttaagcaatcagtgcatgtcattccacattaagtcaccggg

SEQ ID NO: 49492 - DNA, 1407 bp, Bovine  19866880778926
atctactgccctgccttcctactcaccatcactgaacactagagaaaacctttcaaacaggaggaatgtaaatgagcagaaaagcagtatgggtagtgaaaatgactcactctttcttcctcataaggtcatcctgagattgcacgttggttggtaatcagtgcatgctcactgaatgtcttccgttactattatgaccaccattttcaatacagatgctgactgtgccagtccagaggcccaccgtaaccccctgcaccctcatctaacctccatatccctctccgggaggtaggctataatcttctctctcctttagtacctatacccagagaaacatcaaactcagtctgttaaatctacaaaatgtttttcaaatgtgtcctcccctttccattgctacagttagacccttggccccaaatggtcttctcttaccctgctctagttttcaaaatctttcttatccctcaagggcatctttaaatgctatcaccttcatgaagtgttccctgacagatccaccaacccttagctgaaagtgttgtttcctctccctccaaacctgccccggcagatgcctgccatctcgcccatgaacacttcatgcctttgcctgatatggctttgagctttgtaagaatggaaatcccatggggagaatttagttgaaaaaactattacatcaaacccacttaataaattcttcctagaagtcagtgccaggaacaaatttgctccaacagatacatttgtttatatttttttttttatcagacagtaagaacctcatatggtttttccctttttacctcagctaccaggaagcttagagctaaattacagtaaccacctccaggtgcatggaaacacttgtttatctatttctgttagctggtctttgttctattctttttcacaaaggctttgcaggagtagttgattgatagacgctaaataaatgtagcattatagcatgttctccttgacaaactgagcatcctgaaaaggggtaaacatcttatgcccacacaaatatgtatgtctctctgttctatgctagacaccaggtctacccacttggagtttacagtcactacattatgatcttctgaagctactgcagagtctttacaaatccccaaaagtttaggtctctgatctagaaggcccataactttaagaatctgcctccaaaactcaagactctttggaggcagcaggaattcttatactaacacggccattaccagtgtcagcatagcatagctggctcatcctagacttaacattttagaacaagaaggcaccttattcaatttaaccttataaatggggggaaccaagaagagaaatggcttatttaaggatacattgtaagctcatggcaggctcaaggtttcctga

SEQ ID NO: 49493 - DNA, 3923 bp, Bovine  19866880785091
tcttcttccaatgatcctaggctgtaggtccctctgttcatctgcagcatcagcagagcaccctgcacgttttcttatgagtacttattagagtgccatcctattatctgtggaattctggggtcagtgttacgaggacaggcagcaggtgaatgcggttcaccagagcccagcccttagaccagaggggacactgagtacctatctgcttaatgaatgaatgaatacattacacatcaaaggggcctgtgaagtcatctaactcaacccttgtcctttctgccacatccctgcaaatgaggggcctctccgtgtttgaagcatctggggctgggaactcagactcaggcatgcagtttactccacccctggactcctcacatgatcagaaagctcttcatgtttgcagaccctttacagccatgtttccacattcctatggcttcttcctcctgtctgcctctttaccacacaccatcatctccacatcaacatcccactcaagacctactccaaataccactgtgatccaagctttcttcttgcactatacgatccctgtaactattatgaggctgcgggctccacaagggcagggcccacgttgtccttgtgccctgctgcatcctcaggacctagcacagagcctggcacaggacaggcacacatgagataccagatggatggaaacctgactgccaactttgcctgtctttagagactctttggggctttcctggcaactcagcagtaaagaatctgcctgcaatgcaggagacgtgggttcaatccttggatcaggaagatcccgtggaggagggcatggcaacccactctagtattcttgcctgaaggatttcatggacagaggagcctggcgggctacagtccatggggtcgcaaagagttggacatgacttagtgattgagcacgcatgcagaaaatctttagttaccaggccccggggaagaaaaggggttagtggctgcaaagtgatacatacgcagatgactcggttgggtgacccgatgctagagccagggggtgagatggaagtttcagacgtccgccgatgctgtgggagagaggaaggcagagggtgagaggctgtgcctgccgcttggtggggcggggagatggggtgtagttctttgggacacattagtaatactgctaaaagcactctctagctctttctgtactacctctttatagtctgccttttaaatcaatgtctgactgtgaatgaacgtggaaatgcacaggaccttacatggttggacagaatttgtttttcaagtatttttaactggcctgttagatagtagtaagagtcgctcagtcgtgtctgactctttgcgatcccatggactggagcccaccaggctcctctgtccatggaattctccaggcaagaataatctactcataaaaacttgtcattttggcttatcccagtcaataaggtgtttactttaagtggatagaactgcttagcctcattctttagcactttgtttatacaaaaaggaaaggtaggttaaatgtcgcatgatttgcacaatatgctgattctttttatagtgtacccactgcaaaatgacatcaacctaagtgagaaacttaaaaactctttctctgaacaatggcaatgatggattaacggctcccttaacagaaaggcactgtgttcatctttggtgtatttaagcgagtggtagcaagtgcggttaaatagtaaacaaattggaaatcaaggttcactggtaaactatgtgattttaggcatctcgaattcctgatctgtgaaatgagggggcttgtcttaaggactgctacactcccttcaggatctctcatcctacaagttaaagccactagggaagcccctaaagcattctaagttggactacatggcactggttcccaaacgtagatcatggactagtgtgtctctggggagatgaatttaggaaaaaatttgataatactgagtcatagagtgagagaaatgtaaaattctatttcaatcctcttggttagattaaggaagaaatcttaatttggtcctaatacatttcaataacaattgctaattctgttccccaactctctcccccactgttttttttagaaaaaagaaattacaggcaacatgattagctaaaatttctagagttattcttccaaaatatttcattttcaatgaatttattttagggttgccttctatttatagaaagcaatactgattttccactgggtgatacaaagtctcattttaaaataagtttgattaactaaaaaggagtaagtgagttcaacaaaaaaagaagtacatgattatataagtggtacacagatatagcaaaaagcatcaggtttgtagacaggtaacttaagtttgagaaatgccaacaaagagaaggaaattgtggaagaaaaggacaaatatgtcttcttacaccttaaaaaggagaggccttggaagaaattggggaaaaaactcaacagctcaaaaaaatttgcatcaataaaccagctctttcacaaatggaacagacgagatggcaaaggatatagtttaaccagctggtcagaaactgtacacacgcatttttagttgagattccagcaggtaactttcacagcgtcccaacagccgagttaataccgggggaccagggtggagagacactttaagaggtcatcgggggcccccaacacacaccgcagggctcctctccacagcatcaaggactaaggagctgtgccccacccctcctgcagtcctaggatcaagaacccagattcatgggccttcctggtacttgtcagcacacggtcattcagagggacacaggacctcagctgctccagcatgtgtctggggaggctggctgtgctcctgcctggctgcatgactgctggacagtcaccaccctctttaaggccctggttttctcacaagcaaagtaaagatacaattccttacccatctgccctgcggtattaaaacaaatcagagggtggctgtgaagacgccttgcaaactgtcaacttctgtgacaattttaatcactattattaatgaatgactttaggctggggaaaaaccatggcatctgtgcctcatagatgccaccatcctggtgagtaatgagaagggtgtagcctcgccccagaaacatgaaaaactcatattcatacagtgctttacagttttcaaagtgctctcacatccaaatgtcttaatcccttcaaaacctccatgaggtggatgttactgttaaggaaatccaaggagacaggcacacatttgaaagtgtgcacactaaggtgtgattctctagcaaagcgcagtgcctccaacctgggaccagaagtaactggtttggtattatcaccacctttgcttacctttaacttcttctctgcccgggctgcctgcttgcagatggggtgccagacctcagaacctaagggaccaggaaaataataatttcagacctttcacacccatcagaatcctgggtttttcctcatgcccacctccatttactcccctgtcagcacatgtgcctgacagcagccaggaggaccccttggttttcctggatctcagctgcaacgtcgctccaaccacccacactctctctgcctgtccacgccctgccctccccaaggtccacatctcatatgacatcctgtgaagcttcttacctgccagctgcgagtgacttggctctcctctgtgatccgtcattctctgtatcattcccagcacatatggccttaaaacatagtagcttgtggatttatcaccccaactaaattaagagatccttgtgggtgggagctgagcttacttcattactgggtttcccacagcatccagcatggggcttgctctcagcagagg

SEQ ID NO: 49494 - DNA, 2935 bp, Bovine  19866880808476
tcagagctggcccaggattagtgacttttcctggttcagttcttttcccaaacatgatgcttctgctggtccaacctactaaaatgatctttcataagaccaaaatatgttgtaacagctcattttttttttagcaatctctatgcaagcaaatatttttaaagaaaactacataaacatgtaatgcattctcatagttcccaagtaaaagattaatatggaatggcatacaaatcctgtctccttcccttacccctgtttcatctatccatagcagtgctttttgttagtttcttgtgtattcttccagaaatattttgtgcataaataagcaatttaatgacatactctttccattttttaaacacaaattatagcatgctatatacttggcttttacactcaagttgttgtcttggaaaactttccatataaatatatagagagcatcctcattcatctttacagatgccaagttttccattgcacaacggggaccctaatttatatagctgggtctctaatgatgtcaattttgatggtttccagcattttgccattgtaaacaacactgcaacaacaacaaaaaaactttatataaatgtcatttcatggtttttgttattatatatataatattatatataatatataagataaattccacaaaaataaaatagaatcttaagggtatgtacatttgttgtttttatagatgttgtcaaattgcccccaataatagtctcctataaggtagactcttataatacttgagagtgcctttttctccatgtcttctccaacacagcctgttaccaaaatttgtatctttgcatatttgatagtactaataaagtatctcagtattttaaaactcaaactatagaaatgtaaacattaataactgaatctcccttcctcacttctgaatttcttttccaggatactttctatgatcattttgacaataagttctcattagctaacttttcttttttactcaaaatacatcattagttttattcaaaacatacagatctgcctcattcattcatacaacaattatttcctgagcatttatcatattttaggccctggagataaagccctaaacaagacagatacattccatgtctcaaggggcttgtattctggttgggaagacatgtgctgctgctgctaagtcgcttcagtcgtgtccgactctgtgtgaccccagagacggcagcccaccaggctcccctgtccctgggattctctgggctcccctgtctctgggattccccggagaaggtgccattgccttctccggggaagaacatgtagcaatggataaaccaaatagactattatgtaagagaatgttaagtcccttgaagaatacacagggtggcttggcagaggtgctaaggtggggatacagcctgaccaaccccctgcatctaagattgttaagaacaaacaggacaatggctactaagggagcaaacattattaatagtaggaatttatttgatcttataattttttattggagtatagtccatttattggagaaggcaatggcacccccactctagtactcttgcctggaaaatcccatggatggaggagcctggtgggctgcagtccatggggtcgctgggagttgggcacgactgagtgacttcactttcacttttcactttcatgcattggagaaggaaatggcaacccactccagtgttcttgcctggagaatcccagggacaggggagcctagtgggctgccatccatggggtcactgggagtcggacacagttgaagggagttagcagcagcagcagcagcagcagcagtcgatttataatgttgtgccaatttactgctgtacagcaaagtgactcagttatacattcttttctttatatatattcttttccatgatagtttatcaaaggatgttgagtgtatttccctgtgctatacattaggaccttgttgttaatccagtgtgtgtgttagtcactcagtcgtgtccgactctttgtgacctcatggattacagcccaccaggctcctctgtccatgggattttccaggcaagaatactggaacggggttgccatttccttctccaggggatctttacaaccaaggaatcaaacccaggtctcctgcactgccggcagattctttactctctgagccaccggggaagccctgttaatccagtagtgatttctcatttgttagttttggcctggactgacctgttcctctggtattatgtagacagaattcagatcagccttaagatcgcctcagaggtgctgagctagagacagaaaaagcccttccagtttccctagtgggctaaaaacacaaatgtcagtctaattcctgaggacacgagccagaactcagttaaaagaaaatgatctcctcattttcaccaagcaataaacaactcattgtcttgaggtttagaaaatcccatttggatttggagtctagcccagcaagcatcacatgaattaggtagtggaaagagtcctgctcagtggatcaggtacagggagctgtgtttctgattcctaccccttactcgccatgtgactttggacaagccttagtgggagacttaaagtattctgggcaggaagtgtgataccaagtagagtcagttctgactcttacttttgctgtgagtcatggttcctccttcataaaccagccaaatccccaccttggatttcagttctggtgtaagtcttgtatgtatttaagtcctagtttttcccagggagggaccttatttagttccttcttccctttccttgagaccctggtcctctgacctgctcttagacctcccagaaaattctttggtcataaccagctatcaggcgtgtagtttaacacccctaagagctggagagtgctggtttctac

SEQ ID NO: 49495 - DNA, 1277 bp, Bovine  19866880809774
tgtagaaatagagtctaagtttggatggataatttaattcaatggccttttaattttttctgaaatcaaatatcttaaccactaagtctgattttgccagaaagagaagttagaacagcagttttcaggtttttgagtatgtggcttacattcaaacactagaaatgtagagctcccctcaagggatcaggtgattcaaaagaaggctaaacaagtcaacagtgattgcaatgtaaatactaattccacataccagtgcctcagagaatctgtagaagcaccctagtttgtgctttgtaactttatcacccagcaccattagggagctcctaggggacagccttttgttgctctctcctgctcctcctatacacacagccatgtgccagcatatatgcatcctttcttagacgccagctagacaccaaactgtatcaattattcaaaacaaattctaccatctctacactatttcaaaaaactattcaactcatttttatacctgacaaacagccataacagtgtgaaccaacaggttaagtaaaattaagtttacacattgagtaactgtaggagcatacctgtgatgaaactatagaacaattgctatatgatgagcatgatagaaacggttgtattttgagcactaatgttgcatggggcacaaactggtggctgaattaagccttttaccattactgcccatgatttaggtgtcaccagtaaatcatgaacatatcctaattcaaagggaagatctgccccttatttaattgtgggctggaatagcctcttatctgaagtcttcagaagacaaggcaaaatctgactgtgactcagtggacattgaggcgcaaggcaaacaaactccatgaacccctaaaagctcatcctcttctgttgacttattgatgtgcaatctaggcaagtcagtaagctgttatgagcctcgatttctttatccataaaatggtgatattgataatgttttctctgtaagattgtactgtgaaggcaaaatgaagtaaagatcattaaagatctttataaactgtaaagtggcatgaaggaaaaagagtaattattatttttaaagtgatgttctaacagaacctggactgtagccgaaagcaggctgactcagaagcaggtttgtaggggagctggaagcctgctggggcattgctaaggaaaccagcagagaaatgtacgtcactgagccccatccttatctgcccactgcatagtatctaccaagagcacaaacagtgcaaggg

SEQ ID NO: 49496 - DNA, 1130 bp, Bovine  19866880903988
gagggaggtaggaggggggttcaggatggggaacacatgtacactgttggcagattcatgtcaatgtatggcaaaaccaatacaatattgtaaagtaattagccccaattaaaataaataaatttatattataaaaaaataaaataaaataaatttttaatttaaaaaaagaaatgaaaattaagtgtattccatataatgtgtccattcttccacttactattgcagtaaaatttcttactatagccataagtttctgtgtacatcttgtatattacagtacacttgttcagactcttaagtcttgaaccattctacatcatatgtcaaaattcttctcaaccaccaattcacaggtggaaaaaaaaattctctttctctgaattctttaactcaaaattcttttaagcaagaataaaataagatcctattaagtaagaatgtaagttctgtaagggtagatactttattttgttcatttctctatctccattacttgttgaaaagtgtcttgtgttagtaggcaatgcaaatttcatgaattagtgtaactgtcttattcctagcttctctcctcaccagactgcatgttcactgagagcagagaattgtaatattaatatgaatcactcatgcactgcccaacctgcatgtttaactttttatgctaataattttcaaacatatacctaaatagagataataactctgacccaaataacccagttttattatagctagtttttctacatctagcaataaaagtcaagcaattcaaaagtgcactcatgcacaagctaaaggtagagtgatttcaaggtacaaaatcaaatttgtattctaagtgttacattcctcactcaaaagtcaaaattttcagtggtttcatgtccagatcttaatttaatggatcctttcaatgaaaccttctaaaatgtctcttggaagatgaaattagcaagtaacattttttcctgaagcataatagaaatagatttgtactggttctccacatttgtttcataaatgccacatcctaaagctcttcattatgatagttgagtttgttgcattttttcccaagaagagttaaaaaaaaaaaaaaaaactcacagggagaagtcccaaga

SEQ ID NO: 49497 - DNA, 1225 bp, Bovine  19866881123592
tgaaacacatgactggacgcatggcctaacaatgggatgaaaaatttgaaatgaggacagttgtacataaggacactagaggcacaatgaacggactctttttacctcgtcccatttacctataacccaaataaagctagatttgccttgtgctcaatttctgtgcacagctgtattaaattctaatgacgaaaagaaacatatctaacaatccaaagcaataagaaaaaacaattcaaacatttgctggattctctttcaaagaaagtcaagggagaaggcatctatgtaataactagcgaaatagaggttaactgaaagcttctcattcattgcaataattatatcacaaaacatgagtcaagggaaatgagatcactccacctattttacagatgagaaaactaaggctcagggaactgagatggtcccagactccaaatcaaaacttccgactcctagtttagtgagcttgcttttctacacttgtgcacacacacaccaccagacttcctttccaccattctgcattataaaatactttttaaaaatttcttgacactaatggcagcaaaaaatgatgattgtcaatatgagttcaagaaatactcagagattcattgacatttaattcccaaacctcagctaagtgtggcgcccagacaagaagaaacaaacatcaacgaaccatacacacattttcactcttgcaacctctctaaactagattaatgcttcattaaaaaaaaaaaaaaagcaacctaccagaatacctcttttccagccaaagaggcattctgtccccagtcgactctatgaaccctgggacaataattaacatgtgggccaaaggcccaaacccattggcacaggacagattctcagatgagaaacagagaagccccaaatcccactcacataaagggcttattgacactggtagaaagaacacagactacaagggagacagtgaggcagaatttgggctatagaggaaatgggtgggaggacggggtagacttcttccctatttcaaagccccttagattttcaccagagccttttctaagtttacaccctccattggactttgctcctggctaacaagcatttccccacagcacagaatgatgtcaccgaagccaaagtaatccaggtctgctaacacattcctgtggtaaaatagaaggttttggagagctcccgtggacagatcagctcaggg

SEQ ID NO: 49498 - DNA, 1937 bp, Bovine  19866881125010
aggattcaagccagacataggtttttcagatagaacttgcctaatataccctagactttcatggcaagtagtcccctgtctgtcagtgcacgtgactgtttacacagcgtaaaggaatattaccagacataacagaagaggaatccagaataagagtgggattacagcagataagatttcaggtcccttctagtcccatgtatcagtgatttttaacatgatattaattatgttctaaaccttaagacattcatattgttgaatttattaactaattccagactccaccctcctactctggggatgtagaaaatatcaaaaggcaatgtgaaagaatttgaaactagagcatcaggacgagtagatattggattgtgtaatcaaacaggtgctgcaacatgggggctgtgaaaaaaatagatggactaaatactagtgaatatggagaataacaaatatatatgttgcagtaacatcagaatgctaatgtgattgttcagattcctatttcactgacatcccaaagatctcattttaactcttggtgagatttctcattctattttggatgtttttatcccccaaaattggcactgaataaaatggaaagtatatatgtagtgtcatcatattgatcagaggaatttctgggtagaaaaatattaaggagcaattcatatctctggctatactaaatatttagttgataaaaaggaaataaaactgatatagttcactttctacttctcagaccatctaggtcacttttaacatagccattcatggtgtttcctctagagaggagggtatgccatagtctccccttgtcttcctcctctcatcaaaacagtcgttggtgttattgttattgttgtcatcatcattgttctcgttttcatcactatcatcatcatagaaaaggctctatgccaacaagtttacacacattatctccttcaccttagcacattccatcaaattataattatcttcagtttatagaggagacaactcctctacagaagagagagaggaaaagaagtcatttggtctaaattaaagtgagtaaggcaatggcaccccactccagtactcttgcctggaaaatcccacggacagaggagcctggtaggctgcagtacatggggtcgctgggagttagacacgactgaatgacttcactttcacttttcactttcatgcattggagaaggaaatggcaacctactccagtgttcttgcctggagaatcccagggacaggggagcctggtgggctgctgtctatggggtctcacagagtcggacacgactgaagcgacttagcagtagcagcagagccccttttctcagagtgctcccctcccaaggactccctccatgccatgtggagggccagcatctttcagctggaggggcagtgatacagcccagaatcctgtccctgccatcccaggaaaaatctccactagttcctaccccacccacctcccatctttgctcctggtccaggtcatctctggtgtctgtgggcagacggggcatcaggacaaggtttccttttatgattagattttacttagaaccataaatacatttcattgatcttgtttggtttagttgagccttagggagatacagtgaattccaatcaagaaaaaccagggagaagtagtctaatcattgttataagtcttcattttttttttttttaaccaggtgggacagagagggggcatagaaatccgagttgataactgttcacagggatgcaaaaaagtttgtcaaataaaattagaaacctacttaaaaatttatctaaggttataccactctgtgcttattgttcctggtgaatacccaactaagactaagatcagttttctgtctgctcctccaccctccccacctaagtgaaaacagtatgaggtggtagag

SEQ ID NO: 49499 - DNA, 429 bp, Bovine  19866881156519
aataggcacccactcaatactatttaaaggagtgaatttgtgccttcatccaagagtattaaaatttggcctggaatggaatgagagctgcaactaagaacctactctgaagagagcatccaaggaagcattaagtaatttattagtagtctttaaatcagtcatcaatctgtctaaccttatttggattcagtccatattttttccatctcatttgcaagatctcatgggaggcttttctaaagttcagctcactatgtcaactgcatgcccctgctctgctgactgtccaaaaaagcaaacaagatttattttatgcagttagaattcgtgcatagccttaacatacttggtcctccatcctctcacctgtaaaatgctggactacatcaggtgatttcctggattccttctgaccaagactttggg

SEQ ID NO: 49500 - DNA, 1857 bp, Bovine  19866881180545
catattgtccattctcacccttaagagtgtttctccccagcattagaatttcctccactattgaaccacttaagtaacaaaaggttattttgatccttgtcattctcttacctagtataatgtcaaaaaatcctactgattgtatcttcctgggactttccaagttcagaccttcggcatgtcttacctggaccatggatttaggtctcacctctatttttcagtcactttactacctcttcatgaaaaggctaaatctacctttccaaaaggtaggccaatgtgtgctttttccttacttaaaagtatttgatgactccctgttacagaagtacacactcttttctatggcatttgaatgagttccttttaggggcaatactgggaactatatgaccaaacaagcaactgtagtatcaagtggggcttaatgcagtgtggtcttgagctaagctcttggtatgatcaagattcttcaacagacaagaaattgtagggaatacagagaagcacggatatgtgatccagattgtttttaaaattgtgctttctgaaaattccactggtcattagcagctgtgtaggtccctgaatcatttttggcctggataactaggactaacagagatgtgataaatgagggaggtattaaataaacagactagaaagtcttttccattacaggtttgtaggcatgaaaaccgaacttggggccatcattattgagaataagtgagtgaggtttattgaagaaagccacttatggcttgtttttaacaatggatcacactcaaaatttatatgtatattgtttatttgcctgtatattcttattttaatcactgtctctgatttgtggcttaaaaagatttagaaaacaaaatattcctcttagaaacttttttgatgaggcacctttttctaaccactcttccatttagggacagacctggaaattacattgtagggccttctgggtgatggacagttcagatagacacattgagagaagaaatgggaactgcaatagctgatcttggttaagaataatcaaaagtggacaatacatactcacatatgcttaaaatatccaattggattacacatggagtgatgaacagaggttccttctgcaactgagtgatgcatttttactctgtattttacaccttataggatttgcttaaccatgaaaaataattacacatttatattattacagatatgcagaagataccacccttatggcagaaagcaaagaagaactaaagagcctcttgatgaacatgaaagaggagagtgaaaaagttggcttaaaactcacattcataaaactaagatcatagcatctggtcccatcacttcatggcatatagatgggaaaaatggaaacagtgacagactatttttttaggctccaaaatcactgcagatggtgattgcagccatgaaattaaaagatgctctaccttggaagaaaagttatgacacctagacagcttatcaagaagcagagacattactttgccaacaaaggtccgtctagtcaaagctatggttttttccagtagtcatgtatggatgtgaaagttggactataaagaaagctgagtgctgaagaattgatgcctttgaactgtggtgttggagaagactcttaagagtcccttggacagcaaggagatccaaccagtccatcctaaaggaaatcagtcctgaatattcattggaaggactgatgcagaagctgaaactctaatactttgggcacctgatgcgaagaactgactcatttgaaaagaccctggatgctgggaaagactgaaggcaggaggagaaggggatgacaggatgaga

SEQ ID NO: 49501 - DNA, 3217 bp, Bovine  19866881196711
ccatacggcaggggtcagttgaaatagagtaggaaccatgcctctttggccacatctctcactcccttcatcccagtccactcactcatttatatgacctcctacccctgaagcactgagtttgtgttccctgatttgatacagtcatccatctgattcccaaagatctgattcctgtcaatctgatccttccaacctcaaccagcttccacatacgggaaactcactgtctggaaaggcagctcatttcatctctgagcagctctgactcttgggaatgctttccccgtgtagcccatccccctcagcatccccaaatagattgggatgacttgccctaagtctcctagtgtgctggaggattagaagcaaaggtctcaagctgatggcctttttatcccacctgacagaggtgtgttctttctcaccttccttattcactcactaatgcccagtccaatttaggggcagaggggtacttggagaaatgtcattcaacatcaattttatttttgacagaagcgtttgccttcgtaaatattctaaagaacaagagttggcagactttttctagaaagggccagatagcgagtctcttaggctttgtaagtcctgcaggctctgatgtaactatcaactctgctatcttagcgcaaaagtagccatagacaaaacatccatgaatggacatagcaatggtccaataaaactttatttacaaagacaagcagtggaccagaattgatcttcgagccatagtttgtctgctatagttgtagactggatcagcagaagaggagtgtgtctctgctggtgtccccatgccttccatcttgtaaggaccaactccatttctgagtaggaatcaattgccctgattcctcagcaggaagttatttctaaaacattaggattcctatagtgcaacagttttcagacatgttacagggacccctgagactcctggaggccctctgagtggtccacaggatcaataccatttttgtaaccatcctaagaagtgttgtgcctttttcactctctgtctctcaggaggatagagttgagttttccagaggtgatgtctgatgaggtcaccactgacagctaatggaatgtgtgcttctgtttttttgttttttaaaaaattctcgatgtgactctaatatgatagatatcaatagatgcaaagcacctaaacaaaagctccttgaggttcacaatactatttcaggggtgtataggaatcctgaaaccaaagagtctccaacctgctgccgttgtgattttcttatacttcaaaacagttatcttaaatatgaatctttcaaagagtccttacaagaatgtaattttctagcagtcaggatctatgctaaccgttgtgttccatgattgcacatgaatttgcacaaagtaagttcatttattttaaaggtgtttattataaatgtgctgtgtgcctgatattgtacttggcctgattagagaagtgagctcgataaacagcatccctgctttcatcaagcttagagtctaatggagaaaacaataagcaaataatcacaacttgttatatcaatacatactgaaaataatacagtcaagggagggtacccaggactctgagaaccagtaacagtagggtttgtactgtgaaggtaagtcacagaagggcctttgacctgaggtctatggggtgtaagcatagatctaaataatctaaagcaggatttctcaactttgacactatctaggaccagataattccttattgggttggagaggagctatgttgtacaagatagttagcaatatccctggcctctaccaactacatgtcagtatcatacccacacacacacccctcatttgtgacaatcagaaatgtctccaagcattgacaaatgactcctggcaggtgtagtcaagaaggaatggagaattgccccagagttgagaaccactggtgcagaaaagaggtatggtaggaaagccactgtggtagcccagaggaaagatgcttgtcactgggccagagctgatggagatgaagatgagctgaatggcagagctgtgtgaggggttcatctgcacagcttggtgatgggtggaccatgagagtggatgtggggaggccaacaaaggatttcagggcttatcatgctgaaggactgcctttggtttgggcaagctggctctgagacatcacagctacactcctcagaatacactagataaagagaggggaaatacctttgtttgtctccctgtctgcacgacccacctgtgttgtgcatttctgcctgataggggtggctctaataacagatcagaaacagctcttcctaaaagaaatgacaactttagaaaagaaaaaccatctgccagggctgagtgaattaaatgtatgtttaatctagctgtattaggacattatttcaatgccagttgacttttttttaatgtttgtgaaggttggcaaacgtatcagagaaaatatactttgtagtactcagaaggatattggcacattctctatgatggcactttgataccaattaatatatcaagatttctaaaattctcatctcagtgccaaagattgtatgagtcttctagtcactgacccaagggttctcagcctttagtgaacaagactcttcagaggagcttgtttaaattttaaagtctgactcagtaggtctggggcagtgcctagggatctgcattttgataatccacgccgatctccccccacccaccaacccctggacattctgaagcaggtggttagctggtcagtttgagaaacactcccatagcaaaaagcaccatgacggaatgtgttccagttttgcttccaccactgacttctgctctaagaccacttcatctcacatcccaccccccgcccctgcttggctagctttgcccatcttcagagtggcttcaggaggctttccctgatggctccgatgaccccatagcatagccttagttccatagagtgcctgcagcaacaactggcagctcccaattaaaagtggctgaaacaatctagacacatctattttataggacagtgagtccgaggagggacagatccaagacaggttagttcagaggttgagcataatcctcagacacccagattttttctatcttggatggctcccctgtagagttcaccataggcaccagggcggagttccag

SEQ ID NO: 49502 - DNA, 1515 bp, Bovine  19866881199612
taaaatgcagtgtaaggatgatgacaactctatactaagttgtcatctattttgtttgtagtgataaaaatgtttcccttatctttcccaactgaatacattttttagtttctgtggaaaaggaagaattattgtagctcttctttctttgaagttttggtttttgtttttaacttttatactgtcagtctgattcagaattctccaagcttgattctgattgtgcacaaacaaaaaaactgcacaagcgtgttataggaaaagggaaaaagttaattaatataaatggcattcatagtgaatataaatattatagtcaatttttttgtcaattaatttttaaaagtaatatcttattaaggaattctaaattttaaaagctcatcataaacttcctggccttactattagataaatatctctttaaactagtttgtgattctattgaaaaacaaaggttaatatgaagttaatttacaaataggatcaaatgtatactttgcagatatcagactgagggatagaatctcctggttaattacaaatgagcatttttttctccttttgcagatttgttaaatcttaaatacagctattaactcctgaacttgtcacattagttctccagccttgttttaacttttccctcctcctctttttttttttaggaacaaatggattcagtccttattttaactgttgtgatgaagatgggttttggactttgagaagccaggagacaccacctaaacaaccacaagaaaaaccgaggactagtgcgcactggggaaaagaatacttgaagactgaagattgaacacctgctgaatgctcctattgagatttttcctaaacagacatctctaacattttaggacgatttcaccggagaaacattgatctctgggtggaacatcctaccattggcccgtctgaagagttgaatctggatttgactcctctcttctaccaggaatattattaggccagcctttaaccagtccctaaataattgtaatcattaattaacccagaagttcttcaaatataagattaaaaagatgaacagatataattcttacccttattaaagacaaaagagttttctaatattttgactgatgatgtaaccttatgttttctttttagtttgttagtggtttttattttaaagctgtttggatattcagcatagtacaggtttgccctctacctgaaagtaggggtgttcttaaaacttttccaaagctacagtggcataaagtgaaaaaacagttaccttaggatacatgttgctgatacattgagataatgcttagatgctagctgacacagttcaagagcctgtggtaacttaagggctgagaagcagttcccagggaaagaactttgggtggtgccattcttaatacttcaaggtgcatactacgttctagatctgctgagaaacactgagcgctatttttgattttgcctttttttatttttttggaaaagcaaaatacctttgaattt

SEQ ID NO: 49503 - DNA, 1065 bp, Bovine  19866881218939
cacaactgaagcgacttagcagcagcatgtcatttttcagtaaggttttgatgacccttcaaagtacagctctatggctatcattgaaccataactttcaggaagactttatcattattattgcttatgtgcatacatgggttaatgataagcaaactaaaatcctataactactttatgaaggaggctatttcatctgatccttgcaacagggagcttgatagaacgtcccctctctcaagtccacagtcctacccacagactagcagcacagaagtcttgaaagagggagaaagtattagagcttctctcgatactcactttcacctcagttttaatttttttattttgcatgttttgtagtatacctgataatatcttggtatatatgtaaaatgctcatattatgtaagagtattcaaaattatcttactgatagagggcatgatcaaaaaggtttgagacactgtgttaggtactgtggtctccatgttagagcacttgagcaaggaacaggatgtgatctgccagccatgttgcaaggtgtgcatttcatagtttggtgacaaatttctggctgggttaaatgcttgaaatcaattcccatctccccatttttcctattcctgtttcccaactactagtagtggcagcaggaccaattaacatgcagtgagtgcttgctctgtgccagacactgtattaaacattcttacatgtcatctcacttaaaactcataaaaaactctgaggtagacactattatccctgattacaaatgaagaaactaaagtataataacctgttcaagaactaccagtggcagagccaagattcagccctaagccatttaggagttccttgaataagcaggtagagctgaaggggtagttctggattcaaatacagacttagtcatttattaggggggctgtacaacagtactgtgtctacttagagatacgtgatacgttgttttaatgtctagtccaaatcctatagtggccctcccaggcagaggcaaagaaaacatgatgcacacgggatcctgcatttctgatggat

SEQ ID NO: 49504 - DNA, 1685 bp, Bovine  19866881220407
acaatatataacatcctgatgggcaggtccttacccgttctccttaatatttgtcagaaaaataaaattctctaacagtgaaacacatggcaatggatagatagttagaaaccagaagagatccccaaattagaagagtttgggaaatatcttttatttgaaatatttaagaaacagaattaaataattctccctggaggtggaagaggagccttacttaaatgacctctgtaggtcccttttagtctaaaaaaatccccacttagattctcttcagggaaagcacaaaatgatttaactcttcaacacagccttattcttggcaaggttgaaattcaacagtgaaaatcaaggaaaatttgtttcatattctctttaagattgtttccaccaacccaacgcttccctctcagagttgctttgaaataatgcctgaggctttaactcatttgtctgccatgaacattctgcaatgtaataattgaatgccagagatgtgtcctgacaggaaattcaaatcattgatgttcaatgcacaggttaaagaccttgccaaggccagaccttgaagggcactgtgtaagttgaaatgcctaggttccccctgagttccccacttcacccccatttatcttgttctggtcagtctatctgacctagcagtatttacctatcaaattatattttacaatttctattttaataacaaactattaattcctggacacgcactgtcatgcatggcatttggggatatttgtgtagctaccttttatttgtaagaatttcttcagcgttttggggtttctgacgttgctctgtcccttttctcagcctcttttcttttcccttgcattgtttattagcaagggcatgaaaccctgctcccaatgactcattattactcaccatagtaatctacttttctttgtgaggctcagttcagaagatgcttgagttgccattcctgagaacaggtcctaagagcacatcctgttaactctcatctctccatgctaatgccaagaagcactgatactgatcacagaaagtcgaacagctgcttcatttgatgttggccaagcctgacaccactgcaagacgactttctgcagtaagcagagaccaggatctgattggggagaaaaaaaagaactctggattgtaggctcctaatccacaaagcaaaggaaatcaaattgtatttatagagccctagaaagggctcataaaattcataaagtaatttgtcatacgctaaattatacttttcatgaccagttttagagataggtaaatcatcccttgttatatatgaaaccgaggaaggccctgtggagcttccaggcacagaggaccttttgtcccctgttttgtataggcaagattccatgaccttccctgagttccaaagtgcagattcgaaccagttgccaattaagggaggagcagcccagaaactatctgaatcaagattaaagggactagagaatctcatcaagattagagactggaccacgtgagatgagattaagggcgtgcaaaccctactgtcatcctaatcttgtcagagacctcacccttaaaccattgttataaaacctttatcatatcctccgcaggttgagacatagatttttgaggcagactctcagtgtgtctccctttgcctgttaaagcatcac

SEQ ID NO: 49505 - DNA, 1674 bp, Bovine  19866881334659
ataattcaacaaaatcctttgtggattatatttatcatcatggcctggcataagtgccccaaaatcttagcagtacagcccactggattcttcttcctttagtgtggattttaggctttgcaaaaccttttcacacatacacacctcatcaatcttcagcaacccaataagatctctcacaaaagctggaatcccataagagcacaaaagaggttttttcatgaaagtagaatttcagaagtaaattggaattgatctgctcttagaaatgaaaagtgtttgatccagaggtttactattatatttaaatcaaacagtgcttgaagaagcagtagaaaatctatcaaaagcagaggaagattcccttccctttgagggttatgactcctttctggcaggaaaacagcaatcagccagggagccactatgtacctgctcctttttgtgaatgaagagaggctgcaaagccaggaaccagagcagagagatggctagttgctttcttcttccttcctgttatctagaagcctcttccttgtagtatcagggcaagaagatggacaggcaggtggtaggccagaaaggctgtggctggcatgagatacccacagagcagcagttccctgccagtacttggggaaacctgagagttaacgtcaaacttcctgcaatcctaggaagggtctgattccaagaaaacaggctgtgatgagtaagaaaccagtgttctgatcaaatatgcctgcagattaaatagtgaattgtgccaagatttgtgagaaaggtgacaacttgtgagcaggtgtttgtttcgccctagttgtttagtggtgaggtgaaactaggtttgcctacaatattcacgtcttttctaatcttcagtagctactaacagtgttttgcttaacagttttcttcctcccttcaaggaccgatacttctgaagagaagaaagataaaatttcaaatcctgttaaaatattttttttcaaatgctctctcaggttatactatgggtttttatattctgataaagaagtgaacttgtgagttgcagtcattggaacagaattaataggaacagccttacttaagccctgactagagttctttgtcatccaatgtagttaggttaaacaccaacagggaaatattaccagtagataattctacaaactgaaaaagcaagggaattaacaaaagtggtttttaagaaacctagactttaagtttttagtctcttgttcagatcatctcttgccatgtaacctaattcctcccctttgtaagctagtggtacaaaataacaccaatttattgtttctgatttggggagtcaagaagtccagggaaacttgcctctgcttcacagtgtttaggacttgagctggaaacactgaaaggcctgtagtgacacaacagttgagggttggaatcatctcaaagcttattcacttatatatctagaggttagctgtccactggggcctcagtgggggctgtcagcaggaacatgtcttgtggtctttccacgtggtcttcctgcttcctcatagcaatctcagaggaccaggtggaagctgcaaccctttttatgacctaccgaggaattcatgtaaggtcacttacagtcacagtcttgccaagattcaaggggaggaaagacagactcca

SEQ ID NO: 49506 - DNA, 584 bp, Bovine  19866881347696
tgaatgtattactttgaggacttttttaagaaaggaccggacaaagttggcatttgacttcagaattaatgttggattggggaacttgtacaaatgcaatggttacaaaggaagaaatctagctgttgggtaagtgtatatacaatatcattatttgcagaaggcagaatgcttagttgaagtaagagtcaactaaaatatttcagcaatgtgatcagataaagaagctttttgttttgtgttgtttttactttctggctagaataatgtcttgtttaataactgtttctcttaagtgaactagaattgtcttcactgccaattaaggctaaattcgacactcagctatattcagtgctaatatcctagagacttgttctttttaattcttaaaaactaaatgaccatacagctttatctgtgatttaataatatttactgctctgagttcctctggcaagaaaaaggcatcgtattctttccttctggatatttttggtttagaagcaattgctgacctgaccaacatgcagttcaagcacatactatgctctgatcaaaagtcaagggcaggtcactaccaa

SEQ ID NO: 49507 - DNA, 1623 bp, Bovine  19866881360542
ttccgtgggaaaatgtagatgttggatggatggatggatggatggttagataaatagaaagaatgaattaattaatgaatttttaagggactcctactctagattctaggacttgtttcttcacttcaccatagccatgaattattttaccatgttcctttttttttctcttttaaccatgttcttctttaatggttatatagggttcttttccagggcagcttatagtcagctcatcccctgttgatggatatttgagttgtttcccaaattttactgtcacagaattgctgaataacttctacctttatccatgctcacttgagttaatatttctgtgggtagatttctgtagtaggattgagggaattgtatatttcacaagttgctaaattagtttctaaaaagatcccaccaactgatactctcaccaatagaatgtaagaggactggtttccccatattcatccaactctgggtgagtctttcaatttttttttttggccacaccatgtggcatggggaatcttagttcttcaatcaggattgcacccatacccccctgcattgggaacacagagtcttaaccactaaactaccagggaagtcccaagtctttaaatttttattgctcatctgataggctacaaaaagagttttctccaaattactttagaaaggctgtaaagaaagaggttgctgtaattctgtagttcttgatgattgtggagaagagaagtaatcatctctttgaatgctccctgccctatgtcatctctgacttgtgaggcaatagttgtccccatgaggcagttatccttttcccatgaaaagtaagcccagaggacagagttttgcaaatatctgaccactgtttccacctctcctgcccacagtcagccaggcactaggaaacccttggtgagagcagatggtcagcacagacatatcctgacagatagttcaacccctgtgttccaaccttctgcagttaatgggagggagggggtagttcccacctgctctgtctgttccaggccttatggctgatctttcttggacatttggtctggaggttttttccataggaagaacagtaagaggcaaaggtactgtagagagccagataatagtcatgagaggtatttgtgagtcttcatgaaggaggcatgcttagacattgatgtttgaaaccctcacgtgtttctcagaaggttggtctgagggctactggtcgtgatcaaagaaagactgttggagccttgtcccagatgccatggacttgggcactctttctgcaacttccagacatcatcaggaagggggctagaaataatcatttatgcatcaaatggtacatctggaagggaccttgacactattagttcctgtgttttgtattttcctttttcaaattaaaattttcaagccctatagaaaaatagaataatgtaatgaacacacacacccgtcacctgaaatgagcaagtataaatgccttctgtttgctgcatctaattttatactgagtaatttaaaggaaattacagatactatgagtctttacccttaaatactttacacacctctctaaacattaaattcctagattaaaaaaaaaaa

SEQ ID NO: 49508 - DNA, 1686 bp, Bovine  19866881374835
ctgcttcctgcctgctgctgggaagggctgagggtcctgggcctggaaagagaagggaagagggctgggaggctgaagtccagtccctgggctgataagcagccttggacgttgccctaagaatttcctgttgttgcttccttcttcctcataagtgcagctccagtctctcctctagcaacctagcatctggtcgccattgcagactcagaggtcttttgtaggtcagggacctgggtttgccgtacggccctgggctggtgtgtgccttagttttctcatctgtagaatgggggaaataatactgaatgcattctgacagatgatagctaagggattgtactgggttgaatagtgtccccttaaaatttacatccacgggaagctgtgaatttgaccttacttgaaaatagagtcctggcagatgtgatcaagagggcatagtgcagtagggttgccctaaatctattgtgactgctgtccttatgggggatttggacgcagagacgaaacaaatgcccacagaaagaaagctgtgtgaagacggagccgagattggagtcctacggccacaagccagaagctaccagattggaagaggcgaggaagatttctcccggaaggctttggaaagagcatggcccacctgatacctggattttggacttctggccttgggagttgtgaaaaaacaagttcctgttgtttcaagtcaccagtttatggtaatttgttattgcagccctacgaaatgcctacagggatgtctatatgcatgtatctactacacagtggtcactcgggagaaggactcccacccccacgtggctcctggtgatgttagtgcttcttcttcctaaccctaaccctaaaccctatccctaaccctgaatgcctccctctccttgagcatgggctctgccagccaggctgggtggaagggcagagcagtactagacatatgggcacgatatcagcctcaccagggctggctgagaccaggcccagaaaagaccagtttccccacagcatggaggtcagaagtgggcaggagtccccagcagccactgaattctagactctatgctccgtgggggcaggagccaaatccacttggtaccctcagcacccggcacagggcctaacactaaataggcctactgtgtgcccatcctactttaatccctcacaggatccctgtcaggggccctcactgccccccttttacagctgagaaaactgaggcaccggtagtttacgtgaattagccaaagtttattgttggtaagtggtatatccagggaatctggctggtaagcccagcctcttatctgctcatcttcaatatttattgaaataatgaaaggctagagccaggctgccagagaaggcaatggcaccccactccagtactcttgcctggaaaatcccatgaatgaaggagcctagatggctgcagtccatggggtcgctgagggtcggacactactgagtgacttcactttcacttttccctttcacgcattggataaggaaatggcaccccactccagtgttcttgcctggagaatcccagggacaggggagcctggtgggctgccgtctatggggtcgcagagtcggacacaactgaagtgacttagcagcttagcagcagagccaggctgcagcctctggatgagttcg

SEQ ID NO: 49509 - DNA, 1176 bp, Bovine  19866881380618
gctccagtttagtgtttacagctagcggagaaagggtccacgttctcctggaaggtgtggtgttcagacgtgagtcttaggacagcaatagccacttactgttatgagggaggccagcttgaagaggcaagtgacacatagtgaaggtcagagacaagagaattatagggaaatgacaccagctcccagactaaatcctacttaaagcccacgttacctctggacttgtaggttacataagtgactgtcttccctttactagtgaagccagtttgaggtgagtttttttgttaactagaagcattctcactaatgtatcacctaaatgccccaagtccttacccacttctttgcgcctcttgtactcattgatgttggtgaccacatcctggagggcagaggtagccctctgaaggacagcataggcactggcatcagggagtgtgttttccagaattttctgcagcagcaatgggtatttggtaatcctctgcagaggaattaccagcaagaaactgagtcctgaaggtcccgcttgcggcctgagggagaaggctggtgttaagtaggtcaagtccacccttgggggcaccaaagggcctggggtctagtcccagctctgctatttaactcgctgtgtgacctcaggcaagttgccctccttcgggggtcctcagttgcctcaccgggtgctgctagttctcactttacacttttctggacctcgattccccatatgtactaaatccaaaggtcagttctctgtcctcagcttaatcggtctctcaatagcagacacagcagaccattcccctctttctcaaaacactttcttcttttggccccagagatgccctttgtcctgtttctctcactccacaggccactcccctggcttctctccaatgctggagtgcccaggggcctcctctctccactcactctcttcctgagctcctttagtcttacggctttaaacacatggcaaacccagatctccatttcttctgcccagagctccagaatcatggtcaactagcctacttgagatctccacttgggtatgtctcaagcacaactccatctgctggacacgcacatggtatttcattttaaaaaatggtcctgctgctttaaaaaagaagcgcttttaaaatcacaggaactgggaaatcc

SEQ ID NO: 49510 - DNA, 940 bp, Bovine  19866881408311
gttttggatttagtctattggctttatttctgagatactcttgatttaatgtgacctgtttggtctcatcagaagtcttgccattgggcatttgaacaatgtgacaagtgttcctgtggccttatcaaaatgtgttgaagaaaattattttaaaattggtactctgatgactttcaatccaaaatcttttttaaaggtggaaatgagttgctatggtttatgtgttttcaactaaacgttcatttctggtccctataacagaaattgaatacgatcttgaatttggtgggaagaggaggtggtagggattggtttaacatttgggtactgaaattataaagctttatagctgtatgaatttaaatcatttggattgatttttatgcacatagattttcagagcctactgttttcattttatttttcttctaaccgtcttttgtccttatagtttctgccaggtggacttcatattcacactcatttcccttttcaaatcccatttaccaaggctaaggccccaggaaagacttggaagacagagactggcaagaaatcaagataccaggtcccttgcaagcaagtctggccaagaaaccttgtgctttcctatactgagttgtcttcaaattattttcagcctccctgggtgtataatcatttcagggaaattgaggcagcgccaacagctaatgacctaaactggtctatgcaagtagtttaccacaatttctctttccactggcccttaaatcctctgccactttgtcagatttatcttgtgatccatgattagattatgtagggaggcggtcaggaccaaaaaatgttaggttcttatgattcctcatttcatttagttataatgggcttggagtttttgttttggggttttttttggggggggggtactcacaattcactacctctcttacattaa

SEQ ID NO: 49511 - DNA, 1518 bp, Bovine  19866881430980
catgtgatttttgtataaacaggattcaaccaagtttaatttctttttcttcattcttaatgcctggtattccatttgtgaaactgtaaggctgcaaaaatgtccaatttgatgaccattggtcacatgaggctatttcaatgtaaatttatattaattaaaattaacaaaattaaaaattcagtaccacagtcacactagccacattttaagtgcccagcagccacatatggctaacaattattacattggacagtgtagatacagaacattttcatagctcagaaaattctattggacatcactgcttaggaaccagtaattggaaatgtctctcctggataacaaagtgtatccaagtagcataaaacagaagctagaggttcctgccttttagaaatatgtcatatgacccatatgtctaaacttgttaacttcatggattatttaacaagtgagaagagctaatgtcctctgaggctttgaagagctaatgtcctgctctccaatgttgctttaaaagataggcagttcctagcatgaagcagctcaaaacttcatgtataagtcaatttggaattccaaagttattggcccataagataaatgttataaatcacatgactgaattttagtactttctgaaataaaacttaatggaaataatagccagaagaaaatcaacagtaaaattttagagtttcagagggtgttacagattggaaggaagaaatgacaaccccccgcccccaccccccatacactcacagaataagattagattaagttgctgacttaaccaagagtacaacaaaatcttactggaaatgaggtggcttccagggcaagagcagatgtagcatatctcagtggcacttcccttgacccctacagttcctactggcactgtctgaataagaaaatgtctggaagctcaaatcttacacatccgctgcccatttatagtcacggcttacatcagcaatctggaagaacttgaaccaatgatgcatgtattaatttttttttttaatatttatttgtctgtgccaggtcttagttgcagcgtgggatctttgatcttagttggggcacgtgggatctttagttgcagcatgcgaactcttagttatggcatgtggggtctagttccctgaccagagatcaaacctgggcccactgaattgggagctcggagtcagccattggaccaccagggatgtcccattttttttttttaatttatttatttgactgtgaatgcatgcatttctgtttatgggactatttataaacatcagacatttgtggactccagtcatagtcaggatcactgaaacagcaccctcatgctgaatgaagcagtagagttagggcagggagcccaaggctactctgcccccaaaggtctgttttcccaatccatcacctctctgattttatggcttttatctgaatcgttcaaagatgagtttgactaaaaccaggatcactaacaatcttcctagaaaatcaaat

SEQ ID NO: 49512 - DNA, 769 bp, Bovine  19866881609992
atttcttagactgtaaaaggaggtagtaccagtccctataatatagcatatagtaatatccctggacttccctggtggctcagtggtaaagaatctgcctgccaacgcaggagacgtgggttcgatcgttgggtcaggaagatcccctggagaaggaaatgacaacccactccagtattcttgcctgggagaaaccatggacagaggagcctggcagactacagtgcatggggtcgcaagagtcggacatgacttaaggactaaaccaccaccaccaaggtcctgacatgcagggagctcttagttccctcctgcagcagatgcctattgagcaccgcctatgtatccagtgctgttctaacaactggagatgtggccataagcaagtcccctgccctcctggagcttacatcctcttgttccagtatcttccaagccctgcattagaccagaacttcacagattgctgaaagagttaagtgatgaagtgagtagctttgtgatcaggagagagagtgcacaaatgtctccaggaggtggagatattcttggtgataaagaagggtttgtcaccctcctccttaattatccccttccctacttccctggactcctgagagagtgggagtaattgcagggcattcagggacctgcctcgagggatgcttgagtgatcctggaatgaagggggtctgggccatccactggcttgggagtcctgctgacttggcttatgggcatctttagaggtggcagccaccaggggctt

SEQ ID NO: 49513 - DNA, 1525 bp, Bovine  19866881635652
tttccccaaggagaagggcactaatcatgactgctaatgaaaggggtcagttttttgtagaagccaagagcagtgtgctcattgtttcacctgcttgccacagagcaagttcaggttcactgcccctgtatgaaagggttatggtaacagagggcacttattggagataatttccagatgggagcaacatggttggtgggattaggtgaaattactttaatagtcccctccaggcctcggcttaagttgactttgcttatccatctctcccctttgccacagaggccccctccctgctccctaccctcaccctgcccgtgtctccacatctgacactcctcagcagccctcaggactgcaggctgactccaagcctttgtaaaccaccggggattattaaacaaatcctataattagaagccaggtttcctaaacgaagtgaaaaatgtaacgttacccctttgtttgttcactggatgctcaacgcatgtcccatgacccagaggagctgtgactttgggtttccaagaagccttaataaggtaatgtttataaagttcttaactttacaactcccatcagagcacaactctgtgaaatgaggacaagctataattccgagatatctgccccactccttgcccagtggtagagaatgttgttcccttatgtgatgtgtggaaagccctaaggctgggattgaaggaagtgcgttctggtctcagctatgacactgaactgctgtgtcagtccccttccctctctggacttgtgtttacccttctgtaaaagagaggtcatgatgagaccttcttgttttaaaagtctcttgtcacactgacattctatagtttgattgctgtgtttctctaccacagggttgtaactcaagaaagaattctccagattttacttctcttctctggattcatcaaaaggacttggtaatgtaccttgaactggataaattggttggggttggaaagacacatggatgtgtccttttgtgcctcagctttgaacccttaagggcctctctcatgagataaagtacattaaaaatagtgtgaaaatgacttgcatcataaaaaaaactcttcaaaggaattcaaactggtcaacatgaggaatagtggaaagaaccactgttctgtctggagctggtaggcactattcagttaacataattccatggtaacattgtatataactgacatttattgagttctttctattaaccagactctgggccaagggtttacatccatcctctcagttaatctcatagcaaatctgcgagataggtactttctcatgatcctcactttatagataagagacagaaccttgaagagatgaaataatttgcttgaagaaaataagtggttggagccaagactccagaacctgtcattgatctttgtaaatccactgcctgtatactttttgatccaattatggtgcttgtggaagcaagtatcatgatgaaacttccaccacactgtgttgctgagtgattctgatg

SEQ ID NO: 49514 - DNA, 904 bp, Bovine  19866881980579
tctgcccgcgtagcttaatggaacagtcaaacttttggccagatcactgagcactgggacccccccccgatcttcctggggagcagctccagcagaatcccttttccatatggcatgtgtgagcagttgaaattatcaccaagaggagccttagcaatcagcccattcagaacacagaccctgaagtcagacatccctgagttcaaatcctgccttgctctccttttaactggatagctgtggtcttagtcttttgaagcctgttttcccacctgtaagatggaaaatacaaaagctcccacctcgtgagactgactgtgaggactaattcttatttcccctatgcttattcgacacaggggcccggagagtgaaagggctcggccagggtcacactgggggttaagtcataaccaggtggatcccttccccctgcccccccgacctgcttcaccctaagcagcccagagccacaatagctggccagtttgtgcagggcccacagggacatgtcctgggtcctgccctccgtcttgagccctgcccagcctctgcagcaccagagtcccaggtgaccagtggtggccccccgcccacagagacggcggggggtgggggcacttagcagcaggctcccagcccagagcagcctggccatataagggaaggagccaggaaggtctcctcgctcaggcctggcgagaaaatccagacagccactgtttattttctccttcccaggctccccagagcttcccgacagaagacacaggctgccccccggggccaagcgacatttcctgaagacagtggggaacagggaaagaaaaaacagtccgtcctccgggagtaggaaggatgtggacagccagcaccaggtaagattctgccaggtaagacttgt

SEQ ID NO: 49515 - DNA, 937 bp, Bovine  19866880464307
tctgggaggtcgagcggaggctaaggtccgcgcgctgtgcctaggagtgcccgcgtgcctgtctttttaaaatacaggaaatgcataaaagaaagaagagagctcagccggagccagcgctcccccgtctttgctttttcccttccttccctcctccccctccccccaagcaccggcttttaattttcaaaagcactgcaattgcttggtgtggtttcaagagctggggtgccattctccctgatgatgactctgctgacgtcaatggcattcttatcgtgcctagtgcgacatcagaaaccagccctcagaggctcctcttattcaccgagcctgggctctcagtaaaacgtggaacggacttctgaagtgaaagggattcagtcctcttttctagcaagagctcagccagacatcttttttcccgatggcaacttgccagttaggactgttcctcagtgttttcccctgcacagatcccaaaaggagaagagaggactaggtggatcacagagccttctctgtgtcccagctttccgagatctgcctctgtgtgtgtgtgtggttgacctacttctgattagtcttaaggtttcgctaaagcctttgataaggtgatttccccctataccatgctgtgaacaagacccactcagttaagtgctcctagcttactctcagggtcaaaactcaagcccaggaccaaaaatgaagccaattttcacttctccagagtgcagcaaacacccttctcctcttcttaagagaaaaatagaaggttgagcacatagaggggaaggactcacagctgaataacaatagtaatagcaataataacagctgagtatgagcagagtattttgagaatttaacattttcctctaaacactcctgagtttttaagaggccggtcacaaaggttccagttataagcagc

SEQ ID NO: 49516 - DNA, 2241 bp, Bovine  19866880467184
tttatgttcctaaacaggagcaaaaaaaattttgccatgggtaatttaggtgggatttatctattttctcttcccttagatgtaccttctgacaaagccacacttgtagcaatcaatcaaaataaaataaaacgaatattcaacctaaaaaaatggatacaaatgaactcatttacaaaacagaaatagagtcacagatgtagaaaacaaacttatgattaccaagggggaaagggagggagagataaattgagagagagagattgaagtatattcactactatatataaaatgggctaatgaaggacctacagtacagcacagggaattctactcagtcctctgtaataatctatatgagaaaagaatataagaaggagggaagtccatataactgattcactttgccacacagcagaaactaacacaacattgtaaatcaattatacttcaataaaaatgaattaaaaaaaataaaacaacaaaatcagaaaaacactgttactgttatgaccaaatgaatacaagcctgttcccagaatttttttttttttttttttttgatgaaacaccactgggcaagtattcagggcagccctagtagggggaattagagccacagttatgctacgaacttgccatatgaccttgagcactgttgcctgatcttgtgaattcagtgtcttatccaaatgagaatcactgaaaaaactttttaagatgaatgaatagaataatctacaaaaaagcttttggaaaatgccaccccaaattttaggaattgctactaatgtcagtaaatgttttcgagaacaagaaaactatttttcttactgttagaaacacttacagttttaagaactgtcctctaaaatggtcactatatgggcagggtaagttggcgtatcatttaaccagttacagaagatatcaatcttcagttttgatgtccttttctcctcccttatttgaaatgttttttcctgtgtgcaaggacagaatatctggcatgttttaaagattaatcctatagcaaaattttaatattttatttgcaaattaaaaatcttctattgcttctatttaaaaacactaaaaaaaaaaaaaaaagtatcaaaggattctaccaaagttagctgatggaatttttctcaattgttcaaaatcctggccttcacctaaatatagaaacatgactatttatttcttgaaaacttatggggtcctgaagacaggttgtttaattggaaaagcattcacagtactgattccaactcacgctgctctccttgttgaccacgcaccaaataagggcagaaatggcctctttcagttttttagaactatgttaacagacaagaaaagcagtgatggaattaccaggctgaggaacaaaactgctcccttgggagaaagaaaaaagaccccaaataccatggatccctaaataataacaacctcatgatttcaactttggcactgggacttttttccatgacactattcaatatctctctaaatctggatgtccatttattggagccaatattcataaactttcccatttctgggcacttacgctgatatatcattcccagaaccccttcttcagcctgacactctctaagtattgactgattctgtgaagcaaatgtcatcacaaggctggggttcttttttttttaattctttattttactatgacaatggtggtggtttttagttactaaattgtgtctaactcttgcaatcccatggactgtagcccaccaggctcttatttccatgagatttgccaggcaagaatactggaggcttggtggggtttagtcaagacttgagaagtgacattattaatataatgtcagtgtttgtagcactgtgtattgttctggattttctttctgtatagtttaaacagaaaagaaatgaaaacacttttcagtccatccaaccaatgctagcagttcattaggagctaaaactgaaacctgggtgtttgagtaacagtgaaagaaaacagtatatttttgttatttgttttataaccggacgcatacaatttaaggcaccactttctagctatccctcaaaaaccacctaagacattcataacagacatgtgcacaatcaggccattcacatggcaaatatagcaggttcttccttccctcccttcttcccctttctctttctgcccttccatcccctcataagtatatattaagcatctactgtgtg

SEQ ID NO: 49517 - DNA, 788 bp, Bovine  19866880467264
gcgtggatgagtttgtcagctggggtggctggacatgaggaacattcgtttttgatcgttactattttctctttgaggaggaatatcatctgctgtgtgtgggaagtggggagtcaactgagaagaaagaagaaaagacatttgctacagtccttagggaaaatgggagagagagctgattgatagttgttagaattttaaaatgtaggtatggtgcttgagttacagttgtttaaggaatattaacagctttgcttctgcgttttattgttgatgctgctagacctgtggccacagtccctcttttggccactagatggcacactctgtgctgaaatgctgacctgccaggttccttttgttaccagcctatactgacaaattggtaaagtgagttgttaacttcttgagaagaattaagatgttttacttaaaaaaaaaaaaaaaaaaaaaacttttcttaaaaaaatcttcacatgttcctcaattttacctatgggcagagagtgattgtggcaccacaaaagcctcaggaaatacacgattctccttcacactaagtgtaacatgcctaacataccatcgcttccaaattctttgccttaaaaatgctaatcagttggcactaggtgaacatttgcatagtcaaaatagagctgttggcttaacattttaccttaaaataaaccaaaaattgccttgctcttggatgtcagtatggtgcatacagctggaatgctgaagaaatactgccaaatgtcaaatacacagagaaacgaattccatca

SEQ ID NO: 49518 - DNA, 1948 bp, Bovine  19866880468705
ctgctagagaagcccctggtaaaagaagccaatgttaaaagattatatgctgtatgactccagctatatgcccattctggaaaagacaaaaactatagagatagtgaaaagatcagtgggttgacaatgagggaagggaggggaggaaggcataatggtggaacataggatttttagggcagtgaaaatattgtgtatgatactataacggaagatacatttctccaaacccaacagtgagccctaatgtaaactatgggctttgggtgtaatgatgtgtctggtgtatgttcatcgatggtaacaaatgtatcactccagtgggggtgggttgataatggggaggctatgcatgtatgggggtacggaatacatgggaaatctctaccttccagttaattctgctgtcaaccttaaaactgatctaaaaaaataaagtcttattttaaaaagaaaaaaaattaaaagaccaaaacctgaacacctgtggcttcttggaaggtcacaaaatttttataaagcctaaaaagattaatttgtggaacctttcagttctattccatctgcgtaagtgctgatgaaaatcacttggtgaataatttagaagtttagcataaagaacctccttaaataatatgtagttatgagggggaaaaccccaaagctcaaaattggaaaacatcagtaagggaaagaacagaagacttttctctccaaaagtgccaagcaagtctggtttaattgaaattgatggcacagacaacagaatacacttaattaaattttaatcttaatgatctctaagccatgtttgaaacataaacatacatgtaagagttgttcaagatgttggacataaatatgttttcataattcaaaagcatactttgcttgtgaatctcttttaacaagctttggcaggggattcctttcttccagatgtttggtgttgtatagacgcaacctccatctctctgaaaatgatttaaaacacggttctaaagattgtgtttattttacaaaatggtaagaggatggaattctaatagattgtctataggtttgcaaaatgatgagtgtgtgtgtgtgtgtgtgtgtgcacgcgcgtgctcagttgtgtctgactctttgtaactccaaggactgtagcccactaggttcctcttcccatgggattttctagggaagaatactgggttgggttgccatttcctcctccaggagaaaatgatgagaatttaagtcttataaagtcttaacgggtggtgtctattcatctgaaaaaggttctcttaatactttccaaacctgaaagaagtttttagttctaaaacaatattaaataggctaattaataattttgcttaaaagaaagtctcctaaatcataaatagtattttttttcaaatgcattttcatttaaaatccttgttttaagcaatttatagaaggcaagatagtttggtggttgagaggatggtctctgaagttagatttggatttaaatcccagctctaccatttactgacttagacaagtcatataacctctccatgcctcagtgactacatcctggtgctcttacaaggatgaaaataaacaacctatgtaaagaactttttgcaaagctccaagcacataacaagccctcaaaaaatgttacctatcatcagaaacagcactttctagaatcttgctgctcttccatccaacttgcttgatcacttattttctattataaagtactcttttagccaccttcctccacagctatggctccccagaatttctagcaaagatgcttgaacccgtacatgcttatcttttccttctcttcctgatacctcactaaaatgaaaggggggtaaatacacacaaatccacaaaggcatagataatgagagaagagagatcatcaaaggagaaatcacaacgggtttttaggaag

SEQ ID NO: 49519 - DNA, 860 bp, Bovine  19866880493903
ctaatgactttgtgtaagttatttttcctccttatgctctctttggtaaaataatgttaatgacataaaaccctaagagttattacaagaatcaaacgaaagaccctggcacaaacttgctatctactaagtgtaaatatctgtaagttccttgtatcactgagtgacaggtttcatttactgggtatttactctgtaccaagctgtcttcatatactttgtatcatgagtattaacacatcaaatctttgcagtattcttatgcaatagctattattctcattctatttcacacatgagaaactaagccatagacaagtgaagtacacagctagtaaatatcatagctggggttcaaaacatgctttgagttccatacatatgttcttaactgttaaacaacataatctctcccactatcagataatttccatggaccacatcctctagacaatatgaaaatatgaaaagcagtctcattttaatgcactgtttacttaactaaaacgtggttgggagaagtatacaatgcattccgtagttgagtataactcattttaatttatccattcttttgaattagctgcaccattgctccctttgaattgtgagaaatccagccttgtttgtttttacctaggcaagggcacacttttaagtctttgtcccataacctgtacaaatcttatttcttatttgtgttgctgcttatgaattatacaaatgctttcaaggattccaaaaacctgaaaaaacagattttgaaaatccacagaaaggtatctaggaaagtttttattaagttgagatgctatctgctgttctaggcgtgggtgcttttatcaaaacattgtgcccca

SEQ ID NO: 49520 - DNA, 1420 bp, Bovine  19866880579601
gattgttgaattctatgtttttccgcattgtgttgtctttagtcaggattataaaaccatttcaaggaaatataaaaaatatatatatctttactcttcaaaatcattgttggagtggatcagtccaacagctgtttggcagtccatcccaatgttttaaaacatttgaaggatcatttgcaagctcgtataattcacctcatataagaaatcacaaaggaaagcaaatatcagtaggttcatagcacaatgaatcataggctgcttggtgtggacatttacatctgtgtctgtattctctgtgatatattttaaagaactgtgaaagcactgatcatgtataaccatcagagcattcttacaattgctctaccatggtgaaattgaagaaatggtatctaattcaggccacacggctctctgaagcccttccctgttctcttccactttcattaaagtggaaaaacccatctgtttggatcattgaggttggaaactgagtgatatcacttctccaaaatagatttaatagtatggcttggttaattgtttcctgacctgtttgagagagagtccagactcagagaaaaacatggtgtataaattttcgtattcaatagtggcaaagagtcggatttgcattatatttttaaaggtaattttggtagaactattacagtttttgttttcagttattaaagacttatctagacatttaatctacttaatatatgatatttaatgatactttcacaaaggacttataatatttgatcattattattcatccaattaagccatttgaaaattaattcttaataagtcaaaatatgtgaatagccagaaatgagattgagaaccacgttttaaagtccacttctcaaagagaaaatcatgatccctgtagagacatatggtttaaaatagatccttctcagaccttcaaagtgattctagcattctacctggtgggatcactcatctggaagaaggagcataagcgtattgcaagcaaagttatgaaaagtatgggtatgctttggaaactttttggctatcaaaaaaataaagaaaaagaagaattagggaaaaaactagccttaataataatatatcttttaggaagaaaatatgatgccacatccccattttcagtctttccgttgtttccctgtcctttcccattctgttatggcctcaaatgcacagggaagctaatgaagatcaagcttagagcccttcacgggctgggccccattctaaattctagaagagaggcataataaccactgcacatagttatagattttgtaaaatttgcaaaagttagaacttgggggggcattacttttttcaaaacagactctcaaagtaccatgaaaccaggttcctacccctgattccatggctgactggaggg

SEQ ID NO: 49521 - DNA, 1057 bp, Bovine  19866880632373
aaggtactttgtcaccttaggttctaaaacttagaggctcattgatttgatgactgaaaacaaatggaattcctaactcttattgagttccaaaacaagtttgtaccccaatctacctctaaagacaaccaaacaataaaaaagaaaaaaattaaattgttatgctcacctaagaatgtgtttgatatatactctgacacttgatttccagaccgactcatttcagagagatgggtgagctctcgattaagcatccttttaaactgaaaaaacagaaagataaaatgaaataacagaagaggaaagtttaagtgaaataacatgagcatatgctaagatatggaaaatatgccaaagaatctttaacacatcctgactctttaggtcagtgttatccaatagaactttctacaatgatgaaaaaatgctatactctccactctccagacattagtggctaggagccaatagctatatgtggctatcaagccctttaaatatggttagtataaaggaggagctgaattctagattttatttaattttaatgaatttaaactgcaaagtcacatgaagctaggggctaccataaatggacagcacacatttagatattcaaggaggacactggggggagaatgcataaaaatagcatgaattattagcatttagagaagagaaaaaactaatttataaacacacaaaagggttgccacacaataaaacatggtatgttttttatcaattaatttatcattagcagaaatgaatatgtatactgatcagagattaaaatgtagtcttttccccgaaagcagaactgagcagatttgagtactctactagactctagagaaaacatttgaacagataatacataatgtttcctttttaaagttttttaagtagggatttactggttttcagcatccaaagaatttaccaattcatcaccataagtcccataaatacaattgaaaacagacctgttcagctgaaacatcattgcttcacagtttattttactggttccctggtgcctattttatccaaagaa

SEQ ID NO: 49522 - DNA, 1695 bp, Bovine  19866880641431
cagaatcacagtgggaagaaaaggcaaaatgattcaactttgctcactttttactaggagcctacctgtctgtggtttatgttgtaatgtcacacatccatacagatgcagcctgcttttacaaagatttcttcaaaatccttctgaagttgacttgaaagtgtcaccagtctctgagaagcttactgaaagcaacaaaacatcatatgactttagccagaaccagtatagcctactttaaatatttataagtttaaattctcttttatgtttccatgaggtatggggagggggggaatgacaaatataagatgtaaattgagggaacattttaagtaatcttataatatatttagatcataattataaaccctatcatgtacgatgcgtttgggagatattatgaattccttttatctcttctcattactagaactttctcccagcttagcagaatttcttctttaatatccttggtttccagtgctcacaaatattttgtatagggcttttttgtgggtattttgcttcagctccaaagctctaaataaggtcctgagcagtcctagtcacttataaggaaacttcattatgccctcccttttagttcatgtttttcttaaatctgaagatgagggcattgaactgaatacgcataaaaaatacctactgttctaaaaattgcctgatcagtttactcatttctggcttgtataactgtccttcagttaaatggaatactgtgaaatatgcattgatccataatttactctagggctgaagtctgatgtttttctcaaaaaaaaaaaaaaaaaaaaagccccttctgcagaaaatccttaatctctcagccttaggtatttggcttaattccttctatatgaaacttttaaatagcagccttcttcacgggtaagatggcaactttatgtttattagtgctgatatcaccagtaattggccactctgtgcaacatgaggaacttgctcacccagggatggaacccatggcctctgtagtgaaagcacaggctcttacctactgggcaacgggggaagtccagatcaccagtaattgagaaaatatgtcttatgtaccatttttgtgtccattatatttccaactcttctcttggtcgatgttctcaagcttatccttgttcatccagcgtccgtctagtctaagaaataacatggagtgaagttctcagtatcagatacgtagttttgagtttctttgtgtatgagtgcttacttagtgcatttaaaacagattggcaatgtgatggagcagctgttgatgctttagagaagaaactttggcaagttgatagcgggcaaactggtaagaccccagggtcaccaagagtagtagaagagacctcttatacatcatgaagtatggcatcggagtcttgggaattgagttctaaaagaaaaaaaaaaaaaaaaacaattggaaaaaaatcacattttctagaaagtaatccaggcaagtttagttttgagaaagtaaaatgttctggtggatcaggatgtcaccattttaaagacggataacatttggccaggccttcctgcaaatcttgcttccaggacctttctgtgaccaagctaacctgtgagacttcatggtaacagatcacgtccccttctcttcatgatagtagccatctgttctttctatcctgagct

SEQ ID NO: 49523 - DNA, 825 bp, Bovine  19866880693324
tggaaaaaggaaaaaaaaacttgaatgaagtggattttaccgaaagctttatgatgctttttgaatgcattatttatttttttgtgccatgcatttttttctcaccaaatgaccttacctgtaatacagtcttgtttgtctgtttacaaccatgtatttattgtaatgtacatactgtaatgttaattgtaaattatcagttcttattaaaacatcatcccgaattgggatggtgttgatatatttggaaactcttggtgagagaatgaatggtgtgtatacatactccttgtacattttcttttcttctataaaatagtcttgtcaccttagagcttgtttatggaagattcaagaaaactataaaatacataaaggtatataaaatataaaaacatagctgcaggtctttggtcccagggctgtgccttaactttaaccaatattttcttctgttttgctgcatttgaaagtaaggtaacggtggggttagggctgggcattttacatctgagctttgaatcaattgggtttctggcagcagctggattgtacagaaccatggtcaacctctagagcattctgagactcttgagagacaagcccttaaatgctttctgccacgaagcaccaaagcatatatgatgggtgttttttccaataagatactagctgagctgcttcagttagttacatttgattttttcttttttttaattttcaaacactactggggaaattattcttgtccaataattattaaaagtcttttcgacttgagcacatggacaaatgaacttgatttgaaactagagccataggcca

SEQ ID NO: 49524 - DNA, 1301 bp, Bovine  19866880712272
tgaaacacttgattctgagacagatattccatagaaaccatggtggggacacatgagaccaagtgacatgataagagggttttcttttgaccagaaatagggcaacatttacatcttcagttatgacattaaaaaaagaaatgccacgaagaactttgaaactgctgaaggaaaaacagtcagtggaacaaagtcttgaacttagaaaaaccttagctgtccaagagaacagtcctgctgttttctgggaacacacacaaaagtagaatcaagggctgcatgccaattccttcagcgtccagctttgcactaagggagagccagaattgagcctcacctgcttaaggaccaaattaatcaccacagagcttggctttcaaacacactgatggagaaatgagtaattttcagtgaatgcctttcagcatatacttatatcctaaactaaagaagtctaataatagcaaggagactcctccactaactggggttttcatgagataattacacccctggaggactaaaggtatcatctttgtttcttgctgtataagacaatggatctgattgtcttttagttaccacccactgctgtgtctctggctccaaaacttgacagtaggtaagggagaatatatctgtgtgtaaaatcatggcttgctatcacatacattgtatttcttaagggtagcataataactatagaaatcagagaatccatttgcagactttacactgaacctcatttcagcccaataagttggaagaaattatacatgacccccaccacacatgcacacatatacatacaaacacacatgcaggcacacaattgcacccctaaaggaggatatatatagtcatcatatttctcaagaagaatctttgtagataaactttctagctcacttccagaaaatagtatatctttagactagtttgtatgtgtatgcaatgaaattatactagattatttctcttttcaccttagcttttaattgcaacagttcttttttcaggtgccttgtagcatctactcctttatctcttttctagaatctctgtttggttcttaaatccttaattgtcctgttttacataatgtttaattttatgagatgcctggaatatgagattttttaatgagatttctggaaacctagatgtttttaaaatcagttgaatacaccctcctttccctgaatggagggaggtaaattcccttaaatattcccttgccagattcagaattctgccacagtcttcagaagcactcttgttctccttggttcaagtttctt

SEQ ID NO: 49525 - DNA, 2942 bp, Bovine  19866880764877
tataacttcttggtaattctagagaagttatctattctaacaccaccccccaactcttccccacccacttctacaattatatttatatccccctcttttaatcctgaggcacctcttccacctccctgttataatatttgatgtacttttaattctaaatctatgttcctcagaagggagaaaagtacataggccatagtaagagtttaaatacttgttaggcatcaaaggttgaatgctgactactatgagtatgaagatatgaagacagtaactgattgtttattgagaatataaaaggtttttatattaatttacatttcagataagatgcagctggcactcagacacattaaaaagaatgttgaatgaaaaggaataagctttccttgagaataaaagaaaaaccaggttggaattattacactgtattatctcccacatttacaaatttataatttaaccaaaataaagttcatataaagtatatttcagaatcaattcagctccttagaggaaaaaaacccagatatttatttggcatagtcattgaatggctagcactaaaatatttgttcttgaaccaagaatgtagaaatgcggggaaattaaatttagaagtgtgtttattctaagtgcagttttaaagcaagtcctataaatcaaggtcaatactcacatatgtgtgctcgtggaattcgagtgtactttattctcctataaactcaaagcttagttacagttgctagccacacacaaacagcttcactgagcggctgaacacagagggcaaccaaggagcaagaaggtgattccccagtcctaagttacatcctggtgcacgtcagacacttatttctcacattaacgtactcaagctaccagggtaactcttaatgcaccaaagttataatttgagaagaccattttgttaccaaaagttctggagaaatcaccagcaattcttaacacctgatcttcttaaagtgtgaatttcaggcagagtcttgttgaaggaagttgcttatgccatttgagattaaccgtctacaagaggggattctgaagtgcctgccattttcagagcactggagaatgtcttcaatttacagagcggctccactgctacaggtctgtatgtcagttaatctgagtaagaattatctttaaaagggacgggaaagttcaggagcataacaacactgagctcccaacacccataagccataagatttaggtttagaaaccttggaaccagaacacctcctatcattgttaataggaatatttaaaaagcactatcagtaggcttaactccattccggctcaattagcttgtatatttaattagtcctaaatgaaaattctctaaatcagggcagttggcttttgaaatttatactaagcaataccattgtcagcggctctctttctcatttctttttccctttcccttactcatctctctctcttctctctctctctcacacatacacatacccctccttcattttttctcactgcagagatgtaaaccaaagtgtacctgcaaaagcacaaaatttgtggtcaacctagaacatttagcaggtactgcatttgtacctgaagactgtagatatattctgtgaatgtttatagataatctaacatgaatttatatagttattaagtatcagttttgaaccatggaaccattcctaggctatttacacaaaatgagctccgcacagagctcactggttctttccatttggatgtcgcacatctggaaaaaaggctgcccctaagaaaaaacctacatacaaaactttaagaaactactttgtaaaaaaatatatatatatacactcccctttgtcaaaacaaactcttgtaatcataaacaggcttattttttaagtgctatgaaagaccactgtagagcaaaactcccggcccctcccccgccccaggtcgttcccgtgccccgtggcgcacagcagagctggctgcatttcctgaggccccggggctcatcttcagataaacctgctccagtaacgtcacagggcaaacagttccacggaagccgactgcacagctttgaaaaacgatccgctgatacacaaaccacaatgaggcaatgaggagaaactcgctatcactttcaatatcaaagcatgtttctctgaaggcgtgaatctctatctggatcttgacatcaatgacagcaaagggacgaggcaggggaagaggcagatcgacgtctactacacaccactctcctggtggtttgactacagaacgataaaacagaattcttgctaaaaagacaagtgtatgttctgtggtacacttttttgcttttaaagtatatatgtatactttaaagttatgtatactttttgtattaaaaacatgtatatgttattctttataacaatcgctgtttctggaagttagtttatcttgcaggaaatctacatgttgaccagccttgaaaatgaacacaagaagctttcccattgcttaatattacttcttatttgtccttttttgtttatgtactcattcccctattgacagatattttattcctttccatttctattaccaagaattctatagggagattttaaatttaaaacattatatttttcttcttatgccaaaatgaaagcttataaaagaaaacacaggaaaacagaaatgtgagtatttaaaagtatctacaattctactttgaaatagttactgaatgatttgttggtatgtatgtatacaagtgtgttcatacatttatcctttcctctctgagtataagcatatatgtcaatctgaaaatttacatatatgtaaataaacaaatgcatcaatttataaacattggatggcaggcttctaagtatccaaaaccatatccagcaatatccaacaaaactacattttttcaatctcca

SEQ ID NO: 49526 - DNA, 1042 bp, Bovine  19866880780499
aatttgcaacataatgaatgtattagttacactatggatcaatgctatacataatattcctgagtcaacatgagctcttaattaaatttccttattatcatgcctctggaaattttccttcacattactaaacctgaagacatgcatttaagtgtcaactgataactatattagtaattttctgagctgggccagagccagggccaaggtgaggttaggaagtaatctattataaatagcaggtcataaaaactgacacatgtgatatcaaactacctataaactaattcaaaacatttttgcctcaagttattctgtcacccagagtatctgccctggagcaagccaatttcagttactgccttaaaaatataaaagagagataaaaattgagataatcagtttatttggcagaagcagaggtatggagaatgacaaataagttaaaaacaagtgacaactggacagtcttagtcctctagaatgaaaatggaagtattttaaattgacagatacatatcacttagaaatacaaaagagacagagagggaataaaaacctgattccaaggtaactccaaagaagaggccatttaaataaaaaatttggatggtgggcaaaattcaagcgttttggctgtttggtttgttgtttgctgttaataaagaaacattagaaaatatatgttttctcttattaactacaaggtcacaagaggcaagagaagggagaaagagagaatgactgacaaagagacaaagtctggaaagaaataaaaattcagctttaagattcctgctatatttcatgcccttttcaaaatatcacatttttctaaaatacattaaaaaaaattttttttttccaatcaattggccaagatgacatgcatccttggtactcttttggggtgagttccttaagcaagtcctcaccaagctctcattggtccattttgggctacgtaggctacaccacttcctaaaataaaccacacagccttgatgctgctcctgctaaagaggagtctactgtcaggtcc

SEQ ID NO: 49527 - DNA, 2386 bp, Bovine  19866880820910
ttttaattggaggatattgctttacatattgttaatttctgcctacatcaacatgaatcagtcataggtatacatatgttccctccctcttaaaccatttgtttctccaaggtgtgcttccaactcaagaccattttagatcaatttcttacactgtggtttcaataacaacagagattacataaaatttaaacttgaaatatatatgatggcagagttgtaattacatgtgttcatgtgatcttttttcatgaaggagtggtgataaaatggaggaatgaaagaggcatttttactagtcagaggtgaggtcagatcagtaggattgtttgtaacctcccattgctggaaggtatattgtgtttcttttacccaacccatttatcaagaagaaaattttttcaaaagtttcagcttaaatagttacagttgtaactatagatcaatctgatacacattagattcattttttttttttttttttactagttttctatggctgctaggagaaggcaatggcaccccactccagtactcttacctggaaaatcccatggatggaggagcctggtaggctgcagaccatggggtcgctaagagtcggacacgactgagcgacttcatttcactttcacaagttcatgtttagggttcagggcataataatgatggcagcaagcacattgtacaaaggacaggaattggggtggggagggcactgaagatgtccttggtgctgaaacatgttgctacagaataatataatggacgaactctcgtatccagagaggaccaaatggatgtactctttcagcactcctgtaagaactttcccatgtcatttctgcacagagctttatttcatggaaaagttaccatgattttttaacacatttatcatctcctcacaccacgtagtttcacattttaattgtaaaatgcacgcatcaaaaatgtttggcataccatgtgctacatattacacacttatatatttctaaaatcctgaacaaatctctcaccaagttctgtttaaaataaaaacacaagcccagtcaagcatgatagaatatccactcacagaaggccagtacctaccctacaggtgatgcaatttgaaattttgtggaaatgactttgaaaactaactatgcaagatagaagagcaaaggcaggctacaataatacttccttcactggacaacattataaggcctcagaaatgagatgtccaaacctcttctagaaataaaaatcaattgagaagagcagcccagaaagcattaatgtaatcagtctgcatgctgccatctaacttacaatccatgacaagttgagccaagtgggagttatttacatttgttcttctggtataataggagggaggagagcgaaaaggatttgctgaatcagattgtgtttgactgaggagtgacagggaagttttcttcaattaatagccagctgcataacttgagctaatgccagctgggctttcgtcatgaagtgacactgaaataaatgattctgtactcagggactgactgggaggcagtgaactcatccaaagatggagcagggacaggggtgggcgataataccacctgaattttaggagcctattctggcaactgttctaacaacactgagttcatgtttattgttaaaggtccataagaatccatttaggcgcaaagatctacttgaattcttagaaggggagaaccaaagaagatagaaatggtctcattaaagtcatgttgatttctttcactgataagtgaaattcacttttatatttatgttaacctggccggggggtggggagcaggcaaaagggttttattaaaggcatccacattcttgagaaggaaaacaatggctatgacataaaagaaacctagtgtagattgaaagcaatcaaatgcctgctagtacactcagaaaaactgaacaggcccagctgttgggatttttccagtgaggtgcctgtcccggtggtcacaagtccatgtgtctcctggctgccgagtcacattcccgtctgtctggatggaagggcgcccacccacaagccagaccttttcattacgggaaagtttccgaggttccttgggtcaggcaaactccacttccccatcgcctcatgtaaacacctcttctatggggatttcttacagaaaaatccacttgaaagcatctaatcaaagaaatggaagtcagaaagccagagctccacaggaatctagatatgacaatatgggcagagaaagagccctccaaagaggaagcaacagcagcttgacctgtgaattctttgctatctgtctgctccctcgactttcaaaccgtagccctggaaatataacacatattctaacattca

SEQ ID NO: 49528 - DNA, 1479 bp, Bovine  19866880859969
ccaggtgagcatatgccatggggctggcctgagccttatctacattgtggctggataatggatgttcctgaattagaaaattattattgggacaaaattatctatactgactgctgtcaaccaatttgaggtaaaatattatcttggcagttgactgtgggaatttgggatactgcactggtctacgtaatgtattattgatctacagttaaactgatctgaaggtcagacttctaggatttctctcaggctcacattctgaatcaattactgtcttttaggaatggctatattagaggtccctgactcatctttagccagaataacaggaataaactcagtgttgtgggctgcagaggcaacaaaattagtgcctctatattttgctttacagattgttcctgaattatggccccgcagtcatgctgccttgctcactcgaagcttctattttgagagagaattcaaataacccacttgtttacactgcaacttagtccagaggttctcatcaccatttatttcaggtttttcaactgaatcactctgcccatcgatatgtatacttgtaaaatttgtatttatagacacacgtgtgtgtgtgtgtgttttaatcggacaatggtgaattctcaacttcttgcggactatactgaaaaacctaaaggacagtctggatcataaatagagtattctactctctgaattaggtttacatcctattatcacataatattttgtactttaaaataaaccaaggggaacatttcctgtaaaggtattacttctttctacgcaggtcataataccgggaaacaaaggcacatttaaagcttactggagccgtttttctactccgtctgccaaaggactatgctattaatactaaatgactgaggtgacttaaagtggtataatttgtgaaacaccgactaccaaaaaacttctagaggagaatgcataaaaagaacttcattgaaatatctgagaaatggtggctaaactctaagaaaaacagaactacttgtgtatgactgtacagccaacttctttgttccctttggcaatttgctatggtctggatattttcctgtccaccacaaaaacaggtttaccatgaaaggcaaagtttccgacctctctccaaggcactgggtaaggctgggttgacatgctcagatgatttaggaattttgcaaaagcaagatattttaactgtactcatgaccaatgtctactcactgactttgtctatacactaatactcccccttaggttgggtgtcactggagtgactatggatcttttggggatctggctaactaaaagttgaactagagatgcatttagtttaggtttggtgatattattacttggtggatctcagtttcttccctgtatctttaggttactgctagctgttccacaattgcattgtcgtttcactctctacatagaaaacattatagaatcaggtca

SEQ ID NO: 49529 - DNA, 1905 bp, Bovine  19866880862326
attttagtaaaattatgctgctatatataattaataaaatttattctctgtctcttcatctatacacacacacacacacacacacacacacacacacacacacacactagttatatacatatgtaactgtttcaccaactgttaggtatgactgtgtctcattttctctcaccacagaaaactgggaaagacattttaggaggtgagaaataaagcatcctctctcaagttttcaccgtctcccaagagaaacaccatcatctcatagatatgtctccatgccaacagtacacacctctgtgattatttttcctattcatcagggagtaatttggtacttccagctttaaaagagtgcacagacatcccttcaccccttataagtgatttaacaggtgttttacaaaattcaaaatcagtagtaagatatgtaacagaaccacatttcagctgtttctctccattctcactgcctggatctggatccaaggagtttttcaggactaatttcggaaagaacatgtactttttttatattatataacattttgagcaacatttaaatgaatgcttaatgagagttttcaaatagaaatttaaaatattttttaatgctactgagaaagatgaacataacacaataaattatacctaatatttcaggaactattgcttggcagggggaaaaagacaaggcaaacattacaaagcaaaaccgaaggaaacaaagcttctaaaacaattaacccttccctcctccttcatggagcactctgttatttacagagctggcaacaaatgaagcaaagtatggaacacaataatagcaacagttttttgagcacttgccacatacctggcgtaatgctaggttatatacacacgagctctaccactgataatgtcagctactcagggcaactgacaaccatagggacagagcagaggagacacggcgtagcttacacttcctggtgccaagctctaggggcaagaagttctttacaggaaccatcttattatattttcaacaccatcttacagacaagtgattattgttcccattatgtagatcatgccactgttttaagtttgactcaactgctttcttagaatacataatggctaatgtgtccttgctgctgttcggtcactgagttgtgtcccactgtttgtgaccctatggattgcaacaggccaggctcccgtccttcactgtctccaggagtgttctcacattcctatccattgagttggtgatgctatcaaatcatctcatcctgtgccatccccttctcctgccctcaatctttcccggcatcagggttttttccattgacttggctctacacatcaaatgtttaactcataagctacctacaacatgtgaagcactgttctaagtgccttacttgcaacatcatcttcttgaaacttcacaacaatcttttaaaatagggaccatggtttggaccatgattgcccaaaacctgatttaacagaaaagaaaacttaacacttaaaagaggttgtcccaccccaggtcatacagttggtgagtgacagggccagaatatgtacccagactatttaactcaagctcaaaacttttaatcaccatattttcagaaatgtccaaaaataaaaaaataaaataacaacacatggctgatcttggggaacaatatgcataaaatctaaagaaatgtgattaaattcacatttgaaagagaaggctatgatttctaattctgagatgggcagttttccttagacatcatttcttcccagtctccactgaggaaggaacgcagtgaaacacaactgaaactgcatcaggaaggttaaccagaaacaatgtggacaccgaatagaagcaggtctcatcttcccaaagaagctcgg

SEQ ID NO: 49530 - DNA, 3932 bp, Bovine  19866880877749
gaatatatattaaaatgtgaaataacttaaacactattttaaatttcatttaaatcttgctttactattttcaaatactaatttaatcaagcacaaaatgtctgattagaggctgaaagtctgaatcctaattattctgactccatacaagtgaattataaatatttcttttttatatacccttgagaataagaattagtggacctctacagaaatgttctacatgagttatttataaaagtgggtaatactatattactgctggagttctgaaacttaataatgaattaattaatacatcatttagtacgtcaatgtctgtttgcctatttttttaagtacagaaaattattagcagtctgcaccttccaaatgaataacaaccttctatcatttatcttttgttttataaagtgctcacatatttaatctagttttaataatgacctaataatctactcctgtgtatttactggaagagtaatccatttatttttcctactgatgtttttattctaaaatagaaacaagttgggggagaaaaggatgtggaattattttataagcactgccttcagtatagtttgcaacaataggcaattctcacaaacttttaaattcatgacctatttataacttgtacaaaaataataaatagtggaacagtcatgtagaatttagacagaaagaagttttcctccccgtaaccatcactcagtattccttttttaaaaatgaagtatagttgatttacaatattgtgtaagtatcatgacgtacagcaaagtgattcttatatataaatatatatacctccaatgttttccattataggttttataagatattaaatatacttttctatgatacatagcaaattcttgttatctgttttatatacagtagtgtgtataggttaatcccatattcctaatttatcccttcctctcctcctttcctttcatcaatcatttaaatgaaagatttcacttgaggcaatgggatccatgagacggagatgcccggatgaaaacagaaacaaacactacagcggaattaaatttgggatttcctctccttcaagtttgagggaaatatgcaatcagcagctaagaaccaagtgacgtctgctgcttcagcaacctatggagtcatccaggtaaggaaggacgagcgtggctctgtgcacaggaaaggacttgagagacaaactgcccacacactcgttttccatttgaggaaatggagcctaagtgaagttaagtcatttgtctgaggtcacacagctagccaggggcagaggaggaaccataaaggtctctggatgtacagtgaaccggtctgttaatacatttctacattgttgcttctagcactcggcacaccaagagcaatcgaagtcaggtaagcaatgcttcccgccaactccagggtcaacgtgagaaaaattaaacaagagctatggaaaaagataaaacaagtggccactgagtagaaataacgaattaatgataacttcttcccactttccttccatccccattccccaaggcttttgggtcagactaaaaagaacagtacacagcatccactaatctgtgttctagagctctcactgccccagcgtgtgctctcaggcacttttctgtacctctctggagcccatgttatgatctcaaaacgcaagatgacctctccaaggccccttttcctctgtctctaaatggctgacattagcttctttttttttttttttttccttttgaaccctttatccatgcaataagctcaccataaagaaactccaacagtcgtgatttaaatgcagaaaaaatttcaatgggtgtgtctaataacaccagcttttaataattctacttgtaccatgaccaattcagtgtttcatactaatacagttcactgaaagagaacacctagctctgactgcaaagctgtcttgagacatttctgttggatgttagttttaaatttcatatattttcacttcacagaaccttatttcctcctttcaattcacaggagaaaaattgttttaatttacagatggaagcaacagcataaatgtgactaatcactccccacccccacaaaaataactatctttacacacccagtttcttccctttcaagcaacctgaaattacattcttcaagcagttaataaaactccatagtaaatataatacagaggaaaccaaaagatgaaaaaactggctgagtagggaaatttttcctaacagtatgccatctacgtttaatagttcactgcaaccttttgggttttaatgctccaaatgaatccataaacataatgggtctttatacaatgtagggattaggagcctagccctactgtctcaggagtacgttctctgttaggaatggactacttcaaagactgtgttttacaccagcaggatcttctctcaccataattactgttgttgttactgataacaattatcatcatcatctttttagcatatcatgttgtatacagtacaaatcctacaaattatcatgcttaattgcttaaataaccttttcaaattttcgtgcatgctatgtatccctatttagcaaattagaaaaccaatacttagaagaataaggcaacatattcaatcttacagctaagttataataaagccaggccttgaacaacctgattcccgatcctattcctttatttgtaccataagatggtaagtatgattccaagtagtcacaaggttagagctgtcaggatcctacatttaccccaagtacatttagatagacgtcttgaaatagacatcccttttactttctgtagaaactctctcattatttcacatttgaagcaaaaatcattctacaatgtaaaagtcatcctttcacgctggcctcccatatcactgaaaatatatctccttgtttactcagcccaaacaaaaagttattggggaaaaaaagttagtatttattttgaaagtgaatagggctcaagaaagggaataatagagtgtttttaagcccatctttcaaacatttaacctatattaaaatagctaacatttaccattcagagaagtgcaaacaaaattcagcaagatatcactgcacttagtacaatcattacagtggtaagtatggccaaagtggtgctcagtacaaaagcctgcttaaaatatccaaatcttacaagctaatgtgtgatcagtgattatcttataagttggggttggggaaatggttcaaaatagctggaccctttccttaaccctcatatccaaacaaacgacagacgtatcaaaaattaaatataaaaagagaaacctcaaaagaactaggataaatgtaaaaaaagtgatgattttaatatggagtagcacaatcctttggagaaggaaacagcaaacccactccagtgttcttgcctggagaatcccagggacgggggagcctggtgggctgccgtctatggggtcacacagagtcggacacgactgaagcgacttagcagcagcagcagcacaatccttaaacatgttataaaagtagtacatggaggaaagtttattaagccttgctatattaaaaaaaaaatcattaaagcaaaaaaatcaagtaacctgattaaaaattgggcgatgacttgaatagcctcttcttcaaagatgaaaaaaatcaaacaagcatatgaaaagatgcacaatattattaatcatgagagaaatgtaataaaaccataatgagatataatttcatacccattaggatggtgacataaaaaagcagaaaataggtataaaggcagatgtggaaaaattgaaactcttttgcactgtgggtaggactgtgaagtggtacaaatgctaggaaaacagtagaagaatcttcaaaaaattaaaactagaactcccacataa

SEQ ID NO: 49531 - DNA, 1305 bp, Bovine  19866880919969
agctgagtttgccgtggtggttgcttaactaactggtttactagtttgagtctcatgcatcatgatggctgttactggttgtcaaggtgtggttgatgagacatagaatcataaaacttcagacttctcaacgaaattcacagctgactcaaattatgttttatagaagagataatgtgaaacaaatggccaagtgattttggcagagccagacaactagttaatatgaaaactgaggcttaaacaataggctgctaacttgtgatctgatgttctttctagtgtaactgaatcacggaaatgtatgggattagaagtgccttcatgggaatgacagtacagtccgcgggtttgctcctgacattgactaagggtggagtgaaggtagagccaccaaacatcagtgtgcctactgtgtgtatttgttttagaatgttaatggaggtgtggaaagtaagaaaattgtatctgactcctcaaggccctagtggaggctgtgactggtctaggactacctcagttcagttcagttcagtcgctcagtcatgtccgactctttgagaccccatggaccgcagcacaccaggcctccctgtccatcaccaactcccagagtttacccaaactcatgtacatcgagttggtgatgccatccagccatctcatcctctgtcatccccttttcctcctgcccccaatccctcccagcatcagggacttttccaatgagtcaactcttcgcatgaggtggccaaagtattggactttcagcctcagcatcagtccttccaatgaacacccagaactggtctcctttcgcgtggacaggttggatctccttgtgaggattagttagttagttagttcagtcgctcagtcatgtccgactctgcaactccatgaatcgcagcacgccaggcctccctgaccatcaccatctaccggagttcactcagactcaagtccatcgagtcggtgatgccatccagccatctcatcctctgtcgtccccttttcctcctgcccccaatccctcccagcatcaaagtcttttccaatgagtcaactctttgcatgaggtggccaaagtactggagtttcagctttagcatcattccttccaaagaaatcccagggctgatctcctttagaatgaactggttggatctccttgcagtccaagagactctcaagagtcttctccaacatcacagttcaaaagcattgattcttcagctctcagctttcttcacagtccaactctcacatccatacatgaccacggaaaaaccagaccattgtgag

SEQ ID NO: 49532 - DNA, 1168 bp, Bovine  19866881014515
caagagtgggcctggtggctcagattgggggaagaaccagctggcggaactaggcttcagacacgtaacagtcttttccttctctaagtgtccaaattctcttcagtgaaagcctgtgagtgagagagaaaaggaagcagagagctatagccactggggcaaaaaagaaaggctgggcacgggtctctaaaagtaaagaaattcaactggaagctgagaacatcaagcagatcatgtttatttaaaaaggacaatgaaagaggcaattgtgggaggagaaaaacgggctggctgataagtgggtaaagaaaacccagccatttgagaacttaattaaattttgtagcttgaattccccacttgctgctccttctgcctgcctcctccccaggagttggcccctgtggcaccagggtcctgctctctttgtggggaattaaagtttagaaatgaattcatcagggaaagtaaccattggtaatgtaactctccttcagggtaagactggcacttgaacccatttggttggctcctggaggaaggtacttgttctataggaataaagccgctattccagctctgtctgaccgcccctactccttaattcctttattttgaaatgagacagggtgggtccctgatcctcttaatctctgagtggactatatggtgggttactctgaaccacagagggacaaaaagtttaagagaatagcttttagagtaaggcagtccttactgcctgagttttgccactgactagcctgagacctcatacaagttaattcacttgtttaagcttgttctctacgataattttaaaaatgcagagagcagtatatcatagggtgatgctgaaaattaattggattatgtctgtaaaaaataagtgctcagaaaagcatgatgacaatgaattttatatgcagacacatagagtgtggggaggattttctgaattatttccagctccttccagcattttactcttctctcagattctattacccactgactgactgagagggtcttcccagcctttaccgatgtgattaggaacagtaatcctggaaattactctcaaattgtttatctaattaaacaagcaaacctttttaacgcagacatcctgaatctctatagcttgtctctgctcatttgctctgaa

SEQ ID NO: 49533 - DNA, 985 bp, Bovine  19866881015495
tttattaagagttggctgtttaactctgaaagtcactgaaaaaactaaaccctggaagcctttccagctctccatttattttccattctgccatctccatggacaggccacataagcaccgcactgacacattccagcctggactctgtttgcacaaatgtttgtgctgtaagctcacggtctgtaatgacaagcacactgagtacactgcgagaactccctcctgcaaaacacatgagactcttacagctaatactggtatctatttcaggtagatatcgatgcaaatgtaattaagatgtgtacacgtcactgtggctttttaacttccttatgaccgtgtatttgatagtagagatctcaggactttactctctactcatttattttctcccagaagagaaattattaatataaaaccttgattcctcagtcattctttaaatctcaacactttgattaattggacatcagcaaacactcatttttaaatataacaattcaaaactgactgtatgctctttttttaattacaaatttcatcatggaaactatcagaggtataaatgcagttaatgtgagactcacaaacaagagatgctgaattctcttatctgttacccagtgattcattctgttctgaggaagcaatcttaaatagtgttgcaaggtacataaatgccacttatctggctctgcttattcaaaacaaattcatggatatttaatcatagttattagaattgaactgttacattccagaaacatttttaatgcaaaataaatacactttttagaaatatcagtttttaaaagtgaaagatatcatcccacctttcaaaactgaaagtaataaaatatagctattggtaagatttgcatagcggcatactgagctgactattctttaattgaatgttaagcaaaaaaaaaaggggtttaaaaaagcaatgattatatgtgagaatataatatgagtatacat

SEQ ID NO: 49534 - DNA, 946 bp, Bovine  19866881042212
ttttgtaccctaaatgcaggagtccgtataacatcaaagcctggtcaccccaaggtctgatgcatcccacagtaataaattgccaacgtaagggcccggtctgataaatctgacccttgttagagttcccccaaaatgaatctttaatttaccttcagagatggtgttattaaaggaatgagtaaaccaataattattattcagtacttctgatgtgacagtttattagttgcttttacttaattaaaatctcccctgacatagagtctaaatatataacatctgacattgactcgaaattatacagattttgctttactgtttttcacacacatatgaaaatatagaagggaaacaggttgacaagaacataatagaatttatacattaaccaaatagagagtgagacttcctaaatgattcctgtggcgtgttgccattattcaaatgttttggggattctccttttgagccttccttcagagtctgtgctacacttacttttaaattcactgatgccaaatctccatctgctgaaggtcggtctccttctatgaagctgccaaaagtcctttggcattaatatgtgggtcagttggtaaatgactctgaaatcaagaagcggttttcttaggaacactggaaatggtttgtaatgataattcccaaagggttattccaaaaatgacctcaaccctagtagcattccttcattcattcaatcattcaatgaataagtcatttaggaaactaatttgaatttgtgtatggtgtatgtgtttgaaaaagtatattcattactttatatacagtttatttagtaattacttaaaatgaatataaatagaatgatagattatctacaatatttacatataataagatctgatctgataacatggatatgctatatatatatatatatatatatatatatatatatata

SEQ ID NO: 49535 - DNA, 723 bp, Bovine  19866881059209
atttttctttcccttctacccatcaagtacttgaattcattcttggattttttttttggtgtaataaattcatttttaatttatattattactaagagttttaaatgccttaaataactatgttgttacttttattatgtacctttttagcagaggtttttgctgtaaagcatgctgttttgaaaactatatttttttttaaaaagacagacaagaagagtggtgagccatgtgtggaggggaaaattggtataattacagtgaacatttatgggtcagtggaacataagccccgagggaaaaactccgaaaatggggctctgagaaccagggaggcgggggagaggggctgcttctccaggccacctgggaagcccggggctacttggcttggctatgccagcagcacagatggcatctcggtgaaatgattactcttttgttccttctttacaagcatcttgaagacaaatatttatgccccctttctactgaagacattttccctcagtgtgactcattctccttcatcttcagatatgattattctttgagcattctgaacaggaagttgaggccagctgcagacttagcacagagacagctagtgatgtgtgtgtgcgtttctgtgtgtctgtgtgtgtgtatatctgtgtgtgtgcaaacatctgtatctgtatgtgtgtatctgtgtgtgtgtaagcacacaggcagagtctcaca

SEQ ID NO: 49536 - DNA, 1104 bp, Bovine  19866881093820
acagttactgatattgtacaaaatatcctataatatctatgaatcagaggagctgttcaatacatgggaactttggtttttctctggattttttgtttccttatatttttaaatgaatattatatcaatgcatcaatcttaggcctagattgttatgggcaaaaaagaggctctgttttgtaaaaaaaaaaaaggaaaaacaattctaatatcaatgaatctattttcacctactatttctgatatgtctgcagaaaaagcttgctaccttctcaggaatttgagatgcaggtcaaggtcaaatgacatcataaaagtgacaaaggaaaccttagtctccatgaaaccaaagactcatacgaataattaccaaacattctctgttcatctttggagttggatacttgaaaagaatccaatcaagaagtaagtgctgtagcgtcatctgagaagccttggctctcaggtgttccaaggactgtggagcctctcagattcagagaaatgactctttaggtacatttaaggatatgtatttgcaactctagtactaacttatcacagggttgaatgaaaatggcaaatacagcaaaaaaaacccccacaaatgcatagagtggcattttcaagatcttagtgtcaacattttgttaaaagagaattataaagtttgtgcttgtatacacacacacacacacacacaatacgtacacacacaatggaatattattcagtcatgagaaagatggtgatcctgccatttgtgacaacataggtttgctctgagcacattctgttaagtgaaataagtccgacagagaaaggcaaatactgtatgatatcatgcacatgtggaatccaaaggagttgaactcgcgaaaacagagagtaaaatgggggttataggggctgaggggtggggaacaaagaagatgttacttaagggtacaagtttgcaactagtagctaaagaaatcctggtgttctgatgcacagtacaatgattataaacaatattatacgataaacatcaaactttctaagagactagatcttaactattcccatcacagaaaagaaataataattatataacatgaaaaa

SEQ ID NO: 49537 - DNA, 2154 bp, Bovine  19866881100849
ctgatctccttcagaatggactggttggatctccttgcagtccaagggacgcccaagagtcttctcccacaccacagttcaaaagcatcaattcttcggtgctcagctttcttcacagtccaactctcacatccatacatgaccacaggaaaaaccatagccttgactagatggaccttagttggcaaagtgatgcctctgcttttgaatatgctatctaggttggtcatgactttccttccaaggagtaagcctcagtaaaacaacagtggtaccaaagtgtggttgctttagttttctcagtgtccttccaacagacataaaatctaaatcctaaattttaatttaggattaattaatttaatttttaagtcctaaatcctaacgtaaacactaaatccatagtgtaaccactatgcttacttagcaaacacagtgtcaagagacattctccagatcacctcctccaacttgcttctcctaatttcttctcactgagctgcttttgtcaaattgccagccctacaaaggctatcagatttaagggcactattaaatctggggctgctccgagacgtaaagattctgtgtgttttgtgcgtaagctaaatgagatacatcttttgtatctaaaatagaacgccgtagcttagcattcaacaaacaagtaaggctacctgtggttcagataaatagataaattattctatttaaagactttgcagctttggatcaccgtaaacaaaaccttcacatgacatccattatatgctgaatctcaaaagaaatgatacgaattacctcttttataaaacagaagcagattcgcagacatagagaacaaatttatggtggccaggataatgggggaaagagatagttagggtttgggatggatgtagacacactgctgtattttaagtggatagccaacaaggacctactggacagcacagggaactctgcccaatgttatgtggtagcctggatgggaggggaatttgaggagattggatacatgtatatgtatgactgagtccctttgctgtccacatgagattatcacaacgttgttaatcagctttactccaatgcaaaattaaaagtaaaagaaaaaaaaatgccttttcttcaacaatatattgttttcattgtaatgtattatatacaacttgttatgtacttaatgagattactgtcctgggattttaggatgtgtagaaaatacaattaaggcattaaaattaaatataaattatccccaccagaaatactcctagctggttatttactaaagcatcttgaatccagcagatcaaggaaaaattccccaaagagactgtaattagaactatttaggacttggcagaactggaaccaaaatttctttataaaaatgaataatgccttgggctacgtaaattataaaatctgaagctctaatagcagcattacgataactgagtttaattgttctgatagtgagctggagagaggcacactcagcttcctgaatttatgttagaaatacatgggattcttgccaactggcgattgttgttaagcagtactctgtccaaggaatgtaaaacatttttaaaaaacaaacaaacaaacaaaaaaacacctggacgacaaacattctatgccattctatgccatcttcactattggagaaggagatcacagtaatgtttatatgaagactaccagtggatttgaaaaatggttaataataatccccagggggaaagaaagaagataacagattctcttagtcttgaaaaaattgttaataataatccctgggggaaaagaaagaggacaacagagattctcttagtgatgagtgatttatgttgaaatagccagtgcactctccctcacttcctttttggagcattgaagggtagtggggagagggctgccctggtggctgccctggtggctcagtggtaaagaatcacctgccgtgctggagacacaggttcaatacctcattcaggaagctcctagagaaggaaatggcaacccactccagtattcttacttgggaaatcccatggatagagaagactggcaagctacagtccatagggtcgcaagagtcagacatgacttagtgactaaacaacaacagcagcagcagcgttt

SEQ ID NO: 49538 - DNA, 1222 bp, Bovine  19866881119538
tggctctgtatccatatgacttatgaatagagtctacaatttaaaaaggctggtaattaaggtctaatatcgagtggccacagaattggaactacatgacttctactatgttaaactcctcatggtttaaaacatgttttgctttgttttttttttcccccccagcagcaaaaccatttaaaaaatgacataactttgccacactggtgatagtaaagcttcttcctgaaactgctacttgaacaacaattttggtagttttctgtttaaggaacaaaaaaatgtactgaagctccaaagctcaattaattcagtaatctcacaagagctttttatttataaagatatttatataaagaataactttaaaaattattttaatgaactttgagacaaatttttttaaattttttttctcattcagcatttctaccaagtttattagaaagactgttttgcttggaagtaatttcaccactagtagaatgactttggcacagatacacttaatatcttttctatttctttaagataaatgtcaaaggtcacaggaagtacatatgcgtaataaattgcaatgttacttcattgtttacttcactgtctttagttactatttgtcacatttttatttttaaatgctcagttgctcagtcctatcagactctttgtaaccccatggactatatccccacaggctcctctgtctatgggatttcccagccaaggatactggagtgagttgccatttcatcctccaggaatttcttaaatattacaaagcgattaacaagttctttaagatgaatgtcttcctgaggttttctgattttaggaaaggttaatcagattttcaaaagttatagtcacttttaacttgcagtgccccaggatttccagggacacagccagttacaccaaggacacagttcagccaactggccccacccaccctgctggcattacttcctgttgtgcatctcagaaactctcccccaggaaacttcctccccacctccttgcatcacactacccagagcccacctctgagttcccagctccacgggcagcaccagcaatgcccttctctgggtatcaccactataagtgatggagaaaagataaccttaaagttaagatgggcaaacgacagagttggaacaaaggagagagttctcaaatagagtctctaaataacagcttgaaaaactaattgggtgtg

SEQ ID NO: 49539 - DNA, 2093 bp, Bovine  19866881123135
tatatgagacattcctcacagctacacagtatctcattaatgttatacaaaattgttgaatgagccctatactaattgacatgtaggctatttctagttttctactataaaacttgctgtagaacattttgtatacatatatttttgcacttttacacagggccaacagctagaaaaaattttaagagtggagttgatacattaaagatacacaatataaagaaaccttaaacaatgtaaccaaagtatacctcttaaatttgttgacagctgcagcagctataaaaactcagtttaaataagcataatcacttgagcaaaacccattcttctgaacaagattaaatgaaaattgacaattttcccattttctgttatgagagcattaaagaagaagcacaataagctcctttgaaaagaaattaagacaaaacccaactggcttattctacataagctctgaaacttgagcaagagagaactccttttaatagacatgaatttatttgaattcattatgcggtttcccacatgccgtgcccatttaaaagtgacctttcagcctccaagtagaagtctaacagcaaaaggatgaagagaatctgtttcaattaagataaacatcaactgtcaaaatctgattagactatttaaattctaaggcaaaaccgtcatcaaaagaaatggaacactccagggcagcagtaaattgggtgtaatgtcattctgtgaagttctgatggtgcagaaagatttctgagtgtccatgaaacacagggctatgtttggaggcattcattctcctcttttcttccttccactctctctggctcattttggagttgtttttgagtgggtctccttaagctgcattatcacctcttaaatagaggtatctgagcaaaggaaactgttattccctatggtcaaggaatggtagatactaactaacaaacttttatggtcgacagtaacaaaaagttacacatacatctttaacagacattaggttgtcaaaagaattagaatgcaatatgctaggaatccaggaaggcaatggcacctcactccagtgctcttgcctagaaaatcccatggatggaggagcctggtaggccgcagtccatggggttgctaggagtcggacacgactgaccgacttcactttcacttttcactttcatgcattggagaaggaaatggcaacccactccagtgctcttgcctggagaatcccagggacgggggagcctggtgggcttccgtctatggggttgcacagagtcggacacgactgaagtgacttagcatgctaggaacagagacacagagaaaagacatgtgggcatggtgggaggaggggagggtggagtgaattaggagattaggtttgatataaacacaagtaccatatgtaaaatattaggtttgacataaataaaagtaccatatgtaagacacatagatagtgagaacatactctatagcacagggagctcagctcagtgctctgtgatgacctaaatgggtggcatgggggtgggcagtaagatccaaaatcgaggggatgtaagtatgcatatagctgattcactttgttgtacagcagaaacataacactataaagcaattatactccaataaaaaagaatccaatatcctatatttcacactaaacccttaattaacttatttttggttgttattgttgcttttgtcattattttgttgttttctgatttgtgacgggtttcagtgtgcttgttgtctggagctgatagagcccattcatgaactactgaggaattcaagggggaaaaaatgacatatgtctcaagcagtcttgccaaatagaacttctgtctttttcaccattcatattgtcacagggggcacaccctcccatcagctgaaggccaaattatatcctctgcaaagattactctagcaagttgctagaatcatttttttttaaaaaacacatatatctattcatcaactacatttcggattcaaaccttaactaaactaagccaatagaggtattagaacactgaaatctaggtactcacaggcagagaaaattcaatacg

SEQ ID NO: 49540 - DNA, 1281 bp, Bovine  19866881160240
atagccttgactagacggacctttgttggcacagtaatgtctctgcttttaaatatgctatctaggttggtcataatttttcttccaaggagtaataaacatgaaataacttagggtttttagttaagaaaagagaagaatttttaaaaagcatgataacactgactatgttgattaatgggcttatcaagatgaatagagtaaggtcctggctctctgatgggttactccaagcttcttgccttggtctaagttatggaagacacgagagactgaagctgtggggtttccaaagcagatccaggaaccaagaatggcagggaaggagatttcagttgtatataagcaaggacttcccagtcaatagacttgtcaaaacacagaattgctctgtatgatcctcatccaggaggtctgcagaaatgttcatcacagacgttactctacaaactcaactatggtatagagggagaaccaatagccattagcacattgtgactgacacgggctggccattacccacatctgttttaccttgtggctcagctggtaaagaatccacctgcagtgcaggagacctgggtgtgatccctgggttgggaagatctcctggagaagagaaaagctacccactccagtattctggcctggagaattctatggactgtatagtccacggggtcccaaagagtcgggacacgactgagcgctttttttttgggtaacaggactgagataggtttcccagcctcctttgaagttagatgtggccacagaactgacttctttctggggaatcctgggataagtaatgggtgcaattctaggcctgccttataaaaactcaccaatgccatcttctgtgatcttctcctctgattcagtggagcccagcaaacttggaaaccatgtgttactaatagcggaaacataagataataggaccccgggggtccctgagctacccaggtcaggctagctccccacaagaagcagaagcaagaaataaatatttactggtgtcagtccactaagatttgggggagtatgttgtagagcaaagtgattatcttaatcagatgctttccaatgtgattttatatatatatatatatatatatatatatatatatatacactgtagtataagtaatttgaaaccaaggaatagctcttgttcaactttgtaatcagtaggtacaagataaacacttcggattcagtaggtagtaaacatatgcatattgaatggaagggagtaccaggcataggaaacaacat

SEQ ID NO: 49541 - DNA, 1264 bp, Bovine  19866881199350
ataatttacaatttccctttaggaggtcacttcatttagactttgttggtcttcttgttgatcttctatcgttggttttcttctatgcaattaaatgttcttgtatcttaattattttctgtgtcccatacccggcaaagtatatttactcttctgtagaacatttgctttatttatgttctaattgctgtttttaagtcacttatgtttaggtcgcagttgtactttaaatgttagcagacataatatatagcaaataagagcaaataaagacttgatatttttcctactcctttctatagaaggataagctatgtgagctaagcgtgactttaaataggatgctgggaggaattagaaattgtggcacggtcacagagaccccacattacaatccatccttgtcagcactctcattccacataccagcattcctttctggttaatggaaaaatcgttgaaagatattagaggggaaataaaattgtgtaaggggtaggaagttcatatttggaaggagggattatatatggctattataataacagataggggaatgcatatgtgaatttttgtacacccttggttttattgagcaaaagtagagagatttattttcctctctttgttaattgtcgaacagaaataaaccctactgtgcaggaaactagtcactcttccctactctctcctggtattaaaagagtttattgaaatcctcaaatgagcttcatactgtggtcccagtgatgtctcttgcattacttcagtcaaaccgtgcagtgtgaccaatgcagacagtctgttaggagcacagggatagcttgccttttcttcattctttctgcctctattgtttctgtattttggttgcttttatcctgccattttgaatctctgatgccccaaattatagtatgctcattatatgcaaggcttctcctcctacccaccccctctttcttccccccagcgacatctcacttcattcccaagaaaaacatcaccctcctctctcagctcgctgtgtttacatttctctgctcttttcctctcttcttctggcatgctggtttaatcaattttaccaaatgactttcctggcagccgtaaaaagaaaacccagagccggttaatagcaatctgatactgtactttttgtcatttctctgaaatgtatagaaatgtttggtcattggattgatttttaatgatgtaaatgatcagatgtttcaatgctgcattgcagcaggccgataataaa

SEQ ID NO: 49542 - DNA, 1591 bp, Bovine  19866881275932
tcagtctcccttgagatccaaggcccaggattcccaggaagcctgacttccccttgatacagaccgccaccccttcctgcttcccatctatttcttttctttgctcagaatgagggtgcaatgcagtagtccataccacatgtgatcatgaaaggacaagcagaggatgagataatgtgctaaggatggctgagaagagcataaaggaaagcatgcatttgaagacatcacaggaccactgtgctagccctgggctgctacctccagcatcctttgtaccagacaaactcttagatgcttaaactgctggtagtttactgttacccacagctgactgcattcccacctgataaaaaagactctaatctttttttaagtaaagacttcctagcacacatatacttttaaaacttgagtatttgaaaacagttggtgccagactatcataattcaagtgactgccttcttcctagtgttctatttggacacattcatttagctttttagagttaatgtttccttcagtcatattctttgcctactagacatttttaaagtaaatataaacaaattacctatcttagaaattgcaaaaaaaaaaaaaaagcagaaatattggtaagtcatctaattcatttcttgcttcctttcctaaatgattaattcttttggtgtaaaatatattataattgaatgcagtttctactgtattttatgcacactgtcatgctaatgtgtacaaaaggttttgtctatcatgactttatcaaataaatcccaatccttgccgctgcaaacgctgacagactgaataaaattgctgacaatttccaaaatctgtccacagagatcactgctaggcaaacattattgcaagtcctggtgggtaagctaatgctttcatatttgctttcttaatttcaaaatagtaattatgtattattaaattatatcttgcatcccctgtaattttctgtactcactgtacagtgtgaatttcaataaaattcaatctctttctgcctgtagttttatgtaaggcttaaaaataaacccatcaactaacccatccttctttgaaatcctgcaccttaatctatgctcatatccttagtgaaagccatatttttatgattttattgattataaaattgcacagtgtatttcaaatgccaaggaagggttggggtggtggtggagagagaatgaacacaaagaggcagaatttctccctaccaaaaggtctttgttgtcatcaggaagctttctggattaaccaagtaatttaattcacaaattaacaaaactccactatgaagatctgatgcaagagggaatggaaaactcttgaccttttggattctaatctccagatcggctctttctatgctcccccattaaatactggggatgatcagtatcagctttcagatttaggcaaagtagctaataagcctttgactaagatagtaaaggggaactggtggtaattaaataataaaactgatttacagaggtttcacttctaatcttcttcagatggacacaaactaagaacctatttatgtcaagtaaaggcttcatcaatgca

SEQ ID NO: 49543 - DNA, 838 bp, Bovine  19866881277241
tcccatcggtggtgaatttggcggtaattgtgctgttggggagctctgaactcaaaatgttgccattatgagcttgggcacacaagggacatattggaagtggcaggcagtgtcagcttccgccaaaagaatggtcacgcaaaatgtgtgcttttgcccaaaaaggaaagtaacgtggctgtaactggatattgtaaataagcggtcaaaggatccctaaagaagcaatatcacataagcctccttacagcatatttttccttctgggatttgtgtcaggctcacagacatgaaggcagccaggaaattgttatctgtttatctctaatttctttttataattgcacatgccagcaatgggagaaaatacttcttttaaagaaaagtaaaattggcagtaagccttctgagttcttaaaagaccttaacaaacccaaacttctacttatcatggagttgtcatacttatccccatcagcacttgattttcaactgactttgagcacatgcataggtatgtgtgtattagaaccctgacttggcctcaaatcttggctctgccaatagctttatgcctgggcagatttcttaggctctctacatcttggttttgttatctgtaaatgtagacagcttgatgccacacagagttctgggaggttagttgagaaaatgagaaacagggatggagcacaaagctaggcaaatggcaaagatgaaatacaagtgaatttgaacccagttccctctcaggagacagcaaaatggtttcaggtctctcaaaagcatttcaagggacttgcctggcggttcagtggttgagacttcacctttcaaa

SEQ ID NO: 49544 - DNA, 1021 bp, Bovine  19866881351432
gttgatttcttttaggattgactggtttgaccttgcagtcaaagcagtcaggctgttgtggtggtggttcattcggtaagttgtgtctggctctttgtgaccccatggactatagcccactaggctcttctgtccatggaattctccaggcgagaatactggagtgggttgtcctgctctcctccagggcatctgcctgactcagggattgaaccctcatcttttacatcctgcattggcaggcagattctttatcattcgtatcacctgggaccaggctatggataaataaaagagagagtaagatgaccctattctgtttattttcactgtcaaactcctattttaaaatctgttactgtgacccatggaagtaactaattctggttgggtagacagattggcaagtgtttcaggtttatgatctattaagaggaatattatctaatcagagtgcttagatgaccctgtctaattggagtccttttttacgggaagaggagcaaagcagcaaaagattctctcctttatgagagcaatggggatttccaaggttaagggacatgtgaagagcagatctcggtgaaattctagaggtcacactgaagcagcacttggcaaaagccactgaacctctggccccagtccataggtggtttcacatttggggttcctatgctgagttaatggcactctgatatagagtcccaagtcagaaactgctcttttctttatttgcttttgctctttaattttatttcatcaattttgaatatgtgggtagtattttgcatacagtgtctgatcctttttcttgtagcaattcatttatcagactttatctagttagtcatgtggctgtattcatcactggggccaagttgctctgatcatagaggttcaatcctataagccccagagagctgacattagtaacaggcaagcatagttgttccataaggactacttaatttaaatccttcagccatcaccacattaggtgccacaggataacagtttt

SEQ ID NO: 49545 - DNA, 1055 bp, Bovine  19866881359681
agacggataggacttggtgactgaagagcaacaatttttacattatataggtacatacatttattgtatccctctatacaatcttaccacagaacagttttttctaggaaaaaaaaaaaaagttccttcattgaaaagtaagatggcaaagtttctaaatgctttctctttttttgcataaaatcaaagccaacacggtcagagaatgatgagcactcagacattctcactattgtcaaaatagtacacgaagaggaggagtgcaggattgcctcgggcattcccagctccctgacgtcaatttagatgaaattcagataacaggctctgccagctgcttgattctcctgagttctgtgagaaaccaattctctttaaaaagaggctgtcatctaaataccatcaaagctacttgaaatacaagaatttaagcttcttttgaatgcctttcaccacccaacagcaagcctatagaaaatgatcaacacattactattcctttcaatcagggtcactatcaggatataaaatagcttgatctaaagtaaagacaactgctgctgctgtggctgctaagtcgcttctggcaccctgttaaaagttacctcctctaggtacattcccagctcagctggtaaagaatccgcctgcaatgcaggagaccccagttcaattcctgggtcgggaagatcccctggacaagggataggctacccaccccagtattcttgggcttccctggtgcctcagacggtaaagaatctgcctcaatgagaaagacctgggttcaatcccttggttgggaaaatcccctgcaagagggcatggcaacccactccagtattcttgcctggagaaatccccaaggacaaaggcacctggcaggctacagtccgtggggtctaaaagagttgaacacgactgagcaataagcacacatacattattattattatccaggctgatatctgtcatgtgacttgctcagtgtcacatagcttgcacacagtcaagcagaagactgaatcatatagttgggttaaaatatccatgtt

SEQ ID NO: 49546 - DNA, 975 bp, Bovine  19866881366771
tggttctaaagcttatttaaataaaatgaacttaaccatttaatttggctgacatagccttgttaggaggtgattaaataagcaatttacctagaatgaacatattcctctaatctcagggaaaatattttggttttaaaaaaatcaaatatcccagatttatttcatattaccacaccctaaattcaagtagtcaggtttttaaattattctgttcactgctggatttttgagagcaacccaaccactcacttttaaactataaatgtatttttataataaaagcaaaaaaaaatcctagggatatagaaaactgtaaaagtagaaatcttctacctcacaggaatactttagaaagtcactggattgggaattttatgaaggtgagggctaatatctctctaagacccatcagggtgcctggagcagaactgagttaataaacattgttaagtgaagcaatgaaaaatatacctttatttttacaactaataaaagttctacagaaacaaaactcttctttaagaacagtacattttaagctatggaatcagatttcatggtcaagtggctagaaaatgatcttgtaccacactaaaaaccaatcctcaattacaaaggattaagacttaatttcttagtattctgaaaaacgtaagtctagaaatgtggtaaagctaaaagcaacttaatagtggggaaagtgcacaatccaggaaggaatgctcacccagacttcggaggccagaggttagggctctaggccacacttggtccctgacttaacatcccagccatggagtctgtctgatggggtggctatgttttgcttcaaaaggctgacaatgaagctgcagtgagcctgaagcagtggttgtggttcttgccccaaataggtctctcagatgaagagaacaccaaactgataaagagttagagaaagtagcccagacggtaaagcgtctgcctacaatg

SEQ ID NO: 49547 - DNA, 1487 bp, Bovine  19866881385941
ctccagatctttcgtgatggtggctttttaaggcacacacacaaacacgttattatggcatctcccgaaactgacattctcaaaacagtgtccgccactatacaaaggaggtttgaatgttctgaagccattttttcttttaagccattgttctaatcttgtttcttcctcaaccacggttatcaccacttccttacactccactcccaacaacattcccaacgaaacccaatcacgatggtcattactgcaagctttcttcagcactttgaactgcataattaggctcctgctctcatgctttacttgttttatgtcttaagcacgttgaaagcagggtctctaccatctttattttctgtaacgctcagcatatggtaaagattccaattttctttcacaatgccatgcttagaacatttcaatgctctcccaaactggcctccctccctgttgccagtggctttgctgatcatttttttctcagtcccattcaccacctgttctgctgaggtcatctaagtcagcggtccccgacctttctggcaccagggaccaattttgtggaagacaatttttccatgggctggcgaggggcatggttttactgatgtgactgatgtgactgatgtgcattatacttattgtgcactttaattctattattacatcagctccaattcaggtattcaggcattagacccctgacctaagtaatttctcaaaactacagaacagagcaagccatacttatatttggtggtgcaccaatatctgtaaatataaattaaaaatctttagaaggtggctcccacctgaattcacacttaatcttattccttgccatccgtttgcagcaaaggtcactagcttttctgcaacaatcatctcttttttcacatgtctatgactttataatgctgttcccactgtctgaaatgaccttctttatttatggagagattccaaatggcctctaaggtgtaagtcaattactatctacactaggtatatccagcatttcccagaagacagggaagcctcgtcagcaacttgactatatctctacacgcacttccattactacactgggtctatcgactctggaaaattctctgagtctaaaggttgtattatttcatttcgctgtgggtcccagttcttgacacacaggagatactcagtagtctactagaagaatagatgtcagtttccttaactagacttgaataattttcttgtgggcctacctgcttgtcaaatagatttagtctcatttgatcctatattcacacagggtaatgcttagattgcaaatactgtcacatctcttgtttttccagttaatctcgggagtctttaagtaggaaatctggtctcccgcttattggttattcagtctaatgtagacccttgcttctaaacttcaggtggagagaggaccgcaattagcatgaaggcttttgccactactgcgggcatcacag

SEQ ID NO: 49548 - DNA, 1218 bp, Bovine  19866881389713
aggatgtttgggaaatgctttctcaagatgatgagtttagtgctaatgttgctgagcacactgatatctaatggaaataatagtccttaatattcccccaaatatctcatactgttactaaccagggttcttggccttcttaatcaattggaattgatgaaaggccagacaagaaattcaggcaaggcttcttgggtcccctgaggcagtggtggtagtttagtcgctaagttgtgtccatcccttgcgaccatggactgtggcctgccaggctcctctgtccatgggattctccaggcaagaatagtggagtgggttgccatttctttctccagaagatcttcctgatccagggattgaacctgggtctcctgcactgtaggcagattctttacagacttagctacgagggaagccccctgatacaacaggagggagcaagaacagctagctcacttgctccctgaaggggtggcaaacgagttccttatgtgtggtgaggatgagagtctgaccaggggttgggctggaggggtagcttaggtggtgtgcccacccacagcttaggtgctgtaccctgcttttgctcccagctcttcagaagtggcatttggatttttggtctttttgcatcttcttgcccataatttgccccaactctgcatgcacatggttgtttgtaggcccttaaagttagtttttgttgctctgggagaaatttgtccaggtgcaagcactgcagagaagggttccaagttccaggtcctagcctgtctctgtactagatgtgtgtgtgtgtgtgtgtgtgtgtaccttaagttaaggtcattactttattggatggtgatggaaaggtcagtttgaaataagtagattaattttccatgcttggttcctggactttttagaaactattcattttcaaaatctaggttcacttttcaatcttgcattttctgagttttatacttttttgttttaggtttacaaataacacagaagttacagaaagcttaaaagataagtcctgtgacatccttaatagatactgctttaagtgaggggcaggtggctaacaaaggatgtgctggaacaccagcaggggagcctccctctcctctggcccttttcagtccaattacaggtgaaaagatgctatctttcagtctgtcatttgaattcaaatatagaaaagatctgccagttctcttttatgta

SEQ ID NO: 49549 - DNA, 1373 bp, Bovine  19866881396575
taagtatctttaaagattagtcctgaattgttgctttaggatggattctcagaaaagtgatgcatagagttaaagaagtgttcaaaaaacattgtgagctgcttttcagaaactgttattagggtgcttgtagtattagtatataacactccccaaatccttgcattattgcaagtttttactattctacagttaataaagatttgctaaattagtaggatgaagagtaatatctgtttcaattagctaatattgaggttaaaattttttatatatgcatataaataatttatttcttctttgtgaatttaatattagtgttatttgtctatcaggacattggccatttctttttctatcctggttttcacagaaacatttttctcagttcgttatttgccacttaattatttactttgacttttgatgtgaaggaattttttttttcaaactgtatccagagaagttatttttcttttaaaaatgtttatttcctactttcattcatagaaaaagctttcttcaacctcaaattagattagaactcacttttctggttttttaccactctttgtttttaatcactcttcaaataattaaaagaagatatttaaagtctgtgtaaaattagaccattctgataaagattgaaaagggtatgagattttttaaaaggagaaatctttatccagtattcatttattacactattatcatcaaagtcaggaatttaaatacatacctaaaagcattttgtaaaatattagaaactgttcaaaaacaagagtaatcataaaataacatcttaacattttagaaaacagattcttccagaggctttctcctccaagagggccactttgaaagcctacgctttatgttatgctgtcaaagtcaatggattggaaaaaacaaaaagcaaatcattggactgaattctaaaatagtgctataattaattaaatgtttttatataaatgcagaatttagtaaaaagaatttcaaagagtgtaacaatgctaaattgttttcttgataccttctactataaaaaagctataacctaataatattcatttttcattatattatacatatattcaaagtattttattaatagatatttttctgattactgaagtaatacatcttgtgcctagatgtttgaagacttgaaaaaagtacacagaagaactaggtctaaacttttttaaaatgtgtgactttgggcaagttatctaacctctctatcactgtcaccacctatataatgaaggtattgaaatgcacattttgttaacactcttaaccggttacagtattgtgaaaaattacctataaatctaagaaactaatacaaatggtatttcatt

SEQ ID NO: 49550 - DNA, 846 bp, Bovine  19866881589143
caaactgaccaggcagacctccatttcccttctcttgcccacatcagaccactagcagcaagacttaatacccatccctagaaaacgcaaaccacctcagagggaagaaggtcatacagtgacatttagggtggtcagatgaaatacctgctgggcacctaatctcactacagcaaattccccagtgcacaagccccacccaggcactcagcacctctatcacctttctagggctcaacctcatatgtgaccttgggtcagggatcagtgcaggagtttgagaatcctactctcaccaatgatgagctatttgcacgcgcttctttaatatcacttaaatacttaatttaaatgaggttaaatttacagagatacatgtaatttgagaataaagaagaacatgaagaatgaagaagagaaggttagaatatgaaggaaatacaacagcacttaggaaactttaaacagctgacttgagccatgcaatgcagggtgtttttttcttttgatcccatattttgaattagtacaaagttctgagagttatttacaaagtacatatcttgtcaacattactgatctcaggcaaaaatgcttatgcctgttttaaaaactagttttctgcaccttttgattgacaatataattggttgacagatgttgaaatctatattatcagagatctcacgtattgttaccttttaaaataatcatttgttagtcaggattacctaatgaggtaatcaaaatgccatctattgtggaggtaaccacaagtgactatggctaaacatcttacacctttcacagctaacagacttgtaacctgtcatgtatagcctcatc

SEQ ID NO: 49551 - DNA, 634 bp, Bovine  19866881878680
gagtgaatagccttcctttctccgcagatcttccgacccaaggatcgaacccccatctcccacactgcaggcaaattctttaccatctaagccaccagggaagcccacttgttattctgccccttcaaaatgacccagtatcagactatgatttgatttctaagattttatgtagttgattatatttgggataagattataaatttatatactatctccttcatagtaatagtacagatgttgaattaaaatatttcataattgttttataagagtaaacgtaacattcacagttcctatttgtgagtctgacttctgtgcctgtcatgatgactgatacagattcaagtttgtttttaataaactccaagaaagatcaaagccagggatcatctgtaacattgctctcacttgacagccctctgaggcccctgttttgccctgcagccttttcctaaggagaaagccacatttttggctgactactcactttcatacttttttgtttttttttttaacaactttaggtaatgcgtggcaaaaaacaatatgaaaatgttgataaatggagagatgcactctttcaccatctggtgagcattctggagaatggagacaaattccacacagcaaa

SEQ ID NO: 49552 - DNA, 1252 bp, Bovine  19866880116800
tttctggtcttacatttagatctttaatccattttgagtttatttttgtgtatggtgttagaaagtgatctagtttcattcttttacaagtggttgacgagttttcccagcaccacttgttaaagagattgtcttttctccattgcatattcttgcctcctttgtcaaagataaggtgtccataggtgtgtggatttatctctgggctttctattttgttccattgatctatatttctgtctttgtgccagtaccatactgtcttgatgactgtggctttgtagtagagcctgaagtcaggcaggttgattcctccagttccattcttctttctcaagatcactttggctattcgaggttttttgtatttccatacaaattgtgaaattatttgttctagttctctgaaaaatacctgtggtagcttgatagggattgcatggaagatttttctttaaaaagatttgaagatgacttggctggctgttctttcttagagcaagtaagtgatggcgatggctccaactagaacagtgacagcacaatggatggggagtggaatgtggagaatgaataaacatataactgaaatgtatatcgtttaaaataagcttctccattcattcagattgttggtattcatttggtcaaccatttatactgaactctgtgatgctgcatgtactcaaatacttaactctagaaaagaattgtcagagaaaagtaaaatgcattcctttcatcctgtaatgttattgaaattacacccttgccagtctttattggaaatgcggtcatagttgaacatagctaatacttccaaggactactttttaacctatctttaaacattttgggattatttgaagtcaaatataatttattaattctggatataataaaaactctgaaatactttaactcttaatacatctgctttatttgtaaaagtcagttatgatgagaaaactagcaaatgctaatcttgttcagaaaagcttgtagccaaatatagcagatatttaaaacacaaatacctacacatgttcttttattgcttattcacataatttccacattagttgataaggtatactgtgctcctttattgttgatgcaaaataacacacataaataccatgatttaaggttttggcactggtaatgctttttgcatgcaaaaactggtaaatgttttcatcattaaaaaaaatatacttttagaccaaattctagggattcttaaaaacag

SEQ ID NO: 49553 - DNA, 1569 bp, Bovine  19866880393532
tactgctcaggaggacctgaaatccattaatagttacatcatgggggagggaaggatgataggggtctggtttttctgttcctgcattccaagaccctccttggttttatctgctctttcgtccttgggtcaccacaattatgttttatttcacggaaaaaaactgaggacttcagtctgggatacagactctcaagtagctttgagaagctattccaaagaagtaagggaggagccaagatatacaggagtttctgcaacaaacacaggtattcagaacatcaaaatattactgttactaaagaaaaaccagacatctcaagtgactcaatgtaatgcttttctgtgtataagaaaatgcaaaatgctgggctctttgaacccgttcttcaatgtgtacctcagctacttgggatccatatcctgtgtttccctccagagtctcctcagggtgcactgccggggagtcactgaggtgactgatggcttgatggaaggcatggcgtttctctccggagtcccctcagggctcacagtagaggccggatgatcgcagcattcttcgtttactgctatgggctgctgctgctaagtcgttcagtcgtgtctggcaacttttttttttcactcacgatttatcccacaaacattaagaacctatcatgggccagatgccagtctgaacactgaaactacgagaaaagccactctctttgccctcaaccacagtcctgtggctgtacctacattgcaagcagataaattacaggaccgtagaagcgcactggtagtaaatacagacagggaagagttaatgtgtccttggaaatcctagaagcgttcatagaggaaatgacatttcaactggattataaaccagttgcttatactccactgcagagttaatgagcagtggaaggacagaataccttggaaagtaggacatttttaaaaaaactcaatgaagaccatgttcattttataggttgaaaggactactttaaacataaaactgtgtttagtatattgatgttattatatacttaggtttctccaataataaaatcttttttaatgcctcattctttttttcttggcaataaaatatttttcgggggaaatgctgaatgaatcattgttgagatacacgccattgctttcttccaatgaccctgaagtaatgtagaatttacacttcagtggttgcagtgctcaatgtggcaggtagtacattgtgctgctgatttaaaaaaagaaaatgtatggaataggtctaaatggttttatgcatatttagttttgaggaaaagatcattgacttaacatattagtaccaaactgcaaagcctcaacagttgattgtcagtatttttaagattattattgcaaagatcattgtgtctaaatatttttgagatgactgttatctttttatgtatattatgtaaattagcataaacagtgggagtggaaaacaaagctatcccagaatgtgatagagttttaagtggtacctttattttcttatttacttttgccttagaaacagaaagcatatccagaagtttt

SEQ ID NO: 49554 - DNA, 1591 bp, Bovine  19866880452776
caaacgcgttggttcttttactatgtgaaataaaatggagtttgttaggcatgttaacatgtttatctcaatattttattaacaattatggcctcctctcatggtttagcatttatttttctcatttgtttcccctgcattggcttaatctctccacttgaattaaacctcacagaaaacaaatataagcttatacataggtgaattccataagattttttgaggggaggggaggggagagaaagtactggtgggagaaagtaagttggttgactaaatcacagatttaaatggccagacctaccatatttacaaacagagagcaatacacaatcatgtctctcatactgatttcaaaatatatgaagaatagaatccttaatactctcaaaatccaaaacacctaatttaaatgccagtaagggatttgagagatttgtgatgtaatttcttttcttttttttggctcccatctctgtactacagcctgcagtcttagattaattctgtagtgatatggaacatacagccatcttcctgctcatgctcttgattctgggagagagatcccatcttcaatgtctctggggacccctgtaaaagcaagcagttgctgcctaagacaacaagacctacaggattgaaatactgcaagggaagtagcatttaagcagagttctgggtaagagtatttattttagttgcttttctaagtttctctcttgacaggagaacaaaaagagaaagaagcaggatgaagaactttttatcttctcctctagagaggacgtccttagcacttcttgtaaatttatgtgactgcatttcaacaaagcagtgaaaagcagaagttgccaagctaatttaatcattgggtcttccccctttgcttgcctagtttagataatattgttgcagtgataatccatttacaaattctataacaatagtattttatgttttgttggaaaggtgtttggaaagaaaacacaatgttgaatgaattttatattttatcctgttatattttgcttataatatgctacctctggatttatttttcttcatatgcattacagaacaactatttgattttaatatgttttatatattacatgaattacatagctgtgacaataaagatcaattataactatcatcataagaagggcaaatgaattactagcatataaaacaatgaaacataccctatcatataatatacaaatatgcatatgaaaaaagattggaaaagaaaatggtaacactagttttgcttagacaagaggtaggacattttttttctaagcagcaaaagctctctatgatgttatgttgcttttgcaataaaaagatgatagtttatattaatcacattgatttataagtgaatattcaaattaattttctattaggatctcatctgcaaaactagggcacgtaaataaatccttaattcaatagaaagtctctgtaagactataaaattaagtagctggccattttaattctaaaatactctttgcattatatacagggaaaatagtcaaaagaggtcaattttagagcttgcattttataaaccattatt

SEQ ID NO: 49555 - DNA, 783 bp, Bovine  19866880488045
tcagacgtgactgagtgactatgcacagtacaataagtctgtcaattaattttttttaatttaaacaacataactgcataaaactgcagaactaatcccatgcaggtcacctaggtcacaaccccatcttctaaacatccatttcttgactgtgccttgccactaggcatgggagggtggggaggttacagtgataatatatggatgcttttggactctttctgaatgtaacaacttccaaacttatctgcctaatgcaggacaaaatacacatatggataccaatataacctttaatctgccttgagcctgttgattttcagttaaaagtttgatttctagaattaaatcatacatgtcaaggtctgttacaaaatcagctctcatagaaaatgtatatattttggcagcttagcaaagaaatcctcaatttcagtgagatcaacagaaccatttttagaaaatcactgccagacctaaagctaatttcctttcattttgcaacatctgtaagcctcgtatgggagtctgggttttaattagcactgcaggctaacaaatggctagtgatgtttaaaaaataaacaccaaaaaccatttcacaggaaagccacaagatagtgtaaaaaagcaatatgggctacaggctctagaatacatactgttttactgacaatggttaagccttcataggcagttaattcaaaaaacaggaaaaaagtgttggcatcataaagggaatcttcttcaccaaagagtattttttttttaactagaataaaa

SEQ ID NO: 49556 - DNA, 1958 bp, Bovine  19866880513634
ttttgatgagaatttaataagacagagaacagtaccttgccaagtattaactttaaaccttatttactttagaatttcaagatttatggaataccaaaaaacccatggagatgactcacaaagaactggaactttctagtttcctacactcttttaaaaagtcttagttatttaactttgctacatattgccatgactaatactgaaatcaactcatgaattaacataaattaatctgtttctttttggttctcaccccaaatggttaatcactcgctggttattgtgctgaaatggactatttaaaagcggtggcattagtcttttaaattacaaaggtgatgtctgtatttaatcagagaattactcaactatgggaatacaaatatagtttttctctttttatttctaaattatgaaaataagacaacacttagaaaatatagaacaaagtcatatagtcccattatataataaaattatttttaagtggataaattaagatttttgttggaatttcaatatcaagctctcaaaattaatagaatatacagaaaagtagaagggtatagtagacctgaaaagcaccatgaaccagtttaatataattaagatttatacaattttcacacaagagtaggttgcaaagttctatttcacgttcccatagactataaactcggagacactggaacacaccggggacataaaacaaggtgtaaaatttcacggtctaaaggtattgaaatcatacagagtctgttctcttatcattgtggaattatgttaaaaatcaatatcaaaagatatttgaaaataacccacatattttcaagtgcaatgtgacatttaccaagagagatctttgacttagccattgaaagtctcagtaaagtcagaagcctgaaaaaacacagagggtgattgctgagatgaaagcacttaaaagaaattgctgtcaagatgaggaattaataccaaagatcctttaaaaacctcatgtatttgaaaattaaatgtccacttttaaatgatggatgtatctaagaaggcatagcaaggaaaattagaaaatactgataatgaaatacaaatgaaaagagaatttgccagaatttgttgcatgcagctgaagctggcttattgcaactaaatacaatgtggaatcttgaataatgtataaaaacaaagaatggacactagcataaaattttggtaaatttgaaccaaatctgtactttacttaataacaccatatcacacattaatttcctgttttattttgtttttcaacaacagtaaatacagtttttaaaagaattctatgatttagaatgaaaatatacttcatttgtttcatgtgtatcaaccccttttccatcttatttgtcttttggcatacttactgaccgttactattcgaatctcagttacccacatcctagtattctaagcatctcctgtttggatgcttcagagacttgtgaagcacaaaaccagcctggttttatgtaagtaggtgggttgctaatctgtaagaatgccattcttgatcaggcctctatgaattgtttgtaagtaccaaatcagacaatgcagtctttatattcgtcctgcaattagccaaaattattctagttatagtccagttaaagatctctagtatgaaatgaatgtaaagtattcattctttctttatctttctctctggcttcattctagctcatttatgtacttaaaaataatcttctaagttactttttcactgcttttcgtgttgcagattgaaaatgttgatgtctgccttagttttctagcagccagaggagtaaatgttcaaggtctatctgctgaaggtaagtagaagcataattgtcacaaatggcatctgtgtttgaaaagacttttgataacactagaaatgtcaaatgagagtacgtgggcccttaatatagaaa

SEQ ID NO: 49557 - DNA, 1475 bp, Bovine  19866880562372
cctcctatttgtgggttgcctacttaaaagtgtaggtcttgactatattacatccctgcccttcctacctatctaattgtagttccttctttatatttctagttacggaaaatcttttctgctagtccttaggtcattatcatacagctattctgtaaataattgtaattatggtgtgcttatgggaggaattgagctcaggctcctcctataccaacaccttggccacacaataaattcttaaaagtagaattgttgtgtcacatcttatttattttaaatttgaatgtacaatgtcaaattaattaacaggaaaactggatataagtggtgaaaaaaaaaaacccatttcaccatagtttgttagactgtgtgtatgtgtgtggaagttgctcagtcatgtccaactctttgcgatcctctggaccatagccctcctagctcctctgcccatttaattctccaggcaaggatactggcgtgggttgccattccctccttcaggggatcttcccaacccagagaccgaacccaggtctcctgctttgcagtcagattttttactgtctgggccaccagggaactgtaaatttctcaaactcagggactgctactgtcctggattttaccctattctcagcatcgtaactacatctagcatgcagtcagcacacagtaaatattacttgactaaattaatagagattatgtgggatttaaagaatttaatttgcatctgattacttttagatttgaaactgaaccccttctcttcaatatactcactgggaacattttggctatgaagtaagaacaatcctctctcttgacactgtacatgaattatgtacccattgtgctttgccgtttaccagtttgcatgaccttaggctaattgtttaatatcttagaatttccaattttccatctgcgagatgagtataataaaacctcactctgtctacctgtcagaactgttgtgagatttaaaggatataatgtgaggtaaagggagtttgtacaaaatagaatggtctacaaataaaagagattaacaattaaagacaggtttaatgttctggaatgcattatacttgactcatattaacctgaaaagattcctgcaaacatcctaaagctccaggctcaaaagctaccttttctggtgcttacctgaggatgcctcgtgatggtgatttcttttaagattgggaaacggcattttttttccacgtttatctgtcatacttagctgaacaaagtcacttcccttctccaagcacgacatctgctattttctctttgtaagcacagaaatctaaaagcaataacataaaaaaataaataaataaaacccctgcagcttaagtattgattaaaaacaagcttggttcattaaaaacactgctgggatttgaagcacttagaggtaattttattttacttagcattaaaaaatatagtgatttatagat

SEQ ID NO: 49558 - DNA, 1539 bp, Bovine  19866880571929
atccacatgaaattaaaagacactccttggaagaaaagttatgaccaacctagatagcatattgaaaagcagagacattactttgccaacaaaggtctgtctagtcaaggctatggtttttcctatggtcatgtatggatgtgaaagttggactgtgaagaaagctgaacaccgaagaactgatgcttttgcactgtggtgttggagaagactcttgagagtcccttggactgcaaggaaatccaaccagtccattctgaaggaaatcagccctgggtgttctttggaaggaatgatgctaaagctgaaactccagtactctggccacctcatgcgaagagttgcctcattggaaaagactctgatgctgggagggattaggggcaggaagagaaggggacgacaggatgagatggctggatggcatcactgactcgatggacgtgagtttgagtgaactccgggagttggtgatgtacagggaggcctggcgtgctgcgattcatggggtcgcaaagagtcggacacgacttagcaactgaactgaaccgaactgaaaattgccgaggaatttttgtatattttgtatattattggttttcaagcgtcatctagtggctgtgctttgtaatcactacaggtcctcctgtaaatctttctcaaccaagtcttttatgtatacaaaaatgattaaatgctgtgtgtgtgcactcaattaaaggagcagttatactttataactgagtagttcatcagatattaagacgttaggttatatgattctatttgcaactgactaaaacgctacccttattctaaactcaatactggaacccagcgtttcctttttgtctgtttggtgacagtttaatagagctatagcccggtgacagaggagcactgtattctccctgggctgcaaaatgcaggatcactagtcaaatttaggaatagggcctgaaacacctgtaaatgggcaaaacgctatcaaaatgcatggggttctgattatacagtgatgagtacaaaccatcatcagagaatactactccttcatcctatctgtaatcctggaggaagtacttgtcaagcacaaacaattgttttaaaaaatgatatgaaaaccgtatgtctaagtcgtttcactcttttacacagaatgttcttttaagatgatcatgactgagaatgaacttataaggaaaaagggctatctctgagaattagggtgttaacgctttgaagagggaatgggtgagggcagtggtgggcaagggtctccaaattcgaggtgtcctcgcttgtgaagtcctaggcatgctgtgattaggcactgtgcgcgcaaaatcacctgaggtaacagactccgcgatgttcagattgttgagcgagagccctaaggactggcgcgaggaggaggaggaggtgctgctcgcggactcggacgggggccgagcaggcttccccacgttccccgtctccgccttcagccggtcattttcagccttcagtatttcaatctcgttctgttgtgaaatt

SEQ ID NO: 49559 - DNA, 826 bp, Bovine  19866880775904
ttgctgccttatttcaagtcccagtggccattcctgaacataccttctgttccgctgtcatggttagactttgcagtcggccagtcatattccctaaactcttttcaaaagctgctacgaggtgagcctgtgaacaaaatgaaaggaacatatcttaaatgtcagaaccttatgtggatggatgaaaacccctcactttaccaaagtgcttaatttcaggtattcttattctttaagtactgtgactatcatggctggctttcagtgctgactttcctttaacacaaatcttcatctgttatttccaaacttcagcttaaaaatcagtgtttcagtcctgacatgtaatgtgagttcaactactgaaagggaatgatattttgcaaataataacaccttctaacttgcacatcatagagcatttgacacccgccagaaagttctgagttgccaagtttttagactcaaagcccaagaggaactcactgccaacagtcaatggaaaaacgttcctcacattttatacctgcacgatgacctttgaagatattgttagctcctctgttgaactgatgcttcctccaagtgtcagacatctgctgacagctctaacattatctttccttttttcctacttacagagaattcaatcgaaaagagttgtcttcaccctccaaactcttttcaataaaaagggcttttatttttactttattccctcccactaaggaactgtaggtaggccaatgagagataatactcgggcatattttatttaagtttttgtggctctggggttttcttttaaatctcagagaattataca

SEQ ID NO: 49560 - DNA, 2443 bp, Bovine  19866880776494
attctattttataataatataccaaaatactttgaacattttgaaagttaaaaaaaggagcattcagatttaaatatggcttgttatcaactggtcctggtttacctcaccacactgtttcccataaatgatagttttcaaaatgcctcaatcatcagttttatgactcaacagaaacttggaatgctgttacagggattgtagaggcactgtccattctctggtgtatatattgtaccgtatgtaaggtgagagtgctgctttgtggactactgtaagatttagggacgcttcagttcaccagccagattcttgaaacacctaatttatgcataagcatgtatatatgtgtacacctcaatatgtgagcatgtatacatagaaaacaacatattgtttatttaatcgtatcacttgatctatgcacttaattactttacctcataaaaatccccaagattaacctgaagttatcatatcattataggtttatataataattaaggaaataaagcaaaaagtcatggcagaatacataaatctccagtaaagggacataataagtaaagtatatttgcattgcattgaaaaaaaaaagagttcattttttgtcttatagtaatttcagagtaattttttaaaaatacttaattagataactgttttaaaaaaccatgagtaatacaacatttacattaaaccggtagtttaaaaaaaagcaattttgctaaattctctgtatcaagtctaccaaatctatattgaatgcaagtgaaagaaaacacctccacaccagaagctacttcattagaatctaggaaaacagaaaacaaatctcttttggagatgtgcaagttccatgtaagaatcacatgggagaaatataaagagacgggagcatgccctatgctgctgtggcatgtttcttagcaacacagaaaaacatctctctgctaagaaactctgtcaagtaatatgtgttcagggatcataattcagaaagtgaattccaaatagaaccaggaatatttacattcatgataacactaaactgttaagctgttttcatatttatcatgtcaattttataaaacaattattaagataaactacttcagtcataaaaaatatgtccaaatgaaccacagcattttttcccataggatccctgctttccactgaataggtatttgatttttctttaaagcatacatttgtctagagtagtcttataggctccacaagcaaactgctaaatgctagtgtcagaatatattattcattgtcagtttctgaatggcaggtcatcaagggaagaaacttggactccccaaagaaatgcttctctacaaacaatgctgtcttcatttcactgtttgttctgtgaaatttgtccctactacattccatttcaacagaatggtggatggcattgctttatattttaaaatttctatttagccttctctgcaagtgataattaatctatggccatgttcactgatattttaatccatttggtgaaaggagcacactattttttggtttgtattattattaagatgatattagatgtatcatttgaagtgtggtttgtgattctctactgattttcctttattagataagtcacaaaactccaaataagctatttttaccatcccaaacatgtgagaagctactgtgctttcaaaattatgtttttaaataagaagtgaaatttctttaattgtgaataagtctttactatctattacaaattctagagattccccaattgattcatataactcatcatttaagacttaagtagaaagtacatttttcatctagaagcattcagggagcacattacagatagtatgattattttttctagcaaaatatttattaaacataaatgttatactttctaataactaaaaagaaaaggcaattagaatactcaagtcagtactttctgaattctgtcattgtaatactgtaatctttgaaaatcttgtttaactttaaccttatttggacatgcccaggatatgtatgcaaactagttggtcacagagatcaacttattatctgatagaatatttttagatgttatcctaccacaaaacatctccatgtcaaaaaggttaaataattcttatccaaaaagatgtaccaaggaacagtctaaaggataaattatgaactgtttcatatgcgatgtttatatttgcttggtttgctctatagtttaagataatattttgaccatatggcttccccggtagcactagtgttaaagaacctgcctgccaatacagaaaacctaagagacacaggttcaatccctggattaggaagattccttggaggaagacatggcaacccactccagtgctcttgcctagagaatcccatctcttgcctggcaaaactcctggtgggctacagtccagag

SEQ ID NO: 49561 - DNA, 1047 bp, Bovine  19866880794929
cctcccgaagatgtgccatttttctgtgctttctaaaactgtcaaatcatttattcacgatttgcttttgaacaagatttctttatccatctctaccactgaatctgcagatctctcaaaatccaagcaaagtggcttccttttattttctaacacccggaaacactagctgcctttctccccagctgctttcctgcccatgtcccttttatgagaacaaacgttgccattgtcctaaaaggctgggaaacttgagacagctgctcttgttccagaaggtggtttttcttttcagtgagatatccgtcatattttagccaggtgttcaacagccacagaagcttgacggtgaatcttccctttgccctcttcaaatgctcatggtcggcttcattcggtcgcctcccctcgaggtcaacgcttaagcagcagatggggggcttgtatgaagcagctggttccattctactccagccccgccttctctccagggaccctgagcggaagcctgtgtgcccgtcggcgtgtaggaacgttcaggactttcagttgccattcagcgctttctgcttctcacagccaaaaagctgggcagcttggcgtcctctgcagccacgagctccagatgtccggctgtgatacagtttcctttccgcgctccctgctgggcgctgtattcatttacaatcgcgaataaaagacttatccagaggccctattttgtccttatggtttgccgttgtagtcatgtgtgggagaagcagtctgggagccggggcaaccagtcaaagtctaaaattgttttccgtttcccttggaggggatgagatgggtgccccgtgtggctcggggccgtgtattttctgggcctggctttttccatgcatcatcgcctccatcgatgtctctttttctttcttcagatgaatatgctaatgaaactccaagaagcagccaattactcgggcacacaaagctgcgacagtgatagcaccagccatcatgaagacattttggattcgtctcttgaatctaccctctagaggg

SEQ ID NO: 49562 - DNA, 1424 bp, Bovine  19866880796291
cttaaaccgatttctacaacagtttaacagttggtttaaatcctgaaccattggtaatttccaccatcttcacttataacaccagttaacacagtagcctcatctctatttttgtgtttgtttttgaagaaatggataggagaaagatcagtatttttaccttgagaatagattgctttgcctatcctccaaaagactcaagtaacccagaaaccctctttgactgtcatttaaaagctaagccatgtggctatcttccatccagttctaggggaaagagtttcagaaggcgggagagggtgaatttttatccagcagagctggaagcactacatgcagcatgagcacaactattcggcttttctctcctattttttttttttaattattatgagttttgagcatgttgttttgatgggtattattgtacatgagaaattcagcattcgagaacactgaagcagtgaagtcactgtggatgagaaggcatttatactgtaaaagaaggttagatttgcacagtctactgggtaggtattgtaaataatcatttaaaaaacttgcacaactcaaaacaaacacacacacaaattgtattttatcctgtgggtgttaagagatgtttcacttgctgagatttcctgtacgttgcaaacaaatacagaatgcagaccctcaatgctgttgttacctggtgtgtttgtcctgtatttacagtcgtgatgaccatgcaggagctatcagtgctagagtgagcatgcttcaaaactgtccatgaagccaatacatttttggaaaagtaaaaatgtctgaaagtgcatctgtcatggcaggctttcaagagagtatatgagagctgacgggagtgactggagaagttcccaccacgcacagaggacaggtttgaaattcatcaccccaagggctaggccacggtgtagacttggtccatgcgtgtgaaaatttgctacttcaggacgtccaattggtgctaccctctgtgacggcccacgggtcagctgctgtagaacaaccaccgcacgagacaccggcgcagctgccagagtcgctcagtctgcaggccctccacggtgctatcgccctaagggaagtcgggactggacatgtgcacataggaagggcaccctgactgtgaagcctcaaacgtggatcacgtctgcagggaaacgtcgacgtacgtagctggatgagtgactggtggcccttgtacaatatgtgatctaagaaaattgctaatctttccctgccgttttgagaaccacagtccaaacatgatcattaaacagaaattcctgcaatacatcccagtaggtccgcctagttcacaacttaaactagtttgtgaaacatttgtctgtatacattttatattttgtacatttttgatgtaacataccgtgtaa

SEQ ID NO: 49563 - DNA, 835 bp, Bovine  19866880837345
ttgctcccaataccccactacttcccccatattgattgctatgttttaatgtaaagatccaaaatttccatatttcttctctggtttgttttgctcaatggcagatatgaatctattacctaatctctctagacccaacttcaccaaatcaagaagagagaagagttcgactgtaggagccaattcctaaggtcagtttgatactgaaggctcctgttcttaaattctgagattctgaataatagcaattatcaaaggcagtgtgactgaggaaaagcagctttgctctaattaataaaaatagatgcctatcagactgcatgaaaaaatggcaagatttctgaatatacctttgggagggtggtcaggaccattcagtgctccctgaatggctgcctgggcagcagagttctgggccttcagcatttcaatggtttctcttagttctatcagttcagactcctgtgaaacaaacagaatttagaagctttaatactttagagagaagaacaaaccacttttattcacagctccctatctaatgagcttggttttatgtagcactactgtcctgggagatctggatgcttggctgaccttctaagctgtatcctacaatcttttacttgtaaatgtaagaagctaaatctgatagagaatttaaaataatgttttggttactctcttacaaatgtgatctgaatagtctttatttctctaaaagggtaccccaaactgagagcttccagggtaaagaatcctggaatcttgccaatgcagaagacacaggagatgcaggctcgatccttgggtcaggaaggcccttggaggagga

SEQ ID NO: 49564 - DNA, 1827 bp, Bovine  19866880907198
tcactcctttcaatcagtaggtcatcatgtttgaagtgcaatgtccttgagatgcccatgctggtgaggatatatgctgtcactattgcaattaagctgctggacaagtgagtgaaaaagtcaccttggaagtgattcttcagtcaaagacgttttgcctcctaccagtctgtggcatgccagccattccaccctttcccgtgaaagtcccagacacagtggagtagaaagattttcttgctgctcccagtctgactcctaagcttacattatccatgagtataagaaaatcattatcactttgggccaaaatattttatgtagcaagagatacctagaacacatttctactttcacttcctcctaggccaaaaagtggcagcttcctgaatgtgccatggcatccttcaccagtgcctttgtttggtactctgttgtagtagtctgcacacctcaccaaaccatctgtttaaacatctaggttctctattagttggtgggtgatgtgaaagattaaagcatcggcagatctcagctgcacatctagcataattcgtggtgcatagagggggctgaatctttatttgctgaaaggtcacacatgagctttcaaatcaccaataaaaaagcacattgtgctctaaggtaatatacgaaagatcattagaacagtattgtttttcattaagccatatggtatttttggactgtgcccaaatgcatagtgactagctcaccaaaacataaaaaataagacataaaaacagtaatttttaaaatagatgtacttaacataaataaccgaatagactatgttaaccagagcaattttcatatcatgtaggtttttacaactcatctatattaagaaaccttatacaaaactatcttagaatcaaccatctttcctccttttagtctatataactttaggcttggagtcacacaaatattataagagtggaaatccctatacaaaatccctctcagtcagatctttagtattctattcccaaagaaagggaaatgatgcttaatcataagatcacatttttctcttaacaacactattcccaaggagccaaagagggatacaaagaaacaaattttataacaagaggtgagacatttcttgggcataaattttggtggaattttttacctccaaattttacctttcttttataagacagttttaagtgaagaagataggaattatttcctttcaaatttactaaataaggcttgagagaaatcaggtataaattacccaagatgtactataattaacacattgcaagaaagttttaaactaggatttttatacaaaataacactgaagacaatagggcacattccctaaaattttttaagaccgaggtagcttgaaatatatttccttatatatcctatgatatagaaatatagaaaaatatagaaatataaaaatatagaaatgaaaccagatcttcagaataaatattatttaaaccaaattcttcctttagtagatatagtttcccttctgtaggatcattgtgcaatgttataaaatgataactgacaaggtaatagctctaaaaaagaagaaagtgttcagacacttctgcaaaatatcttttgtaccttattcaaaaatatttaagacattttgtaacaactactcacttcagagcattttttaaaatatattgtccctacacataaattttgctgagacgtcactaaaaacagttattgcctaatccataaatgagtcagaaacttagccttcatccacatgtgtttctttttagcagctgggtggctgaaatatcatcctgatta

SEQ ID NO: 49565 - DNA, 1032 bp, Bovine  19866881038611
atacctacaagcacccaggcattcttaagcaggctatgaccggacttctagactttctactatgtcttgtgaatatggttctctaggaactgacagatacacatgatttgtatcacaaatgatgtacagagtgactccatttactgtggctgcacttcattatccgatgccatctatagggtataaaaatctagattaacactgaccatggagtacttaatttttcctagaaaaaaaaaagtcacaaaatgagattaggatatagattttctgacttggaattcaatggttttacattatactcctcctttataagtgtcccattaaacaggcttaaatatgttggttaaaaactaaagccaataaactataaagatgttcaccacagtgcttactctctcttctgttttctctatttggtcaagatctttcttgggggagaactatcccaaggtgaaattcacagcacttatcatttctttgctcaggattcccattttgatctttccaggctccacctatcttctaggctctagcattcgatttccaactgcttggtatattttatctcttcctctgaaaaaatccatatatttaaattgcactatataactaaaccatcctcaaaggacttgaaaagcagaaagaaaaaagaaaatttggtcgaaagtacgtagtacattacatctaaaggggggaaaaattccaagcatgaagcagaactttgtactggaggacacaaaccctcaggtttctgtcctcctcctgtgaccactaagcagcacgctcattattcatctgtcttttcggggagctccacctgtgaaagtggctcttctcaaattaaatatttttatttagcataagcttacgttcagctgctgtctccatgttcagaaatatttttatttagtaaatatttattgagcatgcactatattctaggccctaaaactgaacataagtgagatcacagtgtatatatatatatgatatgtgtgctcagtcatgtctgactctttgcaagcccat

SEQ ID NO: 49566 - DNA, 1949 bp, Bovine  19866881098434
cagagtttgtcttggcattggcttaatatgtttataaaagcatgaaagttagggactcaaaaagaaatggcctcatcctataggtagaaatgtgtctccgtacttcatgtttattcactgaaaatagtagcggctgtcagccaccctcattcctaaaacctaaaaagaaacacatggctttctttgacatagcatcttatctaactaaatacaggtgatgtttatgatgtatggtaccgtgttgctagaactgtcaagatggtctttccacaaagaggagactataagctatgtggccattctagacactggaaagatagatatattttattagactcattataacaatgtccattaatactacttttgtgtatcatttttaagcaaggccctagctgaaaaggcaaatatttaatttttctggaatcaaatattgccttcaaattggcagtgtcatcctgatcctagactcttcttgaaacaaaaaatatttttttttcaagttgaaattgtatttcagtggccaaaaatacaaatttgtaggtatccaattttttcgtatcaaacggaagagcaaagaactttagaattttaagataattgcagtatttaagtttgaaaagtgagctagcaattgtgaatttttacattgagcatatattctaagaattataatgccataagctttctgcttgagctgcagatctgtgcctgaatttcccatgtgggtctttttgtaaaagactataatagtctcagtgaagcttgaacgatctctgatttaaaagcagcagcttaaaagcactgtaagcatgtccattttgactcagttacattaacaccagaaaacaagttttctttttcaaaataattctgaaagacaatatttctgaatgttaagaagaagatatcttggtcttcttgagttaccataacaaaatactgcagattggatggcttaaacaatggaaatttgttttctcctggttattaagtccaagatcaaggtgctatctggtttggttcctgaaaagggctctctctttgggttgcaaatggcaccttcttggctatgttctcacaggcctttcctcaatgtgtgtacttgggggagagagagatctctctcttacttcccctacttagataaggctgctgctgctgctgctaagtcgcttcagtcgtgtccgactctgtgcgaccccacagacggcagcccatcaggttccaccgtccctgggattctccaggcaagaacactggagcgggttgccatttccttctccgatgcatgaaagtcaaagtgaagtcgctcagtcgtgtccgactcttcgcgaccccatggacttcagcctaccaggctcctccgtccatgggattttccaggcaagagtactggagtggggtgccattgccttctccacttgtgatggcaggtggattctttaccactgagccacgtgggaagcgctgcatgatcgtagtctcaaccggaaaaccaggcagcacgtactgtctggcagtcctgtagtctgagtaagtttgttctgtgctgcagaatgagtagttcacatcagtcccttaagcctccaaaacctcctcatcccacccttgctctcagtcgatgaacttgccttgccattcattgactaaagtaggacctactaagtaggaccttgctaagacacgtctccccactatctggatctactccatgcctccttacttttaaatgaagttctcagctcctttcaaaggcagtcctgccatctgtgtctttcccctttccagggcttcgctcctacaattaaagtctcctctcatgcataatcaatttcttcttttaaataattcccttcaacatacaaatgtgctctgtattaatcccctctgtatttgttttctacttactgctataacaagcttccacagactgacatcttcaacaa

SEQ ID NO: 49567 - DNA, 897 bp, Bovine  19866881426533
cacggtaaatcctttataagtatttaccatgaatctgagacttggaacttattttaatggaacatatttactatatggcaccattttcaaaacataagactttaataatactattattataccgtaaaacttttataacagtcagctttcaagtgatttcaaatatttgagatcaaggcataaccttgaaagcatttttgagatcaaggcataaccttgaaagcatttctattcttgaaaggtgctcaaaacacagtgtttttgtttttgttttttacaaattatcttcacccagatgcttgaacatacagctagctacttagagagagtaacaaaagaaaggaaaaaggaatatgaatgtgcatgaaggtgggagtgtatgtgtgtgttcaaaagagagacagagaaggggggagagaaagaaacactatgttgatggagacatttagctttttgactcactgagttttaagaggttatcatcagctacttttatatgtttatgtagcttgtttaataaattcaggggattagacagaaacttacgttgaaaaatattgtcctaaagaatattaaaatgactttaaaatatgctataactatagcttctttgtcaggaaggcattcttgatagaactggtaattaccagtgtgtcactttatttcacaaacatttttttaattgaacacacattttacactgaatgtatcagcaagcagagcttaacatatgactaaggaatcctttttgatttagcctttctattggatcagtttccctaaattttaagttgggggaaaaaaagaacatctttgattacataataaatagtaaagttagcatgcattaaacaatacaaagattattaccataacagaaactcttataagaaaaca

SEQ ID NO: 49568 - DNA, 1101 bp, Bovine  19866881803206
tctagggaagatgcagctccttgcctcttccgctccttgtggcatctggcattcctacacttatgactgcaccactccagtctctactgatgtgctcacatcatcttttctgctgcctgtctcaaacctccctctgtctttctctgatacagagccttgtcagtggatttagggttcccctaataatcgaggatgatctcattccagattcttaatcacatctgccaaagtcattttcttcaaataaggtaacatcaaatgggtctaagcatttaatgtggaggcttatcttttgtggggaagggggagaggtacatgtctaccaactacaccttgaatgaatattctccacaaacagagtcactgaagagctgaaacagtctgttttcctgttgataattgtctcttcttcagatgacgatgagctcagacttcttttcttatgatcagggggcaagggtagagaacggaatagagaggtgcactttgcccagacgggccttttctccagctgactttgctcacagccagttccagctctgtgaaaaaaattctaaggatgcatacctaatattattaagatattccaaacagatacttattccccacagaaaaatatttttttaaaaattttccattaccaacagcaattttctttggacaagttgaagtttacaccaaggctttacactttcaagttaccagagatcaattgagggtctctgatagtcataaataatcctaggcttgagtaaacaaaaagaaaaatgtccagcacacagctggagtaaatcatgcccttgaacatctggctcgatgggatattaaaatgttattgtctgtctttctgcaataggcatattttataatcaccagggatgttagaagctcaatttcccaacaatagaagtgaaggacgaatttttgctgaccaaacaaagggttgcttttttttattcaatactcctcactttccttcttaaagcatatgacccagggctccagaaggagttatgaatactaaagaattacaattagacccacaaattgagttttctaaaatcaaattataaataattgaactgactttataaaagtcat

SEQ ID NO: 49569 - DNA, 1857 bp, Bovine  19866880165982
aaacaggatcttgttatctgccttctgaattatttctatacaatatcctttgatgcctactaggtactgagtgccttgcatgcattgtcttatttattccttatgaggaaggaccattattactcctgctttaataagaactttgaggtttcaagagatttagtaagttgtcaaatatcccacagctgataaatggcaaattcagtgttcgagtccaggacagtctgatttgatgactcacaattcagtttagccaacgtttcccattttctaatccctgatgactggcggtagcataactaataaataacatgtcctccaaatagggtcggagaaggcaatggcaccccactccagtactcttgcctggaaaatcccatggacggaggagcctggaaggctgcagtccatggggtcgctgagggtcagacatgactgagcgacttcactttcacttttcactttcatgcattggagaaggaaatggcaacccactccagtgttcttgcctggagaatcccagggacgggggagcctggtgggctgccctctatggggtcacacagagttggacacgactgaagcgacttagcagcagcagcagcaacagccatctatttaacctacaaagtcttggcaaataaaaagaagcactaggaatcactgtgaaataaaactaaccaaagatcacttatcttcaagaaaccctacttctttcaacttctaaatatgcaagacaacatgaatgaattctgtaagaccatattctctggtaattccaaattgaaaacataaatttcttatcccagtgcctgatattgaaagtaatatttctacagcttatggaaatgcaaacactgaattaaaagctaacattgggaggaaatgaaatacaataaatagagaactcggcattttcatttctacattttgttgttcagtgtgtgttggaatcccctggtaacaactgatgaaatatttaacatgtttatttgtagggaatgtttttcatttctgttcggtaacatttaaaaaaaaaaaaacactactgaaggtcttccatgaatcattaccttgggatttagtttttcatctgctcttaccatttattgtttatttctttattaaataagatgtgtgtctgacccctgaagccctgtcagaacaggccttgaataaatgtctttgcatgattggatttttttttttggtacgtgactcattgatattctagaagataaacctgttcattattagccttgtttgtttttaatttagaagggttaaattacattttattaaacttcattagcttttcaaataagcaagatgaatgtggcttgcgttctgcatagtcactttatctcattgctgctagagtaataagttgagatgaattttctctttgcagttgataatacttctttagaaatcgtgtcagatcacagtcatgattgacgaattgcttggatttgctcctgtttgcctgttgctgctttaatttgttggtaatgtttaaatctgccacctcacatctctatccgacagtttcccttgcttcaggctattgtgactaatgaaaaaatgatctcaaactaaatcattttttaaaattcaagtgaagcttaggtgcttttcttgtttgtaaccactgtacatctgctgaatactgatagagatactcaaccctgtgcatgaaacataacctcactctgactgacacattggtggctccaatacttgaaggctgtgtggatattattcctagcgagtcctgtgccagttaggttagcagatttctcaatccttttagagtttgtcatcagggaaaatgacaactactttttacattgagga

SEQ ID NO: 49570 - DNA, 1489 bp, Bovine  19866880368514
acgacagaggatgagatggttcgatggcatcaccaactcaatggacatgagtttgagcaagttctgggagttggtgatggacaaggaaacccggcatgctgcagtccatggggttgcaaagagtccaacacgactaagcaactgaactgaactgtagccttaaggatagttgcattgtcctcacattgcactaaatagatattaaaatctttaaaagataaaataagagagtagctcaccacttctctccttttcacaaatcttcccaagggccaaatactgacacagaaataaatggctatggcattatttacagagagatacaggctaaatgtaatccagtacatggatttggatataattaaatatgatatgtggcaggaaaatgtatagatataaccacacaattaagtcaattcagtttaaaaacaggaaagctgcatttaaatcaaccaaaagcattaaaatttgttttaagaaataattactattcgtgacagggtttttaagaaatcacaatctctaaatatgtttatgtgtttcgttatttttatttggtctcttttttttctagttttaactttttaatggaagtattccaatataaaatgatactattttgagtgactattattttaaagtttcagaaactttatctctagctaacatgtgtaagacaaatgtaattattttgccagtggacaacgtaacctgattgacttgaagtggaaatattgatttctatggaatacttcccaataacattgtgatctgggaactctaattacaaaactctcaatccacttacaaatatatttggagattggtctcttccaaattattgcctctggtaaacattctattttttcacattgacataaatatcacttaaaataattcacttttatatgaaaattcttgtgtcaatattaaacctattcgtaagtggtaaatagcaaatacgttattttctttcaaaatgaaaatgataaaccaaatccaaatgtttcatttatgattcatttcttttaaaaattaagatgaaagaccgtactcatttttgctgacagattttatcaattttactgatagatgaatctttttcattaggcgtaggaacagaggagtaagtttgaattggtattgtagcatcaaagtacagagtaagtggcagtagaaatgtggagagaaaacaacttagttttggtgattgagaagaaatcttgtgagagcattttcaattcagatggataaggactaaagtgagccacaagctaggctgttgtccatgaattgtctgtagggaaatgcacagcttcctgctctgttacaaaataagaaaaaagaaaatatctaaatctgctcagaaatcaaattgaaggacactggaggaattattataaagtaccaaacatttgcatctagtctgtcaggtaagagaaatctaaataatttagttcagagaaggaaataattaaaagtataatga

SEQ ID NO: 49571 - DNA, 1763 bp, Bovine  19866880468307
tgtgcccatttgcttgagatagtgccagcatataattattaatacatcatttcactctcaaaactgtccatttagatgagctatatagtcatgctaattatgaggtctcataattcccacatctggaggatatgggaaatattaatgttaacattaacaccttggagaaaatgtcctggctccctatgaatccttcattcatgattggcctcagtcttcttcatcactcatgctcatttcttttctcaccattccccttcctcagcttcaagcaagctaatcctcaggctttcccttcctttccaaagcaacagtcacctatcatcccaaaatgttctcattgctgtgcttgaatttttacattttgccttcaatgcccagatttgcctcctcccggctcctcccttatgttggagtatgaatcgggccaacatcatcctaccatctgtcttaccgcctgtccatggtagagtctgtacctgcttatttaataacttatgttgctaaatgcagccatagagaagcacatttccataatggatgttacttcaggattatatacaatacctgtgagacacgtgtcacctacaccctcccccaagttatttttagtcccatagagcctatgtctgcaacctctaaatggattttttttaatgcagtcaaaattgcaattgaatccatgttagggtctgtgccaagtggtcattgagatttttttcattgcttatgactatacacatcctaacaccaccattctcgatcctgccagcctagcagatcttgacttcctaggctaattactgctgcttttcctttatggaaaaagaatttttattcagagtttcattttcccctaatttacccaaggctggcttattaaaatctttgaatttagattctatgaggtgtttactcttgaagctgggactatactgcataaccagaacattccgatgtgaattctagagaatcctcccagagtatggcataccaaattccaagaaataaatagaaggtttaaaactgtctaagggggatggacagttcttgacatgcaccactgtccctcaagactgcataaaatagatatgcagagaaataccttttctgcccctctcctttcaactgttaacttccctggtctcctgttacatatagtatttacttatttgcataaaaatacatcttcaagccttacctcagagtggcaaccagccatcccagttttacaagataatgtatttttccacttgatatttccccaattacattgaattgcagcatatccgcttttttttttaagctaatcaatttcatgttaatatgtttcctacatttttgaaatactcactggataaagcttgaactattttgtattttgcaacaatgtccccgagacacttagggttaagtcccttgatgatgaatatattcattgactatgttgctcaactcattattttagagaggatcaataactcccttgataaaaataaagtggcattcttacaaagtcaagattgcatgagggttttggaaatcccaaatgatattaatgtttacagggacttttttttgtgtatatctttaagtaagctttttgtttttgaccaccagacagaattttgtgccattgtgatggaatcctattaactaatgtgaaataatgtgtcatgtcatttaaaaggttaatgaaaatgtaaagtggaagctttaatactgtctcaatacaaataaaactgtttttgagagaaactcat

SEQ ID NO: 49572 - DNA, 1549 bp, Bovine  19866880492362
aatactgaagggggttgccattctcttctctaggggatcttccctacccaggcatcgaattcaggtcttgtgtgttgggatttgagtcctatgcttttccctgtgtgtatcgttgtgactagaaagatcattttctcaccaaccagacctgggatatggatctttcctgagggcagagcttaaccacgtggacaggattgggaaagaggatttcctgtcaaagggctggagaaatgaaaatgagacccatggtaaaaattcatgcattgggtttcactggactcactattctgaagacactgacccagaacagcacatgttacaaatgatgggtgatggttagcccgagtttacattctggctcagtggtatgtgaccttggtaagttacttaacttgcctgtactccagtttctttatttatggagattatgtgaagattaagtaagataatatgtataaaagttcagccatattacactctcaatgttgtttttaccccacccctagacttaaccagaaatttgaggaaatcctaaatataaaatgatgctttatttttgtctatccaactttcttctggcttgaactgcctttccagactggaaagtaagttaatatccttaggctcatgggtatgggcttccctgatagctcagttggtagagagtctgcctgcaatgcaggagaccctggtttgattccagggtcaggaaaatcggctggagaagggatacgctaccctctccagtattcttgggcttctcttgtggctcagcttgtaaagactccgcctgcaattcgggagatgtgggttcaatctctggtttgggaagatcccctggagaagggaaaggctcatggggcagtcaatgcaaggaaaagtcagcttccagggaggaggaaatccttacagttcttcagtttcatccaattcatttcaatcaaagaaccaaatggggtattctaaaaaagtccaatctgacttaaggttcaaagccaggggtgcagaaatgtgtggctgacagtaatgaagttgtcctgcaccccaggtctaagtaaaattccaagtccattgaggaaagaaggatagaagggagatctttaatgtttttatagctggtgtttcagaagcccatttgtacagcctgaagattgtaattggtctttaccctggaagagttgaggtcattgtttcctgttgttgagccctgctatcaattctgtgcacacagtgttctactgagctggccagttttgtaatacatggtgattgcaggcagtgtcccagcatgtggctattgataaaaggtaattgatttcattgatttaccttccagaagagctgtcctttctgtgaacttggcctccaaacaaattctgttttatgtttgggccatttcctgtctttggtgtcatgaaagataactttccagggttatagcatctctctccttgaaaggagatgggtctggaaggccgcagtgagaggtgtcccttccaaacagctgtcatctattaccatctttcttcacccacacagccttctg

SEQ ID NO: 49573 - DNA, 1148 bp, Bovine  19866880543652
ataaaattgagacctattaggggaaaaaatctactgatttgaaaataagttactctaagtaaatttgtattctattcactttagcctttaggttaagattatgccccaaactgtctcaatttctgttaaaactcagcagacattgacactgtagcttttagctgatcccatggaattagaatttgggtgatctagatacagaatgcagaaaggtcaaagcagacataattgaggtgtactaggaatgacaggtctagatatttgagtagacgaaagacgaagaatcctaaaaggattttactatatcgtcctaaaattaaaaaaaaaaaaaagaatttcacccagcctaagaatagcctgacatgggtcaataaatgacctgcttaactttggtataagactttctatctaatttcaggaagaaaattggaaactgtatcctacttctcaaatgtgcccagataggcctattaagtatctcaaagggagataatgctcaagaagcaattaataccagggtttcccaacttggacactattgacacggtggtccacgtaattctttgctgtaggaggatgtcttgtgtgtggcagtgtgtttagtagcatctctgtctctatacactacatacgagtagtacctctttttctttagctgtgacaccaaagtgtatctccagacattgccaaatgtcacctgtggggcaaaatcattcttgagaaccactgtcgtatgcagtcaagtgtcttccatcactactgtcacaatcttctaaatagcactgttctattcaataaagaaggcttaaattttaagaaaatacattttctactatgagatgcatgtaagttgcccatcacaacttttttcctgaaataatctcaatttttcaaaatattctgtgcagtataatttagatgaatcatttaatctatctaggcatctgcttcttcatccataaaattaaaaagtggaactaatttggcttttcccaaacccaccttagttatttggaatcttcatcacaaaatgtagattcctgggccccatgtcaaatatattgtaacagagtatccagggaagaagcctgagaatctatattttgaaaacaagttcctcaggagaatctgtcatcagacaagtttag

SEQ ID NO: 49574 - DNA, 849 bp, Bovine  19866880628320
ttgagagaaacaggaaatgattaggtaaacaagatgatttccgattgtgaggaaagatttctaaggatccctggtgttaatagtaaatgataactggacataacttttagattggtctggggtctatgcctctatgaagagtgatatttgaattagggtatgaataatgaggacctggttgtgtaggaggtctaggaagaatttctagcagagataacagcacaggggaagccctgaggaaagaagggatttggcatatttgagaaacagatgaagtctgtgtgttgggaggatggtgaatgaagattagaccaggagggtgtgaccctggagagcagggatttcaatgagaagaccacacaggacctcctagatcatgggaagggactaagattgatccagtgttagaagcaatacaagttgaggagttccttcaggttttttttcacctgtgaactcattttattcaattgtcaccccctcattctttcactattacttacagatctgacctttgtcatgaatgagagactgaaggagtagagttttctctcagagaagcaaaacaagccctggctgggggtgttccttgattttgctttgacccttattaatctttctccctccccaatgtcttctttgttttcaggcatacttacccctcaccttctggatcactttgttggacgccttttatcagagcctggtctgcttcttcgtgccttactatgtgagtccttgttcactcaaaggatttgttgttaatgaataaatggtgcctctttgttctctgtcactggtgtcagcatttagagtaggtatacgagggtagattgctcatggaattaa

SEQ ID NO: 49575 - DNA, 914 bp, Bovine  19866880639493
ctgaaatagcttgtttaacaaggactggatttttcctctcaatcacagttctaaagctatcagttattgaaaagctgattttcaaagcacacacaagaacagcttttctgtacagctgcaatgctatttaaatcttccatgaatatatccacaaatccaagaaaattctaagctaaaatattgctcttagagagggacatagtaaaataagaccctagggaagaataatccaggaagtgaaatttggtttttaattttaatgctgaaattataaaatcagccatatggcttcaactccttagagctaaaagaacacctgaaatcactatttagtatagtcagcctagaaggtttttcctgtgagactctttggtggacattagctgtctatttcatagtcattctttaataggtttcagaaatgtgaataaatgcacataaccttctgctgtgatgaggtagggagcgaatatagaattagcaggaaaggccacgttctggagatactggatagattaatgaaaagcaagatcatccttggaaagaacagactctggaatccaggtttctgttccacagtccttctctccagcaccactgtggacaaattcccaggagccccttggtgatcctggcagcatcgatgtcaggctttaatctcatgtcaccggtgtatcattctcctgcagtgatcaagcagtccactgcaacggtgttggctgcccctgcagcattctataatgttgataactctttgaatgtcatcaaggtggaaactacgactttagccagctatattgcaatctgaatttccttcatttaagacattcagtttcatcaaattacctaccaaatgaaattatattgagcatgagtcactatcataaatattttggagccatttacttggaagt

SEQ ID NO: 49576 - DNA, 2273 bp, Bovine  19866880688506
tgtttctataaaagtaatgtgcctgctttgaataatcagaaaggtagagggagctgaagacagtctgtgatgaagtcagccatgaaaaggatgttgctggcaaaaattagaataaatacaaggaaatataaaatgcaataatgaaattaaaacagattttagacataataaaggtaagaattaattctagagtaaatcctatggtataagacaaatataaaaagctcatctgggaaaacagcaacagcagcaataatggttaatttttaccgagtggttcttctgcacctgacacttacctaacatgcttttaattaaccaactaccacaaccaatcctgggcttccctggtggctcagacagtaaagaatctgactgtaatgcaggagacctgggttcgacccctgagtcaggaagatcccctggagaagggaataacaactcactccagtattcttgcctgggaaatcccatggacagaggaccctggtggcctacagtccatggggtcacagagttggacacgactgagtgactcacacagccaatcctaaaggaaatcaaccctgaatattaattggaaggactgatgtggaagatgaaactccaatactttagccacctgatgcaaagagccagctcattggaaaagatcctcatgctgggaaagattgaaggcaggaggaaaagggagcgacagaggatgagttggttgaatggcatcaccgatttgatggacatgagtttgagcaaactctgggagatggtgagggacagggaagcctggcatgctataatccttggggttgcagagtcgaaaatgacttactgactgaacaacaaccacaaacacaaccatatgccaaagctatatgtaagaaaaacaatagccacaagtatttcaatgtccagaaaagatgtgaattatattttttaaaaagcgtctcatgtattaacatatcagttcactgatctctttctgaaacattccaactaccagtaaagtctagaaactggtaaccagggaaaagactggaggaactgttgtaatccaacctataggatgatattcacccttcactatgctatgaaaagacatacccagaatgttggctcacaattagaactttggcaactcagtttggctggcccactttctcaatataatggaatattaaaaagagttgtatctgtggaaatactggtctggcattatagtatcactctttttatttttttttatttaaatgacagtagccaaaggacttttttccacatttaaattagaagaaatgagacaatgaaagacaccaaactggggatagcagaaggcaacaaatgtcaaaaaaaggtaaagagtgaaacattaaaaagttgtaatcattgctatggactgaattatggcccctcaaaattcatatgttggaagcctaactcctcaaggtcctatactggagataggatctttaaggaagttatattaaatgaggtcataagaatgaagccctgatcagacagaactaatgtccttacgaaagagaaagagacaccagcaaaccctttctctgtgtcatctgaggacacagcaggaagacagtcgtctgcaaacagaaaaagagctctcatcagaaacctgaatggccagaaccttgatcttggattttctagtccttagaaatatgaaaataaatttctgttatttaattcaactgatctatgttatttggctatggcaacctcaggaatctaagataatcatctaactttaatacatttaagacatacatcttaatattttaaaataatgaatgttaactttttctcataggaaaaaaaaaaaacaaaacctaaacagttctctcttctcaggtattttgtttctagtttgttctctcttctccactgagtgagtatcctcttttgataaccccccaaatcctaggttgagttaagctatgtagagaaattgagatgcttttaacaggaattaagcatggatttctttgtaacatttttaattttgtccttaacgaatgaaaacacttccatatatccaccaggggggcatcgacatcatctttctaaactggtcaaagttgcttagatatgaattctccacgatatctcttgagttcctttcagttttccttaatcctaatcagaggacttgagtcaaccaggattttcatttaagcttctaatttggacttagctccaggtccttctttaactactcaatatttttcataaaatatttttattttcctttcaga

SEQ ID NO: 49577 - DNA, 1067 bp, Bovine  19866880817328
aggagcccagaagaagaaggaagattcctttccctctcctcttccccaggtccattgtaggagtccctgctccacagagaaagagggagagataggcaagctggaacccaggttatacaaactcagcctgccatcttcaccccacctttaagccggatattctgaaaaatgcttctttctcagacttccagggagattttaaaaattaacatgagaatccaacatggtagccattgggaacatttttcttctcttgttaagaatgagtttggggggcagtgattaattttgtaaactatttcaaatgagcagccctgaacttatttccttagcctggaatcacttgacctcatgccatgaagctatggcgtcacactgtcctagttcctccttcagagattaagagaaagggggctggggcaggtgagctttgaagaagggaatggtaagaatttttgcttgagaaaaatattgccctttccatgaggaaggcaagacttacatgctgtgaaaagggtgcctgggcagttacctgaactgccaaatctttaatcaaatagtatatatttatttcttagctttccagagagcagtatctaatggtgacaagctagttgcacagcgctagtttctcagctagcacagtatgcctctgctctctgagctctgcattccaacacatgaaatgaatgcgtcaggaaatgcacatatacccactttagtatcatttcccttcaaggccagatttctgttttaaagaaaaccttcaaaacagcaaaaccacagataacaacatcactgagccttcagacatttacaacagcccccaaatgacagcccttctctaccatcattactgcttctgccttatctctgctcatgggttactttgctcatcatagaaggagtattccctcaagagctcaacacacaattctaatcaaatccaaccaactacagttgagattcatctcatttatgtcaataaagcctcattatttttttgcagtgtgtgttcagcctgagtatgtatataagaattctatatattcatttccaagatgaat

SEQ ID NO: 49578 - DNA, 2915 bp, Bovine  19866880864384
aatttctctctttgtgtgtgtgtgtttgtaaacatggcaattaacaaagctctgaaagagccaataacctggaccacagtagactggaaaaaaatagttttcgtttctttttgaagtaaacatggtgcagtaataaaattgatatgcaagaccgaaaaccaattggatggctgaatctcttacctcaaaaagcacagcagtatcgctgctagggacctgtggggttaaaaaccaaaagaagaggaaagaagtcgtttaggaaccatgggacagaccttagtgtacatagtaaagccaataaacgacgttaaaaagagaaaaggtgatggggaagaacattcgggaccacttgtctatggaattcacgtcagtcaagtcggggattttgactttgagctgcgaggcgcgtctgcggatgcgccccttgctgtgcgcgccgtgccggtccagcgcgcgcccgtacccctcgcggctgctcattggcttgcggtactggatgctggcgctgtcgtaggagtacatggtggtcttggggtctcccacgcccgtgagcacttcagagccgctcgtctcgttcctgatctccagggtactgaggagaatgttgccgtgggcgtcgacctgaccgagaaaaaaagcctcaggcacagctgccacgacattcgcttgttttagttaacctgtaactgatgatactgcgtcgggctcattacactgtcttgctagacatctggttctgcatgtcccctgggtatctatctatctaagcttcccaggtggcgctgctgctgctgctgctgctaagtcgcgtcagtcgcgtccgactctgtgcgaccccagagaaggcagcccagcaggctccgccgtccctgggattctccaggcaagaacactggagtgggttaccatttccttctccaatgcacgaaagtgaaaagtaaaagtgaagtcgctcagtcacgtctgactggcgctagtagtatctatttatctatctatctaatcttcccaggtggcacgagtggtaacgaacccccctgctaatgcaagagccttaagagagacgagtttgatccctgggtcaggaagatctcctggaggagggcttggcaacccattccagtattcttcctggaaaatcccatgtacagaggagcctggtgggctatagtctaaggggtcctaaagagtcagacacagctgaagctatttatcgaatccatcatctatcaatcaatataatctacagtttgtctatgatccaccatgcctctatgattaatctaatccatccatccatccatccatcttttatctggactcacaaaacagtatgtgtgtatagaatatatattatatatacactatatataaattatgtaatttttgtttttcaaaactaccattcattgaatccatagaaatacactacatataaaacaaaaaatgccatatgtatgtgaaaaaataccatatatgtgtatatatacatggcatttttccttgttacaaaagtgatacatggaaacattcaaaactagaaagcaatcaagaaataaattaaaagctaaaaattcataatttcaccttcagtgtccattatttttaatatcttgctaaacctttagtctttttttttttaattcatttatgcttacagacacaagctcagccagtatattttgttttgtaatctacttttgtcagttaatagtataacctggtcatcttttcatgttaataaatatccctctgtgacataatgtattcatagcctatatggataaaccataactgaatcaatctatttttagatgttaaggcttgctttgctttcatactattaaataaacaaacctgaatagatagctagcgggaatctgctgtatagcacagggaactcaactcggtgctctgtgatgacctaagggttgggatagttgggggttgggagagagattcaggagccaggggatatatgtatacatttaactgattcacagtgttgtgcagcagaaaccaatacaacactgtaaagcagttatatgccaataaaacatgaataaataaaagtaagcctgcaaagaacaccttttagctaaatctttgttcatacccattgttatttcctcagactaaattgccagaagtagaatgaattcactggtcaaaaggacatgcttggctatactttacttttatctttccactgttgttcattgttgcttcctagcattccactgatacctcatccaggtttcctggtttttctctatgctatgcccagacacacacttttgaaactacaagaattgtgagtacctttggcctaacatgttgtggctttaactttaagctgatgtacttgaaaactaacttacctgaaggggacatggctcattcatgcagatgagtctaaagtacctccaaggacaatatagcaggtaaataaattaaataagtaaataaataaaaactctaaatttagagttattagcacagtgcctgacttacaatcagtgctctataaatgctctatcaatgacattgatctcaggaaacactgttgaaaggttttagtaggcaagcagcgaacctggtgatgaagaaagagatagagaaaaccttgggaagaggcagagacaaacaggagaaagaaaagtacagaaggtgagatgtgatccgtggtttatcacagacaagataactaagatttattgtgtccaccatgtgccgggagaaatatcaataacctaagatatgcagatgataccacccttacggcggaaagtgaagaggaactaaaaagcctcttgatgaaggtgaaagtggagagtgaaaaagttggcttaaagctcaacattcagaaaacgaagatcatggcatctggtcccatcacttcatgggaaatagat

SEQ ID NO: 49579 - DNA, 1678 bp, Bovine  19866880972873
aactgctctcattagctatcctcctggaagcaaagtagtgtagtagcatggatccatactccctgggttcaatcctatttcctcaataaactggtcctgtatccctgggcaagttacttaagcctacctgtaaaatgagtagtagagtaatagtacctaactcatggaactgttgggagtattaaacctattaataccaacaaatcgcttagaacatcataaattcagagtacaggttaagtgatgtataaatgttacctgttactattgttaatcacaatccatataagaccacggggcttcccaggtggcaaaagtggtaaagaacccacctgccaatgcaggttagatgtaaaaaaactccagttcgatccctgggtagggaaggtcccctggaggagggcatggcaacccactccagtattcttgcctggagaatccccatagacagaggagcctggcaggctacagtccatggagttgcaaagatttggacacgactgaagcaacttagcatgcatgcacagtaagagcacataacaaatatatttaaacccacagttctcttctggaaggtgacccttgtttgcattagtcttaccttttgccgtggctggttaggagcagaaaccactactgtgttgcaaattgccaatgcaataaagaagtcgatgatgtacagagtctccagtggtggatctgggatagtctcatccgttggggtgaagagcagaggtgtaatctgactaaacttgtccaaaagcctggtgtctggtaccacatctgtttcctgaatatccaatgagacaaagtgtggtcacaataagcatctaaaaatatgaattttaaatctacacaagaaggatgatttctaaccagaatctatgaaacatgagaccgtattctttaaaaataaaatttaatgtacatggtatcatgggaaatgaaaaaaaggaaaagacaaaaaattaaatgcaaaatctagaatgcatatatgaaaggagattaccttgactattaaagtaagagatagagacaatgcctttcaccaaattctaattgaatgagtcttgccttattttgaaatatacagtacagagctatattttactgtaggattctactttgggcatagattcatccaacagcaactgatgaatattaattcttttaaaactgagcatgttattcatactatgttattttaacaaaatattttatggctcaagtcactactattgtttaaaaaccaaccctgcaaaataaaaactactataagcaagttaacagagtttatctgtatttccctagtaataccttacaagccatgaacatccatgcttgctatgctaagttgcttcagatgtgtccaactctttgcgaccctatggactgtacccccttgttcatggttcttctgtccatgggattctggactggagtgcgttttcattctctcttccaggggatcttcccgacccagagacagaatcagcgatgaacattcaagggtccctctaagagatttctgattatcaaatatatctggcaactgtgacctatgcctttctcttttgtacaattccttttacaaattggctttaagaagtttgattattgggggaaaatacttcattctgtttaacacagtactttgcacacttatttagaagtacca

SEQ ID NO: 49580 - DNA, 2586 bp, Bovine  19866880981464
atgtagtttcggcaagtgtgctttccctagtaaagcagccccctcagtaaagaactccgagggagcatttgcttctcctcaacgaagagaatataaaagcatacagttatgacttcacttgactattaacaacgcggcaggcaaaggaggtatttgaatttctcatcttttgtaaagacatcataatttacaattctcaggaaaccctcagcctcacagcccactttcttttgacagtacttgctccaatcatgacaagcagtcttttgtccaagcctctatctgaattttgtgcctacaacactatccagtgcatacacatgaaaactggcagtcacacctccctcatcctctcctatcttctcttcgcatctccctatttaggatcttcaggtcttttattcaaatcctcagtagctctcagcatcaagtcatagttattgcagagataacacatatgttcttatgatttagatacgttatatttttaaaactgaacaagtgagttaaaattacacaggaaaataccataatactcacccagtaaatagtcactgagcgaatgaatggataaatgccctgtcactcacttctgagctagctgcagacagcctcactctaccacagagatgtgaccgtggagaaggctacctttggatgggaaggtcaagtttatggtattcgggtgtgcaacatctactcacctgcatgccttcttgcccagagatgccaatgccaatgtctgccacttgaatcatgctgacatcgttggcaccgtcaccttcgtgagacaggagaagagaaacagatgaggagcaaagaaaagatgcaaactacaaatcagtagcagcctctcaagccaacaaactaatccttcaaggtttatcccatgtctccaagctgcctggaagctggctaagcaggaattcaaggtggtatcccattgccatcagaagaattccaaatcagtactacttgaaaatcctttgcctgggctagcctcccctttgtctatgtcacttactctacttccaatttcccagatatactctgcttcttctagccctgcacctcgtgtttctctattcctataacactgccctcatcatccccgccccaccttgctagattttaattgctctctcagcttagatatcacttcctctgggaaatccttctcatattccttttaaataatacttatttatttgcttatttatggctatgctgggtctttgttgctatgtgtgggctttctctagttgcagtgagcaagggctactctctagttacgatgcgtgggcttctctttgcagtggcttctcttctggagtacaggctctactgagcatgggcttcaatggctgcagcacactggcttagctgccccacagcatatggaatcttcctgaaccagggattgaactcgtgtctcctgcattcgcaggtggactcttagccactggaccaccagggaagtcatcatgtttcttttagatatgatgccccttccttaggtttcaagtaccactgagtgtgtctctagtaaacctgtcacgtggtattattatggttgctatagatttccttgtctcaacacaggggaagcttcttaaggggagttattacattcccactggtaatgaacattggttgttcccaactgcccagcaaactttacttgttttctaatgaagtatcctaccttttcctggggactgagtccatgtgttttgttaggatgaacccaaatctccagatttgggatgggcaactgaagcaagcctgggaaattagcatcatctgttccctggcctcagtgattggttcagagatgggtacatgattcaacttaattgatacaattgacatgtccagggctctagcctcaggaacatacggattcagggccttgaacaattcactcatttatatgttctttcaataggacagttgaacagaattccaccctaaccctgatactttattccagcaacttgaaaacatgtactattatttctctcaggttgctaataggatgagatataaaggtgggaattttcagtggctagaacagcatcctgaggggagaggccacctgagactgaaaataatccaggtagaagcagagactataaggaaagactgagttctcattgtgctaatgtctgaattttggtatgtcacagaacttaatctcaccctgtttctcttttccacttatattcatttttggtgagcttatctaatatcaaggctttaaatatcatcactagacttacaattcccaaatttatgtctctagccaattcctcattgctaaaatctcagactttatctccagctgcctacctaacatcactgctgacagctaatggatttctcaaacttaatgtgtgtaagaccgaactcctgctttccctgactccatctcagtaaatggatgctccatcctttatactcttagagataaacccttgacctcccccttgacgcctactattcttcaacacatccaagccatcagcaaatttaaccagctctttcttcaaaccatgtccattatcgatcacatcccaccacctc

SEQ ID NO: 49581 - DNA, 793 bp, Bovine  19866881001095
tgagtgactgaacaacaacaacagcccagtctctagcgtctaaaggtggttggttttattttccgacaagacaataaatgggcttttctcttgcaattctcaaccatttttgaatatcccatgttcttttggatttcctttaggatcaagttggatagctctagcaactaggaggccatgtgcttttgtggctcacaaactattatatgtttttgtataatttcttggcttttgaaatccttgtgaatagaatgttgaagagctgacagttcacagttgtttgtatctacaatttatctgtgctcattcccaagtgctagattggtgtcatggaggttattgtggcagacttgttgggcacattaatatctgtgttttaaaaattgcattttgtctgggcatgacgggggaaaaaaaaaaccctatcagattattactggttttgctggaattgatttttcactccctgtaacttggcagttacactgatgaaacatgtggctcactgccattttatttatgttgagggttttatttctgatgtccatgaaataaggagataggcaaatataaatttatctttgaagatgcttgacgtagaagtctgagaacagcagttaggaaagggcattgttctaatgttattgcctgatctcaggccagggaagaaaaatggtgagtatcatttcatttcagaggagggaaatgaaagtacagatttccatgacctggttgggaaagctgaatgtttccaagtttctatctgggaaaaggggccaataatctgcagtac

SEQ ID NO: 49582 - DNA, 882 bp, Bovine  19866881004827
tctgactctttgcaaccccattgattgtagcctaccaggctcctctgtccctggggattctcgaggcaagaatactggagagggttgccatgtcctcctccaggggatcctcccaacatggatcgaacccaggtctcctgcactgcaggtggattctttaccatctgagccaccagggaagcccactatacaggaaatcaattataccttaatagaaaaatagaatttagaaattaaaaataagtcactgcattgaagagtggctaaaaaatctacaatggctttcccagactattaccagcctgttttgtttcttttatgaatgatagcattctttcatttaattcatttccttattatttattctttgactcccccaatagcatgttaagtgcctgaggcaggaaacttcagatttaccactgtaacaccagaacctagcatggaatggtgtacatcaggtggtcactcaataaatgttgaatgaatgggtgtccaaatgcaatttttctaccaattatatatttttaggctctcattcaatctcaaagacctttttgattgtgtaaagtaaatactgaataatgtcacaaataatcaaggttgtaattctgaacataaagcatttttcaagaatcattgaaaaagtaacaatgttatgtcagaatttgaaaagattggttatcatgggagtcattataactttaagaattagcataaacccacacaccttaaaataaatgtataaggaaaaatatgattggcttaatccctccctttcctacctttcctgcatgtcaatagaacacctgtggtattaatgttttacaggacacaattagctaaataaatactgttctaggaaacagaataaacattttc

SEQ ID NO: 49583 - DNA, 1268 bp, Bovine  19866881047443
atttatttcaagtgtagggctggaagggtaagaatgcaacaggaccaatgaagacagaagtcagctaggaattgctggactgggcggcgttttagtccccaggtttctgccttttacctgcccctcagtgccaattaccaacaaaccccccactgatcacacttttccatccctgctcgattcacacttgaaagaatttcttttcccatgtgatgccaattcatgataaatgttcacaaaggcatgacaatttcaattgccagaccatctggctactggatattttaccgtggtctttagagccaagagctttaccagttgccctgtttctaaggaaacagaagctatggtaacaattcgtgacttagatgaactgtctcattgctcattaaaaacggcctctgggggtcagcaagcacaagctgtactcctgttcctgcagccagaacactagatactatagtgctcgttttcattattcttctttgcatcttctttcctgaatcacttgcggaaccaagctgaagtgggatctgagcatagaaaagtccatattctacccactttttctgggatctttggttgggtggatgaatagatggatggaaggatggatggatggttcaatcattcattcagttagtcaacaaacaaatactaagcatttgagtatcaggtcacgtctatgcttaaacatttcagggtgaaaagtccaagtttcttagtttaataataaataaacaaaacccaatgtgggtcaaaatgcagccatacattgatgagtaatactaatttagtcggtgatgagaagcatttttacaaatgagtgaaataggctaggacagaatagagcaaagtgcattgtaagtattaagggtaaatgctgcttcatgaaacttttcttaaatatgttttgtgtgttttattgagttgaaaagtaaaatgcatttcttattagaaagtcaagttatgaaaaaattttaaagtcactgactacaaaagcccttttacctacctcccagtcccaactctaattggtacatcaaaattcattttctaatcatgctgcactgctccagttctctaaaagcacactttttttttctttcataaatatcttcaatgtccatcttaatagaatatggttgggttctcaaactgcttctgcttttttaaaagttatttatttgaattttaaaaatgtatttcattgaagtatcagttcagtgcagttcagtcactcagtcatgtccaactctgcgacccca

SEQ ID NO: 49584 - DNA, 1233 bp, Bovine  19866881101837
gaagagtcagctaggcatttcaccccagatcatctaataagttactatagctatctcaaatgaagagaagcagagactcacgggtttataaattacgcactgtttataaattgcccaaagctggtaattgacaatatcagctgaaatcagttttgtccatgtagaacccacgtagggcacagaggccagtttaaaggtgcaaatggagggtcactgtcctgcctcatcttgaaggggacttttcctggctctgccagggaacactctgggtgtctgagctatgctatttatgactcattctaaatcccttagaacaagaaaacagttaagcctgagggatgagaggctcagaatcaggcagtgagagaagccccaaactaatcatagctaccattacaaaattctattttgtgccaagtgctatgctaaattcttctatgaattgtataaacggactctagggaaagattattgatatcagatctggttattcagtgcattaaaacatatcaagagagagagaacaggcatcagagatgttttggtatcttgcatttacttttatgggatgttgaccttgaaatgcagaaagagggaagtctagtttgaagacatatgtgaaaataggatcaggtttcagtggtgctaggttatactgataaccagttaaagatctagaaaacaaaaaacagcctccctgtatttgccttataaagccaaaaccacatattggcagaaacattcccacagaagactgaaatagaaatggcatgacatttcagtttaacacattctatttatttaagctgttattgatgtttgtccttgagacttttagtttaatttatcctccatgaaagaaaccttagttactttacattcatattgataacttactctaagaattccttttaattaaaaaataatcagttttaatttaaaggaatcaaactgtattccttttctttttttttttctcctttgcagctgataatttttatcctatgagacaatactttgttacagtccatattctgggcttgggagacaagagtgaattgactggagacctaaagcaggtggctggctgtgcagactctctattgaggtatatctctgatcagaaaataagatgaatagaggcctagagaaaatccagaacaattattgagtggtaagtagtaagaatgagcacagggcagcaagattcccaggggggatccaaaattccaa

SEQ ID NO: 49585 - DNA, 1518 bp, Bovine  19866881101893
attgagttgtgaatccaaaatgactttctgattgttaaggagggtacatcaccaagtttatgaacactttcaacaatatatggctatgtggctgctttgcatttcttttttattgtctagagtacacttgatttaaaagtttgcagaacggtctttcagatattatggttcctattttatgacttgggaaaattaagaaagtaactggcataaacagttggctgagtgtttgaaattgccatccctttagacactaaaacgtttctctgtctggagttcaattctaagaaagaactagcacaacaggaatgggcttcttacacctgtgtctaggtgaaagcagttggttaaatggacaccaacaaaacagcaagcagacgtaacctctcagataagaagccatgctccttctgcatctaggaaggcagtatatctgtcaccacatctatcctgaaaatactttaataaccatggaacttttttgacaagttcagatattgatgccaggccccgtttttagaatgctgaatatgcaccatattggctggcccaggagctggaagaggacatttaaaagtaggctaagactatacacaggagtgaatttggggttagctactcctagaaaacgaactagtaatgatgtagatgtgccagctggcatttatgcagatttcatgttttactatactggaataattagaaaacttaagaggcatacatctttagtaatagacctttccagagaatttggcacatgctacttctcacatttacactaatttttattagtttttctttttgcgtgatctcgagtgacgtctcttactcagcaaattcttccttgagtaaagagaaaaatgagaattgggacagataaatgctagcccagaattatttctttttatttgaatctcatatgaaatagactgttcactccccactccccacatacttaaaacttaacttccttaagaaaataccattgaaaatctcaacaaacaattaaatagttactgttctggcacatcttaggtcttagaagacttcattattgggcataattttcctggtcaatccaaaccagtatcttggtgcctgagcacaatcagaagcaaatggaagagttcccacaaagtatgcagagcacacagccatacacatccactcagcagctctgaaatcatccacaagcttcccaggtccccagactgtctcccccaccccacccctaccacataaggacagaatggtagagtggacatgagggagttctcaaaggcaggcagaaattgtttggggtttatcacttcaatatatgattttatacaagtttcttaatctctttgtggctatatccttatccatataaaattactaatgcctaacttgctgagttattctgaagattaaataagatgatctctatcagtacatggcaaattttattatcattattattagtgttaccagggcttccgtctacgggctcgcacagtcggacacacgactgaagcg

SEQ ID NO: 49586 - DNA, 1403 bp, Bovine  19866881171528
caaatccttcatatcccttcaacccagtttcagacttttgcagttcagaaaactgttactttccttcttgtgttttagctctacagcattatttatggttttacagattatctttctagtgaaagggactgaaaaatctgtgtacagtgatttctggtggtgggtggcaacaacagagctttcatgttgaaaatgacatcttatttttcaaaagtaatttgggctaagagggaaagtgctaaaatgttgtaggatggcattggcattttcattccttttcccttccccttagagtgtgttaaccaatttaaaggattattgtgtgcttagtcctggctaatgagaggaatgttcaattgcacagtcttggccacaattctatgcaaggccacatatgttcccacctgactgtgaagtcagcagactggcacacgataggtatgatctcaccttgatgcacaccatctctcaggcttcttctttaatcttcattactgtaaagtatatttgtttaagagtacagaatctgaatccacacaagttctagcttcaaatcatggttccccgcttcccagcggtgtgattggaggcaaattatttaacctctttgtgcatcactgtgctcatatgtaaagtgaagatagtcattgtaaaactttctgaggttactgtgaggattaaatagtcaatgtatattgactatactaatatatactaagtgctatgaaagtgtttgctattattatttttttatgacattgtctttgagtttctccaagtgatttctaaaagtctccctttttaaattttcagtaaaaatagtatgtggacactgtaagcaatttgaacaataaagaaatatgcacaatttaaagcaaaggcaaccactggtaatagtttctcagatattcttccagagtgtttctatgctaccttttttcttcctttctgccttccttccctccttcctttcctccattcctacatctttcccttcctcactttttttttctccttctctgtttactgtacagtaatggagatagaagaagactgaaaggtggcgattttcatccttatgcacatgaggaatttaaaagggaaggaaattttattggctgtttttgtccacagagaactgcatttgtaatacatgagctctaattaaagcataaaccaatgaattttatgtatgaaagaacttgtcagatgaagaaactctggaatggcaaaccaagaaggtgactttgaaaacatagcttttttattattaaaaaaaaaatctctgtagagtaattgcggtaattaaactgcccatcctcaccattatcattgtcttttgggggaagcaatgtgcctcatcttcaaatttcatttccttagttttatttacaaatgttccc

SEQ ID NO: 49587 - DNA, 1066 bp, Bovine  19866881201674
taaagtttaaaaatggaagaaatatcttcattagcatttgttggacacccagtccttgctaagcactgtatgtgacaaagaattagtcatagtctaaacctcctgggcttaagagatagtcttattaatattcacttgtaaatagcttgtacttactaataaaatcccctgatgaagttcaggtcattcctcctacaattcctacactcagtatctcagaatgtgtacattctataacttccaagttaaggagctctacaagacagagccgtgccctgacatttatcacagaataagcagaaatgagccctcatcatgcccagctgataaacagcctttggtgagctgaactcatgttgctgatccgctaattgtccagctatattcatttgacgttgctgagcctctaaacaaattaaggttaattggaatcaggaatggatcagcaaccttggtactcaatctgtttagcagttctcctcaactcattacttttcttcttttagctcttgcatgaccaaagtgccactcattctacctgcctctattttgactggatcttattacaaaatgtttcaaaagggaattatctgggggacacgtggcaaatcacaactcagtagcatccagagactcaacgcctccaagagacaccttgtgaatgttgttttcatgtgtctttttcaagtaagtctctatctaatccttcagacgtttcattttctcatttgggtcctctttcggtagaacagaacctagtcctagaaaggacttcaacatatccatctgatctagctcctagtcagagattgtattaaatgcatttcatagattaagtaaagaaactctgaatgtgataagaaatttccccaaaatcctgtacatagggcattagtattttggttttctgcttcataatttagtgactttcaactgtgccatgttgcctctgtacttctaatagctaatattagacaatcactatgttccaagcaatggtggagtgctttacatgcattacattaatgaatccttacaagctttaatcccatttcagaagaaacac

SEQ ID NO: 49588 - DNA, 1991 bp, Bovine  19866881304888
tcaaattaccttggagaatggcagtcccctcagaacctcatggaatagaggagtggtaaagtacaaagaagttggtactagtattagcaagattgatactcggtagacaaaaattgaacagtggattaaaaaacatactacactgcaaagtataaagtaccatataaatttagccttactctcacacccatccatgactactgaaaaagccatagctttgactatacagacctttattgacaatagatgtctctgctttttaatacactgttaagttttgtcatagctattcttccagggagcaagcgtcttttaattttgtggctgcagtcactgtccatgttgattttggaggccaagaaaatgaaatgtggaaggactgatgctgaagctgaaccccaatactttggccaccagatgagataagctgactcactggaaaaaaccctgatgctgggaaagattgaaatcaagaggagaagggggcaatagagaatgagatggttggatggcatcactgttgttgttgtgaacaacaacagccatataaattcaggcttaggtagtaaagatggttagaatcactaactcaatgggcatgaatctgaggaaactccaggagatagtggaggacagaggagctgctgtgctgcagtccatggagttgcaaagagtcagacacagcttagcaactgaacaacgacagtaaagactaaatagacttacacaaataaaacgagctatgtgaatcaagtgaatgacctatttctatatactaaaaaccaactggagtgaaattttcaactccaagatctacgttagatatataaggatcagttaggccatgacaggttgtaattctcatgactcaatgggtatcttatccatatgcattcccttctccaggggatcttcctgacctagggatcgaacccaggtctccggcattgcaggcagtttttttaccatctgagccaccagagaagcccaatataatatgcttatttaggtacatgaaaagaatttggcataaaattgtaaatataaaagaaatttaaaatattgcaatacattttcagaatctattactctgatttttaaaaatatatttcagtagcattaaaaatcatcagttaaggcacatattttatcactttatgtctcattgcttgtgcagctttttgattctccaattagtagagcttcacttacatgcccattagtggatgatacactgttaagcaaagttatagccatcactgaaatggaaaatactaccaaagatgtagaactaacacaatgctgctttcctgagaaatctatccccttgctgggaaacaaacatacatgaattccataaaatctaatgcagccatttgtgtggaaattcctccacagttaaatttttaaaaatcagatttcttcttcttactccatacttaaagtcccttcatcaccacattttatccaaattacagcaagtatgttaagataataatcatagagaaaggaaaaaagaaagccatgggtggagggttcttctttacttaatcacatggatggagcagaaggggggtggcctgtgagaaaagagcctgttactatacagcaaccctgccgagaaggaaacagggctttctcatctaccaatctgattaacacttcctcttctagaaacaaataaaggaaataaataggaaaaaattccattttataccaattcttaacactggggagaaaaatagaaataatgtatgtaaagtgcctaccaaagtgaccacacacaataaacacttactagatggaagcagttagatctttttgaaattcaaaattgttcattagttttattttcatggttaagagacaatacacattccttggagaaaaattttaaaatgcgagaacaaaaagaataaagccgaaaactgttgaattcccactaaatggactacttagtcataaccactggtataacatggggtatgtat

SEQ ID NO: 49589 - DNA, 876 bp, Bovine  19866881319229
ttgaatgataatttacaggagtgagggtgatttcagggggtgggtaagagttctgtttatgattcaaggatgaattattatgtttatatttggaatttctgtggttataggagggtactagaatataaaaaaaaaaacttagaacttaagatcaattttttcacacaatgaatatttcaaaagtaaaatgtgatgtcttaattctcatatttaattattaaaatgttcatgagtttaccaaaaagaaactgtttatagaaatttggcactgaacaaagctatcaccatcaaagaattttattatcctgtaaaattttatctcagtatataatttaatatttaccaaagcatatattactgatcattaactttaacttaaggagtttacggcttagtattcccaaattctacattcaggttcaccactgattccagatataaaaatggataagggcaaggaaaaaaataaattcacatttcttcagatagttacacatcatagtggtctggctggcatagcagtaaaagaagtcctatcaccatataatagaaaaatgaaaaaaaaaaagaaaaatgagatttaaaaaacagtatataaaaaaggtaacaaaggatattgtacaggacacagaattttaagttttatcttttaataacttataatggagtataatatacaaagattctgaatcactgtactgtataccttgaagttaagataatattaaaaatcaactatatgtatcaataaaagagtactcaataaaaatgttttaaaatgaaaaaggatagtgcccaaatttctcataagcatgattatacaatcacaccagggggcgctcttaacactgaaatgatggatggcattttaaaaca

SEQ ID NO: 49590 - DNA, 940 bp, Bovine  19866881427000
aataaagatctgcatttttccaaaagtaactagcttatatttttattatggcaaaagtaaatgatagcaactaactttgggaaaatcattatcttggcatagctttttattcctattacctaatcagggttcacatattaataagtaaacaaactcaaaagctgaccttttaaggaaaagaaagagaaaaaattcacaagttactgtaatgccatattaacatcaagttaatgggttgcctatgtagataaatgatctaaacttacatgggctttgtgcaaattgtgtcaggatgcaacaaattttggcatgtcctgtcaaaaaaattggtatattctagtgaattctaatcaactctactaaaaccttgttcctcctttccctatcaagaaagagttaggtttgagttcatctcaaagaatcataggttgctgggaagatggaaaatcaactcacagaagatgttgtcatggtggcttaatgccattcaggcttctgaatagaattttaaattccgaacactttttgttctgttgtaacctgagaagtacatgtatagaaattacaattcaataaactaaaatctattatcatagtgaactaaaaaaaaaaaaaaaaaaacaaatttcaaaattttctgtaaatgaaaatagattaaaattttttttaaattaaatctgaaacaagctgaattcaatggtccttagcactttagtgcaaagtaagtaaaaataaaaactttttgtttttcatgttttaagatacatggttaagtaatggaattttttgaagtgataactacaagtttataaagtaaaatttaactatattaatagtgttctcagtcttacataataattcatttgcctcctgaacgatgaattataaaacatagtctaaaccctgatcaatataacatataggtaaaacatgcatggga

SEQ ID NO: 49591 - DNA, 827 bp, Bovine  19866881934760
agcaattgcttaaattgctaagaatggcattactttctttctgagattaaaaaatgtcgttcagtcactcagtcgtatccaactctttgtgactacgtggactgcaggcacgccaggcttccctgtcttttaccatatcccggagcttgctcaaactcatgtccactgagtcagtgatgccatccaacaatattgttgtctgtcctccccttctcctcctgccttcaatctttcccagaatcagggtcttttccaaagagttggctctttgcatcaagtggccaaagtattggagcttcagcctcatgtaggagtagaagtctaggtcacagtgggggttggggatcttgattgtttttggatatgttaaatttgagatgcacattagacttctatatggagatagcaagtggtagttgagtcaaaagtctggaattcatgcttaagatctctgactttgagagtccttagagtgaagttgatatttaaagctattagactaggtgaagtaggctgaaaagagcaaaaatctgaaaaatggcagataatgaataacaccaaagggaactgaaaagaagtagttgacagagtagggagaagcctaggttgagtgctatcctggaaggcaaagggacaaaatatttcaacaagaagagcaaatgcaatgttcttgctgaataagatgtcctggaacttatggttaggtacagcagggagggtgtttttcttgatctagatatgaattgtcttggaatagcagagtaatttcaacagcttaaaaagcaaatgtttggggagaaattggaggtagtgggtatagttaatat

SEQ ID NO: 49592 - DNA, 1286 bp, Bovine  19866880973424
gaaaatactacaactgctgctactgctaccgctaagccacttcagtcgtgtccgactctgtgtgaccctatagacggcagcccaccaggctctcccatccctgagattctccaggcaagaacactggagtgggttgccatttccttctccaatgcatgaaagtgaaaagtgaaagtgaagtcgctcagtcatgtccaaccctcagcgaccccatggactgcagccttccaggctcctctgtccatgggattttccaggcgggggagtactggagtagggtgcccattgccttctcaaacaaatattatatctaacaaaatattataaatgctaagaaagcataaaacaagagatatggtggttaagtgtaggcataggtgtcaactacatagattcatagtgagtttcaatatatacaaagaatgtaatttggggtaacaatttttcttcatttatgtaacagggataataataataataactccctaatgaggttgttttgagaataaattgagatgacaaataatgtcatcatttacgcaaacaacttggcaaacttgaggaaataattgattttctgaaagtaaaattgattcaagaggcatacaacatcaagaagcaaataatctacttttcaaagatcagtctatttcccaccttattgataaagcttcccatagtatcttgcccacataatctctttctttttctctgaatcttcatttaggttttatgtctaaactatcttttcagcatttacagtaggaagaataatggtccccaaggatgtccatgaactaatccctgaaacctgtgaatatgttaccttacatagcaaaagggagtttaaaggttaagaacattgagaaagattatcttggatttttcaggtgagcccacatgagtccttaaaagtgaagaatccacagacttcttgagattctatggtattagagagaagaaggagaaagggtagaatataatactgtaagaggaacatcagatcaatcaaataaatactgaaccctctgatgtcagatgagatacaatggaggcggaagggtcagagagaaatctgatgttgttaacttggaagatagagtaacagagcttccagcagatgtatatggacagctttgaaagctagaaaaagcaaggaaacaaactctaacctggactttccaggaaggaatgaagccttggagatttctttattttagcctggtgagactttgaagctatagaactgaaagacaataaattagtggtggtttaagccactgctg

SEQ ID NO: 49593 - DNA, 834 bp, Bovine  19866881940796
tgactgaactgaaatgaatcgagacatgctataaatatagaattaatggaggagaataaacaataattcctgatttctgatagagatcgccaatgtcatattattgagaaacaaattttgtcccatttgacttctctctggagtgcatagttttgctgctacccaccacagtccatgataaaatatttgcttcttgcttcagggatcaccaaggttagtaattttgaacatgttgaagggaagaaaccaattctgactctatgttggaactgtttctttgacttgcattcattgcttttgttattacaatcatatagaatggtttgcctcagagaatcctgctcctctgcctgactgttaaactaagtgcctttgttcagaaccctgtccatctgtggatgataggaaggaagaaattaacacatcccctgcctgaggtttgccattctggagatgtttgcaagatgaatgtcccttttactttgcttcctccgctcccctcatctctaatctataaaagaacctggcatccagacctcaacaagatggctattttgaatacagaacaatcagaatcctctttgttctgtttctctggagaaccctgattaatgcagacaattaggttaggagataaagattctggtgcccagagaagatgaagttaagtaaacaacaacctgtgcagaatcctgccttagcaaagtttttcttgtttttctcctgggaatgctgtgagctacacctacaaatgtaaacagtcagtcaatagcattgtaaacaaaggcagctgtgttttgtagttcatagaaattcaattagaaagaaatttca

SEQ ID NO: 49594 - DNA, 1413 bp, Bovine  19866880359904
ttcttgggctccaaatcattgcagatggtgactgcagccatgaaatcagaagacaattgcttcctgccaggaagtgaagtgaagtgatagtcgatcagtcatgtccagctctttgcaaacacatggactatacagaccatggaattctccaggccagaatactggagtgggtaacctttcccttctccaggggatcttcccaacccagggattgaacccagctctcctgcattgcaggaggattctttaccagctaagccacaaggaaagaaaaaaatacaaacctagacagtgtgttgaaagtctgagacattgctctgccgataaatatcctagggacaaggctatggtcttcttagacgcagcctggacaatatatttaaaagcagagacatttctttgccagcagaggtctgtgtagtcaaagctatggtttttccagtagtcatgtatggatgtgagagttctaccataagaaggctgagtgctgaggaactgatgctttggaactgtggtgttggagaagactattgagattcccttggacagcaaggagatcaaaccagtcaatgctgaaggaaatcaaccctgaatattcatttgaaggacagaggctgaagctgaaactccaatactttggccacctgatgctaagagctggctcattagaaaagaccctgatgctgggaaagattgaaggcagaagagggcagaggacgagttggttggatggcatcaccgactcaacggacatgagtttgagcaagttcagggattggtgaagcacagggaagcctggtatgctgcagtgcatggagtcacaaagagttggacatgattgagcaactgaactgaactgaactgaactgaatttggcagcaatgtcagtgtcaagacactggtaaggtcctttccatgactcttacttttgcaaaaacatcagaatgagacaataagtgtttataaatgacaaaagacttgaagtttatggttaaagatctgatgagagttaattgtactgatattgacaaagaatgttggttcttttttgtaacacacaacattttaagatgataattggaattatggctaataaaattatactaggacatacttgatttttaaaaatcttatacattttttataacactgatattaataacatacaaatataacctaaaaagtttaaacatcacttcttatttgacagtgattcctatgtcacttaacatatcaaataagcttaattagtttaacatttctctttttataaaaagagaggacaaatcatttgagatgttccaaggactctgaaaaatcccagttagttcaaggcaaaaagactttacttagaatttgatttggaagggagtttcacaaaaaaatctatgtaatcaaaataaaatttaaaga

SEQ ID NO: 49595 - DNA, 2464 bp, Bovine  19866880654072
atcggagtagactgtggatatgagccaatgctcaatgtataataaataaaattaagaaattttggcaccacagaggcctagcttctggacttattcccacttttattagctattttatcactgaataagttacttaatctttcaatgtcccatttttccaatctacaaagtagaaaaaaatgactgattcaacattattagggctgtggtaagaaaattaaaacagaaaatcctaaccaagtgcattggatgtgctgtttacaaagcaaatgctgaatagaattttctctctcattgtgtgtctcaggcgctcaatcctatctgactctttcgtgacccagtggattgaggccaccagcctcctctgtccatgtgattcccctggcaaggatgctggagtgggttaccatttccttctccagggcgtcttccccaaaattaaaactaagcaatgaaactcgtgtctcacgtctgctgctttggcaggcagattctttaccgctgagccacctgggaagcgccatagaggggaatggtactggcttagtctctaagttttgtcctactcttgcgaccccattgaatgtagccagccaggctcctctgtccatagaattttccagacaagaatactggagtgggttaccatttccttctccaagggatcttcctgacctgggattgaacctgggtctactgccctagcaggcagcatcttcaccgagtgagctatcagggaaggcaatagaggagaatactctctcttaaagatggtaagtaagaaagtggggatgagaaccaggctatagcttgagctagaaggggtcaaaaagtttagaagaggcttttactgccccctagtgttaaatctccaggttttgttttggttttgtttctaggtggtattttactaagcaattccaaagtttgaagcaagtaagttttgtttaaatgatccttcatattgggttacttccaaatccatatatacacagttactgtaagacagaaaagccttatacattaaagatataaagtttggttatttttactgaagagaagccaaaatagaaatgagaggggaggtgtatctagcataggtaatcaaattctgtatttaaatatgtccattaattgaagaaatcagatcattaggatacgtatattttagtaaagtatttaggcattagcaactctaactgaagcaatagaatgattgaatccagttaaactccttacctaggctatttttactggaaatgctgacatccttaatacagaggtttggatacttccattctagtagtatatatagcccacaggtaagtcttactaaaatgtgctgagttagcttctcaggtttgggactttattttacaagggcacggcattcaattcatgacattcaaatgttctaaataattgtagatagccactgaatgaaatgactgcttttattttgtagttattagtcacagggaaggagactcaaaattatagagattgggaattacttatgtaatttagtaaaaaaaattctgggtttttggctgattcaacaactttgtaaaagtggcaggtggaaatttaagctacttcagactatgtataactggtttaaataaaactgaaatagatcagcataaagaaatactttattggcttgatttcagcctgactaatatttctgtccatgtgtttttcttctttgaagaaaaaagccatgtttgatgcaaaaggtggtcttaccaaactttgaagtaagatgattgattgattaatatagaccttccagaatccaaagaaaaatacatttctactggtttttaaagtctgtttttgtatcctattgtttctctggtagggatcattctcaaatcttcattaaaaacttcagctctaaacctgtgagagaggggctgatgagttttcatttagagaattaggcaatgaattattattcatgatacattcaagtcttactgtatatcttccctataatttctcaccacaatcagttataatgaactgtacttacttggcatgctgactcctcttcaaaactcattcttgtgagacacctaatgtctttttaatctggctcttctagtaatacatcccttgattcaaatgcagaagaatttatggttgtgatcataattgatgagattctcctggctgttgagataagttagtaaagactgacattgaagtaattggtatacctgaaaaataccctttgtaagaatgttgacatatatactaaaaagagttatcaagaacaggtgcttagacttgtaaaagtccagttatatttttcctgtccttgtttacatatgtaacatttttgcttaattaatcaaacaggtaccatgatgattagccatgtgtattatgtaattttaggtgataacttctaaaataagatatcatgaaatattttcacagtcaataggatctacta

SEQ ID NO: 49596 - DNA, 3465 bp, Bovine  19866881296352
aggctttttagttcctattcactttctgccataagcgtggtatcatctgcatatctgaggttactgatatttctcccagcaatcttgattccagcttgtgcttcctgcaacccagcatttctcatgatgtactctgcatataagttaaataagcagggtgacaatatacagtcttgacatacttcttttcctatttggaaccagtctgttgttccatgtccagttctaactgttgcttcctgacctgcatacaaatttctcaagaggcaggtcaggtggtctggtatttccatctctttcagaattttccatagtttattgtgatccacacagtcaaaggctttggcatagtcaataaagcagaaatagatatttttctggaactctcttgctttttcgatgatctagctgaatgctggcaatttgatctctgatcattaaatagcaaatgctcaaaacattatataacaatatgagcttcaatttaagctctattttttattcaaaagagaggatagtatgagatgactttttgaatttaatatctgcaattgaaagagaaagtaaatcatagtggaaatgtcaacaaaaaagtatttagaatttcaaataaaatatatatttaaatagcttaatatatatacaatttggatttatttccaagctatttagatctctctcctcttcttgttgttgttcagtcgctcagtcatgtctgactctttgcaaccccatggactgcagcatgacaggcatccctgtcattcaccatctcctgaactgagtcaaatttatgtccattgagtccatgatgccatccaaccatctcattcactgttattctgctctcttcctgcattcagtctttcccagcatcagggtcttttccagtgagtcagttctttgcatcaggtggccaaagtattggagtttcaactttagcatcagttcttccaacaaacattcacgattgatttcctctaggatggactggatttccttgcagtccaagggattctcaggagtcttctccaacacatgtttcaacagcatcaatcctttggtgctcagccttttctttatggtccaactctcacatccatacataactactggaaaaaaccataactttgaatagatggacctttgtcagcaaagtaatgtctctgctgtttaatatgctgtctaggtttgccatagattttcttccaaggagcaagcatcttttaatttcatggctgcagtcaccatctgcaatgatttgggagcccaagaaaatgaagcctgtcactgtttctgttgtctccccatctattttccatgaagtgatgggactagatgccatgatcttcattttttgaacattgagttttaaggtgtctttttcactctcctctttcactttcatctagaggctctttagttcctctttgctttctgccataagggtgatgtcatctgcatatctgaggttattgatatttctcttggcagtcttgattccagctagtgcttcatccagcccagcattttgcaggggcttcccttgtggctcagctggtaaagaatccacctgcaatgcaggagacctgggtttgatccctgggttgggaagatcccctggagaatgaaaggctaccactccagtattctggcctggagaattccatggactgtatcgtccatggggtcgcaaagagttggacacaactgaatgactttcactttatttcactctgcgtataagttagataagtagagtagcaacatacaatcttgacatactccttttcccactttggaaccagtctgttcttccacgtctggttctaactgttccttcttgaccttcatacatgtttctcatgaggcagattaggtggtctggtattcccatctctttaagaattttccatagtttgatgtgatccacgcaaactttaatgtatagtcaatgaagcagaagtagatgtttttctggaactcttttgcttttttgatgatccaacggatgttggcgatttgatctctggttcctctgacttttctaaatccatcttgaatatctggaagttcttggttcatgtactgttgaagcctggcttggagaattttaaaaattactttggtaacatgaaatgagtgcaattgtgcagtggtttgaacattctttggcattgcccttctttggtattggaatgaaaactgactttttgcagtcctgcggccactgctgagttttccatatttgctggcatactgagtgcagcactttcacagcatcatcttttaggatttgaaatagctcagccgaaattctgtcacctccactagctttgttcatggaactttgtttctcctctcctgtcactatgtttttattttatttaacaaccatttaaatatcactttccatgtgccagacctgtttaaagtactttacccaaattaactcatttaatgagttctattcagctttctgttcaattattctacaattatctctttctttcttcatgattataaaatacagtaacaatctgcttcaaacgtatccttaactcaagtgtttgtttaccatggaatgcactttatgtccgattccttactatactattatctatgtacacgttggcatccaaggaacttctctgtggagtgctgactgcttggggcagtccccaaggacttcagtaagttcagtaccaagtctatagctgtaattcctccagtcctttcctcagttatactgaatagctttctactacccctgggtggccaaagccttaaataacattgcaagtgtatcaaataaatgtattcatatcagtatttgtctgtgtgcatcccataaaacacactaatcttgaattttctgatagacaaagaaaaaacactttaaaaatagcataagattagcaacaattttgtaaactagtctgttggaatatgcattttaaatgctctgagaaatctggctgtttcaaaaatatttgactaaaaaaatccacttcaccttcttttttaactaacacttctgcaaattctgagcaactagtgatctagagaagatctgtctagaaacagtgatctatatccaggttcagtgaaaaactctggtttgttatttatactttttttttttcacaacagcaacagtgatggttttatttttcaatattctattatcaagacttcctggtatatgagaagtcatatattttacctgataagaaatgcagctgcaaagttctaaataaatcagaaatgattctaaatacagctattaatgcatagcaaaaagtagtccagggtaaaatataactacttaagcattccatctggtttgtgttttgtctatatccatgtatatcccaaacacaaaaataaaatagaagttatttatgacactgtaagttcagcccctgtctagactgcatgcaatatagggaatcgaaatctcat

SEQ ID NO: 49597 - DNA, 1355 bp, Bovine  19866880350257
ttgcttcccgcgctggtgtactaagtgacccagagtaagaagacaaaactactgaatggaagaaaacgacctgctgtaagaacgctgtagataatccataaagcaattaatccacataagcaaaatcaagtaccactactgacccctgtagacagggagaaaatgaagtcattctgtaaaccagtgcaatacaggggataaattctgatttctgggcccagaaatgtcaaagagttgacttattttacacaggatctttaccaaattgcttgcataagccaaagtgttctaaataaatccaatgaaactaatttcacagcgtttttatctccattgtcaatgaaactcagaagtgtaaagaaatatagtcatgaaagctaactagcagaataaaactaaagaaacatttctaagcgtcttaaaaagaaagctattcaaatcatactgggatttgggagaagacccaaaccacttttatttctttcatttctgctcactccttccctctaatctagacattttaaacctagaatccatcgatgggaatcagaacagtggttctcacgggtgtggttcccagacaagcagcaacaacctctgatgctgggcacttgttagaaatgcaggttccaccttagctgctctgaaccaggaattctggaggcaggcatctctgttctgatgcatgttaacgtttgtgactcactgagctaatgaatgacttaagagatatatgagaatttctgaagtgtaagaatgtaggtgaaaaattatctaactttggcattgggattccatgggaagattcttgacaagccctcccaggatagtaaatatatgagggaataaattttgactgcctccaacaaccagagggtgtggaaaaccattctgtatgagaaaggaatagaattttgttattttacatttgaaatggagaaataggggagaaaaggtgaaaaggaagtttatattggagacagctcctgctgttgttgttgttcagtcgctaagtcatgtcagactctttgtaatcccatggactgcagcacgccacgcttccctgtccttcactatctccctgagtttgctcaaactcatgttcattgagtcagtgatgcaatctaaccatctcatcttctgccacctccttctctgcctgccctcaatcttttctagcatcatggtctttccaaatgagtcagctcttcgcattagttcaagttcagccacccagtcgtgtccgactctttgcgaccccataaattgcagcatgccaggcctcccctgtccatcaccaactcccagagctcactcaaactcacatccatcgagtcaggatgccatccagccat

SEQ ID NO: 49598 - DNA, 2705 bp, Bovine  19866880378703
actactcaggccccacctggctaggactaagggagagcttcttactatccggacggttgggatactcctctctgagtgagctaagtcactttagtcgtgtccgactctgtgcgaccccataaacggcaacccaccaggctcccccgtccctgggattctccaggcaagaacactggagtgggttgccatttccttctccaatgcgtgaaagtgaaaagtgaaagtgaagtcgctcagtcgtgtccgactctttgcaaccccatggactgcagcctaccaggctcctctatccatgggattttccaggcaagagtactggagtggggtgccactgccttctccgtctctgagtgaacccaggcctaaattgtatcgtggtccataacggtgttcagatcacatgaggtggcaggccactccctcctagctagtcccatacttacctcagggccagtggctccgtcctctgcctccttgcagaacctttagcgtcaacgtgcagctgtgagccacagtctgtcctgagatcaacgctggcgataccgcagcagcgcctcaaagactgtactgctggcccagcccagcacgtgcttctgggacgacgtcggccaatggaaggcggggctccgtcggcactgctgattggtcctcaaatcccgcaggaacgcaactctcgcaggagcaaaaaaacctagcactgcagagttgttactgattgagtttaaatgtgacaaaatgtttatttctttaacttttacctaacttaagagttatctatgtatattcacagtaaataccagttcttgcttgaggtaggaactcaacattttatcaatgattcattagtgtttgactgtgggaatcaaatcacgtcaataaaagaataaggcaagtgcttattgggggcaagacgctgtgccaagcaacttggaaggacaaactctgaactgaagttccaattttcactgagggtataatccagctggggcaagattaaagtacattaaaagttaaatcattataaatgagctacatagaagtgcaataaataagaactgacagcaaagttgcaagctgcctgtttaatcgccaaaagaacaacagactagagcatgaatagaaacagagaatgcgtcctgaaggagcgagggagggagatataagggagaggactgagaaagctttaagaagacgagggtattgaaggcagacgggtgagaaagccaaagctgtgtttaggaaaacgtgagggggaaagtagttcacctgtggttacacgattacctcagtgagatgtgagtggtaaaggctattaacagagaaataaaaatattaaaataatttagcttattaaattttgtgttaggtaagtgcaagatttacccatattctctggagtgctgtccaatagaactttctactatgatggaaatattcagtgtggaccccgtctactagctgcaagtaactttgagcactttaagtgtgactcatgcgactaactgaaatttttattattttagagttaactttaattaatttcaaattaaatagccacaattaacagatggttgaatgaaactaagtggtacctatatgttctgtcctgtgagccacatatttaaaagatgtatgtcatcaaattgaatcaaaaagagagaaaaatctggtgttacatattatctcaaactcaaagacgaccaaactcaggaaataaaatgagactaccatttcttgagtgcataccacatgccaagttaggcacttgtgtacattatcagtagcctgtagacttatagatgggaaaatggagactctggaccatattcatgcagaacaatctgaaagttactaattgatcaccaataaatatcagtgaaaatattttaaaatccagtaaaaatttgcaaataaggcaaaacatttttacttaatcagatataatgtataattataattatatataattatgcatcccagacagtaaagaatctgcctggaatgcaggagacccaggttcaattcctgggtcgggaagatcccatggagaaaagcgtggcaacacattccagtattcttacctgaagaatcccatgaacagaggagcctgttcataaatatgtggtcattaccacagtccacagggtcgaaaagaatcagacatgactaaagcaacttagcacacaaagactaatatcaataaccaataagtcttattgtagttagatcatagtttagagaaattttggaaagcaatgacaataatttattattttatccttgcatttcaaaaataagttacaatatcaatatgatcacttttaaaaaagattagtaagaacttattaaaaatttcaaggcaaatctgaatttcatgtgaaattcagtgtctatcattctaataattgtgcattgtaggctacatgttttatttctcttaatctgcaatggcctagcataccttttctctaatataagacaaattagtaatcattctttcaaatctcagaattttcaactgttttacttccatgtgattcatggtcaaatgtgactttatatgatttgaacataaaaaaaatctgtcattactgagtgatggaaaatgttctacaactgtggagatggttgcacaactctgtgaatactaaaaagcaattaacttaattctttaaatggggtgaatcatatattttgaattatat

SEQ ID NO: 49599 - DNA, 1871 bp, Bovine  19866880419938
caggttcacagtctgtgcagatgtccagtgtctgagagacctgccttgtgtcttttgtccactttcatagttatttactgagggagcactgacctggatctgttactctttcatattggaaacagaagtcaattatttttgtattagagatgagaaaactgagggatgcaaacatttagcgacttgtccaaaatcgcacagcatttcaaacctaggtagtctgatttcagaactcctcacttaattactgtaccatgtggcttctcagaaaaatggttttatgtatatacaggtgtaaaatgttttgtctagtgtcaggaaacacagtaagtctgggtattttatcctttaaaattctaaaggtcagtataaatgttttcttagcacagtgtttagaagcaggaaagagtggataggacagaagcacctccacaggagttggtattcttgatgagtactaaacgttatcattgtcctaccactagtgaaaaaagggcatttacttaagtcctttactgctcaagcactatttatttacaggaaatattaaatccttactatgctttcttttggggcttccccggtgactcagttggtaaagaatccacctgcaatacaggagacccaggttcaattcctgggtggggaagatcccttggagaaggaaatggcaacccactccagtattcttggctggaaaatctcatggacaggggggcctggtgagatacagtccatggggtcacaaagagtcggacacaactgagcatctgagcagaggctttcttttgccattgaaaccaatctttattcattagaaatatagagcaaaaaataaaacgctccaagcaaccaggcttaggtgatactcctatcaatttctgaagttcaaatcaataaatactgtatagtaacacacccatctggccatgaaggagattgcagtggaatgaaggtacaagctcatgaataggaacacaaatatctgtaatagcatccagcaccgaatctactgtttaattcttaatgtttaatctaccctatgtgtgctctaacttttcatctaaaaaaatgtataatggagatgtcattaagcccgggcctttctttggttttagcccgtgtacttgaaaatagtttgcgtctgtcttgtgctattttttcccccctgagatacatgcaaattttttccaaatttcagttatatctactagcaaaaaaatgcaacaaacactttgcagttgtccattcactctgattagcacaggaaggagaactagcttattctgggcttctttccatggtgccccctcttgcctcagatcagacaagcccacaggcatacgcatccatcaactttgacctctctaaataggagctgccagatcttcactgcacattgttctccgtagatggttagaattggtaagttcgaacctaaacaaatttacaaagggaaatgcaaaaatcaggaaatggtagattaagtaaaataaatgtaagactaggtttattaacttcccacaagcccaaacttcccttttctgggatcagctttatctgtggtggaaaatcatcattatctcctatctgtcaatagttctcagatgtccagttagtaaaatgttcaagtaaactgtactttaatgcattaaatttattgtttctactctattaatattactctattagctctcatgtgctaagtcacttcagtcatgtccaaatttttgcgaccctatggagcctgccaggcttcctctgtccatgggattttccaggcaagaatactggagtgggttgccatttcctcctccagggtatcttcccgacctagggattgaacccgcatctccagtgtctcctgcatt

SEQ ID NO: 49600 - DNA, 730 bp, Bovine  19866880517340
tggaaaatcccatggacggaggagcctggtaggctgcagtccatggggtcgcgaagagtcggacacgacttcactttcacttttcactttcctgcattggagaaggaaatggcaacccactccagtgttcttgcctggagaatcccagggatgggggagcccggtgggctgccgtctatggggtcgcacagagtcggacatgactgaagcttcttagcagcagcaggagcagcagccagttccagcaaacagtcgtgattgcagtaaggtgccttgtctatgtttatttctttgagttcttcatataaattcttaaaaaaataaaaaaggtataatagttctctgcctgccaaacacttcattggttttacagtgtgacttgagtcttgcgttttctctcccaattgcatgccttagcgaataatccttactttggcttccatgtgcatttaatcttaatcctctcagtcatttagccttgttgccactctcctgtctcttgcagttgatccctaaaagtttaaaaaccaaaatgtcacatttttcttaaaatgaggaaattctagaacctaaaaaataacatttaatagtctagtgcttatgtcttcacctaaatgtttacttctcaattgcacttttggtataagaataaaatgtatagacattttgataccatgcatacgtcggttactaaaattgccaacaaaatgtggtttttatgagttttttt

SEQ ID NO: 49601 - DNA, 1759 bp, Bovine  19866880552779
atgagaagagttgactcatttgaaaaggccctgatgctgggaaggattgagggcaggagcaggaggggatgacagaggatgagatggttggatggcatcaccaactcaatggacatgggtttgggtggactctgggagttggtgatggacagggaggcctggcgtgctgcggttcatggggtcaaaagagtcggacatgactgagcgactgaactgaacttgaacttgatattctaaaggcttttattttttaaaaacatctaacttctcattagggagctatgtcatcatatggtagaagacatgtaaaataaaatacaaagcttttagtgtgttacaggcaaactacaatcttagttgtgaaagaaaatagatgtttacacttaggaatgaaatataagactgcatgtgagattgccattggacatgtacagataatgcagcctgtttctcatggactttctcttctcattaaacttaaatatattttgggacttcccaaggtggtccagtggttaggattccatgcttccactgcagaggaaggggttccctcatacgggaactgagatccagcatgctccagcacagccaaaacaaacaagcaaacaaacatatttaaaacttgacacatgatgtaatttaaggctttgtactagagattcaatttctcaaatcttagaatcttctttatgttcaaaaatgctaatattttctgcaaattaagaaaactgatgaaaaaattctcttggaattcaagtgttaatatttatagaaaattaaatcctttggtaagtccactatcttagaatttaagaggcagccttagagtgaaacaaagagacaaatttatattagtttccaaatgtattagttaccttatgtctgttagaagaaagatatattttcactatgtttgaacaactactgtctccccacttcttgactttaactactgaccccttcttgcttaactttaggtttgagattttcctgaatgaatgtttgagggaaaggaaaggagcagggagggagagaaaaattggaaacagctctggcccacaattgccacattcaggggaaagtgtaacctgttttggaaccaccgaggcagaaagacacatttcagtctttgcatttatcccatgtgtgaaagcatagatgtaaacatatgtatgtactaggattaagagacctgagttctatttgggactctgctaagaactcactttgtgaccttattcaaatcttttctctctctttgggcctcaatttccacagagtaagataaaagagttcagttagttgctttctgaaatccccatcaacttcaaaatcattggttcttatttaaaggaataaatatttgtgcattgtcctgcttaatgttgatttatcaggagtcttcacttgtgagattacacaagagtatgaacataagttgatgagtcctggacgtgaaaaggaggtacatttaaaaagcagatagatatactttaaagtaaattgcatttttgttttaatataagaagtctgataatttaggtaatgtcttaccaattatttggtggttgctattccaaataggtacgcagagaactgatcttatgtgaaaaccagatatctggtcagcctaggacataagaaagcaattaattaaaattaaatatcatctacccatttctgatatatggcttaccacccttcataacaggtgtttaaaagtaacttttaaaaagacataattttaagcatatac

SEQ ID NO: 49602 - DNA, 2400 bp, Bovine  19866880563779
tgtgaagaggactgtctctgcacaattgatgttcccaggtgatcttcattctctgggctcacacagcccatgttctattcaattcactagcagtttatcataaaatataaactatatttctaaacatgaaaaagcaggctgtctttatcctcaaaaaataataaagcatattcttagtattgaaagcaaaaaacgttaaacatctaatatgtttttccttttgtctttttttgaattacagtatgcttgctatatacatacatgtagctttgctttcgtattacctgaattgaagtaaaaattcaacttttaaaggcttattagatatttactcttttttttaccatttttctttttaccatttatatttggttttgcacattttatcgaaatatgagagcagagatacattgaccgatttttatttgaccacatcatgacttcctgagaatgaaatgaagagtattgacagatgccagaggtttgctttgaaatagtctagcaaacaaacgaaacagaacatgtgaggggataaatgaatcaaggcagcagaacgtggcttcctgctaaagttaggtaacgagtacttaggtattcaatacagtattctatttttcatatgtttttaactttacaaaatagataatttttttaattaggataacaagtaggttaaaattaagtcaaggaggtagttaaaattatttaataaaatgattaaagtcaattcattttttaaattcatgctacaaacagttactcaaacatgtatgcttgtaccagttttgagaggcttccctgatagctcagttggtaaagaatctgcctgcaatgcaggagaccccggtttgattcttggttcaggaagatccctggagaagggataggctacccattccagtattcttgggcttaccttgtggctcagctggtaaagaattcacctgcaatgtgggagacctgggttctatccatgggttggaagtatcccctggagaagggaaaggctacccactccagtattctggcctggagaattccatggactgtatagtccattgggtgcctggccattttgagtcttacatgagtaagcatttgctatgttatttgagattcagagagaagttgtgtccaaaacatgacttaaattttgcaatttgataataagtggcttcaagaagcttctggttataaaagtattcaagtatagactgtaaggtcttcccaactctgaacttgacaagcaaaggctcattgcagacttaaattagtatttaattaaggccaaatcaattattgactacattcatcttgaaaacgaagagaagcaaatttgatcaaaactgtcccacgccttgtacacctgaaactaacacaacactgtaaataaactatacaccaataacaaacaaacaaaaccccccaagctgtcctcccaggtaaacccaagctatactcccatggaaactagacaaactacaactggtttgtattgtatcacatgctttggtaaaggagccatgtaaacatggtgttggttggtggtcccctaaatggcaccccactccagtacccttgcctggaaaatcccatggacggaggagcccggtaggctgcagtccatggggtcgcgaagagtcagacacgactgagcgacttcactttcacttttcacttccatgcattggagaaggaaatggcaacccactccagtgttcttgcctggagaatcccagggacgggggagcctggtgggctgccatctatggagtcacacagagtcggacacgattgaagcgacttagcagcagcagcagcaacaactggaaaggttctggtttctggacctcgaaataggactgaagtgccatttcttcagcctggcagatccaattattggcagacaaacattactgtaaacaccgatctagatttagatgcaatctagatctaaatctagatgcaatagtttatctagcggggttgctttttcaatgatttgacttgtttacctgttggctgtgctgggtcttcatcgctacatgggcttttctctggttgcggcgatcggggcctcctctctagctgtggtgcatgggcttctcattgcggtggcttttcttggatagcagaacatgggttctagggcacacaggcttcagcagttgcagctcataggctccagagtacaggctcaatgattgtggtgcatgggcttagttgtttcgtagcatgtgggatattccagggattgaacccaagtctcctggattggcaagtgaattctttaccactgagccaccagggaagctctcaagtaaggttttctccccacaatggaagattgcgttgtgaatacctgttattctcccactgagctttcatcacccactgtct

SEQ ID NO: 49603 - DNA, 3313 bp, Bovine  19866880589525
attccttgtaggcttttaagaggagagtcctaactagtcactctgcagctcactactttctctttctttttttctagattgaacacaaggcatgaaccatctggggaacattgagttgtttttgaagttcatttcttgatatccagaaaagctgtcttggtgtagcaccttacttttccagtttatcaattctaactccaggttctacaacttgaactatattttaaagattttttttcctcccttcttttcagaaagcatgttagtaattgcatcaggtggaatgcattttccaaaacaaccgtgacaaatgaaggcagaaaaaaagtcagaagttactataaccctaacttcagaagccctgcctgttgcacaaatgccttgacattctcacaaatcttgccaaaatcttcttttacaggagatcagtattccagctagaacctggccaggtcaagctctttttttgttgttgttgttgttgatcaaatactccaaaatcaagagccagtttgggataagctgaaaatctgattatgttcataacaaaaatgaactctctcaacccttaacacacagaagatttataatgatttatagcgcctcattgaaattctaggtgcactgaagtttgacttagttgagaatgaaaatgaagggcaaaagctttgcccgctattgcaaagacaggctcagtgtgatgctgctacatcaggttttctgtttatccctaaggctggtgcagcaatgacttcaaagtttgatggtgtctggggtttttttcctacgttcttttttttgttttgttttttctttctctaaagaagttgagcagcaggctaatggatccccagcagggtgcaaagacagcggaaagcgagggaatcagatgtcaatgtgttcctccgagataccctgctaggacagctaactaaccagggctttagtcttctcttggggaacacgctttgatggttccctgcccactcctggcttcctatatgcttcctgattaaaatgctgtcacagataaatcatgacttctgcgaccgttttcttttcttttttttttttaaggaaaagtttggaaacataagattaaaatgatgagcaagttctagagaattttatgtgcacatataaatgtgtatttaagcacatcacatctccctactgtagaaccatccatgggtctgggactattctctgcatgttccttcccgacccattactttatgaggtatgtttatatattttctttcagtcactttcagtcaatcactagattactctggaaagttcctgttgaacagattttgaggggttgggggggtttcattgttttccttcagcataagcacaagttgggaattgaagttgtctcagaggtaagagtttccactttagatgcaatggacattcaaaatctaccagtgtacttttgtgggttcccacctaggcacacaaaataaatagcccttcgggtaccacagagtattaataatttactctttgtttggagaagagacaaaactcagcaaactggagtggaagtggaaagtgcttcatctattttgaccaagcacaaccctcttaagctgattttacccagtagaagtcaatgaagtaaaaaagctgccctagaaccatatctgtatctattgccgggctgcatctccatcttcacctccacaagccccttcctgtctggggctgcacccagcagccttagccagacagtgcgtttgattggcttctctcttcatgggccctcatctttctaaattgctctgactgccaagaaggtttctgatcatgatgtacgtatctgtttgcttcaggctctatgtgaggtttcttgccactcaaacctgctctaccttggggtcagggctctggccatgaaaaggtctcagagctactcttccatatcattttgccctctgcccagactaactcagcaaagccacactgcattcttatgttccataatgaggaagatgatgtcatctctcacagtttggggttcctgtcagcttcatgctttcccgtttgcctttatcctctcagactctttattagtgctgctgctgctgctgctgctgctaagccacatcagttgtgtccgactctgtgtgaccccatagatggcagcccaccaggctcgcccgtccctggggttctccaggcaagaacactggagtgggttgccatttccttctccaatgcatgaaagtgaaaagtgaaagtgaagtcgctcagtcgtgtccggcttttagcaaccccatggaccacagcccaccaggctcctctatccatgggattttccaggcaagagtactgaagtgggctgccattgccttctccaacagctgtctcttcaagatagttattttgtatcacactatggtatttctattttcaaattattttggaatcttcatactgtttttcatagtggctacaccagattacattcttgccaacagtgtacaaggattctctgttctctgcaacctcaccagcatttatttctttctttttttttttttttgataatagacatcttaccaggtgttaggtgacatctccctgtggttttgatttgcatttctctgatgattagcaatgttgaacaccttttcatgtacccattggcaatttgtgtatcttcttacaagatgtctgttcatgtcctttgtccatctttgaattgcccattttttactttggagatgtgtggttctttgtgtatgttagatattaacctcttgtcagatacgtggtttgcaaatattttctcccattccatatgttgtctcttcttcattttgtttatggtttcctttactgtgcataatctttttaatttgaaatagtctcatttgtttatattttgttttgttgcatttggttttggtgtaaattaaaaaaaaaaaaaaattgccaaggccaatgccaaggagcataacctgtatgttttgttttgtttttagcagatctcgattgcaagtctttatttcattttgaggttattttgtgtttgtgtaagatagaggtctagtttcacttttttccatgtggatatctagttttcccaggactatttttttgagaaattattctttcctcattgcatattcttagctagtttgtcaaaaattaattggcctttttatgtatgggtttatttctgggctgtcgattatgtttcattgctatatgtgtcagttttcatgtcaataccatatagcttgatgactatatatagttttacaatatagtttgagatgaggaagtgtgatgcctccaa

SEQ ID NO: 49604 - DNA, 961 bp, Bovine  19866880591517
tgtccgactcttagcgaccccatggactacagcccaccaggtcctccgtccatgggatcttccaggcaagagtactggagtggggtgccattgtcttctcccttaacagcggctagacatattatatttagttggagctggtatacttggtgacagtcttagtgcccttggacacggcgtgcttggccagctccccaggtagcagcaagcgcagggcggtctggatctccccggatgtgatagtcgagcgcttgttgtaatgcgcgatgcctcgcataagaacaaagggagggacattcccactggagtacactgggcagagtttgtccaaggaatccagtttagccgtccagtgacaaccaagtgtctctccttttgtgactgcccaacagaaatatatcacttctttttctcaaaaattttctaacattataatatcataaagtttaaaggttgggaatgaggagagaatgggtacttccccccattatccatccctaccagtttcctccgaccatgggattttccaggcaagaatactggagtgggttgccatttccttctccaattatccgtctagtgatagataaaaatttaggaattttttaatgacaggaccgtattgaaaaacacacaaaattgtccccactctgaaaaattaacacaaatagttcctattcaaaatgacattgcttttaaggatcttttccaatctatcccatactctctcactataaaaataaaagcctgcactattttgtggcaataaaacattcccccttcctttgacttgtacccagttctcagtgacctgatgacttgatttagtggcagttacctatatctgaagacagattttggccccaaggagttgcatgctatgaagtccaaataaatccgcttacaaatctcataaaagagggaaaatacctatttctcatcacagataaaggaaaagaaa

SEQ ID NO: 49605 - DNA, 1102 bp, Bovine  19866880595144
cttagtatcaagcccataataataaatataatcacctataattacttatatagtatgcaggcaataattttacattattttgtgctcaggtttcattttctttataaaatttttcctaatctactagagaaaattgtcacttcaaatctaatagaaatcaatctaatagaaatattataatatttctatacatatgcatatatattgaacacacacctgcactatgtgtatttgtattgatcctgcacaatcttcgagggtggggactatgtcactttcaaagttatagtctgatatcacgggccacaaaatccattcagattgtttactgggcttatcattataaagacttaaagcctccattctacacattaagtacagtcaactatgcacacagtctgcctgaagataatcaccctcacaccagttatttgattttattatatttgcccaaagataattcaaaataacccaagtgatttgcagactggagttccctatctgttcatcagtcagctagagagaaagactgtacaaagttcaacattcccaagagaaaacctcctggttgtcctaaaaaaagacccaccaggctgctaatggtgctctagaggcctggagcattattaagctctgttctcccaggtgaagagttgtacattagaagtaggaatggaggcagcagtgtcattctttcaaagcaacgcctgataggttaggttgcgtacagttactctacctgccacctacctaatgtactacccattatcttcccaataacagatatttcagaaggcttcagcagcatttttaaaaactggtacccctccagaataccattgtttatgcagacctttacccgtatctcagattgcctataattaaattttccttgcgctgggcattcagcatgaatgttggtttcaattactgctcattcattgttacaagagggaagaaacagctggcagtaaccaaagatctactgccaggcctaccttcttccgccttgtgaatgcaattccctggtgtcgcaatctctgcacacatctagtggttactggagcaggcttacccaggctcaggagccaacagcacacac

SEQ ID NO: 49606 - DNA, 2234 bp, Bovine  19866880607588
tctagattccagtttgtgattaatccagcccagcatttctcatgctgtactctgcatataagttaaataagcagagtgacaatatatagcctcgatgtactcctttttcaattttgaaccagttggttgttccatgtccaatgcttctttttttttctcctgtctcatttctcatgttctcttcagagataccaagtatccttattttggactttcttttactccatatttatcattctatcttatcttttaatactgttttattttccatttcacttctaattttatcctccatgcctctgaaaatatgttagaaattcttttcttctgtttttaatgtaatattcatttctgcatagttacatattttcttctatttctttctaagctctgccaactaagttttcttatctatttactgtttatcttttattccttgagtccttgtatctcttctttgaacacttttttcccctgagagatcacactatcttgaatttcatttcatggagaattggtagcaatttttctgctgtgtgtttctcaactggtgtttgtttttacattcttttcctccttttttccttttgatatctttccataagctccaggctggtggctttttgttttggctgatatagtggtaaagaatccacctgccaatgcgggagatgcaggttctatccctgggttgggaagatcccatggagatggaaatggcaatctactccagtatccttgcctggaaaactccatggacagaggagcctggtgggttacagtccatggggctacaaagagttggacattgagcacccacacacgccacatctttaagtaaataatggagaaggcatgacatcaggacagtgggtaaggttgatggcagttgaattttggtctttgagtgcttttgcaacaacacacttttccaggcaacccctgcctaacagaggccgcccttgcttactatgaagtcctaagtgacatagatatttttgtgtgatgaaagccttaaattctctccaggagaccaagattagcagctgcacagggtgacacaccactcacattgtcaactctcctgacagccttgtttccaagacagcttgtctgaaactgtcttgtcccaccccacttttcccgccactctatggcagcaaggaggagtccagaaacattcctaaagcctgcccaggcacccatccatactgctccaagcaggtgagccatgcacgccttgttgtgatgaacactgtactctgtcccagatgctggatgcaggccacctcagtcagctttctactgtaccccacccaatcttcaccatgctatgtgagctgtgtgtggggtgatgattggagtagagttatgaacgctttttcttctgtgaattatagttttatttcttgtccttggtgtttttaggttggtccttaactggcagaaggtaataaaaatccatttagcagatcctctctcatgacaccttgactttcaagttcactctcttactgcaaggtccagtacctgctccctttttccatgagatgataaattctaactctgcttgggaggataagatgcaagataacataactcaaagggagaaaattaagactccatcaatttaataattgtgaaaatataatctcatttatgtacccatattttgataaaaatcacttccttttacatttgttttttctcctttattacttaaaaatatatcaaggatactgttcctatacatatagataaacatcattattttaaaggatatatatatagcatttcattatataaaacttctgttgctatttgatttatattcttaaaactataaatattacagtaaaacttcttatatactgattttgctctcttactcttctccatctccttcactatgttaaattttaagaggagaaattgctgaatgcaaaggctatgctcttttaaaactgaaacgtattttaccaaacttatatccataaaggctaccccagtttaaaatctcatcatcagtaataagaatgtccattttcttatacccacacacatacttgctattataattctcttaaatctttaccagtccagtggctaaaaaatcatagaagtgttttaatgtgcttatattctctaaagaattgtgtgaatgttttagaaaacctttccccgccgaagactataaaacaatactcaccagtatttttaagttcttttttaca

SEQ ID NO: 49607 - DNA, 1104 bp, Bovine  19866880619286
ctctgtccgcgatctgcaggctgctcctcttccctgtaactaacgatgtagccgtcgattttagcgcctccgtcacgcaggggtggtaaccaggctaatacagcgctgttctttgtcatttcagtaacctcgagtttcctggggggatccggctcacctggaagaaaaatatgattaagaaaaaactgtccaggtcgccaaatccatccctttgtaatatacatcaatgttttcatatgccacctgcttcaaagttatgtgggaaaggtggttcgggctgttgaaagtaaaaagtactcgaggaggcagatcagaagtcttcagtgagtgagtgagatatttttttgtgctgtgtaggtttctacgagttaaagccctttagggttttggtatttggtaagtgtttgtgtcttgacttgattgaaatcggggactggggttaagaggggagaaaggatgtgacttacttagagggtctgtcgcaagcactggtttggggacatctgttgggacaccggggccatactcgttgacagcagtcactctgaagaaatactctgtcccagggacaagattggtgacgtggaagctcgttttcttcacttctggggtgactgtcgcccatgtctttctctcggcctcacgtttctccacgatataatgtgtcacctggctcccgccatcattctcgggaggggcccaggaaatgtggcacgatgttttagtgacatccgagacttttaaatcagacacgggcccaggggtatctgtaaagaaccacaagattagacatatgagttccctcagcctcctgattaactaaggagtttctgaaggggaggaagacagttgttcaccacccacctaatactctgacattcacaaacacggccttttctcccgctgggttcacaagcgtcaaggagtattttcctgagtcgtcacgtgtagaattggggatgacgaggaaggccatggtgtcaaccaaaatcgacctgtccctttctgaccacgttatcaatacccacttttctccaggtgaccttaggggctggtcgccctctcacgatggcaaatagtcggatggggcatcctgccctcacg

SEQ ID NO: 49608 - DNA, 837 bp, Bovine  19866880640741
gctgtggaaatatttttgattctctaataaagagtaaataatacagtttatccaaaagagaatattcttaaaaattgtaattacctctgagaatagttttcctttataataatttgattacatggaaactttagattgaacccactttatggatccatataggagatctgtacaccagcccatctaagaaagagagtcaatggattatacatttatattctaaaaacaaatcaggtcatatttctcatcatgccagttactcttataaacacacaccaggtgagtaaagccctttttctgtcttatctcttcatgtcttactaaatgctgagatcattcagtgtgctcagtccctagccacagtatatgagcaattcttggaagagtcatgaactgcaaggtgaaggaaaaaagcttcttgttcttatctagagtgattggatataaactataggcatgagacagcagttatttttttattctttcagaggtcacaaaggataaatgattacaataacatttcacccactgactttagatttttactagtaaatcctgttattgactttaagagctgcaaatcttcaaatcaaatatttctgatcagaccataaatccttaaaattcaaatcttttttctgaatgaaagatctatgaaaacagatgatggatttcatgggctgtcaaaggaaaaatgttgcatttcacagtttgtcattgaatatgatataaaacacccgaaggtagattatttatattgataaaactattctttggcaacagaagctgctttcttggggaataaaaataaaatatcgaaatacctagaaatttttt

SEQ ID NO: 49609 - DNA, 1935 bp, Bovine  19866880713031
gtagaccaactccgacagctgtatggagcaaaccggactctaaccttagcattcgggctgacatccacacaacagattccttcagcaccctcactgtggaaaattgcaacagaaccgacgcagggaaatatacccttactgtagaaaacaacagcggtagtaagtcaatcacattcactgtaaaggtgctggactctcctggcccacctggcccgattaccttcaaggatgtgacccggggctctgctacattgatgtgggatgcccctctccttgatggaggtgcccgaattcatcactacgtggtagagaaacgagaagccagtcgccgtagctggcaggtggtcagtgaaaaatgcattcgtcagatcctcagggtcagtgacctgctagaaggcgttccatactatttccgtgtttctgcagaaaatgagtatggtgttggtgaaccctatgaaatgccagaaccaatggtagccacagaacaacctgctccacctaggagacttgatattgttgacacaagcaagtcctctgtagtcttagcttggcttaaacctgaccatgacggaggcagccgaatcactggctacctgctcgaaatgagacaaaagggatctgacttctgggttgaagctggtcacaccaaacagatgactttcacagtggagcgcctcgttgagaacactgaatatgaattccgcgtgaaggccaagaatgacgccggctacagtgaacccagggaagccttctcttctgtcatcatcaaggagcctcaaattgagcccactgctgacctcactggaattaccaatcagctcataacttgcaaagcaggaagcacatttaccattgacgtgccaatcagtggtcgtcccgcccccaaggtaacatggaaacttgaagaaatgagacttaaggagacagatcgagtgagtatcacgacgacaaaagacagaaccaccttgtctgtaaaggacagcatgagaggtgactctggaaggtacttcttgaccctggaaaatacagctggtgttaaaacatttaccatcacagttgtggtcatcggaaggccaggtccagtaaccggccccattgaagtctcatctatctcagctgaatcatgtgtcctgtcatgggctgaacctcaagacaacggaggcactgatattaccaattacattgttgaaaagcgggaatcgggtacaacagcttggcagcttgtcaattccagtgtcaagcgcactcagattaaagtcactcatctcacaaaatatatggaatattctttccgtgtcagttcagagaacagatttggtgtcagcaagcctgtagaatcagcaccaatcgtggctgagcatccatttggtaagaaaattaaaatcatattaccaagtctctatgattaaacatttcccctgaatgttatttatattctgtatttgtattttgaaactcaatttatattttgatacctctgtttatatttagtcccaccaagtgcacctaccagacctgaggtttactatgtgtctgcaaatgccatgtctattcgctgggaagaaccctaccatgacggtggcagtaaagtcatcggctactgggttgagaagaaagaacgtaacaccattctttgggtcaaagaaaacaaagtaccatgcttagagtgcaactacaaagtgaccggtttggtagaaggactggaatatcagttcagaacatacgcactcaatgccgcaggcgttagcaaagccagcgaagcttcgagacctgtgatggctcaaaacccagtgggtaggtgtcaaaatttaagggtacatttgtttatcatcatcatcagtactagcagaattcagagttgtatttaacctcacgtttgcctcccttccagatgcaccaggaagaccagaggtaacagatgtcacccgatcgaca

SEQ ID NO: 49610 - DNA, 820 bp, Bovine  19866880784444
tctttcctggaatgctacctccgttcactccgctaatttctaagcttggttatagatgaccacacagcattatgaatggaatttgggtattatcctacacctaacctattctgtctcttctctgagcccccagcctcttgaatcaaggcaggttgttttgactttaaatagtatttatgccaagtttaatatctgagattttcttttttcatcatcagtgaaagttattgaaccttcagcaggaaattgactgtgggggacacggctgagtcagcgtcttaaagggcacatcccactcctatggcagcagcctgagccaacggcctcgctgcttaggacaggaccataaatatgtgggtgccttgtgtttagatgtctgcgtgttcataaggggttctctttatgaactgtgtcttaattcaatgccacatcagagaaaagatggctatactttgtcactcttgggtattgaaaatattgggggagggaggtgatggaaggggaaggcagggctgcaggtccaggctgaccttttgtcctgctgaactaagcagctctgtatggagggctctgcaaggacccacctggtcaagaacatcctgtggtgaccctgacctcctctcagatcaccttaaatagccactgtctgtcacttctttccatttgaaaactgtctcccagaggacactgtgagcatctgcttttcctgggagaagattctcccatcttctctcctccacctatcgttcacacagtgggttcaactgcattccttacttgaagacccagggagtctgagcctgagagaatgtaatcaaag

SEQ ID NO: 49611 - DNA, 2451 bp, Bovine  19866880795855
tatatgatggctcagatggtaaagaactcgcctgcaatgcaggagaccttggttccatcctgagtcaggaagatcacctggagaagggaatggctacccactccagtattcctgcctgggaaatcccatggacagaggagtctggcaggctacaatccacagggtcacgaagagtcggccacagctgaatgactaacactttcacttacatatatatatacttttctttctagaagggttttgaaactttttatcctaggtgagtttgcaacattctaacttaacaatggatattaatttaatagagacttcaaattcaaacccccaagcctcaatgagttaaaaaacagaaattactgttatgtatgtatctctcaatagactgtgagcacagataatgtatagcagagctttctttcaggattaagatctatttgtacatctttaagaagcaagaagacagcagatacactcctcatgctaccgatgcagaccatgaggcacaatgaggtaaagagattgccctgacctggcactgtcagcatagagccctgctgtctcctagggctgtgcttcctgaataaataatcccatctcccaggtgacacggtttcatatctaaatcaagaaaccacatctctcaaactgaactccatgccaattaccaacattttctgagttctaaaagaaatctaaactgagtactttggaaactagaaactttcttataggcttatcaactggattttgaagttataattgaaatacaaaccttgccaaaacacaaaattcttggattcacagtgacaggcagaaatgggtggatgatggctaacctgaaagttaaaaacaaaaaaagggcaatgacatcagtgttaaaacttccaacaatgatcatttttcgcaacatgtatttggctaaataaaagttactcaacttatccatctctgttattgcattattctcaagatgtgtaagtaaattaccaaatcttacaacttcatgcttaaaaacatttagaggatataattacataaataagctaagtgaattttctgttaactagtattataacccatctcaaccagatgtttacaaaaacaagctattttcatcatcaaacagccctcctacagtttctacacagaaacctgagtccagtggcacttacttgttctgagaaaaatcggaatcctttgtcctctctaatgcattcataagtctccccaaggacagggttgaatggcttacttcctgctctgaaataggtggagcaatatcctgaaactgcaaatgcagcaataagaacctgttaaaacatttaagaaaggaaaataatataggagagactacttccaggcctgtttgtcccttattcctctagattttatatacccacatcagtgggtgccgatttgatgacatctgcattttctattacttgcacagactcttcatatactcatggggaaaaaaaaaaaatgaaaatgcagttaaactctttgcatgggaaccagcaggcaactgagcccaaatattcttcattcatctgtccatccaatttcttgagtattacagagttcaaaggttctgaaagccaggttatgccatttacacaatcttagcaggaaagttgtgactgctggtgcttttcagagggcaggttaagttttccagagtcacgtggagtaaaagccagggcagggaacaaacaggaagttaccttctcagacccaagttcctaaacaaatgggcttccctggcattcagaaaaagctgataaaagcaaggccaggcatgtcttaaacctataaagaagtgtgatgcctttagattctgacttcagaactactcggacccaactgtaagtcacaaagagtgtatctttcaatagagctatctagagcttttttggccctgcctggtttatgcaaatggatttctcttacctatgcagttagagtattaggcaacaagcaaatacactaccctaatgaatcttccctagcccaggtctaaggttggcaaatccaaagggatttgctctgccatttattaccatgcgctcatagggactgtcagtttccgaagccttgtccaggagctcactgtattccatttcctcgcagagatgctgcagagtattgagtggctcgtttagctccacaggcatggagactttagacaggtctttaccaatgttgttcctcaatatattccacaggttaatgttactggtgtcgggacagggagctggcaggcatgttcgacgtccgtttcggaaggctcctcccgtaagctccccgttcaagactagaagaaggagaaagatgagaatcacagtgaaagatattttgcttttctgatttcccaaaacctgggagggaaagaaccctttcaaataattctgactgtgatacatttcttaagccttccttacactctcccaa

SEQ ID NO: 49612 - DNA, 1197 bp, Bovine  19866880809576
aaccttaggaggatcttagggtatgttcctgagcttctcttaatatctagggaagagaaaattagggagagaatcagaaagttgcaaaatccaaataacctgagaaaggcatcagtttcaagagactgctcctcactgacgtctctggcaaaaagggcactttttccgaactgagaagcaatacccaagtctggaccaccagcccacatggtcatggggttaatacagacctgtgcaggttatgtcaccaacggttactctgaaggtgaaagtgggcacgtgtatttgcacatcggatctttcacattcataaaccgggatgttcttggtcttcatgccgtattcgtgtaatacctgaattggtgtttttcctggcttagctgtaatcatcttccccaaactgcaaaaatcagaaaaagctgtgcgctgcatgtcaaagcggggagggaagcagaagcaagcagagactagttttaacagccatcaccggtgacgccggaggcaccgagcctctggtcggacagggttagagctggcgaggcgcgccagtctccgggccccgctgcggaggtcttaaagaagataacttgaatgcgggtaggagggattcgcaggggaatcgagaggtacggctgatgctgcaacctcccaggtccagcctgcaaatccctttccctccgcggcagccgctcaccacctccgtccagccggcgctgcccgaggccgcagggggggcggggtccccggccggctggcggcccagaggacggggtggagcgctcgctggtccgcccgcccgccttcttgctgccgctaggacgcgagcgccgggaaggggctttacccagaatgctgctggatagccggctcccccgccccctgctgcccaccactccgggccctgcccggctcggtcccgaccgctcagaaactgacctgaaggttccgctgtcctcgcgctccatcggcggagccgcggcgcgatgcctgctctgagacatggcgagaagggacagctttgcgggagcaagagcagtgcagagcgacgtcctcgcttccccggtgggctggtgcccgagaggagggatgcaacgccgacgccgctacctcctcccctctcctcactgcttgagttcctcccggggacgggcggggctggaggcggagcctcggtcggcagcgcaggtcccgctccca

SEQ ID NO: 49613 - DNA, 2111 bp, Bovine  19866880829725
tttatcagttttcttattccttcacatgtatgtccttgagaggaactatgatcttaagctcttctaaaagcagtcagtaagactttatattattaagatgaactaaagtgataaatataaccaaaacccccccaaaacaagaacaaacttcacaattatgtgaacagctgtgacactgctatcaggtattaaaaataatgggatcatataagtgtggagtcatagagggctttggatttcatgcagaccaactcctttgttttccaaatgtgtaaactgagacttaaagttgactctcctatggtagttaacagagaaggcaatggcaccccactccagtactcttgcctggaaaatcccatggatggaagagcctggtaggctgtagtccatgggatcgctaggagtcggacacgactgagcgacttcactttcccttttccctttcatgcactggagaaggaaatggcaagccactccagtgttcttgcctggagaatcccagggacgggggagcctggtgggctgctgtctctggggtcgcacagagtcggacacgactgaagcgacttagcatagcatagcatagcatggtagttaatggctaccaggagtatttagttgagagataggacattgctgatatttgattgtttttaacttaagaaaaatctctctcctatggttcaaattaattatatctaaatgccctgattgtaaatccagcgttttttaagtaatagcaagtgaatactactaagagaacaattaaatcaagtatgtttgtcatacgagagaaaaaaccattaatctaaaagtaaaatgattagagataggtttggttcacttttttttttcttctcattttggctgaccaaaagtaaacaaatttactggcgaacacaagttagcaaccacataatcacagaccttggcgttttctcgggaaatttcacactcaaatcgggccatttctttttctttaactcgaaggtcagtgagtggtcttaagaattccacatgaggagctgtaagagaaggtcagaattcaaaatgaggtttctagaaattcattctgacattactatagtgcatattaagaaaaagtgagtcttttgcaggctttttcatattaggctaccactgatttgcaagtcacttggagctgccattcagttgtgatgctttgcattttacacatctctgtagtttttataaaattatgtagcatattatatgcccaactaattcttcctatcaccagcttagttcttctgaatgatagctggaaggaaaaatcttcattgatacttctccagagttgaaagttgatattgtcaaagaaaataccagtagcaaagaatcattatcttatttaaggcaggcagaataatctttgagaaattagaagaattcaattgtagtacagcttggagagctatggccagtcttgtctatagctaagaggcataagtctgcaattgaaatcatatacgttcagcttttttggtgtgtcagcttcaaataagtcaaatataaggcataaagttcattagtgcaactaagcaacaagctttgagtgggagggggtgattcttttatatatatatatttatttatttatagttttatttatctccagaattaagttggtggatttataggattgaagagctgccaacatgtccttcctttttccagggctctttgtgagtccttcccaagatgacctttcttgatcagtgagattctgggacacaagtgctggctaataggcttgaagatatgctcattgtagctgagccttcttggagtggagacaaagtagaggacagagaagaaggtgacccaagaagctattctgtcttaagtgaaagtagagcaaccacaatgtggaaagaatgaaactgactaagatgcacggaagcacaatcaaagccattacgagctgttaacagatgggaagcaactaaaccaaacagcaagtgtattgttttctaattccacacaagaattaaaaaatgggcttgattctttaaaaataaaactgttttccatgctagggcagggactaccctagtttgcagagtgcagaaagtaagcttgatgga

SEQ ID NO: 49614 - DNA, 1199 bp, Bovine  19866880837312
cagcagctagttatgtcaacagaacagtgggttcaattttaactcttctgagtgaggctcctaggccccctggctcctcggttcctaccaggcccatcttaacagtcaaactcaagcctgaagctggcagggttctaggatcaagctgagatccctgctactgatacatatgtacaaagaagttggcttatatctttcctacttccaattgtgagtttgtgccttgccttaaattttaaatatatcagactgcccccgtttactcatttttcattgatcaaggaaggtatacaagatgccttttatacacagttcctgggtcatagccatcatagcctgtttctcattttatgtcttcacggatgtgactgccctaattaaaacccgagactacagtatagttaacgctgaagaatattctttctgaagttaagatattagcatcaacactatattcagcctctgtggttggggaaaaaaggtgttaaaatcaggcatatgaaggaaatgtggaatctggctccgtatttttatggtttaatgttctcaacactttctttgcccccaggtcatgcagatgtatcttccattttgtggaatcgccatatccaatgctcagctctttgctgcctcaaggaaagaatatgaaagaagcagggtgagtagaaagaagcattgctgacagccctcagagctctttgtctttcaagtatctgtgagtcattatgtcttttaaaaacagtagatgatctttgaatagtacagaaacatttgtttttaatctgtataatccttcaagtttctggttgatgatccctttaagcaataaacccaaatggaagtggatataaatcctctgatgttgtgtgggggaaatagcttcttttaaaaaggaaattaatttcacatctatactacaagacaatagatatattctagcttacctacagttttgaaataataacacaaattagtgatctttttacaatttagttcctttaagaagcaaggtatattatagatgatttcaccccaactcacaaattatgtttgtgaattgaaagttttcctggaagaggatgataatgctgcaaacaccagcttatagaattataaagaagcatagatatagggattactgtcatataccttcaccagttgtagggctaaaagtaaaaacaaaacaaaaacaaagaccg

SEQ ID NO: 49615 - DNA, 2457 bp, Bovine  19866880868565
tggaatctgctttgctggcttgttgcccttctagggattctttgaggggacaatgtcgcctcctcctagactgcagtttaccaaagggcctgctcctcatgaacaaggtactcttactagctgatgatacatccctgctcaccaacaagagactgtccgtttcagaagaaatgtattactttacttttcagagcaaagtatgcactaagaaagctgtagttgaagagggctttaacctttctcagatttatttgatatttgtacagattaaggatgaaactggtagcatatgtataatgtgcttgtgtatgcacacacacacattgtgtttgtgtgtgcatgagtgtgtgcatttgcctcaaaacatccagtactgactcatggaaatgtgagtttatttgttctacagaacaataagtctggaacagggcagaccagggtcagcttcatttctctttccctttctgctctagatctgtaacaaggcatctattcacgcttatggccataacctcatagatgacagattttgctgaatgtctaggccttacagctgttttctagggaaaacaaagaaaggatacaggcagacccaacactcccacatatatttcatcaatcagaggaatgtcacacggccacccaacatgataacccctagtggcagggagcctgccaattgggtttttgattttcaaactctatcagtaagttatgatgcgatgataaagcacaaaagctgatttcttgctcatgtgacacagaatcagcagtgtgttggctatggctcagctccatgcatcttcttcacctggagacccaggctgagaggggcagcacctctcagggccatgcccgtcctgtggtggagggaagagagcatggcagaaccacatgatggctcttaaaggctgttctcaaaggtagcatcatcactttcctccaccatccattgactaaaataaatcatatactaaagctgatgtccatgaaacaggtacatatcatcctcttacaaaaaacattgcaggggacttcccttatagtccagcagttaggaatctgccttccagtgcaggggacatgggttcaattcctggtcaggaaactgagatcccacatgcaacagggtgaggccaattaaaaagaaaattgcagatgattgggaataacaatatatctttcctagagaacaaaagcaggcaaataagaatagaccagacatggaagttgagtcagcaaattacagtgtctgccacaggacacaccacagagacacacaaacacaaatatgcacatatatacgtgtgcacacatacatataccttttaatttatttgcatttcaaagcgtttcatgggagaaatagtcacaccttgggaactgttgtcttgagccacatcatgtcccttgggtaaaataactacttataaaaatatcctggtataatatacgtagcctttaacgtggactgtcattccattcctcattgtaatagatttctctgtagttgcacagaagataatctgtatcacagatggttactgggaattgctcatcatatattagcacccactattacgtcaaggtggtgtacttgaacaaagtttagttttgtgccaggagaatttcagaaaattaagtcatgtttagttattgaagtggtttttttttttccctttttttctgaaccaggtgctatcttatcatgcaacatgttcaaaagctgaagttgacaagtttaaggtaaggaagcaaatagtgcataaagttaaacttcccggggcttttggaccctttgtatcttgcctctaaactagtcctgccctctggatgctggggaaatagaactgggtaaggcccatttgcatatttcagttttagaggggaaaaggaatttacgtataactgaatggccccttcctaatcatttaaatgattcagtatttctttctttccttttttaagtatgcaggatatcagaaaaaagaaatctgtgtaatatgatgagaatcaggatgcctgattttggcatttgtcttacctctttctgttcacttaaaatcttagggtatatttcttcatctgtaaaaagaagtaaagagattagaatagtagctaccatttaccagctgcttactatggaccaggtacaatacaaagcattctatctgtattaatctgtctcatactcctatgaagtaggtactcttttacagatgagcaaactgaagcacaaagatattgagcagacaggccaatgtcaaacgattgtaagaggtacagtcaagcaatctggccttagaactggagtcccctaaccactgtgctacactgccacccagcaagacccccttccagctctgacatgagtctcagacattccgttccccttagtcaccctccttcccttcaaggcaggtcaggattcttgctcctctccctgcacttctgagt

SEQ ID NO: 49616 - DNA, 2405 bp, Bovine  19866880875985
aacatatccgtatctgttttttttttctgtctcttaaaaaaaaaagtgtttctgagtaattttacaaatcctttcatactgactcaattttttcacaatttcccagtggctttttttgttttgttttgtttagtataattgaagtttcttttaggtattttgtacacatttctactttcaaatacaggatgaggcttcaaaataagccttgaattattctcccccatcatgaagacagagaatcacaaccctcgaggaacctttaagtgtccattgctccttttcaatgtttgactaaatgtattttaaagtctcagcttagtagtttgacatgataccctcgtacactggataatcatggaacatgatggagggtttgcagttactattctcttaacctgtgagacagggtgacaggaatttttgtcttcttaagcctgaaggcaaattcatttttctctagatccaaaatgccagttgttttaagatttgatcccaatgtttatgacttgttactgtggatgtttccattgttttacaaactaaggacccatccagttatgaacaagaagactgtacaaatcatggcaaacttctaatctacacataaatttcttaagtaaaagaaaactggaaactaaactgcttagttctttcttgtcttcagattgttgccagggggaaaattatgcacagatcattgggttaaacaaggattattgttccccctgccgtacacaaagcaataagtcattctccttcttgaaattacatcttctctaggaccagtatataaaacacagttccatttgtgctggaagtacaaggtcacagccattcacttggaagatgatccttcacagatattcccagaaaaatactttggagaaatactctctgcccttcatggttcaatgatataaaatctttgtattgcacttgttatgggctctaaaggcagagtgcttatccaacagatagacctgtgtgtctggtgctatatttagaaaaatagtcattgactggaagatggtagaatacatgccaggtatatagtttgttacatttactatcttagaaagtatcaatcattataataatatcaaaatttatatttatagacactttaatcttcacccatgtattaactcatatgatcctgtcagtattcttatgagataggtaagattactgtgaaactttttattatagttgaggtaactgaagcctgtcttgtctagtaagaagttaatagtagaattgggaggtcagtgttgtttcctctccttttgcctggcttgtcattttttgtaaacagcaaattgactattcctactactaagaaagggcttccctcatagctcagtcggtaaagaatctgcctgcagtgcaggaaacctcggttcaattcctgggttgggaagatcccctggagaaggaaatggcaacccactccagtattcttgcctggagaatcccatggatagaggagcctggcaggctacagtccatggggtctcaagagtcggacacaacaattaaaccaccaccacaggcttcatcagacttttcagatggggtgggaagggcttcaactcatcctgtaaaagtatcagcacaagaagatatttatatcctgattgtgggggcatttgggtgaaatctaactggtagtcttcccttgggtatgtcccgtgattttgaactggcttgagtaaagaagtgaggaattgggtaagtctccgggttattatggacacataaatcacaggcaagcattacttgtttttactgttcttttaagctccttcgctgaaaaagccttttgcaccaagtcctacagtacatccctcccatagtgggtggcatcacgtaagctcttagtgagcttccgttgttgggcctcagggattagaaacttcagttcagttcagttcagtccctcagtcgtgtctgtctcttggcgaccccatggactgcagtacgccaggctgccctgtccatcaccaactcctagagcttgctcaaactcatatccattgagttggtgatgccatccaaccatctcatcctccgttgtccccttctcctgccttacatcattcccagcatcagggtcttttcgaatgaagtcagttctctgcatcaggtggccaaaccatttggagtttcagcttcatcaccagttcttcaaatgaatattcaggactgagttcttttagtatgaactggttagatttccttgcagtccaagggaccctcaaaagtcttctccaacaccacaattcaagacatcaattcttcggcactcagctttgtttatagtccaactctcacatccatacatgactactggaaaaaccaaagctttggcaaagtaacatctctgatttttaatatgctgg

SEQ ID NO: 49617 - DNA, 1143 bp, Bovine  19866880886221
gggtgccattgccttctccaaaataaatcagcattgttacttaaaataatttgaaatggccaaggtaaataattattttctggtggtgatggtgaattatactaacatttattcctgtgcctttttcttccttcttattaaagagacagcatactatgattgaataggaaagattttgtgatttctgttaattatttttttcttcagaggagaagctttgaaagtctgtcagaacatatacttagacagtagtgaccatgatttccagtgaatgcaaatatggtattattattacaactccattaatagacttttgctttccaaagtctttactatttttccacgaaacatgtggggtagaaattacatattattctcagttaaggaacaggttgtgttccaagggtttatttgtaagtcagctgcttggaataagattttatttcccttatggaaatgaaatggtgaatggtagttagattctttagactgcatggaggagcccagctaatttgtagtgtggctgaaatgagatgaaacaatagtgttggatttctagtatttgattatattgaaaacattcattaatatagagttgtttgacttaatcagaacattaaacaggtttaagtagaggggaatgtgaagttcatgaacatggttgagattctagaaggaactgctgctcactttcagatctcaagaagttgttggcatctttttttcttaatgcccatttttcttacagaactaatctatttattgatgtagaacactactgtgtactcattatcattttgaatttatgttggggcaacaagtgaataaacaaaagaaggaaatggattgagtaggggaagggtatgggagaaagaaactttcctaggccaatttagtacatctttgaagtgataagaacaagagagagatggttaaagaggttaagtatggggaaaaaaatgtcacctgaggcaggttctatacattgcaatttacctctgcctttaaaaatacatgacccttttcatctagagcttatgaaagcagttttgtactgccttgtacttttttttttaaatgccatttctcttttttaagggtgtcaatttcatttgtgatagctaaattaattttttaagccag

SEQ ID NO: 49618 - DNA, 1070 bp, Bovine  19866880890193
ctgcgaaagagcccattctttagttccctgagaatcttggtctgctgtataaaatgtttagaaacactgatgagatgttagtgagatcaaaactaaatgaatatttagcaatgcattaactttgagaaatgcagactacgagacttaaataaataaccttatcttaaaacagtattttaaagactccatcagtttgacatactttctatgtgtgtttttcaaatattctgcaaatatatattttcatattcatgcatatctatgaaaatataaaatttcattctatatgttttaatatgtgcttaaatttatagtaatatataaaaattgcataaatgttataaatctcaaaacacacacacacacacacacaaagactgtattagtattgaaaagcctggggggatgaaactgaaacttcatccatacaaggacaagacttgtttcagctcatgactcctatgaggcagcttctgtggttttctttctttttcttttcacatttgtacattgatatttgggcgagggggttcttttacatttaatcgcaattacatacttcaggaggctgtgtgtgggtgaatgtgggggtgtggggagggagagttaattttgcagttggataaattccgtttagaattttataaatctccctctctccccagtctcacattaaaccctcagcacaggaatcacagcacacagtgctgctttccttccagcctccttctaagcagggatctaaagacagcaataaaattcctaaataagtaactgctatttgaacaataaccccacttttgtacaagttatgtactcaataaaccaaagttccaggataaatacgattataataaacaaaatgcactccctgagaagaaatgggggtgaatcatcatttacaagtttgatagaataaaagtgggctgttcactttgtcagcatacgtatgtgattcggcagttaatactttagatttctcattgcttaatttgaagctcattctttgaggtttaaattgatcaatgattatgttcaattcaacagctattttacaacatcattttata

SEQ ID NO: 49619 - DNA, 1491 bp, Bovine  19866880898206
ctctccaatctcactttttggtttagcaacttccaaccctaacatcattcttatatcctcctatcaaaaaataatagatgctggaccctgtgacgtgtcggtttcaccttaactccttccctatgaagaaattctcctcaaggggacaactggggtgctgaccttcacttgaccatcaccacattttcacccctttcatctggattttattgatagaaactctactgaaacggctctctctctctcttgagaaaaaaaaggtaaatcccacatataagaaaatacaagtgtgaaggagatgagagggcacacacagagtagttaacctaaagaaatgctcaaatattttaagggaacctctagtagcagagaactattagggagggtaaagggactatcacaccctaaatctcatgttttaccttaagcacacttgtatgctttcaatttattccatagtatctgtgttgtattatttatttagttagttattggcaggtgcgcagcttgtgggatcttagttcctggaccctcggcagtgaaaatgcagagtcctaaccactgaactgtcagggaatttcttgttttattatttaaaaatagggggcaagtctcctacgcgtcttattgattaatgatcaaataagctgtgagggcactatacccatccatttggggatgtgggtgaaatggagagagctgacatggaataatataaaggcaggttttccagtctgtgtatcccaatattttgaaaacttagactggcatatatatgtgaatatgaataataggcttttcactgctttctgagctatgacagggttactgctcagaagttgccagaaagcaatgttttcattaagtgtgctcttgttgagagattaggtcacaagtcatatgttggcaaaaaggatctctgcctcctggattcagtccttcagtttgtctcagaaatacttgttcattttcaatgaaagaagataaagatattcttaaatactactattaatgccataatttcaggatatggaaataaactggaatcatagcccccaccatcaattcttttcatatcactctcacactttattttcattgcaatttttctacgtgtataattttagctgggatttcttaggcatactgaaaagctagggcttcagtgaaagatgcaatcccagggcatcaagagtgaggaaaaaaacatgtgcagcaaggaagaagggagcaaatgcatggaggtgtattgccaacctggtctgtgcttcatgaccctgaggagatgcagccagttccttggccacgtgatgtgtctatgaacacttgagttcagttcaggtgctcagtcatgtccgcctctttgcaactccatggactgcagcataccaggactccctgtctgtcaccagctcccggagcttcctcaaactcatgtccatcgagtagataatgccacccaaccatctcatcttctgttgtccccttctc

SEQ ID NO: 49620 - DNA, 1178 bp, Bovine  19866880915649
gagtcggacacgactgagcgactgatctgatctgatctgatctgaaaggcagtctatagtattagcattaatcataaggagtaagtaggaattaaggatctctgtacatacaaatttagttttactcaaatggccttgatcaagtaaccaatgttggtatctatgatactgatggcatctaacttggtcatagttgtttaacaaagacccttgagctcctcccgaaagtctgagtttaggcactgatcatatgagagcaaaaaagctcttattttttgtttcactcaaattatttctcctgctttaactgttttgatttgggctgctgctgctgctaagtcgtttcagtcgtgtccgactctgtgcgaccccatagacagcagcccaccaggctcctctgtctctgggattctccaggcaagaatactggagtgggttgccatttccctctccaatgcatgcatgcatgctaagtcgcttcagtcgtgtccaactccatgcaaccccatggacagcagcccaccaggatcctctgtccacaagattctccaggcaagaatactggagtgggttgccatttccttctctttgatttgggcaattatgctaattatagcagcagactatggtccatgggtcaaatcttgccctctgcttattttgcaatgaaagttttattgacctacggccatgcccatgtgtctgtgtagtacctatggctgctttcacacgacgacagcagagtggttggcaacagactgcatggctcacgaaatccttaatatatactatctgcctcttccgtaaactttgccaatccagttgtaaatgactaacattaatcccacatttaaaaaagagaaatgaagtgacagtattccaggctctacatcttttgggcaacaattttctaaaaatggatggtagctttccaatgcaggagttatttccagcataatcaagaactcagcctttgcaacctctcaagtgcccagggaacgtttttggtgtagtagctcatacagttaactgtagtttcaatggaacaccactcctcagtctcagatattcttaaggatccaaaggataaacacacaggcacagaagtatgagaaaacacatttcttcctgctcagagtccagcatttcaggagacgaaattacacagtataagcaca

SEQ ID NO: 49621 - DNA, 1153 bp, Bovine  19866880960823
atgtaaataggctagaaatgaatgtaccacatttaatttttaatttatcccaggcaaataacttaccaattctcatatggcaaaatgtgttggaattacaccaaacataacacagctgatagtctccagaagttgacattttaagatatcaggatatacaaatcacattatgctaaatgtgcaataaatttaccgctatgcatatgaatgatgacatagcagttatatgtataaactaaaataacaaatagagttcaaattttattcatttggattggagtagatggtgagatttcagctcattattgataagagctttacatctatcatctacttaactcctcacaacaaccccaggaggtcctgaggctaggaggaattggccttagcagaaggtcattctgctaatccgtgccaggcaaagacttgaaccagcctggaaggccatctgatctgtgcccctcaccaacagtgaacactgcacttttgcttccctcccttgtctccttacttgtaggcaacgatgaaaattttgctgctggagttgatactggtaaatgtgggaggaggttctctgaagcctgcctggcagactaaggaaaactaatttgagtttttaaatgtgaattgaacaaagttggcaggtgtctgtgaggagaggtatgggtatgctgctccctttataaatgggctcaatatatctgaaagctatttgataacttgaaataagagctataaaacttttcttgctctttgactcagtaatttcagtctctggaatacaccccaaggaaataacacaaaagaaaatggtaatttgttcaagatgttcattcaggagttatttgtattagtgaaaaactagaaacaacccaaatttccagtaataagaactaagcaagctagattatatagacaaagaagaaaattcataatccctaaaaatggcaaatgaaggctacatttgtatgtggacacatatgtaagaaataactttaaattagaaagtagaaaaaaaaaagaaagtagaatacaagttggtataagtataatcttgtacaatcaagtaaaacagtatgtgtataaacaatcatacaagaggactgtaaatttataaagaagtatagccctcattttgttgttgaaatttgga

SEQ ID NO: 49622 - DNA, 1461 bp, Bovine  19866881011542
ttggaagcttcgctgggttcgctgttaccgcagcgtttactgcagtcacccggaactggtaatcacagccttccatcaggccagtcaccttcagcctggtgtcgtacaccacgtggtccttgttgacacgcgtccagcgcaggctcttcttctcacgcttgtctaccaagtagttgctgatgtcgttgccaccgtcagattcaggtttcgtccactgaatgatgatatgctctttgccagccccaacttcttcaggtatgccaggttgtgatggaatcgctgtttatatttttatgagaataaaaggttgatcagaattgcacaaaatcactatttctatgactgtctgccccctgcccaccccatcctctgatcccatgacacttccactggcaagttaagtgttaatactcactgaaggagtttctggcaacaatgggctctgattcaacaggcacaccagggccatatttgtttactgcccgcactcggaatatgtattcgttgttcttgatgagtctagtaaccacatgggatagggtggggcattcgccttccacaatcacccagttgagcctgctcgtctcgcgtcgttccacgatgtagtgagtaatttctgctcctccatcttcctgaggaaggctccaggctaaagtgcacttctcctcagttactctgctgacggtgagctttccacatgggcccggggaatctaaaacagatgtaggaatgagcaatgaggaaggtccttctttctgcacacatttgagaaagctatggagatcaaaaatcgtttgaccctcttaccgagaaccttgaccaggacagacacagcctttgtcccgctggcattcttcactgttaaagtgtattttccactgtcacttctgtcacagaacttgatcacagcagttgctcgtttgcccgtatactgcagagagattttctcacacatatctagttctttgtcccctttggtccagataatcttgggttcaggtttgccaccaactgcagcatcaagaacaagatccgagcctgctctgatggtgaccagatcaccctgtaatctggcatccagttcggctttgggtggagctgtcatagacaaaatgtgaatgaatgcgtgatagtctgttgtcacagaaattgtgatcatttaaaaggagaacgtggattattattattatttttaccgtattcatctcggcaagtgatggggcctgtggattctgatcctttgctaattacgcctgctgcattcttggccaacacacggaattcgtaagtgtctccctcactgagagcagtaacggtgaagaaattgtcagatacgatggtgtagttgcacttgagccagcgaccgtctccaacttcgctgactggcttacgctctatgatgtagcccacgaccttgctgccgccatcatacaccggggcagaccagatcagtgacactgt

SEQ ID NO: 49623 - DNA, 1039 bp, Bovine  19866881012950
agaatgttttgcaagtccttaatagatacttcttgaatgaatggctcatgatctagatactcaactgcttgtatactattccctgacttactccctcagatctaatcttatctctgtagccaccaaccttgcccagacagcataaacgctgccctttttcactcttacttttgagcttctctttcctccatggcaactgtttgcccttgtggccctggtcattttgacagtgacccaaactaggcctcgtcccttcttactcgttttactccaggggtagcttccagcaaaaccacactacttcaaacataaagttctctatggtgttcctgcacaatcaatgcaaataatcaaggtatttctgcccagatcaccaaccatggtagtcttgttgattatgcaaaaaccatgaggggagaggtacagaaaataaatatatattcaataacaagctgcttgaaatatggcattaagtgaaatcagatctggcattaagaaatgtcagttccaaatatttaaattatagatttgaaaaagccttgacacacattatagttgttttagaagcagaaataaccaatccaagttgttcagttagtccaaaagaatgctatgttctcttcttttgctattaacaaataagaaaacaagcaagcaatgagttcattagaaaaacacttgtgaaatattaatactcttaataacctacatgattaaaaaaacagcctcactttcacacataacgtggggagttatgcaattgtgagaaaggaacatttattttgaaacagttataaattatagtgtaatatgcatatatagagagctatattaaattacagtaagaattaatccaaaaaagacttttgaatttaaatgttaatggctgagatcttttatgagagacaactaaaaacttcttaaaaattagaattattgccacgtgcaactttttggaaagaaataggctatttctctcaccccaaggacattaaagtgattgaaattggtagctaagcagttcctaaaagctatggaa

SEQ ID NO: 49624 - DNA, 1045 bp, Bovine  19866881064791
tttccaattaaagatgtatatactaaaaattttgcttagtctctgtcctcactgggtctttccagttaatggatataatttaagactatttacctcatggagccatcaaaatatactgtcatattttccagactctcaaaggcactcagaggcaatgttaaaagaattggtgataacataatattattcattactgtgcaatgtgttttccttccctagaacgatatgtgcaacttcaatagtaatctaaggtaatgttttgcccctcaaacaccaatctaccagtgggaaattctggctctaggacaagtgagggagatgttctgagtcagtcccctgacttctctgaaacaaagggacatttctttatgccaacctcatctgcacgtaggcttctagaacactgccaaaaaatgattccttaaattcctgacaaacgaactcctcaaaaataaccaacctttgggcttaaagcagaggcatcacatccaccactgaagcagcaaagtctgtttgacttagaactatgggaccccatacttacagcttccccattcaagtctcagtaaccctgctgactctgcttgccctcctggtcatctggaaatccagtatccattgtccagtcttccctaccaaaccctactctctggaaagtctctcgaactggtttacacttgagtttcagcgactgagagattaccgggagcaaatacaccttggcagattcacagagccctgtctcttaatggttccatttttgcacatttccttttgtaacagaagcataactgatagaccagaaggcgttataaaggatgaaaaaggagctgtcctgccgggctagcactcagcatcccagattgcagcagtgcttcgctgtgaagatctggcagatgaaaggagctttaatgctctaagtcaaaggatttcagagcctgaagccccattatccttaagtgctacatggcaaggggaagaactattgacttctctataacaggcttaaataaaaaaaaagaaagaaagaaagaactttacaggg

SEQ ID NO: 49625 - DNA, 1721 bp, Bovine  19866881068988
cctggagcactgtttttggctggctccaaaaaacaaataatgtgataacaagtttattttggaaagatatgtcaagaataaacatcccatttagcatcctcctatatttggtatacggtctctagtagaaggaaatctctttgtctccttacaaattcaaatttctaaaagagtacttttagctgatatttttctgtctcacactttgttttcttcagtgtagaaacaaaactcttaatacaataagatgtttgtcagaagcactctggttttctactcctgtacctcatctggaaaaaagaaaaaaacctagtttatgagagccttcatctaataatattgttgtttagttgctaaatcatgtctgactcttgcaaccccctggactgtagcccaccaggctcctgtgtccgtgggatttcccaggcaagaatgcctggagtggggtgccacttccttctttgtcatctaataaaagctggatttaatttcttacggataaagtgtctttaggggatgacaggtcttcacaaggagatagaattttattaatagagctagacactatcaactgtttactttgttgcttttgtgagcacgttcaaacttttaatcttacctcagccatgatatttttgagctgcagaatacaaagaaatttagctcaccaaatacttgcattggctttcaaaatgtttatggcagcctctgcagctctatgtttcgccagcttcttacttgtaccttcacctgaattaaggttaaaaaaaaaacaacaaaaacaactctttacatgctgaaaaaatgtgaggcttgcatagaggtttgcatagtacaaaacaaagtcactacatgtattatatatacacactaggtatacacactgggtaataaaaacatacactgcatacagttatacattgaaataaaatatcataaaaattaatatattaaaaatccctttgattttaaaagtgctaagtatttaattctaagtatacttatataaaaatctttattatgtctactttgtacatgtttattacataaaatgataatacagtagactgtcactatgtatgctaatgaaatgcaacttacttccattattcctagagaggaaattcttctacaggaagaaattttctttaaaagaggcacttagagcaacattattgaacagcaaaatgtacacattttactctaacagcccctcctatactggatgaaacctctctgcttggctaagcagtcactggctacctgttggatacagcaggggaaggtgtatatagggaatgtgagagattacattgttacgtgtctttcatacaatctgtatcccttacatgagtagctaagggggtagaagagaccaggcctgactaataatcactgagactgacgcctaatatcagtaagcaaccacacaagtaaattataaattcagtctttttccttctgagttcaaagtaggtgttgagaacctgtccaaagttgtgtcagaaaggcaatattcattcctctgatgcagagtaaagaaaaggcacatggaacaaatgtcaggtgtggttctcaagcatcagagaacacagaaaccacactcatttatccattcacataggtattatggatactgtattcctttgaaaaatgtgggcattaggagcactgagctttgcactgaaatatatgggaattaggggcaccgaccctctgca

SEQ ID NO: 49626 - DNA, 1124 bp, Bovine  19866881104271
taaaaaataattttgttttctgatacatttgattatatattattaatgttgtgatattagtgtctttctatgttgttttatctttgtgacaacacagactctaggtattcaatctgctttctttttaattcccatatattctctgctttgttctaggtcatggagtggttcagtattttaatgtagcatcagctatttatgcaaaatacaagttacatggatttcagtaccctcctgggaatcggataggtgtttccttcattgatgatgggagtaatgcaacagagtaagtaccattccaggaactactctaaagccacacttcgggtgtgcatgccatgactgagagaataaaagtagagaacaatttacctctcaggtgaggacgttacgtgaagcaagttattgtgagagacttgagtatttctagttttctataaattacctgttcttatctccagtctccttagaaaaatggcaacgcagatggtcgctgcacagcttgcatcaattgtgtggaataacccaagtcagcagcaatttctggtaagtgaagaatttaaccttacagtacaccattagggtataaaataaatgtggcctctgtttattacctgtgtaagaaaatgttcagagatatagtaaaagaccacagaggtgccatgataacacgtctatttttagctcttgacttattataaaatccccaaagtgccgttttttctttttctcattttgaacctaattcttcaacagcaatttgcaggaagttctggatcacagctgcctcaaatccagacggatgttgcactaccatcatgcaaaaaaaaagctcctcctgacactcctgtgaaggaaagactttttatcgtttttaatccacatcctttgcctttagatgtactagaggatatattctggtaagatttcagttccatagagttacattttattttattttattatttaaaactttttaaatttttttggctacgaagcacttaggatcttagttccccaacaagggacttccccacaccttcattggaagtggagagtcatcccaggacttcctggtcgtccgctgatgctgtaatgcgggagaaggcaaggcaacccactcg

SEQ ID NO: 49627 - DNA, 939 bp, Bovine  19866881138896
tcatcaaaaacgagaccagtcaataatacgcaagcacagatatacccgagtgtccacaagcgaaacaaaaatccatcatgtgagataaaattctgggccctgagtagtatcttaacaaccagcacaggaacacgttcattaagttaatctcactttctcataaatcttacccatctgttgttagaggctttattttttttatacaggttctcccaagtcatgtaacttttcatatgtgtatataaatcaatgttactgccatactacaatctacaattacttttactatataccatatatatacacacacatgtataaaatatttccaccatttagctaaatcttctaaccgtatttgtggagacattgaagcagagtagagtctgtgtatatgtgtatatgaatatgcacacatgcacacacaggttattccaagtctttctcagttttatttgttgaaagcacatatagagaatatattatggaaaaacagatattttggggggttcccagttaatcttctcaccgtgggccatcctcaggcacttgtgttagaactaacagtatagaattgattgtgattacaaaagtcctttgtaaaatgtaaagtatattataaaagttcacttctctagagtaaatgattagatatagagtgtaattctttttgtcctctgccttatgtcatttagatatcagatggaaaaacaagttctggggcaagtcaatggaaatcctgcccgtgggaaccctgaatgtcatgcttccaaagtaggttgctctcatcttccttttggtctcttatctgcgtttctaaatcataaatgggcatttgaaactcttgttgtttattactgttcagtcgctcagtcgtgcctctttgcgaccccatggattgcagcacaccaggcttcccggtcctttcaccatcttccgcag

SEQ ID NO: 49628 - DNA, 664 bp, Bovine  19866881139637
ttctgggctgacttttacataacgaagtcatacctttccatccacaactgaaacattagcagctggtgaggattcagctgtggaggttgaaggaaatatgtgaaaactagcatctcgtggtgatctcacaatttcattctgccgatacaatcgatgatggcgcagtttggagacccatgcatcaaaccagtcctgggatttcacctacaacaattgaaaaagaggaacaggtaatggtgaagccaatctcctgtctatccactagtctaggcaaatgatttccccagatattggcagagaaacctcgaaaggcatttttaccttcaaatgatagatgtgttcttctgtgtcaaggtctattctccgagctttctttttaattgacatgacagagagtcccacatcgatgcttccatggaccttccccttttggatctgaaatcaaaagactggttaaaaggctggaagggtatgtgatctgatgtgtttctgtactgaagtgagcttaatgtaaactctcatttacctacaggagatggaagatcacacctcctgaacagagaggaaatggataaggttctgaagttaaggtcctcaatttgaggacagctgaagttgcagtgacttcatgccaatttcaataagtaagactattcatctcatt

SEQ ID NO: 49629 - DNA, 1206 bp, Bovine  19866881148449
ccaggctcctctgcccatggaattctccaagcaagactactggagtgggttgccattcccttttccaggggatctttccaactcagggatcaaacccgggttgattttctatccactgagcccccaggtaagcttatttcccaggagacttctccatgtctaatgcatatggactcccagcaagtccaggctgccagacacagtgcagacatgggcccacagctcagacatttcttgagagtccctgtgatatcagttctccattttttcttctgttaattgctgcagttgtggtaccacggtaggataatctagggaggtattaaaatccccattttcaagaagaggaaaccagggcccagagagtaagacaccctactgggaagcagtgagttgggactggaaccagctccttaactctccccatgcttttctgagaggatgcagagcatccaccccattcatgaaacagggtctgtcacaggcagagcaagcccgagggggctgtgaaaaggctctgatccactgccagggatgctcctgcttgtcctctgctctgtccaagtacatggctccgccaggctgacactgcagcaagaggaaaagacatagctgaggagtaagggaagggagtcaacggtgtattagcctgaaatcctgagcttccaatgcagggggcccaggttggatccctggtcagggaactagatcccacatgctgcaaccaagaccccacacagccatataataaatatatcagttggaaggaaaaaaaaagagagtgtattggtctgatggtaggtgctgggacctcacttccctgaatatctcaacatggaagaggatgacggtgtacccccacccccagggacgtgatagtccagtgttagtattcttttattcctttccaggtctgtagttgcatgcaacagggtggggttaatcttattctagttttggacaagaaaaaaaatgaagactctgaaagttagagtctctttttccctttttatatttttcttgctaattgaaatagtttggcaatctcttgtttgagaaacttgtactagagcaaaaggtttttaatctaagatcatttggcttatgtttttttagataactacttctttttccaacataatgtctcaactttttaatttttttgtgggagaaggaaggatttatggatctttcccaaagcaatgt

SEQ ID NO: 49630 - DNA, 1346 bp, Bovine  19866881154948
tcgatacttaagataaaaatttgaaaaaattaaaactttgttaaaggaatcaagcttttatttttctggaaaattcagttggtgaaatatttcatttcctgatagaattagatacaatactggactcctatgagcacataatagttcaatcaataacataatcatgagagggtaaaaaatagtgacaaaataataaggggtctcagcttttattcttttttttggtagccactcagtagacatttactgaaagaaagattcattaaattctataatactttacaaatttctaaagtttcacatacatgacttcatataatcctataataaccattttttgcctctaccccatattaatgtagagacataaatgctaatgtcactataatttcatcactttccaaagaaccaataagacaaccatagcaactcgaaagaatattacctgctaagataaacagcatgggatatcctggcaagatcaaaaaggtaaattttttacatgtgttgatatgaatatatactttaaaatatcaattgctttttctctcttttcagtaacagccttagctccaaataaaacagctcagaacaaatatatgattctataataaactatagtaaaataagcctaagtttgaagccttaatacattgaaaatggatttctattaaccgtcacttgttataatttacagcttaaaaaaagtatgatagctgccaagttgcttaccttactggcaattttattcactcattattgttctttactgactatctagtggggccaggctctatactaagcagtaagagaaacagtgatgagcaaatcagaacaagactctgcccatacagagtttatattccattttatgaaagacaaaaaaaatttccctaagtaggtagaattttgagagaatttggtcaaaagaaaaggttattttacctctctgtactgcaagaaccaggatggctgacagaacgcttcatctagaaattttaaaagaaaataagcttaatcacaggtcaagtagaacaagacagctctaatacatttttatggtgatgataattaacataaatttactcaaggaaaagatagctggccaaaaaatttgtttttttacagactcaagtaacattagcacaagataaagctttctccctagtaactaataactgaaatctttctcaaagcatacaaaaacatgctggattattttctcaatattaaaaaccaaattttattttatatatgtatctaggtggcatcagtggtaaagaacccgcctgccaatgcagcagacataacagacacgggttcaaccccggatcaggaaaattccc

SEQ ID NO: 49631 - DNA, 1283 bp, Bovine  19866881195349
aaaactaggatttgtgaatgatttctgtgttgtcttactactcgcaaagcacactgaaaaaggagaggtttttttggcactgaacatacctctgggtacacaaaattgtattcactgaatctgctttccaaaaacataagcgcaaggggctctcacagatcagatctggaaaaactggaaaatttacttatttattaaataaataatgtagtaatgtattataaagcatgaactgaaataagatttaatgaatctatgttgatcaataaatgaatgggaatgggggagaataagttctaacaggagaatgcccaccaaaaaatgtagggtaaaaaataggaaagtcatcatttggcaaacaacacaatgatgattgataaagccaggagttgtctgtgtgtgggtagagatttgatgaacagtggatactggcatagtctcagtattttccacaaaatactcattaattacaaagagggaaatggagactagatgcaacgtctggcagacaccaacttgtgcaggtgatcaaggttaacaccatcgatgatgggatgatctgacatcctttgcctcctgatgtgatgcgctgagaacagcatggcatcattttaaggttttttttttgccaggaatacaaagcccgaatccatgttcaccttgaatcttcacaatattttggagcagatgtttttatcctcgtattatagaatagaaaattgaagtgcagatgttgaacagtttacccaaaaccgaaaatagtaagtggcaaagcccagtttcaaaatccaaggtaaatttataaacttgcggtgcctcagtcctgctgtaaagcccatgggggttgttagttccatgacagttgggttctgcagatagtaccttacagtccaagggtgacgtttagaggagtatcactaaggagccacagacagcgaatcttacgttgcttataacactagtggtgaggggagggaaactgaattttatgtcagcatctgaacggctggttcttagcgagtaattatttatgatcagcgcgtgttgctgctgaaagccatcccgtcagacccctttccagcaagagtctcctgaaacaggaactgattatgcagtattaaatctgagacccatttcatattcagaggttccagtggtaaacctcatatgtcaggagcaattagtgaccttgtgacatgtccttttcaatatgctgaactgtggtcaataaatcctagcaggatggatgggaattaaaataactacctccaccatcaccctag

SEQ ID NO: 49632 - DNA, 1794 bp, Bovine  19866881258502
tcgtgtctgactctttgagactcttggactctagcctaccaggttcctctgtccctggaattctccaagcaagaatacgagtgggttgccattcccttcccaggagatcttcctgattcaggtattaaacctgggtctcctgcattgcagacagattctttaccgtctgagccactggaactacacactcacagtaagtccaaatactgaatgttctcctatcctcttactgttttttcaaaaattcttctgaaaaatggaataataacagcacctacatcagagagttgttgggggtatcaaaagagataacacatgtaaagtgggttagcaataccaagcacatggtaagcattcacttgacacatgttaaccattcattattagcatcatcaccaggagctgtagcagcactaataatattttcttagcaaggtcaggtgacttctctccttagacagaacttttaaaacaaacctttagaaaactttaatttagcaccttctctgctaaaagtgtttgtttcaacatttcatggaccattaatgataatgaatatttcaaatgaagagtgacagaaaagtcacaagctggagtatacataaattaaataatcaatagcatgagatgaacacaggaataaataaaaatagacaaccgatcaccaacaataaatgatgtcaagctcatgtatatccttcactccaaagaacattgaactgtcagcaacacaagatttatgccgggaattgtattagtagtgaaagaaccttatgaaaataaataaaaatatgcagtaggtgtagatgctacaaagtaagtattctatatcttttaaaaatgaatcttacctcatcagggctaggaataatatttacactaacaacctgatcacaaataatagattctgaatgtattctgttcaaccggctccttagttcagcattctggttgagtgccttaaaataacaaaaaccgcacatgtaattgcaagttattgagcaaacataaagcagaaccagcacacaggcacactttagacaacaaagtctaggatgcttttagctgtaacttttggagccaccacaggccagatcccaccagtaagaaggaaagaaatggctcagagttaaggcattcattttttgcaatataagactactacttagtagattagtgggttgaaaagagtttaaggatttcataaaattgattcgtggaattttctctcctttatagtcaggcccactatatccaagcccagtctaccaccacatacatataacattttataccctaggataaaaactattgattcttttttttccctttttggttccagtttctaaagtttgggcgttgtttcaaagccagatgtcttataaattatttgtaaatggaatgaacaatgaactggctttatatttcatagagctgtattttgacctggtgaaagaaaacagttgttgtgtttccattttctaggagcacataattaatacttgtgacagtacagcagaactaattcaagtgtagaccaaagctgccttccctggacagtgtagacactgacaagcataataaagagcataccacagaaaggaaactaagctgtctgcatctcatgattcttaacacaccctaaatcagcagtgaaacaccatctgctgtaccccagtttagcgtgtgtggtggaaagggaacatatttacatgaacatgggctccctataggggccctggggacagaggctcgtggatcacatcagtgcatggaaatctgttccatatacag

SEQ ID NO: 49633 - DNA, 1367 bp, Bovine  19866881272874
tgtagcatatatccgaatttctttcgtttttgaggctgaataatattccactgaatattttgtttatccatttaatttaatttaattaaattatccatttaatttaatccatccacattttgtttatccattcttatgccaatcgaccatttgggttattttcagtttttggctattttgactaatgctgctgtgaacatagttgtaacgatgagttactcatagtaactttgagagtctgctttcaatttttttgactatatacccagaagtgtatgatttatttttaccatatttttaccttaccatagccttcctttccatatgcaaatgaaggaggtataatcaattttcgcttctctccaggacacatatccatcatcccaatgtctaggccttttatgacttgtccaacaccaagaacaaaccatttggggtggccttcattttgtgtccggctgtaattaaaaacagcaaccaggtaagttgatttgaaggaaaataaaatcaaactttaaaatacagctgaatatttagttcctatgtaaaactggaaacctctctaaccatgtcttttcctatattaagactcattcggaatcccattgtggggtctttggctcaaacttccctcataatagccagacagaggtttgatttgcccaaagctagtcattaggagcggagaaggcaatggcaccccactccagtacttttgcctagaaaatcccatggacggaggagcctggtaggctgcagtccatggggtcgctagagtcagacaggactgagcgacttcactttcacttttcaatttcatgcattgaaggaggaggtggcaacccactccaatgttcttgcctggagaatcccagggacggggaagcctggtgggctgccgtctatggggtcgcacagagtcggacacaactgaagtgacttagcagcagcagcagtcattaggagtcatctcattttcttttttcttgtcatctttacaaaaaccactcaacagttaactttttaatgggtctcctgcccctaactgcatagtttgtccaaattacagatttaaccattctgtatttattccaaaaaaaaatggatggtccaggtttagcctcaaaaagtcatttgaatcacgattaaaatttgtatcttcttaataaatctctctattttcttctaaatggaaagaattaactttccccaatcttatttttatagggaagtagcacagaaggagaaaagacattctatctctgagtaataaaacatcaattaaatcagagtaagtagtggtgggacgaaggggcagggcacagagacacagggtctgaaaatcaccagagaaaagtcattgtagt

SEQ ID NO: 49634 - DNA, 1864 bp, Bovine  19866881286450
tgttatcgcctttattatatatgaggaaataggtccagagagattataagaaacatgcccaaggtcacatggcagcgaagtttcaaaattcagattatggtcactgagcttcagcaaatgataactgaagtagcccatttgtaaatgtagacattttacttcttatgtatctatttaattgcaaacatgaaatattgaatactaaatttaatttggaagaatgccaagaaagaaattcagtaagaaggctgaagttccaccatctggtagcctgaaggcatcatttgtgtccacgaaaatctggagtccgctattttcattgaagtccctttaagaaaattttgaagcttttttgtctatgtggggcaggtggattgtagttagattctagctggaagtttctcatatgaatgacagactcaacattgcactactgctttagctggtctgtctttaagtattcagtgaaaattcaagaaaaagtagcattttccccctctcagtgtgttttatgtgaaagattaacaacctgtggcaactgcttagtccccctcctcttctcaggctggcctgtctttctatgcaagcttatctacctccatggtttcagatactatctaatggctaataattctgaaatctctgtctttagcccaggcgcagttacaaaacaatgcatcagcctgaatttgctagacatttttgcttggatgacccaaagacacctccatctctcattgtcccagactgaatccatcttctctctcaaatccatttcccctgcattccccagttcagtataggcaccaccatcattgatttgctcacagtggagattggagtttcaccttctggattccttctcttccctctttgtgctgtccattatgccaccagatcctacttctaaatatctcttgaatctgtctgcttctctcctcttcctgttgctattgtctgagccacttggaatatagctgcagtcttgtagctgctcttttagcttctgtcttgtggtatccattttccacacaaaaaaacagagtattttttctggcattcaaatctgttcatttgaagtattaaaactcttataatccattcagtggtgtttccatcaccctctggatgaatacaaatttcttaacatgactgacaaccttacttcacaaagtgtggtcaacagcagccttgctatcacccaggcacacctactcttagtatgtgttctaagaaaattcccaggcaagtcctaaagttagagaagcacagttgaggagactgttctttgaactctccttctgcccttcagctctctgaccttttatctcgaaggtccctccttcaagctcgtactgtcccagcaacttggggcttgagaacacgtgctctgtgttgcatctgagccttcacagtggctctttctctgcctccagtgctcttcctgtcccccagctctgcttacctcactgacttactggtctttcagatcctggtttagttatctcctccttcatgaaacctttctgagtccttagtaagtaggggagctaccccttctgtaggctacccaacaacctgcactgaggccgactgatgcttcatatttcagacatcgttcttatagacaaaatctcacacattaggctgtatgctctttaaggacagggactctgcttagttctctactacagttagctcttgaacaacacagtttgaattgcacaggtccacttagatgtcaatctttttcagtagtaagtactataagaccacacaatccacagtttgttgaatctacagataccgaggaagctagagatggaggaaccacagatatggacggctgactgtaaattatgca

SEQ ID NO: 49635 - DNA, 1382 bp, Bovine  19866881295847
aagtatgtaattcttctaaagtatctgtgaccagttgtggtaagcagtttaatgacattcgcaaagacagggatcacagtcgttactgcttcaaagttcaatgaaacagtattgtcaacaagcatatttacaacatagttcagaatcctctgagctaatggcttgcctcagcctctttccttttcctcactttcctttcctctctcgtttccttgtcttatgctctccatttcctcttttctgacaccccatacctgtcttttttgtgtgtaactgcttcccttttcccctctcacctttcctcctccttatcctgtcctcccctccccatccttcatattgcctttgtctctttttccttattctttattccctgttccatgtcttcttcttgtcctcactggtattactgacattaacataaaacagatataacatgaaaatagttttttgttatcatttccaaatcaagatttaaaatctcatagacctccctcagaaaacaactgtttcattttttacttctaagtgacctgtgattactatctttcctttgaattttaaagtcagatacatgaaatattggcctttctgttaagacacacagattttaattacatttcaaactgctaccccgtgagcccatgattataacttagttcctgcagatcaatgccttgaaatgtaaaagaccttgcctctgaagtacattataagtagaacaagcgatgggaaaattggtatttaaatacttggtatataacatcaaggcttttattaaagtgaaaacaatgataaatactattttttgacatatctcttagcctagtatccaccaggaattcttagcaacagcaacagaaaagttaccatgccagcaattctcaggctgacggattatttgtggttttgcctctgttaacctaaaattcctactggtgactgtcccctgcagggctgttttttttccccccttttgtacatcgagaagaaatattttccatcctcctgaacccaccaggaaacatctgggatttaatcacctctgttattatattgctactccctcagtatcaatgctctggaacttgcttagtcatttgtaaaattcagcccagcacttgcctctgcccttctgtgacaatccatcaaaggcaaagtccaccaaactctgtgagctgtgtggctctgtttcctagagctgatgttttctcttgactgaaaaccacgctgaacctcaacatctgcatcttgcttcattatttctagcagaatgtaacgtctggcttgtgtgtgtaagtgtgtgtgtgtgtgttttcttgtcattctagctttagaaagaattttttcccatcctgaaaaaggaatccattcattaggaa

SEQ ID NO: 49636 - DNA, 1218 bp, Bovine  19866881305590
gctgtcaaaaggcatcggtaaatcttcaatactgaataaacacacaaacaagagctttttcttaccgaaatatatcacgatggtttttgatgttccaatcatattctcctttactgacaagttcgaagaattccgttctccttctgcatgaaatcaaatgaaaattctcagtctgtgtggtgatataaacacatttatgggaaaatatgaccacttcaaccaagtaatttaatatttgaaatcatgaggctaaaatgctatcaaaataaaccactttttaaaaaatgttgaggctttgacaaaaagccacaatcatttccaaatgtatttacaacagaagagattatcaagccataaaacagaaatcagtgtggtcccgcatttgggattacctgctgtgaagccctgtgactcttactgaaaaagtcagagaagggaggcaaggacacataaaaggtgggaacagttccagaatgttcttttatcattcaacatagaactgagctgtatgatcatccaagataatataaactccctggtagtaaattcaggacaaatacttttgtagaggttaaaaagtaaccatttcatcatttcagggccttaacacatcggctatggagtcagaaataactgtgtttaaaccatagctcagtcacctcctttctgtgcaactttggaaagtcacttaaacactctgaacctcaatttcctaatctctaacttgaaggtcctatttggtgactcagagttattgtgaggattaagtgagatgacatgcaacgtgtgtttattagtatcagcacattttaagtgtggctacacaagcatgtggaaatgcatgtagagatgtgtggatatggaaaagaaaagaagggaaccttcgcaatttgtgaaaataggatgccattcctattttcaaaacttttgtttaatctagttttatgatttttcatttttataatgagaaaggaaaaaaagacatcaccattttggctctttaagaatcatttcccaaggtctcacatttttggcacttcctaatgagaggctctttaaaggatcctgacacactgcttcccagtgtgcaccccacaaaatgctaggcttaggaggtgctgcatgtaaagggggtgctctggccaagtgggtttgagaaatgcttcctgtgatcctgaagattcaccacccacattagcctttgaaggctctacaaaa

SEQ ID NO: 49637 - DNA, 1763 bp, Bovine  19866881309824
tgctgctctaattaccagcgcatctcagaaaaactcccctgatttttattttatgagtgacttttcaaatacagtaaatttgaaagggtcctctcctaagcttctttgtggagaatacttgatatgctataaggaatgttggaaatgagtaattgtgctacaactaaataatttaattgtaagtagcttttttccctccatgtaggagtacttggctaatactgtacttatgaaatgaacaattgctggcattttatgtctaagaacacataagaatctgtaggattcaggatttcaaagagaacaggaaagagcatatagactggcagtttacagtcactagtaatgtctctcattaaataaaggaagtgaatttctatgatagagttcccatttaaaagattgcccctaagacacattcacagattcatgtggaattttacgtattcacatttttctattttgtaccctaagcatttctagcattattagattttgtagccagtcctctgaaaaattacctaagagtttatttgtgtattatctttttctaaaggagatttctggcagtctgagtactcgccttctcactcttttgggaattttcatgagaattagtgggatttatgctcaactcatgttcactcctgggatagattcaccaagggttcatttaatcacagtttccttcaagatcatgagaaagcatgcctgagaatgataaatcagcttcaacatcatttagcggggtgggaaatggggaatggaattatagaataattcaaatatgatgaagatatttttgaagtagcagcttgtactcaacattaatgaaaaaaattggaactgattactttcctagtattaatgctttagtgttctctgtaaacattcagaaggatatcatgtaacttgtatgatattaatttttcttaacctccttctagctaaaggattgctcacttgtctcctagtaaatgtatataaacaaagtgattttatgtttgaaatgaagaatgtatataaattatatttatgcttttaatctttacataagattgcttaattttaggaacctcaacaggaggctttgtggtaatattactcttctttctgatgggctttagtatcagaaatcttttttcttggtggaggctacagtgttagctattacaaagaaaacaggtgctaacaagtattactgaagatatgcagaaatcggaacctgtgtgtactgttggtaggattgtaaatggtgcagtgattatgaaaagcattatgttagttcttcaaaaaaattaaaaataggactactatatgatctagcatttccacttctggctatgtatccaaaagaattggaagcagagttttgaagggatatttgcacacccatgtttatagtaacattattcacaatagccaagaagtagaagcaatttaaatgtcaccaacagatgaacagaaaataaaacatgctatatacatatagtggaatgttatccagcctgaaaaatgaaggaaaatcctattacatgctacagtgtgatgaaccttgaagacattatgctaatgaaataagcaagtcacaaacaccatatgattctacttatgtgagatacctggaatagtcagattcatagaaacagaaagtagaatggtggttgtagggctggggaaggaggaaaagaggagttgtttgatgggtaaagaacttcagttttgcaggatgaaaaaattctggacatctgtttcacaacaaa

SEQ ID NO: 49638 - DNA, 857 bp, Bovine  19866881334035
aaatttggggatgctcttctcaaatcttttgtggactggatctccgtgtatgcctccaggggacacacacgactctcttcttcatatatttctccagaaactgctcttgaactcaagaatgtagttgaaaactatcgatacttctcaaaatagctgaaaatggtcataggcttgggactttctctgcatctacgagtgtcagcaagggtttacgacggggcccaggatgatctttacactggtatgatttaaccatggatcaatcaacctattaggggaaaaagacaaggtcaataaggatgggtcttggtgaaccagaggccatcctacatttttcaacctaatgttcttatttcctttccattaacatttcacaatgaaaaaatgcctatattctttaatttttaaggtaattaagggaatttagtgcttttgaaggatagaggatttataatggcatcagggaaggcactataaataacccgcgagacaagggccacctggaaagcagcagtgcagtctccatcatcatttctgcttcttggcgacaggctgtaagagggtcatctcccttggccagtgcagaaccaagctcctctccttagaccagaaagacctgcttgttctgggacagggcttctaccctcttgggaagtggttttccagctgtatttgagtttgaacaaattataacaaacacagaacattctaagtacatgcattctctgtatgcaaagccctgaaatgtgtgatggaagtagacagtcattctggagcttctctaagggaaagaaacatgccatctgcctctgagatcgttacagcctaatgaggtcaggagacacaagggaacgtac

SEQ ID NO: 49639 - DNA, 817 bp, Bovine  19866881341488
aaatgggttgcctttccttctccggaagtgagtgaaagggtgggaatgactccttcaaaggaggctggacaacctttacctgatgtagctactaacctagatcttaagaatgaaatgccacatgtgttacacttctgtttcatattatcccagcatttacttaacatttctacctggagataccacagatatctttaactttttaacagtttggtcaaaaccagccttactcattggctaagcctgtgcctctgtcctcgtgtgagatagctccccattcagttagttgctccagtcagaaaccagggatcttgtttgctgcctcaatcgctcactgctctcctgcacccttattgagcaatcctatccattcatctccgaaatatatcccaagctcatcttcttctcccatttccattaccatagcttccccatttcttatccttctccatccattcttttaaaaatacaagtcccattctgtctgtaccctgtttgaagcctttcactgccttctgttgcactaggaagtgaaaacgacaaagcaaaatgcagatcctttgtttggctctgaatatttggttcctacctaggagcgtcacttcatttcactccctcctgtcctggcatactctgctcaagctccactggtctcttttcgggtctgtagtatgcccagctctttcttgcctcagaacctttgcacatgctgttcttttagctagagtttcccctcccactttgacccttcagtttttagcttaaattgctaattcctccaagaagccatcttctcctctcgagttgaattcagtcc

SEQ ID NO: 49640 - DNA, 1445 bp, Bovine  19866881351664
atgagtgatggtttgtagcatgttccccacgaagttctgattctgtgattatgtcagggagcacccctaagctgcagctttatcagatactatcttgacttctagggaattgatgctggtgatgtcattttaatctcttgtccatccatttacctaaaatccatagatgtctaaggatcttctatattctaatttgtagagactcacacattacaaagagatttaataatcttggcctaaagcaagtttgctgaaaaaaaaaatcttgatatgcttgtaaggtaattacaattcattttgacattttaaaactaaatgttatgggaggtagtatttttcatgccagaaaaataatttaagatagactctcccccaagaaataaaaatcactcataatcccactgtccaaacttggcgttaaatactcagataacatttgatgtttaaatacccatattttcttccctaagatttatattcctatattatttatttatttaaaaaaatagacacatggtactttgtaaaccctttccttaccccttgctccaaccagagaaaatatttgaactgctgttccatactggtgactatatttacatcatcacttagaatggctgtgaagatttgctggatgtaggttgtgtcctgattttttgctgttataagcaatcccatgatgaacatctttgtatacatgattgggcgcttgcttgattatatactgaagataaactcttaaatacagaatttattagatcaaagcagagcctacattgaaggcttaggagacttgttactagattactttcctaaaagtttattctgcttcattagtaatctgtcatgtgaaaagtggtttcttattgttttaaatttcatctttgtttttcaagctgagtgtttctcagtattgtattggccatttgaattttgtggtcaattgactagtttgctttatccattttctataggagtattcctgtttttggcttattattttgagagcacttcacatattagggatatggatttcttctctgcattcactccacttgattggaattttgattgtgatttagtcaaatgtaacattaatttggtggatatgagcatgtttttcaatgttgtgtcttggtatttgagaataatgttttaaatacttctgatctcaggaaattataaaaagtaaaaggtacagagttacttttttcagacccttccatttattgccttgcctcggggtagaactgttcctaaatcatttgagaaaacccaagtagctaaagtgttttcaccagctaagtgatcgaattccatctggttggttttttaagtgttcattttgatgattttagcacacgcacctattggtccttctctaagctagtatctttggctctctgaaatagtctgttcgtatgggtcctcatggctttgggagt

SEQ ID NO: 49641 - DNA, 3075 bp, Bovine  19866881504907
tttgctataaaaatataaatatttttgtgtggctaaattttagagtgtttatggttgttttgacatatttccgtcgtttcatttcataacacagtcttgaattataaaatataacttgagaatagtgccagtccatgtgtgtgtgtgcgtgtgtgtgcgtgtgtgtgtgtgtgtgtgtgtgtgtgtgtgtgtgcttaggtcgctcggtcgctcattcatgtccaactctttatgatcccatggacagtagcccaccagtccatataatcccacataaattcctcatatatctatatgactatgttccatacagttaatgactacatggtctcatataatcattaccgacaggcttttctgcttctacagtagtttttctgcaatgttttaaaaaaacatgactgggtttaaaaatcaacattttatgaataccaaatactcgattctctccaaggcacatttatttcagaaaattacaaagcatctcttcctcaccatctggaagaaatagcttcatggtcaaactaaagacttattttcactaatatatatctctcacagaactattaaagaattatagtagtggatgctagttaagtttcaaaaccttcaaatatatatatatatatatataaaacccctattaatccctctacacaagaaatttgtccaggagaatatttaaatgccattatacatctcaaaaagaaaacatcattaaaaatttattaaacaataaaataaaaagcataaaaattaaagaaaaagcttaaattctaacttgaaaactgtatactcatttaaaaatgaaattgtgataacatgtcattttattcagctaagatagcttgcaatttatacactgaaataatatttatttagaatttttaattacatggatacatttagagattgaagaacagtgagccatttacaggtagtagatactttgcctctatcagagcacaatcagaaaattacacagccagtgaactggccagaggatgctttattcaatagaattcaatatgatgtctccaatctgacctgtcacaaaaggatttcatgggttttcaaattcacatctattctgataggtggtgttgactaattttcaactttggtaatgtatttgatttgtcctgaaaccatttgaaacatgagaatttcttctttgagtcaattcaggtagaaaagtatttgaatgagctaagggatccatgaaatgagtctacttccctgagcaactcaaagcagacccaaaatcttggacagcgttttctctaaagagagcttgtgactacggctaagggctatgcattgctctatgattcccaaacaaagagaaacactacgagttttaagtgtattctgtccgtttggcatttgggcagcaaatcgctgtaagaggtcaatgtgtggtaatttcatgtgcaaatataatattaaaaatgaggcaactgtctgcataattaccaacaaaatcccttgttattaagggaggggacattatttccttaatcatccagactagttcttcagatggatcatattaactgaacaattatttaacttttcaatttgttgtgactgcatggatggggcctctgggacccatatacaggaacatttatctcagaggaaaaactaattgtgccttgagttttgtactgacaaatcgcattatagtaattttattgtttctaattaaaaattgctgctttactaacaagtgataaaagtttcacaaataacaatgcagactggctccaaataaaaaagagaagaaaatctaggatgacacgcaatactacacacacggaagctttgcacacagttgaacactccctgtttctcaatgtcatttgcatgtccccagctccttcttcagaccttctttggctcctggactcatccttggaccttttcccttctcttatccagatatttttcccacctgtaccctagttttaaataccatctatatgctgctgctgctgctaagtcacatcagtcgtgtccgactctgtgtgaccccatagatggcagcccaccaggctccctcatccctgggattctccaggcaagaacactggagtgggttgccatttccttctccagtgcatgaaagtgaaaagtgaaagtgaagttgctcagtcgtgtccgactcctagcgaccccttggactgcagcctaccaggctcctccatccatgggattttccaggcaagagtactggagtggggtgccatcgccttctccgatctatatgctgatggttcccaaataataatctcgagtcttcacttctctccaaaactctagactcccatatccaactgtttacttgccacctgtacaagcctaaagttgttttcattcattacccatatcagtaggtcttgtgtttcactgataaattttttgaagactctctcacttctcactgtccagctacattatttctccccactctcagctttattgagatataattgacataaaactttgtatgagtttaaggtgtacaatttgatgatttaatacacctatacattgcaaaatgattactacactaaggttacttacatccgtcaccttacatatttacatttttttgtgttaagaacattaagatttattttctcagcaatgttcgagtacataacacagtgtcattaactatagtcatcacactgaatactagatctccagaacttactcatcttatatctagaagtctgtatactttgacaaacatctctcctttttctagacactccaagctactggaaaccaccatactacactctgcttctttgagtaccactttcatagatccaatatatatgtgaaataatacaggctggatcatcgaaaaagcaagagagtgccagaaaaacatctatttctgatttattgactatgtcaaagactttgactgtgtggatcacaataaactgtggaaaattctgaaagagatgggaataccagaccacctgacctgcctcttgagaaacgtgtatggaggtcaggaagcaacagttagaacggacaggaacaaataggttccaa

SEQ ID NO: 49642 - DNA, 785 bp, Bovine  19866881548768
atttattaaattttactcaaaaccgaaagttaaccagtggcaagtaaactttaattagaaactataaaggatcttgttttacgttgcacataaactgcatacggggcagaagttcaaaggctctaagcttacaaagttcaagtctgattactccttgtgacagtacacactgaagtttaattcctaaaaccctcattaaaaataaactcagagaagggaaaatgtagtttctttttaaaactataggcaaaatcgatggtttaaaagaaaacattatatctgctttttatcaaaatacactaaaggaatcatgttctagcttaatgatagcctctgcagtttgacacccacctgctcagctcttaataaattaatagttggaaaggttggaaaggctgatttgaacaaagtcttttatgctagacagtacttgagtaggtgtctctgcaaaatctcatcaggggagttgagtggtgtggcaaaggttccttctgaatggctcattcaggaaccaaatgatccattatctttgcaacagaatttttcctgtaaattatgtgactaatcctcctacagcctgaattttgcccgccagacaccatgttcttgtctggcacagtccccacacagtctactcacgtcttattcaagcccctctactaagcacatgatgtattctaccaaggactagactgtccctttagcactaagtcagtgcagagaaaggagaggcaactccatcactctgtaaaatactaaagaaaagattcttaaaacagtaaagg

SEQ ID NO: 49643 - DNA, 1209 bp, Bovine  19866881671319
tatggtctgcaagcagatcacgggggcactactcctatgcaccttcaatggaatgcccactgtgtgctgaggaaatctgggaatacacagaatcagaagccagaatgtgacaacaggcttggccaggacttaagaactaagttctgttgtgctaattgactatctcagattaatgggaagtatgtaagttggaaaatgagtcaacttctaactggaatttgatatctgtttctaaaatatatttcatattcttattttatagagaaaagaaatgaaaccgtatttttagaagtaaaatgtgatgtcgcagaagcatcatcagttgagttgcatacacagccggactgtctcttgtagttcggcttctgttgctgacatcaggattgtctcctgaaatgggattttcctgtcgattttggattttttgcatgttgcctagacactccatgggaaaatgcagttacaggaagttgctagtgtgcggctgagcagtgaaagcatctgaaaagattgctcttgtgggatcactggattgtgtccattaagccaagttcttgcccccagaatgctggttctgttatgggcttagctcagaggtaattgactcttgagccccctgaggcaagtcaaggactccctgtggtaaagaacctctttgtctcccctgcattctggggcttggttgtttctactagactgttcacatcggctgtaaattctaaccaccataaaacaagcctctggaaggcccacttgtgcacagccaagagattgccacttaccaaatgcctaaaaatgaagagaaaaaagaaaagaagaggaaatataaacctgaacaaaaataaaaataaagaacttgagcagcattggtgaaatttaggtgggcctggggtattgccagctattttagtgttgggtagaagcatcactcggaaatacctaataagcacacctaataagcttattataagcatattaggtgctacttgaaggaactgcattgtaaagtgaatacataacctcttaataagtgagtctgtcattattgaatgaacctgacggaaggcaccctgtgtgggtagatgaggctgtgagcatgctgttttggaaaagtaagttctaagattatgtagtcctaaacctatttgttggttatgcacagaagtgtgtgtttgtgttatgaaattttcaccaggtaataaactccta

SEQ ID NO: 49644 - DNA, 1185 bp, Bovine  19866881822086
tcaccagttggaaaatgtaaagggagtgtctgtgccctgggagtagcattgaaattctcatctctcaacttgcttcacaagaaaacaaatcttactgcgtatctttttaaccgtagcctttttttcagcaaagtttgtctgagttcatgtttgtccatttgatttctgtgatcagtcacattgaactttagcacattctagcatacttcttgtatgctttagcaaaatagtagatgtaccatggtgcagtcgggcttacagaaatggagcaggtgtggatgttgctctcagaatgcatccattctgggaaatgaaagacacatgtgtcaaaaactgatcaaaatggactgaggaaagtccaggaggtactgagcaaggattataaaacttagaaacctgaaaaattacttctagctgaccataggaagtaattccatgtcacctgcacagggttgaaaaggtagaaagggttttagactttggaagtgtaaggggaagactgttttctttagaggaaacacataaaataggcaaagagtgggtatatttgggggaattgcaaggagttgtgtctgttagatttcaaggagcctatcgtggaagataaagttggacagttggttggagttagatcatggaagacctttaatactggaataaggaatttgagctttattttctttccttagtttcaaatattaactcaaatggtttaccttagatgtgattattaggtatgattatgcatgagtaccatcatccttttggcagtttgcttgggaacgaaaaaatactgttacacaactgcaacatgggtggtctgggtcaaatggctctttttggctgaaaattttctgcagagggggtgccaaagatatcacataatgctatcactcagacatcagtcatctacatcactacatgcacttatttcctatcactcagatatcagtcatctacatcactacatgcacttattttgattcctccctaggttcagtgatgttaggatttctattccccagctgtttgtttgtttgtttgacccagtgggttgttctgtaatgcctaatactccatgtgcctggcagacgagctagtttgaaagctgagtcattaaggtccttcatctttcttctcaatttcctacttagcattttcccttcatagtgggcactttgtaag

SEQ ID NO: 49645 - DNA, 698 bp, Bovine  19866882189925
tagaactgggtattgagagtctagtggttcattatattaatacaatattgtggatatagacttttagtatatttagaacagttagataaacagataaagaatatgtgtacatatatacatggagagttttatatatttacaaaaaatattcccgattaaaatttacacgggattggtgatttctcactttacatataaaagatgccttgcagataaattataaaccagaaagattttcaatgtggtcatgggtgactggtagccaatcattaggattatttttgagggtaactttagcatttctgttcaaatgatgcttttaaaaactattactactaccactacttttaaagactactatttttctgagtggaacctatgtcaggagagcaggataaaagcctattaaaaacatattataaaaataataatattgtgtatatatttggattcatttattattttgtttaattttatgtatgtttgaaatgctccatcataaaaactttaaaattaaaaggaagtaacaatgaaagttacaaaacatttagaactgaacaagaattaaaacattttatgtcaaaatacctgatttatttgtttaaatatctagtacacatggaagtacattttataaaacctaaacattatatgaattaaaaaatcaagaaaggttgttatatgaatgaaatgagcta

SEQ ID NO: 49646 - DNA, 1587 bp, Bovine  19866880194292
tcatgcaaagatgggctcgataaaggacagaaatggtatggacctaacagaagcagaagatattaagaagagatggcaagaatacacagaagaactgtacaaaaaagatcttcatgacccagataatcacgatggtatgaccactgacctagagccagacatactggaatatgaagtcaagtgggccttagaaagcatcactacgaacaaagctagtggaggtgatggaattccagttgagctatttcaaatcctgaaagatgatgctatgaaagtgctacactcaatatgccagcaaatttggaaaactcagcagtggccacaggactggaaaaggtcagttttaattccaatcccaaagaaaggcaatgccaaagaatgctgaaactaccacacaattgcactcatctcacacgctagtaaagtaatgctcaaaattctccaatccaggcttcagcaatatgtgaaccatgaacttcctgatgttcaagctggttttagaaaaggcagaggaaccagagatcaaattgccaacatccactggatcatggaaaaagcaagagagttccagaaaaacgtccttttcctaggttttaatggcgaaaataaaatgttgcaaaatgtgtgttttgcaaccacatcctggtctgatcttcacaggtacaacctgacatgcacagatgtgtatttgattgtgattggattttgagtgtataagccatgcaatgggggagcagggttgcattctgcactttagctggtgtttgtatatctgttatttcttccccaacacaagcttccagagaggaggcagtactctccatgattttattctgcctctggagtctaatctagggcttatcatacagtagatgacccacaattttagaactgaaatgtgttttcatgtgtaaagtcagttctcaagctacacacctcctttaaagcttctgttgtttgccccagcttctcctagcctcctgacgcacacctactctctcacagaacaggtgcagttcagtagaatgtaagcaaatcagctacgaatgtcaaaacaggatttaatcaattattaatttgggagaaccaggagaacaaaaagtaaataccccaatgaggtcatgctatgaaaaatgtgaaagtctcttagacctaatatttaatttagatttactgtctgagttacttcccagcttcccagatgcaagccagaggccatcaggcaagacttgtgatgatactcagcagccatagaggcccaatgtaaaggccaaagaggaaccactccccttgggacaagttcccagagggcagaggctgcaaagcttctccaaagagaccaattagctcaagtgtaggaaccaaagatcctgagccctgacatctggataagtcagcctgccaagtcagggcttggtctgattctgtaggaggctgggctttgaaccagcatcagcatcagactcgtactgctccattctctccaggccagccagaaggggtaggaagcatgggctgaggcgagagggctgaggctgtaacagtatttaggtgtcagggccacagcgaatgccaaaggggagaggg

SEQ ID NO: 49647 - DNA, 2220 bp, Bovine  19866880668327
ctgtggactgtagcccgccaaactcctctgtccatgtgatttcccaggcaagaatactgtggtgggttgccatttccttctccaggggatcttccttgatcccaggagttgaatcgtgtttcctgcttggcaggcagattctttagcattgagccacctgggaagcctatgtcatgcattacgaagtcctaaacttatttttggatagtcttctgtttttctccagcatgactctcctctgttagcagaaatagtgtcaagtgctatgtgtatctgcatgtacatgtctctctctcttttctttctcaccacacaaacatactcacagacaaatttcaaaaagcataagtgttaattaatggggatagagcattgttcaagctgtcacaatgtgtgatgaaggtaccgaaaatgctgtaaaccatcagcgttaattccattctccaggagagatggaaaattcttgcatgcaggggagcttgattactttacttcagtctcagttgcacaccaggttttgtgagctgtggcagggttgggtagtcccagcttgctgaagctgcccccatgtatcaaatgagataatgcaggtatacttggtgtcttttaaagtgctgaataagggttatcctttcaccctagtttcccttaatattttgaatttgttatatatgaattcatctaaggtattatagaaacttccctggtggctcatatggtaaagaatctgcctgaaatgcaggagatctggttcaatccctgggtcagaaagatcccctgaagaaggaaatggcaacccactccagtattcttgcctggagaattccatggccagaggagctttggtgggctatagtctacggggtcacaaagagtaggtatgagtgggtagtagcattctgaatggtctagacatttcttgatctgcccagaatcaatcagcaatgctaaagtgaggggtgggcatgaataatagtgatcccagaagcaatatattaaaatatacacagagatcatggtggataattcccaggagcatgccaggagaatctctgcctccttgtgagagttgtctatccataaatcgagagtgacattgtttggtggcctctatggctcagccacactgcaaagctgatgactaagatttgccttcaccaggttccttaatctttgaggaagggcaataccatttgaagcccagttctgcttcccagctcatcactcgatttgaaagtcgtccttctgagctctcattccatttgtgatcacatgtcatccagactccctctattcccttttctttatttactattccttggtcttccccaatctttgaaaactgagggaatggttgagttgccctggcaacctcctacccccaccacttctctgtttctcaacgatttttctacattttaataaaatcactatttatggtgtgcaaagcttcattcccctccactgcaactcttcaagggaggtttcctttcttaccagaatactgctgctactgctgctaagtcacttcagtcgtgtccgactctgtgtgaccccatagatggcagcccaccaggcttccccgtacctgggattctccaggcaagaacacttggaggtgggttgccatttctttctccaacacatgaaagtgaaaagtgaaagcgaagtcgctcagtcgtatctgactcttagcgaccccatggactgcagcctaccaggctcctccatccatgggattttctaggcaagagtactggagtggggtgccattaccttcgccggaccagaatactaatgatgactaaaacctggctttccagtgaggctgcaaggaggccctacagagtgatcagatttgtgtttgtgttcaggatcatttgtgttcaggatcagggtttgacttgtaaacatgaaggatcacagttgacagggctgcaaacccatccttggaaaatataccacgctggaaacgtataaaatacacattggatatggctggaggggaggaggcatgaagtgaggtgttcttacctttgttatcttgacagagggaactgaactcctgggccagcctgttaggaagagccgggaggtagcatgaactgaggggagaacacaagggcttcatcacatcctagtctatgcgatcttggtgttctcacactatgtacgctgtagagctgttgtgaggggcagagaatacatacacctggcgtt

SEQ ID NO: 49648 - DNA, 2869 bp, Bovine  19866881001211
atgtgcccttgtgtcctttacctttgtataccactctttcaaatgtagcatttcatttgaaactgaagttcaatacctctaaaatacctacatattttatcttcttttaacaataggagaaattgaggctcagagaggctcaccaaatagcatgctgcttggacccagatgggtctgattctgtgagccccactttctccacaacacacccaattccctgacgagggtttcaggtgcaaaactcggggctcagagcactctcacattctacatctctctgtgcctcacgctggcagcccagcgtgcattgctatttccctttggcagatgagaaaactggggcccagagacaaagaaacttgccgaggtcatgcagctgtttggatggagagctgaactggaagcagagctactcaaagcgcttgtacacctgctgtgtcacaccctcctggaggcaggaaggggactcaccaagacctcatgtgctccctgacctgccaaggccactgagcagcaggttacagagccaggattggaaccaggtcttggtcttggggttagagggatttgatcaggcagccttgctgctgagcgtaatgcaggccccaacctgatcagaaagtaaaatggggtgtcttttacatgctaagcattgcgctgggtgctttatatacactgcgtacagtcttgggagacagcatcacttccttttcacaaatgagactgaagttcagagagagtaggtaacttgctcagagtgacacagcaagaagtgctgagatgggaactggagctgccgctcaggcttcatcactggcatccttcggttctcagcttagatggtgccatcacaggcaggtctttcccaaacagccccatctaagccatgctccttatattcttcgtgtctgcactctatcttcttctgagcatttttcataatcagcagttcatttcatttatttgtccccctgtttattttctgactctcccactagaatgtaagctccagaagggctgagacgatgtctgtctagtttcttgtagaaccctagaacagagcctggcccacaacagacgctcatacatgctggttgaatgaatgaatgaagactctcagcactggcccaagtacagtgagcctggctgagttaggcgtgtgtacaggaagctccactggcccagcatggttgggggagcatggattctagtgtcagtcagacctgggttctaacctcaatatttacttgctgtgtgactttgggcaagctatagtccttggtttcctcattggttaaatggacacagccacccttgctttcaaagactgctgtcagcatgaaataagatcagaaagactgaggatccacaaaggatcctggcacatcccagctccagcacatagcacctcccatccccctccctgctaacaacagaccctaggactccaggctgggaatcatccaaaacctcacttgcattaagatgcagcctcagagcctgttactgctcccctcactccccccaccccaccctctatgcatgcagcagccaatttcaaactatgtaaatatgccaggctgcctcctcagcaagggaacagctatacttagtgcaatttgcatgtattttaagctgacttgttccaggcaaagaagccgattcatgaatttaataacattcatagattcccagaatgtcagcactgtgagagacgtcagagatcatctagcccagcccctcatttggcagaggaggatggccagggcagtggtatgtccaaggtcacaacttggcttggagcccaactccagggttcttttcaggcccatctgtagttcactctactcgcctcccaggcgctcatctaagtgtgaatttgcagcctgcagtccctcatgccgcctggaacacctcagctccaggggagacatctgccctcccaggcagccttgaaggcagaggtgagggtatggatgtgggtctggggcaagatggggatcagctgcatgcagaggacaaaacagcccagtgggtacccagtgatgaatctttccctgcctggtcacagacagacccgtagaacaaaatcccgctccccttaacagcccattaaagtgatgcattaggtcatccagggatttacctagagcagagttttaactctaattgacagcgattgcatctgcctgcccggcgagccttctcccttctggtaactgcacaattctttgctttatgggaataggcccccacctccaagggctcatgggggctgtcagtcaggggaccctcaggccctgccacagggctgggcatgtgacccaaacccaatctggttagaggtccaagggtggtcatgtgacccaaatagtcctttggaaaaatgtgatgcttgctcagggagaggcttgtcgctcttctctctgaagcaagcggcgggatgagaacagcagctagctttgccaccaggaggaggaagcctgcctgagaaagaagccacagaatgagaaagagggcccaagacgagagacactatgctgatgccattgttgacaagtgcctgggtgcacacatgcctgaagcccagcacaaccccctgggcttccttttcttctcaagctgatttgggttgcatttcttcactggcatctgaaataatcgtgtcttagtcactaatctgcagcatctctgataataaaccccatgaggtgaatcctgtcacgtaaaattgtacttctttgagggaagggtcctaaacctaccttcttaagctttatgagagtgtctccattcacattaaaggttttggagcctttctgtgcccagatgctcttacataaagtcattcagttaccctaacaatttt

SEQ ID NO: 49649 - DNA, 1042 bp, Bovine  19866881104290
tttcacttttcactttcatgcattggagaaggaaatggcaacccactccagtgttcttgcctggagaatcccagggatggggtagcctattgggctgccgtctgtggggttgcacagagttgaacacgactgaagcgacttatcagcagcagcctcaaaaggtagctctgatgttcaggtcaatttccccattcataggatagaacctcaacttatctcaaaaagcaactacgatatttggcaaaactaatacaattatgtaaagtttaaaaataaaataaaatttaaaagaaaaaaaaagagaaaaaaaaaaagcaactatgcatataatccattatcatagtttttacatgaaaaaaaaaagtgaatgctaaaatttattagtatttttttctggttgtccaattttcaagagatgtaacaaacatattttaaacaaccattgatttaactatggccttggtttttacttttgtaacaatatctcttctcacattctatgttgattgttatgctaaatgtttggcagtttactcatcatataaattggtcttcatgtagctagccaaaattatttctgacagccttttatatcaagcagaactacaatagtctgtttttggagtccaaggctcattcaggaaaatagataaatatagcaatttacaagggtccaacatatttattgtgaaattttttattcttagcacataccatattaatacttttaagctatacagatttatattagaaagaactggaaatatttaatcagggtttttaatctcatgagcatcttttaaaacatcatgcagaaatttgatggcaatgagctttaaaaatgactatcagcagtgaggattattataatattaattgaagtcccactccttcagcttaatacagttctaagggcaaaaaaaagaccaaagtcagaccacaaaagaaaagaaatcactgcttggtaatattatttcataagccagataaagatagacctaaaagacacgttcatctcctgccaaagacagcttcttcggcc

SEQ ID NO: 49650 - DNA, 1219 bp, Bovine  19866881128277
aaatgacagaactcagtgatagactgaatatattcacttctctttgaattactacattaatagatattgatacactgagactacttggcaataaatcttccttttaaaaggctttaaaaaaattaaaatgatttataaatgtttatgctgcacatatgaatgaaaacaaatattttggaaattcattaattgtcagaaaatgaattagactttagatctacagataaaaagcatatacagataaaaatcatataggacaggatataacttatgaaaaggtgaagtgtgtgcatgtaataaattaatcccatgggcttctctttcaaattaaatgctttaatttaaggaaatgtttaaatgtataaaaataagaaccttaagattcttaaaggaaaggagtttaaaataaacaacagaaaacaactgaaagagctgtgctgatggccctataacacacaggcgcaatgctgactttcattctaaagaggtaatggggaatcgccatagagattccccagagcctttatactctcaaggaagaggtgaggggaggttgggggctcatcagaagggaaaaagtatctctccatttcctaccagcaccatgggggctatgatccctgaatctgcaaagtcagagccctgcatacacagatttattcctaacattctttagataggatgaaatgtgatcttttgtccacttgaatgctatctgactaacaatcagaaatcccaagatttattttttggacaagagttcctattctgcactgtttaggttgcagcaataataaaatggctcccaagaaaatgatggagcctctttttcagatcacttctttaaagcatttgatggttaatagtgcaaaatctgaaatataagaaaaaacacatccacgaccaaaaaaaaaagagaagagaaaaaccacagaaaagtttttttttgcaaaatgctttttctttacaatgtcaaagacaaaattcattcatagcatcactgaaaacaaagacaaatatctgaaatgctctaacctgtctaaatcatttaaagaatactattatctagtatatggcaattgccattttcatgcaggaggcttagggctgagtcacaaccatacggtttgggctctgcgtggttttctctcctttctgtcttctcgatttgctttctctcaaagactatcaaccatttacagcaggtattttaaaaaaa

SEQ ID NO: 49651 - DNA, 4316 bp, Bovine  19866881229633
ctgtccgtggctagcttggaacttgcctaattagtgagcttgccttccattttaggttctggagttctagaaccaagtagaaagaatttcctacttcttgtggtcctgcaaccatggcttgttatactccagtctcatttgcttactctcatttccaacatgcctgggtgttcacatttctttaagtttgcatattctgtttgaaatgctgttacccctagtccccataccaaattcatccttccctgaaaatgaacctgagcaatcatctctcccagggagtcttgggcacactcctaaactcctcctacattttgtgcacaggactgttccattatagaaaagattatattgtattgctgtgtatattgctgtgactgtcctcatgctactctacaaataccacatcagttatccttgtgtctcctgtgcttagcacatgcctagctcctggtctgttgcaaggtaggattgaggaaggtgaacagacttcacatgctagtctgaagccccctggacagtcaaaaatcaatctgaagtcgtaagaagctaaagaccaacagagtgaggtttccagtgtgtgcctcttgtccattaccaagtgtgaggtcacttcggtagtagtagatgtgaaaggtgaaaggctgggctttgactaattccttgctggtttaaatgtgtcaaatccttttatttcaaggctaaatactcttaattggcccacagaggaaatcatgctacagttcagcctctgctctaatttaaccacagtttcgaaacagtgcagattctagtggagattgagaaagcaaaactttgtttagccagcagctacgattctgttttgttcagttctgttccctggcaagcatatctgatatttcttatctcccaagggagttccttaagggcaagactgtttgcaggacaaatacttccctttctattatccccccacacccccacctcccacccttaccaggcatagtacctggccctgctgctgctgctaagtcgcttcagtcatgtccaactctgtgcaaccccacagacggcagcctactaggctctgccatccctgggattctccaggcaagaacactggagtgggttgccatttccttctccaatgcatgaaagtgaaagtgaagtcactcagtcgtgtctgactctccgtgacctcatggaccgcagcctaccttcgtccatgggactttccaggccctaggatgtgcttaacatctgattattaaatgaattcattacaaagtctgatctttattttgaaattcaaaggtcaatagcccctgagatgcttatagaatctatagccctttgccccattcccgtgtctcattattaggtggatgagtgtggttctacagaaatttcctttccattccctgtatgattcttgcagatcttggaaggagaaagctttcatctagagttccttgtggtaatctgaaccccaacgactatagtggttacagaaagccaggaccaaagcttggctatcactttctgagtccataatactgcagttattagttatggggcccaaattagaaatccttgcaatattgttttgttttccaagtcatccagatttggtacatgtcatattatatttatcaatattcttgttttgaatactaagggaaagtgttagttgctcagtcatgtccgactctttgagactccatggactgtagcctgccaggctcctctgtccatggaattctccaggcaagaacactggagtgggtagccattcccttctccaggggatcttcctgaccaagggatcaaacccaggtttctcacactgcaggtagattctttactgtctgagtcaccagggaagcccattgaatactaaggataagtttatttgggggaatcctgaggatcacagtgctcttcctgctcttttaaaacaactaatctatgcagctcttagcaatgtctatcttttacctctttttttttttgtataataaagtttcattaaagtataaaggagatagagaaagcttctgacataggcatcagaagggggtagaaagagtacccctatcttttacctcttgaaacacaggttctgaacatgtcctgtgtccttgactctgagctgggtgttaagattaatcacagtccttctgtttagtgtctctgaggagtcactaactttacttttgaaaatttctcaaattaagaagatctgcatctcccagttgccttttagaatagttctagctgttggttctctgctcactttaaaattacaagaccaatcttctaaaaaccagatcaagtaggaaatcttccagtttcatttcacataaatggctctggtcatcggtaatggccagacagagaagttcaagttctgaagcaatttaagcacatgaaaaccatgacccatcaaataattggaacccagttaactgaaactctttctgggcagattgccttttaaaggccactagaatcttgcttataattttactacctgcagtaaacatttgcaaaagcttcaggaaagtttacagtctactagagagatacacagagactcctaagaagataccttagcccacataatatggttcagttctctgctttcaagccaaattaaaatgtcaccaatcttacctttaagcaggcacttttcctctcacctttagacagaattggtgattatcaatgaagcgccaaaacaagactggtaacacagatgtcagggctatttgtgtaaaaggagaagtgaagggggaataaatgtgatcacactctgacgacaggaagcccagatgaggagagggaggaagtgaggctgggcccaccctctttaaccacagaaatgcaatccttcccctgtggcttttcagacacctatctcacaactcacccaaatatctacaccagtttccatgaaaaacaggaaaactcgaagaccaagttgattcaggcaggaatctgtgagaattggtgggttgtggagtgatctgacattgatttttgcctagaaaaggacaacgtttcttaatcaaaatgacatctcagaattacctgtggatctgatcaagaataaatatacctgaccccaccatactgattcagtcccagttaggtagatagacaggaatggaacccaagaatcaatattttgagaagtttctaggaatgaaaattaggaatgtctcctaagccacttcaccttctcctcattcttcctctggccaccttctggaagctttgtagtctccagtttgattgagtcactactttcagacttccatgtctcagaagctagactgcccttacggaagtgtattgtcaggggcagactccaaggcacagtccaagggcactagtagaattgatttgattagtagagagagccccagattcagagtcccaagatctgggtttcagtcccagctttattagtgttaactgtgagatactgaggaaatctcaacctctctacttcagcttattaacagtaacatccaataattactgtcttccttcaccctaagactttaaaattctagtataacttctgagcggggttggcttatggggaaaactgagttagaagaaaagaagaaaagattctttactgcagactgtgtcttatcagtctttaatattctgtgtgtgtacatgtgcttagacccgtgtgtctgattctttgtgaccccaaggagcccaccagcctcctctgtccatagggattctgcaggaaagaacagtggactgcgttgctataccctccttcaggggatcttcccaacccagggattgagcccaggtctcctgcattgcaggtggattctttaccatctgagccaccagggaagcccaagaatgctggagttggtagcctatccattctccaggggatctccccaacccaggaatcaaactggggtctcctccattgcaggcagattctttaccagctgagctaccatggaagcccaatattctcttaacattctctaaatatgtagatttccccaaatttgcttgatcatataacagtgtgtgtgtatgtgggagagagaaagagggagagagagatttctcaggaaactgtttttcagtgtaactatacttcaggaaatgctgttacaaactttcctctcttcagctggcatcgctctgagaaatcactgcccctcacctgggactgctgtcatactgacaggccactgtagtggagtaattgaggaaagacctcttgatggctttcattactatctctctgggtcaaagatgcacatccctatgtacaacctggt

SEQ ID NO: 49652 - DNA, 773 bp, Bovine  19866881463825
tttttatcatcctttgaatgtatttttcttcaagtccttaagattttaaatcacatatttgggacatttgccagatgcctttctgaagctctttgacatttattttggttactgtttgcatatttgattctgttgttttataattaatctgcaggacattcaaagatacttttgtaaatacgtggattaatgtcagctctttagttttttggaagcttcatggtcttacatatctgatgatatttttattgtacaaaagcattttttataagcttaaaattatatgattttctatggatacttggatttttcttgagttacctctttcctgctgtaaaagctttcagtaatgtaatacagaatgttgattgctttaaaagtgtttcttttaattcatcagggtataaaatgtaaaagccaaacttaatcttataatacaaaggagaaatctggaagatatctgtgatagtaggcattaagtttatttagatttgaactttatatgtaaagagaaaaccaggagtcagaatggtacagttgaggtacaaagaccttgatagagttagagaaagaagatagttacagagacctaggttcatgttctagttcatcacttagtatagttaaaacatttggttaaaagctgttcactgagtgcctatggtgtgactgactttactaaatggagagactgattaaagaataggctatggaccatgcccatgaaaaacattaacatctaggggggaattataatacacttgttaataata

SEQ ID NO: 49653 - DNA, 1294 bp, Bovine  19866881517747
ttagtcaatttggcttctttggggttccacagactgttgctgtgctcctccataaatgtacatatccgagacattcttttatcaccagagtctggttttgctttgggcaggctgacttctgaagctgaaggctacggtggcatttgggcatatccaggaaagatctgacaaacagatagatgtttttgaccccacagagtcccacagaaacttgcttccacagagaggatggcccaggctggatattctcaaacttctctccactcagcatatcaactattcatcctgtccttaaatactcctctgtgatgaaatgctaagtgacacattgaatattcatcacaatgcacctagcacagggccaagggtagaattaagcagaacaaatgtgatttctgattatatctgtttaattctaggcactgaacaccctcaggcagctaggactccatcccattctaaaaggaagccaggaaagtaggttccacaacattcctttatgtgctgccaaactgtcatgagagtcctggcaagaaattctttccctttttgctttcttttttaacttttaaagactggagtattatttacatgcatagttgtatgcacccaagtaaccaccacttgactcaagatacagaacattctagccagcccagaagatttcttcatccttttttccagtcaatactactactctctgataccattagtttgacaagtaaccattttttcgtaacattaacttagagtcttctttctgtcatttctgttcacttcctctcatttttaatttgaaggcaaaggccaaggagttatctactgttcattgacctgaagttcactagattggaagcagaggaaacaaaaagctcttggacaggttggaagagagatggtgctggtttggttggaagcaggaggctggaaagtagaaaaggaggagagagacttgtggaatgtatttgggaggtagaggtgacaggattggatgtgacagcaagagaaagggtggaatcaggcataatctatgggtttttacatgactttcctgttggagggtgattccatttgttgaagcaaggaagatggcaaaggagcagagtgatatcaagagctctgtttggacttgatatcttgagacacatgctaggtatccaaatgtaaagacaaagtatctagcattcagggggagagatcaggcctggagagagaggtgtatctgacaatcatcagcttgttgatggatttcaaagcctgggatagcatagaattacccaggtgaacagagcaa

SEQ ID NO: 49654 - DNA, 1777 bp, Bovine  19866880716151
atgaatatgtaggccagaaattcagacaaaagcacttcaagggtcttagaacacagctgtccaggagaacttttgttaggataggaatgtgctcctccgtccagtctggtggccacagtcatatatgtaccagtcacagtcagccgtttaaaattttcattgtaattatttttcattttaataaccaccagtggctaatggcttggacagcacaggacaagaaaacaatagattttgacccattttcatgtgtcagaaaaaaaaaaaaaaaaaaaaacagccaaagatcacgagatgttgtggatggctgatttggaactaagagaatgtctgaagagctcttttgtggaatacaatcagatttataccttgttgttccaaaggaaaaaaataagaccacttgagagtaattgcagggcaacgcatttaggcacagcataaaatacttccttacagttagttatatgaaattataatcagatgtcttaaaatgtaaggacatcccccagctctgagagtactcaaggtcaggtttggtgacagtgtgacagggacctacagtttccttgtcaataaaatgaagatgataatacttgtcccaccctcctccccacaggccagtaggtgcactaagaattagatgaaatactgtttttataagtgctctgaaactaccaagacattttattaagcatgactaatactaggttaaagacagcgattaaaggattttatgtacttggagtcaccttaaggctgcttgttcggaaacaagcaagaagattctctttaggatcctgtaccaaaacctcacagttttgacagtaaatgtgcctcccccgtgattatggtaaatggcatctatcattcagttgttgatcttaaattcttcagtgattatttcacccagaaaggatgctgaatttggcactgctgcctttccaaagacccagaaaattcctgaaaataagcaaatggatgccctcacagtacttttttcatggtaaatgccctcatcacagaaacacctggttcaggcttgtagcatccatcagccttataccctgctggttcctcctattggatgtaacagattcatggaaaaaggagccttgtacctaggtaatgtcacagcagtggcctgaaattgcaaagaatttctaccagccttgtgaaccagggcctggcctggaatgcattggccctgcttatccttccacggagacgtgggaggggcagaaccgggatgtggagctcagccgcccagtggtggggatcagcctcccataaagaattcccacgaaattcattagccgcattttagcaccagagctggcacctcttgcatcacaggagtgatggttcagaaagataatgatggccctcaggtcattattgatagaccctgctttcttttttaagcaggaggacatttccttgtccttttctcttgttaaaatggtaagagcacgtcactctcattaggatgtagccccccccagccttcaaggacatgaggggttttccttccttttctgctctcattttccaggtcatctcattcctacatcttgagcagacaattatgtactaataaaagctacgaataaggaaagctagacaactcccaacttacaccctggcattaggtccttctcttctgtatccttctctggagagtaatgatacccacctggacacaagccagggaattaaacttcagccccgattcacagacggctgccttcgttcatggcgtgtggagcacgtaaacatt

SEQ ID NO: 49655 - DNA, 1374 bp, Bovine  19866880785330
ctatttctttcgagctgaatcatgactactgtctgatgaaccttcagagggacacagaacagcacaaaagccatctaaacattgattaaaatcagttgtgtgtttggtacatatatgtatatacactaacacattctcacccttctctctctctctctcttttttttaagggaaactaattatggaagcctggctcgaggctgtaattttgtagaagatgccagcatagttgttttcaagttaaaaaaaagttgcacttttgtactcagagacctcttgttttaatttatgcaaagcttaaaacattttgttaggcctgagtgagaccatctgtgcaagaaataaaggatgcctaagggtaaaataggcaagaatagtaatgctgaatgtgtggagggcggcaggcagcctacaggctttgcaactactgctgtgacctttactactttagagaagaaacaagagtaatttccatatattggctcctctagaaaaagcctggcaatcctcccctcttgctctttctctttttcctcattccttaataataagaagttggcaaggcagaccttacaaagaaaactacagccagtttgagaatcatgctttcacacacacacacacacacacacacacacacacacacacacacacacacacgagtgagacaatctgaggggaaagagactagggataagaaatcaggatgtatgagatgaactcagaaggaacatgataactatctcaattactggaggagttataaagtagaaggaaggaatgaagaaaggtattacatgagggaatactggtatgtcaggcacttccaaagggcatccatatttaattttctttaatgtgaaaatgttgcctgattttataaccccagaaagtaaaagagggacaaacagaaaagacatgagacagaaggggaagtacggatagaaggaggtcggtatggaagtgcagtagaggagaaagggaaccaaagacagaactggtgacctccgaagacaacagactggcagaccctggcaatgctctagtcctgactggatgactacttgccttggagcctgtctgaaagaatggggtacgagtttcacactcttcccaactgcaaaatcttggtctatgaagtgaggaggtttacagggtgggtgagaaccactggcgccatctgtggtggaaatcggggcagtgggggctgtgtcgggtctctttaaccaaagacacctgcagcacctacacttacactgtgtctgccacgactcccctcctaagtgccagcctcgggagagaagaagggtgctgtccttgctgagctaccctgaggctccagaccaacaggtctagactaagggctgtacagca

SEQ ID NO: 49656 - DNA, 1093 bp, Bovine  19866880812994
ttctaaaatattctgaagcacaacacatgcacacatgctgaagtgtttctggagatctttgctggcagatgagtttctcctgtcattcgttctttaaaaaaaaaaaaaaatactgagtgcctccaaagggctgggaaatacaccaggctaagagaacacagagacaggagcatgaaacagttcctgcccgcaaggacattcctgtctacatggaggaagagccgagtaaatgcacacatacaaagctctggggatgataagctctataccctgcttggccaaggataccaggagtgaggagggtacgtgagcccttatgaaggtgatcaggcaattaatcagatcatgggtgagtaagaacttgccagaggaagcttgttacagaaggcaggaagcgccgggtggagccccacatggctgggaggaacagggacccagtgaggagccctcagggactggcaagggagggagggggcacaggtggctggagaaaatctgagtggcagtacaatatacatggaagacttccctagtgatcccagtggttaagaatctgccttccaattcagggtacgtgggtttgatccctgggcagggaacttaagagcccacatgcatgtaactactgacctcaaggactctggagcctgcagcctgtgtgccacaagtagggagtccactgcacaactaagacctgacacagccaaataaatatttaaaataaacgagtattcacggcaagtagatggggaaaggtggaaacagtgacaggctttattttcttgggctctaagatcactgcggacggtgactgcagccacaaaattaaaagagtcatagtttttcctgatccctggaagaaaagctatgacagacctagacagcatattaaaaagcagagacatcactttacaacaaaggtccataaagtcaaagctatggtttttccagtagtcatctatggatgtgagaattggaccataaagaaggctgagtgccaaagaacagatgccttcaaattgtggtgttggagaagactcttgagagtcccttggactacaaggagataaaatcagtcctaaagaaaatcaac

SEQ ID NO: 49657 - DNA, 1680 bp, Bovine  19866880827819
cttacgagtaatgggggcccaaatgattttggaaagttcagacgtactggactccctgcagaaatgaattcagccctgaacatattgatgcagaacctgaaatgaggctgctccggtgggactaagagaattgtgatctctgcaagaaatgagtgggtagtagaattaaagatcagatagatgttcggctcaagggcagtctcaactctgaagttcatcacagcaatttaatcaggctccaatgagtgttgcccagaaaagaatcagccttgtgtgtgacaggaaatagagtgtatttaagagtcttttatttctgctaattctgtgtgcagaggcttcccagatatatacgaagatgagggaatggctacatttgattggtgatggcactttggtttaccttggttcagaaaatgaaatctggagaagatttacacaaggtcatggtcttgtccagaaggagcatgccacatcaaaagtttcagttttaaaattttcacagattaaactggccaaggaccatctttggctggagccatctgttgcctgctctcctgttttgaaactgtttttatgtaaaatatttgtgtatcttcagagagagctgtatagcatagtggtaaagaacttgagctttggaggaaggcacacctggccttgaataccatctcttccacttgctagctgtgtgaccttgagcaagttacatcaactgtcagaccggagtttctttccctgtgaaatgagaatgataactcccacttcacaaaattatggtgagacataaattaaatgaagcaatatatattaattgctttatcatagtgctgcacataatacgtgctcgataaatggtagttccttgaagctgaaggattctcatcatcttcttcctccttcatttccctcttaggtaccctctttgtgagccagagagatcactgttttaggcaccatcaagaaaaccttttatgggatgtgtggattcagaaatggggaaagagagcagagtataaagcctctggaggcttgggcagctgattgattgtcaagagcccaaaggaaaactcaccctccccctaactcctggaagtgcgttatattgacacataattagccaagaaacatttggggagtcatgttatggttttatacatatgacaagaagaatctgtttttcttctgtgttactcaccagctcttaactttgtttactcggtaatgcatacgtatttttgtctgactgataaaatttgaaaataatatattaaatatattaggacttttcttctccactttaggggtctgtcagagtgtgtctctgtgtcttaatattcctatctgtattcttatatttatatatctgtgtatatatgtgtgtgcgtgtaaagagagaaagaggcagagagaatgaatgagtgaatgaatgagaactgagagccagattatcagctttattgatgtctgagtaaacacccaataatttataaaaggcagggcactcaggtgaaaactggattggagaaggctaccaagtatcctcttaaagtgaagcctcctaagcttctatcttgggacccacagggacgtgcctgcacctgcagtccatttactagccagctgcaggatccaggagcacacaccagcctcaactgtgccgcacctgcagtccagagacat

SEQ ID NO: 49658 - DNA, 2195 bp, Bovine  19866880889902
aaagctgctgtggtgagagcaaggctgattcctttaaaaaaggtaatatggaaaggctgtcttttaatagaaattttgggtttgctgatttaaagcagcaacatagttgcattctagagattttagaaaatgtcaaagaaaaaattgcacttataatacaactgagaggtgatcactcttaccattttaggatataagcactttagtcttccttctctctgcatctcacataaactttcaaggtcattaaaaattttccatagcttgatttttaatgactgcacagtatcctgttatattgataatgtcattatttgtctaacttgtttttaagtatttgagttatttattattatgaaaaatgttgtagtgattatgtttttgaatacatatctccttgtgaaattgttcagtaaaagacgaggcactcttttcaaacggtgctcctggttgtcacgtttcacttcagtgtcccagtttatgttgccatcagtgacaaaggaaggtgcccactgaagagtcagtgctttccctgtgtttaaaagacatctcaccatataacagtcagtccttatgtatgacttataacaatgttcatccacatctttgcattcataaaaataatgaatttggattctctccaattttcatcttagtaaaaaggcacaggttccataagaaagtctgcttggaattgtattgagtagagaaatattctttaatttcttcagtttgtgacacacaaacattaaaaattggttaaaatttttaataatgcagagatttgggtagtataacttaaaaatcaagccacctatgctcatcttcttagagatgaccctctgcaagaaagacagactttaacctatactgtgcaaacatagagcaagtttctagttttctaccttttcatactgctaaaacctcagaaaatatgttgtaagtccactggacatattgtcagattttgggatattcgtaataaaagagtcacagtgtaagtgtaaaaccagtaagcagaagagcactgactacataatgaaggattcaggatggagaaaataattctatcagacaacctaggcccaaagaagcaaatgagcacgaaacttaggctaagtttcttacagcttgtacaaaacatgggaattcatggtttatttttcccctttatagcttgcattgtatcatgtactgaaagaagatactaaagtttatcagaaccaagaaatgtttctttgtcactaaacattgagaagaagttgtaaggagacttaaaacaacagacaacagatagtataattcacaggacttgcagagagaaagagagctagggaaggaagaaagaaaggaaggaggcggagagagagatgggtgatccttgttcactattttgtctgtcaatgtgagctcaaggcttaaagttagacactaggttgtgggtatttgaagacattgctcagagtagctggacctaccaggtgtgtatgtctgtggaggtttgattagatatgagatagagcctggaaaaatctaccgcatgatcctgagactggtgatgctcaaacctacgtccatcagggacttccttggtggtccagtggctgactctgtgctcccagtaaaaggggtccaggttcaatccctggtcagggaactagatcccaggctctgctagtaagagtttgcttgccaccactaaagatctcgcatgcctcaactaagacccagcacagccaaataaataagtagaaaatatatatgtgtgtatatatatatataaacacttacctctatcaaaacatgtacctccatcaaaacacacttttcctatgagctaagactgagctatttcaccatcaaatgactgctgccatttttccactgaaagattggggaaaaaaagaacaagtaaatgagtaaaattattttaggtatgtgtttttctaatacatatttatggtaagccatgacttcttacgtaatcaggtaacaaataccaaacgaaacaactgttaactctggattaaaaaaaaaaaagaagaagcacttgttttgaggaagacactatctttcatttgctttttaaaatatgtaatataatcatgtattttctgagtaaaattgttccaatttaaataacaaacatattaggtgttaagaatattccataaccataaacgcagaggagcaca

SEQ ID NO: 49659 - DNA, 1878 bp, Bovine  19866881018899
tatactctgtttgatattaagacaacataaccgtcaacatcttgttaattcttagaaacataagagggaaaaaaaattaagatcaaagaacagaaacagaagtctgtaactatcccttatcctctcccagaaataccttctggcttttccttacccctggtactggtacttgcaatgtagatagtaagccattcctctgacacctgttccatctctgtatctttatcctctaacatgtagacacattcctcctaaaatggtcaactgctcaaggaaaagaaaatattctctcacattgctcacattttcatgtatagatccttctcttctgtggtggggctttaaataagtcccacagccaaaaacttttgtataaagaaacattttggaaaactggccaatcttagtaaaaagcacaaataagatggcattaaaaaaaaaacaaaaaacacccatgagaacaacgataacaacaacaaaaagtaagtctattctgatcagcagcaagaatgcaaacattcacaagtgaaccagaggttcaaacacaaagagggaacatctccaggaagagttttttgtcacaatatcttatgaatgcttctccccttccaacataatagaatttgggacaagagacagcaccattgccaactgcatcaaattactagtggaaaaaggcaagtagatgtgtctttggttctacacagttttgaaaacttcaagacaagaataaattgcatgaccccctggtaacttccactagaacttataggaacaaattgtttgcctcaagctgggtggaatatacattcaaattcaggctcttgaaggaaattattaagtagagtcatattagctttctctgaagcatactcgttttcagtattgccactatatagaccaattatgatacctttccatgctgagaaatgattgttctgctaacacagttctggtaagaatcaaaagcactacatttttaaccttgggggatttttgttattgttgctcccttgccagttccttcaaatggaaaacatcttccattaatctaaatgcaaaatttgtttcggctttccaaagttacttgaaaaatgttaagcacaaagcaataaagtttttatgctcttaagaccactaatgctttgagcttcatattcattttgaagaaatgaacattttatggttcacagaggaatagctacatgaataatatctgcgattataatgcatctagcagaaaaagattaagtttatgtaaactatttaatcagacgtgaaattttctctagaggataaaaattctgaccttatttaagtttactttaaaaataccagtatcatgtttctaccaagaggacccaccaatttttccatttgtgtaatataaatattcattacagaaaaaaacttaacaagatgtactgtagtgacccaaggatgttacaataaacagtccaatataagacagagatcaaacgagaagaactccaacatgctatgtggcccaaaatactcagttgttaaactctaactgatggacaaccattttaaggtggctaccactgctgaagagtaaacggctgcatatgtcatgataaaatctttatgatgtatttttattaaatatggaactaatcttttttaatgcagtttatgtatatttgtcaagttaatttatatggaagattccaaacttgataaatttaataaatcatctatccttatgatacatgtccacagacataaatatcacagtagggtacatggaccccacatctgaccctcagtgaccaagaattgtcctcattataaatgcaggggctaacactgtaacactgtagatggggaaagaatggaaacagtgacatactattt

SEQ ID NO: 49660 - DNA, 1767 bp, Bovine  19866881229331
cctccatttttcagttttgagtattttaaggcgacaatgtgttggctctatttgtagtgaaaggtgatgccgtgttagcctctcagggtgccttctgagacagaccgctggccctaggtccccacgcggccaccgccacaactgaggctggccagcgtcaggagtggccagtttttatgacagccatttcaagaaccacagcttacagcaccacaaatagaatctctttgtaattctctacttcctgggttgatacaaacaccctttctctccattgtcgctcactcaatttgtttttgtttagttaagatgtgccaactgcggggcaccctggaggtggctccagaacacaccatcctattttcacagcattagatcatgaaatcaggcagaatgtctggaactttgggggaagccaggaccccaaagcactataatgatttataacaccttatatttggctgtgctgggcccaaaatgtgtacagaagggttatgagctgatcagaaacctgggggtagcctatcatagtaaaactccctcagtctctcttgtctggtgtgcatgtatgtgtgtatgctcagtcgctcagttgtgtccgactctttgggaccccatggactgtagcccgctaggctcctgtctgtggagtttcccaggcaagaataatttccccctccagggatcaaattcacatcccctgcattacctgcattggcaggtggattctttaccactgggccacctgggaagccctctctttgtctgctacatcagctcaaagacactagagtttagaaaggagatttttaaacgtgtgtgtctgtggaggactgatccctttacatgagcctgccacgtggccccaggggacagaactgccccgtgcacttgaccacgcctgtaggagctggtggagcaagagctctgtccgcctgtgagcaggtctcccccggctccgagctctccgggctgcagggagacagcagggtccttgcgcctctccaccagctcttctttgacctccacctgctcgtgaccactaaacagaagctttctctctgggtccctttattctctctgcagtgtcagctgtctcctctgacctccttggggtggcctttctcaagtgcatctgtaggggagctcctgcccccccagctcccggggctgctccccgccctgctgtcagctccagccctgtccttccacgtggggctcacccctgcccctccctcctggtctcaccacgccccctgcagtaccatcactctcaccgtcacagagcctcagtctgcagggtcacctggaggagcttctgtccccccaactccacgtgagccgcccagggcgagggggtgctgatctgccccctccctgctctgcctcaggggctgagagagaggagaagggtgtgggaggtgaggctggaagggggagcaggtgtgtgtaatctgagttggggcccctggggactctgttaccgctcccctcgagccgtagagaacgcggctctcaaccttggcattatttgttaagtcccatttctctctcacgctcctcatcaaattggctacccagtccttgctgactgcctctcaaaaatacctcccctgtctgatgcctcccttccgatcccacagcccccaacctcattatctcctgccgggagagctgttgcaatcgcttgctagcaggtctgcgaacctccaggctctctcggctccaatccatcttgcgcactgctgccagattaaccttccaaag

SEQ ID NO: 49661 - DNA, 724 bp, Bovine  19866881292325
aaaaatgtacaggtagcaactgcttcatttaaatttctccacatggtccggtgccattcatttcccaacttctccatgagaatgtctcacttattatcatctctagtgatgaccatcattgtcatcatctccagtgatcttgcctacagttaatcttttctttaagaaatacagaaatattttcagtaatagctccatcagatgtttgttcacaaacattaatttgactggcgtatttctgtattgattgaaaagttataaaacgcagcatcctcatctgcccagagtcaacacaaatgtttcctctgcacttgattcaactcagaagccaacgctctacatggtgtttcaaaagctactggctagtcttcataatgttcatgtccattttcagactggtcataactaagaaaggcaaggcctcttcccttggtcaccagccaaacccaagtatcagcaaacagcccctctttcgtccagagtgggagggcgaggcttgtctctattcctatcaccctgtgccatcccccataattgtgcaatttccccactttgtagcgtattttctcccttatgttttgagctagaagtggtggcagagaaaaagactgtccattttattgaatcacctatatttaattgggaaaatgggtggttgtaactctgtcaacaggacacgttccatttcatcgtggaaccgtttttcttcagaaagctttaccat

SEQ ID NO: 49662 - DNA, 770 bp, Bovine  19866881566035
tttttttttcttcctgatttttatgctagtgctgtcggccgcctgtgtttcttagccttcagggttcttttctctgggttgctcacctctgattggagatttattaggtgctcttcagtaagaggggaggaaggccaaaggagaaggaacacggtgaagcaggaagaaactgaaagaagaccgcggagggaggaacgggggagggtggagataaagagggataaatgaagacgaatgaagagcgatgagacagggaggccggaaggggagtcatgtactaaaaccaagctggtgcgaatacatgtaaaataaggtcttgtggaagatttccagcaaaaatggtgtaaatcagtgatgagtaaattaatagggcaattgtgcaaatgggactcactcacttaaactaagctaatacatcttggatgacttagaaataatgcaacccgcagggcataccttttaatctactcaagacccagtaaaaaatgttgtcacttcaagggtaaaaaggcagaaaggatcagaacattgggtgtgtctctctattttaaaagtgttaataagacagattctgagcaatgtgcaaattaaccagattcagaagcttctttgtgatatataaattcaaatggagccttatgtattccaagcttctttccaccgacccaaaatatttctttcagtagtgttttaaagtcctcatttgaataggttaacatgttcaattgccttaaattgaactgaaagtaaaatgagtcactgcacgtgtg

SEQ ID NO: 49663 - DNA, 1786 bp, Bovine  19866880392712
ggggaccctaggggtttactgtacccactaacctcctttgtgataggagcattgttaaagacacagatctcaacgcatggcataggcaaaaggcaagatgtctaaaaaaagtaattggccttcgaaagaaaataacgagagaaaagaacaaaatgaactcctggcttccttggttaagggcttcttcagacacgctgagcaggaaccacagtgcaaaattgctgcaatttaacagggcgtctaattaaaaggagcaacacggagggccttttcttcctactctgggtgttgcttctttctgtgcagggttcaaaagtctgacaactcgaggacaaagagttatgtccccaaacagtaaaaagcagcatattggctactgaatgactggtttttatatccttctgtccaacaaatgttgcagagccttgctatgtgccagctgctgtgccaggcactggggtcacagagaggaaagagatgctagcagagttggagggggcaggagagagtgtcgaccactgaaatacagtgtgggcgaacgcactggggcacatggcctcctgggagcagagggtcacccaagtatgaggccctttttctacctaccacattggcatactgcaccttccaagaggccctcctactaccctaactttaaaaaagttaacacattcagggagtcggggatgggagtgcccacccactgggcctgggtttccttctgggtgatgagaatgttctggttctggaagaggtgacggtcgcaaagccttgtgactgctctgaacgctgctgagttgtgtgcgcctgaaaatgatggattttatgcttatggatattttagcacaatttttaaacagtaatgctttctgaggtcaaattcaatttaagctctgtttacaacttcaagggttactgaacaatccatgaggtggggcatggaggggtatcctgaaagaagtgtggggaacccctagacaacgatgccgtcccaggggcttgactcccaccagcaagcaagcgacacaatcctggctcctggtatccgagatcagaagaatctgtcataccacatcacagcctccctctgaaaggccaccgagaagccgctcccggcagcatcttccctggagctttgcctggtctaactgtaatctctcctgaggcagagccagtaaagtggtcttcctccttcaagaggaattggccagtgcgtacaagtttacttctcggaacgtgtatggtaggctgggtacagcctcgttcctgttaccccgagatgcctcccgactccggccttctgtttccagttacaagtggtcctttcctcttggtgagggagtttgctgaggcacagatctggggaaaccaccaggggtggggggagaaatgggagaaggtggaaatggagcttcctcaggtttgacagagaccccccagacagatgcttctcttcggtttgaactaaccacccagcattgaactcatcatccgagcctcccctcctcctgtgactgtgcaaatatttacttcaccttcatgcagccagcagtccatctgttaatatgctggccagacaggggcctggtgacacagaactgacctagaagtaggtataatcctctcttctaaatgtgcttaataccattgataatcttgtcacataaatctctcggttagcagtgagctgcagccaccaccagactccaagaatctttcagtaacagattccacctcctatcttctttctatacggatttcagctgccatgttgctgagggcttgg

SEQ ID NO: 49664 - DNA, 2808 bp, Bovine  19866880545506
tttaaagatttgtaaatactaggtatgtcttaaattccttggttacaaggatatcattttgacacaatgtttagttactaagtcatgtctgactctttgtgatcccaaggactgtagcctgcccggttcctctgtccatgggatttcccagacaagaacactggagtgggttgccatttccttctccaatgcatggttacattttaagtgattaattttggggaacattgattcaagagactttttaagcacctatataattgtataggcagaccaacccttgaaataccaatattatctttttacatccgagtatttcatattctatctcctttttttttctttctcctttttataaagagaaatgataatggtacagtgatgacaataagctatgattgaaagttaatgggattgattgaagaagttttcttttttcgcccaccttaaatcagatctttcattagcaatgaaataaaagcaagtaagcactgtcttctttagaggaacaaaaattgttactgtgttttcatcctagtgatgttattttttcaacggagttttagatttcttatgtagaatgattttagggttagcatcttttcttttgaataatttatgtgaaattccaaccatttggtcttacatacagctaaaattcatttgaagccaagaattgtgaattaactgatgtccctgagttaatattatgttgggtccaaagccaaaatgtatttatgctttttctctgtggttttaagtggattttaagaatgattctaggaaattccacatgtataatgtgttaaggaataacctaataacatcaattttactactttatagtcaagctcataaaccaggagaattgtataataaagattctaaaaatgaaatactttccaagaagtagtattttagaacaagatggttgtgttgttttcctggggaaaggagggatggacttttttgtttttgtgttcttgatagtcggaaggtatgtaatagtttttgtttatatcatgtggtcattctgtctgtgacttttactagacagggacatttataattaatatttatgacattaatatatataattaacataaagcatgctagagtaaccaaaaatgttagaatattttagttaaaaaatgttgtgcaaaccacatagataagcagaagaaagtcatatatactattttttgaatgtcgtctctctcccctttttaatatttggaaataataattgttgggtattttaaaaaaataagtttatgttgacagctcttttattatgtaacaatttttagtttttgtttttgaattttaattatagtaaggtatactgcaactttcttccataaattttcatattttgatgacactttaagtatctttctagtgactgaacatttctgtccctccaccaaaagggagagtggtacaatgacttttgagagattaactaagttttcatgtattagtttagaatgtgtaatataatactttgaagaaattattaaaccttgttggtattcaagtacttttttcttcttacaatttattgcttgaataactttgtttgaatcttaggttgtcaatggaaacaagtagtaaagatctgtgaccattgctatttatggcattagttaactttacggtacatacagagcttaagcctttccattggattttaatttatagagttgaagacagagtgagttcagtttataacttgttattaaagcttttcttgaagtaatgaaatgacttttcactaatgtattttattaatttgtatattatcaatcttaaggtaaaaaaatgttttctttccttttaaaaaagtaatattgcattagtgacatttaaagattaacgtgattccaccagtattgcatttttgtttctttaaatgaatgttgatgtgtttgcatattaaatataattgtgttctaggttaacttctcagcctggtgctacattaccaaacggacatagtagcttatgtgagtattctgttatgaaactggttagtattgaaatacttataatgttgttagagttctaaagtggggtaaaatagtgtaatttactagtatgctcagcatacagttggaagtgactggattacagtcatggtaaatatgtatataattgttaaacattgagaaattagtacaattgaaataatttaagttatcatggcagattgtaaacagttttagaaattttacattattggatattaaagccatttaagaggttatagtaagctccttatagtctttttaaagtaatttttgatttttttctttctttttatactctgtactttgaaatggaaatttctctcttcttgtagcccttcgaagccatccccatcgaggggaaaagaaaggagatggggaactttcttgtataaatggtgacatggaagtcagaaaaagctgtcgttccaggaaaaacagatttgaaagtgtgaaccagagtttgttatttgatcaactggtaaataggtatgaatgtttttgcagtaagccgtttcatgtaattgttttttttttttaagccagttgtgttttaaaaagtaacttaggcactgacttagcaatcagtacaattatttaaaaacttaatttgaattaaccttggttagctctagtcactttactagatttaatgcaatttatgtgatagcatatttttttccctcatactttttaagctcttgtgcatacttagataatacaaaaaataattttattttaacttcactagtatagtcctttaatatttgctctttta

SEQ ID NO: 49665 - DNA, 2118 bp, Bovine  19866880572776
taataggtatagttttacttagtcaagattctgaattgaaagtcttttgagactgcaccatgttggatatagcctagctgactcctcccctcagcatctacgtgccaatgaaactgtattcttctcaaataataatcattcctacttaatccttgtaatagcctggagaagggagatgactgtaattcctatttgaaaggagaggaaattatattttattgtggtagcgtcaaatttgagtattagttattatttgttaagcacctagatcagtatctgaacacatagtaagtgccgtgtgtgtttaaaatgtcaatgtcagtatgtattttgtggatgtcagtttcctctaatttctaaatatatctgcccttggagtgggaggtgggagaggtttaagaggaaggggacataggtatacctatggctgatttatgttgatgtatggcagaaaccagcacaatattgtaaagcaattatccttcaattaaaaataagtaaattaaaaaaaaaagtatcagttcagttaaccttatgctggctttaaactttttacaaattctttattctatacaatttttaacaccatcttcaaataaaaagattcgaattagttttttttttttttttgtaccatggatctgatagtcagttatttgtagtagtattatgaatttaaatatttgaagctgagtaaacaaaggtcttctatttgtaagttttattttaatatatcatgacagaagatgttctgtttctgtctttcttttcttttttggccatgctgcatggcttgtgggatcttagttccctgaccagggtttgaacccagaccccagcagtgaaatcactgagtcctaaccactggactgccagggcattccctgtttccttctgtttttgaggcagtatcttctaatggatgctagttcagaagaagatattaactgggatattaggtacagttagaaattagatggcttaattattctttgatggtgagctcttttacctgtatgatatacagtttgatcctgcaattgtctaaaccctagttttattatgtaattgtagtactgctgaagctgtactacaggaaatggacaacataaacattagacggaatcgtcgatcaggagaagtagaacggcttcgaatgtggacagatacagaatttgtgagtatgttaatcttaacaactgtccctggtggctcaaagggtaaagaatctgcctgcaatatgggagaccgaggtttgatatctgggtcaggaagatctcctggaggaggaaatggtaacccactccagtattcttgcctgggaaatcccatggacagaggagcctggtgggctacagttcatggggttgcaaagagtcggacatgactgagcggctaacacaacaacaacagcaacaacaacaaccgttgcaagtagtttttattttgatcgaggaattcaaaagagagcagcatttggattttcttgaattaaccagaattgttcctttttcgtttccaatttaatctgagattttattgttttcttttttcttttatccataccttgcttgccacaagcttcctcaaaagaccctctacccttttgccagagagatctcctggagaaggaaatggcaacctactccagattcttgattgagaaatcccatggacagaggagcctggtgggctacagtccatgtggtggctaaagagttggatgcagcttagtgactaaacaacaacatcttaaagtacaactctgattctgttgttaactattaaggttttttttttttgctgcactgtgtggcatgtgagatcttagttccccaaccagggattgaacctatatcccttgcattaggagtatggagtcttaaccactgaaccaccagggaagtccctttaatggttttttaatgtgtgctgaattaattaaaatcaccttagatagccagtgggaatttgctatatgacacagggacctcaaacccagcgctctgtgacgacctagaggggtgggacggagtaggaggaaggctcaggaggaaggggatatatgtatacctatggctgattcatgttgatgtatggcagaaaccagtacaacat

SEQ ID NO: 49666 - DNA, 814 bp, Bovine  19866880580978
taagcaaaactggtatagcgtgtttcttttgcggggggaaaggggccagaggagttagtacaatttcagctcatttttctccccttggcattagattggctttctccttaagacctaaactgttcagagtggcagatcctatcatactgaggttgcctcctatttctcttatctctatcaaggttaaaattaaaaaacttgatcttttggaagcattttaatgctgaacataaataaatttcccttgtcaaactcactgatggctaaaaccttaacctgtacaaatttagtaacttactaagaacatgtgcattttttttccattcacaagtgctgctgttacttgaacagaatgcttctgaattagagtaactggaataaatatttaaagaaaaatagtgcagcaagaacctgagacttgcaaaaaacccttttaccagaaacttgctacaaaaaatctgctacatcttatttcatcaaatctttaaattctgtaacaatttccatcaaaatacaaaatgctaatgtattagacagtaaaatagcttgaactggtatgatggtaataaatactaaagaaagcatgaaaatcctcccaataatcaaattagaggtttcaaatgacctcccctttaaaattggttcatcgttaatcgcacttgcccagcttaaaaatacagtgtgtctacacgggtagcatcttgaattatatgactaactgaatatcatgaaaagttcataggtataaagaaaacaagtggcattattttaaaattaaacctagagttagaaagcgtaaaatgttcatgtaaat

SEQ ID NO: 49667 - DNA, 1932 bp, Bovine  19866880593091
tcgtgtctgattctttgcaccccatggactgcagcactccaggcttccctgtccatcaacaattcccagagtttactcaaactcatgtccattgagttggtgatgccatccaaccaatgatggcatctcatcctctgtcatccccttctcctcccgccttctatctttcccagcatcagggtcttttcaaatgaatcagcttttcgcatcaggtggccaaagtattggagtttcagcttcaacatcagtccttccaatgaatattcaggactgatttcctttaagatggactggttgtatctccttgcagtccatgggactctcaagagttcgttcaggggctccataagatcttacgagaagcccaaacaaacactttggccattgtaatatatccttactgtgtgcttttctcttgccagcactactttcccccaaagccagaaccttgccccatccccgcctggtttcagatcttgcaccgagtcatgcattatggcgcaagaggcagttagtacttttggtatgacctgacaaggaaaggtcaggacaagtgtgcatccagggcatgcccagggggttgcttggaagggaaaatgggggcagagccctgacccatgatggagccccagaagaggaagccagctgcctcttaatttcccagggaggggttctggataaagaagagccctcccccccagagatggagacgagagagcagcaggctcatgccaacaccggtgaaggcgccacaaatcctgccgctgaagtggctgttggttgtatattcactctggacagggattttaatgtccccagccctcggagcaattctgcagccatcagcccagacactacttactcactgaaataaaaaagcagtcgagtctctcccaaggaagataatatcctgtcacaggcagtatgatctgccggccatgtgacggccgttccctaatgtttccaaatagacttttgaatagactcttgtctagaagaaagcaaattgcaagagcatttttggcagccaaatagagagcgtgtattcgtctttcttctgtgcaactctagctgctggtctggctccaggcaccgaggaggattcatccatcaacttgggtcactgatgaacaccatttgctgtgaagagagatctcgtcgaattagtcagttctgcaagattcggaataatgaggcgtgccagaggcagtctgcgagagagcgggaggcctgcttggagaagggaggtaactgtgaagtctagctcccaagtctgcgagtgtgtgtctgcaggatggtgggaaagcaggctccagaccgtggtgttgcccttctcagtggagccacccagcgcaggaagtcagaaggaaccagagatggttacttgtctgggtaatggtcctctaggacatcaaaccatacccgctgccacagctgcctcgtcaatcctaatgtttatgagcccctaacttatacacgcctcccttcttccctccgtttatgctgatattatgctgccaactgtcatttccaatatcttttttatttttcattatcaccattataatgatttacaccaagagcaatagcacaaatgcctagtcaattagtcccatgagaaaagtctctgaatcatgtgcgccttttcaaaaaaaaaaaaaaaaattactgcatcaaaacagccaaaatgtctcaaagcaaaggtgcacacgagcagggacagaaatgggagccttgttcttttaatatcgtttatcgttcctctaacgcatatgctagataccacctttccgaggaagggagattgctttttgcaccagaaattgtgcccagaaaaggaatcagtggcattttttctggaaatctatcatcacaaaagcattttgagacatttgtctttttaggtcgtgtattaagcttcccaggggcatt

SEQ ID NO: 49668 - DNA, 1248 bp, Bovine  19866880602457
taatttccacttgctacacaacagaccctgaggttgtttttctaatacataccaagttgttctgttgctaagaaagaaaacagggctcttgactaaagatatgaaaaaaatctgaacagagccgaaatcatgcttttgaattatatgatactttttgcatctaaaacagtaaaggaataaagttacaagtctaccatgtcaattctgtaagacagagccatatcctttgattatacaactacattctatactaaaaggttattatgcaccagaaatcaatgcttctttcatgaaagtaatattattttgatgtgattataattaagttacacagaagagggggaaaggatctggaccgatcctttctactggctttttctaaccactcaaattcatttatcactagcagtccttagatttgttccaaaatagaatttaattttaaatgtggtccagggaatacagtaaagggtcattctaaagtaaatgtataggtacccactaaggaaacaattatgacaaattaaggtgatttaaataataatgataacaaaaacaaatatatgaactactaacctttatggaacacttatcacatcctaggcactatgctaacatattcaagttgaaccacatgaaaatgacaatttcataaggtagggcctaatatattttctcatctaatccttacaactaccccaagagaagagtagttttccataattgcagataaggaaactaaaatttagaggacttaactttatttcctaaagaactaggaaataaaatggggactgaagcctaggtgcacatccaaagcccagggtctcattacctactgcacaatgtcagtaacctccatgtcttgaaaacctaacagaatgagagtgtaggtgctcaagtactctcacacactgcttaaggccattatagacacttgtgcagttgtaccttcacccagaacccagcaagggaatcaaaggagactgacatccagcccattctttactaggcaaactgtggccctgttacagatgccatctacactgcaaaggagattcactcagtcacacaaaactgctatattggttaacaagtgcccctgatgctgctagatgattttttaaattgtgagaaagttttaacaacacagatttaaagccctaaaagagattatacactctttgatacagaagtttgaccttaaggaatttatcttaaggaaataattaaggacatacacaaagt

SEQ ID NO: 49669 - DNA, 1308 bp, Bovine  19866880659346
ggacagttttaagaatcagtgtgtgtgatcccccaaacgctcttttgctctgcaaccatggccagcagtgcccaggtgaggggcagcactctacctgtgtcttgaagaagaaagacacggagcaaggtccccaagtgaccagtggtgaacaggtggtatgaatgaaaggctcgtaattgtagttaaaccactgagactgactgttaagtacattcaagtcatgtccgactctttgtgaccccatggacgatagcccaccaggctcttctgtccatggaattctccagacaagaatagtggagtgagttaccactcccttctccaggggatcttcctgacccagggactgaatgcgggtctcccacattgcaggcagactctttacctactgagccaccaaggaagaccacaaaccactgagactgggggctgtttattatcgtagcctaactcacctagctaggtggatgcaaacatcatttttctaagtagcccaaatagaaaactaaaccctgagagactcttcagagactcctctctgagtctgtaacccttccctcattggagccaccttgcccaaggaatggcaggcctggattacagttccatctctgccctgacactctatcctcaggtaacaccattgtccaagggggtggctgacccagagtgaccgtgagagtccaacattgtagggatacagtcttcagggacctgggggttaaggaacagccaacagacagcctgcatccatcagcttctcagccttgtgccctgagggtcactgtgaaggtcaaacccagagttagacacgggacaaacccaagggagggtgagggaacatggtggtctttgctgctggggggcatggggccaagggtcccaggctgccggacggggtggaagtgacagcctagaagccaagtgtccctgcttggttaatctaaaaataaacagaaaggcaacaaaaaaatccatgtttcaattactgcacacaagctgttcaaacagccagctctgcactggagatgtgaacttgtcaacagagcctgcctcgtttgcatgctcgggtggtgataaaacacaaaacctcgcaacaggctgccctctggtctgggtaggttttttcctttttaattaaattaaattaaaaatacagacatagaataaagagtgaaaatctgaagcaagtgcatcaagatagatgtgctcagtcatgtctgactctgcagccccatggactgtggcccaccaggcttcctctgtccatggggattctctaggcaagaagactgcagtgggttgcat

SEQ ID NO: 49670 - DNA, 3722 bp, Bovine  19866880672892
tgaaagttttctgcggtgtcaacccttcttgtaaagtgtgtcagctcctgccggtgtctaactccagcttactcgcagactgtttgggggtggttcaagttggtgaggaagtgagcggagagctccagttggcagccaggcagggatgctgaaaaaagtttgtagctgctctgacagcaactttaaaaacaaaatcaacactatcgcctctccaggcaggagcgatcaaacgtgatgtttagagtcagccagcccgctaaccagggttctagaaggaactcagtagagttttctagtagagtcttcaggtcgcaaaaggggcacgtcgaaagaaacatgtcgaatattattggtagtaggcactatcatctccagattgtttggtttcttgaatgtcttcgtctgggtagtagaatagtttataaaagatgagttaacaacaccgttgtcccattactgcgaaagtgacatttgaagaacaccggtgatgatttagtattttttttttaaagtggtagatacctaaatttattacaaggtaaagctctaagctaatacgtatgttttatcactttaaaggaatcggtaaggttgtgttatgagattggttatgaacttaaaaaagagagtgttgcttctgtctagagagaggctaattttctaagagtaatttgactggacattgttcatttaaagtaactcatttaaatccacaccattttgttattcgtaggggaggaaagcaatattttatataagggtttacaagattatgtttgtgtatgctttttttctgtatctgacactaatcagaatgaactaaggtaaatacaatagacacattttattttacttttctgaaatatgctgtatctttgaaaatatgtttggcctttactttgctaaaaatctggaaaatattttttaaattgccctatgagtagactattttgggtcttaccgctctcttaggttgaaataagaaagctaagtctgaaagttgtgcatactattcagaataattattctcaactttctgtcaaaattattccaaacacatacaagtttacagactttctgaagctaacatctattttaaaataaaaggaagacaggttttccctgtacccttaagtacaaataaaatatttagagtgtaaccatttaattgtatcatgttatgaatgcctcgtctattctggagcagtgtctcaatctaaagcaattagctcatctgtcactgatcattttgtggtcccatttttgaattcatggatattatgctgtccttacccccctgaggaatgaggtgaggtaatttgtcaagcagctgttatggagatgttaaaaggcaaggaatcaataatctaaggtggaaatgaacatgtggtagcttttaaattgctagaagaatgaaagatgttagagctctttccagagagatactaatgaaactgtttcaaagatcctttcaaaatggttttaaaagaccatgaacaacaggccaatgaatatttactttgaatttttttttcctgctttaagaagatttgtattctgatccgagtagatgatggaatgatctaattgctttcactgagaaatttaagatatttactaatcctgtattgtcctttagaagaggataagttataattctaaatttaagtttatagactgtatatttatgaagcatgcagtagatttctttgctgtatatttctttttttttttttttttgctgtatatttctgaaatgggttgatttgggtttggtaagctcttcctttcaagtttgttttcagttgcaagaatttagcattcctgactcaccctttcttgtgtacttaaaaggcaccctttatgtctgtgtgtcttagacacttgctaatatctataaagacttacttggtggaaaatggggttgcttgtgttgttgctttaggagacttatttttgtggtaagagatgtattcctcttgatatgatatgaaatgaaaagattccctcttttctatttttgtgtgatgttctttacaggtgatgctgatttcaccccctcccccaccccatttgtcctctctcatttttagactatttgatccactgtgtctggagacattttatttgctctgaaaagccttaggaccatgagctgtcatagctttgccttttccccaagtgtgtgtagggtagtgaaataaacatgatacctattgtaggttattggaatgattttttttgtgcgtacactattttaatgtcaagttgacttgtgctctgcagtttttgtgtaataatttctcctatatacttggctttgtttgcttatttaacgtgtataaaacttgacctcttttaggtcagttaattagcatttatttgctaagagtcacttgcagcaaagtcatgctgtagtcagaaatggaaagcagttaaaaaaaattttcaactccttgttttttttttaatctcttttaggcctgtttgttggtacttttggcttgtcactacttttttgtgctttttgaatcttagttgagagaatcaaaatacatatcttgagtaactttataggtaaatctgcttgatttttattttttaggaaaaaatctctcaggccttctttaataggctcttttatcattctgtactttttctttttcaacattcattcatttgccagtgtaatagaagctgcatggtggaagttgagggttaaacatggaaaagaagcctgagagggaaatataaccatatatataactctcagataagtagagaagaatacaagttcctcagagtagagcaaatttttccttatgttagattcacatggagcaccatataggtggtattgcgtaatgttgtaaaacaatttcccctgtcacagttttgaactaaaagcagctataaagttcataggcttatctccaggattgaactgataatgaaactttaaaaaaattcatttgttggccatttctgtagtccagatatatagacttgcagttttttaggtcatggatgaaatttacacttgtagaagtgaatgcatactagttcttcaagtcatttggcagataatctttttaaccatccttggatacacccttgattgcatgtcttctaaatactgattataggtaaacctgtaacctctgaaagctcagtggacaggtggtaggattaacatttgttatgagaagtaaggagcccaaccagtgtctgcacctgagtggggagtgatcctgtctctttaaggttgcacgttaggaaagtgccgcattattttgagttatgtgtttggcatttctttttggacacacataatgaggtttcatttgtgtacgttcctgagtggtttcttgatatttgggtttttgatcttgtattaggaatgttttatgtttctgttatgtgtctgttctgggggagaattttgtgaaaaatgagtcattgagtaaaaagttctatggaagtacaaaggtagggggaaaaccctatgtaaaatgtgctaactttatttaaatatgcattagacaatttttagagaggcaagtgttgtaagtggcttatgtcaaacaatagaaaagctgtgttaaaattaataggtcgtgatttgtttcagcttttagatattttaagtatatgctataagattctaaacttcagatgctttgagctataagatttggcataagattttttaattttcattt

SEQ ID NO: 49671 - DNA, 2177 bp, Bovine  19866880682120
tctggcattatcatagatttttttaagttattgtgacagttttcttgtaggtggcaggcaagggtcttgagaaaagggtatctttaaaaatttcgcataaagttgctaaatcggctgctggtgcgggggtgttctaaagtcattcacagtcgagtgggggagacaggcttgaaaataaaccatcaagatgctcgctggtgagccgggtgagtgaagtatgccatgcatgggggtcggctgaggagaggatctgttggtcctgagttcccctgcttcttgctgaggctggtgcctcagaccctggtgctttgaagactgggtgttataggaaccccagcttcatgggaggcctggggctgcgggcggccttgttcccaggccctctgactgaccgtcctgtccagacgttcctgccacaggcgaggccgcggggctgcggctccagctctgagaggcccaactccctcttctctgcctcagaaccgtaaatgttcctctcctgacgcattcaattctgctgtggcaaaggcagacgaacgcaaaataaataaccaggaagacctctgcgccctgggctcccctggctttgcggtgattcctgactagctcataattcacctcccacagtcctccaggtggccctcccgcctggcccacctcccttgctcccaacccagggaaaaccgagcccctagcctctgtactgtagagaggatccatggcctgtgctgagaacgcggtgtgtgtgtgtggtggggtgtggccctccctgacctctgttgccccctctaatcagccatcagctgacccctcacccccagacatagcatcttcttgtgctgacggggggcatcttccccatcctcatgagcaggggtgaggggtaatttctgaaagaggagcaggctttcctcacagacccttaaggctgagctggggttcagctctggtggcacaggctgtggagccctggaagacagagaccctcgcccctgtgctggcctttgtgggggcagtgtgggaccctcagggagagtcagctgcgtaggaggatccaagtgtgaagggccagagaaagggggactgtaggccctgttccagggttgatgctgtttctataaaccttctcagggctcctcacgggccttttacctcagaggcctgatgatccctgagggcttctgtcaggcagctaagaggccaggggagaaaaatgcatcttcagtctctgactccagaagcaggtgaccaaccagctcgggagaggctgctctggctggggcccacccccctcctcagtgctccaggggagccccaggcttggggttggggggcgcgggaaaaggagaggccagcccggcctgcagctctgtcctcgaggcttcacagtgttccaaactccctcccagagagggccagagaatttttccggctgtgctgagctccttcaaagatatcagcacatggttaatcttccctccattcagaaatgcagagtaatttgcccgagtggggatttctgcatatttatactaatgtctgtgtttaaagcttatgagacagagaattgctgagagatgtccattagcaatatatacagactgcaattatttctttatggtgtgtcgtctgactgcagaatactttatttcaatggaagtagcaggctctgcctactgtgttttcttatgtgcccgaaaaaatcaataagaacagaaaagatgtaaaaggaggcaagaataaaaggagggtgacctttcaggattctgggagccttgaatatgctattccaggaactgccttcatccttggaatctaaatgtgtgtgcccaagtcggggtagcggaggggaattcagtaagtttgagaccgtggatgagaacttgtgaatcttctccatctcggaggcgaagctctcaattcatttatcccgatgagctgctgggggtgctccttcagagacaagcaggaagagaacaaggagtgtcctcagaggaccccacttctgacctccagctcctttctccccatgcccaccccagggacagactctcagaaggaaagcaggttttgatctgaaacaaaagaagcctcaagctggaggtgcacagaccaaggctttctggaatcagattggaatctggtagaaacccaactttttcctggggtggggagga

SEQ ID NO: 49672 - DNA, 1150 bp, Bovine  19866880781734
gaccctatgggctggagtgcacccaggactctgcctgcagtgtgagggacaggtgtacagggcacatggctggtagacagggcaccacgcgtgggcccacctgaggcagaaccgggaactctctcctccctagtggccatggtgtctcccaggtgtgacacctcagctagctcgggcaccctaaggcagacctgaccctctggccctgcaactggcacctgctcacctggagggcactgccccactttcttcttttaggtttatttcctaattttcctagaatgatggtggcaattaaagaccatttgcaatagaagaaactgaactatggcttaggctttcacctcccctgagatgacagggttgaggtgttgccccagacctgaacctggccaggccctcgggacgggtgagcacagatggagacccaggggcagatggccacagagggacacccttgcaacaaaattgtacaggacatacttggggcagagaggggtccccatccccctacacacacacacaaacacacacacacgcacacacatgtgcgtgtgtactcactcctcccctgcctcctcgccccaagtcctccatggctgtgaattctcttctcctgtgatgtgattcacagagctctgagctgccattagcccctggcatctggggttttccgtttcatttccttctttacctgggtaactgaactgattgtgctcccagctccggttcactaattctcacaaatccttttaaactattgatttatttgctggaaccgtggctctcagaattcttgggagatactgggttttgctaaagcatgtgagggagggctgtgtgtccctttctcctgaccggtgccccatccttcccagtacctccgcccaccccttctctgtgccatcctgtcccttcctcgggcgggtggccaactatccaaagcccaagctggctggaccttcctgatgaatcgcctccaggaagcttacagccgagtgaggttctctgggatgtccccacacatgataatgtaggccttgggactgttgtctggtggttgggctctacagtccttatttgagatctcatttcctcacttgggtccactcttctgtttgcaaatcatgccctcccctagggtctgcgg

SEQ ID NO: 49673 - DNA, 1440 bp, Bovine  19866880791279
agttgcagagacacggagggagctctccgctgggacctgggactcctccctgccagctatgctcctcccttggcccacgtgcacacacagctgtgaggctgcctcctttctcgacaaaagtccatctctctccagttgggattctggaaccaggccctttgccccgaatgctcctggatttgcagaggcctgcagcgaccaacgaacaacctccctgccttgccccttctcctggggcagagggtggggtgggtgacattggggacacacctcctccagccctacatcacattctgacccccaaaccacaggttccccacccagcccctccaggctgccccacatcttggaagctcatcactgtcacgtttcagtcttgaaagaaatgttttagcctcgaaagcaagcacaatatggcttttgacacaggaaccagacgaagtccagccttggccgtgtggatcccctgatggcctgctcaccagggcctcgctctggacccaggagcaggaagccggcagggcgcagagggtgtgtggcctccgcctcccacgcgcctccattctgctgcaagcgaagcgcattgcaaacgagagtattttttctccttgtcagtgagccgttgctgtctgtgtattccaggaggaggccattacggggagttaatagagttttaaatttgtttttaaattttataacgcaattcatcaaattcagcatctgagcacagcattcatgttcagaccaggcaacatatgccaaactggcccgagctttcctctaccctttccaccaccctcaccctcaaatgagaaaaggtgaactctttagggtaactgccaggcactgtccccaaatggggtgggtagaaaggcagcaggttgggctctgggctgccagggtcattctggaactagcccatggaaaggctagcgacttattgaggtgctctgggcacctttcatggtcaagcatgatcgaggctgccctaggccgtagtcaccaggctgaggtgcctacctgggtgtcacggtgacgtggttctttcagacccacgtctgtgacggggcaggtgtcaggagaacggggccacatgcagggcacagatgtggaaagtaaatggtgaagtctgctggacaggacagatgggagcttattcctgctatttttcacccagaagggtttccttcaagggtgtgttcggctggacttcggatcactgttgtaactgggaaatctgttgctgctgagctggaaataaatgagactgaagggagcacggttttgtaaagaacatctcggatttcaggatttgcagcagatcttctgtatcatgaaccacagccaattttgtcttttattaagtgttaataagtgacttggttctagggaaaattctgagatacatgttgcggcaagtaaaccttgtggtctcagaac

SEQ ID NO: 49674 - DNA, 1566 bp, Bovine  19866880834487
ataagtggtagaataagaaggaagtaaccaaactacctgcctctgacgcccaccccattccaacacaccgcaccttgaagcttcgggttgcaacctgtacggtcactaggtatgtttggagtcagggatgggcaagtcccacagtggctgtcttacgtctctacgagtcatgcgtctgatatttctcaatatagactgatgattcttgggttctttcctcatctccaaaagtgtcatgtaatggatgggtgactggacaagtggacttaagtcccaaagttaatcctcacgacacatgggcattttaggggagccacagacagggcattcgctgaccaccacagaagcgactggaacttgggagtcaggcagactttcctgttgctacatctcccacgccttatacaaagtattgccagtgcaataaagttaatggagcccatcatcctatgaaagaaccaattctggccaaagatgatacatctttgaagttaacgaggtctattaattgagcttatgcccttttaaatgagcaaaatttttgaaatctactaaatagccacacatccatctagacgtagttactgacacctcatacctctgtccctggtggttcagacagtaaagaatctacctgcactgcaggagacctgggttcaatctctgggtctggaagattccctggagaagggaatggcaacccattctagtattcttccctggagaattccatggacagaggagcatcgtgggctacagtctacggagtcgcagagttggacactattgagtggctaacacttttcatatctctgtcaccaatggagccaccagggtgcagctctgggaactggctttcagccaacatctagcacagccaccagctccttgggagctcaacagatatgtctgaccagccattctggcctgaatcagccagtacaaccttggggaccggacaaccatatggtaaatcgcgcaaagaaaaaagcgatcaaactgaagcatgctcttttaaagagcaccccaccccaacccacaacctctgaaccctttagtcctggtctcaggattaggtgggagagctgcacaggactcagctagtcagccagcccttcaaaaacaaccaccgcacaggtggctctagggctgggtggtcctcgggctcagggaaggggagcagacaccgctcccaggaagtcgagacctggaactggccgagcataaggatgaggtccagaccaaagagggcccatcatgccagggccccggggcccctgaacacacattgacgctctgcccaatttcagtctcccctcagctaccacagctcgcagttgctgaagagcacaaagtgatacttgttgtgcccacagaacatctgctgaaggcaaaacttgtgtttatagttcttcacttcaaaagactggccatgttataaaaagaaagggaccatctgtcccgcttctggaccccagcgcctcttggaaaagatttctgtgcaagaagacagtgagaagtcaacactgacttcaggaaactattttgaggccggaaaagagtggt

SEQ ID NO: 49675 - DNA, 1898 bp, Bovine  19866880878462
ccaaattgtttactatggccattcccagtatttataaatcataatatgtataataaccaaccaaaaaaatccaaaagacacattggagagcctcgtactgggacgtgacgggtgagtctcaacagagagagttccaggaggactgaccagagcttgtacgagggtagccagagcccagccaggttgggggtaaagtgtgacgtggggtttgagcagacagtcacccactggggacagtcacaggaggccaaaggggcctccaagggacacctgcaggcctctctcaagtgaggccaccgcgctctggactcctgctggaagctgactcagtgacccagctggcggggtggaaggaggcagcgcccccttgtgggcatctctgagcagcgaggctttcctcgccaggaagccgcgaagagtccaggcaggtgggagggtggacggacttagctgggctctgatgcctaatgcagatgacaaacagcgcctgcatcagggcctgctgggaggagcggagcgcatcctattaggaccgtaggctgcgctgagctaattgcattaggcagcactttatctctgggctgcgtttcagatgcttcgcttctgtgaacagcgcaggaaacaaaggaaaagagtgaatctcccgagggagaaacaattctgcggacaagcttccttatcagagggaggcctctgccccatttctgtctgcgggacagatgggagcttagggtaggctaggggcttcgggatttagccgccctcaccaatagtcttagggaatttaggaaacaatagcttggcatctgcagcgtctttgcatagacggctttcccgcgtgtcctgtctgcagcaccctatttccaggctctgggggtgccgtgggctcagaggtgcagaggttgcttccctcatagtaagaggcatctggaccggggcgaggggaaggcgccagtgtgatgtcctgttgggggccctgttttggggttgaaatttgaatgtggagtcccctggccttctctccagtcccctccttcactggcaatacaacaaccctttctgtcagtagggggcgccacagcccctctgtgaggtctggaattcctggaggcctcccaggctagaggcaggtttggttttccaggtcctcctgcagccgccctttgtcttccaatgaatcagtatccatggccccagcctggttaactcgacgggacggggaagggctttgtggacctggagccccgcacctggtccttagaggcttccaccgctgccaggaggggtggctggggtctcctccttaagagtgggtaagtgaaaaagtaaaagtcactcagtcagttctttgcaaccccagaggccctcctgggttctctgtccttggaattctccaggcaagaatagtgcaatgggttgctattcccttctccaaaagatcttcccgagccagggatcaaacctggttctcctgcattgcaggcagattctctaccatctgagccaccagggagtgggcaaccagactgtaaagcttcaggagttcctgctggtctcttgtgcctttgctggtcatctggtttgctcttcagttaactgggctcctgctctgtggtcgaccctgcccaaggcaccagggacacgctgtggctgagactcagccctaccctcgggggtctgctccccgctacaccatctgtgacccaagacacactccagaaggaagctgggggtgtggggcgggcccagggcactggcacaattgagctgtggctacaacaggtctgctgtctgcctgtgtctttcatgactctcacaagcgagttcttacctacaagaaagaggttgtgctggagaaggaaaacagcctatttttttttcttttctttaggaaagac

SEQ ID NO: 49676 - DNA, 734 bp, Bovine  19866880970973
tgtcaatggaacaaaaattattccgaattatataatatagacctctaaagtcaaaaatcacccatccagcaatatactatatatatatatatatacacacacacacacacacatatatatatatatagtttgtatatgtttttctttcctcccacctgaactttgtagcatttatttcataaaggtgctttacaaaccttcttcttcaccctcagtagagacttcatgatgattttgtataccataactatttcttctcagtgactttcttcgccttttcactcttgaatacatatccatgttttccttttaaagagagaaatctgtcaaatattaacatgaaatttattcccagccatcagtatcattagcccaatgggacatgcccacttgataaaatttactgaggatctatttgcaaggcacagatcaatgaaaatggaccttactgaatttaataaatgtatgaaacaagaagaaaaataaaactcataagatacttgaaaattgggcagggagaggggaaatgtgcctaagggaatgagggaggaagcacttgaaatgagccttgaaacaaagacagaactgcattaagtcctcaaccagaagtattaacaagagtaaaagataggaaagtaagaatgatgtgtttgtatttggacaatgatgtgtgagaagataaagtttgaaaccacattatgccagttgaggtgatttggggtttttttcattta

SEQ ID NO: 49677 - DNA, 1085 bp, Bovine  19866881027575
tgccctgatggacgggcttctgctgcagctcagggcaccgtgacagacaccaggtccagggcccaagggtggcctggagggggggaccagaggataccaggttcaggttcagccctgctggccgggccgtgtctccataattcggtgtcatgtctgcttgctggataccagagcagcgtcttgtcccacagacttgcctcgacatgaataattcatgaataaataatcaatcattgtgaatgtcacagtcctttgctttgtgttgtccatgcgggactggggcccaggggccactgtcgaaggagcccacggcaccggcccctgagactcctgtgctcgccgacctgcgctctgtgcacccccaaactcacggcaggacagtggtgctctgtgtcctgggatgtgctctgtgtccccaactattgacacacctggtgtgcacactggccccaagatcacaggtgactaatgacccttccctccttcctatcattaaggcatgcagaggagtgggcgccggctgtgagggcccgaaggcacgattaatccacaggacggtggggagcccgcgctgcctccagacagggggctgaagaatgagccgcggcccgtccagctcgatcggaaaatgtatgattgcctcgtttgggggagacgtgctgccaagtcggttggaacagtccctgcccatctttcttattttcgtttccctctctgcatctttagtgtttcttctggagcaaaataataaacggcagccggaacaccatcttggcaaatgcagcacaaaggaattctctgggtgcttctggggaagccggcctggtcctgtaacttggcaccaatgtcagcaggagctggggatgccgctgggaaatgcctccctgggggtgcctcggctcccaggaccccctgtctccaccagagccccaccgactcagacaacttggttctggttgagtctggggggctgggcccactccagccctcctgcaggaggcctcctccaaccagccctcccttctccgagctcacagaggccggctgacgacccaggaatgggctgggacattctactcccccgg

SEQ ID NO: 49678 - DNA, 2956 bp, Bovine  19866881367501
aaaaaaatgaataaagatcttttaatggataaagatgcataatgtatcaacagcacatagtgtgtttacatacttttttcacccttttatctttaatccttactaagtcttataaagacaccaaggtaagatatatgacaaattgtcataaatgttacttttctttctgatctaagaataaatctaccaaaggtttctaaaatcatttccaaaattcaacttatttagtgacttggctcaaaatttattttgccctcaaaactgtactatcattgcaatcatctctccattcgttcccccccccccatttctatttttacaatttacagttacagggtaattggagaagaaatttctatattagtctactttcaaaagcacaggctaaagtgatgagcattcataagcattccattacttatatgaaagattaacccagtccatattaaaagtgaaagaaaagtattcagcttgctctttctctaaaatgtagaactgttaggcttttctacctgaccagtcactcctgacattgtgtccttgcttattctccaacaaccaaagtgacaagaggttcccttttcctttccttactaggtcatgtagcactaaagccaggaggctggaccctgctcgatcaagagccagctcaattatttgataacgtactcgtaccctaagcaaaagctaggaacttttctgaagtttacttctaatgctttcatcccagacaagagaaaatgttcttatttgtggggaggtcaaactagaggtattttccccatctttttataatcacttctaatgcttagtgagattttggtcaaataagagaaattggttatatatgtgccacaagaatcaagatttttgtttcagtcactgttctatcacctttttcaggggtactttttgtgaaaagcccatttagaggcacagtctttaaaatcaagttttatagcatctctgagcttgttcccaaaactaagaccttaggaaagcaactcttccatagggagatttagacatactaatttaagtaacataatgtaaaatagtcaaatgatgagtcacatatgccatctactggtcagagaaaacaaaactcacatttgtagattaaaaaacattttaacacttatagaaaattaaaactgttgaagcaatgttcaatatattttagtgggtaaatatttttatcagttgcagagaatgtaaggatttcaacatttaaattagagtgttatgttagataatccaggtcacgattcaaggtacaaccaggacaaatagcttaatcagcttcctaggacgaaatgcaccattaactccttcaaattttctcacacatgaatgccatttatcacaaagaggacaagattaaaaaaaaaaaaaaaaaactgagtctggttcattcattcaacttcaatgccactggtggaagaacttattatggccatctttactgacagccggagcagaattaccacctttatatcagaagaatagcatacacaatccgaagatggccatctttagtgaaacataaagattacattaggaagatgctgtgtttattaccatttgtcttttagaaatttttacagatcaccatgaataaggaaaagtgaggaaaacatagaacactgaattttccccttctaaatacacctcacttacaaaacaaacaaaagaaaacaaacaaaaaagaacaaaacaaacagaggaaaaataaataaatacatctcacttaaacaaaaccagaaaaagaaagctgaatagatttttctcagaaaaatcaacttcctgctgttaattcaggcactctcttacagcacagtttccatttcccaccataaagagagcaccctgcataatatacagcaaggggttgaaggtggggtggataatattctactggctgcatatctctttccaaaacccaaagtctaaagctgaaaatatttaaatctagttcaactacaacagcaagcactgaacagagatagaaaaaaagcaaataaggttaaagaaatatactgattcagcatcttaccccacaagctcctggcagcccctttggtgtatgtgcccaattcctaacacttctgcctcattcacagttgttcccactgctggataacaagatctcaaaatactcacatgcacatttatttgcagaactgtgccagacatccattggatttctttgtttgtgccgaaatgcctcttcaactctagtttctgtctttcgagctccagtaccatgaggatttatttgttctgctgttaccgataagcctgcaagcagaagataagcgatacctatttaaatatccccagctaaataaaccaacaaggttaaaaaaaaaagtctgaaatactgagttttaaagtcattaattatacttggacagtttgtaatttggatgaaaatagtaccttttgtcttaagatgggaaagaaactagatatcatatcataaaaataaaatggtaggccatgcttatttacacttaatccccaaagggccccatgttgactaactttattttgcaaagggatacatttcacatttttatgactgtaagacaataagattatatattgccaaaaagtcatgatttctgccatcttagaaagtataagcatatactgggccactaaaccccattcatataaaccatttccatctgatataagctggctgttacagcacactgtgtaagtttggtttttctgcattgatcttcataaaaataactgttccatctcaattttctttacagatctctttcttctatgctgtctttagtgttaccatccaagtttctaaggactatctctggaatcccttttcttctcacttcaatctacatcttccaccacaagtatcattcatgccttcagcttctactgacattatataattattcccaaatcacattttaatcca

SEQ ID NO: 49679 - DNA, 1078 bp, Bovine  19866881470266
tgaaagcttgccgggcattataataagatccaccatagaactccttgagatctagctcattaaagtcccacgatttttcctactattgcttgacgtgacaacctggtctctcgcggagctgagtaattacgaaaagatcccctccatgaagaacaggtcttgccagccaaaaggatgggccactggtatttttagacttcattagtgccctgattttaaatttcacattttgtttcttgtaattatcttcccatcgactgagttgaaatttcagttggggctctgttactgcgccttcccagaaagggtgttggggctttcatttaaaacttaaccagttgaaaaatacaggtggtgtggaaatgctttttgatttgcaataggtcaagcgattgtctctcatctctgactagagaagccagtttgcatgcagctccctgtaatgaatgttatttcaatgcattgtgtgcctatagattttttcttaagaaacttgagataaacctttctttctcgaagaacaatttggggtgggaggaatctgtaggatttcttttctttttttttaagattatatattgaaagctaattaaattttatatgtgcaaagtgataagggggggatgaagatttagttctactcgaatcctgttaggaaatccctgagccgtttgttggtcttgctgcgttgcacccctgagctgatccgcgggcagaggtggtgaccagcatcagaccttgtgaatccggaaagtccggtgtccctgcacccgtaccatgtgaacccagctatgtgtgtgtcaccgcagaggtgcaggctactgctgtcattctttctagcccctaccttcttccatgaaggacttctggtggccaggagggtgaccagagacccctgaaagccccaaacactgggcctagtggcgagctgcagaaaggctattgtaatttcatctgcatgtccgcagagagagaagccaggctgcaactgtcccctctggcttctggaccaaaaagcaaagtccaagtgaccagaagtgaagaggcttatctctttgactttagatttcataggccc

SEQ ID NO: 49680 - DNA, 1199 bp, Bovine  19866881673475
ctaacactatatactcccacaatttagagagcacaatacaatttcaagataatcgagtgcaagactagttacctgtttaggaaggaaatgcacagtgaacagggtaggtctgtctcttaatacaccccacccctccacgggctaaagaatcatgataaatagcaaagcagggccagaaaccctcaactcccccatccactgcttcttcaggaatcacatatccaagggaagtcaggagtgggcagagagctctgactcagcaacaatcaagtcactttgacagtgaggattctgctgctttcttccaccactggtttataaagcaacagtgtctctagattaacacccctcagattcaactgacaatgactgcctggcatgaatataccttaggatgtgccaggtaccaggagaggcaattaacatacaagacttatttaatccctgcagtgataccaccctgaagtttaattcagaagatggaaagacgcagaaccagaaaatacaagcaactaactcagaatcacatgattataataaacaacagtggaaatataatgtgggtttatatgactctgatataccatactgccatagcatccaagtcttctcacctacctctcaccccatcccaataatccttctgtcagaaatcccatcctcttaacaactgtggatttattcagctttcagtcataaatccattaggaaagggacaataatcagacaggagcatgaagaggaagcagccaggaaagcaatgccttctggacagtaaaccctctaaaacatacaccaaaatttattatgtgtgtgtacacttttctaggaaaaggggtgaaaactgcaacaaattctcaaaggggtataattattcatcaactattgctactggggaccagataaaatatgcatgtaattaactctgcagtttaaaacctcaggaaaaattttaaaacattagcctctaccttctttatccagttctgcatctttaacctctacatcagggccaggctctaacttctcgttagtgctacattccagtgcctctagtttctcaggatcatctccatgattttcatttgaagtttctggtttttcttttgactggtcctccaggagagtcttttgttcagaactacatttatctccactgccacagcaagaaactacttcagctttgccattctgacact

SEQ ID NO: 49681 - DNA, 1684 bp, Bovine  19866881741050
gattaaagggatggaaataaaacagagcaaagcagaacaccgcctggccttggttgagcttttcaggctccttagtgctgctgcccaaggccaccagcatggcgacattattgacaacacacggcccacaccccaaccactcccaggggtgctaattacttgccaggattaattcttcagtttactagacacttcccgcagccgtgccagaaacaagagctctggatggaaggtacacctactgtttcccaggagctggacttcgggccaaaacccacacctccttttgcacaaggaaaaaaacccccagctctgctgctatctgctgggagcaccaattctgtgaattttttttggcttggactttcttagaaaaacacattgtataggaaaaactctgatttttttttccaagtagaggtaaacccagttcttccctactgtgtgtctttatcctgtgggtctcctgtacttttacatagagtccttacttctgacactgctggtcaccaaatgtgtggggtttttttcccctacaagtctccaacagcagccaggtgtcttattgttcaactcagttccaacactttctaccttgagatagacttaagtctcataggttaagagtttggtcctacaagactgaccctccccacccccagttcagatgccagctgcaagtacaggtcatcacctgtgcttctgactgatcagcaatggatggagtttcccatgacttcctcaggcttgattaattttctagagcattgaccttagggaaacactcatttctactcaccagtttattcaaggacacgataaaggctatagatgaacagccacatggagagacacacagggggaggtctgggaggttccccatggagctggggtgcagtccccttccagcggggatgtgtttaccacctgaaagctccccaaaccctgtattattggggttttatggaggcttcatcatataagcatgatcaattattatctcctcttccttcttaagggaatgaggggtagggctgaaaattctaagcttctattcatgtagctccatctttccactgaccagtcctcatccaggagctcacccagagttgccctctagaacagaagacactcctatgacccaggaaattacaagggtttcaggagtcctgtgttgggaacagaggtcaatgacctgtattagaacaagagatgctcccagtgttcttacctcttaggaaattccaagggtttcaggagctctgtgccaggaactgggggcagagaccaatacacaccttgtgtaagaaaggtgagaccaggattccggggagagttgccgcctcagacgctggaataaccctgcatgactggccagctcctatcttattctccctctaaaacagaagatgcgctgatggctgtcagacttacagcccctctgccagccctggccggcactcagcactctgccaggggctgtgaggggtacagagatgctctcaagaagcccccatctgtaggggttggaccagttctcaaggggatcttagaccagcagacagagagtggtgcttctgccgggcatgggtgtgaaacctgttgagttccaggacgcggtactgtcccctggcctttcacacagcgttagctaatcatgtatgtatcaatccatccatccatc

SEQ ID NO: 49682 - DNA, 2937 bp, Bovine  19866880467826
tgttttctactagctagacaataatccacagtgtgaaactacatttagttcctttacatcacgctttatgtagtggacatacagtcatatttcactttgtatccaggtttcttccactcaattttctacagtcatttcccattgtcattataaaatgactgtcacatctctcctcctctgagtcagttgtgagatagagacagggttcgcataaccccagaatatcaggtatactgttgggagaagctgatccagagagcacacatggatccgtctctaccatgttcctcctgagctgactgatgcagggacagctgagcggcaaggagctgcaggcctccctggcagggcagccggtgccatggggggaagcataaattcacaggacgtgtgggcagcataagagttcctacttgggcctgccccatgtcccctctcctggccaccctagaagtgaaatattggtaagcagttccatcttacagataacaaaactgaggctttgaaaagagattggtgggaggtgccctagactgcttacctgcccttagaggactctcctcctggttaatcatcccatttcataggaggtatccatctttcccacagtggactccgtaacctttagaatcacacttctcatgtatcagtctctagggtgtcttaccactaagaaaatccacaggtttcttaccctcttctcctttcatataacatcttgaatacttctctctcagactccaaaggagaaaactgctaagaagattaaagctattagagaatatcaattattttataatgagggaaatctataaatcttttggtggctatctggcaagaacacagcatgcaggagttgatatgtttatgggatattttgtgcatcttaaaaaaaatacacaggattttatgaatcaagcactgtataaatgatttactgggatagcaaaaaaaaaaaaaaaatcaaataaatagctctgcttgcctctgaagcatcaaaagctctgatgtttggtaaagaatggttcctgtagtggaaaatagctatgttatattttcagaaaggtgatgcttctattgaggtgggcaaggcttctacattttaaaaactcacctcagcaaaactgtgcaaaattgctgatattctcctgattctcttgtgaggattaacatctaaccttttccactgttttggtgttcccttaaaaatgtaatgggggagaagcaaaacccaacaaagcaggtgactggaggtccttggaataagatctccaagcagagagccacagagctgcccccttctatcataatctgtcttcagaaagcttctgggcctctccgccagcttaggtctgacatgaattgttatttgctcagagtctaaagggagatgagatttgaggctgaaataaaagtaagaggttccttagtacctaacttgatcaagtgcaaaccaaccaagtccttttcctgtcagcttctttcagctcagtaagttgggggctgaaagggctggttttgtccgccttataaaggggaagaagcaatagcatcagtagtgaccatgctgtttacacctgaacagcactcacgtgtgccagacactgtggtaagcaatttaaacatagtatctctaatttcactgggagcctcttagaagccaacatttatttgcctaatgggaaaattcagctttagtagaaaatgtaaatccaagtacaaggaattcacctcctctccatatcccaccccctaaataaaacaacttttagctaaaatcaacatcttcttggtaaagatatgaagtgctcagtcatgacatttgatacacattcatatgtctaagaagtatgttctgctgttttcattcacaataaatgtaactggacaggtctgatatgcagctctagttcctctgcttgctactcaaaaggtcaatacgcaggagacaagtgctggtagaaaaagaaaaattgctttattcaacctgagaaggtgatagactaatgtcctaagactacctttcaagttgatagttgtgagataaaagttttgaaggcagtatgagggagggaactgcagggtacatggtcagctcatggtcagctcatggtacaattctcgggtgggttggcatcaagatgaagcttcaagcatcaaccctcttctggtttcatccgatctggttgcacttgcagtcagcagttttctggtggggatctgtctcctgtaaaaacaacttgggaatgtgtgtcaggcgtttatctatatctttcagggaactgggagttcagtgactgtgtggttggtttatagtctaaagtgttatcagtttcttggcccagcaagtattcttactttctgctgctgttgctgctgctaagtcgcttcagtcgtgtccgactctgtgtgaccccatagacggcagcccatcaggcttccctgtccctggggttctccaggcaagaacactggagtgggttgccatttccttctccaatgcatgaaagtgaaaagtgaaagtgaactcgctcagtcgtgtccaactagcgaccccatggactgcagcccaccaggctcctccgtccaggggattttccaggcaaaagtactggagtggggtgccattgccttctccgattcttactttctacatcttcataagtcctaatcattaactcctgagccagccttttgggactcgggaagcgtgggagaccgtaacgtttctatgaataagaggcaggtggaagacatggtggggtgtagggggtctgtcctgggaaggccccatagcgtcctgcttggctccataaatattagccagctcctctaaataatgttgattctggactcttgagagtcccttggactgcaaggagatccaaccagtccatcctaaaggagatcagtcctgggtgttcattggaagcactg

SEQ ID NO: 49683 - DNA, 4417 bp, Bovine  19866880500531
acacaactgctgcctttccccctctgagagcacaatgggtataagcacagactccatcagcaccagtatcatccagtgggttgggtggggatgaagcaagagaggccagaagtgacagttccagaagctgagtgatgggtccttggggcttcttttttctgttctactttttaaaatatgtttgcaatggtacttaatttttttaaaagttcaacaaggaagcctacatacagactctcgaaccagattgcccaggttaaaatctgagacctgccacttactgtgtagacccgggcaaagttactaaacctgtcagcacccatgagtcctcatcagtaaaacagggatactagccacgacctgccttgtagagtgtttgtgaagattccatgagtaaatacatgcagggggcttgggttggtgcctggcaaggtgcatactaaacatgtggggatcattagttacagaaataatggtcccaaaggtcattgtgttgctgatccaaagtcatcaccttcaagggatcacaccatcagccttgcaaatcctctaactcagcggggcggtccccaaactttttagcaccagggaccagttttgtggaagacagtttttccacagaccagggtcagagtggcagggtgatggtttggggatgattctcataaggaacacgcaacctcaatccctcgcatgtgaggttcacagtaggatttgaggtcctatgagaatctaatgccaccaccactgatctgacaggagacagagctcaggccgtaatgcgagcgagggggactagctgtaaatatagatgaagcttcacttactcacccactacttacctcccgctgtgtggcctggttcctagcaggccatggactggtgctggggtttgtggaaccctgttttagctcatacctgccacttggactctgtcttggtttgggtttcctgaagcatatcgtgagatgggctgtgagtgcaagtggttaatttgagagaggctttcaggaaacaccagcaagagagcagggaagtgagaagaggaagtgggaggcagctaggaagggcgcctatgacaggcaccaagactggcaaccacggtgaccccacagggagcctacacagagcacatgctcagagttatcccacctgaggggcgagggggctggggtggttgtctacacacactgtggtccttggctgaggtacaccatgtaggcatagaaccccaggcagcatcaagtgccggcaggtgggaggcaggcacggagagaacaaaatgctgaagaggtatgggcaaagcacgcagaacccacttgtgggcactctgacccatgctctgcaaacacctgctgaaggccttgcactgatgggggctcaccttaggatcaacctcaccccttgttggatagctctgacttatccttatattaggaattgttgttcagtcactcagtcgtgtccgactctttgcaagcccatggacagcagcacgccaggcttccctgtccttcaccatctcccagagtttgctcaaattcatgtccattgagttggtaatgccatctaaccatctcatcctctgttatacccttctcctgccttcagtctttcccagcatcagggtcttttctagtgagttggctcttcacatcaggtggccgaagtactgaagcttcagcttcagcatctgtccttccaatgagtattcagggttgatttcctttaggattgataataagggcaaactcaattctgttttgctttacaatcagagcagcccctggaatgggcacggtgcttctgtggtacagggcagctgccaccttgctgcttcaggccagacatctctcagccctggcattttcacactgagccacgatctggcctcagagtctttcttaacactgctttagctacccattacaaacctatgagtacaggcatttccgtgacgcctgtttgccgtccttgccctagggtttatgaaactggggggagccagagagtggaagactcactatatgattctgggcaaggcatttaacttgccctagctgttcctctctgcgtagaacagaggagttaacagaatggaggcagagatgggctttgatgtggctggaagagccagctctcttacagtcaggggtgggttttagatcttggcctcatcatttataaactgtgttctttgggtaggtcacaccacccattctgagcttcacggtgtcttttcatacaagacaggaccgtagtatccccatttgtagtggtgttgtaagcaacggagattatatatagagagagagctccatgtgtgagcagagcctcagtaattgttccctgtaattgttatcatcataactatcatcatcctcatctaaagtcccttccagctcgaaaattctatgactttatgagatgtcctcatccaagaagacggcatggtaaaataaggcaacagtcctgattttgtgtaaatgttctttctaatacggacaggaggaacataattgcccctaaataattgcaccgactttgccacaagctgtcagaaggccttaattggtccatctgtaatgactgcggccatctgcgtgcagggtgatttagcggtgggtctctgccggagcggggccctcatgattagagccggacggggccatatatctccctctgatgggagtagtggtgtgtggtatagaagattagctcatcctcatgttaacgaccgaccagttgaacctagccaagaagaagcgctggtcacaagacaatgactatggatttttttttttttttaaggtagtgttcctgccctaacagcagcctatctggagcgtgatcgtgcctcatgctatcatgtctcgcttcccaagaaagtctcttttggaaagatttagtccctcaattagggcgaattgatttctgctctctacagagccactgttccaaagagaagtggggaagggcaggaggagccatattaatctttgtgagcaagcgagaggcgacctggagtgtttttcagccttgcagcctggggttgtatctggagttaatctttcctctgtgtatcttttaattgttccgatttgcgaggtgccagacaacacagcacaaaacacacctcatctctagtccttacgtttctgaagacttaaatcaagtgtttccccaagtgcaccagcacgaaagtgattttaagtggtacctaagatgatctcaggtggctctgagactttgcattaagtaatgttgactcataaggagagtacattttctctcttcagatctctctttcatttcctctgattacctccaatggaaggtctcggctggttacccttatctcccttctttaaaaagagggaatcaagatctggctgaaacctagtaacattactttatccttattactttggcttttttaattcattagctctttatcacaaatggtactgattttccacttatagtgtttaatgtttccttttaaaataaaattaattaagtaaaattattagcttgaaaaaaaagtgagttgatttaaaaaagaaaatcttaaggaagttgttgtaaggtaggtggaagtggcaaaaatcatgcaggtaatatgatgatgagagattgggaaaacacagctagagagggggaaagcctcctgtttctacggcgaaccaagcagtttcctggctgtattacctggggcaagtttctaagcttctctaaggatcagttttctcatctgtcagatgggaagacttgtgatgcagagtcagttcagttcagttcagtcactcagtcgtgtccaactctttgagaccccatgaaccgcagcacaccaggcctgcctgtccatcaccaactcccggagtccacccaaacccatgtccactgagtcagtgatgccatccaaccatatcatcctctgttgttcccttcttctcctgcccccaatccctcccagcatcagggtcttttcaaatgagtcagctctttggatcaggtggccaaagtacgggagtttcagcttcagcctcagtccttccaaagaaatcccagggctgatctccttcgaaatggactggttggatctccttgcagtccaagggaccctcaagagtcttctccaacaccacagttcaaaagcatcaattcttcggcgctcagccttcttcacagtccaactcacatccatacatgaccactggaaaaaccatagccttgactagacggacctttgttggcaaagtaatgtctctgcttttgaatatgctatctaggttggtcataactttccttccaatgagtaagtgtcttttaatttcatggctgcaatcaccatctgcagtgattttggagcccagaaaaataaagtctgacactgtttccacggtttccccatcta

SEQ ID NO: 49684 - DNA, 1183 bp, Bovine  19866880504055
actgcaaggagatccaaccagtccatcctaaaggagatcagtcctgggtgttcattggaagcactgatgttgaagctgaaactccaatactttggccacctgatgagaagagctgactcatttgaaaagatcttggtgctgggaaagattgagggcaggaggagaaggggacaacagaggatgagatggttggatggcatcaccgactcaatggacatgggtttgggtggactccgggagttggtgatgggcagggaggcctggcatgctacagttcatagggtcacaaagagtcggacatgactgagtgactgaacttgactgagcaggttaatgaagcaaatcacccaaaaagttagcattaactctaacctgctgcccaaccagacccgtggtcagcagtgaaatagactcattgccaaaagatacttaaagcatttcttcccaacttccttgcagaacgtacagcctccaaaggttcagtcatatctttatcaggcagtcacagttccagagccaattttggcttgatttgaatccagaggcaccttcagatctgtaaacaccggaggcttaaaatgttaccaattttcatagcccaaaataggcaatgcttgacagttctgaagatcaggaaggccagatccacacatttgtatgtctcttatttattccaaaaattaaaagattgcagcaccgtcgatcaatatcacgtttgtgggcattgaaggcttcatttctcttttttctcgttttattctcctgctttcctatctcaaatagaagaatctcatgaaaatttaattttcacatcattgtatagaataaagaaacaggcataggaagaccatagtgacattctttcctcttgtgctacttaggaatgttgattcttgtaaagtatttacagatgcagactgcctttttcaacctttgggatccttgtatacacttaggttctttctataaaagaccacactagttgctcctcccagaatgataaaaagaaataaatctatttgtttgctttgtaaatgcagacctcttcagagatgcccacattgtttatgagcagccaggaatctcaaaacaactaataactcctactgtctattggagtcctctgttgatgtgtctgttaatgaatggaatttactgggcattgctagtaatatgtagtaag

SEQ ID NO: 49685 - DNA, 2996 bp, Bovine  19866880573396
gctgctctctagttgtgctatgcaggcttctcatacgtggtggcttctcttcttgtggcgcacagactctagggtgcacgggcttcagtagatgcggtttctggactctagggcacaggctcagtagttgtggcacacgagcttaggtgctctgtggcatgtgggatcttccctgatcagggatcaaacccatgtctcctgcattggcaggcagattcttgaccactgagccaaccagggaagtcctcaatacattttttctttttttaaaatattaatttacctcaatacattttttaaaaaggaaaagaaaaagaaatgtctggcctcagtttcctcatttataaaataagtcatgggggaggtgttcccatccagcaatgccaagatgggattttaaatataatacctaaggggaaatcagctggggctgcacacactgaacacggtgggtgctgcctcagtgatgaagctggcttggtcttggattcaggtaataatagtcatcggttcgtttaattcaaaatctctgatccccaaaccaagatgcttcctggctttgggtagatcatagagcctgaacacgttagattgtgaaggactctttgagactgaaacttgtaagtttctttttgtccttcccttctatctggactcaagtttattttatgaacttattttataaccctcagtcctggactacttcccctttctttctggaagcagcactatcatttggagattcacctcccaaaccttcctcagcaccttttcatgtatctatccacctgtagccagatatccagatttattctgcaggaggtagggatttatatcaaaggaatcagcctacccagatttgagtaccatttctaccattcagccctgtggccaggggacccatctatgctgggacataaagattcatctcattacacctaactggggttcagctcacggctgggtggtccagtctttcagaaaagctctaagagggcagagacttggtctatccttttctctggtgattcccagtgtctacaacagggcctggcaggtattactcaatagctatgaatgaaagaagagatgaatacaagcctgatctcacgcatgtagcccatcctctgctggcaattacttccaacttctcaccaacacaagtggtgtgtgatgagcatccctgaacatgtcctcccacccctgtgttcacttttgagaaacagtaaattgtgggggggctctccctgtgccccaaagagcacagtttgaaatcctttgattgggccaaagctttcattctgagcatagggagcccagagagggctgaccaccggccccaaggtcacctagtactttaagaattgagtagagtctcaggggtagtttgaacttctctgccatcttggactctcttagtatctacactgtctctcaccccccaactccagcctatctccctcaggagggtgactttagggacggaagttctgattcactgaagacacagagaaggcatctgcctccagaatcaggggatttcatcctggggttctcagtcccaatattgacttgttgaaggatctgcgtaagttatacttcctccctgggtctcagtttctctaatctgtaacgctggctaacaattcttgcctaactcttgaagtggggataacaaaagagtttatgaaatagagaagagacataggaatctaagagagggctagtttagttttacaatatagaatttttaaaaacaattttcagattaaaggatgtaacaggtttccacttttataaaaagaaattatagatatacatatatatatatttgaataaatttgtataaatccagaaaactaacagcagttacccagaaaatgttatttatcagtggcttcctctggagttcataattacagaggaagtaaaatggctattaacattgtcttgctacactgagttttgtttgattctgtaaaagcttgacaaaacaaaagatatatttacacattaagggcatgtattcatgcattctcagtcatgtctgaccctttgcaaccctgtggaccgtagcccactaggctcctctgtctgtggaattttccaggcaagaacactagagtgggttggcattcccttctgcaggggatcttcctgactcaggggtcgaacctttgtatcctgcattggcaggcagactctttaccactgagccatctgggaagcccatatattaagcggtggtggtttagtcgctaagttgtgtccaacgcttgcaaccccacggactgtagcccactagattcctctgtccatgggattttccagggaagaacactggagtaggttgccatttccttctccaggggatctttctgaccaagggattgaacctgggtctcctgtactgcaggcagattctttactgactgagtaaccagggaagcccacatattaagtatgtaacctcagaaaatcaaaagagaaaagataaatattcctaataggaaaaaaaagtaaagcaaaagctgcaaataatccatttacaaaaggtaaaactacaaggtagttaaataagaaaaagcccagatctttttcttgatcaaatagatacaaattaaagtaacagtgaaatgtctttttttttttttgtctatcaaattgtgaagagtgatgtgacagaaacaaccgacaaggttttattcctgtctagggagaggataatcataaaggggattagcaggaaggtggggacacccacacccctcacagcgatgacatgtccgtcctgtcctgctccccagtgttctgatagagccatcctgaggacagagggagatgacaggacagagtcaccacttccttcagcttccccctcctccagctgttggcgtcttctgactcactgcccctagccagggacactcctcccgcatcagatctaaatcccctttctcctgatgaaagagttctggatcctgtgacaaaaccag

SEQ ID NO: 49686 - DNA, 2665 bp, Bovine  19866880670009
ttctgggatgacctaaccttggacggggtttaaatggcccaacacctctccctggcgtcttacccatcggatcttaccagcaattcttccgggactaacgcctcttgattctgattggctagaccgaggtcacatgctcattcctgaccaatccctatgtccccactatctatattcccattggccaggctgggtcacatggctttccatcagccatctaaaataaaaggcaggggtgggtccccaaattcagtgggaggcaatctccaggaaggaaggggcacaagatggtcaagaaaaccagcagcagtgtatttactcaaccgtaagctatagagcccttaaaatgttgatttaaaaaatggaaatactgaaggtttaaaaacagtccggctacagtccttaatagaacataaaataagaaaggttgacctcaacctcacagaccctttgcaccccctgccctccttgaccctacggagagcctgacccttgcacctgccggtctccttcagaaccttaagcgagtggcggaggtgtggatggacgagtacgcagagcacatctaccagcgccgtcccggagtaccgccacctctccgctggggacgtgactgcccagaaaaagctccgtagctccctgaactgcaagagtttcaagtggtttatgaccaagatcgcctgggatctgccccaattctacccacccgtggagcccccgggctgcagcctggggtgaggtgagtgtgaaggctagggcccgccacataagtaggtctcaagtcaaaatgcacgtgcagggtccacaatttagagaaaaagtggtggtaacacaacactgtaaatcaactacatttcaataaaaattaataataaataaaaaaaaagcttagcatcatctagaaagtgccagtagaggtataacatataaaactttctcctttccttcgctggtctctcttagccttggggtggtggtttttgtttgttcactatttaatgttacaagtagaaaaaaattaaaactttaaattattagcatgaattttactattcatctttatgttctgctgtgccagttttaaaggcaaagagaacattcaatttgtgcacaactggtgaaatttcacaatccatgtttcagacctcacccatgcatatgtatttcttaccagagctgtagaaacacagcacagaactaactcagctgtatttattacacttcttgataatgtacacatcctatcaacatcttactgatgagtgagaaagagctgaaggaaaaggaactctaggttgccccctccttccccttgtttctgtgctatttgctgctgaagtagttgggtcatccagggaattaacgcaagaaagaaaggacatagacttccctgtgggtccagtggttaagaatctgcctgccagtggcggggactcggttttgatccctggtctgggaaggttccacaattgcagggcaactaagaccccgtgacccaactactgcagcccaggcgccctagagcctgtgctcggcaacaagagaagccggcacagcgagaggcctgcacaccgcagcgaagacccagtgcagccggaacgaaaggacacgatagggtttcccagtccctcctgtgtctcggacacattcctttgtgaagctgaagccggttctggttggaaaggagggtgtagcctctgggacaggccagcacccccgcttagtcacagctgtgacaccctcagcccctactcgctttgagtgttgctgagttcccatgcctgtgggggacccagggactctgctgcagggactcagaggtgctgtgtgtgagctcagcagagaggaacagcaggtgctcatggagtccgtgtcacgtctgcccatgtgcatgctctgttatcccatgaggtttcacttacaggtccaaaggtaaaatagtaggactttaagacagtgacagcagagctttaaaccaaacatggactctgagtaaggagccctgtgccgctgcccttctcacacacccaagaagctggtcccgctggaggaggcagatagtccatcaccacatcttggctcctgagatggctgtggcttcaactgtgaacacctggatccagggggttcaaataacgtcagtctctttttgtcctacttaactgtgcttccttgtgtgttgtcctcatgccaaaagtagcaagatagctcccggaaacctcaggctgagagagccccagcttggccaacctagcagaaagtaaacacctctttcccagtagagtcagcaaaggtccaggattgaagtcttactcttagatccgcatgaatcactgtggcctttggagaaagaggggacaagggtggggtggatgttctggccacgggatgggccacagcacccaggagagaagtgtgttgggctgcagacacactaggtgtcacttgttcagccaattagagggacctttccccactaagccctctgcctggccccacctgacaccagcgagagttttctagatgaggtgcctcttggtttccctcgtgaagctcctcatttctttgccacctcattggctttctcccccatgttagttcaggtcctccaggaagcaggcaccaagaggggattaggccagcaagagacttactggggcttcgc

SEQ ID NO: 49687 - DNA, 2989 bp, Bovine  19866880915557
cccccttctggtggtcctgggttcaaatcctgactcaatcactatccagctttgtgacttggatgatggcacctaacttctctgaggctcagtttcctcatctgtaaaggatgaaatgaggtaggctcaggggatgaggtcttttgggtgaggagcttaccacaagacctggcacctagtcagagcggtgtgagatactgcaatgatgggttcatacatttggctaatatttgtggagtccctgctacatgttaaacactgtgctgggcacgtacagcagtgagtaagctggccaaggcccctgctctcacggaggcggagtgtggtggccagccttggagatgccccccagtgacccctgtgtcccagcatttgcgcccttaggcagttccttcccaaaagagccgaatgcagactgacctgtgtaaccaacaagatgctacagaaacgatggccatgaaggacactgtggcttccaccttgctccctgggatcacttgctttggggcagccagcagccacattgtgaggaccctcaaacagccccgtggagaggcataggttgtgaggggcctgaggtctcctgctaagagtcctgacttgcccaccacatgaataagccagcttagaagtggatcctccagccccaggcaagccttcagatggccgcagccctggctgacacaactgcgtgacagacccaggcagaaccatctcacttagctactcccaaatccctgaccctccaagactttgagataataactgtctactgctgctttgagattattttttcctgtggcagcagatacccaatacagggactttcagacggtgatgtgcactctacagaagccaaagcaaggtaactggacggactcatcagacagacagatgggatatgctgcattaccccacctgtcagggaaagcctccctgggaaggaagtagtcatatcccatgaggggataggcgcatatggggctgcaattagtggaaatgctgcttggagaaatgcaattatattctgatcttgggggagaaaaaaaaaatcgagcaagtcaatagaacagaacattggtctcgagataatgggctcctgatggtagattaatgtcaaggccaagccaagaagtttattttcaaagcaggagatattgatcaggcgccagcatcctataacaataactcttcctttatacagagtgactgatgtggaagtgatgcttttgtctggcggatactggccgggtcgctgggccgcccctgccttgtgggaggcggagcagcacggagcaggtggggcatgccttcccctgttctattttgaatgtcttctgggcagttgactaggctggcatccagctctctcaactccatattaaacttgcattagctaacgaggctgtgtctccggctttgcctggcaaggagccttcctttatgcagatggatttccagatccttctctgtgctgtgacctcgggattctttggccctgaccatgctggccatcagcctgaaggttcctgagggtgaccttgatctactgagaggtctgaggcagccaaaatgccctcagattcccaggatatccggagcccaggaggagtcctggttttggacgatggcttccctaccctagacctgactcactgacagctgagtcagaatgcaaactgccttccgagagatgcatacctgttcagtgaaagctgctgccaactgtcgagttccctgggagcacctgagcggtctgagtagctctgggtacatccaacccctcagaactccctctggagcttccctggtgggtccagtggttaagaatccaccttgcaatgcaagggacactggtctgatccctggtccaggaagatcccatgtgctgcaggacaactaagactgagcactacagctactgagccagagcccgagagcccaaacgactgagcccgtgtgctacaaatactgaagcccacatgcctacagcctgtgctctgcagcaagagaagccacttccatggcgtggctctgccaccaaggttctgccaccaagtcagaaaaacgacatcatctctttgagcttcactttctccatttgggaaatcgggccacaggatatatgaagacaaaaaacacgacagtgttgggtgaaagggcaaatactgtatggtttcaaggcaactgtatttctcatcctttcgcaaagagaaatgagtagcccctgcttgccataattagagcaaggccacacgcagcaatgaagacccaccacagccaaaaattaaaataaataaatcctaaaaaccccaaacaaaccacactctggccactcagaacacatcttaacgcagcagcaccaccctgctgtggtggtcactggttatctggcaggatcccgagactgcaggggactttccatctagggacatgataaaagttagaggcatcgacttatgtcctgacttgctctgggccggggagatggactccaggttcagctcctggcccagggcacctacctgtgtacctccaggccccccacctccctccctttacagcagaggacagcagccacccaaggcccacaagaaccacagcaagggggtggtatgagcagacactcttttctaatgccagtgccaccagtgcagccacgtgacctgggtgataagcatcactgccaccttgcaaggctgccgagacggcctgagacaagccgtgaagagcactcagcttgatgcctggccacagcaaacctgattagtgttacttacttctctttgcgaaaggatgagaaataccactgccttgaaatgatacaccccaaaccattggttttttaaaaaatatcctatggcccgatttcccaaatggagaaagtgaagctcaaaggagatgatgttgtttttctgactgacttggtggcagtacctgaaactgaccaggagaatgacagggccaggcgagtggggcatagtcactg

SEQ ID NO: 49688 - DNA, 1464 bp, Bovine  19866880969470
atggagatgtcggctgggaagggcaggatgaagaaagtatatcagacaggaattgatgccactaacaggtatttaaaacacctatgatgggccaggaactagggtacagagatgaacaagactccctccctgccttcagggagctcagagtgtagttggggagacaggtcaatctttgggtcatgtcagtgggaggaaatcagagacatgctgggagcgacactgggctggcccttaatcacggggagctcaggtaaggctaagaggagacataagataggctgagcccaggaggatgagtgtgggttggccagactaaggaagggtgtttcaggaagaacgaatagtgcatgcccctaaagatggcaaagcctgagagcctgaggcttgtgagcatcccatatggctgggtaaggtggacctctgtggtttgccctgtaccacctcttctgcacacagtgcccagactttcctttggggaaccagctcatcccaccttcctgattctgggatgggcatgtgaccaactagattcagacagcatctgaccaatcagaatactcctcagggatgagcgaggaacccagaaggtcaatgagacttgacttggggacctactataggaatgatgggaaacagaaactcttcccactgggctgctgggtatttccatgaaagaaagcttgcttgagagggaagccaactcagataaaagcagagctgagggactaagggagatggagcctaaataagatgggttagtctctggatctagctggacctggaggatctaccctggaatttcagttgtgtgggccaatcaattctgacctttttttgcttaagccagattgaccaggatattggttatctgttactaagagtccagactaatgcactggggaggagggtggagagaaagcaaggaatggtcagcagctcgtggaggtgggtgcaggccaggctacagggttaaagaattatctgaccatcagaactgggaagagtgtaactgccaggcaggagaactctcataatgtgactgtgccttttagaaacaaaaggtgttgactaagagagaaaagaagaagaagagttaatgactcctccagaaatttcagagccttcggaacatcttttgtagggttttcccatcaggatagatggcctggtctgaaattggagccaaattattaatccatcagccctgatggcatgtatcaatttatcttaatttctgaaaatacactcatgcctttcagaccggtctctcttctctgtcaccaaaaagaaaagggggcccagcagagatttatcagaggccatttggccctttgtaaatgccctgctctggctgaaactgaacacccggcatttcaggcagaccactgggcccccctgtgccctcagtgctgtgggcaagcctgcctgagagacagcatgctggcagaggggctgctgcca

SEQ ID NO: 49689 - DNA, 1896 bp, Bovine  19866881056922
tttagtatctttgccatactaaagattacacacatatatataatttaatatatattatttataatgttacattatatataaaaatatcctatggtatatcacattttatttatccatttatcatcgaggaacatttgggttgtatagattttatatgtactacataatcttatatatgtcttatatacatatctctcacatatcaaatatatatgacatatgtgatcatatatatagtcaaatttaatttttaaataatacctcttttcttttataacttcttcattttcagccttgaaaggagaggtcttcccatttttcctctaaaaggccaagtagtatgtatatgtttcagattttgtccgattctgttgcaattactcggttgcaactactcaacactgccattgtagcaagaatgcaaccatagacaatatagcaacaaacgtgttccaatgaaatattatttacaaaaacaagcagtggtaattctgctcctaggtatctgcccaagagaaacaaaagcataggtcccaccaaaaatatgtacctgaattttatagcagcattaatcataatagccagcatgtagaaataactcaattgtctatcagctgataaatggataaatagtcacgccatggaatagtattctgctataaaagtcctgatccgtgctgcaacatgagtgaaccttgggagcagtgcgctaagtgaaatcagttagacaccaaaggccacatactgtataattccatttctatgaaatatccagaataggctaatctatcaacagaaagtaaactggtggttgctaagggctgggagaggataggtgataggaggttgataactaatggttatagagtttctttttttaggttatgaaaattttcttaaattgtctttggcaacggttgttcatatctaaaaaaatactaaaaaccattcaattgtacacttcatttttggggggaatcaactgagaatatgtttatttaaaagcaattttaaatattaaaaaggtagaaattaacacataccatactaaaaaactgtcacattaaatgaaatgatgagtgtactgatgtttgagtgtaacatgcaaaattcaaaatttaattcatgatgctatggggttcctatacaatatgtttaatttctaggaaataaaaaataaatagcaagtgcttttcaacagtaaaataaaactcacactatttgcggaacataacgttcccctctgggggaaaaataactagttagctattttttccaaaataagtgaattctatggtatgtgaattacatttcaataaacctgttattaaaacaaaagggaaaggcagcatggattcgatccatgggcagcagttagctgacccctgctctactttgcacatgcagtctcctggaatctcttacaatattttgtattattttcattcttacgttaaattttttgacacacttgaaatgcaggtggtgtaagatgggcggttgtttttatttatctcagtgggctacataatttgtgaaataagccatccctttttccagtgaaacgagatacctcttttgtccagtattgacacctgtatcctggagtctaaatctggattatttaccatgtcccatggatctatttgtctatgcctttcctgatatcagactgatctgattttagtgactttattgcatgttctggtttctgtaaaggaagtcccccctcatgttcttttctttaacacttgacttgtagccagtgagcttatcaaaatggatatcacgcccctgcttaaaagcctttaatggatttccactgctcttacgattatagcccaaatcctaactatgtcttgagtgctgcacacttggcactgcctagctctgcag

SEQ ID NO: 49690 - DNA, 1496 bp, Bovine  19866882105255
aatcaaagtattgttgccaggaaaatgagggaatgggtccaagccagacataaatcacagctgctaactctgtcatacagaagttctctctgtgttgcaagtctggcactaacactggccctctttaaacttcactttccccctttgcagtacacaggtggtgcttcctgcccttgttggccccatctgagagacccagtaagacagtgtaccagaaatctgtctaaactgtaaagtgcagtgcacacttaaagaaggggggtcacaagaatgattactcagcaattgttcttacccacctgtccatcttttctctactctctgtcttgcagaacacctgaagaaaccacttgaagactacatggcccttttccccagcgtgaggattctccgaaccaagaaacgggaaggactgatcaggacccgaatgctgggagcctcagctgcaactggggatgtcatcacattcttggactcacactgtgaagccaatgtcaactggctcccccccttgctaggtaagggaggcttgcaaggtgaagtaggcagcctggagtgtgccagtggccaccggccccaccttttgcagggagtcacctactgggcttcccttgcctgcctgagatgcacccagcactgtgccgggtgccacgagggtgtcagatcttcaagggtgctcaaagtgaccttacgaatccatgcagtcctgccccttcattttacagaggaggaagctgggactttgataggggaagtgacttgcccagtgtcataaagcacgttagtgttagtgatatgactgcttctcccaagttacttcaggtgttattggaaagcaagccaagactgcctacttacaagaactaaatcttagcagtaggcatcttgatttgatgatgtaagggacatcatcgaatcaactcagaacagtggttgttcattgcattgctactgtgagccaaaaaagctgtaagctttatctccaggcctcacaaaaccacaccaggtccaaagtatcccctttttatattagaagagactgaagttctgagataatgagtgactcgctagttcccttgggcaaaaagtgtcaaagtccccatctgtctgactccagagtgtatcctctttcaggattccatactgtctgcctaagttcatttgctcctcagggagtttctgacagctgtcagggaagaggtccagacaggggcagcgtgatccaagagtccattcacgcaaccttgtgggcaggagggagacctgaagccaggctgccaggcagtgaggtgcctcatggctggttgaagaaccagatctgaatccagagctttgaggaaggcagtaagctgctcccaataggtagatgctgaagaggaaatcccctagtggggctggtggtcaggtgaggaacagggatggaggcagattggggaacatcttgtcagtccagagagaaaagtgaaagcctcaataatagaatgagtatgggaatt

SEQ ID NO: 49691 - DNA, 2413 bp, Bovine  19866880214648
taagttcaatacaactaactccaaagttattttctgatgggtgtaacagtggtcatgtatggatgtgagagttggactgtgaagacagctgagtcccaaagaattgatgcttttgaactgtgatgttggagaagactcctgagagtcccttggactgcaaggagatccaactagtccattctgaaggagatcagccctgggatttctttggaaggaatgatgctaaaactgaaactccagtactttggccacctcatgcaaagagttgactcattggaaaagactctgatgctggaagggattgggggcaggaggagaaggggatgacagaggatgagatggctggatggcatcactgactggatggacatgagtctgagtgaactctgggagttggtgatggacagggaggcctggcgtgctgtgattcatggggttgcaaagagtcggcacgactgagcgactgaactgaacatcttaatcccttaatatcactaagcttgagtctaaaatagtgaagctttaattcatttttaattattaaacacactaattgtgagccttgtatgtgacagacaccctgcaggattctaaagtttaattcattttaaagaccttagatacttcctgctgtcacagaattcatagtcaagtaattgtcacccatttaagatttttgtacttccactatgtgtgagacacaatggagataaaatggccaaaaagatacatgtattgaaaaaagtgaattgactgaattaatgctataaatgcctggagtaatgtactcccagaattgaccatcagtatgtttaatctagtctcctctgacatctatgctggtgcgtactcctagattcagtctccacccgtggttacctttaatttgggtaatcttatcaagtaagattttgagtctgcacagtttgaatcacaccttaatgctcctataaataggcaacttctgtgaatggtcctctatcaccatcccatgctgtattaaaaatggttatatttgaagtatctccccaaagctttgtatcctctcttaaacaagctgagtgtgccactaatgtcagtgctcaaggacacactcaaacccatctaaatatttctaagaggtgttttccatattatttccatctgatggtcaacctctaagaagggaggagggaaggagaaataagggttatgttgtctcacctgtctgttcatatgtgtgtgctaagtaacctcagtcatgtctgactgtttgcgacccccatggactgtagatggttggatggcatcactgactcaatgggcatgaatttgagcaagctctgggagttggtgatggacagggaagcctggcgtgctgcagtcctttaggttgcaaagaagcagacacaattgagcgactgaactgaactggacctgccaggctgtgaggttctccagacaagaatactggagtgggttatcatgccttcctccaggggaatcttcctgggccagggattgaacccatgtctctgtgtctcctgcactggcaggagggttaccactagcaccacgtggaatgcccattttacctgtttaatctccttaaacatgcccttgttcctttcttccaaaaagtcttaaggtagtacatcatgtgtgccatagactattctaggtatggctggttttatccttgtggtataatttcacatgttcctccatccccatatatttcgattagctgaaagttacatctagaggcttaatttaattctgtttttgttttgtgttttctgagggttatttttttctgttttttccctcctatcatatcaggaggcccgtaatgtggaagttttcttctattagtgatgttaacatagttgtgagcacttaggctaataaaggctaaattattagcctaaatcttccattaaatttttctatatcattctttcttctaatattttagcatctactgatattcataaaccagctccattgtttcattaggtaaaagtcttatttattaagtgccaaagatgagtctatattgacttacttgaaggaaatttttaggtgggtttctaaggactatgtatgcaggcgagcactgcagtgtttaattaatagccaacctcccaagtcctggcctaatggaattttattcttttgttaatgtaatggagtttgagttactttttaatgaccttacatgattgactcttcccattagagagcaacagtttttgctgtgcattatttttatgcatctataatacaatttgtgttttggaagcacttcagattttgcctttcattatctagctattattttgcaattctgctttcatacaaggcaaagcatacaatcagataaatgaacaaatcagaaagtagcccacacttcagttgagaaagacacaaa

SEQ ID NO: 49692 - DNA, 892 bp, Bovine  19866880351383
ccatttaaagtaagtctacaatataatactttccagcaatattaactattcacatgaaatgttacaggagtatctaagggaacacagagactagcaatggttacggaagaacctcaggcatcttctatgctttaaactgagtggatagtttcctacccactaagtattatattgtatgatttgaagacagactacatgtcatttttattatactctgtcaatctataatatattagaccaatgctttatctaaaatgctttgattttgtgtatcttgacaaattttactaccgtatgtaataaacgtgtatttttgtacttggagaaacttgctaaattttaaagttgtttggttttaaaggcattgataagggatatgtatgaagtccatactgtctttcaaataaaacactacccttcagaaaaaataaataaataaaataagtctaaaccattctctgcatgcaaataccagatgcccataacagcctttcaatgctggttttatttgcacttcagaggaaactgaggctcagaaagtgcctgagaacacaaagctggcttgagccatgatctcagactcaagtctggccagctacacattccgggctctgtatttattggtacattcattcaacaagcactcaagtgcctaccaaacgccaggcactgcactggccctgtcacatacctcagaacagctggatggctgaccccgggtctctggggaagctgaggaacaactatattattaactgagctgtcacttaagctcagctctgggagggcctgccttcactatgccacctccctctctgatccaaggggaaaaaaattaacgagccatccaccttatttttaaaaaactgacgtaggtttaagaaggattcta

SEQ ID NO: 49693 - DNA, 1644 bp, Bovine  19866880482718
ttttaggatttgaaacagctaattggaattcctcacctccactagctttgttcacagtgatgcttcctaaggcccacttgactttgcattccaggatgtctgactctaggtgaatgatcacaccattgtgattatctgcatcgtgaacatctcttttgtatagttcgtctgtgtattctttccacatcttcttaatatcttctgtttctgttaggttatttctgtcctttattgtgcccatcttttcatgaaaagttcccttattatctctaatttccttgaagagatctttagtctttcccattctgttgttttcttccatttctttgcattgtcactgaggaaggctttcttatttctccttgctattctttggaactctgcattcaaatgggcatatctttccttttctcttttgccttttgcttctcttcttttcatagctgtttggaaggcctcctcagacaaccattttgtcttttttgcatttctttttcttggggatggtattgaatactgcctcctgtgcaatgtcacgaacctgcatccatagttcttaggcactgtgtttatcagatctaatcccttgaatctctttgtcacttccactatataatcataagggatttgatttagttcatacctggatggtctagtggtttttcctactttcttgaacttaaatctgaatttggcaataaggagttcatgatctgagccacagtcagctcccagtcttgtttttgctgactgtatagagcttctccatctttggctgcaaagaatgtaatcaatctgatttcagtgttgatcatctgctgatgtccatgtgtagagtcttctcttgtgttgttggaagagggtgtttgctatgaccagtgtgttctcttggcaaaacacatacaggaagagaattcaacattgatattgatgctgcaaaaatatttaagtgctgaatttttcacatagacacaaaattagtaacatcaactgggaatatatcctaaaggagttttaagatggaaattcctgactttctacttagaagtagtagcacatataaacacatttaaagactgtgggaaagggaaaagcaatagcaatttgctatcaggatttagagatgtttgttcatactaagatacaaacctatgtcaacataactattgttgcacttttttttaaagcaacatttaagtccttcctatgtgtctgatcttttaaaaatagaatttctattcttcattattaccaagtaatatatatgcaggtcgaataaaggctcagcaagatgaagctgtccattagagaaccccaaaggtcagtgtctcagaagatgtttcagtgcaggctgctaatggcaagtagatcttgctcgcatatgttaagtcaatttaaatcagtaaataattgagcattgctccatgaaataatctgcacaaagactcgaaaagattatgtctaggtcatctttcctgatctccctaaggagactaatttcagagacattctctgtgtggggagttaaagaacaatcaagtaggactgagtgtcaaaatgttagagcagtgattgtctacaacattggttaaccaagtacagataatccttgagccgcatctggcctccttcctgtttatataa

SEQ ID NO: 49694 - DNA, 1333 bp, Bovine  19866880510412
tcagtgtggtgttcaggcttctcattgcagtggcttctcttgttgaggagcaggggctctaggtcaagtgggcttcagtggttgcagcacatgggctcaacagttgtggtgcacagactcagttgccctgaggtatatgggatcttcctggaccagggatcaaatccgtgtcccctgtattggaaggcggattctggatcactggaccaccttagctagtttatttttcaggtgttttcagtatactttattcctcacaatagcacttcagggtagataccactaatttcattgtatgagtaagaaaaactaaggataagactgttaaataattacttagtcttagaaaagtgaagaagtgagcttgaaatccaggtctaactctaaagttaattacctttttccatgtgaatgtctcaaaaaaaaaaaagtttgataaatgaatatataatgaaaagcaatcacaggagacttcttttacttctgatccatgatccaagaatataactctccataaaggatatttcttaaagtttctttgccctttttcccttcaggagggcgtaaggccaaaaatatcagctagatattataaaagactaaatgcacgtctacaaataaactgagcatttataggaaggggcactaatttggacattgagaaacaagtgttaaaatttccgttcacttaccattattgaaacagcccaaaggggaggggagtacataactgcaaactgctgatgtgaattttgcaaaaaaaaaaaaaacaaactaatttctgactttatgagttgttacacaacacactgagttgcttaagtaatctttcccttttactgagatcattcagttgccggctgacttagattgctttaaacgcaatgtgctcagaagcagagagtggggctaagattgcctcaccagggccatgaaagggtcacctcattcaaccctcatcagtctctgctgccagaacccagctctaatttttcagccaagttcctccaaaatgcacacttcgtacttgagattccaatgacacagcactgttaagccaagggtccgttgaaagtctgcaccctcccgagttcccagtttggatttaccataaagcactgggtgccaggaaagggcatttagagctcactgtttccttccgcccacgcttttcagctccaccctcatcactgctggtggttttactcccctgctgtgccccttaacagaccggagaaagaagatacgacaggctagctttactactactaccagaggtacttgtacagtaaaccgcacgtttcctctgcctgcgtgtgttgcgtgtgtaatt

SEQ ID NO: 49695 - DNA, 882 bp, Bovine  19866880521485
ctgtttatgaaatttcccaagcaagaatactggagtgggttgccatttcctcctccagggatcttcctgacccagggattgaactcacctctcctgcatctcctgcattggcaggtggattctttaccactgcaccatctaaattgagacctttgtgggaaatacttaaaaagaaaactcactgagctactagagcaatttgttatagtaggcaatccaatttggagatttttttttccccctagtttgaaaatgtatagaacagagttacaagacagaataaagcttccacaactcttgactaaggatacttgggagataaaccatctacaagggtaaatttaaattggaagaatgtcaacgcttttctttttatctaaagtaggagagagagagaggcatgccaagacaatgtacacatttaaatataaaatattaaaatgcctttcttattatttgcaaacccaagcacgagataaagcaaatagtgtatgtatttccagatacttgcctgacaagttcttaaaatggattttttgccaaagtgacaacagagagattattaaattagaagttgaaaaggggtaaaggaccattgaatattgatggaaaaaaatgttgtgtatcgtgttaatcacgaataaagcataattgattctcattagaaagataatttcagtactaaagtcagaaggcaggaggaggaggaacaacagaagatgaaacagttggatggcatcaccaactcagtggacatgagtttgaacgggctctgggagatagtgaaggacagggaagcctggcatgcctgcagtccatgggattacaaagagtaggacatgacggagcgactgaccacaaagagtgttatgtaagtggaaa

SEQ ID NO: 49696 - DNA, 1643 bp, Bovine  19866880561898
gaagggaaggaactaaaccattagcaacttaaatttctgagctgcaagtgccctttatgaccacttgattgctttgatttaacacaatttattgaaaaatgtattgtttgccaagtaataataagtgccatggaatatactactagggaggaggagagaacagaaaaagctacaggaatggaataattatccttgaacttttaattctataaaatcatggagaatgtctattttattcaccaacataccttacattgaacttagtgcctagcacactggcagtgcctaacagagatctggtgagtgaatgaatgaataagaaacaaggtcaggagggactgggaatgtttggataactcagacaagggtcaagcattgagtcacatgctactcaccaacctgaaagctctaagaaataaataacaaagaaagtcattacatatttaaataaggctcaaacatgcccttgccagtgaattgagggcaatgaaactggcagttgaaaattagtacatttgtgggtgaaaaggacatttacacttcttccttccagttcctgggaaaggtactaagtgattccaagagccaggcttcataggtagtctcctgaatgaggtcaggaagaaaaacctacatttttaagcatgcacaccagaaaactgttaccaccaactttgtcatgcctgcatcctcttggagattttaatcccaaaatagtttcattaatttctacaaattggtttctaatttgacagtttcctcagtggttatttctcccaaccctagtgagtccgggaatagcttgagaggtttaaattgtggggtttcagatacatggctctaagattttgctatttgcacagtggaaaggattttaaattggtggcctccatcaaacttcctgcttgtatttcttctgggtagattatggataatatttttacatccttacctcctctgggttttttgtttgtttgttttttcttatttgcactgctgcaacttagaatgtccatctcacatttgtgcatgactactggaaaaaccacaactttgactatacagacctttgtcagcaaagtgatgtctctgctttttaatacagtctttaggtttgtcatagcttttcttccaaggagcaaacatcttttagtttcatagttgcagtcagatccacagtgattctggagcccaagaaaataaagtctgtcactatttccattttttctccatccatttgtcttgaagtgatgggactggatgccatgatcttagttttctgaacgttgagttttaagccagtttttttactctcctctttcacctacatcaagaggctctttagttcctctttgctttctgccattagttgggtgtcatctgcatatccgaggttattaatatttctctcagcaatcttgattctagcttgtgagacatccagcctggtattttgcatgatatactctgcatataagttaaataaacagggtgacaatatacagtctttgatgtactcctttccaaattttgaaccagtctgttgttccacatccagttctaactgttgcttctttacctgcatacagatttctcagggggcaggtaagggaggtcaggcattaccatctctttaagaattt

SEQ ID NO: 49697 - DNA, 1519 bp, Bovine  19866880655785
agtgggttgccatttccttctcccaatgcataaagtgaaaagtgaaagtgaagtcactcagtcgtgtccgactcctagcaaccccatggactgcagcctaccaggctcctccgtccatgggattttccaggcaagagtattggagtgggttgccattgccttctccgatattatgggagtgggtctgaaaaaagtatacaaggccttgataagactagctaggggagcattctctggcctccttctgatgtctgtgtcagaaactttctctgtctcttttcactttaataaaactctactgtacaaaagctcttgagtgatcaagcctggtccctggtcctgaagttaaatcttcttcttctttggagatcacgaatccaacactgttcatcataagctttcaataatagatattccaaatactggtataaaagacatctttgggctcataaaaaataggatgattaaaaatcatcatatacatatataatcaaattgcaagactccccataaaaatatctttacattctcacttggtaaactatttcattttggaataattttaagaaaattttgtttccttctttctcaaatataaatctatatacttaatcgtgattaatctgattataggtttatttagccctgtgtgtttttacatattaataaggtgaaagtatatgtaactcctttcttccttccttcagtctatagttatattatctcctctaagtagacaaagactggaaaatgtcacaatataagatacttagataccacttatggttttatgtggagcctaggagagttgccacctacacacatgagctcagaatatagcagtcaagattcagagatgaccttttggtccagctgtccagaacagataagatcaatgtcttaggtctgaaacttaccttgctttagatccattgtaatgtttactatagagctctgctcatttgagaactatttatttatttacttaataaagcaatatattctgttggacagctgatagctttgcaaacagcccaagtttttttccttttttcttcctcagtgagaacatgctggagtcagggaattctctctccattaaagaaaaggactaaccaaagataacagggatgcatctcagttattggactctgagaggactattgctagcatgttctgattgtaaaagggactgtaacacacattcagttgcctcttaacctcttaaccagactaaatgagcctcattgtccatggatatctggctctttccactgaccattagaatcaagacagacagaagcagaggatatgagggtcagatataccagcaaagccacagagtaaagaaatcagtaagaaatcacaagtcagggaaacaggggaagctgtaaaatcagtgaagcataataagcaaaaactatgagatcagcagcagggataagggaaatcataatcaggatgaaagttgagactaggttaaagtcacttaaccagacacactgggataagaaacata

SEQ ID NO: 49698 - DNA, 3110 bp, Bovine  19866880682323
agaatattctagcctcaggcctcagatagggaactcgggtggtattatacaattttcactaacactagctgaaggagagttctaaagaggtagtttcattcctgaagagcatcagctacactagaatttgggaaatcacaataggtaaggaacaatctttcagctgaatcccatcctttcctcaaatgaatttacatttaggcttgtcctcacaaggaagaaggaaggaaggaaaagatggaaggagggaggaaggaagggaatcactcctcatattcccatccctcattgtataccattcaataaaaatttaaaaggaaataatacttcaaagcactagaattcactctgtgtgtgtacctaccaagacactcttgaagcacttgtaatgtgtacagtgtatattgggatacctggagttgtgccctgtacaacctacaaggtcatttacatgcagacctgaagtaacagttaagaacatgcactcaagagctggcagatctggaatcaagtgatcctaaccctgtgactgtgggcaaattaaagaaactggctaagtttattttccacatccatgaaatggagataacaatatgaaccaccacctaaggttactggaacaataaatgcaaataaaacacacaggacactgcctggcacatatgagtgagctctaacactcgtttaatttattatcacagggcaaattttgtggtaagtgtcacaaaagtatatggagctatatgcttgaatatgattgaatatgaggaccctggaattttaggcttcaaaccccattgctaaacattaattagccatatcacttgtatctaacctttaccatgaaaacacatataatatgacatgcctttgtgatctcatactaactgataaggttagtagtctgctagggtctaagtatctgtaaccttagtaaccacactgcacaaactgcacatccccaagtgtcacagcttccccagagcccaagaaaatagaatagagaagggcagggtagaactgatcatagcaaatataagcacagtgatgtattaaccaagaagacagcctagttttataaaaagaaaataaagtacaagcacgctgtagattttttttttttttgagcatttgtacaaggaccaggaaaacatagttggaagtctcatcatatcgaccccaagactgacagcaaagttattattcttcagtgcagccgaggcctagaagtcaggtagattattaacagcaggatggatccttcacctttaggtaactttcatacaaacccttgtctcttcctaatgccaatgcctatcagcccattaatcacagcagcctcttcccacagctctctcttcaaatcttactccccaagtgtgtctcagcccaaattccatctgtatttagttgctacctttcagttgaattccatcacactgctggctgctcctcttgccattttacaaatgaaaaagaaatatgctgttattccagtaaaactgcagtggttcttaacctgggtggttttgtttccccaaggatgtctggcaatatgtggagacttatttggctgtcacagctgggagggagctactggcttccagtggacagaggcagtgccaggactgtgacaggcatgggaggttcccagagctccaaatttaaggaggcacttactcactcttaggttatccacactcaagattaaagttcacatgaccgcaagagtgattgcctccttaaacaccatggcctacctgcctcccttgcctccctctaatcctagacctgggttaaggccagggctgcttctaaacatccccaaaaaaggaattacccagtccaaaatatcaataatattgagaccaagaaacctagatcagtttaaagaatctaaagaaaatcagggttggaaacaggattccctcccttttctactttaagttacaaatttaaatgcacactctgttaaatctaacatctctaatagtgaaataataccaaattctaacatttagcttcaatctgttttattcccagggcttcccaggtggtgctggtggtaaagaatccctgctgatgcctgagacatgggttccatccctgggttgggaagattcccctggaggagggcatggcatcccactctagtattcctgcccagagaatcctctggacagaggagcctggtaggctacagtccatggggtcgcaaagagtcagacatgactgagaaatagcacgcacactcgaattttactccaatccatataaactacaacggaggtgaattaattcaaccttctcttccctggcctatgtacttaggcctcagtcttctctctgctagtgtatctttcactcaactcatttacctctaaggctcagatgcaaagctaccttcccatcaacatgcgactcctcccttctcagatctgtttctctttcttgtgtatctttctttgtacttatattccactataatcatttttttttaattctccctatccctgacccaacctcccccaccaacccacacgcacacacacacatataaacatgcaaacacacacacacacacacacacacactcatttaatctccttactatcatgaatcagattttctttacttatatatatatctccagaaaaacctctatgtagtagagtgctttgagtaaagtacttaatgtatgtttgaaatgaattagcgaggaatttacatacaataatattaataatacagcatgaaccataatatttcctgttgattatctgaatcttaatataactgcattactaggccttgttaaatccgataccaattttcttctcctggcagatgtcaccgtctatttatttatttattttttggttgtgctgggtcttcattgctgcacaagctttttttcagttgtagtgagcgggagctactctttgatctggtgcctaggctcaaagcactctactacacagaggtttttgtggagagagatatatatatatatatatatatataaaggaaatctgattcatgatcctaagcaggttaaatgagtttgtgtgtgtgtgtgtgtgtgtgtgtgtgcttatctgcatagacat

SEQ ID NO: 49699 - DNA, 1660 bp, Bovine  19866880715545
ataaaatttgcagtaacatacatgtgagggccatattggtcaaactagaaggtcaagaaagatgtattctgaagcattggcttgagacaaagcataaatttgtaatatcaggttatttattaaggaaaaatcctccagacaaccaaagacaactaccaacacccaagatactggctcaaccactaagccacagctcagtgaacaaaagcattcaggagagagatgtatgtcttctcaataatcatctaaatacacaactgaatatcagtatgtgtgtatgcttttttaacttagacactgagtactatattccagacagtggacatagtgcacaaaagttgcattggccattatttaaactcacagttgtgggggagaccaacaaaaaccaagtaagcaactaatataaaattgctagtcgttgattattgtcatatagaaattaaataagatgttttgatagaaaatacagtctggctatttattttaatttggtggccagcaaattccacctgataggattaccctggagccaagacttgaagaagcaggaatttatagctgtacaaaaactggtgtctgtgtgatagtatatgtgaatgtgtttaatgggggtgaaatagaaggggaggcaaaatgtgctattactcaacctgctagtctgcaggagatagatcaaagcatttcattaagaaagctttgctaaagggaaagcaaaacaaacaaacatcagctgagcctagtaaagtgacttacattcaaagtacttaactgtttgctgctctttgacatactatttgctgactagtaagcagcccactggggaagggaatggcaatccactccagtattcttgcctggagaattccatggacagaggagcctggtgggctgtggtccatggggttgcaaaagagtcagacattactgagcaactaacactcaagcagcccattccacttgtctacagtacaccagatctagaaaataaaatatgaaaaagcccttgaaaaatttttcatgctcctcgggaatggacaatgaatcactgtatctggtgtgtagcaagattgctgggacagcgtatgaaattatgaagggataagatttctcaagacttagttggatagatcaaaaagtctggaattgttattatacataaccaaaaaggcacaaatgacttttcagagggaaaatatgtattgcagtttatactttttgggtattaaagaagtaataaggtttgtttatacaggcttttctgttcaaattccctatctctgacaataagggtgtccttttacctccgtatgctaggagtgcacttttcacgtgagagatttattttctactttcacgggacagagaggagggtcagacatcctttttacactctccattcttaagtaaattcaactcaaaataatcagtatggctactgaggcacatgttggggtggcttaccttggaacccaacacatttatgcttttattcctgttttattaaagtattactctgaatacttttatatttatgtgttatatctttaggcattattttaattttaaacagcttctttaacaatgaagaaatgttagaggaatgttagagaattcaaagcttaaagaataagttcaaaggattttgggataatagaca

SEQ ID NO: 49700 - DNA, 1279 bp, Bovine  19866880830855
tcagtgttttcagactgttcggcttgattacactgctgtggtaccacttatctagagctattttaagcatcttcttgggttacagtaagctatattgtaaatctaattacatttgcccacaggaaagtaggttcatgtgaatcctgctctgtaatctacttaacaaaaggcactgtatttttcttcatagcatttatcaaaattgttattacatagttatttatatttctaaatgcctttctcttccactataaatttcaaaagggcattgagcatgttgtatacacagtactttttgctcagtgcctagagggttaatgaatgtttgatgaatcaatgaatgaatgagtgatcacataagagataactgaattatatacatttatgcttgacattttaaactcatgctgaaaatgtatacatacttcaggcactcattgggatatattacagtatagtgcaacaaagcacaaattttcaactcaaatggaatggatttgggacttccctggtagtctagtggttaagatccccacactcacactgcatgaggcccaggttcagtccctggtaagggaactagacccttgtgtgctgtaatgaagacccccacaactaaagacctggcacagtcaaaaaaaaaaaagaatggaagaataaaacaaatgaaaaaaattttaatggaatgaatttaatgtcagatctggcatttcataaattgtgtgatcaaagacaagtgaaatgagctctctaaccttctgtttactcatctgtaaaatgtgaacaattgcagtggattaaatattaaagataatgcattcaaaaatatgaagcacactcatggcatggagcaaagtcttaatgtggtgggtattatcacttattaatatttaatatagctttttaagtgaattatataaatctaaattatctaagggcttttaaaaattgacaacagaaatctagtttgagcatatgctagcagtaataactcatcgataatttacaataataaaatgaattttccaacactttcgtgtctatttttccaattttaaacaagttattttcaattaaatttcatcattttttactctgtacactccttacaaattcttcacaatcactcaagaatccttctctattggtcttcataacaacaatttgaattcatcagttcaagtctctcacctagattgaatactcttccctaagcaactctcatttcattattgtccctgtattgtccctgtatttcataacttcaaccattatcaca

SEQ ID NO: 49701 - DNA, 2211 bp, Bovine  19866881017490
cctagaaaatgatacccacatagaacatctcaaaaaatggcttcccagcatgaaagcaatacctcgccttgtcactttggaatctgatgttccaagtcaaatcctttgacttttcctagtgcatttccctcagtattatcaagggcttcccttgtggctcagctggtaaagaatccacctgcaatgtgggagaccgggtttgatcctggagttgggaagattcactggagaaggaaaaaactacccactccagtattctggcctgaagaattccatgaactgtatagtccatggggtagcaaagtgtcaaagacgactgagtgactttcactttcattattaagataaggttaggttattaccaagataagtctatattatcaaatagccatttactgcatccacagcaaaagaaaagcatcagtttatttcctcttcaaattatggggcttcccaggtgactcagatggtaaagcatctgcctgcagtgcaggagacctaggttcgatccccaggtctcctgcattcgagccatatgtcaaatgatggacattaagacagccaagaatttctgaaacaattactgcttttctcagatttagacgatgggataccaggccacccaactagtcatactgcaaatccacctgaactggcttcatgaaagatcaggagccatctctgagaggaataccattgaggaacacagccttagcttttcagaggagacaaatagccccctttcccagagaatgctttatgctaagctgctaagtcacttcagtcatgtccgactctgtgcgaccccatggatggcagcccaccaggctcccccatccttgggattctccaggcaagaatactggagtgggttgccatttccttctccaatgcttgaaagtgaaaagtgaaagtgaagttgctcagttgtgtccgactcttagcgaccgcatggactgcagcctaccaggctcctccatccatgggattttccaggcaagagtactggagtggggtgccattgctttctccaaatgctttatagaaagtatttaaagataaatcaaccttaactgctcatacgtgtttttgatctctaatccatgatgccttgccaaaatctagaaacaggagatagaattattcacatcacccaaatctaccccagatatgaaaattttctttcttatatttaggaacacagagttaaggtttgacttacatctcctcacctaggcgcagggtcattttctggatctgaactaacagatgcagacaggagagaatctctctttgcgtctaaggggtttagggtcaacattacataatgacctgcttatacaggttgcaggggtattccttctatcttaaaattagtccagtttctagtcagtaagttttattgcttctgatggtgatgataatatattccttgatcaccctccccaacccaacagtgcagcagaggttcatgttccctctaacttttgctgctcgatttgatcttctagttccgtctgaagctattaaggaagttatttctgaaagccctagagtaagcaatgggaagtcttcctgggaaaccatgattcagaggcctggagacagttgggtggtaccgatacccttcaaaagccttgatcagattgaagcaacaatggttgtctgccctaccagctgccaggaaataaatttgtaggaaatattgttactggagtataactgagttttactcctctgtatagaattcgaaactcagcctctcacatttcagaaaaatagagcttaacactaaaactgcctcagtatgttttgtgctaaaaactccacaaggcagtacaaggcaaaaggagtaagactacgatatgctcaaaggggatgacctacaggttaaataagatagccaggagtagtgactgcacaaagtctgcaatagcataagacaacaaagaagcctattgaaggatgtcctgggcttttatttttacaatagctccctgtatcgatatagctctctacagattatagaacccttcaaacacattataaccaccacctcacctccatcctctaaaatcccagcaggaaaaccaaggagaagagtgaaaaggaaacctaactgtggctgcacatgtcttatttctagaaaggcattttgcaatttctgtcagtttcattttgtgctaaaaggtaagagagtgctccaagttt

SEQ ID NO: 49702 - DNA, 1257 bp, Bovine  19866881107671
ctttgaaagttcttcctaagtaaattcttcggcattaagaataattatttgaggattttaaactcatggagccctgcagtgagtttgtttcacaatattgttttcacttaaaaacaattttggctttctcttcccaaagtatttcaacagtatgtgttagtgaattaaaaaaatgataataataacttcggttattccgagacacactgtggggctatagaccaaatttgccttttctatgttattcttcaactgactttggcttgatttattgtagctcaacttaatctttatcttatcaactttgtgatcccgtttcatggtttttataaaacaaagtcatatttccaaggagtctaaagggtaactacaatgtcattggttaaactcattgtcatcaatagctgaggaatgcttttcccactttggggtataaattctgaggatggatgaatttttcagggactgactttctttgaaaagcactaacatcatggtttttccatttctgtcattaaataaaggaaaggacatagctatgtgttgatgtgtatgtattaactatgtatacatgtgtatgttatcatgctttattacctccagcccagggagttaaaaagtattctgagaagctctacaaggtggaaagagaatgtggactgtgcatttggtccatatgtaaatatggtcttcatttgggctgagatcaatgtgccggcatggtcaggttttggtgagggtcctcctccgagttcacagacatctgccttattactgtatcttcacaaggcaagggaagggaggtcatctctctgtatctcttataagaacactaagcccattcatgaggggttcaccttcatgacctaattgcctaccaaaaccctacctccaaatacaataacattgaggactagggctttaacatatgaattttagggggacacaagctttcagtcatagcatgtgtgtgtatgtgtatgtaaaagtcaatttatgtaatctcaccaattaggagctattattatatgaggaaactaaggaagaggttaagttctttcagttcaaaaattattttcagccaaggaaaatgttgtcccaaataagatcatcagtatcaatgttctccctactgatgggttctcaagctctgtgtcatttgcctaacagtaatttgaagtcaggtggttgaacatcagagtcctttagcttaagcaccaatcttactttgcccctggctggtaaagaacccacctg

SEQ ID NO: 49703 - DNA, 719 bp, Bovine  19866881196418
ttcctattgatatattccgatcttgatattataaatgtattccttccttaagcatgtaacaagttctatattaatataaccattatactccaataggaaaacagatattaaccttttgagagcattactttaaagttttgacttatttttaaaaaacaagagaaatttgtttaccaatgataaagtgatattttatttttatatttttaacaatacaagttgatataggtaaaaatctgcaagtcatgctaattatcagtctaatttaaattctcaagttcataataccaggctataaatgaaatttttgtctaaaatagactaattaggaaatttaaaatatataataaggctaaaattaacacatctacagtcttttagggtattagttgtctattattacaaaccacatttacactacaaagaaagtctcagctaatggatattaattttatgctattttctttctttgatgataaatattcttaccagcaagaggaggaccaaggaggacaggacagcactccacaactgtgacgagtcccacagcactggaaaatctttgagcaccaacaaggtccatgagcgtttcaaagaggacactgctaacactcccaaatccaagaccaaaaaatacagcatacaccaccaggcttgtgtagtcctcagccaacgcacataagagatgacagattccagtgaacatcactgcgaaactg

SEQ ID NO: 49704 - DNA, 2095 bp, Bovine  19866881342722
tacaatggtaagtccaagagaccatgtgtagaaatcctaactgatagcctagtattaatagaacttccaaactaacagccagtttcaactctcagccatgtgaatgagccctcttaagtatccaacccagtcaaactctaagaccactgaagtcccagctgacacgtgactgcagcactgagaaatcacactcagctaagcctaggaatcctacaaaatccacagccatgagaggtcatgtactctgttgtttaaccactgtattttacaattgttatgcagtaacagaggtcattgaaagaagagaatttcacaaatgcaggaaaagtttgtagatttgggacaggagaggtggagggagagagggagaggcggaggaagagagagtgagaggaaggagggaaatgggggagaaatggaagaagaggacaaggaagagaaatcaactacagatttacaaattttgcttcttttttcattcatcccattgaacaggacatgataatagcttcttaaagcactaatgtttctaaagtgataagatttatactagacgctctcttttgctttcttgactaaatcatagtaatgcttttcatgttgagttgagtgtgtgttcagtcatgtctgactctgcaagcccatggattgtagcctgccaggctcctctgtctatgggattttccagggaagaatactggagtgggttgtcattgtaaatcattgcgattttttgaagtatgcaactgttttaaaagataaaagactaaagttttgaggagaatagataattatcataggattacatagttaattgttgccagaagggaattctgaactcaagtctttatgaatcccaaagcaaagtttaacttagtagattgccaagtttgcctattttttgttcttttatttggtaacatgaaactgatttggtaaagtttgcttagttatttcaaagaaaaaacgtagcagttcagaactggttgtttagaattgcccatgtgattttgggaagatgacaacaacagtacttggtgatgtatattgcaaattatatgtctagtttcatggaaaagctccctgaagttctttacttgaaattatcatactttttggaaatacacttgactaattactgcttctatcaatacatgccttcagaaccattctgtagacacacaaagacccacttatccgtaggctgtgcccaccaatttaaggacttagatataagcataacagtgactggtggggtaatggcagatacattgcttatgcttggtacttatttataaaaattaagtagtgtattgggagagttattgggcctttttagctggcttgtcaaactgaatgattatggggtcacacagtaagatacttactaaaataaattagtctatttgtaatgaatctttgtttaggccttcctgctagccagttgttgcaataggacagttataacaatggatatctgcaagtacattattccctaatagcttgctaaattagactcaaaacaggcctacaccagcatgtgtcaaagtttaacggcaatttaataaacactgacatattttctgatctaccttctcaaattacttaaacagtttgttaaaaattgtgacagtcagaaatggtgctaagaatgaggattcaaagggtattaatatttaaaaaattcatatagatagttaataagaaatcttacaatcaaaagggaatatgaaagtatgtatctttgagcttgcctaacatttattatttatgaaatatgtattgttaaagttaaaaaattggataaactttctagaaataaaaaatacatcttcagtgttaatttatactgaatatattgtgaacacacattaaaataaagtgattaatgaagcttaatatgacagactcattattgtagaggataacttggctattggcacattgaatatgcaatttctccaaatttacaaataacttcttcatatcttacctccttatctagttactgctctacatttttttttttttgtatcagcaccaccttctgttggaaaatcactgtctctttgatctcttactgtctatttttcct

SEQ ID NO: 49705 - DNA, 1191 bp, Bovine  19866881399410
atgaaagtaggatcaggctggtttaattcctggcaatgaaattaatgagactgtgttttgaattgatattccatctattaggctgatcaaaccttgtttcaactaatttgataattgatatgcagttttaggaagattctgaaaagggtataagaatgaggaaactatactctgatattaaggcaaaacttgctcttgtctgttatctgaggaggcaagtcttgattttttatcatgaagcaattcatgaggatatggtacttaatggtgatagggaaaatcttgattgattatcatgaagtgattcatgaggatatggtacctaatgggtgatagtaaagagatctccctgcttttgtgtacactgttttcctcatattaagatgtacttccctctttccatctgctaaaatcttacttctgaccagatgctaaactggtaattggttcagaaatatgcatgtgatctccactctctgatctctaattcctctgaggtttctgtggccattattttgaattaggcagctaagcctaagtcaactcagagaccactggcattgtttaactccaaaattctcttatttttattctttcttttgcacttagagagtttcctgttatttttaaaactactctggagttggtaaaaattagaccaggcagtcttccaaagcattgagtcttatatcgcagcatgaatttaatgcctgttcccctcctggttccaatgtgacaactaccccttggatcagtggatgctttatagccagctgtccatataggaaagggcctcaagatccaagaaagtgcagtgccatttccaaaatacttctcattcaatttgggtgttagtacatgttgatctgataagcacttattgacacatattttgaagagctgagttaattagcaagatacttctcaaagctttgcgctaaacacggttttggataataagctttcaccttctcctaacaccacatttaccctctacaaggcagagttcatcgtatctttgacttctaattttatagtctctacttataatccagcataaactacttgaccatctcaaatctgaagtaagaaaggctagaagaaagaactattggtttatttcttttggggatcacacactagtccaacttgactctttttatttgttacaaatcttttatgatcttagtg

SEQ ID NO: 49706 - DNA, 723 bp, Bovine  19866881691035
ctaaattacattttttgacacgatcttttcatacaccacacacacataacttctgaacaccatttctaaaggaaagagtgcttatgaacacatttgtaataatgtgtgtgatttctggcctatattttaaaatttctggaagttatttgatagaaaaatcaaagtggtaccccagatgactgactctgtagtggtggacagtcagaacctcattaagccaataaagaaatgtccagagaactagactctttcctgcatccttcaaatcatatcctattagaaaaggtgattacaataagcagaggcaataaaatattaaagagcatgtgcttcggagtcagacaggttcaggtttggatccaagacgctcattacttacaaggtggagactttggacagatctaatctttccaagtcttagttttctcactgggaaaataaatttagaaaatcaacttctgtagcttgttatgtagattagaaataatacatgtaaaacatctagcatataggtaaaaattaacatgatagatattgtgtatacacaatgaataaaaggtcagtatttgaaggaagcctttaagtaatatatgtttgaggattattcatggctctagaaacatgcttgattcaacgtttaagatagtcttgccatatggtttattgttttccctattcaaagtaaaaatgccaaatgatgctgtaaataggattagcaaacaa

SEQ ID NO: 49707 - DNA, 870 bp, Bovine  19866881942592
acatgacttagtgactgaataagaacaaatgcaccaagaaaggcaatgtaagcacacagtgaagaagcagttttctgcaaatcaaggaaaaggctttcagtggaacctgactacactggcatcctgattacagcttctagcctctagaagtgtgagaaaataaattgtttaagccatccaatctgccacccaatatatgatactgtgttatggcagccctcatagactaatacacacagcaagtcacatggccaagcccccagtaaatgtgaagaactatttaaagaggtagataccatagaaagggggaataatttctggccaatttggctaatttttcaatctaccataattgcatcatagtctttaaataaatatgatgcatgtaggtatcataaactagtgaattatgcttctttgggtataatttttttaaaaatgctactactttagaataaatgacctggagccaagtattctgatgttattcagtgcttacacattatgcatgtactctttaagggcactccaggactattatgtgttttactagttttgcagactagttcatatttcctagtggttatatacatgagtcccaatgacaatgcaagtgaaatactcattaaatccgccttcacataatctgttcagaacttataatttctattatttcattgcctattgaccttcaggcaaattgtcaagaaatttatgagggtagcagcatgaatatgtgttgccaaatgtctcttgggtaaaatatgactcatggttttcttggtcctgaaatgattaagcctcaaacctgaagttgacagcatagtcattgtacagattgatgttctcaatgactaatatttgacagag

SEQ ID NO: 49708 - DNA, 1044 bp, Bovine  19866880149519
catggcttagtttcatcgagttagacaaggctgtggtccatgtgatcagattggctagttttctgtaattatggtttcagtgtgtctgccctctgatgccctctcgcaacacctaccgtcttacttgggtttctctaaccttggatgtggggtatctcttcaggctgcttcagcaaagcacagcccccatatttttgaaagaaatgatattttggcagagcagtggtcacactgggatctaagtaacaaagtttaacagatgagattagttctcttctcccaggctcagaccccagagtaacagcacccacacacagctcagtcaactgtcagacatcaagtgctgagcccataaatacaacaggagaaactctatcacttggcagaacaggcttctcatgaagggctcctgcagttgtggctgacatttggcagatcagtcttggggtttgacttgtagggtcaccaatcattctggttttcccatgacttttccaggcttggcactgaaaatccttcattcctagaaaacccttcagttccaggaaaggcaaggcagctagctggtcaccccacttgggaaacagactacttgtgatctcgtttttagggaaactatgctctgagtgctctactatgtaaagtgagcatctcaaccgtccatctgcatttacacacctgaacacaaatgcttaactgcatgctgttttcctaattgactttcctaattgactctttggtgagagtacagcattctctctagatcattataaaacgtgatttcaaaatattcccatgatagaaaagaacatcagctgttaagatattgagaatgttttataatttctagactagccacttccttattctaacattatgagcacattggttctgtgaatgcataaatatttaatttcatggataattaagtctttataagaaaaattatttcaacttgaaagcttaaatggctatttgccttctgaaattacaagttttgcaggttttgttttttgtgacaagaaataggagagagatctaaca

SEQ ID NO: 49709 - DNA, 1426 bp, Bovine  19866880354225
tggcagtgtcccgatctgggccttctgataggtgtagagtgatatctcattgttgttttaatttgcatttccctgatgacatatgatgtggaggagcatttttccatatgcttatttgccatctgtatatcttctttcatgaggtgtctgttgaggtctttggcccattttttcaactgagttgttggtttccttatccttgtattcagtcgtgtccaactctgtgtgaccctatggactgtagcctgctagtctcttctgtccatagcattctctaggcaagaatattggagtgggttgccatgccctcctccagggaatcttcccgaccttgagttgtacataatttttgattgcctgactaccttgacttcaaatattctcaaatcttaaatataagatgcgtggctttagagttggctttcttacctctagaagctgccgttaaagaagactaattaggcatttgcaaaatgtggacagccacagaacttaaaaataacagaaagggagaataaaaagatagatgagaaaagaactttttagagtctagaaagtgcttgaacctctaaagttgcaaggtatcaatatttagtgggtattcatgtgcacttatcttgagaaatagactatagttttgcatcagagtcttatgggatttttcaaatcacaaaagattaaataaacccattgttggcaagagaaataaataccattttatttccagatgatagaattaacaataatttattgaacacattttgagattggcactgttctaagcacttttgtgggaattatcgtttaattttcaaagcaacaattattactgtctttaactgacaaatttggagactgctagtggctctaggtcatgtgcctagtcagtggcagagagagagatatgcccaaagctgccctcttaaccactatgccatattcccttcagtccttaacttaattttactttacccctctccgtcttccttaataattttggttaaaaaaaatagtttttaaatttagctccctggcagtcacacactggccagctctcagatttctgacagggtgacccagtttgcacatcacaaatataactgaagacataactagatacttagatacattttcatcattgtgcaatcttactaatgggttggcctcagacttcaagtggaaagttgtggtgcttcttctaatgggcaggcatttcccaagttctgttcaactactgaattctgctcattaggttaatgaaaagcaaatttgcagtccccttgctattgtaaagcattccagcaacgataaattcatatggaaacgataattcatatggaaatttatcagtttaagtagctggaaacctccagaaattgtcctgttgtatgatgagaattcacttgctgaggataactctgaaaat

SEQ ID NO: 49710 - DNA, 915 bp, Bovine  19866880360120
actgaactgaacccctttatttgtttagctatctttctctttaagtatctgagggttggggcctgatttgttctcctattccttgcaaggacttagtataggtgctgaatgggtgaatgaattaatgactgacccagcaattcaagatggaaaatgcaggaagaggattgagtttgttgaaagtaatgagttcagtatcaacctcataggctaaatatgttctgagtcctgtcctggtagtggagctgtcatattttgatacactgagagttaatgtgttctgagttctatactaccaactctttttgaaaggggctaaaatcccatggactgaggagcctggtaggctgcagtccatggggtcactaagagtcaggcatgactgagcgacttcactttcatgcactagagaaggaaatggcaacccactccagtgttcttgcctggagaatcccagggatgggggagcctggtgggctgccgtctatggggttgcatagagtcggacacgactgaagtgactcagcagcagccataaaccttaaatagtatgtaaactttacatagatacttttagagaaggtttaggttcacagcaaaattgaatagaaggtaccaaaatttcccatacactcctcacatgtattcttgcctaatctcccttacttatcaacatccctgcccccaccagaacggtacagtggttacagtagatctacatttacacatctacctacatttacacagcattatctccccaagtccatagattacttttgggttcatatttggtgttgtatattctaacatttggataaatgtatgatatatgtccaccattatagtatcatgttattgtttagttgttaaatcatgtccaactcttttgcaaccccatggactgcagcacaccag

SEQ ID NO: 49711 - DNA, 795 bp, Bovine  19866880379887
ccaccaaattggctgttccttgaatcacaggttactctccattctagagggaacattttttcttcctaagtgagaactgttgcatctgtaggtatagtcttgatgcatctgtgtagagacatgcactccatgtctacctactcctctgccatcttgactcctctttttctttttgcatgcatgtgtgcttagtcgcttagtcatgtccagctctctgtgaccccatggactgtagcctgccaggctctgtccatgggattttccacgcaagaaaactggagtgggttgccatttccttctccaagggttcttcctgacccagagatcgaactcgcatctcctgcctctcctgcattgtcaggtggactctttaccattgaaccacttatcttcttaagtgattttaattcataatagtgcacaaacaaaataaatcacaggagatagccaggaggtgtcaaaatctttgggacaaacagataaacacaaacaggaaagatttcgtgtcctcttccattgaataggcagattgtctgtcacctgccactcacaagagacaagattgttggaccatgtaatcaaaaccaggcttccaatgaaagtcatacaaaatggtgaccagcataaactcactcagaaaaaaaaaatcaaaaaagaaacagaaaaacaaaaagagtatgagtgagactgaaagcagtattgtggcacaagattctctgcaggagctggaaaagacttcccttcccataaggcttccatatgaggtgcacttatcctgcagtgcagtttatttgg

SEQ ID NO: 49712 - DNA, 2128 bp, Bovine  19866880411704
tagttctttggcccattttttgattgggtcatttatttttctggagttgagctgtaggagttgcttatatatttttgagattagttgtttgtcagttgcttcatttgctattattttctcccattctgaaggctgtcttttcaccttgctaatagtttcctttgaagtgcagaagcttttaaggttaattaggtcccatttgtttatttttgcttttatttccaatattctgggaggtgggtcatagaggatcctgctgtgatgtatgtcagagagtgttttgcctatgttctcctctaggagttttatagtttctggtcttatgtttagatctttaatccattttgagtttatttttgtgtatggtgttagaaagtgttctagtttcattcttttacaagtggttgaccagatttcccagcaccacttgttaaagagattgtctttaatccattgtatattcttgcctaaaaggaagctagatgttttgacacgtgctttgacataaggaggaatggtcctatggaagcccttcaacgtaccaaggaggccttttctggaatgcataaagctcttctctgcacgttttggtaggagagattttcctcaagcataagaatttaagatgaatcaggaactcttttatcatatttttaaataaaccttcatgggattggcctgttttatttaccacagtatgttcccaccaacagtgcactaggattcctttttctccataccatgaaaggcccttgtgaatatgtgctcaatgaaacacatttgttatcagatttgtgcaaatgtgacatggctattgcaaaagtataaaaataaagaagaaaacagttgttcccagtatattgccatagaaagtgatctccactttgccaatgaataaaagcatggaatcgtggggtttacttcttccaaattgtataggaccttgaacatagggttacaaggtaaaatacaatcatattaaattaaaaccttgacagctatctctcattgtcaggttaagtatctgcactcctgtgaaatgcaccagtctttaatcccagagaagccaagagtcagtacatttctcactttgtttcgaggtgaaatcagtgattgatgttgcctgcttcttcatcagtaaagcatgtacatcccatcattctacggatccctgtacattcatgctttccccaaaccctatatttccttgtaatgtaatcgccaatgtagtggatatgaacttgggcaaactccaggagatggtgaggagcatgggggcctggtgtgctatagtccatggggtggcgaagagtcagacacagctggcaactgaacaacaatgctggttaatccaaaaatagtcccctaaggagagagaccactttaaatactgctctgttcccaatagttgttttgttgttgttattgttttaattaaacctcatttgtacaggggaataattttctagatggaaagcaatagacacaacttgcatttatttttaatgtcagcatcaaaaggttcaaagtctcctgctgagatggtagggtactgaaatagtctcctccaagctatttgtagactcattaattgagaaattagagaaataagggtacatatgcctatgtaattaaactgcccatttcgcctttcttcactaaagcagtttcccaggatgttaattgactggacaacttctctgtgtctggtatatcttgataagctttacattaaaaaaagcactgctcccaccctcaaactgtcaggaggcattaaaaaaaatagacttagcactttgaagagttaattacaaatctaaggaatatttctgtttggtgtacctcttggcatattggatactaacagccccttcctgccattaaatgataaaaacttcctattgcattttctggtttgctctgggcttggaggagaggctttcctgagagcattcaccagactgctgctttgttttcaataaaccattaatttccttgctgttttgctttataaggaaactgtatttgatttctgtgtctgccatcctcccttcattcgggtgcctgtcgttcatcatcccatcagcccgacgcgtctgcagatgcattgtcctttttcatgaggatt

SEQ ID NO: 49713 - DNA, 1425 bp, Bovine  19866880556842
cctcttctttggtaagtgggactatggctcactctcttctatatcccaggctccctctaggggccccatcatttgctgctctctgaggttggtgaatggttcatcaacaattacattttgctcttgagaattatcatttatctgcctgaggagctgatgtcaacgttttaggggccatagctattagctttcacataggagcagacgcttttagagcctagatcttgtttctctttgcccagcatccttcttcactctaagctccgaggtttctaaatggttctacccccactcgtgaggaagctgtctgtctgccaacccattctgctcctgccaaagctgcctgacaagttcaacatgaacagtttgaaatagatttttcatcaatataacgtattaaactcttaacccacagaggcacagagcagtttctcatacatttctttttctttttttttaagaaagggtaatatcccaaacatcaagctttaggattttcttgtgcacaaatattgaataactccgcttcaactctactcttggtcacagtccttcttcctgcagcaggaaacacaaagctgtattaaattaaaagttctggggattctaggctaggatcatgaaaacccagtttagctttttgtgttactaaggcagagcctctctaggagtctttcttggcttcacaatgacctctctgatgtgagtcagcacttcgctgtttgtttaacttctaaggttactgaagcaccagggggacacagtttgtccaaagtcacgctgcaggatcgtggcaggcaaaaatcaggctgcgagcttgtttccactaggctgtactccttgaacctttgtgtgtctaccagacacagctatgctgataccagtcctggacttctgtctttaaataggtgcccagcaaacatgattgtaagtccctttgtgatattagttcaggccctgtgtgaagatcagactctggtttgaagggattctgacagtttcagctaaataggatgcttagatccaggagtgaaaaaaatgatgccaggtggcaagaatagcaaggcagactgaaacaggacagttcttctgcttttcaacaggcaggcgtacctcttactcttttcttgctctgggaaattcttctaaatccaaattcactttttttcttgaaacaattaagattgggtgttcagaatgcaagcatatcctttgcactattcttaacagtctccagaaattctcctacggtgtgcaaggggtgtagggctgcgaaaagatgagcggtttcagattaatagcattctaaattcatcacgcattttcttagaacgtaattttgaagagacaggaatccagtatagcgcatgtggtcttttgttgcttatagcttgttactttccttcacattaaaaaatggtagag

SEQ ID NO: 49714 - DNA, 733 bp, Bovine  19866880942105
agttgctccgtcgtgtccgactctttgcaacccatagactgtagcctaccaggctcctccgtccatgggattttccagacaagagtactggagtgggttgccattacagtaggaggattttatttttaacccagataacaggacccgagccaggtatgtatgtatgaaatagtaacccagccctcagaaagagaagcacactattgacaaacaatgcctaactctaaatgaaaatttggactcacatggtctttggctgcatgaggaaagcacttaggttcagtaatttacagaattaaatgagtgtcatattcaagagcttttagtaggaatggtacaattaaatgaccaatatttcaacaaagcatttaaaattcttatccttaattcaatttgaccatttaaggagatttattaagcagataaatattatcctgaaacctgagacagaactgtgtttgagtgtctcttctagaagtacaggtcagcagtggactgttgcataagcaggggctctgggtgcagcagacttgggtttggcataagccctcttggaggaagtcgccattaaccccaccatagagctgccagaacttacattggactgggaaatagactcttggagggcacaaacagaaccttgtgtgcaccaggacccaggagaaagggagcagtgaccccataagagactgacccactcttgcccaggagtgtccaggagtctcccttggag

SEQ ID NO: 49715 - DNA, 2327 bp, Bovine  19866881045583
aaatgtaggcctattcagctgctctgtgttggccttggactatgattttaaaagttttccaccctaaaagagagagctcaagatttttactttaaggatgaaattacatttcattcaaatttagcgtcgtgcttcataatacatccagtttgtttcatttaaaatatctgaaattgtttaccactgtgtaagatggattacattctccatgctattctacagcttgtgtgcccaccggtgctcctcatgggggcttctggagtgttgtttaggcaagtgtgggaacacagtgttagcaagcaggattagcagactgctaagatggagtaacagagacaatttgttagcgtgtgttcagaagaggggtaggttggctaattgacaccaacatgccatctgcttggcaggtgtgtctcgtcagtgaaaaatctcaaggcgaggattaaatgagatataaagtattgagtacaaagtctgacatgaagtaagctctcaataaatgctagctgttattattaccaaagagagttctcacacccagatgttactaccacttacatgatcagactaattactgttactctgattcaaggtgcaccaagccatgttctcatccaactacccaggcatatttttccctccaggaggggatgatcaaaataacttcatgcagccatatatctctttgcacattgatatgtgaatcagtcaaaagatactggacatctctttgtgggcagcacaacaaattcttttgcccatggaatggtaaaatagaccttggatgtggtgattttatcaaggtatggctatctcttgaagcaaatttggaccatgggtcttttctaatcaacaatttagcttatttccctaactaccattagcaggagtataattttcaagtaggtctcaaattccctaaagcacatttcatagccgacagaaaaaaatgcatttcataatgtgatccagaacatatattgaaagtttcatgaaacaatacctacccgtattttattaattatctaaaattagaattctgggccaacagtcactgtcctgggatccacatatgaaaactgactgtacttcctgcttagtctatattttcttccctctctgttcattccattgctcagtctgaactgccatggtctatgctttactcatatcctcctccattcgtgactcctggccagccttgagctctcaacaacaatatgagctcacctacttcttatgtctacagtaacagttagtcttgcttggatttttcaggatactttgaatattttattctatgacccttggctttggatcatatatgttaatcggtctaagtcctctagtttgccctggcctcctcaattctgacctcaacttcacacagaggatgtgtagtgactgaagaaactttcgtccatattaaatgtcctcattcactcacttgtgccaggcactgttctgcaggccaccaacttcaatttgcctacaatttgtccattccagtctgcctccattttccaagaatagtctctattttaagacagaataagtcctttttgcttagttcttagtgtgtgtatgtgctattttatgaatgactaaggctttctgggcagtcgcagactatccctctgatatggttctcttttcagcctgatgattgctttattgtagacacagggaaataattcctggagtcagagaactatggactcaaatccttgtgccacctgatttgtaacctaatcaaagttttgcaaagattaaatacaataaataaaaattatactgtactatctgaatgcttagtgagtcatctagcatataataggtggtaagtaaatgttaattcattctccttacttttttctagttagtaatgcatgaagataaaatagagtatggtagcatggtaatgttagcagattttaaacccttacactgtgctaaatacatcttgtgccttatctgagctaattttagaacaactcaacaggattccttatcattttacagatgaggaaagttgaagtgcaaagagattaaagagatggctgagttcaaaaaattagtaaggtgcagagctgtatgtgaattctcaaactagaaagacattcagacttctgaccccatttatgcaatgagatccattgggggtcagaattccctatagattaaaatcagattgcttattgcatacataatgatatttcttgcctctccccaagattctcatctagacttcttcccattatcccccaccctccattagcttaggaccaagtctggaaaagtcttgggcatgatgtagttggaagcag

SEQ ID NO: 49716 - DNA, 1802 bp, Bovine  19866881060528
acagactggagacaacaggagggagacctgatcccaaacagaagagagtaaatcaggaaactagaagacagctgcgctatagacagaaaactcagacagggtgacaaatgagtgatctgagaggaagaaaatgaatccagtaagagggggaaaaaggcagaaaaggaagcacataggtggtttcatatggatgacgggatgcagaatttgacagagggggaaacatacaaaagatattgaacacagaaaataagatagagagcatatatacatattttttctccttaataaaaagaacatatataacatagagcattaaaaatcctgtataatttccacctacatagcttccttcaaaataaccactgctaatagtccggtgaatgttctgccaggttttccttgtttctggcacagttggaagtgtagggaggaatagatgaagggaagagagagtggggagagcacggtggggaggaattttgatgggcttatgtggccaaagctgccagggcctcgccaggtccgcagagcaccccgatggccatcctgggcaggctgacagctctggctctagggcgcagagcacagggcgctctcttcagagagcctgttggaggctcccggggcaagatggaagcacaggagagctaatgccccaggagcaaccttcatcaactcaggatgggcaaaggagcatagttatttggcgtcttccccatagtttgtcaaagtgtgctctgtgggattcgactctgatacccccagtggtaacctgctcatcaatacaccttttactattttctttctcccttgtctcactttccaactaccaaaacaaaacaaagcccaaactgaacaaagaaaaaccatggaactatgtgtatacaaatctttgcttcagggtctgctttggagaaaaccaaagctgatatggaacagaagccaccagaagtgggatggggcaggtggacagactgtgatccatttaggaggcagcctggacacgattcacccagcaaagggcaaggagagggctgaggaagagaggatgccacagtcggctgagaaataagtctcacccttaacgcttttttaaaaagtataattcatgacatcactttatggctattctacagatggtgtgaataaaaagctgagagaatggatagtagaatgcagagataggtggagaaggaatttaggctcaagattgcagagaaagaaagtataaaatgagcaaacagcaaaaaggtacatgagaattaattgcaggaagaagcaaatgggagaaaagtgacatgaatgagtgaagtaatgggaaaatgagacaaaaaaatggatgaggagtgaggaaatgtaacaaatgagatggggaacaaagtagtgaaggagagaaaagattccacagtaaattagaaatgttcattttatgggcaaggaaatgaggaaatggaagggaatattaagaaaattaatcctggtaaccaaagctgtgggaaaatgtataatgaatgaataaattagcagaaagaatggatgaaggaatgtgaaactgaaaaaaaaaaaagaccccaaatgactgggtgattgagaccgtgaaaatgaccatagagaggaaacaggcaccctaaaaatggacataaaattaaggaacgaaggaatatccaatgagaaattagtagaaggataaaaaataaaaatagaggtcttctgtgaaggaatgaacacttccttccaaactttaatcaaaacctcttgtaaggttctaaagttttcccctggatctgcctgctgttttt

SEQ ID NO: 49717 - DNA, 1642 bp, Bovine  19866881089017
ggagtatttatacccttccccaccttccggcctctcctagagctgctgggagcttctgtcacacctctttgaaacctactcaaatgtcaacacatcactcagcaaaacaaacccccatgttttctaagcctgtagtatcgttatatccagagaactggagccacaagaaaacttagcttttccatgaatggtttaagggcattaattatcatggaaaactacatgcagactgttcagagacaaaatgatacccctccctatgtgtttcaagagaatagcatattgtcatctgaaagagtaatttatttccacataattggctccataaagggcattttcagtgtctaattccctaaataacttggggcctaccattgccaagagaactgtaattaattaactcatttatgattaatgcattccagttttcctttgctgccactttttgaggagaaaattggccagtctcgtgactctattttcatgtacctaattcatttaaaataaataaagaaatttggatgacaagcccaagaagttgattgttaatggaagacccttggaggctgcacctttctgttgtgttctgtccatctcagaagactgagattgggactttgcttagctgtcagcaataagattcttaatacacagctgtagatactggtttgaagggtggggagggatggttagtttcctggtttgtttagcaactgtgatacctaatggaggtaggagaggaagaagggaggaagtagagagggcacaaaaggcagaaaagaagatccataaaagcattttaagcagctctacctctccacgtagtatgaagactacctatcttggatcacacccaatcaatgtgatttaatgagcaatgactatgatataacatatgctgccaacatttttttccagattatttgttaacatcctatcatgtacttttaatttctctcacttgagctcaaattcatgagaaagagtaactgaataacttggaaacctatacgtagctcttcattcatccaacaccatttttaaagcaaggctagatgcctcactatcatttccccaaccccatttctctaccaaaaactgaattgttctctgtgtcccattctttcagtcttgctagacaattgaatccatttttagataattgtgctgctcacacctccagtggatgaattatagtcaccattattccaatgaggcatatattggtgtccttaacagagtaccctgataaatcgtctattattaccatattatcctatttccagcctcatcattctattcacttgtcacctctgactttcttaggcctatggtaactgggatgaacttttatcttacacatcccagacaatcccagtatgaactcagattctccagaagcagtagacaggcctatcaatgtaaagattagagctagaacctcctagaataatgataacacccaaacaaaaaccaccaaagacaactagttcacacacaagttgatacctactgtaacctggtgacaaaaatatcagaggggtgaagactagggtagggggaaaggggcatgattcataacttgctttaagaagtttatttagatgaattattatttacattttacagatgtgaaaattgg

SEQ ID NO: 49718 - DNA, 1374 bp, Bovine  19866881089517
tattaaaactctattaaatataaaaattagtttgggaatgtttggcaactctagattccctttcacaacatgggatatgactggcttataagtttttgtttagatttcatatattaaaaaatcagtaacaacttataaagatcttcaaaataaccaaggatatatttcacagtctctgccacttttctttctgtttaattaagcataaaatacaaaaatttaaacatctcaagaaccaatataaaagatatattaaaacaaaatcttctatacaactggcagttttaacaccagctagatgtttgatgatattaaggaattattgttattttattagatgtgctaacagtattgttacattatttaaaaaaaaagagtcctgatcttttacacataaacactcaaatatggtatttgggatttgcctcaaagttaacgtaggacagaaagtatataggagtatgaaacaaaattggccatgagttgctaattgttagagctgataattattgggtttgctgtagtatcttttttggatatgtttgggaattttccataataaaaataaaggcaaatgtagaatgtcgaaaaaaaaaagtcctcataaaaaaaaatacttatgaaaagtagagctgactacatttatagccacagggtaaaaatactaatacttctgaagattgttggttctgttgttccctgcccagagtacactttggacctcaagcaaaattatgaagtagactttgcttatattctttatttcctagtgtcgacttcatcttagctccatatcagttttctttctgcttgttgtaaatgcacatttttctcccattcacctctttacttcccaaattgtaacttacttcttcctactgagtcggagacctaaagatgaacctgtcccaattaaagtgcaagagaagactactcaggatagagtttacgaaggtagaagttggtagtagttctgtttgagcatttggaaaaattactgatagaaatgtgagaagtttgttggaatattgtggggagaaacttgtaggagtcctatatgaaaagcactaactgttgattttatttaaaaattgccagtctgcagagagggaaaagtaaacgctttactagtacgattagctgctgctgatgatgctaagtcgcttcagtcgtgtccgactctgtgcgaccccatagacggcagcccaccaggctcccctgtccctgggattctgtaggcaagaacactggagtgggttgccattgccttctccaatgcaggaaagtgaaaagtgaaagtgaagtcgctgagtcttgtccgattcttagcaaccccatggactgcggcccaccaggctcctccacctatgggat

SEQ ID NO: 49719 - DNA, 1485 bp, Bovine  19866881107702
aatacacataaaaacccactgcgtgctagctgcttggccaggtgcctccaggctatgggggtgttctggttgcagagcacacacacctctgccttcaggatgctagaagcttgtctgggagctatatcactaaaaaaaatcacctgctatgggagaagactctggaaaagactctgaagtttccttgaacccttgtacccttggcctggcattcccccagcactgtgctctggaatcccaaacaaggtagatccctcccttgattgggtttcctacctgttggtatggtcagtctctcctgctttgtgagtccctgtaaggtgggagcccatacatatacctctccaggtccttaaagcccacttcatgatgtgtagtgggcacctgatgaacactgtttgaatggacagatggttaagatgctccccagagtgggactcctagaggcagcaagaggagaataggtgcctaggagggaagaagaagggctcctagcagtggacagtgactgctaaaggctctggaggagctggaggaaataaagagttccaggctcttgtcgtcttaattaggtggtctaaacaggaatgggtttccctgtcaacctctctccaggaactgggtccctccctaaaacccagaactgatcactttcacctagaataccaggcaaatagagtccaggcaaaactacccatgtctgtcccagctcagtgggttttccagggtcatcacggctcactctctggggacattaagattaaatacagtaaatacacatgaggtcaagtttatgacacagtgtatgaaataccaagaaatggagattactagtcagagatttgcctactgcactctgcccgaatagattcttaacctgaccatgtccagacacaacctccgattttcaaatgtggcaacataaagcatttaccaggaagaaaaacatgtcttcaagctttgagtcttccttagttataaatcactttttggggtcaattttaaaagtaccttgtgatgatttgcctctggtctgcaatgcaagagacctgggtttgatccctggtttgggaagatccattggagaagggaaaggctacccactccagttttctggcctggagaattccatggactgtacagtccatggggtcatataagagttggacatgactgagcaactttcactttttcctattcacagcagcacctggcaatggacaattctcccagctcagtcatcaaagcaaaccctacactcagagatggttcctgccctataagcatttatatattcgactttgcttgtcatgtcgattcacagagagagaggccagccaatgggggatgatctcctctctgttttaattactataggcccagagatgaatgaaagtccttggccagtggacacaaagggccagggtcaccaaagaaagggtgcctgaactgtcagctttgtctctggacttgataagcctcagg

SEQ ID NO: 49720 - DNA, 1506 bp, Bovine  19866881144120
tagcacctctccgcttctcttggtctccacacactgccaaacatgcccggggcaacaacatcacccctggtggagaaccactaatgttgacaataatggattatggtctagagacttcagagttgggcaggagcttgtgactcacaaaatccaaatttggactctactggttggttcatgtggcaaaaaaggtataagggaagcaaacaaatctgaaacctgaaaggctgaagaatgaaatcaatggataatgtggaaggagtgagttcaagaggaaagaaagaaaccaatgttcaaatccattgtggctgctcagtggtggtaccatcttgagcaagtcacttaattgactaaatctctattttaccatctgtcaaagtgggatagtaatcatatctacattacaggggtggatatgattaggtgaggtagtgtactaaagtgcttcttacagttctgggatcagagcaagtacaatgaatgttagctacagttattgggctttgaaaaaatgatgggagagagacagaattaagtacggaaatttcaaagttctaatcaaaaattagaatgcttaggttaaaaaatgaaattaactcagtctaaacaaatctaaataagtttaacacagcttagtcaattattagagggaaaatacactggcataaaaatcacatagctataaacattgatgtgtgaggaaagggtttccaaaatgaatgatgcattgaatacatgacttctcctttcccagttctgatctagaatttagatctgtaggttccagacattccaggaaacatgctgtttggacgtgctttgattttcaaggtagttcaacacccggtaaatttcttaggatcactgaagccaattagaaaaaggttgtgtaatgatgctgctggggatgccagtcttctgagttctgagagggtgtgctggtatctcagcatcactgagcctcccccagcccttagcacacatacctccctacatgaggtagcgctgtaaatgtttgtggaattgaattcaattgccttaatgaacttcaaacaagacttcaggtgactgcaggtgactgaattagaccaaactagttcttccaacctcttgtggctcatcaccaataagagaacactgcacatctgctctggaaaaaaaaaaaaaaaggctcctggcttaaacacaagtcaggttttgtgcttcagtaacaagttaaaaatccatctcgcaatagtcccgtaattcatttgctccactctttttttttacatgaattttgtagttgtgatttgcattattgtgggctatttcaaggtagaacaaagaatgccatgatgtgattaactacatacaggatggcaaaatacaaaactcaaactctcgagtgatggactgtgtttttaggatttgttttaaagaattgttgaaatcctctcctctctaaggagccaaaaataccaagctgagatttttatcacagcattttttgaatcaattcaaact

SEQ ID NO: 49721 - DNA, 1805 bp, Bovine  19866881206543
ttttaaaaactttttttttaatggaaaatttcaaacatgtgaaaaagtagaaagaatggtaaactgtacttcagaatacctgtcacttagcttcaacagttgtcaacttgtaacttgtcactgtatttcacctacatctctacccacagtatgtactctggattattttgaagcaaatctcacatatcatgtactttcatctgctaatacttcagagtgtatctctcaaaaaataagtactcttttcaaaggtaaagcctttaatacaattttcacataaaatttttaacaattcctcattatcataaattacagtgttcatattaccccaattatgttaaaaatttttaaacagcttacttgtttgaattggaatccaaataaagttcttacatagcaatcagttcatgtgtctctcaagtccccttttatctgtatgttatctgtcttttccttaaaatttccttgaagaaactgtatttttttcctttgagttttctaaattttcagtcttttgcttattgcatctctgtgggttggtttaacattgtctttggactcctgaatttcatgtaaattggtagtgggaattagatgcttgattagatctagattcaatatttttttcttttggtcagcactaagtgctgtgttttcccattgtgcagtccttaatttctggttgtctttttcatgattattattgactagatctataaattcattcaaagttgcacgatgaagatattccagttctagtattctttcttcatctatgaactaaaacagttccatgaaaactaatgtcctctcattaattatttcattttcctgaggtacagttcttatagaaaggtacagataaatgcttaattagtttcccttatttatcagttttccaagcaatgagttttctccctagcaccttccaaaagtggccaataagatttttcttcttttagtataatttcaaagtcattgatttcatacttgaaatgtttgaactcattgcacttattttccttacttaagatggcccctgacaccttttgctatgaccccaatggtcattgatagattcagagttacctgttctggaaagatattctgggctcattttgtattttcagttctaggcctggaatgagcctttatctccaaagaatcttgcatcctttattggaaaatgatatttaaagacaatctgagtaatagggatgctcttggctactggattagttattttcagtggacagaggtagccaatgggatttttattttaaagataaaatattatcattagctcatattgatacttgtaattcagtttcaggactacagcacttttacataaccccatgaatcttttatgtatatcttcttttacttaatgccaaaaataattgagtctcaattacacaaggataatttctgtttttttttttcttactttataatatacatacaaccatctcagaacaggaataccaagactatcaccaataataataattctgaaaacagtttaaaatttttttcctgctgtcatttttgttacttgggtatattccactagggatgtatataataaattactaatttaaaaaccagctagaaatgcttttctttatatggttatgccaccaattagatatacagttaaattcactgttttattttacttgtatttatgtatgttaaaaattattttataattatgcaaaacatttacatggtccaaaaatcaaatcaaaggaagacatatatatatttaaaagtttagcttttatccccattatttctac

SEQ ID NO: 49722 - DNA, 1336 bp, Bovine  19866881260433
tgacgtgcccttcttattgcatcatatctgggaacatgatgtcctcatgatttcttggttaatgtgaccttgatcatgaccaattttctccactataaacttacttttccactttccatcctctcttattggaaacgagtcactaagtccagctcatactgaagggagggaattaaagtccacctcctagagtgggatgtatatatacctgttattggctgcccattctcttcctggtgcccagtctttctcagtgaggatctggtaaggttcatggagaaaactctgcaggaacaatatactcccactatgattgcacctcgtatggatcctagtccatacttggcatggcaactgtctagtttatctgaattcttcttattcacttgtgtgaccctggcatctcttccagtcacactctgcacagctgagccaggactttcctcccatctcttcttggaacaccctgtctttttttagatttcaggcactttaggtacccacaacctcagatctctaatgatttcaggaagaattataactttgttgtttatcaaagttttacctgctgaaaagggtgatggtctcttcagttttctatatccagggtggaagcagaacttgatgtaatgaatatgaaaagcaatcctctctcctccccatagaaagtgagatctaaaggcttcatacttgctgagacctcagagagcatccatgattatgtgactctcaacgagggcaaccattggcaggtattcccttgcacatcaagacccatgactgtcctgggaatgactggagtcattccaagaatgaatgatcagggccaagtccaagcacatgtttccagagcctctccgtctagtagcatcccttactcatgcctcacttgcccaaggcgccctccaggtagcccatgtcttaggtctgccatggctcccaccaactgggtttatgtactcccttaacagcacctggggacacctcagcccctcctgaaccaatgagaaatgtgagcacaggctagtatttgatggcggcagtagtgggagccctgccatccttcccctagaacacaggaattctaacctcacacactcaggtctctgaaaattttgttccttttttgttcattcaacaactagcaaatatggtagcaattatgtggcagaaattatgctgcgcactggatgtgcatccagccacccccgtaagaacaacttaacatttattcgtctacataaggacaggctaagcaacacagatctttgcatttcaagtatacagaataacctttgtagtgactgcacctggtatgtgaatgaaccattatgaa

SEQ ID NO: 49723 - DNA, 1748 bp, Bovine  19866881314123
gggcgtgggggaggcattgtgtcgacccactcaaaagcagttgtgcaaatcaatttccttccacagtaatttgtggagctattgttgagggtatttgtgtttgaataagagcttgtctgtctcatcacactgcttctctcgcccagagcctagagtgagagcacaaactttcacctgaactattgtagctggtagtcatggaaactgccagaggcacccagttcaatagtaagacttcactgcaggaacacaggcaggaggacgaagagccagcgggtttaaataagagactcgctaattaatggagcaccaggggacagcttaaagagaaaattgctcagtagataaatccaggttttcaggcctctctaaaggaatgatggcagtccctggagggctgtggaagtgaatgttttctctctcctctgtgatctggtttgtttggagtctttggaggccagtttgccctggctgtctgcagcgaggagtaaagacagcaggtacttggacttcccagccagttgaaatcaagatgtgaagtggcacggctgagactctaagacatggctttcccagcccctctgtcagccctgtccctgggtctctggctgtttgtgttctggttcttggtgagagccttttcagggaggtggctcccctgcccttacagggcttctctctcactcttcccctttcaccaatggcaaatggatacctctctttggtctccctccccattcctttgttcctggccaactttcaagactgtcccttttttaaaaaaaattttattgaactatagttgatttacaatgttatgttagtttctgctaactgaagtgaatcatgtaaacatatacatatatccctcttttttggatttttgcttcccacgcaggttaccacagagtgttgagtagaggtccctgtgctaaacagtgggttcttattagttatctattttatatatagttgcatatatgtgtcaatcccaattgcccaattcatcccaccctctactttccccacttggtgttcatacatgtgttctctacgcctgtgtctctatttctgctttgcaaaaaggttcatcagtatcctttttctagattccacatacatatggacctagagactgtcatacgcagtgaaataagtcagaaagagaaaaacaggtatcatgtattgacacatatctctgaaatcaaggctgtctcttgatcaggtaacaaaaacacaagagcatcaggtctagcagagtctgtgtgtataaaatttgaaaacactactgtatgcctatcagtccacaaatatcagctgcttggagaggaataggaaaatcattatctcaccagtcacccatttgaaaacacttcacaacaaatgaaagattgatttggtcatttaaagtatatcagatttcattccccaaatgctttctgagagccgtttactgaactgggtgctgcaaaggttattcgagtaaatcaggcagattcctcctgccagttcatctccctcaggtgaaagaaataagcttgagatgcttgatgaacagaatctaaatagtgtgccagcctcctcctctgtcagaggtgacgtcaccctgagatgaggcttactgtccatggctttgtgcattcctacagaacaagtttagtccagtttaactcctgaaggtgctgggggtcactctgctggaggcaagttctgctgagttgatgcctggacattagcatggagagtga

SEQ ID NO: 49724 - DNA, 1481 bp, Bovine  19866881502395
tagccccatctgggttttgtttgagttctttccttattttcctaagaaatccaattccactgttggaaaactcattattaaaaataacatttcaaaaaagctacctctcagctcttctcattgattctatatctgctgtttaccctcctgaccactttcatcaaatactggaaggaagatataaaatataaacatactaatttttcccatgacagaactatggaagtgagagcaaacactacaaatgaaagagaaaattcaaagctaacaaggtgagatgtaactgcaatgcatgtaaaatcctgcatttagattcaaaacatcagctactgaataggcgagaactcacttggtaggagttcctgtgaaaaagtcctgagagttgaaatgaattcttaacctaacatgagctgacaatgtgatgtgacggataaaaaagctagttgtcttagcccacacatctaggacagtgtcaagatcatagaagtaatagcaccaatatatttatattgccttgatcagattatatttgtatggcgtgttcaattttgtatgctatattttaagaggtttcctgatacaaacattatcatcctcatacctgtcaggaaggacacacatgtcataaacttcaatacagaaaaccttttttccccccttatgtctactaagaatactttttcaaagtttagaattgactgatccaatgggaattttgggaaagggacacatgtggaactagattctacctaagcctcacctagaggatgctaggctaagagcatgacgggctagtgggtatgagacgggtatttgtcagaagagaatcatagcctctgtctggaagccagagaaagatctgggctgctctgcttactgttggctttttcaaatcccccaaagtgggtgtctaggcagctgggcttcccagctaatggcgatcctttgaggagggatttaggaaacactcagagctgcctcagttggaaaagcgaggctgtgtatcaggtaattcgtctgctggactccctgaaatggtagtgaccaggtccatccctacctagtacctgtcctgggctcctgggctcaggaccagcttgtaccacctgcttccccagtagatctgtgccaccattaggagagagcaccactctgttagccttggatttcaaggcaaatccacaggatggttatggatcatcaggtggaaacctgtgctgggcctgagccaagcttgtcatacaactttaaaatatttagacatatggtgaatggcctccatttatatttgtttactcagcctgtgtcaggatacagacaagtcattataatgcacctagtttagaggaagaaaactctattagggtgatactaatttccccatatatccctaaccacctgcctttttttggttgttgttaaagaaatggagtcagtctatgtaaagtacctggaacagaggctcacagttactgctcaat

SEQ ID NO: 49725 - DNA, 1393 bp, Bovine  19866881656485
cattaacagagcctggcatgcatagtaagtgcttggtaaatgttggccaaggtcccttggccagagttctgttggtgaataagatgaataacagtatcaagagaattttcttattttatattttgctctcctacttctgaggacaaaaatctttcaaagttaaatattttggtctatgaatacatacaaaatttatttattttttccttttggtcaatgaataaggaaacacagaaaaaatcaatctatatcctctttcaaattcccatgatgttatcagggtcagaaatgtcatatttcaacaggatagctcagatgggacacaacagtttgaataaaaacttccactaggaaaactgccctctgacttctggttcctacagcacaagcaggataagtcaggtggtgactgcctcctaacaaatataaatgacacaattgtttacttggtgcaattttaattcagccttaaagctctctacagccaattttggtactgatctcctctaatggaagattaagtgccttgaggcaaagaaaaataattgttttgacattatgagatcaataagtcctggaaaccattaaactgtatagtgaaaggccctgagcgtatttaaaagtacagttttagatttcagtacaaagactattgggcttcccaggtaaagaacctgcctgccaatgcaggagacaaaaaaaagacacacaagttctatccttgggtcaggagatcccctggaggagggcatggcaacccactccagtattccttcctgaagaatcccactggcacaggagcctggggggccaaagtccatagggtcccaaagcgttggacacgactgaagcgactgagcatgcatgcacaaatctgttgcttggtttaaaacatacaaaggaagttaatattagcaagtgagagatcccaattgagattttattttattcttttgtctttcaggttttagttcagtccagtcgctcagtcctgtctgactctttgcgaccccatggattacagcacgccaggcttccctgtccatcaccaactcccagagattacccaaactcatgtccattgatttggtgatgccatccagccgtctcatcctctgtcatctgcttctcccaccttcatctttcccagcatcagggtcttatcaaatgagtcaattcttcacataaggtgaccaaagtatttggattttcagcttcagcatcagtccttccaatgaatattcaggactgatttcctttagaatggactgattgtatctccctgcagtccaagagactctcaagagtcttctccaacaccacagtgcaaaagcatcaattcttccatgctcagctttctttacagtccagctctcacatccatacatgacta

SEQ ID NO: 49726 - DNA, 1417 bp, Bovine  19866880245912
aactccgggagttggtgttggacagggaggcctggtgtgctgtgattcatggggtcgcaaagagtcagacacgactgagcgactgatctgatctgatgaaaattacagggaaagatgctccatagcacttgacaaagtctgcttaattctgggaagtgacttgggatgagagtggaggcagatttcttgcttccaccttataacaaaaccatgtgttccttttatactgaaagacatactgagagaagaaaggagggagggcgggagacagaaggagaaagaaggcactcaggtgcagttggcggtcccctggtatgcacagggggtggggtccgggagcccctggaaccagccagagattctttttttttgtttttgagccaatgaactcccgcttgaagatcaaggtgggctggaaaacaaatttacttaaaatgtaaacttcagtcaaaactgaacgacaacctgagagcgaaaaaagaaaaagaggaaaaaggaaggaggaatgcaacaaaaagaccaaaaaaaaaaaaaaaaacagagagatgtatgcttggctgttggggttttttagttggttaattctcggtttggttgcttttttttttccttaaaaaacaaaaatgccctcctacttttggatgcaaaacccacaagtctggagggtagactgtgtagtgaaagaagagaagcgacagcttgagaggcgccattcgacccctgcaaactcaccatcaacgtccgggctacgttacaacccaaggtgccggctccaagcagcagacacttggcagacacaaccttgtctaagtccagagtagggaccaatctccaacacatcagcttgaggttgagatcaaccgatgactcagctaacctagaaagggagagaatcatttatttatgtagccagtcacccgcttatgcccccaatcttgtccttttttagaaagaaagtagcttgtatgagaagataagaaacaagtaacagagggaatcaggatcaaaggaaaagcaacacgaggctggagggtaggcgaggacagcggttactacagagtgctgcgtgccgccataatcctcggcaactgtaccgtgacaggcccccatttgatcctgagctcccaggggcccagatgaaatggaaagcctgactggttacgggggttattacgtccaggactaaaacaacaccagccgcttaagaggaaacctcttcctaacactggatacagagaaatttctgtcccctcagtagagggagtacttacatcatcccttcagtacaaaactggtttctgtgaagtatttcttaccatggccttccctgtaggctaatgggacacaagtcaagggagacgaataaaggacaaaaaggtggaaggaggtgcacaggtctgaaagggcgggcttgaag

SEQ ID NO: 49727 - DNA, 1125 bp, Bovine  19866880354665
tctgtgctttcaacacacaggcgtgcgtgtcttcccacaagtgttctggggtttaagaggatattttatggcctttagtttcagttatcctaaataactaactctgaaatcctccttagtgtctagcaagtatgtgtattcattttgaaaggaacaggagaagggagcctggatctttaatgaaggctttggttcagggaggtggagcctaagaagtgcttctggtggggctgccttggccctgccctgggggtggggtggggtttgctgcctgcctggggtggaagcaaaggtggttttcccgctgctctgcaggcccttaaaggcacagctgtgtgctgcctgcgagtgttttgctaatgaagtgtggtacctttaaagaaaggtcacaggcctgacctgtgttgtgtgggtttcttgtttgtcaggctggaggcattttctcattttcacagttcagccgaaaacaaagacctccttatccgagccggggagccgtgctcttaagagctgacatcagccttttcccagcaggcagcgtttctgccttaagagtctttgccgagagctgggcaggccgacggccgccctgccctgggtttcttctggccggatgacacgcagggtgaagaaatgtcaagcgtgccagcagtcagggcagcagaacccagcgctctcgtcacgggtcccttcttgtctgttccgcggacctctgggcgcctccatttcacagagcttgtgaacgttgggccgaggaccttgagaaaggaggactggtttcctagagaggcgctgaaagggcctttggggcctgttggggaagcctcattagcatgtgtgaagacactgtttaaagacgaccctaaagttggggatggggaagtgttttttggtggatggattaagtcagaggcgtttgttgagaagttgaggaaacaaaaccacacagggtttggttccccctcctgccttgactctccgggttttccgggcgctgtttgcgtgaagatgcttctgagctggggacaccgacagcagccctgtgtccacgcggtcggaccatctgccttgctgctctgaggacgcagagccagcctgtcatgaggtcagggcctggcactcctg

SEQ ID NO: 49728 - DNA, 2337 bp, Bovine  19866880455917
cccattaaggaagagagggaccagccagggaggcccggagcagtgccagctgctgccccagaccctggagctgtttgagggagggaggggatgggatcccagggctccacaccagtgagctctgaggctcctcagcccttggccagaaaggcaggcgggccggctcctggggaaaaggtagaggagaagccttgtgaaaatcccaggactctgctggtggcaggaatggtgggcagggacgggggcagtcacatgaatgcaggcaagggaagagggcagggggatgcccagagggagagacgaggtcgggggatgaagaaggggccgaaggacgaaacctaactccaggcccaaccacagctctgacccaggaggctggtggggggtcacatggtgcagaccccgcaggggcagtggtaggacagacagccacaaggagaacggagcccaggaaccatcagccaggcacctccagccagcctgctgaggaggaaggagaggcagagccgagagcgcgagcagatggcccggaggagccctgccgtctgcagggccaaggaccaggctggtctccacgggagggaacctctcacaagcctcatggtttccaggataaacttgctttaaagaagggagtgacgagtggaaagtcttcaggagaatccaagatcaacagcaggtctgcacgcccaggaggcatgcaaaggatcccgggagaggtgcggccaggccaggcagaaacccccagagctcacctgacccagctgtccccacgggggagacccaggagggctgggaagagcccaggtcactcggtgggaccagggcagaggggggcctgccgcccaggagtcctgagtaggccgggacgttttcttctctgacacagcttcgctgtctgcaaacccaccagctcgggaagccggggaggatgggcaagggaggggcttcaggtggcttggagacagacagactggcctgatgcagggcacggacaggtcggttcagaggctgacggaggaggcagacgtcgctcctacccgctcaccccatagcccgaggataaaaaattccggtcctatggtacgacttcttcctaaccccagggaatgctggttacaccctcctctcatgagaagtccctgtatagggttatctcttcgcatcgttactctcacagcagttggggggatgggacgaagaaggggcatgacttgaaaccagagtgggcacggccaccttaaaattaacttgttaataaatcctgtgcaaaaaaacaaaacaaaaacaaaacagaaacgagcaagcctctaccattaggtgaagtacgcggttcaggtgttcatttgtacacacggcggtggacggcagggggcgaggagcaggaggagggacatcgaggtggcaggggcgctcagaagtgcgtctccttctctgtaattgccgcaacggtcccatcgcccttgagtttggcgtcacagtcattaaccgccaccgtccgtgggcctgccccaagcatgccccgcattttcaggtcggcgctggggatcatcaacttgcggaatctctacacggttggagaggaaaagagctgtctgagaaggctgttggagtccctggggggccctgcctcagcgcctcccaactgcacggcggacaccttggggggcaggggggcatggaaacggcaggccaggcttggagttctgccctgggcgatgcgtcgacctggagatctatttcctgcccccaccccgggacatggggaccacagggtaccagcgctgggtgacgaaggagatgatgaacggagttgactgccctgtacctggcccgctgcaggtgaccaggacgcaggagctgtacccaggcctcatccttccttcctgggcagactgaggctggggtctgagtccctgcttggcctcgctgtgtgtggggccagtcacctaacatcactgagctgcgctgtcccacctgtgagatgggccagctgttcctcctggggactctgctgtgagggtgagctacagcacctccagggccgtttatacagtggtctctacataaatggcagagaaggcaatggcaccccactccagcactcttgcctggaaaataccatggatggaggagcctggtgggccgcagtccatggggtcgctaagaatccgacacaactgagcgacttcactttcactttccactttcatgcattggcgaaggaaatggcaacccactccagtgttcttgcctggagaatcccaggggcagcctcatgggctgctgtctatggggtcacacagagtcggacacgactgaagcgacttagcagct

SEQ ID NO: 49729 - DNA, 1552 bp, Bovine  19866880845244
ttttgccaacagaggtctgtctagtcaaggctatggtttttccagtggtcatgtatgggtgtgagagttggactgtgaagaaagctgagcgccaaagaattgatgcttttgaactgtggtgttggagaagactcttgagaggcccttggactgcaaggagatccaaccagtccatcctaaaggaaatcagtcctgggtgttcattggaaggactgatgctgaagctgaaactccaatagtttggccacctcatgcaaagagttgactcattggaaaagactctgatgctgggagggattgggggcaggaggagaaggggacgacagaggatgagatggctggatggcatcaccgactcgatgcagatgagtttgagtgaacttcgggagtgggtgatggacagggaggtcacaaagagtcagacatgactgagtgactgaactgaactgaactgaaagggctttgtggtttgagagtctctatttccccccagacaagtgcctgcattcctgggctgctgtgttcacgtcttgaaggtgaaaaagccagtgtttcgagtgagagatcctgccaggctgacctggtgcagtgtcagctggggggctttggttcacaggtcatttgggggcctgcagtccacagggcagactctgaagtcgcagtgcgaaactggttttgtgcttattttaaccaggtgactttcggatggtggttggagaggataaggcaaaagtgttgaatatcgtgaagcccaacatggcccacttccgggagctgtacggcagcattctgcaggagagcccccaggtggtgtataaggcccagcagggcagcctggaggtgagcggtcggtgggacatcacgggtccgtcctgaggcaggagcccgtttaaggggaaaagtcgagtgcgcagtatgaccagtgtggtaactattcatagaaagtgcgttttgcgtgtaaacgtgttctctgtgtgtttgaaataaggctaaaaggtcgcataagaaactagtgacagacaggaggctgcctctggagaagggccaggggctgacatgagccgggtgggggccggtcttcaccgtgtgtaccttttttgccatttgaacttcttgctacatatattaattattaatcagaaacaaatagaagcaaactctgaaattaccttctcttcgcctccaaacccatctgcctcccagaggtagtcttattcacaggttggtgtgttcgcttccagatctcattgcgtgtgcttctgtgtgtacgtgtatagacatgtaggaagtggcttggtctttttcattttttttttacataaatgtattcatatatgttattctgaagcttgtttctcccccactcgttatatgtattgtgtcttgggacttttcttttgacatagcggacaaggctttctttcaaggtatttatcaaaaaaatactaagttttttgaaaataaaagtcaaagaacctttgaaaaatgtaatttggatataagattttttaaactataggatttgggttttttaatctttacgataacacca

SEQ ID NO: 49730 - DNA, 1619 bp, Bovine  19866880847261
gttgatttcctttaggattgactggtccaaccccaccctagacctaattaatcacagactctgggggtggaccccagctctgtgttttaccaagccctccaggggattctcacgcaggctccagattgagaatctctgctctgtagtttttgtgctttgtgatttattttgaagaatgtctttagaaagttatactttgttatattaagtttttcatgtattgtaagtcttggaatcctccaaatgatcctttaaagaatatatccaggatgttagaatcaggtaaaacacacacacatttggtttaaaaagataactgagaaagaaaaatgacatccctaaaaattctgttttaaagtgagatttgtatgacaaaagatgcagttacacccccctttgtgccgttttcctccgctcctcatatgctgaaatagatgcatttttcagggatattttttactgttaaagactttgggggaaggtagtaagagagaagtagttgagaggatttttgtcagtttttgaaatggtaggcatttcagcttgtttgtgttcagaagaaaatgttgaaaaaggatagttcttgtccgattcctctgtttagatattgaaggataaaaagtcatttaagaaatacaacttgtacctaatgtaaacttttaacttatatatttttaaatattttttccacttgtaagttacttgcttttaattgggggaaaaaaaatcttcctttgctaagtgaagtgacagttactcagtcatgtctgactctttgcaaccaggccaaaatactggagtggagtagccagtcccttcttcaggggatcttcccaacccagggatccaacccaggtcttctgcattgcaggcagattctttagcagctgagccacaagggaagcccaagaatactggagtgggaagcctatcccttctccagcagatcttcctgacccaggaattgaaccagggtctcctgcattacaggtgaattctttaccagctaagctaccagggaagccccagctgcaccctggaggatgctaaaatgcagggctcagggtagcaggagcacccaggatccagagacaggcgttaagcatgggagaggagcacccgagaatgcaacataccaggaaggctcacgaggaaagctcctcgcctcccccagcacttggctaaatgtggcttcaaagagcttttgttagaaataataggacaaaatgaggtttgtaaacctgatggcagtctggttccagattctaaacaataaaaattttaaaacagcaataaaggctattttgaggacaacaggaaaatggattaaacagtattacagacttgaattattttcttagctgtgatgatggtgttgtggttatgcggaaggaagtcctcagtcctacaaaatgatagcagagggatgtaggtgaaatgcaacactgaatacaacttgatttccaagagttcagccaaaaaaagtaggtaaatggatggatggacgggtggacagatagggtgagcaagtgaatatggtaaaatgttgaatccaagtggttcacacagcagtccactttacttttcaccttctctgtaataataaagttctctaagtc

SEQ ID NO: 49731 - DNA, 995 bp, Bovine  19866880867959
catcatcttctcttccctcccattttgtagttgtgaattcctgtagcaattctctacgaactcaaaagggagatatttaatattaaaacagctcctgggatctttcatgatctcgatgtggaaatgaattttcatatttgtatatttttcttcccttccagactttttatttttaaaagaaaaatggctgcatcttttcttcatcttttgttttcttaaagatttatgtagcatacttacaaaatgcttgttgacttggcattttatgtggatataatttgtagaagcaatacatatggatttacactcttagagaaatcgaatccagtttgaaaaatcaaactgttacctcctcagtggcttttcgatctattgtaactgcttttttattggatcacgctcttgattccttctaaatgaaatgagtaaatcttcgcatttgaaatctggggaagttagcatttctttctctaggactgcttttctcatcacattttttacatacgttcgtttttttcccctgtgcaaaatactgcttaaatgtcccttcttttatggagcttaacttgtttaactaggctataatcagtttttattaatgaactagacaaggcataaatctgttttttttttcttcttccaccaataagtaggagttgagaacgatgattttttttttcagttcccagcaaagtgttagctttagggtgctctgaataaaattaaattacataggaatgtttcattttggaattcaggaggatcaactaggtttttggagtaaaatggtagcctgaacacatgtatcaggctcctctctcaccaaaaactctgtaagatgatgacaaaatagacattaagaaaaatctctaccactgctggaaaactagctggaaaacaaaccttcataacgccaaaagttataaggaattccgggaaaactgaaaacaggtgggagtagattgacaaaaggaagcaaaaacaaaaataaaaat

SEQ ID NO: 49732 - DNA, 727 bp, Bovine  19866880907025
catattttaagctccacagctttgtagagtctcttacctcaggaggcaaaagaacagagcgattcagtcgtcgtaatttttgctaaaactaacaaaccaacaaccaccagctctgcaacaaacgtgttgctggcgtcatgctgtgctcatagagtagcttttgttctgagaggtgattttactgggtacgtctggacaggcctgctgttatacgtacatgtaaacatttataagcacaaagaacatgggcacgaatattcacaacctcccttcttttagtcctgacttgagctgcttcctggaattggcacggtttggctcagtggacagaatggaatttaacccctttctcttccgttcccgaaccgcgtctgttggctttcatcccaggccagaattagtttcatcttcagccttgggatctgcatttaatggaggagtcaccatctcatgggtaactgccagaattctagaagaatctttcgaattccttttaaattcttcttttcccttctaggctccaaccaggaatggagaccccattggatgtcttgtcaagggccgcatcgctggtacacgctgatgacgaaaaacgtaagtcaggaatccattctaagtgctttgctcctctccccccttgcctcctgcaacgtcgtaacatcaaggtgtttctccacatggtttcggggctgacgctgtgagcctggcttgttttcttcagagataa

SEQ ID NO: 49733 - DNA, 2582 bp, Bovine  19866880958415
caagggacaaaaagacatttctaaattccagtgacttgggacatctcagctactgagctcatagccaagtgcgggaacagcgtctttatgtgcaggcaagaagccgcctgatgctgtgctttactgaaaactgctctcagcatatgctggaaaggcaggggagcagccactgcttggatggtggcccggaggggcctcactgtcagtcatcctgaccatcgccccaccaccttgctttgtggaggtgaaagcaaggcccagagacctatcaacaggacaaagcattggcctggaggtgagaagaagagtgggattcaaacctctgccctgcctcctcctggctgtgtgaccttgggcaagtcacgttccctttctgtcccgcaggttcctcacctctgaactggggggttagaacagtacctgctgcacaaggtcactgcaggaatcacaagctggggacccggcagctttcaatactccgtccccacctccccaaatagacgagaacttacccaaggtcacctgtggaaagaggccgcagccctgctcaaagcccattcttcccgggttcgttcctggctgtggtctcagaggctgtatttcatggccttcctgctcagtgatacagggaggcccacgctcacactgtcctcaccttccatccgtgctggctttattctaagatccttactgagcgcctgcaacgtcctgggcgactgcattggagtcacagcattggagctccaggttgccatgcacgtgagaaccagggacagacggagcaactgtgcttctttcagctttgagggacctgctccttccttgtcttgaccctctgcatttcctcctccttggcctctagaagccccctgccagccccatcctgagatcctagggggccctgcttctcaccgagcctccagccaggactgaacaggcagagtgtcagcagagacggttcctgtttcccccctgcagctgccgcctctctcctgtaattctcaaggctcgcgccacgctacagatgccctgccagacaagctgggtttcctcccgctgccggggactcacggttcgtcctctaaggactggccattgagccagtgcttggctgggtagagagcagtttctttgtttgcagcctgcctaacagtttcttcctgaggctcaagggaggctcagccattttgccccattgccctgggaaaaggtccctctcacttgtccagggacctgcagcctcctctgcctttggggtggggagtctggggctgctctgccaggacaagggcaggggctgggtcaactcttcactgagacagccaagaggcagaggacacatgcctgcggttcccactgacatcctttgttctggaatttcggagttggggtactgcatttcacgctatcttatgaatgcgtttcctccaaagttcccaatgagagaatctaggccatatccaacacccaacagccccctctctcaccgaacacccatcaggattgacccgagtcggctcacttagcctgacagagtctctgatatgggggtgtcaccaaagctcaggagccattttattcagtgccccctccccagttcttcatgaagagaaggctgagcttcctgggacaggacagagagctccagccccatatcaggcagacactgggcattataactgggcttttaaaaccctaattttctccccggggattcacgtctgtttggagaggagatcagctcagagcctccgtgtggggctgccggatctgggttccttagccgaaaagcaagctaagctagagcacagcatctgtagatgccagccatggggacatgggggtacaagaggacccacctatggagacctgctgatcattgtcccggggggtggcagggtctcctctttttccagtgtccagaaaataaatgtcagaatgtaaggcaagaagacagacacagtcttcaaacctcagggacgcccccccttcccccaatcctacactgctcggagagcgcggctcggacttatgtgcgctcagctcaagcccaagctgcggtgtgctttctagccaacgtttcttgagagcttaagctgccgaagacagaaaggaagtgtcccattccccagtcgcctggtccccggagcccgcagggaacagaagaggggcccagctcgacctcggcgcagctgaccccacaaggagaagtggcgcacggctcgccaaacgctatcattctttcccgggtctcccgccgtcccctggggggtgaaccgggcgcttcgacggctccagcagaattcagagtcagctgggggtggggtggggggctcaaggggcccgcgacctcttggaaaaaagccggagattttggtgaccctcgtgggtgctcccccggccccctcgcgcatcccagagggacagcccgggtgcgcgtcgactcggagcggcgcctcgggctccttcctgtgggcccgaggccgggcgaggcgcgggggtgtggaaactcggcgagcccgaccccatcccgcccggcccgcagcagtagctctgggcgcccggcctcgctgtccggttgt

SEQ ID NO: 49734 - DNA, 1670 bp, Bovine  19866880965361
tgtctttcggggcatctctgaccttgaatgtccctctggccagaacgcagttgtctccagagctggcaggcgacaccgatcttgcagacaccatgcagctgacaggtgggcagagctgcagatcactgtccgaagcagccactaactcgtgcaccctccagcccggcctgcctgccacgatgccatcaggccccagaagctggggacccccttctgcagccaggagggcccctggcaccctaatgtggccggttccacctagctgcacaaccccctgcctgcacagggctccagccaattgctccgcaagacctggcctccttgtaatttccaatttgtaagaaaggtaaaaatagaaggccattcgctgcaggcagctcgcatcaaatcgcatgccactttggtgtcatgtcagatcacggtaaacagagctgatggcttcctcagctgctcccggggacttccagagcagcaagaaggtggtgacaagttggggttggggggagcacctgagagtcagggcaatgtggctgggtgcacgatatcaacaccagctttaagtgaatctaaagcacagttcacaaatatgctgtatattacgggggcacctgggcatgaaccccagttctgccacttagcagccaagggaccttgggtacaaattcatctctctgtacctcaacctccccagctagcaaagagcagcgatcacactaccagcttcctgagctggggcaaagctcaattgatgggatgaactgcaaggtgcttcctaatgggcagctccttaaacagggtgtcatggtcctggccacgcagtcagggtcagggccttctccgtggcaggggcgtcagtaccacgtggctgcacctgggctcccgggccagctcctagcccagtggtcttgcagctggtgccttcacctctctctgtctcagtttcctcatcggtccagggaccattccactatggagctcacgaggttttgtggaaacgagacacagttctatcaggaaggcacacagcacagccccctggcatatcactaactcttagccgtgactgtttattgatgagattatcactggaaccacatttcgtggagtttctttttttctcctgtttatgactgaatccaagtctgtgctgaaatatcacagcttgcattcacacctacggtccgtgccaggcaaccctgtctccgctattagccggctccccgctcattccatctctacctctgctctggaggccctcaggtgagctcagagtaaagatgttggatgttcgtaaggctcacaaaggcacatttcccgggaagccctatcttggggtccacatggggcttcccagcatttcctcaagtaccatgccctttcccaccaccttccagagaatgggtggcaccaagtgcacccccccagcccaccccggtcctgggctcacttggggaactggcaccggggatgccacagagcagcagctgagcatctgatgttcttgctgggggcctggggggacttgcaggggctttttgcagttgctttcatcattggcaggcatgctctgcctgccgttcaagcagcttggcctggctgaatgaagggggcagtcctgacacaggcaaagggcagcacacactttctctgtccccacctggggctcaggt

SEQ ID NO: 49735 - DNA, 1121 bp, Bovine  19866881107975
caatttaaagagtacgtggtgagcatgtcaagggctccgtgacttggaagtcttgtgtttcatcaactttagggtcatttcctctggttccaactgggatcaacagtcagctaggagccatgggggactggggtccatctttaaatatgcgagaccattcacaacagggtcttgaaagtaaaggtcagaactctgtgcaaaattccctgttcagagagcaacattttaagagggtaaaaagctaagtggggcctcccagagtgtacttaccaagagctaaactggctataaagaatctagcgatctctgcctaagaccctttccttatgaaaaatttatgaggtgggtgttttaagtttttcaatctacaacttgagataaaattagttcatcaccacatatttttcatgtaagtatttttactgcatccttggtctatagcttctcttcactgtactaaatgaaacaggaggactttatctgctaaaccaagctaccggttctgttctttttctccaagctgtatctccaccctgtctctaataccatctagtcattttcacttatttattccactacctcaaaatcatcacagcccaagataaactgacctccgtgactctggcaccccctcccccaactgccagccccctttttgcaccttgctcctcagccctcttccaacagacccaacctggcgatctgtctgttcctctccacagcactatcattaaacagtacaaaggcagtcatttttggatactcgatgatgggagggaggtgagtgcagaaaactccatgggtcaatctcactaaacgtggttgattctgtcttgaatctctctctcaacccattctctctgtgcccctttcaatgaaaataaagggatctataatctctagtgggatcagttttgcattcctccttcataaaggggccatatctggggagagagaccacagatgttaagggagatgaaaaagtttaataacaatgaaacattttctttctttaaactgaaaggaattaacctgctacaaaatggatgaacctagaaaacatcatgctaagtaacagacatcagacacaaaggccttaacttttggtttcaggctcttga

SEQ ID NO: 49736 - DNA, 1021 bp, Bovine  19866881153566
catacaatgggctggaggctttttaaaaagcacaaacccataagcctattttctcaccttcaaatggtttcttcacggttttcaaatgcagtaagaggttttgggtttttttccccccaggctgggtatcactgaatttcagggccttcatgaagccttttcctgcacttggccaatctctggatgagccaaatcctgcctgtgggcccacagacagagagactaagtcacccccaggcctcccaggtctgatgctggggaaagcagagacacgagagcaggaagagaagcaagcttctccagattatacaaccgactggctagtgggtgggtggccttgggattctccgctcgaggaccatcgcttttctactatatgtcattccacaggggccaattaataaacgctctcctctggggaatggagaaaaccgagcccgggaggccctgggctgccctctgtatacagagcacacaaaggggctggggagttcctctccaacaggaagtcgtttgtctgggagagccaggaagtgggggctggggtgctgagtctgcactgcacacagcccagtgttttcatggaaatgacagtctcctagtcaaagcacggttgcatacatggactcactccacttcaaaaagaaaaaaaaacaaagagggaagaaatttaaagcctctaaatagggaccacacaaccctgaataatcgtaaagttctttctccactgtcttttttagaaagtggctaaaaataaaggcttgacacttgaaataatgtaagcaagcagtcacccgcacgcactgggcctttcccttatatggctgcgttacccttcagcctttgaaaaggccaaatgaagagatggccaaaaaccaaaataatccttcagacgtttgaaaacgaggagaaagaagtagaagagtgggtgactgacaaacaatcaccaggctccatgggggtgagtaacactgagaaggattagttgccatagtacttgaaaaacatgggcacgcatttt

SEQ ID NO: 49737 - DNA, 2033 bp, Bovine  19866881254499
ctacagagtgggataaatgatgctgaaaggcaagcagactcagagagcagcatctccattttccaggcacttcatgaagactggagttgaaaattcacctgcaaccaccagctaataaaggcagcgcaaggactttcctgtcacctgtccagtgtgggcctccctgctctgtctctagaggctaacgctgcagggttaggaactgtgcagatatgagggaaccttcaaggagcagtctttttctaaattaattttgtggatgcagcttgtgaccccacaatataaatacatacagtaatacttttaaagatgatcttcaaagggcacgcgtacggtgatacccagcaattacaactgtgaagtcatgctttccagaaatgatgactaaattgggtcgcatttctttattttttattgaatccaccaggtgactgctataaacatctaaactagctctgaggtcattttcagataatgtgcctttccaagacagtactttctgttcaaaacaaaataattgatagagcatcctataaaatgaaaggttttatatggacctttcctggggcataattttagggagaaaaatccttgcctataacctaccaggcctgtacctagccctgaggtcatgcggggtcccagcttcaggaagctcatggtacagaagacaagcagtgagaaatggaaagaagtcaagggagattataggaatgtataaaagtgtcttaatccagtgcttctcaaactttaattgcacatgaatcacttggtaaaatacagattctccaggcttctatggtgcgccagtgttaagaattcaccttgaaatacaggagacacaggatcgatccctagtcagagaaccaagaacccacatgactcagggtaatgaagcctgtgtgccacagctagacagagtctgtgcacctcaatgaacaatcttgcaacaaagatcccacatgctgtcactgagacccaaggcagccaaataaacaaataaaaatttaaaaatgagttagactttaaaaacaaaaatacagattctcagtgagtaggactggggtcgattccaagattttgcatttttaaccagctccccacatgatgttgatgctgccggtccgtggaccacactttgagtagctgaatggctgcttgtgatttgggatataattccctataacagcatcatatttccaaaggggtagcgtctcaaacataatacatgggttgatagcatcaccgactcaaaggacatgaatctgagcaaactctaggagatagcagaggacagaggagcctggtgtgctacagtccacggggtcacagagcatcagacatgacttagtgcctgaacagtaacaacaacaacgaaaatcaaaagctctgaaaggcttggagggatgacatgatgaggctcaagctgctgttcctgaggtgtaccgactgtgtgctaggagaggaaacagacacgtttccatcctgcaggcgtgagcagctgaatggagggagacaagtaaaaatcaaagactcctcatacatacaaatgtaaacgcacatctgggacaaagcttgtgagagtctgtaagggggagcatgacctggctggggaggttggggatggggaaaggagagaagagcaaaggcctggcggaggaccaaggggacccggatgaggctgggcagagggatgaggccacgcaggacttcgagaagtttcacgtccatgctaagagtgtgaggggctcctgaagtgtgttacccaggagaaagaatataatcagatttgcattgtgaaaacccaaagctggctctggctgcagcggaggatgggcttggaggggccagagagtgtccctcccctgggaggcacagggcctgacagagaccgtgtttagtctctctctggctggcagaaaactctcaagctacggatggccgctttctgccccatggatgctggaagcaggacagtcggtctgctcagacacatgggaatgaatcggacacccaggaagtactgggggaaa

SEQ ID NO: 49738 - DNA, 1373 bp, Bovine  19866881312827
tgtttggtttgtgtctgctttgcatgaaaatcgttgcttgttaattcttgcttggctaatgatttgattttaatagagcgaattccagaatttaatggcctgatgcagatgtgtgctgccaagctctggagcgctgtttacactgcccccactccagctggacccagcccgccgcttccccgagaacagctgatgagtgcccatctctggatgttcgcctcctcccctctctggaaacaagcacatctttcccttaggtggcggcccgattaaagtgacaagggacgaacctaaatttccatttcattgtccgcagctttctcctgtacccctgtcctctccctttcttacagcgtgtgtccttttcagctgttgtttttccgatgagccactgataaaaacgattggctgaccccgcagagaacccttgttttatttccctgatgaaaagcactgacctctttgtcattgcttacaatcacccaggagagtgactcgggcagcttcttaaaggaatatgtaatagctgtgccaggcttgacgttctcttgagcggagggtaagagggacggaaaatagcagttgttctccgtctaaaacctatgtgaggttttcgagccccaccctgcagaactcccaactgggaacagttaaaaccaggtactggagatgatggtagaaccctttttctgttagaggctttatatcaataaagagggggagaaagaaagaggggaaaaggagcggagtgaaatagaatcccaggatgagcagaaaagacaccaagtataactcctggtgtccaatattaaatacaacacattacttatatatacgtgtgtgtgtgtataaaacatgagtgaaagtcactcagtagtgtccaactctttttgagaccccatggactgtagctcaccagtctcctctgtccgtgggattctccaggcaagaatactgaagtgggtagccattctctactccaggggatcttccccacccaggactcccgcattgcaggcagattctttaccgctgagccaccagggaaggctaggtaaaacactacataaatacataaaatccacacacacacatgtgtgatagtgtatgtggttttatattgtgtctaacagaatgggagagagctttcctgtagaggtggaggaatccttagacaccatttaaagagaaagcagagagaccaacatgactccttggccttcccacctgcaggctcttcaggatccaactccagccctctgttgctgctcacaagtccccaccttctggcctccgggacgtctcagtgatggggtgtctttcctgggtccccttccttccttcctcttctgggtctccctctttgtcatctg

SEQ ID NO: 49739 - DNA, 1255 bp, Bovine  19866881323246
gtgtcagcaaagctttgttctctctgagtctctgaacagaatcagttctttgcctcttgctagcttctggttgttgttgttatcattcatttgctaagttgtgtccaactctttgtgaccctatggactgcagcacaccaggcttccctgtcctttattatctccctgagtttgctcaaactcatgtccattgagccagtaatgccgtccagccatctcatcctctgtcacccgcttctcctcctgccttcaatcttttccagcatcagagtcttccaatgaatcgactcttcacatcaaaagtattggagctttagcttcagcatcagttatttaaatgaatattcagggttgatttcctttaggatggactgacttgatctccttgcagtccaagggactctcaagagtcttctccagcaacacagtttgaaagcatcagttcttcagtgctcagtcttctttttggtccaactctctcatccttacacgactactggaaaaaccatagcgtttactagacggacctttgtcggtaaagtgatgtctctgctttttaatatgctgtctagacatgtcactgcttttcttccaaggagcaagcatcttttaatttcatggctgcagtcaccatccacagtgatactggagctgaagaaaataaattctgtcactgtttccatttttttccctatctattttccatgaagcgatgggactggatgctgtgatcttagtttttttgaatgttgagttttaagccagctttttcactctcctccttcacttttatcaagaggctctttggttcctttaggaccataacaaaatcatcttacctcccattatctcccgcgaggtttattgtggtttatcaagtggttacatgcattaatgtgctggctcttttgctaatggaggagttccttgcatggaggggggtgtggttaaggtaatagcaccatttctgaaaacaaaacacaaagccttgtttctctacgggagatgttttcttaggtcaaagagaggcttctcagtcttactagagcttcagagaagctggtggaaggaattctgttgtccagggagacagagtctgttctgagcagctgaaggcatcagggcggaggcccgggtgaggtgtggggaacagactcaggcatggcctttcctcctgagcccctcactccttgcagtggcagattgctactgttgtttggtcactcatggactgcagcccaccaagatcctccat

SEQ ID NO: 49740 - DNA, 1140 bp, Bovine  19866881403243
acaaaagactatttttaaatggttatgtttactctaataagagacacatttactgtgggctccttaatggcatgtgctccacatctgctgtctcatttaaggctgccaagtctgacaaggaaggtgctgattatcctcagtctcacggacgaggacaaggagcaacaacctgcccaaggcccggccacgtcccaggatcagggcagtgacatttcaggtgctaacttcacttcactctgtaattctcccctgtaatttcccccctttccctcacttctgtaatgctggctcactacctctagcgctctgaagtaagttcacagatgcacagacatgctgtcccagcaaatgtgaatggagaggcagctgggttgactttgaattgtgtatataccctcatgctttcattcagagcctataaatgttttctacttctccctgaagggatgaaatgtcgtctaactctgagtctcacacagctggctcagaattgaagcatcagcgcaccactgttgagatctaaatatttatgccacctccttacctcctgtacatttaacaaacaaaagctcttacattttagacagtaattttctgagagagggactatattttaccaaaatttaaaggcagacgatccaaaccctccccaaacaacaactgccggccacgatgaaaggagctgggaaacattaaggactttgtgcaaacagggaccaaagcgtattcgtccctgtgaccccggctccacgcccgctgcctggcacatgaaggcagatccataaatgtctgctgaattggatttctcccactgctgtgcagcagaaccagctcagccatggggaacagcaagcaaatgggcttatcacccgctgcttcagaacaaaatgaataaaattgtggacacagcatgaaccagcatctgatcctaagaatcaatttttcttacctccacagatacgctcacaacaaaatacagagattgaggaaaaactgactgctgacttgtattttacgggagtttaactcttaactacccaagccagagaacagcctgtctaatgcgatggctagacaaaagggtaatctctccttgaccctgaagtaagacaaattcagaggcttgtagtccatttggag

SEQ ID NO: 49741 - DNA, 1188 bp, Bovine  19866881407907
ttgctgtcatcaaaaagtctacaagaaacaagtgttggcggggatgcggagaaaagggaacccttgtacactgttggtgagaatgtaaattagtgcagccactaggggaaacagtgtggaggttccttagaaaactaaacacaaaaaaaaaaaaaaaagaaagaaagaaaactaaacacagaactaccatatgacccagcaattcccctgctgggcatgtatctaaaaataaacacacacacacatgcccacacactaattctaaaagctacatgcaccccagtgttcatagcagcattgttcacaacagccaagatatggaagcaacccaggtgtccatcagcagatgaatgggtaaagaagatgtaataagcaatgaaatattctttagccataaagaagaatttactgttgtaagtcaactgctgctgctactgctaagtcgcgtcagtcatgtccaactctgtgcgaccccatagatggcagcccaccaggctcccccatccctgggattctccaggcaagaacactggagtgggttgccatttccttctccatagtaagtcaactattcctcaataaaagataataaaataaaatattttaaaagatactaattatacaaagtaaatggaatgaaaaatataataactgttataagagacaccctgaatggtctcaagagtagagtggagatgacagagaccctagattcagtgaaattaaaaactgtattaacctgaacaacaaagataaaaagacttttttaaaaagagcctcatttcctgtgggacagtagcaaaagatccaacattcatatcatccaagtcccagaaggatagaaagactgtgggactgaaaaagtgttcaaagaaataatggttgaaaacttcccaagtttcatacaaaacacaaatctatagagtcaagaaactgagaaaattcctaaatagataaatagaaatcaaaccaaaacacatatttctgaaaactaaacaaagaaaaaaatattttaaaatagtgaggaataccaattcaaaagactgggatttgtcatctgaaaccatgttgagcaacaggaaatggcacaatactttttaagtgctgaaagaaaagaactgtcaacctcaaattctacacacagtgaaactatctttgaggaatgaagtagaaataaaggcattctca

SEQ ID NO: 49742 - DNA, 2797 bp, Bovine  19866880240341
ctcaatggacatgggtttgggtgaactccggggagttggtgatggacagggaggcctggcgtgctgcgattcatggggtggcaaagagtcggacacgactgagcgacttaactgaactgaactgaactgaggtgggcgctgaggtgaaaacaagctgcagtgagagagaaggcccttaggtgtggccgtgttctgagatgaagagaggccactggaaaggggtcaggaggtggaagaccatgaggcaggggaagggtgctaagcagaggtgactgacgtggtgacaggtgacgtgcagaatacttatcttaatcaggatactcgggttaggaggtcgaatatggcgggggcaggggtgtgtggttctccctactcaaggcttttcttttcactccaagtttttcatatctggcttcataatctgtacctaatacctcagtcagtgttcctaatttctctttctctgtgactctcttactatttaccactctagtctgtgagtgagacacccaaggcccattcaggatggagagtaatatttcttcctcttaacttgaaattttaagtagccaacagaagccaaacatattttggtccagcttttaaatagaaattttaggccagccttcatgccagcagagctgtctctggcagcatcatactcctccccttaaatggagactgactgttgaggagtcatgaaacatttcaaagagcatctgttgaggtagaggctgtgaggtgtcttggatgagtatctgtacaaatagttctttgggttcaagacctagtacagggtgaccctttttcttcagtgtctgaatcattctttgctggaataaatagcaaaaaaattccacaatagcagttggcattttgtaggactacccccctcaacccctgccccgacccaggtggtctgtttaaagtgccaacaaatgactgccatatttcttcaaaatctgttattttccagaaacaacctgttcagtttaaatggaaactaatgcccattttttagatgaactggatggtcataatgggctttcaccttgggcctcacctaaaataattatagtaacttttgagcagcttgttagatggagacatcaactgtacagaagagctgcaaagagcacagcaagatcgtttagggaaatataacatatgtagtttggtgtagtgacagctgggagagagaaatgttcataatatttgaaggttgtgtgcagtacacttaaactaaaatgaacttggtaatgacaaattggtgaagtgagtataaaaatcttgtttgaataggatattgatggctttttacaactaaaaaattatttttaaaaaatccaaaaccctggggtggttaaaaagtacacttgaaaatcttttcactcaaatcaggacaaaaaaacaaacaaacaaacaaaaaaagactagtctttaatatcttacaaaaattctgaatataatgaaggtggtatttcaaatttgtgaggaaatgaattcagtgaatggtgttggaacaaactaggtagtcatctggaagaaaaataaaattggaaccatatttcacaccttatactaaaataaattccaaatggatcaagaaattaagtctgaaaaataaaagtgctagaagaaagcatgagaaaaaatgttactatctcagagtaagaaaagtctttttaagtatgacataaaacttagaagccataaaaaacttataagaattactaaatccttcatggcagaatgctactttcctatcctagatacaaagcatggcaaaccaaggctttgtgtcaattagtaaccaaacagtaattgtgtcaattagcttttccagtttctcaaataagtttagcaagtctgggagctctccataaaattttaaaaatttgtgtcattttatgatactctaagaaatagaacagagagtggaattacagggcaacctgaattttaaaccattacactgtactgcccctctgtggacaaccaccttataatcaaataaagttatataatttcaccatgtacggttaagtttctccaaactggtgcctctagatttgtgtattcttggtttcaagagctcaaatttgaaaaatgtttcagtaaagaactaaagaatgaagggtcattacaaaaagagaatgtcattgggtatatctccttttaaattagcatttattttaaaaaatgtttattgaatccctactatttgacaagggcttcgcaggtggctcagcagtagagaatccgcctgccaacgcaggagatgtggattcgatccctggattgggaagatcccctggagaaggaaatgcaacccactggagtattcttgcctgggaaatcccatggacagaggagcctggtgggctacagttcatggggtcgcaaagagttggacactactgagtaactaagcgcatgcacgcgtgcacacacacacacacacacactatttgtcagacactgtgctaggtgctgggtgccagaaattcaataacaaacaaaataaaaactctagtgtggattatagataagtttataggcaattacagtagcatatatacacatacatacatatcagtcatttgaggctttctcatttatttagatttctctccaaatttgaaaagcttccaactttggcgcacagctgcccagagaggcatgcttgtgaccatttatttaactaatatttattaaacacagcttggacccatctctctgctggatatgaagataaagacaggtctttgctctcaaggagaaagagtctagtagg

SEQ ID NO: 49743 - DNA, 1743 bp, Bovine  19866880344321
tgtgcttcttccgcccagcatttctcatgatgtactctgcatagaagttaaataagcagggtgacaatatacagccttgacgtactccttttcctatttggaaccagtctgttgttccatgtccagttctaactgttgcttcctgacctgtatacagatttctcaaggggcaggtcaggtggtctggtattcccatctctttcagaattttccacagtttattgtgatccacacagtcaaaggctttggtatagtcaataaagcagaaatagatgtttttctggaactctcttgctttttccatgacccagcggatgttgggaatttgatctctggttcctctgccttttctaaaaccagcttgaacatcaggaagttcatggttcacgtagtgctgaagcctggcttggagaattttgagcattacctttactagcatgtgagatgagtgcaattgtgccggtagtttaatggtgagcaatttctccagaacaaaaaaactgatcaaaacctttggagttggatgacttcttgttccagattcctagctgtgtttgtacagatttggttgcaaacaggaacaagaaagttgtctcttaactctcaagtagatccttggaactgaaggctctttggaactccgtctcttgctaactaaactttgtgttttcagaccgctaaacctgggtatgttatcttctcaactcaaatggctgctcttgcttgcttgctgcctgggacgagtcgccgtggccagcattattagagtttgactaatccctaacttcaagcttttcagtcttttggaagaagaattcaagacagtagaacgggtattgatagtgttttgagttggagttttccacagctgatgacactggaagaatctcccataggaagctaccttagcagacactagagtttcgcctttcagtttacaaatgtggtgaggtacttttggcttctgtttgagctggttgcctcattttggtcgtgtaattgctttctccgcagagacaatgaatggggaattctccctaaggtcagcatttaattaattgccgcgctccggctgctatagtactccaggcatcgatcttattaaaattgcctggagattgccagcaggttgaaaatccgtcttctgtgacagcctggagtccttgagttgagtgggaggtgccttgctcaatttacaatctccgtgggcgcgggacttatccgaagactggattgggcctttctcctgtctatcatcggaaggctctccgcccccgacaatcctactgcaggatttggaagctgagcaccgcctctgaaatcttggggagtgatgggcggtaagggtaaacgcggtgtgaatttctctccttattggttggctgatgtgtcagtcgtacaccgctctgctcccattggcgggaagactccaggccggtagcgtggacactgtactgcccacttgaaagctacgatccaggcgcgtgacgtcccagacttttgttgttgggctttgggcctcattaattattcattaggtacttgaacgagctgtagcgattggtggccgagagggccggtcgattgtttcttagctagagatacgtgtcaccctctacgcggcgggagaattttcgcataaattattctgataaggtttgggggcgtggccgctcatagattaggcaaataagctgagagggaggggaggccggctacaaattagcctaagttattaaagat

SEQ ID NO: 49744 - DNA, 1868 bp, Bovine  19866880528400
tattatttctatctatgtacctgatgcgaagaaccaactcattagaaaagaccctgatgctgggaaagattaaaggtgggaggagaaggggatgacagaggatgagatggttggatggcatcactgacacaatggacatgagtttgagcatgctctgggagttggtgatgaacagggaagcctgacgtgctgcagtccatgggatcccaaagagtcggacacgactgagagactgaactgaactgaaacttgatctatgtgtctttctatccatccaagataaacacacactcttggctgaacaaatggcttcccacctgcttagatcaccggttatactgtgtatgggtaggaggatcgacaaaacaatctataagtcctgctgttcccactcctgtctaccaacaggaaatgagctatgcaggccttatatttcattattctttagaattgaactgaggtttgaataaatggttttagttattaattgggttcttcatactgtgctgggactatgtttctaaaagtcaaccaaatatccaaattttttaaagtactgagaaacatgaaaaatagatattaggagaatccagtgattgtcaccatgattgacgtatctcacacaagccaaattctatgaagaacatgtcagaatagaaaatattcaaagatgtgataggtactgctagcagttagaaaaataactgtcagattttgacagcatgtacttaattggtaactcagtgatttagtgcatttgatatatattcctgatatgaaaagacctaaagttaaataatctcattcattcatttaatgcaacaaatattaactatagtaattgccctaagatctggtaggagcactttaaacatctttgtagtttatattagcatggcttttgggacatggtcacaaaccagacagagctctaagagatatggataatttaacagatgtacatttacatagtttgagagtaacttaaatgtaacttgaagcagtgttggaagttggccacaaattgagagctgtggacttcaatgagaaaaagaaaaaaatctagatactgacccgcataaactgaatctaaaggacatgctggagagaccactccatttgaaaggcatatttagagattctatatttagaatttatttagatttttatttagagattctataagtctaccaattattaaagggaggttttacttgtccttcttcatcttgagaaaaaccaccctaaaactttggcttagagaaattttagagaaatggctatagccctggaaaatctaagacaaaatttctggtggatattctgaaaaaatgaacccccaattcaactgaaagtgtacccaaaattgcttgggatagcataactaactgttcccttgggaaactgaggaaaatttagtattaggaatagaaatggtgcttttaaatcttgaaagattttaaaatagagacaaaaatcaagctcatagattactattttcatattaaatttgggaataaactgtgcatatttggtacttgaaaactctcatagtttgagaatttgacatttttataacataacacattagcctgtaattgattaaatgatataaagctgcagcttctaagttgatagctaactttatacacagtatttgaacatttaagagtgtctaagactcactatacttatgtttaatttattaaatttataggggcttccttggtggctcagatcataaagaatctgcctgcaatacattaaatttataagacattcaagtaattgaaaagattttagtaattatacaagcaaagttctgaggagaaatacaataaatttataaatataagttaaaatattca

SEQ ID NO: 49745 - DNA, 2252 bp, Bovine  19866880540882
aaaccttttctttcttttttttttttttttacaattagaagttctttagaatacttggggctctcttcctcacagaactggctactgttggcagtaacatatgaggatgagcaaaagttcagattggaaatttaactggaaagattgagaggtaaccaaacgtggagtgccccaagaacaagacgactagattgtgttcaggactgccaagggtataaataacaaggttactgcctggcagagaacatgtggccccaagactggcatctgcagttttgctagcatttcattttctctcatctaccctttttttcctgtaggaagtttctaaaacatcatttgcgaggaaagaactgtgaactcctgctggtggtaccagaagaggtggaggcccatcagagctggagggctgacgtgtgatgcagtcctacccagcctccggcacctcagccccctggaatcctccgtgatgtgctgcggcctctgccgtgggtccgcccttgccacttccccaaacatctcatcgggttttttccctctgatttgacagtgcaataggacagacacgtggactgttagaagaaccaaccagcgttactcgctcctggaaaaggaaggcaggagctctgtgtgcttagggcgagctgtggagaccttggttttattttaaagagaaggaaggtgggtctcagctgcctctcccggcttctgtgagggcttggcagaggctctgctggagttcactgctgctctgacccccgcgggacgctgcctccccatccccttccctggcagctggtgaatctgaacacagtccagacaaagcccatgggactggcttgaaggcctcagagcaggaaggcctctcaggaaaccatctccagagctgcagcagccgcacagcaggctgagtccagccctcaatgccaccctgaccccatttttaggagtggtttatggtcgtccttgaagtttgataatgaaaagttctctaatatttcatgccaggtggttgaatcctgcaatattctaacatgacagggtgagctagatacctaagaggatgtggccagagccaggctggggacaggcacggacagcctgtctgcctcactccagctttgtccccgccacttcactgcactggtttagaaggtttggggacacaagacaggccaaagggcagttttcccagctgacccaccccggcaaaatcagaaaaaaataagactgcctttaccatcaaattctactagtttgagacagtgttgggcaagggaagtattgtgaagctaagccctcagagatttggagcagctcaaattagtagaagtcttaggcttggagtcactctggtgaccagaagcagggccctcacgttgggtagatatgtgcattctgcttaggacctgggtttgtcatctctctggagtttcctttacagatcaactgagaattgaccccccctacctctttaaagagctgtaggccacttttctcctggtaactttggaaaacaggagaagtgttagactacaccgcctgtcaccaaaggggccgtggtggtctcaaggcaggggggcaggcaggggtggcctgttcagcccttcacagatcagtggtcttggcaggtctgagagctgccccactggccagactcctctccagcagcagagccagcctggggcttgcatgtccagcctgagcaagcttaacgggatgaagctgaggctttctccccactgtgactggagtgcatgtttacaccagcaccttttctgcacatgtatcttcaatcccacaaggccatttttttaacgctgagtaacagaggccaccaagcaactactgcgtttcaccctctcagcaagtggccgcagtctcttctgcaccattttctacaccagacctgcttggcaccacagggagctcgtcacccctgcacaatgacattccaaccaccaccagccagaagttacagccaaccttgctgactgtcacaagcaggaccttgggtccattggcacggtcagtgatgtaagccatctcctgggaggaggaggaaactcctcaccaccagtctgcttgggcctgtgcagacagcacttcaaaggagtcctcatgcactttgggagtccataagccaatgggatatgcaaagatgcttaaccatttcagggctggttcctctgttcatatccaatttctggtgcttaggaacagggacctatgctgatgcccaagggcagaaa

SEQ ID NO: 49746 - DNA, 1943 bp, Bovine  19866880551432
tgttgttggagaagactcttgagagtcccttggactgcaagaagatccaaccagtccattctaaaggagatcagccctgggatttctttggaaggaataatgctaaagcctaaactccagtactttggccatctcatgcgaagagttgactcattggaaaagactctgatgctgggagggattgggggcaggaggaaaaggggagacagaggatgagatggctggatggcatcaccgactcgatggacgtgagtctgggtgaaccctgagagttggtgatggacagggaggcctggcgtgctgcaattcatggggtcgcaaagagtcggacacaactgagcaactgaactgaactgactgactgatgctccagtctggctcataactagagaaagatacacacacacacacacaatgtgtatacttacaaccctttcttccactgaaactcagttctagaaactaaaattgtattggtcagtggacaccaaacactttgtatagcatttgtcatgtttcaaggactcttccaagtgctgtacatatgatattaactaatttactcctcaaaataatcctatgaggtggataccattattctatttcactgttgagaatactgggtctctatccaaacaagggagatgctgaagctgagatgaacaacacgttaagttctacattcatcagatgtcccgcatctcttcccggtaccaagtgagatccatcatgtgatgtaagttgacttaacaaaagtacggacaaagaagctgaagatctgcagtcaggtgtcaatatgagtctcaaagaatggaaacacgtacattgccttctgaaatattgtgctgtgaaattatgtgcccccagagaaaggctaactatttttagaaggagagcagtagagacttttggaaatatgcctgaatagagtcataattgggcaagggatacggggaacgccaattttggcagaaggatcttttggaaaagcagctctgacccagtcattcctccttttaagacttttcaacactggaagaagctaaaatatcaacagggagaaccccctctcagtggctcatcgctgtctctagaagtcagcaagaactctttctcatggcaaaggggcccctcccgagggttttcacttccctgcccccaccctgcacaaccccctcctttgatctcatcaaaccacctgctgtcttctgaatggtccctgctttttcacactttcgtgtcttcagttcatctgggaagcacctacatatctttcaaaacacaatcctgatttatcctcctgtatgaaactgtctctgttcccccaggtagaactggctagacgtccttggccccatgtgagtgcctgcagagttctcagagcacagaagagttctgtttggttacttgctatcacttcctataaagcatgacctccccgagggccaaactgcacacccccctcccttccctgacactgggcagccaaccaactcacattactgagtgccacccatgtacccagcactattctaggtgctggaggtgcgacagagaaaagacagatagatccctgccctccggaagattgttatgaaggcagctgcagaggtggaacacacaagacaagggcatgattttcaggcctgtgaagcgccaggctgactgaagcccaagctggaatccagactgccgggagaaacattaataacctcagatatgcagatgacaccatcttaatggccaaaagcagaagaggaattaaagagcctcttgatgaaggtgaaagaggagagtgaaaaagttgttttaaaattcaacattcaaaaaactaagatcatggcatccagtcccaccacttcatggcaaatagatggggaaacaatggaaatagtgacacactttattttcttgggctccaaaatcactgcagatggtgactg

SEQ ID NO: 49747 - DNA, 1036 bp, Bovine  19866880553090
aaatagcggtgcctgtcccagcacaacaggatgggcctggatctatggcatcgatttataggtattatgatggtttggggaggggggaattcctttcccgagcgagtcacccgtctggaaaaataaagaaggaaaaagctgaaattttttccttccatcaaaacaggaaggagctgggagaggtgggggatggacggagagatgaagggtggaggccgagatgcaccctccaccctgtggtggtcttctgggaggggagacccctgccgggcacctgcacacagggccccaggggcgctaggaatggcgccgcgtctcccctgtgtgggccatccctgctgccccaggcatttttgtcctctctgacccccgggcccatgtgccttcatggacatagcacacagatgctgatatgcacaagacccgtgtccctctggtcccctctcacacccgagtcagatgcccatccccgcaatcccctccaaatcccacgggagaaaaggtcttcctctgggtgaatgggacttggggaagggtctgcctttctgacctttgctgttccctccccttgaggactgccctggaagtcctgtgatttcagttcagatctggcttcgctccaactccaaggggcagggcgagctaagggaagtcaatttccctctctgagcctcagttttctcatctgtaaggagggtatggtcttctccgtggtgcttccctctggggcaaatttctgggaccaagttttccaagtcagggggctgataaccacagcccccgtttactcggcatgctctcggtgctaagcacctacatccagtcactagattaacccccctgaccaaataaggtatgttccagaatcaccctcatctatggcccagagggcagggaccacctgagggccacacggctgggatgtggtggaggttggttgtgaactctgggttcctcagcatggttcatatccaaggaaaatgaaggagcaccccaaagaggagggggaggaggggagggagaggggggaggagtg

SEQ ID NO: 49748 - DNA, 1402 bp, Bovine  19866880562403
tcaggctccacagtgtcagccaactccccaggattccccggctgtaaccccaccccagcttcctttccagctgagcgtcagatcccttcaagtcaagcctggttcgattacctgcgcttgtcccaccaaacagcttcatagcctttggtctgaagtgctgccataatgacgttcacatcgtagttcccatttcccagcatgctcttcttgtggggggtcaccatggtgtttggcgacaacctgcaaatgcgacaggagggaagctgagattggctggccagcccaagccctcctggctccacactggcagggacagaagacactttacaccactgcccctggaagcccgttgccgtccactcaagttaacgtaaccagttttttactaaagtattttgtagtctgagctcctgctgtcctagggatttatcttttgatgcaaaacggtaattcagcagtggtggcgcctatctgcctgccatttagaaagtgcgtctatagtgaattcaatggatataaagaaagaaatctctcatttatgaaatccccagatttcccttttctgaaattttctttgctgatcttcctgctttgatacagcctttttttttttaacattagaaaatagtatttgatattttgatttgcatgggtagtatctgtcattagttttattttttacaatttaaatgctttctatttaaggcctgcgtacttggtaattattaattattaaataaaggcctacacacaggtaacatcaatgtatcaactggggccccagggaaagcaattaaaaacagtattaacctgaaatgcatgaaccacctaaaggtattccaaatatacatgtgtgtgaaatactggaatttgaaagaaaatacgccaactgaaaaaatatttttgccaccagacaagcaaaactcaactgcagtctggttcgcctgctggctttaagccatctttgggtcaggcctctttagccactcctccatcttcagataaggtcagttctggaggcatttccaatcctattaatttgctttcgcaggccgcacaggccaggacctgcggaaaggcaggggcagcacacctctcaccccaaggaagcgtcgtgagttcctcaggaatacaggtggagagcggctatctaggaggctgctaactgccatctccagaagagaatcagatcttgcagtcaactctaaaaacttaagagatcttagactctacacacagcaaccatactggtattttcccaacatactcttgccactgcttaaagccttcaaggctcccaaagcacttaaatagatctaaatgacattggcaggtctgtaagacccttaggattctgctgacctcatcactacctcgcagcacaaagaccttctgtctacta

SEQ ID NO: 49749 - DNA, 1360 bp, Bovine  19866880648080
acgcagagagggctctggggtgggacaggggatcggagccagtcccccgtgaggagccagatgtcctgggttccacagggaacccaaagaatagcagctgtgcctcatctaggcctgtctggtgggggtggctcatcccagcctgggtggggaacagggactgtgaaggactctggaatccggacccccgaagggagagcagggtcaaggccaggggcgagaggaacccgagcagtccctgtgcccctgtctgtgcgagggccgtgtcctcttggcacctgtctgggggtgaggagtgctggcccaggaagtgtggcttccagcccatccttgctctctgtcctctgcaggagtccgtgcccggccaggcattgtttgcgggtataaaaataaaggcctcttggcctgggccctgctggcagagggaaggagggggcagccctggcccaggcctgaagggcatctggctggaaaaggagcctcacccagctccaccatcagcaaagcaaagctgggcatgtggggggtccccagagaatctccagccccttggcttctcttgccacaagaggcacaggagcgtgtgcgggtgtctgggtgctggctgccttctccccactccagtcactcaagtctgtctctgaccttcaccagaggcttccaacaacctgagcccactggggtataccagattccccaagactctctttcccctacccgctggtaacagtgacagccatagctcggtaacctggttggggaaggcaccgctatggtttattaccattggataagtaaggcaatcgaggctcagagagtttagtaacttggaaaaggccacacagctggtcagtggaggagccagggctcaactgagttctgtctgactcctgagccaggaccctaaccagggaccgcactgcactgccccttgccgctcccgagctccacctctcctggtctctggtcccgtcacagcagagaagcttcctagttccccacagtggccagggaaagcggggatagggcagctgatcaggagcggggagctgggggggggatccaacagacaaggagcgctggagggtgccaggcactggaagtggggtgaaataaaagtcactcagtcgcgtctgactctttgcaaccccatggactgtacagaattctccaggccagaatactgaagtgcgtagcctttcccttctccagggaatcttccccacccagggatggaacccaggtctcccgctttgcaggcagattctttaccagctgagccacaagggaagtccaggagttgggtggtgggttccttattacattctcacacgaagtccttgtgcagggggaatcatgt

SEQ ID NO: 49750 - DNA, 1178 bp, Bovine  19866880826432
cctgccatgccggagacttaaggagacatgggttcgatccctgggttgggaagatcccctggaggaaggcatggcaacccactccagtattcttgcctggagaatcccatggacggaggagtctgatgagctaccgtccatagggtcacaaagagtcggacatgactgaagcgacttacacacaggcgcgcacacacacacattggttagtgaaagggctctatattatagacattgactgagaacgttactttcatagtatatgcttttttggctgtgccatgcagcttgtgggatcttagttctctgaccagggattgaacacaggcctcggcagtgaaagcatggcatcttaaccattggactgccagggaactcccctaaatgcacttttaaaagaagaagagggaggggggttcaggatgggagacacatgtacacatggctgattcatgtcaatgtatggcaaaaatcacaacaatattataaagtaattagccttcaattaattaatttttaaaaaagaagtgctaaatgctgtaaagaaataaaacagggatcgagagagatggggcaggggaggcctttctgaaacctgagggtatatcggatccaacctcgtggagctctaagggctgaacatgccccactcaaagagaccagtgggcacataggccctgaggtgggaacgaggctttggggctcagatctgagctctcaaaggaagcaactctccaggggaagtctggagagtgagtgagcatatagtagatgctcaataaacgttccctgcatctctgggactcatcaatgcttgggttcatctgggtgtcccatatgggggtccccaggcctttccgtggacccgcagtgggcggaacagcagtccgggcctcctgagatccgtgtctgagcgtgtcacggagagcggtctccaagtgcccccggaggtctgtgcttcctgtcaccagaaccccatacaggcctctctggaatcctgcggtgacaaaacaaggagcctcattccattcctcctgaaaaaaagaataaagaaaatacttgctggaaatttctgagcaagtgagaacatggagacggcagaagccaccatcgccttaaaaggcagagccagcgactttgtggagctcacctggagacgggcttgggtgggaggtgct

SEQ ID NO: 49751 - DNA, 715 bp, Bovine  19866880893109
tgtgccgcgccctcggcgccgcctcggcttcagcatcgtcgggccccggggccggggctcagagcgcaagggtccggggacccatggcgctggcgtcccccgcgcccccgcttcgggcgccttcccttcgccgcccccaccgttctctcgctgtcccctccgcgcagtcgcccgccttgcgctccgatccctgccccgcggcgctggcctccagcccctagacccccgcggccggccgacccgggctccgccgccacctccccgccgcgcgctggtctctgtccctcccgatctctgccgccccctgggtctctctccccgcgggtcccggtctccgtctccgtcgccctcccagtctgctccctgccgtcctccacccctgcccggtccctcccttgcgtgtctctctctctctgtctcgctcggggtctctgtctgtgtgtctctctccctcccactcttgctgcggccccccgcgctctcggacccaggcccccgtcacctgcgccccagtccccggcccgcccgcccgggagcccgagctcccgccgcccgcggcgcgccgagaactcccaactcgcggcacccgctccgctttgcgagactttcgcccctcctcacacgtgacccgcgccccactgcggaggccgcgccccccaccctcccagccccggagccccgggcggcccgcggggcccggcccagcccctttccc

SEQ ID NO: 49752 - DNA, 916 bp, Bovine  19866880896921
tgctgaaggagcccagtgcgggttcccccacctcaaaaaggaactgactgacccaggcagggaactgagactccacctaggaaccaaaacaaggtctcactctgggaggctcaccaggaaggtggaagatgccaccgcaggggcctggagtggggggttgggggcggcacctggcttgcgtcgagaggccaggcagtgagtacaggcccctctgtagtcactccagtgaaaggagggccggcacgtgcctgctcaggccacaggggggaaggaggaacaaccctccatattattatcagtgacaaaacgggaagaccttccatcaaagaaagccagcatctgtgcccagagcaggggtaggaggcactctgcctcgcagactcccaggaccagtgcagaggaggggtattcctggggaacccagagggttccaactcacatcgtcccgcacggcctggagctgctggggcagcagccccacctggtcctccaccaagctctgcttcagggtcagggctgccagctcctgccgcaggcctgccagctggccgtccagccgccccagctccttcatggcattctcctggaaggactcctgggtcatcctactcccaaacagaagagtaagctgtgggtctccagtgaggggtaaggctatgctgaggcaaatgagaggatcccctagttggcacctgatatacgtgagtgtgaggcctgctctcggggattctaaactgaggctgtagaacacagctctggtgcctactcttggcctgcatatcccaaggagctagttattatcctgcttccctcctaagcccagatccagaattcactgcctcagctctcacatcctccaccaagtatggacgtctgggacacgaggaggcagccagcatgaggcagcacagaaaag

SEQ ID NO: 49753 - DNA, 742 bp, Bovine  19866881019735
ccaagtagtagccacttcattcctgcccaatacccccagggtagccccacctttgcaagaagagcctcagagtaaacatcacgtttattttggacattcaaatttacaaaaacaaaaagtaacaaaaaccatgacatagcatacacacacgcgcgcgcgcacacacatacacacacatgttgcatctcatgtcactttatgtacaaaatcaggcgggatcagggaggcgggttgccagtaggatgcactaatttcacagagtctgacagcttgacatgctcattcactgctcagcctgggcccacgtgagcctcttccccacccagcagggtcaggggccagggggacgggtttggagtggcaggcaattgggacaaagacggttaagagaatgattccatcttttgggggtgggctgtgtcccttccccggtttgctcagagcaaggatgctgggaaacacagtgaagaggggacccatttgaggggggggctaggaccgctgcatcatggagcgagcactgaatgcagagtcagaatgctgggttcaggtctcccagtattccggctgggtaaccccaaagactgctcatcctccctgggccctggcatcttcatctgtaaaaagagggcttcggagcccttcctgtccacgcctgcggtcccaggtcttgcacagatgtggcaaggtgatcggcctcttgggatgttggttaaggggcgccatgtgccacaaggtggga

SEQ ID NO: 49754 - DNA, 808 bp, Bovine  19866881028602
atggaagacggtcactgtctgctcctctggcctgtgagctgagacctgtgtcactctccttcatgtccccagctgactcaggctggcaggcagcaggtcagtaaatgctgttggagtgacgtgctcggctcccaacgttctatttccctcgaactcctgtctgcttccctctgcttcccagcagtccctcaagccactcagaactggactaaggaatcaagcacctcctgtgtgtgaaggctcacactaaacacttgctggaaacatcaaaacaagggaactggccacaggctgctcagggcctcgtggagcctggccatcggagcccagcatgtccagaaccacccccagcctggctcgggtaccatggtggcccagcagcgacctccagccagacatgggtgctctcccaagctgtcagggcaccctccccggcttcccataggcccgggaacctggcggagcatctccccgagcctggggaaggaggacgtcgcctacctacgtagtcatcctcggaggagtagcccgaggaggacccgaggaagtcctcggagagcttgttctccgggagcccgttgggcttgctgctgtcggtgccgcctgtgcctctcctcctcctcacccgcaggtcctcacctgcggagggaagaactcggggttctcctggggcagatgctccaaggagggaggtggtgtgcttggggacaccctgatgagcatctctgatgggcagatggaatctactctgagcccctcctgagctcccttgagtccaaggatgggtaaccaggacccagccctgtct

SEQ ID NO: 49755 - DNA, 1101 bp, Bovine  19866881082718
cttctgtgtctcccacatggcccctatgttactctggcttgtgatattgtccctgaagtcctcccctcctgtgcagactcagctcattttaggaccggatccgtatcccccggtgtccagaacaaggcctggcatcaagtaggcctcagagaacattgtaataaattgtgatctcagagaacctaggagatgaaagagccctttgggagccccaaatccacaagcagcaagtacctttcatctcacaggccaactccaatcaatcagcagtgccttccaaaagcactgcgatgagaaagattccgagggtgagtctaggctcatgattgattagccatgtctgccttgggtggagtaggaggcagaggtggctgcatatttgccatcctttgcccaagcccctgactttatggatgaggagactgaggcccagggaggaaagaacaacctccccagggtcccacagggcgttgtggttgacagtgctcggcctccaagtacaaggcttgttccatcattcccagcacttcttgagcccagctgtgtgctgggcactatgtgagatattcagggaagggaggcttgtgagatacaactcccacccagcgtgaccttacaggcctgtcagagagtgaataaactacctagaaacaaccaaaacccaacactgagtagtcccttgtgatctgagtgaagtgcctgatgatattgctacattgtggggaaagaggaaagagtggctggaaagacactgggcagggaggacaggcagggtcagatcttgggtcagaccctggaaggagggtcactggtctccccatcccccatcccactgcttcagccttggggcttgtggcacctctgacccggggctgggggacctgtttccaggtggcccagttgcccctgagcctgaaggacaatggctggcaccacatctgcatcgcctggactacaagggatggcctgtggtctgcctaccaggatggagagctgcggggctctggtgagaacctggctgcctggcaccccatcaagcctcatgggatccttatcctgggccaggagcaggtaagggtcagggtggatgcaactagatat

SEQ ID NO: 49756 - DNA, 916 bp, Bovine  19866881109487
cccgtgctggggtggcagccccgccccgcgtctccggcctcccgctccccccactagtttcctgtcttgaaccactggaggcaaagtttagccagctgggagctggatggttgaaccacagacaaaggcaacaacacttcatttttaaaatgagagaaaaaagagatagcacccctccccaaatatagagctatatatgtatattttatatatatagaattcattcgtgcacaattcattaaatgagcttttcaaaaattaaaaaaaaattataagatacatttctttaggcttttgcgtttttaaattaaaaccaacaagaagtctccatctctactccacccaatagcaaggggaggccccagaacccttggttccttgtactgtggcctcttgcaaggggtccctcaattagaccaccagcccctctttgcctaactgaagctctgcatacaacaggcactcacccactgctggagtggggtgctgactccttcaaggcgggatggggtgaccccacaggcctgggagatgggtacctcggtctccacccagcctgtccccatcttggtgtcttggcaactatcagtaagacagggccaggatggggacaccctccctctctcctggagtggtagcccctaattctgggctttctcaatctgagaggagatgcagacagaaaaaaaaaaagaaaaaaccctttaaacactttcctttttttttttttccaaaagtgattccttaaaccatacaagcccccaaaaggctgccttgggctagtgcatgggagcctgaaagtggaactgaccaggcgggtcccactgtccggcatgggccaagtgcaaaaaaaaaaaaaaaaaacagaaccgaaaaaaaccccccaaaacacaaaactaacaaccaccaacaaaac

SEQ ID NO: 49757 - DNA, 691 bp, Bovine  19866881244710
caacccccacccatccacccccacactctgacagcacgctgtgtgataaacaccctgacacacactccggcagctccccatcttcacaatggaggtgatttcccagcccggggtgaacagtgcactgatcatgtggacccagcagggtggggttccagccttttcctcttactgtccctcagacagacagatgtcgggacagacaccagacagcagacagagagagcagacaggagacagacaggggtcaggggaagtagatgcaatggctttggggtgtctgggcttttaaggaggtcagggatggggaaggtggggcggtgggcagcagggctgtgctctgacgggaaagccgcgggccagagcaagtgacggaacggggcttcttctgcttaatgccctcgagtgtgtacagagggagactgcagagcagaaccctcagaatcctgggaccatggaggctctgccctccaatggtcaatgcaggcgtggaggtccagcgctgggacctctcagggctcctgattccagcaaagagccttttctggctccctgtgtggcctggaccagagtcccctggtctctgtcccaagagcagcaaagagcttttgaattgcattaaggggaaaggagggcagacggctcacagggtctctaggactgggcagaagggcttggggtggctcttgaa

SEQ ID NO: 49758 - DNA, 1250 bp, Bovine  19866881465754
tgtgtgtgtgttgccggggcggtgtcttctgatatgcaaaagatttgagctcctagaggctcacctcttgttttgttttggaggacagagccttgacctttttcatcttgtgaaacccaggctcagttttgtgttagcagttataaactgttttgtgatagcagaaccctaggagaaagatgaaaaggcacccctctgggtagggtgtgcactgctgatggttttcagcaaccccttcccccagccccaacacacacacacctctccatctacatatttctttatattcttgccaacggcagcctgagttctgcataaacattttgctttgttcctgccccagggcaaaagcttcatcaactttatcagggcagggttaagaggaggagcctgtgcctgtgtgggcatctggagctttcaggtagggagggtagtagtgggggtggaattaccttataaggagttgaatatagaaaaggacccaggccaacttcctgctgtggctactaccagtcggtccctttaccaacctcggcctaaaccagggatgatgccaggtgagcatcctacctgtgaggacaccaataagtcccaagacatgagactgcttatgttccagaagagaactttgtagaattctctagccagaccaactagatctcctggtttccatagtgagttgggatgtgttagagcctatggccacctcacaacccagagaagtagtaatttaagtatcaaccagggagggggcttccatggtggctcagtggtgaagcatccacctgccaaggcaggagacctgggttatatccctgatccaggaagattccacatgccagagcagctaagcccatgcaccagccctctgcaacaagagaagccactgcaatgagaagcccgcgcagctgcagcaacagagactgagcacagcttaaaaaaaagtatcaaccaggaatattagaagtgataacaagtcacaagtactactagggccaaagtgtaacagtgactttgtaacacaggccaacaaaggcaccatgtttggagtgctcacacggtttatcagagattctgaatttgggtttctagagctaaaaggtttattaatccccctgtgttgtagaatgccgccttttgccaggttttttcaccttggcctcgtcccagagcccttggtttccacccactgtggtgactggtctggctggtagaggctgacagtaatctcacacagctgctccaccggc

SEQ ID NO: 49759 - DNA, 1205 bp, Bovine  19866881484046
tcggacctctcttcctataccccgacgctcggtctctctcctccctggggtgcaaagcagatggcagaagaaaaggaaacactggtgacatttaagggtaagtaaggcgtccgctccacctggccctctgctgtctacgggggaggggggcacccaccacaggctaccacccatcctagggtcgggctcctcccgttgctctctttaggccatgacaatggggcaaagtgttcaactcccagggctccctcttctcaactgactaaaggtgagggcacagccaccggtcccatctgctgaggtgggactcagggggcatctccaaaaacacgtgggtcttcatggccccaaggtcaggccagacctctgctctctatgcactgggaacaacccccagaacatttccagtttccactcttaggagacttgtagagacacctctcaatcaaatttgccttgaatgggcccaggggagctgaggagaatggcggacgagtccttctgcatgtgaggctctgcccagaactccccgccaatttggcatctgcacgaacctggtggggaagacaggctcccattgcctgtatcgtctggctggggaaggggagaaaaactagcttgcattcagtccccagcagatgccagactctctgccggatgccctcctcacttcacacacatgcaaggcacaacctgaggacgcatacaaagacacacacaccgcaacacgcgagatgccccagccctgtgctggagcagagggatgattcaaagtcactgcgcttggcttcactccactcatgctttctgaggccttaggccagtctctcagtctgagcccagttaagccagtaggtccatggcccctgtttccctcctcaaaggagtggctgccacccgcttccaggcatcagactccaggggcgctgggggcggagctgtccctcccaccctgtggagcttcagcaggtctgccctggggtcccagaaccagggtttgagagaagcaccaagggcatgcgatacccagaccaatcaggcctctccgatcctggagagtgagaatctagtctcagagcccggtgctggagcccaggtcacccctacctgagccaggggacaccctggctggccaccctccctctctgggcctcagtttcctggtctggagcacgagcttcccttctcagctgggccctggggct

SEQ ID NO: 49760 - DNA, 1707 bp, Bovine  19866881539830
cctttgaagccctcacatttactctttttcagttgaatttagaaagttggagcaagagaaaatgctggttttttggttatgtagttatttgcattctccaagggtaaagaaaaaaatcttaaaagatttttaaagaacatactggtaatgaagttctgtagaaagaaggagctgaactgagggggtgaatgtgtgataaatttgttagcttttctaccaacagactcttcttttgaattccttgttacattgccatggtctcactaacattcttgggaaatcagggcacagccagaacatttggcagcatgctgggtatgttctactcatatatttccagaacatttggctacatggtgggtgggttccacctggctgcttgtgtaaaattggcatcataatggaagtagatggacatgaaagcacatgacataataggggagcctttcaggctggcattttctcaatctgctgcacccattcttttacttacagaatgtggctgacattaagaaactgaagtcagtaggcatctgtaccatcaaagggatacagatgacaacaagaagagccctgtgcaatgtcaaaggactctcagaagcgaaagtggacaagattaaagaggcagccaacaagcttattgtaagcaaaatccattctttgttattttagcttaaatgggccctgggaatctctgtagcctttttcattatgtacactagaaactattgtgataactgtgagttcctgtgcatcaccactatacattatatgccccatgttaacttttcatcatgtaagtttcaaagcaataatttctgaaaaaaaatgagacagaggttaagagaccaggaaaactatgaaggcaatcattttttacaaaaccttttatttttgtctccttttctatcacttttcccttttctgtgcctctgcctttccttcttttcttctttttttgtccaggatgtgctgcttgcaagatcttagttccatgacctgggatcaaatccaggctcccagcagtgagagtaccaaatcccaaccactggactaccaggggctccctccttttcatattttttttaccttcctcctccttatttttttgcattatctcctcaaacattgtatatatggctgttgtgaagcactcagcaccaaagaaattgctctctcctggtataggcatttgataagagaacattgcatttgaaaaagaccaacagtggctgggtctccatttgtgcagttaagatagatatgaccaagaatgtgctcattgaggcacctgagcataaagctaagtgaaacctgtactttgtacctgggcccatagaccataagagacctatgccgctgatggctccaagcagaagcacatgcctttgacccaagtttttgtgtagcacttttgggggccgctggaggcagcacctctgggaataagaatgtgcagaaaggccaaagcctctctttgcagaagagcaggcttctccttttctacatgtgtataagagagtctcattctcaccaagtcctagaaattctcttcaccaacagttacctctttccttccagttgcaagtgtcagtgtggtcctgaacttggagaggacacaactgaactggtctgaacacaactcagttgctgtatgttctgagtactcttgggctgtatacccacaaggcagttccgtaactgcca

SEQ ID NO: 49761 - DNA, 1290 bp, Bovine  19866881618176
cacagcagaaggggttcctgtgagcccgcacttggttttggggtttccggcctggcttatgcttgaaactgcctctcctcacttcctgttccctgaatataaaacagcccagcttagagagaagaaacagcactgggccctggcaccctcggaggtgtggctgaccggacatgggcaaggtctggtctctgcccacggaagtcacaacggcaagaggcagcacggtgaagggcccaagacatctgctcggtgggtcgggggacccatgcgggctgggggttgggaggtgagcccctacctgagagggctgtccttaaacagggtgctctgactccccatcactgagctccctccgctgctgctgctgccgccatcatcctcaccctgggaggagtagcgcgttaggcgctggcttcgccgagacatgatgaggtgggcggggggacccttcccctgaagggagtctggggagagaaaggcggccaggtgaggcttccaggggcccggcgtggcaggggcagggaggaaagacaagacacagcctcccagcaaacacacacccctctgcattcaaccaaagagcttgacatgtgggcgagacccggcgttgattaagcatccctgccccgcccacctgcagccctctgcactctgccagcctctttcaaaacaggttcataggatttccaaactttcagattattggatgctgagctccgagatccagaattgggccttctgcaacttctgacacgaggcggagctcgtagctaggtagctacaggtgctaaataaacaccgctcctcactgctgccctgcagactctccagtccagcctcttattgggctgcccagtcctaaagctgtgcccgttcttgttctagcttgtttcccttaagtgggacatgcatttctttctttgtagctgtatccattgattcagagccccagtcaaactctgactccagaaaacctttccacggtaacccccgcttacattctgctagagcctgcgtgcctagcctattagtgattactggcctgcaacatcagtgcctcttgatatgatgctgacggtggtgataaaatactcagttaaatgcctcctgggtacggggctcctgacatactcatctctgatccttatgatcaagggaggtatcaccgctcccactgttcagtggggaacccgggggcactgagaggatcagtaacctgcccatagatcagtaacccaggctgtaagtgacagaggcagaagggtgtgctgcgctggggcctggatattt

SEQ ID NO: 49762 - DNA, 644 bp, Bovine  19866881685527
attgtgcttaccctgtttctccacttgagtacttgcctatctttgcccttttgccctcactcaattctagcccatccacaaggtctggctgaaatgacgctttctgactgaagtctttcctgagcccccataactaccccctgacagagccctaaagtctgcctgggacagtctgccctagaaagctggtggtccagcacaatgagaggtcaaggccctgttggtcccagttctcagagggactcctgccccaccacaccagggcgtgaagccacagggcattactgtccctgaggtctggggttccctcttgttttcagatcaagcgctcatccatccggaagggcatggtgatggtttctccacgcctgaatccccaagcttcctgggagtttgaggccgagatcctggtccttcaccaccccaccacaatcagcccgcggtaccaggccatgggtaggtgtcaaagggcactgccagcccggaagtccccggctccagcagccctcaccccaaagttccagctgcagccaagagtcaggtctctgtcctgtttaatgacaccatcccctctgttccacctacaagctgtagcctgtgggtctgttcattcttgcaaacactgaccgagcgctgcttctgcg

SEQ ID NO: 49763 - DNA, 743 bp, Bovine  19866881881230
agtgttaattcttcatatccaactgtttcacatattttaaagacttaattcagcattatgagtcacttcaaaacgcctcaaattccgcttctctagacaaattgaggtaggatcaataatactttttcaaatgtattgatgcacacttaaaagcagcgccaacactgaaagcactaggaagcccaatatggcactcagccccctgcagtggaagcacaggtcccaaccactgaccccccggggagttccaacagtctctccaaactctttaagaccttaatccaaaagagtggaacaacacaagctatttttaaatatgttttctcagtcttctccaccagaccttgaactccttcctctgctatttggtaccaatatggccataccaattgttaaattattaaaatactttcatgccagctgctaagtagctaatcttagctccccttgccaaacaagttgttacatatttgtaatagtgcctctctccagaactgttttatttctaataaataaaaatagtagttaagtttctaaaagtagttaacagagaaggaactccatttttgtagaatgaatgaatatctatgtatctttcaacattctaggcatacatcttcatcttggaatcccggttcttccagcacaacttgatcctccttcatattgaagggtgaacagcagaaaaataatcaattctggaaaaacaagaaatattagtaagttgtcacagatcatatagt

SEQ ID NO: 49764 - DNA, 3523 bp, Bovine  19866880372379
aaaaaaaatggacatggctgtgttctaagaactttatttatgggcactgaaatttgaatttcatataattttcaagtgtcataaaatcttattcttcttttgattttttccccaataatttaaaatgtaaaaaccattcttagctcacgagctatacaataacaagaggcaggctggatcactttgtcgacactgctctaaagcaagaatctattatggcactctagaaagaattgaaaagagttaaccaggcaacgaaatgtgtcaagcctcaaccctgctcttctaggcagcgtggagtctaggataataggtcttttcaaccaacagtggaagactattaaatacagacaaacaaccaatataacccatcaccactgccactccaagatgctacaaaatgagcagacaggctaagagtcacagggccttagaatctaaccctggggactcagctgctcctcaagacttgtttaatctcaaacgacactggaaaataacaaaaggtttgactctgaatccaaaatattgttggatacagtgcagtatagctggagaaagctcctgtagggctattctgaactgattttataataattcccagatgctctctcagctaatggggagtgcagaatccagggtcatatcacaactcccttgcagtctatcctcaacatgttagaataatttaaagttaccctgccctagaagtttctgagaccttttcatggagccttacagacattaacatccttatatacagctcttatttggacatttctttcaaagtacctaatggagcaggtgaacagatagaactgtgatttctctcaatcaccctgctgttcccctactcttgactcaaaaaagcaaaagagaatctatggctttttcttccctccagttttattgtgatatgattggcatagagaactctttaaggtgtatggtataatgatttgacttgaatctatagcttttttttttactagccttatatcctgcaaacttgctacaatcacttattagttccaggagtttccttgttgatttttgggatttgaaagactaaatgtttagtttttctaacatgtagtttcgtatcacaatttaaagactgatttctacacttcaggtatttgtaagtgaaataatatgatggcttgtatttgctttaaagtacttaaaaaaataaagtggtggtaggggagatgaaacaagattgtcaaaagtgaaattaaggaagctgaatgatggggtttcattacattacttttttgacctctacataaatttgaaaatttctaaaattatatttcaaagccagatacattatttgagattacagaagaagtctctttctgtattaaagggaaaatttttcttttctccccaacatttctcttctgttttcctagaaggtatataatacattttggaagaatagttggctgaatagatggataaatggatggatggatatgtctcatcttcttcttatccatttaaatcttcaacttggcaccaggaatatactggaacttaccttcaccacagaccaaaaatatgatgagcctttgtgatgcccatctcagtaactcaactgcgtttactgatttgatgatagttcaattttatatttttgtattatttcccatttaagaattgtgataaataaatgaatttaccatttctcataaaccctctgtgaagcagatgctccatccagttcacagaattaataagcccctggacctgacccacaatgatacagaaccacagaacctgagagctgagagggaattcagaagttatagacctccacattctacctagtgtcggaatccatctataacgatgatccatttcatttatttggtacttttctaagcactggggatacaacagttggggcaaaaaaaaggcaaagttcctgtcttcacggagcttacattccagtgggggagaaaggtaatatataaagatgtgcctgaggtgagggactataccacgagcatatctaaggaaaaagaattctaccattggaaacagtgatgacaaaggcccggaggtgggagcatgcctgtcttctaggaatggcaaggaggccagtgtggctggtaccaggtgagaggggaagagaagccagcagctggggggcttcgtgggccactgcaagaactttggcttctactctgagctgggaagcatatgttttgataggatcactatagctatggtgttgaggagagacttcggggaggcaaggcagaacttaagaaactggtcagaatgaaactgcagcaaccactgcatgctagcagtagaggtggagagaagtgggcagattctacctccatgctttgaaggtagaaccgacaggtttggctgacagggcagaggtggggagtgagaggagaaggggcccagggtaagttcaatgttttgggatgaatgggactgccattcactgagaagactggaggagaagcaggtttgggaacgggtggatgaagataggaatttggctttcgatacactgagattgaagggacttactcaccactggtgtgcagatgtcaaatagttagctggctgtatatgaaactgagttgagggttggagagaacagtttgggactcaccagcacgtaggtggtaattcataccttggaagtggatgaggtcacttaagctgagacttggagaagaaaagcacaggcctgaacttgggcgctccaacatttggaggttgggagataaggagaagacagtgatggagatcgaggaggggtagcagtgggtgtcagaggatgagatggctggatggcatcatcaatgaaatggacgtgaacttgggcaaactctgggaggtggtgagggacagggaggcctggcgtgctgcagtccatggggtcgaaaagagtcagatacgactgggcagctgaactacaacaagaagccagtgagacaagagaaaaaccaagacaggatggaattctggaagccaaggaaagacagtgcttcaaggacagcattccagctctgtttcgtgggctgacagttcaagtgaggtaagtaatgaaacctgaacattggcctcagcactaaggatcctcagtgagcctgaatggagggttccgatgcctgcagggagaggaagtgaagacagagagcacagaaaactctttcaaggagcttgttataaagagaggctgaggaatgggacattgtctagaggggggatgtacaggaagacgagttctttgttttaaacaagagcaactacaggatgtgtgcacgctgataggagtgagccggtagaaagagacctgttaggaaatagtcttacagagggaagctgtctgagatgcaaggcgagttctattggctctgaagatatcaatgtgttttgcagcttattgtccctcatcataattaaattcaagctttcagtcagaggttaatggaaatattatgcaacattttttcctacccaagctcacgagaggcccggtttcagg

SEQ ID NO: 49765 - DNA, 1719 bp, Bovine  19866880456147
tagctttgattgttggtgcccacgcagggtttccttgtcctaaaagaaatttaaaattttagcacattgaattatagcttttaaatatcacttttcttctcgtagggcttccttggtggctcagttggtaaagaatctgcctacaatgcaggagacccgggttcaatccctaggtcaggaagatcccttggagaaggaaatggcaacccactccagtatttttgcctggagaattccatgcacagaggagcctggcgggctacagtccatggagtcacaaagagtcggacacgactgagcgactaacactttcttcttatccccctctttctggtcacctatccatcctccaccaaacagtctgtaccaatatttactccattgagaaaaaaaaaaaagaaccaccaccacgcaacaacagcagatttaagaaaaataatatggtttattaaagggggaagaagattcagtacacgaagccaagtggtaaagagcagacttctcagagagaaaaacagagcagagtcctccttgctttatgtccaagctgaagcactccatgttctgatgctaatttagcccataagattcataagaaccatagtcatgattctcctgtaactggctgtacattttaaataaaaccagcttctctgtgaaagttcctggaataattaaggcagtacatattctaggattagcatctggtcagccagtccatcctccctttaaaacacatgatctccaaggttaattacagcatgattcaaaagaaggctaaaaaacctgctatttattaaaattcttcagtcttaagagtgacttgcttagatgacctaatgcagtttcaatttgctagatctttttttgcttatcagatgatcccttaataatcttgactggatctagaattcacactctcccttgtcagggacagctatagaaagggcactgctgagtaaccatctagcattttgccaaattctattcacagcactggtggatgggaatagaggtggaagggtttattttatatttcacagttaagatatgaaacttaaataaacttcaataagtttatatataagctttataacttactcataaataagtttacaataacttaaatgaacttcagcctccaatgtcctctgggccacagtgcatgagacctattaagatgtggctttcaacatttctttatcctaaagaagcaacacagtcattgactggacaccgtctctgtgccggacactgggctgggtatgagagacatgaagatgaataagacactccctaacctcaaggagcacagttaggaagggaaaaaaccctgctcagcaaagaaaccaaaaccacagtattgtatttgctgctactcaggctgaccctgcccacagtgtacatccgggcggacgcctgccagtggaaattcaagccacatagttggttcctgttctctgggccctgctctactacactgtctacttggccaagggtataaacaaagcaatccagagactgtctacagggctagaggctggggacctgaagccacagggcgaagacaaaagaaagggcatggctaaaactcagatccctggctcagagcgtgtttccaccacatcctcaggtgtttcctggtctcttttaagagtcttacaccctggtgcaaaagggtttaggaagaaggaaacatgggcaagacatctgttgatt

SEQ ID NO: 49766 - DNA, 1044 bp, Bovine  19866880519428
ttaaaactctatttatgagcaatctccctagcttctattggctacattgcaatcactcatttataataccacctttcagaacagttaaaattagaattctgagatcctcaggggactggtgatataaaaaggctaagaacagggaaaatacattgtactattccttctgagttcctgattagatgtcctcattaccccttccaataaaattctaaaatagctggaatttatcacattggtacattaaacaacagtataagaaaagaaagttcttctcatgcatcatttactagtgaagaaattgtggaaaaaggtatgttttctataaaatattttcaagggtcaaagtaaatgttttatgtttttcctcatgtgtcttttcccaaaaaatcactaaatacaaatactgctttctataggctgagagcttttacacactcattatgtttgaaattgaatgattaaaataaaaatataatttctattcatcttgaaaggagagaagcaaagcatgggtgagaaagaaaacattccaactacagctaagcgttattaatctaatggtataaaaaataatatctctacatttccaatgagcaatttttcctcatcaggagacaataacttcacacgtttcacttttaaatgaaattacagagaaatggaaagttcagctaatattttcttccagcaaaatgacaaatggcatctcaagcatggtctcagcaagacaaatgcaaatacaatacagcatcatattaacccaactcctgaggacaggggatcacaggattatcagggtttgctaaatagggaagagggtatttatagatatcagggttctgcctgaaagggacaaagtaagctgatttaagagattggacaaaagtgcagaataagtctactctgtgcttctattcatatatatctatattttaatgtcaaacgaaaggaaacacagccattataagttaattttattatggggctgagtttcgaggtattcagttcagttcagtcgctcagtcgtgtccgactctgcga

SEQ ID NO: 49767 - DNA, 1792 bp, Bovine  19866880579879
tctagggctgggccgggaatgcaccctggttccctgaaagtctagccaggaaaggcagaggaggcaaattggggttctcttagtaagaaaatgagtggccagcagatgggcaaaagagttttctgtccccttacccaagtggtacctggggtcagaggatccttgtatattgatcaggatgccaggccagtattaaagtgtcatgtggaaagagaatgtgaccgggtagctgctgttgtttcacctgctacacagatttagaacaaaatccagtcaccatcatgaaccagaaagttctgcagtaactttaccagtagacacttcaacttctttccctcttactttacagccagttcctcttacttccccattcccttttatttttgtgatcagttcattctttcttctcagattgccagtgattgctcccctgcccccccaccaccaccctctgggtttcattagaaagaaaccattccccaactcagcagggcttgatttctgaactgcgctttagaattctgctggaaaggctgtctgttctcagttctgccattggtagactttaaccacaaattccaaggcaatttcacttgagttttaggagaaacgtggccctccaaccttgtaactgacactggaaattcaagtgcctttgcttgctgctgtttaatggcaacctcatgacatgggctaagtcggctcactttgtgattcaggcccaagcagggagatgggggtgggggtgggtggcatcgactgagcatcctgagttctgtggtacggacagactaatgccaacaagagatttttttttactttacattttttccttttcccatttattaaagaaatacttgctcattataaacctgaaacatagaattatgtgacagagtgaagtcctttgtaattcattcccgcactgagaaaacgttggtgttctattttttaattttccttttttctgtgataatttcttttttaaaaaaatttttgaattggaggaaaattgctttacaatgttgtgttggtatatgtcatacaacaatgcagatcagctgtaattatattaatacatatatcacctctgattttcttttcaatgcatgtatctagaaagaattgtcattatgttataaaaatagaccatgtttttcataatgtttttcaacttgcttttttttttaacttcatatcttttggctatctttccatgtcagtatattttttctaactgtatacttttttaaattatctagatacactgtactttaaccattttcctagtgttgagcatttgggtgatttctagtttttccctaccacaaacttgcagtgtgcatccttgtctatttgtgtctttgtactcttgcctaagtatttctgtgggataaattcctagaagttggattgctaggttaagggaaatgaacattttatatggtaaccgccattgcagatgaatgattatattatttaagaatactcctgtgatcatccataaatgttataattgttttcaacaaacaacagaatgattgttacatcaaattactttcatagcaacatagtactcttctgagtccttgagaatggtccccttccttaggttacttggcctgaggaggcttgttaatacatgttgaacggcatgcgtttggggttaggaaacgtgcaggctcttatgtggttcttaaacagtttagatttagcccgggaacccatccatcatgcttcctgtctctgaagctggaagtggtgagggacacagcctgctgcctgaagtcag

SEQ ID NO: 49768 - DNA, 2606 bp, Bovine  19866880586235
aacttcccttgtgcctcctctcagtcatcttttcttttcctttttctttccttctttcttcctttcttcccttccctccctccctatctccctcctttccatccttcctgttttactgcatagtacaggctctcagctccacgtgcctgagcttgttggtaagttaggtaggtagctatagacgaggtagcccccatttctgcttctttccctggcacactttgccactggcacatttcgccatctggcacattactactagatcaagggggacagcatagtatgatggtacaagcatgggccctgggcccatactgcctgccttttatttcagctctgccagttattgcctcctgaccttgtgcaacataacccatttgctcatctataaagcagaaataataatagtaactatgcatgaagttattgagatgatgaaatgagttaataccctcaaagcacttagaatagtgcttctttctccccccacccccgctctctctctctctctctctatatatatatatgtatatatataaaacctccaattattattattcggtcttcaaaaactttatatgaataaaaaaggtgggtacccttgatctttttttttttttttacagtgttaataaagaccccattttacaggaaaaccctggttgtcccattgcctgtttctgtatcagatgcctgccttagctgatatggtaacagttttggtgccattatccttctcccacaccgaaaatcaataataatgatacaaataaaatcacctcattttatatgtatcacattgtaaaacgaaaaagcaaattcagttcaactgtggctccttgatttatgtagttggcagtgcctgtaaagtcttaagcaaatcaaatcctattctaaatgcactagagcccatgtactttagtagaaccttgtaagtaaatccttctttataaggtgaaaaatctttttatagttttctcggagcagggcacactttcctgatgctgcggagaacctcccttgttatgtgcaggcattgctctgccctgactggttccactgtacaaggatcacacatacgctgttatacagaacatgtattttatgtctgatgtgtacatagatagatccacgcgtgtacctagcagcatagttctgtgtgatggtcttgcctcacttggctgtccaccttaaactcagtgacttacatgaagcaccctgcctatttgcatgtgagaacatgttgagcagtatctagtaagtggagtgcttagacctgcttttccaggtctgaacagcatccacagcattgccatccagacttagaaacagcattagggcggtggggagggcaaaggaaagagacaagactctagggggtgtgatggggggtggtggtgctctcaccctgtcgtggggctgcatggggcagtctctgaagcttgctctgaagaatgacttagatgggttccataacttagccccgacctgctagagggcagtcatcttctggttgatttgctcagagatgggaagctgagctgtagagaaaaggaagtagaaatgtgagcagcctgggaaagataagtatccagagaaggtgaagaagtcaaggtgtgggggtggggcaggtcagtgtttattttagtctggatggttctagtcataaacagatgacagaagcccaacactaactacctgaaataagaacagacttcatcggctcaggttactgggatgtccagggcttcaagcacggatttacctatatgttcaaaaagtgtcctcagggctcctacttgtgtgttggttttgtactgtagactgactctgcccacgtgccaggaaagatgagcaccaccaaccagagtatcccgttctcccagtttgtacccggcaggcagaaggcttttttcttccaacatctctccatcagtcctggggaaggactcagattagttctgtctaggtaaatgggttcccccagttaagggtggtccagatgggagcaccaagatttgtgtttaaagtcttccctgctcctcacttccaactacgtggagtgggagagaagtcctctagagcacagggcagaaagcactggagaaaacatgcaggtctagcccttggctggcaaagttagctgttctcacagggctttaggggcatctaggacctcagacctggtgtgcagttaatggaagttaggtcattagaggatgcaggtggagcgggcaccttttgttcttgtatctgttgggatggttttgactacaagtaatcgaacaccatgactaaaatggcctaacaatagtgccgttatcttacatagtaagtcatctggaggtggggagttccagggttggttattatctgttcagcaatgctgttaaggacctgagttctttctaacttcctgctctgtcttcttcagtgctttggattgtctttttaaactgcggttccctgatgttctagagagagctgctggaatccctaccatcctgaaatcacacttgacagagtctaccagcagcaaaaaagacacttctgtcctgtgtctcttttcaagaccaatcaaaaccttcacagaactgccctcattg

SEQ ID NO: 49769 - DNA, 1690 bp, Bovine  19866880598880
cctgcacagcaaccaagacccagcacgccaaaactaaataaataaaactttaaaaataaatattaaaaaaaaaaattctgggaaagaggcagggagagataagttatttgctagtactgacaatgaaaccagcctttatgttaagaacttttatttaaccaacatctcatgatcccatcatgtaggtattaatatccttactgctcagctgtagaaactgaggcatatggagacctgcccaaggtcacatagcaggcagagtaagagcaaggatctgaatgacgtctctggctccaaagactctttcctttacagtaatacaggagtcatgatattaaaccagaagtgaccagtaaagcaaaaaccggaactgagggtcagctaaacgctaagcagacactcatgttcccagtcagtgttctagaaccctctgtagactgtcacttaccactggatctgacagtggtgttcccaaggacagggtcagggccttgcattcggaccgactctggggcctgacctccatgaggtaaaagactaggacagtcctaaagttctcaaaagttcccaacatgcacctggtccccacacgaggagcaaggtggcatggaaggtcttccatgccttggatctcaggtaagctggtgaaatgttcattggccagcagaggctaaaggagactagggctgagggctctgagtttctcatttcgcaatcaaggaatctgaagaaagagggttttgtcagaacaggatagcaactgccaacttccagggcaggagttaatctccagacctaaagccttttatttccagacgctttgagtagaggctgtgatgcagacacagaacatctaagataaaaataagagacctttcttatcactctcaggctgtctacaagcacatttaaatgccttcaagttctgactcaaaaaatgcagaaatgaatacttacccaaaccccagactgacagaagcaccacaatcaaagtcaaaccaagacatcatgtcacgaatgcaaagctgggcatcaataaaaggatcctgaagtaattattttggggaatgccataggaagaattccaagcccagaacaaagatttgcagaaccttgctaagtagaaatgttacggactgttcagctgccagaaatcaagaatactaacttatctgtgtcctggggctggacaaaggcagacaaggagcaagcctgccgaggcaaggtaacacacctctcctggcttccgagagggacaaggagttctacaaggcacagggcttgtttcttctacaaggcctccgtgaaaacccggggatgctctcctactactttcctgagtcttcccagaagttggctgggtaaacagcccacaactgcagtacacaatcacttgttaaacatcagatgatatatttcagagagggagaacctgaacctatgttgctatctcatattttacagatgacaaacatgcgcttcagtgtagttaggtaactctttcaaaaacacacacctagtaggcagttggagccggcatttcagccagacctgtgtggttggacaaaatggcttgaacacgcatggacacagtgttttgatattacacccgtcacttccccctcttctgtgacatgatagtcacagtcacgtccagccaccaggatagaccacggggagggaaagatca

SEQ ID NO: 49770 - DNA, 2796 bp, Bovine  19866880600038
gaacaagcattgcaaggaaaaagcgtaatcaggttttggggatggattttttatttgggcttctcacagtggttagagccactctgtcctcagaacaatcacagcacaggaaatgcgtcaccaagactgcccagaaaagtctgaccagctgaatcttattgcttaaaatacacatattcacaataactgacaaagggtgatgtgcctcacacaggaatgtgttagcaattgcaaatcttccgactgtagcaccaaacccttgacccgtccctttcttctcatttgcctggaacaccaggctccctcaaatctgcccggcccctcaagggtccttcagctccctacttcagtgcctccgtgtgcagggcagcctcatgtagcaggggccaggcggtgacactggactcgagtccagctccacccgccgcattttcgttttcttctcgtgcctttagggtcagacactgcagtgaacccagcagtaaacctgcagaccagttccccactctgactggagaaggaatcttcagagggccagaatccacccctttaaccagttaactccaacacggttcattttggtaaaacttaatagcctttgagacacttcagtgagttgtttgggattaaaaaaaaaaggcatcaggaaaggcatctgaggggggctgcaggcacactcctgcctgctctggccacacgtcagccacgtgctggacctcagcagagggaggtaagccctatggcactgtggtggccatcaaagcctcctggcaattctgggtagggccgatgcctgggccaaagccagtctgagcttgaccttgaagatccagtcaagcttctgtctgaggttccaccttggccctctgtcctgagggggtctggaccctcctgggggctgatgccgagggctgggagcagctggggaaagcagacaggttcagagcactttccgcttacagggaacaggacacaggcctccgtgtgtccatagagcaatgtgcaaattgcagtgaggggtagagtaaaacctctacttggagcacagtatctctggcaaacgtggaggactgccgtcaacagcactgctgagtacacccaagtgcacagtcagacatttgctcagtaaacagtaaatgcgtaaaataaattaccttgagagggctgcgcctgctccgaacgcatgggtaatgtgaacagagtggctgccgttcaaagtatattcacaggaaaacagggctaggggctcacacacaatggacagacacacacaggttactggaaaagtcatcgtatacagactgcacttgttcaacatggattttggttttgtggactccaaatgcagacacttgttcacctcacagcctcagatttgtctattttgtgtgtatgtgtttatatacatatacatatatatatacacacatacacatagatacgtgtgtattcatatatatacagatatataccttcctttcttaaccaaaacgtcaacgcctactctgaatatcatcattcaagagtgggggaagaaccaagctcttcatgtgaacagggctgggcagggaatgttagtttcggcagtttgctttctccattcagattattcctatcaaagctcacctggtttctgaagcaaaactacaggaatcaaggatcctgtggtccttcaggagggctgcctacaccttcctatctgggccactgagactctttacataggctacaaaaatcagataccccactcaaggggtggtgcggagcaggcaaagggcatgaaaaccacagataaccaaggcattcttattccaagtggtcagtttgaaaaaataaacaaataaacaaaacaacttattcagaatcaagagaaaatactgtgtgagagccagactgtgggcctgcccttcctcaggacccacagcctcatttgttcgtagagaacagtgagacgtgaaggctggcagacgtgtgtctgggatgggggtagggcactggtcacccatgggtgcagatcaaagggcagagacaacgggaagttgcacctccatccgctgccacactgcagggcctcctgctcatccacaggagttccagagacagcccccacccaagcctgcacattatgtatctcctggctcaactatagccaggctctttgaaggccaagttgagaaaaagacacaaacttcccttttccaaaacagaattcttgcctgcccactggtcaaattcttgttttcagcttgcttttgttgttgtttttttttttcttaaaaaaaaaaaaaaaaggcaggtatataatcttccagcctggaaccagcctgtggccagccagatcctgctgagaagggaggggcccctccagaacaccctggcaccgcgagctcgtcagctggaatttgagagcacaagtcccttaccaatccaccacacaactgccagtcaactctcctccccaccacagcagaacacaattctggctccacagatgctggtagcaaggggagacaatccctgggcctctgtgagcttccttcttcatccagggctgagaccagccacctcctctggacagagatgcagcgaggttctcatacactaacaccggaaagcacatccattccatcaccaagagtcacctcagggcacggtctcattccctccttgggggcttttgaacacacatctctctgacccaagcaggcagtgagatgtgactttaaaagaggtaaaggggaatggggtggggtatgaggaatgagtcacaggataacttctcagccctccacagca

SEQ ID NO: 49771 - DNA, 1667 bp, Bovine  19866880611972
gcattgaatatacttacagtgttgtacagcctcaccactgtctacttccaaactgtcttcttaaccccaaacataaagtatatccacgaagcaataactcccccttcgcctccccccaggccctggtaaactctaatctgtctctgtgaatatgcctatttcacttaagtggaatcatataacatttggtcttttgtgactggcttgtttcactaggcgtaatgttttcaaggttcatctactttgtagcatacgtcagaacttcattcatttcctaaatatttgtttatttggttgtgctgggagttggctgcagtactcaagatctttagtcttcattgcagcatgtgggttctagttccctggccagggattgaacctgagccccctgcattagaggtgtagaatcttagccaccggaccacaagggaaggcccctccactccttcttatgactgaacaatcttctagtaagcgggtatgccacctttcgtttgttcatcctcagttgatggacacttaggttgtttccactttcggctactgtgaataatgctgctatggacaggggtgtacacgtccacagcatgtacatagtatctatttgggtccctgttttcaattttgggggtggtaaatacgtggaagtggaatcgctgggtcatatagtaactctattgttacttaacctgttttacggagaaggaaatggcaccccactccagtgttcttgcctggaaaatcccagggacgggggagcctggtgggctgccgtctctgggctcgcacagagtcggacatgactgaagtgacttagcagcaacctgttttaaaattcagtttcctctctataatgggaataacagtggaatatacttcttgttttttaaagtttaatgttcatttattcatttattaatcaattaattaactattggcttccaagaccttaacttttcaaaagccctttgttcccaacgttagtgtggacgatgctcttgcaggatgcctttccttttgggtcttagacaggtaatggaacgggtggtctggggattgggttcggaaagggaagggggtgggagcttacttatcgcactactgctttgggtggagggagccttttagaaaatgtctcgcagttatagcaggccagctcccttacagaattttccaggcttttcttcctgctttctagttgctccttactcccctggccaccgggttcttaacccccatgtatccctgagctcttgctggattatctgttctgattttccatgagacaccgtaaaaccattgccaaagccttagtgaggaaacagttgaggggtgaggccgggaaggggagaggcggagcaggattcctgatcaaaaccccttttattccttctccattttgattgggttagtgagcaaagatttcttcacagttctctgcttctgaagagattctgagttggggtggggggtcttcttttaaagggaagggctccttttagagactttctccttttaagcctgtggtcagggctgtgggtccgatggacgtcctgaatgtttcagaggggtgggggtgggactgaccacactctggtcttcctgatggatttttccaagccagcagacccccgtggcacagacttgagtactttgcgagctgccgt

SEQ ID NO: 49772 - DNA, 2447 bp, Bovine  19866880611973
caattgaggatgaacaaaccaaaggtggcatacccgcttactagaagattgttcagtcataagaaggagtggaggggccttcccttgtggtccggtggctaagattctacacctctaacgcagggggctcaggttcaatccctggccagggaactagaacccacatgctgcaatgaagactaaagatcttgagtactgcagccaactcccagcacaaccaaataaacaaatatttaggaaatgaatgaagttctgacgtatgctacaaagtagatgaaccttgaaaacattacgcctagtgaaacaagccagtcacaaaagaccaaatgttatatgattccacttaagtgaaataggcatattcacagagacagattagagtttaccagggcctggggggaggcgaagggggagttattgcttcgtggatatactttatgtttggggttaagaagacagttttggaagtagacagtggtgatggctgtacaacactgtgaagtatattcaatgctactgaattgtacactcaaaatggcaaatttcatgctatgtatactttaacatactaaacctttttaagtcatatagcaagaaaggggttaagctagaatttgaggctaaacccgtctgacaatagggcccctgatctcaacccaagggtttcactcccccaggcaaaagcagcaaacatggaatgaagagaactgcattcaatgcatcactatctgtgtgactttattcaagccttaccctgggaagcctcactttgctcaactgataaaattggatagctgtctgttgattgtgatttcgtaatacagagtgtcccaagccgtgattcctgatccagatatcatttgcttctgcccactctagagacgttgatagacagtgagcaagggacagggactagctatctgtgcccttacctagcccctcccctaggggtttgccctggtgtggagccagctcttgaaagaagcctcctctcccttcctcattctggaagaggactcctggctgtgctgcaggataaacttccacaaggtgagcattaacataaagtcaaggagaaggtcaggggagcccttaaaaaggccttcttgcaccctaaggtggctgaagccactccacagctctttgtcctgactgctgccacccagacacaatgtggctgctcctggctgtctttctgctcaccctcgcctatttattttggcccaagaccaagcactctggtgccaagtaccccaggagcctcccatccctgcccctggtgggcagcctgccgttcctccccagacgtggccagcagcacaagaacttcttcaagctgcaggaaaaatatggccccatctattcctttcgtttgggttccaagacgactgtgatgattggacaccaccagttggccagggaggtgcttctcaagaagggcaaggaattctctgggcgtcccaaagtggtaagtaatgcctctgacccctcccctcaccagcccctgggcacgttgagctcttcagccaaggccatgcctgcaatgccccttctagttccagaagaatcctgtgattcttccagtaacagcctggtggggctgtgggtggggagcgacccctcagacttcacccagcttctaagctaggcaggaagaattaaaggaagactttattttctggctttttctggaggtgggacagggtgggagtggtggtttgagggggtcagggagcccttacaacatcatctctcccagctgaaaaagtgaaagtgtgagctgctgagtcttgaccgactccttgcaaccccatggactagcccacaacactcctctctccacagatttctccaggcaagcatactagagtgggttgccatttcctactctggggtagcctcctgacccgggaatcgaacccaggtctcacccattgtgtaaaagttctttatcatctaagccacttggaaagcccaagagtctagctctctgagcctgaaatctgagctctcatgattcactgaaagagtatctgtaaagcatttagcccagtgctggaagttctcaataactagccttgatgaacactgttcacatggaaaacgggttagtgattcctgtcctccgcaaaaagttgtgagggggaagtaccctgattcttggagggctgggatcactatttccctggggcttcctcgagctgctccagccctggggaattgacctatgcaagcacttttggggaggacgctgaagattcaacctgtcgagctttctgtttgttcccgggggcagaagggagtaggagctagtcaaccaggaacactgccagcctccaatacagcacctggctgaggggactcccctgaatgtcctgggcaatgccccctggctgctcatctttgatcagaccaaggcttgactcttctttgcttgggccagtcgg

SEQ ID NO: 49773 - DNA, 2853 bp, Bovine  19866880616711
cttcgagagtcccaagtcccagaactgcacaggcttttcccacagttgcatcacaacggcgtgtctgttcctcgtgagagcatccaggagctgatgcatcgcggctgtctatctccagtgtcctgttgataggatctgttaacattctcagctccaggtctgaaatatacaaagaacagggcctgtttgttcaatctaagcttctaaggtttaactcccaaaggaaattaaattaggtgcctggagctatgacagtctgtcgtgtttctttgtagggaatgtcacccttaatatcatgcagatctcatggacaattttccccattcaattcttttaaaataatgcgaagtttccagcaggaaccagccaatcactaaaagtgaaaattgaggagccactagggtttgtccctccttttggtcctgccgtcccctcccccagctgagtataaaatgagtccacacacagatattaatagtacacatttggtagttgatctaccgaaagccaccataactcatactctctccaccaccaactccacacctttgtcagaagaactggcttaggactgaactcctgttggtgggattattttccccatttctccagctctttggagcctctctgtgtggtcaccattcctgtgaaccctcccccaccccctctcacccccagcactagttacagtcccaggcctatttacctctctggcagaaatgtccaccctcccaagtatttgtgggttagaaatcggttcagcctggcccggactggagccattgtaatataattgggttttaggtatgcttgtgtttgtgctcacatttgcagagatggcaacaagccccggaaattcccaaaatgtgaatatgacttttgtactgctcaagcagactggtgataactggtcgagagactccaggctttggggggtgggggtggtggtgggggaaccctaggataagagcaagaggaacagaggctccggctgtgggagctggaatcagtggcattgggcagcgccacagtagtccatgagaggagttaccgggtcccagcttagggagccaggaggaaggtgggagggagcatctcaggtgggcattctcacagacccgctttgcctgtccaaactttgtctctgtctccacttgaagcctaagcttcttaaacagaaactggtgaggagatacgggctggtggttggagctgttttgtccctgactgtgggcttgtagcctgagaaggagacgacctttggctccctgttaaccccaggaagaagcttgtccagctggggaatggactgctttcatggctgtttccctagggctccacccagggccaggcctagcaaaggcacccagggaatgcttctggaatcaagtaggttgatgggcaggtgaccggaagaatcaatacatgagtaaatgccgtgagggttagacttcaggaattggaagctctgctttgcacactaactttagagtccagagaagactgggacatggggacttccctggtggtccagtggttaagactccgccttccagtgcagggggcctgggttaaatctgtggttggggaactaaggtcttacatgccatggggcaactaagcctgcacaccccagtgaagacccagctcagccaaaaaaataaggaccaggagatgatcttttctccgctgctcacaagccatgtgacactgggcaaatctcataacctatctgtgtctcagtttcctcatctgaaggagataagctctatgagcgcttagcacagtgcccggtgtggtgatattttgtctgcccacttggggtagttttctcattccttgctcacacctccacccagtcaacttcctcccttcggaaacttccctcctgtgaggtgcctagtgagcctgcttgcttgccctccttcctctgccattccactttgtctgatacactgacctattccaaatgttgagccatatgttcttatcagaatggacaattccctggggaaacctgctggtattttctcaagtcctggatcctcctccttgtcataggggatttttcccacaccttggtcttcacctcgttgtttctcttcctctgtccccacatcccaccctggggcattcagaggctactggagaaggcaaagtagaggtggggagagccacagcctggggttacagaagggtccactgcagaagtcaggaggtcccatggaccagcatgcggaggagatgggtggaagacaggatcaggttgggaagaggaaagacatgcccagcctgggcccagtgtgggactggcctgaatagaggagcctgttgagaagatggccctgcaggttgaggaagtcctgggtatccttgctgttgactgcatgcatggttgactacacacatggttgagggtggtggttgtgcccctgtacgaaggggcaaggctgttctcaacagcaagcgtgaagcctcaaggtagcagaccagagtagtgaagtgggataggtgggaggtgccctggagaagacgtttcttaaaacttgtaggactcagtggctgaatggggctggcaaggcagggctttgggagcttggggcctgagaaaagatagacactacgcatgggagttgaggtgtccctttcccttcgctaaaatgagagaggctggtgcagctcatacattcctagaggtaccttccagggcatttccagattccaggcaaggcttgtattccaaacctggacagattccttttgtcctcccaagcggggctcggggaacacacaaaccttgttgaacaaggaagatgttggagtcactctcctctgccctgcggcttttctgtt

SEQ ID NO: 49774 - DNA, 1634 bp, Bovine  19866880688807
ggtaggtactcaataaatgttgaaggaacgggtgaaggccccatgttccacaatgggatgaaacaccgtttaacttttcagaaaattcatgtgtgaaaataatgacctttcaggcaaagaagggtggagccccaagcgtgttgcctctcttcactgccaagtagaaaattttcccaaagtcaaagagctccttaagggcagggaccttatcttttccatcaaagacaaaatgttgattgtgtttggggattttagtggatttatttaagcatctaaagtgttaaaagcaagtgaagaagaataacttaaaccaaggatgttctagtttattagttaaaagctcaggatctggagtcagatgaattagctagctgcatggcctcaggcaagttacttagcctctcttgacttcagttctcttttactacccacttcatcctcttgtaaggaatttagaacagtgcctagcacataggaggtactcagtattattcacccacctcattctgccttcatggaggctgcatagccattgtttcattcaccaaacctttgtgagcccagcactgtgcccattcttggagttggggatggggattaaggagacagagctcttgcccataggaagggcacaggtttttctctcattcactcttgaggagggaaggggaggggtgggatattaacttcccacttgagacttagcctaaacaatgtaatttgtgtatagtccttggagatgcttggaagaaaagcaaaggatactcatgaagagtgctgagaatttttcatatttgaactttccattgcattctctccagttcctttttctattcgttatgtccgaagcagcccacattgccagtgagctttactgttctgagaaatagttctaagtgaatgcacagtgctctttattgaatactctctcactgaatgcaaagtgctccttattgaatgggctttcatgcccagcaataatgactcagagaataacattgatattaagagctcagagaagttcagttactactgaagttaccacagttaataagcgtagtgtgagagccaaactttgaacccagatctgactgaatcttaaccatttggatcttgagctgcctggagatccctgagagtcctctgggtgacttcctcctatagggaagggtagaagagcagcaagcaacatttgcacacctctattctttgctttgactgagaggagacacaggttacaggaacttttgcattggctgctgccaaaaggcaccccactccagtactcttgcctggaaaatcccatccatggacagaggagcctggtgggctgcagtccatggggtctctaagagtcggacacgactgagcaacttccctttcacttttcactttcatgcattggagaaggaaatggcaacccactcatgttcttgcctggagaatcccagggacgggggagcctggtggctgccgtctctggggtcgcacagagtcggacacgactgaagtgacttagcagcagcagtaacagctgccgaaaggaatgggaagtgggtaggctggtagactcttcaggatgaaggagacatgagtgagcatcttaactagctcttgggccactgagtgagtga

SEQ ID NO: 49775 - DNA, 2498 bp, Bovine  19866880702473
gacatacggcaggtctctccttctacccgcaccccacagtaatccgtttgggaggtcaagtggcaaaaaaaaaaaaaaaaaaaaggctttggagccagacaggccagggttcaagtctgctacttttatgctgtgtgaccttgggcaaatgacttaaccatctctgagcttggggttgctctcctataatattggaacagtgctgtaaactttgtatgggttttataaagatgataatgataccaccaatatttattgagcactttctgtgagttacctcatttaatccttttattcttctgagtagccatgatcacccacttttcccttttacagaagagaaaactgaggctggggttaactagcttgcccaagattctactgtaggcacagtgtgtgcccaggcccagggctgtcaggttagaatatggatgaaagaagatgccctagcatgcgacctgactctgcacttgctagctgtctgccttctcttcccacgcctttatcagtttccttttactccctaatagtggtatgtagtccagcattgttttagctggtgattcccactggcgattccccagttttgtgtgcaaactttctcccagtgagatgactcagaggtctggggttaggagcaggggtggctctgatccctgcagctaactggctccttcttccccagggacaagtatggccagaatgcccatggccatgggcgcacctcagtgctcctggggctgaggctgggctggctgccatgaggctgggtgggccctgggcctggctgctgggcctgcccacggctgtggtctatggctccctggccctctttgtctctgtcctgcacaacgtgttcctgctttactacgtggacacctttgtctcagtgtacaagatcgacaaagctgccttctgggttggagaggtaggccagcactggggcagtcagcccaggtgggagctgggcagatggcagggcagggtcctacccaggcaggagcagagggtaagctggcttgcccactaagattcagcaagaaaaggtagagctggaggcctcagtggggattatgccaactctcccgtcctctgtcctgtgagccaggcactgtatgcacacttataatatattcacatgtatttatcagcagtgccctggatggtgggagtttgatggggggcagtggcttgtgggttatggcagagggactgacctgagcacctgtttgcaggcaggaaagctggcatcatctctgaggggtggcgagcaggctggggtggggaaagccctggagaggacgctgcctggagcccacctacccgtctcccctctgcccacagaccgtgtttctcctctggaacagtctcaacgaccccctcttcggctggctgagtgaccgtcagttcctcagctcccaaccccggtttgtttcctggggaaagctcaggcctggtcctctcccacctccccctccccagggctggaggaccgctgcctgtgtgtggggtggggaaagaaagggaaaccactgccagccgttggctgggccttctcatttcctgagttcaggcagggagtggggcctgccagggctgccagggcatctcccaacggcccccctctccctggcaggtcaggtgctgggctctcctcacgggctgtggtgctggcacgggtgcgggcactgggctggcatgggccgctgctggcactgtcgttcctggcattctgggtgccctgggcacctgctgggctgcagttcttgctgtgcctgtgcctctacgacggcttcctgacgctcgtagacctgcaccatcatgccttgctggccgacctggctctctcagcccacgaccgcacccacctcaacttctactgctccctcttcagcgcggccggctccctgtctgtctttgcctcctacgccttctggaacaaagaggacttctcttccttccgcgccttctgcctggcgctggccactggctctgggctgggctttgtgggggccgcacggctgctgaggcggcgggttgaggcggccggcagggagccagggtgcccagccatggctgtgaatgacgggtgagtggccagcactctgctgggcttgattgccatgctggggctcctggctgatggatggctgcctggggtgggtgatgtctctggcccagcttaagctgttcttgattcccctctgccccgtagcctatgtgaagaagagctgcttgtgggcggcgaggaggcgggtagcatcaccttgggccagtacctccagcagctggcacgccaccggaacttcctgtggttcgtgggcatggacttggtgcaggtatgggagcaatgcccattcataggatggcttcaaatgcctcactcaagggaaccaccttcccagaagctggaaaatcagttctggccttgcctgaggctgagccgctgaatggcaggaatacaagttgggtagttagagacctgattctcactgcat

SEQ ID NO: 49776 - DNA, 1900 bp, Bovine  19866880747220
attctttggcactcagctctcaatagttcagatctcaatagcctatggaaaggcttgtagttacagattactagaagagatacttttttcctctcaattcagacctttcttattctcgctgtgtgccagtgggctcttttttctagtctgctttctctctttgagggttttcaccttacattggaactcaggtccaagtgcctgttttaggtggactcaagaaaataaaacagctcctttccacagccactggaaaggcctgatctcatttatcactgtagtttctagttccccacccccaacatttttggccctggggttcttccttgctttcagctatataattaaaataatattatgatattttttaagttacctactcagctatatcatcagaagcaagatctttccccctagagtctcttgctcagtgcagtagctgtagcatctaacacaatgcctggcttgtgaagaaagtgatatcaatacatatttgttattcaattttagaaatgggtgtttccattaggaaaccattcctcttcccagtagagaaggccagagatggtgctccaaattcactagtacccaacagccaagagatttagcgtttgtgatttagcaacttgtgaaggatttcagttttcctatttttcactattaaacgttaatgctttcctaagggcatgaagatgctgttgccagttgctagcagggttttccagccccataaatcggcaaattaaaaccatccctggggaactattattgcccagtgtctctttttatgctggcattttgaaagttcttacactgattaaattgacctttacagtggctcagctaagaatagcaactcaaagacatggaaactcttaaggaaaatgatgttagtcccatagtttatgctgccgccaaagagatgagataattttttgcatatgtgcaaagacatactattcatccttttccattgtaaaaaatgttctttccagttcattgttggtctagctcactggttcttcctgcctgtgctttttgtttggtgaccatatatgccctgtttcttagagcagctggtcactgtgctaccagaagtcacacctataacaaatgagaattttgagggtcatcaccacagttattctgaggtgaaaggcctcagcatatgagcatgtgttattcactcaaagttcctttttgacaagtctacatttcttgtattttggggccaggagtttgtgcaaatggaacattgctgagaagtatctttaaaatgcgaatctcatcttacccccacgcacctaactcactacctactttttcaagcatctacagctgaaggactttccttgtactgtttcctttgttcttcccacccctcttccgtggctactaactttctaaccatcctggcagtctcagttcaggcttaccttcctcacagctgtctggacctccttaactagtttctgttgtaaactcttaccaaatgaggtgtttttccttcctacttgcagttttatgtgtatgattactttatcatcttttgttagactttaagctccatgagggtaaagacctttatttatttatttttaagcttgttttattttattttaacattttatttatttctttttgcctgtgctgggtcttcattgctgcgtgcaggctttctctagttgtagcaagtcggggctactctctagtggtacgcggacttctcattgcagtggcttctcgtttcagagcacgggctcgggggtgctcagatttaagtagttgcagcaggcaggctcagtggttgtggctcataggctctagagtgtagactcagggagttgtaatgcatgggctcagttgccccacagcatgtgaaatcctcggaccaaggatt

SEQ ID NO: 49777 - DNA, 991 bp, Bovine  19866880798844
tggacagaggagcctggcaggctatggtccatagggtcgcaaagagtcagacaggactgaagtgacttagcaggcaggcaggccagccatcgtgcgaagttctgtaaacaccaccccaagccagtctggcatggaccctcccctcaggaatctttccttgccagtgggcacctttgaggtaatatccttgttgactgttgcctccctgacacctcccagctccagttcaggtcctcctctgggcagtaacaggaaaggcacaaacccccagcctccaaacactttagacagatcagccttcctgaaccagagcggagttaagtcttcccagcttcccatactccaggttgcaggcagcagctatggaaagtgcccccgccccgcccgccagcaggtcagctggtggggcccgacctctgagcgccctctgctggcaggactggggctctcacacacatctggaggacactgcccctcagcagggctccccattcaaatcccctctgcctccataacagatacccagtagaaagctgcccctcaccctccacgttctgccttgggttcctgcagctgagtaaatatttttcctatctctttgagtgcattcatgttgagttacatacaataaaagaagcccagccccctctgtaatcagccgtaaaacaagagggaagacggtattcagtgggaacactgctcttgatttctctaagatgatttgataaaatagtgcaagtctctatagatcaggaaatattgaggtacgcacctttgatggtgtttgtgcgggttcctacagatggaaagtgccacgtaagtgctgagctattcaccttagaaggcaaaaagaagatggttatcttattcatctctcttttatttgtaaaatcttttttgtctcctggcaggtgatcttttttttttcctggaaaccaattagctcctaaaattaaacatccttctcttgaaattagtccttttcataaaa

SEQ ID NO: 49778 - DNA, 1987 bp, Bovine  19866880856375
cccccccaaatcatagaaaagcaaactggccacacccccagacacacgccttacggcaatgaggggagatgccatctctctagacgctgttgccccctcacagcaccctgcagcggtactgtcccgttctcacggcactgtgtcaccaccctggcaggtataccagatgttgaaaataaggcgtagggggcatgctgggggcttcagaatcaagaagcggtcctagagggctgactctaagggttgactggcttgaggttgcttggcaggatgcgtcagagctgcaattgttgatcattctttgaggacactgcctctctggtgtctgggttaccatcgtgttctgtcccaaattaatatcaaatgaaggggagcctgctcttccggtacacagttcctcggtgtaaagcgtaaggcttttaggcggcagaagcctccctgtgggacaccaacccaaagcagcaggaaatagacaccaaccctgagggtagttgagacagccaacagaaaaaaacgaaacacttctaggataactagtgtgtggttgatggctctgttaccttgagagtaccaggtaacagagcactggtattagcatccataatagcagattcaactcaaaaccctcagcccagtcatcagagaatcctagagttgggaaagcagttttgaaatcttctgttccgacctcctccctaattgggcagcttgttgcttgtgtggggtggtttatctctggctttcctggaccagttaatgatatcagattggttgctaagtaggaaagaatcagacgcctccaggccctccacatcctggaatggttcatctgtccatcaaaggctatttgtttcatatctttttctatctagatccgtgcaaccaatgagacaggctaccttggttgccaggtgaccgagccctccggtgacctcacctgaacgccctctcctgtgagagctgagcaagactggatctgccagaatcggtcgcggatggtgtgcaggttcagtccttctgcaatttcagaggcaggggctgctgtgagcagatcctgcttattagcaaagatgagcacgggcacgcaacttagcttttcttcctccagtaattcagctagttcctggatcatttggggaatagatggggaagagggggacgaaatctatgatatttaaccatgtacttctaattgaaactaaataaaagttaagctgatcaactagtaactttcaagggcagtagttctcaaacttgagcgtgtggaagaatcccctggcagatttctgggcccaccccaaagatgctgactttggaaagtctaagccagggcccaggaatctgcatgtactcctactaataaagtagttctgttatagggggattcataaatcatgcttagagaaactcaagggagaacaaaagttgtggttagacatttaaaacttacccaaggttattatatgcaaataactttcaatgcatatatatacacatatacatatgtatatatgtacagatacatatatatttttaaaaacttgaataaaaatgacagttgctttagagactataattctggttcatcaatctctatctccaaaacatgcatgcatgtgcattacatttcctcaaacccacatcctaaagtaactgcgttagtctatctgacaaggtctctgagttttaggtgattgtttgggatctaaactgtatgttaattctgtctgcaacaagtccaggagaaggtatatacttacctaaaagccaggacccaccccttcctccctcgacccacactttggccagttaaaacactggagctgtcagagagaactggatggtttgacgggcagatccctgtctgacacctttcagccccaagttcatgtgtagcactggttcacatgagtgatggtccagaaatcatcgaggtatggaagggagaagggctgtctccaggcgagttctcaaactaatttccagg

SEQ ID NO: 49779 - DNA, 869 bp, Bovine  19866880879847
cccagacaagctggaacacaggtctcctgactcttaggagtctttcctcttcctaccccttcccaggccgtgaaagtcaagatttgttttgcttattccaatccagtgaggatgtcccatgtcttctctcaataggcctgtaagcctagttaggtttctaggcagtcagacagcacagactccagtcctactatttccctaccctgggataaggggcaatgatcacgactttttacttctgggggacttgggactcagttccctggctccaccacttcttttacaggaaccgtcattttgtgagtctctgctttactccttagagggattttgtgggcattaaatgagaaataggggtgtaaaagttttgttgtcaacaggaatattaaccgtatcttccatcctgacaacctgggtggcacccattgcaaagggcacacctgttgcaaacagtccagcacaagagcctaagtgtccaggggtagagtctcttcacccagttcctggagagtcctagaggccccatgaaccttgcccccagcgtccatctcccactagtctgtctcattttcctcctccccaatcctgcccttcagaccctcttcttaccacctgtatcctccccgccttggccacacaggcatcatctctcttctaaagacttcaagcaattgctgaatcccctcatgttctagaaagccctcattactagaatgaagactaccatttctctcccattgctaccccttatccctgtctatgctttcctggctgtgagaatagaaggcaggaaacccagcattcagtatggactctgatacactaggtcccccataaatgactaaaggagtctttctggcatcccatct

SEQ ID NO: 49780 - DNA, 1321 bp, Bovine  19866880919793
agccgagcggagccatcgctgggtaggggcggaagaagaggctggagaagctacaggcggcccgcgcgcaggcgcactggctggcagctggctcccggcagccgtgggattaggcttcgcgtgccacaattgcggtgagcggctggccggcggcaggggctagggggcagcgggccggactgggggccagtcagacacaaaggacacacggagggggacaggagtgctgtctgctctgggagtcctgggggctgtcttcgggggttcctgaagtgatctggttgtggattgagaaagtgcttgggtcagggtgggaaaagcttgagctcaaggggtgaggatggaattcttgcagaggggactccctagagtcgccggcagctttaggccgggatccatttcattaacataatggcctttaaccctggtgatgtagtagaacctatagaggagctttaaaagaacaccgatgctgggccccttctctagagattccaatttatttaattggttgggagtgaggctgggccttggtttgattgagcagctcctcgggtgattttaatgtgcagacaggctggagagccaccacatggttcagcaccatggttgatcccagactcctctgtggcttggaacgggtgggtggtcttggggtgaagttactgaccctccaaggaaatggtcccaactcccaacagggtgaaattgacttctagcctaagaaagaggatgggcccattagtcactgcatggaaagtgggcacccttccagggtgggcctccccaacagccctgccaggggttgtgggaagactaaacagggagacaaaggggatgtgaaacaggaaactcagcagacaattcaaaggtcaccttgttgaaaaaaggacaaccttaatatttgcatagggttttatacctttaaaattcatttaataccccctggggacagacagggaatggaatttttctcccgctttgcagatataggaataaactagttagtgaatagctagttagtgataaggttcagacttgcagggctcccaactccaaataatgcttactagtagatttttcccctccatactaattgcttctcatacagtctgcagtccttcgggagcccctcaccccagggggccctatctggcccccttggttttctctcccaagtttatcagctccctgcccaccataggctggttcaaagagcagggagctactcttgtttccgtgcttttctagttatttccaggagcccgatggggtgaagaggggagcatttttgaaagatgcggggggggattcttctaaa

SEQ ID NO: 49781 - DNA, 1511 bp, Bovine  19866880980137
tggggccaggtcagtgggatgttgagtcatcttcccaccttggtcccatcccagggaaccctgcctcttcacagatctgccaaggaccaggaggtgagaaaagagtctcttggtggaattatttctttgcaagatgctttgctggtcttcggggtaaagcttactactctggtcccctacactgagattttggtctaagacttatttctgcaaacacacactaaaaagaaaattaatgttggttgatcaaagggtgggcttagggtagatgctgaacatgattagtgatttttctagctgtttgttacagcctcatggatcttacttaaaagaatttttttaaaatagccaataatggttgaaattttggacaaagctgtgaatccttccttaaattagctctttttcgcaaaagcaactgaatgagtctaataactgtacagtctctcagaacctccctggggcttggcacatcattagaacaagcaggaaggaaagaaaagggtcagatatttgcatgaggggtttaagttgttctttatggaaagaaaaccttttataattgctatcacatgtgtttgtattttatgcaggaccaagtatcttactcttcaaaacataaagaaagggggaagcatagagaaaggaagtagagcagctataagcacatgtctttatatatggctgcttttcttttgaagatagttagggatgccctttctttaaaaccatgactgcttctctagccaagactagcatgctgagcttccaacaggagagccataccctccttctccaaggcccacccgcctaggttcagaggtaagggtgcttgcccctgcccttactttgtatctgcaagacagtgtgtgtgtgggcggggggtagagtctataaactggtctcatactcaggcctttcccatcagaggcctgggcagagctgaggccagtatgatcctcgggtttggcacggctttcaggctagagctgggccctgtgtcaattctgtgggtggccagggcttgttctcctgcacttgggtggactatggtcgtttcctgtaactgttctagggcttccactcacctccccgacctcagattgcaaggggcaaacctaaaacacaatggtccctgctggaggtacaatgtgaaatacatacacacaaaacccaggagaaatgggtcagtaaagctccctccattccaccttgctggagatctcactggcggtttaaatactgccaagaaatgctaaaacccagcctgggcaaggggaaggcaaggcccccacctttgccggagagccgccggggctgagcgcccacgcagatgctccggctgtcctcgtcatcctcggggggccggctcaggtcatcccaggcgcacttggcactgacaccactcaggttggagccgtctgtctcgatgcctttgtcaactcgctcctgctggaaagaaccaaagagccagagttccttcagccaaccagggcccaaggtcaccaccc

SEQ ID NO: 49782 - DNA, 1942 bp, Bovine  19866880986139
tgtcctttgggagaggtgtctgtaatcccaaactcaacccaccactacccctccctcttgtcttgttccccaaagactggtaggtctccttttccttgttctgtactggagtaaccatgaccagggaagggcttccacagcagccttttgctgaagcaccaaggctctgtccccattccccacccccaaaccccaggaagtctataaacgtcttactagaaaacagaaccttgttcaaaccttaaaaccagcatctttaaaccttggctgctcaccagtctgcaaggaaacgatgtcctgagatgccctgggagaaactggcccttgctctttagcctagacagaggccccaaccacagctccttggcgccagccagaccagggtcagatcatcagcgacccaatccttccgactggagaagggctctggaccagctggcagggcaagattgagaccctcctggccaagttccagacagacgaaatcaagggagccccacaaggagggagggtcaaagttttccatcacagcagcatcttcttccttcagagagctttgctaatccaggggtacctgactcctgtcccccaactcagtcctagccttccctggcccatgaccctgaggccttgctaaagagcccagaggagacggtgggcagctgtggctgactcagcccccagcacacgcagccgagagagatgacaccacccgtgagctgatgagaaagaggttaaactggaggtggcaccgtccttctcacgggtcccttgaccccatcggccggtcgctgatccagagctgagcaacccctcagctcagaaagtggagagcgtcccagctggaggagggaagtgatccaatctgctcagactctgaaaggaacaggtaaacaacatcccctttagaagaggtgggcgagtgtaactgggatggaatcaaccactccccaactactgattcagaccattgactggccgtgaaatgagaggtgaagaggagaaacctgagggccaggggggcaggcatgtggggatgacgtgccctaaatcacccagcgactcagcagcagggctggggcaagaacccaggatatttcagtgatgtggaatgagaagccagcacgctctacccacaggtcttctgcatctgtgcagaagggcttggctgtctggctggcaagagagggtagagttgagtgtcctttcaggaagtgacctctgacacctgcccaaactgcccttcccctgcctggaaggccttttcctactgacctaaatccttttagtgctcagcttttgttccttggtgtggaatcgcatgtgcatctgagcacctgcctgagctgcaaatgggtgcggagacctccagggacactgtctgccccagcatctctggaattcaagactgagccctcttgtgttcttttggctgaatgacaacctgacaagcagaaggttagacacacaagagaaatgagtcagatgctctacgtcactcaactaattggtctggtgataaaagaaccctaactccttatgcagaaggaaatccagatctttggcaaagttcgaaggtcttcatcaagactctacagccaccttttcagcctcagactgcccttaaccagagtagtggtgtgatagcaaataaacattaaacaacacaagttatttggtgctggtgggagggaacagccctgatttgtagtttgctgatcactgtggtgtgaacattcccatcatgaccaatttccagccaccaatataatatcacacaggagctggggaagagactcacagtagcaaaacatactatttgccattatattacagttaataccattatacagtattcccaccctacatagacataaacctcaagggcatcgataatagcaatgtagtaaaataattagaaaatgatcagtgttgtgtattt

SEQ ID NO: 49783 - DNA, 2512 bp, Bovine  19866881023374
ctgcctgcagtctgacttatcagggaccttcttcccctcattggctcgagcattggcctctcctaccttgagagcctcttccctgatgctccctcagcggtgggcacctccccccagtcttcatgcctcccccaccctttcattcacagcagcctcccccacctcagccattccccttgcaccatcagcactgaacataactgactccaaattgactccaaagcacttatgagtctctagaatgttcatttgtcagccctcactagaactttaagtttcatgaaaccaaggagcctgagggtccaaatagtaggtggcccataaaatacttgttgaaagaaacgagtgaacaaatgagtgagctgctcagatgcctttggagaaagaaactgttttatgtacatcactgccagggctgcaggctgggaaagaaggcagagtgggaggggaggaagaaggaatggtgggagggggtgggggagctccctctaattctgtgcggtgggggtcacatagggtggagtgcatgaggtgctaccctcagcctgggcttccttccaggcctggcgcacctcgatcttcaccttgaaaggtttgatctgcaaaacgagactggcatggccctccagagagggtagcttcccatcatccgggatctccaggttgaacctctgcagcagccgggacatgaagaggaagagctcctggcgggctagcatctcacctacgcaggagcggggtcctgctccaaagggcaagtagcttaacgatggcgagatgagttgcgcccccgtggggtccaagaagcgctctgcagacacggggaggcgtcagccaggggccagggtcagtgtcagtagaggagtagggggaggacaagccctgcctggggagccccagtctgagaaggtggacagccttatttgggtgggggggggggcggcaatcttaggagagataaatgccctgctctcaggtagcccttaatcacacagagaagatggaatattcaggaaggatgaaaaggtgtattaaacatgaaaatggcaccatcccacaggagagggggctgacttcacaggagacatatgcctatgggccttctcagaagaggaggctgcagttggtggaaggagagtggggaacccagctgtgaagaatctgggtaagtgtagggtaggctaggggtgtcaacaggtccatgtagtgggagtcaggagtcttctagcaggaagcttggcagaagggaagcaatgctggagaggtgggcacagagggggctgtgtggctggcggggcaggacagaacagggactcaccgggcatgaacaggtcgggatgctgccactccttctcactgtgatgcagtgcccacaggttgaccacaacgtctgtgcctttgtcaatggtaaggtcgccaatgctgctccagagagggagaggaaaagagggtctggagtatcgttcttccccaccttctctgccccaagtctccgtggtcactaccctggggaaaagagtcctttgctccctcatgcccgctccctcatgcccactccctcatgcccactcctgcatcttctcctcagcttctgccagattgaatatgaatccagccctctcttcctgagtagcacttaggatcaacacttgtgggtctgttagggcctgtgggtgtgcatattgagctggtgcgtgtgtgcatgagtgcgtgtgtgtgtgtgttgcggcttttggattgggtaggagcacgtgtctcccaggcagcgggcagcttctgagggaggtcaggtcgatgggtcagtgggtatcagtgggtaggagacacactggtcagtaggtcgtgggtacgatgatcggttgtcagtggttgactgtaggttgaccagccagctggaagggtcagatgctgggggagggaccaggagggttgggtgttcctgggagggaaggcacacctggagtcaatgcacagccttgtgggggatcagcgtaggggccacaggccggattcggagcacttctctgatggtcgcctccagcaggacaaggcggttccggtcactgatggttggggtgcgattgaaacctataatctggtcaatgtcatcctggatcctcttcttcaactgggggccagaacagggtggatgttaccaggatgtatcagcccaggaggagcaagggcttagaagaacctactgtcacacccagaagggcaagacccttcccagaggtggctctacaaccctggctttgcttgcagaagatgaggcagctccacccaaaggccagagccaaccactgcttgggtaaagggtgcagcacagtcatcctgcgaatcctgcgaagaacccccgagatactgactctccctttctctggagcagaggtgagtgtgcctggggtcaggagtgcttgggaaggctcgggtagagagaaactcactgaaggatggtgtagcaggtaggccacgatccactttatcacagacgggggtctctacaccagcc

SEQ ID NO: 49784 - DNA, 755 bp, Bovine  19866881034973
cagacggcgcaccgacccctgccaacttagttcagcaaaacctccatcccaatcgcctttcacgcccgtaaaccatcagctcatcccagccctcacggccagtcctcaggcagcttcttgccctcctgtaggcagcctcgcaccaccaggactcctccagcccggattttaacacggatgtgtgggagacgggtgcgcaacccatgacgcccccgctcctcagcctggcacacgaaggtactggaggccataaagagatccacaggtagcgcctttccttgccacgtggctttggcaggtggaagcccagcccgcgccgcagcctcgcctgggcagtcaggacagaaatgcaaactccctcctgggatgtggggaataaaacctggcacaggtagatgttgcaggaggcctcctctcaagatccttacctggatccgggagaaacggactaacacagccgcttccaaaagcagcccgctttggcagccaggccaggatgcccttctggcctccgccagggaacctcccctcgccccgccctcacaccctccctctggaccaatcacaagcctggtggcccccgccagccacgtgggcgagatttcaccattccccaggtctctgcagcctgccgccttctccggccgctccagcagcccgcctgcgcagtgggagggcagattggcgcgcttgcgcacattggggaaagcggagctggaccccgccccgttctgctgctttgctcctctgccgtg

SEQ ID NO: 49785 - DNA, 724 bp, Bovine  19866881051950
ctgcggtcttctgagaacacagctgttgccaactatttgttccgggcttctgagatcaggccacccctgccccctctttggtctgagaggcaagtctgtattggaatgtgtagctgtaatcagcagcggctgtaagcgggggtggggacagacacacacccttctgctgcctgttcctgggtgagaaaaagccacagatgtgatcaaaccagagtcttacaaaagaaatatatatgcttctagggactgctgtttaacctcatgcttagaacaggactagagtgtcccttgggtggcctgaaattcttctaaaagtaagcttttctgaaaagctccacatgttctattactgcttttgttactgttcagagttcctttgatgcagagacaggcagagagagtggggaccctattggagcacttcctctgtccctcaggaagggctgtccttttgacttgtgggcagagtaagccctggcgaggattttgagcagtgttggaaataggaagcatctcatgctatgtcagcaggtggggaatgctgctgctgctgctgctgctaagtcgctttagttgtgtccgactctgtgcgacccgagatggcagcctaccaggctcctctgcccatgggattttccaggcaagagcactgaagtggggtaacattgccttctctgagatatatatatatatatatatatatgtgtgtgtgtgtgtgtatata

SEQ ID NO: 49786 - DNA, 1567 bp, Bovine  19866881090844
catgcccccagccccaccaacgagatcaaaggcggggcccagagcggttcacttccacaagcgctgtggtggccatttttaagaagggcaattgcccacaagtgggcggggcttctgtttccagtcccatttgtctcagggttttggacgggttctcgcggcggccatttttttttgagggtagggaggagttaggcatgaagattacgccatgggtggagtctcaccgactgactgtatgccctcctagttccttgtctgcccagaccaaggacgtttggcccaacccagtgtattcccatccaccttatttccgagccccccaaatctcgctcaaatcctgtatcttcccctcgacttctccttgtttttcccgtcttcgcacaaacccgtggctcactggttgattctggtggcccctatactcccagacctggtgttccccaaatcccactgtctctcctcctacgtgtccagtccagattcaagccctgtcacccatcaaaaataatcagcctaaattcattcccatgctgaagagaagcatttgggacagcaaattttgctccctatgtcagcaaataggaggaggtctttgatgttgtcatagggcatgggaactccccattctggtctcccaagtctatttaattaaggcttctgtttatcaatttttatataggccacacgttgcccagataactcttaagtactgacttgcccgccatgcaagtgtgtgcatgtgtttcgggctccttgtgaccccatggactgtagcccccaggctcctgtgtccatggaattttccaggcaaaaatagtggagtgggttgtcatttcctcctccaggggattttccaaacccaaggatcgaacctgcgtctcctgtattggcaggaggattcattaccacaaagccaccagagaagactatatctgcccctatgcattctcttaacagctatgtctccccaagattagggtggctacagggcctaagtttgggtggtttggatgggggaaggggcagcaggtgctctgaggacccacctgagctcagatgcaggatgcctgcaggccagtacctcaatgctccatgttggcagggctcctcatttaggacaggatggctgaaccccagtacccagtaaagccccagcttcctctttctgttcctgctacctcagcttcccggtgctatccaggggggaagtccagagccttcccttcccagaagtccttcaatgtgtcatgatggaaggagttccattcaagaatgagctctcccattcccagtcacgaggctgagcctcttttcaggtctagtccccctgtaaggtgctgggggcccagagattgtcactatgctgaggagctcatggtccaaggtagaaagtcccattctctatttcctaaggacagaagcaatgccataatatggagaaaaagaggatcaccactccctattccagtcctgtccctcacttcaacctcccacctccccaccaggattctctggcctcaaagtgagcaagatgtgggctgactggggaaagaaggagggagca

SEQ ID NO: 49787 - DNA, 1090 bp, Bovine  19866881109507
gaggcggctagtctgatggggcctgcagatatggggatagaggacagaaggtctgggggaccctgtatagttttgggggtcttctgggcagaagcagcttggcccatgtccaagctgggtggacaagacatgtgcctctcccgatgtgggcctgtattgggcacacggctggcaatggaagggagaactaaagggggctcagctgctgtgcctttagctgcccccatccccagaggacccagggaagggtaggggcctggtgtgtcctcaatctctgctcctacaagtttagagagtccatcccatcacagctgcctcaccctgtcattgatctgaacaatctaattcagagttccttcttttgccttactctgtctctctgttggaactgggagtatcaggccataggttctgtcctgccaaggccttgcagtcagggtggagtgaagcagggagctctataaggaggctgcgcgacagctaccagcctcattgccctcggggagggcaggtggatggtgtctgagtcctatgtccttttctgctttccaaaggccactctagacatcctgtcagacaaccaaaagggcattgcctttgccgaccatggtgcccactggcagctgcatcggaagctggcactgaatgcctttgccctgttcaaggatggcaacctgaagttagagaagatcagtgagtgcctggctggccctgggctgaaggagcctgcagagggttggggagggagagggttctggtacctccattccacattttcttggctaccactgccatctgctggacatctgctctcttcgattcagatggaactggtcgagatggcggtgaagggatgactcaactcccgccctcacacccctctctctccccagttaatcaggaagccaatgtgctctgtgatttcctggccacccagcatggagaggccatagatctgtccgagcctctctctctggcggtgaccaacataatcagctttatctgcttcaacttctccttcaagaatgaggatcctgccctgaaggccatacaaaatgtcaatgaggcatccggaggttcgagcaaggaa

SEQ ID NO: 49788 - DNA, 763 bp, Bovine  19866881243941
gattcccgtaaaggcctatgttgccacttttgtttctaggatttaagtctcccctaaaaacacttaaatttaaatactgaataaattacaatttacatgcaaaccacttaaattttaggccataagatcatttctgaggagttgactgttttatttcagtggagtagaaacacaatctttcaatcaccaatcttaagatcttggaaaagtgcagagaaaccaggaattgttttgccttatagttgatcagtattactaacagatgaaagggaaaatattttacagatccatagcaaccagaaaagaggataaatcaggctgaggaaaagaaatcgtcaggaaaatcaaaaagagtatgaggaagaaaaatgatattaatataaccaggcagctccatttggcttcagttaacttactagggcaatggaaccaggaaaagcgagaactcgacagctctcattggtaatgatggaacatctcctttcagaaaactttacttgaggcaaagatattaagatcgaatacacttgggatatttagagagaagccagccaggtaagcggctgatgagaaactgaactgcagcctagcaacatctcacacctggggacatgctctaactgcctcactcaatcttcctgacttctttcactcaactgcagagcagggatgaggaagcaaaacccggtccacttctcggatctggaaagaaagccctgtggtgtgctaccgggcacaggatgccaaggctgctgacaatccc

SEQ ID NO: 49789 - DNA, 1653 bp, Bovine  19866881262310
ggcccagattccatcccctggtcagggaactagacccaatgaagacagaagatctcaacaaagatctcaactaagacccagtgcagccaaattatatatctatatctttaaagtaagcggacattggaaactatataaaaaggtaatttcttacatcaaaggcatttgaactaataattttggatgacttttcaactctaatattccaaacttccgtgatcgatgagcaagacctgagtttcccagataaatacctcctttcccttatcctcggaagacttcctgagctcaggtctgaaagtctggccagctgttaaatgttctgtcatttacagaacaagcttcaggtccagacactttcttcccgggaagattgagagtattacggagtctccatgaggctgcagaggggccaccagatggcactctagaacctactgcaagatcaacttccttcctcttcctctaagtcttcccggcagccgggcccgctccgggcgggaccagagggctgaggcatatcagcttccccctggggttccccgacttcagaggtggccgagcattaggcggagcatagaaccgagtagcagcaggggcttccagccggcttggacaggcctgggtgtgaggagaccggagccaggtccctcggctggggaatggcgctcggtcagcggatcccgcagcgggttggcagagctagtgcctgtctgagggtcattctcactctggcttccagagctacacaaatgtttctcctccaaggggcgccccagagtcactcccgattggttgtgtaagtccaggagttaaactttcagccaatgaaaaagggcatggcgagtgacgcacggaaacgtcacgggaattcccccctcccgggggcggtaaaggggctttcccggctgcagtcctggtggtgggagaggtgtcgcgacccgtccgaggtgggtccggccgggagagaatcctgaaccggagccgccgccgcggtgagtggccgggttcagacccctgggtggtgggacaccggcaagggtgggaggagggtccttagctgaccgagccctagagctgaagagcggcatctgcgcattcagagagcgcgtatacgaacatgacacgcggatacacatcgatatccttgtacaaagacacggggcgtacgtccatctacacgtatgcccgcagatgcacaggatcgtccatgcactcagactcgcacacacatgcatacgcaaagcacactcacccgtgcacaagtgcctggacacacaccctccacgcagaaactcaacgacaggttcacctgtgccctcagatacatgctgacatgtgtccacactaataagtttaaggactctcacctgtacacgcatgttcacgtcatgcacacaatgcgcaagcacatgggctgaaacatagacacctgtgatgtacctatgttacatacggccatgggacaggggcgggggaggtgcacccaaagcaggtgcggtgtgggaatcaacgactgttgagattttcgggaagagagaatggaggtgcccatcccaacaccccctctggccccttggcctcagagactgcttctcgggacagaaccccggggccctctactcggaagagcccccacctacaggccttcgg

SEQ ID NO: 49790 - DNA, 531 bp, Bovine  19866881323671
cgctgggcggctgcgctcgcgctcgctgtgctccgtgcgatacggtcgcacccaccgcggcgcggagaccctgtgctacggctggccgcagcgttcgcgcagtctcaagcccgtgctctacaccgacctggtggtcagccgcctgcagagccgcaagaagaaaaaggcggtgagggctgtggggccgcagctcacgccaggctggggggagaccgagggggttgctgagggcggcgcgccactgagggggcggcttgagggaggcgtcgaaggcggcacgagccgatgagggcctcgctggggggggagcccgacagggacagagcccatgggtagccaggggtgggcatggatggagagggtagggcagaggccctgagatcaagttggggatctcagaccaaagggtccttctaggtgagagcacgatatggggctcacgcgtggagtttaggacttttggaaggaagacgtggttgtggaccaatggaagtgccgagagggggtaggggatgaactgggaggctggat

SEQ ID NO: 49791 - DNA, 730 bp, Bovine  19866881662190
tgcggtcgtgatatttctgagtctgcaaacagcactgacaatgcccactccttcccctcggtgtgacaatcctcactttgtctggggccttgtttgctcttcgtgttgacacgttgttcttgcttcccaacaagtttggctttctttttccctccctttccttctctcagggaaggaaatgtgttgtttacagggtagggcctgccaaggagctgctctggcacccatgatggcagggaggaggcagggactaggaagccatccagtctgcgtccccccaacaccaacaggccggacaaaagctagacaacggcctggagcacccccccccaaccccaggctcaggggcagaggtgcgggtgcggcaggtaccactgcagcagccacacaatgaggctgcattcatttcctgttctcggtgggtggcgaggggttggctgaggtggccaggagcgggctcagacttctcttgctctggctggcagctggtgagggcacgacaggccctctcagtcctctcctgtacctccccaggcacagtgctgggattgaagccctatggctgtacctgtgacaacgaggaccctcggacagccaagcaaaggtcttctgggattccacattcactagtggaaggagaaatagcagaggaaagcaagaggagctgcgcagggccaaggccagggttcaccaagtgtcttccacacaatgtccaaatgggtgcatggga

SEQ ID NO: 49792 - DNA, 2547 bp, Bovine  19866880234438
atgaggaacacatgtatacctgtggtggattcattttgatatttggcaaaactaatacaattgtgtaaagtttaaaaaaaaaaaaaaacccttctattgagtttttcatctgctatcataactttaattagcaatagctcttcagtgttttttgactctttttttaaaaaacaagctgatcctatttcaaaggtacaacatcctttcttaaatttctgagaaaagaaatggcagaatttttgaaattattcttttctttgcatccttttttggtctttttgtcccttttctcccatttgtgtgatttagtcattgtctttgtgttgaggctttcctcaaatatttggtgattcttggctgcccattctcatttaagagaggataaggttgccagatgagatacagaatagtttaatttgaacttttcataaacaatgaatacattttcagtatatgttaaatatcacattttttatttgctaaatctggccatcttaagagagaagcacagagcagctgaggaaagatctgtgtacatggataaggcttgttgactcctatgtgtcactaagctgatctaaatggatcagctggatacctggccatcagtatctttaaatcttaatgttgggctgggtcagagttcccagaccagagtcattcaacctttagcctaggggattatggcatggctgtcagttccaggaactaagctgagacaagaggctgagattctcatcattcagaatgtgtgcttgtaatgaatcccttgttgtcagttggatattcctagtttcagtcatgcctgtcattctttggtttggaatcttactgataacagccttactggagagtcagtcttcagtcttctgccagagggtgaagggaccacttctcaaacgcagttagcaagtcctatatcagcttcggctgcacacccactttcagaggtatttcttgctgctgctttctgagactttctggtattttgcagtgcaaatcaggttgcttctgggcttccccactgtcaacttaaatttcagcttcatgggtctgctaagcctgttgcccctcaaccatctgctttctatcttccaaaatgttgttgttgttgttttccttcttattctttttgtccttatgggttaatgtctttaaaatcaatccttttattgtcttttttagtgagtttgggagatggagtgtaatgtaaagcatatgttaaatctgccacctctacctagaagcacagctatgaattttcaaagtgactacaggagagtcattcagttgctcttttctcaatgttctttttgtaaaatgagaagactaagagagatgattgttgatgggccccacacaaaattttatgattgtataatctcccacattatcattcttaactgagactgtcaggttacagcttcctaaaccttcaaaataaattctgtgttcagtcttttaaggaatagacaaagacattgtctacattttcaattatattgagcctcccaactctgccacttgctatgatgggaatttctctgaagcctggacttctgtgaaatttatttcccctcaaatgtagacaataatagaaacttcttcataaagctgctgagatgagcaaatgagttaatccataggaaagtgcttcacatatggaaaactgctacacaaatattagttgatgttttgggggaggagtagtgcatcttcttaacataatagttcttggcctttaaagccttctgattgggaaatcatagtatttatctttagttgcctggacttaataggtgatgctactagtccttgaatgttgccagtgagttggttcctatagagcactgagtcctccaagacattaataatactattaatacaggccattcttaatggaaaactattaatatgttaggtaatccacaaagtactttatataaagtcagtcctctgtattcacagtgcaaaactacagttcaggagggtggaatgtaagggacttaggatccagtggattttgttgtccatggatacctggtatcctggaacactggataccaaaggacaactgtatctgcagcatctctaatctttatagcagtcctgcaagataaagtcctattgaactcgttttgcagataagaaaaaatgatgctcacagaagttgtcatctgatcaagttcacttagtaaatagtggagttgggattcaaaccaggtctgtctggcaccaaagtccatgggcactcaaaagaatgctcttaactcttcagaagccactaataaatcttataacattgtgaatgaactttgaataagagctgtaatttggtttcttctagtctcatttctggcatggtctgctttctcatctctattggtctattggtcctgctttctcatctctccccttttgtattcagtgactgtctactcagcctgcaggattccatcaaggtccagcttcttcatgaagtttttctttacttctccaagcaaaaccaactgctcctttgctgctgtgttctctgaccactataat

SEQ ID NO: 49793 - DNA, 1873 bp, Bovine  19866880440577
atggagaaggaaatggtaacccactccaatattcttgcctgggaaatcccatgaccaaaggagcctggccagctacagtccatggggtcacaaagagttggacatgacttagcaactaaaaacaacaaagctttgtaataatgagacttccaaggtgacaagcacaaagtcctctagactctctcccaacacccagttctcttcccctacattctgcctgtaagaggatttaaggaaagacaaataaatgaagtttctgtacctcactatggaaccatcaggagatcccttactggtctttgttttttcatgaccttatacaaccagaagcaaacaaataaaattcagtcaactacctggatattagttctctaaatttaaaaaaatagaatatttggaaaatatccttaataactaacaaaaaagagttggctgttgagtgtaggaactgtgtgtcagtcccttgtttgtttctcccacaagattaaatcctgttcttagcacatagtgcctgaccaatcaattcttgttgattgattatagatggctgaggcgatggcactccactccagtactcttgcctagaaaatcccatggatggaggagcctggtaggctgcagtccatggggtcgcaaagagttggacaccattgagcgacttcactttcacttttcattttcttgcattggagaaggaaatggcaaccactccagtattcttgcctggagaatcccagggatgggggagcccggtgggctgcggtctatggggtcacacagagtcggacatgactgaagcgacttagcagcagtagcagatttacttttaggggactcttttggaaactttccttgatccctcaactcaggtaaaagttgatgacctgtatatctgtatccagttcacgcattggctgagaacgacaaaaaattttgtcaaatggctgttgacaaaattatatctttattaaatggagaaaaatgtggttggctggtaggatccaaatcttttaaaaccatgccttaaaccacatatttgtgtgtgtgtgtgtgtgtgtgtgtgtgttgtttctagatgcatttgtgtgtagttcttttcccctgaccgcacagtggaaacaatagttcgatctcactcttcagcaggtagactcctctagccatcttggaccacttctgtgccacaggcaaagttttcttcttcccaagctctattttgaagcaagttcaaggaaattcaaaacagcagggttgggtgaaaaaaataagaagtcttttgttcagcatgtacagtttgaatcgtgtcaggaaatattgctacttccatttcattacactttactttggaggaaccactttttttttttttttttaacaaagtcaggagaactctaagtcaggaggctgtccacaactgagtctcatggacagatggccggctcaaacacataacaaaggttctgttgtgatgttgccagttctatttcatgaaatcttttttggtataaactggagaaagcactttgttcagttaaagattttttttcctgccagctgtctttgccaaggtcaatgtttctgttacatgggggaagtatacactccctctggcggctgatttaacacatttttctttaccaaaagacccatggatctcagtagctagaatgtcttggtgtgatgtacattcatttaacaaatatttattgaggttatgcatcaggcactgtactaagtggtgtaggaaaacccaagtcttgctctgggtctgcccatgttaactcactgttggacctgttcatgagacagacacttaacctctctctgcttcattttctcagtgccatatatcaacacactgcttatctcaaag

SEQ ID NO: 49794 - DNA, 2094 bp, Bovine  19866880449721
agcagagttggggagctgggaatccatggatgtcaaagggcactataactgttaactctacttgtggattgcttgagtttttgaaattaatagacacattttgcttttttgacaagtttaattaaaaccagtaaaatattcattcaaataaccattcaaatcctgcaaacaggatcctgcaacaggatctagaaatgtaggtgatatattctaacctaattaacttaaaaattatccttcttaaactatatataaaacatatataattatatatatatatatatataatacataaaatgaaagaaaatcatacatgctggaatgggaattctagatctcaaagacaagatgagaaaatcagaattaaacccagacaaactaaagcagtttctgatcaagtcgcatgagatagataggcgttaaaaggcaggtgaccatggaagcactagacatatgtgcatgtatgctaggtcacttcagtcacgtctgactctttgcgaccctatggaccatagcccaccaggctcctctatccatggaattctccaagcaaaaatactggagtggattattgtgcccttctccaggggcacaaccctggagatcccaaccctgtgggatcgaacccacatctcttgagtctcctgcattagcaggtggattctttactactagcgctacctgagaagctatatatgctttgggaaaccccaaaattcatgtgcaataaaacagacattgccttattgaagtgggctggaaataagcccaccatatctctgtaactggaataaatgtagcctataatgggatttttaaaaagtttcccagataattctattgtacagccaacattgaaagccactgctttgaagtacccatttcttgctgatatcatgtatttattttactttcttctttttctggcactgccatagataacatccatgtttctctaaaaactaacttcaccttatcctctccagctgggaaaaggagacaaacctaggtactttcataaaattaaatctagtggctgagaataattaccaatatatcattaagcttattgtggctagaggtttgccaacaaaaagaaaatttttctaattatcagaagggcatgagaaatcattaaatgtgtaattataacattattaataatgtgcctttcgggaagatttttaaattgcagatggtaggacactgaataaaacagggcatttttcctgagtacctaattggaattattttaatgattacaaaaagtatactgtgaacgtttttgcagagatcaaggcattgacagcatgagaacatttgccaactactgttttttttttttttaagctaacttgtcttcttcatcttcacttaatttcgaatacgtaatgcattaagattttccataacattgacaaattcattgatttcccatagacatccagagtttatttctcaaaagcatttatttatttggctgcatagggtcttagttgtggcacacaggccccagtgcctacagatttcagtcgttgtgacatgcaggtttagttgccctgcagcatgtgggatcttagttccccaagcaggaactgaacctgaatcctctgcgttgcaaggcagattcttcaccactggaccaccagggaagtcccagagtatttaattatgattgatgatatgatagtaaatgataggtagttaagaatgttataatgccagagatcatgatttccataatagataggtgccaccaaaattagatttaagtataatttatattaataaacttccttttaatgttttagaaaaatttaatattaaatgcaattttatggtgaatctttatgtaaagtaaattattacaaatgtatcttttgtatatatttggattcccatatgttagttttttccaaagtagctactaaaatattgcttttcatgtcttaaaaaagatgtttaatcacctaacctaaattgattgccatatatttctactccaaatgttaaggtggcaatatcttgtgagtacacatctgatgcttgctttattgcagatggttagtgggataaaatgacttctcaaaaatt

SEQ ID NO: 49795 - DNA, 880 bp, Bovine  19866880553728
tagaacttgtaacaaccccatttttaaatgacactgggaacaatcaacctaaaagctctctttagacagggatttgatcacactagagtgtcccacacatactagacatttcatgacaatgcaaattgacatatgccaagttggccctacataattctccaattcttctggtaaacactgattttttcaatatttggtgacaagataagggataaatagaagttgtgacagcttcctctacctcaccattaggcagtaagtatagtgaaagtaaatctcagaccaaattctgccccatagaaatatttattagctagaaaactgcaaaagagtcacacaagactataccaatgggcttgaaaaagttcctgctccctacctttttggcactccaacaagctttacaataataccctaacaatatatctaaaaaatagcaaacctactaattggagcaggtgacagagtcttgattagatagggagaaaaagaacaaaattttagacccagggcatactttgaagatgttaggcttctgggtttgttaggtccttcagttttgttccttcagggacacttttagcctgatgcatatattgcctcccattcacttactccccaaattatgtcaaacattccttacatcaatcagtgaaccctctggtgcaacatatgaagagctctgggtctggatccctgagcagagaactgcaggggtcatagtattgtaggagagcaggtggtactggctgttaacctattgtgcacatccctgaatttcataaccttacactggtagcttgaaactggccatggtgggaatatttacacaagagaaatcaacaaaatgccaaaaatcaggacttcacccctccctagg

SEQ ID NO: 49796 - DNA, 1032 bp, Bovine  19866880675085
cagcaatacgatatgagtaaaacacacatttctcccctccatgcaattagaaatatttttttaaaggactcttgcttggctgttcttaaaaatgtaactattgaaaaagaaactggcaaagatcttaaggcctggacctcagttcctggccccagtgatgggtttggaaactgcagccacagcaattaggagttccaatttccagttcacagaaggtcaggccgtggggttatgcgtggagcagttctatatttcctctgaggaaaggctccaccaacttcagaggattaggacttgatactgtcgaatcagcatatacattgctaaccatcacaagcaagtttggccccaacaccattcttcaactccttagtgaaagtccagatctgaatattttgtgttctctctcttagacgagagagagagctatcagtcagcaggtatttgctatttcctgtgattcggtagaccagggctcctcaaacccttatgtgcataaaatctcttgggtatttgctaaaatgcaggttttctttcaattagttgagggtagggcccctggttctgaatttctaactagctctcagttggctttgagtagcaagactctagatccagctacactaacctgtagttttactatgtgacactgtaacatttgttacttaaacccaattttcccatcattaataagagattatttcttgtcacaaaacactttccctggccttcagtgaagtctggcttattctaagaaatagactgttttgttcattatgttagctatttttgcagggcagcattgaaatcatttttattgattgaaaccaattacccatggaatgactttaagacactaagtgatcagtgcctacttcagaaccagccagaaataagtccttctgtatctttagccatttttgatggtggttgagagcaacattactgaatccttgtctgatttctctggtaagggagatctccataattgcatgcaaagtactggtaatctgcagaaatgccagccagatt

SEQ ID NO: 49797 - DNA, 719 bp, Bovine  19866880836007
tgaagctgtgaatctctgcatttcaggagtggatgttctcatgatatgagcacatccttgctattttggtggcacaccattcccatatctaactgtcaggttgttccaggcgggagacgacataatcattcagtaattttagaacaaccctgtatgtttctctccagtagggcctcttgatctgaactcttcctgaggattagatttactaccactttggaccctctggtaataggtgccttcatctctttttctcctaaacaggtgcagactcagtcgttaaagagtcatcacgtgacacatttattgccctttggctttcaggttgactcctggaattagccaagaaaatggtcatttccttaggaatgattgctctgttgctggctcaccctacccagaaatctagaccattctctgcactgaagtgtacaataatcacttcaggaaattgctttccctattggaaactgagagctcacatcggaatgtttccacagtacagctgatgataattacgactcactgaaatttcagttttcttttgattgtgacataaaaactaggacataaattaaaacccaattatcctttaagggtaattggggttataaaaccaagagactgtgagtcagtgtgtcggtagcgcaggagacctgtgtcagatggaatggcgtgtgttctgtctcccgaagcagcctttcccacgaaatggttgg

SEQ ID NO: 49798 - DNA, 992 bp, Bovine  19866880858796
agtgtaagtggaagactactttggtagcctgtacagtgcagagtgaataattaataatcctcctgtctcctcagcatttggccaagagaagaatgtctctctgaacaacttcagcgctgatcaggtaactagagccctggagaacgtgctaagtagcaaagcctgaagtctccactgaggattaaaaacaacagccccagagtctgggctctgctggactgagaacaatgtggagaaatgtattttgttctgtataaagattgtgctgaaaatgctgtctaaaaatgatctgattcgcatcccaccaactacccattattgtgcaactgtctgagggaaagcagttgaatataaaaataaaacttattttattctgtcccatcaaaaaaaaaagaaagaaaaaactgttgtatattaatacatatgtatggaatctggaaaagtggtaatgctggacctatttcctggactcgtggacacagcaggtgaaggaaagtaggacgaactgagtgagtagcactgacacgtgaacactaccttgtgtaaaaccgagagcgagtgagaagctgcatacaggcacagagagctcagcgcagtatcccgaaaacctagacgggtgggatgcagcagggaagggaggctcaggagggaggggatatatgcacactaacagctgagtcacactgttgtacagaagaaatcagcacaacattgtaaaccaattatcctccagttaaatttttaagattacttgatagaaattaggaaaaacataaaacaaaaatttatgtataaatggaggaacatgtcagtcttctcactggacagttcaacactgtaaaatgttaatattcttcaaagtgatctgtacatttgacaaaatcaaatcaaaatgctacagtttgggctgtgtgtatgtgtatgaactgataagttgattctaaaacttatatggaaaaacatcccaagaatagccaaaacaatcttgaaaa

SEQ ID NO: 49799 - DNA, 1691 bp, Bovine  19866880866930
tgtttgaaaaatttaaaactacagggaagtgtaaaaatgaaaattgaaatcacttataattctgtcactcacagttaatcactgttgacattttggaatattttctctcaggcattttttcttttttttaaatgcatatatgtggtaagcatgtctctgagtctttcaaaataaaaatttaatagctatataattttggtcaattctgattttttttgaccattttaactaacataggcacctactttttttccatatttctcattatttatttaggaatagattcttataaaatagtttctgttatgtaaatatatttggtaagtattgaaacaaatatactgatttaaatctcgacaagcatgataatactagagttatttcactataaccttgctaccattgaatattattaacttcagtttgataatttagtagacaaaaaatggtatattctaatttatatcccatttataactggtgagttttataacctttgatagaaaagtgattccagaagacttggttcttatttttttgcacttaccattctattgatggttgggttctatttatgttctattgatgttgagttccttgcttttctaagtgagcctctgtgtcttttttttgatccgtaagacatgttaaccctctgtactatatattttgtttttactcaacagtcatgcactcaaaatatttattgactatcatatttcaggcttctgaatccatagagataaatacatgaaaattgaaaatccttgacctccagaatttcaaaatatagagacaacacacagataacaagagaaatagaaaacagtgttctgatgctatgcagtcaataaatatttactgtttgccatctacatttcatggattaggctaagcattaaagatacccaaaatgagtaagttagacatagttcttttctttacaaatattattggctatacagaatagcataaagattaattataatacagtggggtaagttgaaagcagcttaaaatagtggctaaggacatggctctgaagctgactgtctgggtcaaatcctggctcaaccactaattaactatactctgtgattatgggcagataaattagccattctgttcttcagtttcctccttgggaaaagagaggcaataactgaattgtttcatagactcttgcagaacatttagaacaagacctagtatgtagtgtgtgctcagtacccgttttatttcgttgtaagaataagatgtggaaagcacagtctgttattgaaatgtataataaggggctgttaatataaagtcatgagagctacttttggaggaagaaaccccaaacagctgaaaagtgaggagatagtatggctcatttgggagggtgcaatggagtgtgaacatgtgtgagggcatagttttcacaaagagggaaccacatgtgcaaaatcccagaagaaggtgaagggctttcgaagaactaaatgaccttcagtgtggattgtagggtatgagtatctttgtattgctgtgtaacaaaccacccgaaaattcaatgcctttaaaatacaaaggttaagagaacaataggtcaattaacagtgaaattttcatcagaaaccagagtgactagaacagaatggaacaatatctttgcagtgcgaaagaaaagaactatcaacccagga

SEQ ID NO: 49800 - DNA, 775 bp, Bovine  19866880875288
atgggagatgttgagagcaatgtcacatttcaattttgaggactttattccattgcgcaggctctatctgctctgaatttagcagtgacagtgagatttagcaaacagaagagggatttagagaaaatcctcacatttatctacaaaacacagacactgtagacaggaaacagctgggggaacgcttgccttctctctctctccctcttctggcaaagttatcgagtaaggacttttttgggcatggtgacaaataacatcatacctttgcattttaaaactagagcacagaagcatttttttcccttaaaagaatgtgtgttagtgacaagaggagcagacattaaaatactgatgctgtcctctgattaactttctaccgggcgtgaagacacacacatctgctaatacaccttacccgtatgaaaggaatattcgtggaggatgggcgagcaattttatattccagagccaacacaaaatttaaaaaacaagaaatgaaaaaaagaccatctcaagcctactctatgattttaaccctcaaacgactggggtaaactagaatggaagacagcgctgggatgacccctcgtcctggttgccaagtgaggggaatgatctcatttcctagaacctggaaaggggcaggcagctttgtaattggctcccctcaggacactgtctcatgctttttgcccacgacagggcaaagattttgctgagctgtaaagccaactgaaaaaataaaatcaaatctttttcttccttccttcta

SEQ ID NO: 49801 - DNA, 848 bp, Bovine  19866880890078
ccacaatactgttttcggtatcagtgctcctacttaagtagacaatcaagaaataagtatctggcctctggaagttggatctcctgggtcggagagagaaaagtttgtatataaattcttttccataaaaggctttttcaaatgactgaaacatgtaataccaggtaactagctccatattcattttccatcagcattttgtgagcaccaactaggtaccaggtggtttatagaccaggggttcttcaccttgacttcacattagaatcacctagggagtgtttttaaaaacactcctccctggggcgcacccttggagagtctacctcaattagtttgggatggaggctgagcattagtatttttaaaagctccctaaatggcaaaactaatacaatattgttaagtttaaaaataaaataaaatttaaaaaaaataataaattctttaaaaaataaataaataaaagctccctaaagactctaaggtggaggcagcaggaagcaacactgatatatctaattgtgcttattcttcctggcaatctgaccagagtggcaggaatatcatgcataacataagaggactgctcactaaaaagccacccccatcaccgcctcctcgagcttgggtctatttcatgctcaatttcataccacaacagcttaggacaatgggaattttttctttgagttcttaaaatatgtataatgctcagaacatctcagaaaattaaacccaccattctaaaacatgatagatatattttaaactttgtattaaatatctaatgtacaaaaaaggaaaagaacagtataatagcccccatatccatcacccaactaaca

SEQ ID NO: 49802 - DNA, 628 bp, Bovine  19866880922646
gtgatctaaacccagtaactctcaagaaccgacacaaaacagacaaaacataaacccccaaactcctggcagaatgaaaggaatctgttcagtgggagagaagaaccaagaacagacagtaagtgcagtcaggaataaccagacaatagcaatcatcagcagttagcaccagtgctgataaatctacacttttatgctttataaataacaattccacaggatcttcactgagtcctttgaaaaatttcagcagcaaccatgtcccaaacaggccaaacccagactgtgtgatcctacataagagagaattttctctgtgaaggaagggaagccattcctgaaacacatgactgaaagatacaattcatgagttggggcagtccaactacccatgctaaacctggggtcactttcgaccagaggaaacatcattctcttagaactactaaatcgctgcctgggggagtaagtttacacagctcagtgtcaagcaatttggttaagtccagaaaatgggcaggaaatgccagggctgggctaacatgggtgccctgagctaaagcatgaccttaaatgggtctattatttactttcttaaatacatatcatgtggcaaaatcttgcctta

SEQ ID NO: 49803 - DNA, 1052 bp, Bovine  19866880922787
cccatgtcttctatgtgtcttgtactggcaggcaagttctttaccactagtccacttgggaagcccattattgttagcactgctcctccagaagtctatcatggtacctggtatatctcaggcgtgatataatctttcctgatatcatccagagaccctatctgttttaccttcatatacacaatcgtcttcttcagaatcctaaaatagccttagagtactgctttaccttggggatcagtgatgaccaccctggcaagttttaactgagtgttcagtacacaccaggcacagtgttagttttttaaggtccattaacacattcagtcattgatacagtcctatggaggagctacctgtctacagctggggctcaggaaagttaaataacatacccagagccacacagtaaattgcagggcttgaggttcctcccaccccccgagtctggctgcctccagcacctactcctcaccacccctgctccactgtgttcttgcattctcctgcctttgaggccccagtaatggcttgcttcctaacaggtccccacagtggaggatagatttgctaggctttggttgggctgttttgtgcagtgaccagggcacacattttgttagacattcggcctgaataaggggctcaggtctttagtctgtggctgtggaacagagaaaagctaactgacccagaaggggattgaacttgtgacctagatttcagaacatcagattctagccactgggctgcaagacagtccctctggagggctgttttctgagagtcctgagctgcatcttaaatctgaggctttttctcccaccagcaccccctcctcattgctggagattaagaaactgaggttcacgcaagagcagagtgagaagaaaataaatcgtgatttaaattcatgcctctggacgcgtagcttagcccactgaacccctctctcttcatctctgccacctccattctgtgatttatttcaggcgatggccctctgtgtatgtataaaaatcccccgaatgcgttccccgagggcagtcaag

SEQ ID NO: 49804 - DNA, 1299 bp, Bovine  19866880933845
tgatgatgataaatactgcatatagcaaaaatcagaatttaaaattaagaaatttaagagatccacacaagagagaagttaagtatctttttcaggccacacatagataatacacgtggaacctaggattgctgtccagtgcaatatggtagtgtaatatgcttaatacatgacatcttatttggaggtgaatgtagaagctggccatgttgaagaccaactgaaattcctccaaataccatgaaattgaattgctctactgggaaaactctgacagcaggagaatcaagaaatactccattcagtctggggctggcagaatctgtgtacacatgtactccaaaggcaggaacagcttgttaatctggcatttaactaccagaaattactattaatcattattactgggaggagttattgatacataatgatggccctagggtattgcttagtcatgaagtaccttctgaatcatcaaagaaaactgaagttctgttccgctgaagtttagtattaagtctgctttattgtcttcaatttttttaggtgttagtaatcactaaataacatagatacatcgaactctcttaaatattttattaatagtaaccagaaccttcccctaaagagaaagtttgatattatttcacatctgtttattttacttgcaaagatatgtaaatgtctgtgtaatttcagagatgcatatttgtgagaaaatacccaattcgtggcagcttttggttattacaaaattttcaactactgggtataatttgcttatttaatagatatttgccaagcatttaccatgcgggcaggagctgtattgagtactggagttgcagatgtgattaaaatgggtacagtccctgtcctcctataataaggaaatccatgaaagtttttgatgttaaggtaggaattctgattctcaaagatgaatgctatcactagtaagactaagagtcccaggttgaattaaataagtattaaaattgaactataagcacatttctgagcatagaaaagaagtgatctgaattgggaactgagaaataagacagtgtgggtgatctcttgggggtggacagataagcaggaggcatatggtcctgtaatgggaagcattctttggtcagattgttggaacccaaggagtttggactttatcctgtagaataaatggaaaatagactttggtatgtatgcaaattcattggtagtgtctacttgaagcactctttgggggagctttatgaggtcccctctgcctttcagaaaaagtgctatgaatga

SEQ ID NO: 49805 - DNA, 1404 bp, Bovine  19866880949377
atcaaaccccccttaatcactattattaaggacactattgctctatcaaactagtaaccaagttaacaggactaaaaataccctaatttgggttttaacctctttttctgtttacaaggtatgacagcttagaaaaaggattttaaagaatctgaataaagcccattctaaggaaatactccagaatgaaatggttacaagcaacaagaaagcacatgaggtatttaatctccagtcttcttctcaagccaaattaatctcaggtttccagataaaaacttcaggtatcttctatacctctctcttcacattcatgatcgctgtagcaaaaagaactgaggttagtttggccaatcatatagatcttatccctttccccaattcagagattctttcttttctctcaaagcagaagtgtaaggtgtaaagtctgagtggagggatcttctggactctcttctgggactgtctctgcatcacagcaaagtcctgggcagaaactcacttgataaagctgacactgctccaagtagcatggttcccatgcacacaggcgtatgatggaggccattcagaaccagctgggatgtcgtctggtttgcatttggctctcttcccaggctctcacatgtgacttctttgttgcagacaatgacagtgacaaaacaaaagcactcagggatttagtctcagttgcatctgttgctttgctcattgttttaatttaatgacgcgggccacccttgacaatgggtggcaagtggaggcctgctagaagcagccgtcggagctggcaccctccttcagtgcacttcttgaaggggttatgaaactgtcccacattcagtcaagcaaaaacttttcacttcaacagcctgtccaagacaaacaaaccagctaaaactgtgtctactatgcaactagacagatttttgaaaggaaaacagtagtgagtaaatactgtttcctattgacaccagagaaggtaagattatttaccaaaaaaaaaaaagttggtcctcaagctcactggggttgactgaggaaacataccctctgaaggaagggttaactgactcatgagggaataggtttgataggggttaatttgtgatatacattattacacagtgtatgccatacacagatatataggaagctggaaaatgccatgaagggatcattcacattcccccatttttctcttggcgatcctagctcttagttttccaatggaaaactgtccacaaacttaagttccctgagagctaacgacaatggcaataatagttatcttgattaaaatttgcacacattttacagtttacacagtaatctccatgaatcctcccaacaacctcaggagatgacgttgtttgcattggtatcattcacaatctaagg

SEQ ID NO: 49806 - DNA, 1920 bp, Bovine  19866880957380
ctcctacttgcccttgtgtttctccaccatcgctcctccatgaccccgcatggtttgggggtactctcggaaatgactagggaagggaagttgaaatggatgtaaagaccaatatttcagggcttttttctttacttctggctttgcctaaagatatgaaaagatgtcagtaatcatctcaatgaaaagacaagaggaagagaagccagaacaggtctccccactttgactccacaacttttcttatttccttggtccatctttagctccccaaacccctgatctgaataggtcttgctgatgttgatgctgaactattctggagtggacatatgaaaggtccctgttgatttcagtttcacaagacaactcagacttgtgagaatctgaagcagagagcttatttcatttaagagctttcttatatctggtcaaaatgtaggtttgtcctcaaagggtgtctcaaacttctacctcctctgcatttctggcctggatgacagacttctaactggtcttgtcttccccaagcttgctccacctcaactctatctctagccagtaacaagagggatcatcaggaagtaaattcaaatgatgccatcctctgcttcaaagcctcccatggcttctttgcacctagaataaagttaaactctacatgtcgtatatgatctggtctatatatgatcactcatttattatcattcttcccctcgctcacagcagttgagacactagccttcttgtttcttggatagggtattttggttcctagttcactaatggggaaaccaaggtacaaggacattagctaacttcccacaagtgttcaaacacaccaaaggaacttcaacttaagccttctggcttcccagtctgccaggctgcctctcattatctcatttgatgttcacagtatccctgggaggtcagaaggacagggtcataatccctgtgacattccagggaaatcttcacgttacagagatgtgtgccaaccctggctgggaaaccgtgatctgcatggataaaactgggaagcaagatttccacgggttctctcagtgccacacaagtggtaggatgggcctgtctaagttgctggcctgtctgcagcacagacaaaagatggattcgtgctttctctagcaccacattccccagtgtccaagtcaccacctttacctttctgctgctgctgctgctaagtcacttcagtcgtgtccaactctgtgcaaccccataaacggcagcccaccagactcccccgtccctgggattctccaggcaagaacactggagtgggttgccatttccttctccaatacacgaaagtgaaaagtgaaagaagttgctcactcatgtccgactcttagcgaccccatggactgcagcccaccaggctcctctgtccatgggattttccaggcaagagtactggagtggggtgccatctccttaccactgaccccccacttcccactaagtccctgcacaggctcggtgctccctccaaccatcatcctctctcacccctccactcttcagccctgagctgtgagccaggctgccacattcatatccctactctaaaagtactaagtggtgtgggaccttggcaagtttatttaacttctctgtgccccagttttctagtctgtaaaatggaggtcttaagtaaagctgatctcgcaggagcgttacgaagatgaaatctaccagtatctacagcgtactcagcacagggcacagagcaagtgctgtgcacctgtgggctgtactcatcaccattcgtctttctaggtcaacactcctctggattctcttttcagcctcctagtaggcctcctaacttccatcttgcctatgccctccactcaccactgagcttcttaacatataaaatgggccatgtca

SEQ ID NO: 49807 - DNA, 1669 bp, Bovine  19866881109969
accactgctaatgtgtagaactagcccattatacttgttcacatcaggtatggcctccctcccataacgagccattttgataaagtccaaggctgattcccctcccatagatgccatcttgaatactcagctggaataatctgttcaccgaagaggccagccaagggctctggaggctggggtgtgagagagaagggttaggccatagctgttttttcttctctctttctcatttcccctgagaaagcgaaaatactttaaaagactattatttataagaggtttctaaaaatcactgaatgacagatttaggaactggagggtccttagagttttgtgaccttatataaggccccatcatctctatactgtcctcaggacctaggcaggaataaggctggtctgtctccaagtccccttccacttctatgaagagtctgtgtccttgtggccccatggcatgtgagaacctgcatgaatgaaagtgactccatcataccttacttagtctggtggtctggcgatctaggctgagttatctgcttgggccatgccttctccaacctcgtgtgtctcagaatcacttggagagctagttagaaatggatagtcctgagttgtactccaagactatccctgaatgtgtgatatgagtcagggatttgtatttgtaatgaagccccagtgaattctgacatggagtggggatggggggctatgtgaaccctacttttaggttctgtggcttagccccttgcgagcatctgtggatggtcatgtgaaaaggaaacttaaaagctagtgatttccctggggagaaaactattaactccttccctgagaaatagaatatggaaagatgaagcttaattacattaatagctctttagcacttcctacaacttggaatcatctgtaatggctcagattttatcaccctaactaagctgtcagctccttgaaggttggggtagtacctagtgtatccacacaccccactgattccctagccttttacacactgcagatacttgaagggtgtttgtttacagtataagtggctcctttgtttttctttgtaggtgaagttgagatcctttgcagtgccctccagaaattaaagtgaagtcacggacagaacctaaactgagaatctctcaatggaaatccacctacttcttttatttcatcttaaaaagtgtaacaaacaagtcttgattcaaaatgacagccttaaatcctttcgagagcaagttggcgggtcaacaaataaaatcatatgaaatgacagcatattaataatacccaaaagcataatggtagatcttttgggatcatctgtgatttagagatgataatctcatactctgaattgaattaaaaatcaataacctgtcacatttcatcaaagttaatgaaaattcgggacctgttttattcaaccttcctaaatactttcatttgctgtagagaattcctaaaggggtatatccctcactgtgaaacacaagcctatcagaattgaatttctggatttaatataaattttaacctacaaaagtctttttctgtttcagggaactatgattctacttactgctttgttattttgcctatggtagattttctttaattcagaagcctattaaaatcaatacaaatattaaaa

SEQ ID NO: 49808 - DNA, 730 bp, Bovine  19866881210861
gaggcctgagcgaggagacggatggggagtagggcccctgagaacacagggcaggtgccaaactgaaaagaaaagagaaatgatagactttagagtgaaactaaaaataaagagaatgtgttttaatacccctttggctgattcaccttcctgtggcacgagaaagaggggcgtcgccctctactcatgaaagccttatgttttgcctgcgaggcctctcttcccacatctgaaagggtaaactgaccataagttgtaagtatgggagataacgtggtggtggcacggctacaatctctaccttggagccagattcatcttacaatttccgtcacagtctttctcaaaaaagtgagataactcaggtccatatatgtgattcctcaacatcccttcttattctttctcttgtttggtctgttttcatctcattcaggcatgggtccaaggtggagtagagattaagtgggactggtgacattgtatgcttgctggctgcttatttccaaagcatggttggcaggaaagggagccttagatttcagtcatttcagagagggaactaaactctaattcttaccctactgtgaactcagaataacatgagctttggctctaaagtgcaccagtgagaaaaagcatgtcagtgattgtcgatagcagaagatgagaagatatagaggaagaagagaaaagaaagaagggaggaatacatacattggttgaaagt

SEQ ID NO: 49809 - DNA, 649 bp, Bovine  19866881254278
tgatctttttgtcgatagagtttgtaccaatttctcatcagttttgtgaaggaggagataagaaagtggattatgaaataagattgcaaaagcccaggttagacatcccacttttcctggggtctattggggcatggttttctggaatggtgggaatagcctggatgttgtatttctccctcttgattctcaggggacacagtgatcctgacacttcgactaaaaacaaaggtttgcttgaaactcttctctgggtctttatggccatggccaggaagttgtttgcagaggtgggtgcccctcaaaggaaaacctgattggttttgaaagggggttgagtttactcaagccttctctgtgattaaacgtggggcagtgtgtacctttgagaaagacaagttagacatgagaagtgatgccgtttcaatgcactatattcagcattcagtgagtacgttcctactgtgtgcccagttacacacatcacaggggctttcaaccaagtggcagagacagagaggaaaacagcactgtcatgtggtgggatgtgtgcttttaaaaatatgaaaagtgcacactctctctggaaagacagggaagtgaaactactgaggatccaggatgggggaggaggcgtgtgtcatagagg

SEQ ID NO: 49810 - DNA, 748 bp, Bovine  19866881334421
ctttgcctggcttctccagacaggaaccacagcaggtaaaacccaaggtgaagcagggaacaagtacactaacaccagaggaagtttctgcagaggtgtttttggcaagtgagatgcaaatacattgacttgcttaattccgtttgctttctggttaggggtcattaagtcatgtgactgctaattcttctgatatggacctctcttccagctctatgaaccttctctaacagacaaagcccttagatgagagtttaaaggcacaagttgttgctctgccacctactatgagaaaagtgcagtcatttgacatttctgaatctatggcaagattaagatgcttggaagccctaaacattgagcatatcatgacaatatgaccccagatgtaactgtcagcaaatacaacaacattctgattctctccaatctgattacttgatgcctttttcaaaaaaataaatgaccagttgtcaaattcgcttatcttttgttcttttggtgtccctaattgagtctacttgttgggtaaccattgtcttgctctcaaatgtgcttcatccataaaatgaacaaatagatggattgatttgttaaatttctttcagatctaaactttgattctgatttttaaaaaaatcttatttatttatggctgtgctgggtcttcattgctacacagacttttctctagttgtgagcagggctacactttagctgtggtgcgcaggcttctcaggcggggcgt

SEQ ID NO: 49811 - DNA, 1103 bp, Bovine  19866881385076
taatattttctaaaaagaatagtttcatgtaattttcacaatagcatgccaacaccaactattctaaaatggcagcctgttattttaccagttatataagtctaatagaggagaaaaagtcctcttaccacctctctttgggaacagtttcttagaattttcctgactaatacgggatcacgtcagtttgctcatttctcatcttctgtagctcatgccacacaaccaatccaaacccactccctttctaaagccaacccaagactcttcaaagtgaactgtatttgtatctgctctgtggtggagaggaaacgcttgggcaagggtcaacagagaattgctcatcaaattctagaatggttgggcagtgagacactctttgaagttggaaggaagcatctgagggtaaataagagagaacggcatcaggtattgaatagtactcatttggaattggtcactcctcatggaaacctggaaccccaatgccaaacccatacacgtttgttgaatgaatgaatggaataaatagggtgaaacagagtttggataaactcacagatgattgatatgtaactgattagaaaaggagattctatttcttttaggctatggaccctctacttctttctcctttccccttcctctgttaattatgtgaatgacaaagaaagagatactcttacccctgaaaacaggagaatctctttcactattatattcttagaagacataaacatattctttgaaatttcttcttctaaaaaatgattgaaagagaactttatacatgatcttgaagatcctttaaccctaaaaagaggtcttttccactgtatgtgtcaaaaagggctggattaagagatcagagcctccctggacttcatggtcctgttgggggacaggacatattcaaaaattgagaaataatgacacaaatgagtttatgctgaattcccaacaactgtcctcaggagacaagacattctttaattaagggagacattggctctgggctcctgctccattccacccctttcttctaggccattattccaccaatttaatcctttctctgtgaacctagaacttacatcctttct

SEQ ID NO: 49812 - DNA, 1753 bp, Bovine  19866881665620
aaatttttaattttagcatgttctttaggtgactcagtatcagagaattttggaaaatgctattaagtgctaaagaaattgcaaaagcaggcagtgaatgagtggtgatggagtgaaggaagacttgatagggaggtaggtaggagatgaagtttgtctttaaaaaatgaaaggccaagccaaaaggaattcttgcacatcggtttagattggtataaccattttggacaattgcttaatgatatcttcccatgttgaactacatctatcctataagccagcactttcactcctagatatagaccaaatagaaattcatgcacaaaggtacctaaagtctgaacaaaaatttcatagcagcgttatttgtaatggccccaaacttgaaataagtcgtatcttcatcaataataaaatggaaagattgtattgtagtcatatggtagaatattacacagcaatgaaatgaattgaccattgcaataagcagacacaaaatatgcataatatggtttctgttatatgaagttcaaaaataggcatttttaaatctatggcattagaaatcgagatgtgactatatgtggggagttggagggccccatgtctggaaagggacttagtagggaaacttaagtactgacagtattctatttcttagcctgggtagtagttatatggatatgttcattgtgtgattatttattcagaggaacacttaacaagtgtgtactcttttctatacaaatatatgaataccatgtttcaagaaaacacacacagtcacacccacagggtttgaaaaagaagaggagagaccacagcccaggtatgctctaggagaggtttgcagggactatatttctcaaggctcatctcagggatatgacattgaactggccttcaaggatttcattctccccaatcttatcatataaaaataatgttagacattggttcctcctaaaccagatatttctgaagaaactagccaagggccacatccatctttctcttggagagacacttaaacatcacttaccctgtggactagttttgttcctgattgaaaggaacagccaagattcattgctgctggaaatttgccgtaatcattgggcattacagagaattatcaataaagtttgataaatcctgtgactagtcaacccagtaatcacatgtttccgctttccatctctccaccccctcccgagacaaacagacatgcctattcttctggcttctgtatccaaccttgcaaaatttaccttccacagctcccaaggcatgagatttgctttttctgattacccagctggcccttagtcctggctttatcttcaagccagaggcctgggtggtctttgagaaacctgacaagaaggtcattaacaaagaatcatattcccaagttgacctttcatgaaacctcaaactaaaatccccttggagccttgtcttctcctggttgaaggtggtaccatgggaacttgggcaagaagttggaaggattctgaaatgatgcaaaagcagagcaatccaaagtgagtaacattttaataagttagtcaatagacaccaaatgggaggcaggcggttactatgcaaataactagagtaaaaggaaatgaattataataaggggccacttgctcagaggtcatttacctaactttcaggcgatctgcctcgggacctcagtttttaaagtaggagctgcaaactgacagctggaggtaacagtggccct

SEQ ID NO: 49813 - DNA, 819 bp, Bovine  19866881783530
tgtgaacggagggcaatgaactcagcatttcagtttgcattgagcaagagcctgtgtctttgcaaatgtgcctttcagcgactttcaccttctgtctgttcggggtgatttcatgtcacatggagacatctgggatgtgcccctttgccaagtccaccttcctagtttcctccaagtgacctggcacttaaaacatccctacacgttcacatacgttgctatgtgcacccacagatctggaaaaccaaaacctcaaccccccagggccattttgtcctgtcttttccccggaaggaatggaatagtgagggcagagcagaatagttgcgagaaagcctagcgggaagtagttaaaagacaaactgctaaagaggaaaattccatccaaaatctgcaaaacgtgccacggccccgctgaaacactaggctcgcattaaggtgaggaatctcggaggctgaggacggctgccagccacaggcagtcattcagttcttcgcacactcccggcagttgtaaatccacagagcagcgagagggaggctacttactgaaataaaagcccctgtctccgcacacgaactggagagcatccaccaactcagccccgcagagggtctcgggtcccgccgtggcagagctggtgaaggcgagcaagcacagggccagatagaagagatgcgaggaggatgtgatgggcatcttcacctgctgaaaaagcagaaggagggtcatcttcctcctgggtccttgccaggggagtgggggcaagtcaagggtgcctttaccccagctctgcattcctgttattaatcaaaact

SEQ ID NO: 49814 - DNA, 1942 bp, Bovine  19866880116067
tgtggtcatgtatggatgtgaaagttggactgtgaaggagggtgagcaccgaagaattgatgcttttgaactgtggtgttggagaagactcttgagagtcccttggactgcaaggagatccaactagtccattctgaaggagatcagccctgggatttctttggagggactgatgctaaagctgaaactccagtactttggccacctcatgtgaagagttgactcattggaaaagactctgatgctgggagggattgggggcaagaggagaaggggacgagagaggatgagatggctggatggcatcactgacttgatggatgtgagtctgagtgaactccgggagttggtgatggacagggaggcctggcatgctgcgattcatggggtcgcaaagagtcggacacgactgagtgactgatctgatctgatctgatctaacaaactagttgtagactatgaaaacatcttaaaagtcccctgaggttctactcttaacaaagctggtgaataagaatctttagaaaatggtgagttggccaagtgaaactcttccaagtgatggaggcagaaagtggcagggagaaaaacaatgcacactggcccagtgtcattggtggccaggacctattttcaattacatgaaatcagaagttgatttaccagatgttgtttctttatgaagtgggtataccctatgcttttgctttgaaagttgggtggaattcaggtggatgtgtaggaatcttcaataatccattagaacatagtttatctgtattttcttcctctcaggccatttagggagaagagagctttggttatttctccttaagtgcggaagataaaatgaaaccgacaaaggcaaacaagcatctacaactgagtcactaaaatgacaacttagagtttaacaaatggaacaagcctttgcaatggatttgagaatttggctatggaattaagactgaagtgtaacttcactgttcacgtgaaactatcacaacattgttaattggctatataccccaatacaaaatgttttttagtgttaaaaaataaaactaaaaattaaaaaaaaaatttttttaattcacacacatttaagaaagaactaacaagcattatgcctgatattaatgaattcatttatttatagggtaccaggcacacattatgttaagtgaaaacacaataaatgaaaagcattccttgcaaaaaaaaaaaaaagactgaagggtaagctgaagagttcctctatatatggagcaacacttctcaggctaactttttcatgcccataccccattagcaaagaagttattggcaagctttattttcaaagtttgtattatgaaagtaatatatttcattttctaaatagaacattgtattaaatattgaatgtgctttttcaaaataccattcctcgcccccactcccatattgtcccctctacccattactctgtgcctgagggtcactgaacagcacaattcaactgccctgctcatgatgctatgaatctactgtcaattctggcaaaatgtctcagggtattcttcttaggaagtttaacagcaaactgtgcaatgttaaataaagtaggggaaggtttggtaattctttaaaaataatgcaaatgcagtggtttaagtttctggacgagatacttcttaaaaattgttactttgacacaaattatgttgtttgagatccatgagattcaaatgggccattgatattatgattttgactaaacaaaatctttcatttacctctcccaagccatagaaagaagcttctaattttctgtattatgtctagtggctagaaaaacagagcataggaaaataagggaacaggatacagaggaaaatttttccttagtcaagaaatatgccaaaacaggaattcttctcaattcctgagtgcctcatat

SEQ ID NO: 49815 - DNA, 2647 bp, Bovine  19866880186945
tggtttttccattggtcatgtatggatgtgagagttggactgtgaagaaggctgagtgccaaagaattgatgcttttgaactgtggtgttggagaagactcttgagagtcccttggactgaaaggaggtccaaccagtccattctgaaggagatcagccctgggatttctttggaagggctgatgctaaagctgaaactccagtactttggccacctcatgtgaagaattgactcattggaaaagactctgatgctgggagggattgggggcaggaggagaatgggacgacagaggatgagatggctggatggcatcactgactcgatggacgtgagtctgggtgaactccgggagttgatgatggacagggaggcctggcgtgctgcggttcatggggtcgcagagtcagacacgactgagtgactgaactgaactgattgtgtgtactaaatcatatgtacaaacctaaattgctgtgtggcttaaatgagatcatgcagtgaaatatttcgcacagattctggaatgtgtaaaatgcataataaattattacattaaagaaagaaagaaatcacctgatcattggaatagccccaccaactttatgtcagctggagaaagctgtaacataccaatcaaagactttttggctgcaagggataaaaatctactcaaagtagcacaaggaaggagggttatttaatggacaatttactcaacaatagagtgccacactccgtcaagacatgagggtatcttatagaattttgtgtaatcaggtcaagaagtccagccaggcctcctggactggagttggaatctgggctttgagaagtagtccttctattttttcaagacctacacagtctttctcgtatcttctcgtgccttcactcctttttttgtgtcttcaccacttttccctgtttctctccctgtgttctttctctgtgtgctcgttttggacatggcccagtgcagctctcttaggcctgatctccatgttctccccactcaagtatttacaccaactagaatcctcctctctgtggttgaaaacatctaaagaaaaggatctcactggcctacccagactatggctccccttggggtcagatcatggtaatcagctgaagccataggactatgaaaatggggactctcaagtgtgcaaacatggggacccagccccactcatttcaggtcctggtggagtagcattttggaaaatggatttactgcatgctatggtctcaaggaagaagggggatgaattgattttgatgtcttgcaaaagtattcccaccatggaaaagaaaactaaaagtcatgcctactcaaaaggtacacgttcctttaattgtttttttaaagggcaacatatgaagtcctggtttcacaatgtgtccaagtctttaggcaaacatgtccaacagtggtttgttcctgtttcatacttgttttattttatttggcagcaaaatgaagatcatgtttcgaataaaagcccagttctgtcccttatacgtttcattaggcattatatgctgatcctgtcgtctctttccaggcgtacccaagcgtgttttacagactccttttgtaggaatattttggttgtaggatttgaggaagataaaagtcactcataactcattatttatattaataaattaataaaattgctttttcttgatgctatttggaaaaaactgctgggaaacctaaaactgaactatgcttgtggagaacaggaagtagagagaatacaggagattgtggagacaggagtctgagtgcaggctctgcctctcccacacgagctgtgtgtccttaggcaaattaacctttctaggcctcagcttcccttcatcagtcatataaaggtgattgatactgccttgagcttgagtttataagtttgaggacacaatgagataaaaatgatatattctcatgaaagtactttgatgatttgaatatgcttcaaaaaatggaagcttctaatttaaagaacaaaaattgcctgagcccagaaaactgagcagagctttccccctcatcctgtgtctcccttcagcagttctcagggccttaaaagcagatggatccagatccttagcactaactcttccctgttcagttccccactagcttgtggcaacatcctgtcttatgtggcttcctgctgattcttggatgagtctctccaaaggtgcatattcacctctgatggtcatttaaaaattcagtcaacatacatcagcccaagtgttcatcatgcatttagataggctgtgattttataacaaaacaaaagtaagaatataccaggtggtcttctaagcactttcatcaataacctcttctgacaggcaccacggaccccagaagtatatactattattatttccctgtttattaaatgaagaactgaggcagagagaggttaagtgatttttcaaaggttaaacactttgttatggaatcaggctgtacatccgaaagataactagaacctcctccctgactccaagggccttctagttcactaggaggtttgtatttcacgtcccactaaccataacatgaatgacatatcccagtctagtgttgtgggcagagggaactcagatgtgggctta

SEQ ID NO: 49816 - DNA, 2009 bp, Bovine  19866880430365
ccagtccatcctaaaggagatcagtcttgaatattcactgaaaggaagctccaatactttggccacctgatgcaaacagctaattcattagaaaagaccctgatgctgggaaagattgaaggtgggaggagaaggggacgacagaggacgagatggttggatgggaggagaaggggacgacagaggacgagatggttggatggcatcactgactcgatggatatgagtttgagtaggcttcgggaaatgatggaggaccaggagacctggtgcgctgtggtccatgaggttggaaaaggcagacacgactgagagactgagcaacaactgtctctaccatcaggactttcctccagcctccaaagggtgtgtttcacatctggatttgccatgatgacctcctaatcattctgtctgcctccattctctttcttcttcttatctactagcttccttttttgtacaaagcttagaatgtcttcacctgcactaaaatataataactagtaagccacggagctaggattcaaatcagttggcaaagtttttttttaaattatgaataggaacagaattttcctgaatgtttcccattatcacttgtaatatgtcaatgtgataaattgtatgattgattttcttatgttaaacaattcttatatgccacatgaaacatattttatatgatatttatataatatatacccactcattttggatttcttgcttatatttatttaatatttttgtacctttgtccttaagtgagattgagtcttattttgtccttgtctggttttgacatcaggattgtaatgactttataaaacacattgacaagttttctctaattttctattccctagaatggctatttgttagaggttattatttcttccttgaaatttttggggaaaaaaatgtttacaaaaccttctggagctagtagtctttgtggtatatttttgattgttgagttaattttttccccttactggtcatagatttattcagtgtcagtttcttctcaagtttatttccataatttatgctttctaaaaattgtatggtgtaccaatatttcaaatatattggtctgcaaatgttcatgtcattcccttatgatttttaaatatttactttttctgcttcagtgtcccttttcatatctagcactgtttagttctgcctcttaaaaaaaaaaaatcagtcatgcaggagtttgtctatttaattacttttttgaaacaaccggcttttcattttgttgatcaggtgaccagccattcatcttgacagcaccacaagagtaattttttggaaactcaaatccactttcgaaaacccatcagtggctcaccaaaccacatccaaggcccggcctcccaactacttcagcagttcatctctccacgcttagcccgtctgctctcccctccagcaatatcagattccttctgggccccaaaatgtcagctcatttcatgctctgtgcccttgtacagactttgcttttttcttccattatccacttagtcaaaatctttaaattccagctcaagttttcctccttgtgaagcttttcctgacccattcgtcctctctttaggtaattacgtacctctcttttttgggcctgatacatgttcgtatttttcacctaccatcctgttttgtttatgcgtctgcctctccttctggaccacaatgataccctgcaggcaggtgcagtccctttgtcatcttgattattactcgcactgttattttaatacccccatgtcttttccttcatcaaaatgaaagataacaaaattgagaaaataggatgctatgtcttttccctctattttaagaaaggtcagcagccacacccttcaaagaagcgaactgaattagctttactcttcctgctttgtcaacatgcactcagcactgaacaccctgtgtgctaatatttttaactttccaacttttcaaaccactattttcctcttataagagccaaa

SEQ ID NO: 49817 - DNA, 1791 bp, Bovine  19866880584972
tcttttaccttctcctgggcaccttctctctagttaaagtagaaaatatgtcctctttagagatgtagtcactttttcctatgtacctatgtcacatgcaactttagtacgtagtctcctggttttcagctaaaccctcgtaggcaattatatatcagagattcaaaggctgtgggacacccttgcaggcagaatgacctactcagtcttctgttcttgactgtaggtaagtatgtctttgttggttcagtttgttaattattcttgcctttttttttttttttttggcagtggggagaggaggttggacaagacatttttagtaaaatgcaattgactgtatttgaaaagatgtagcaattattcatttgatgaatggttctccatctggtagaaagcaagactcaacccgaacagtatgtgtgacttgcctacatcacataccaatgagaggaactagaaagtggaaagccttctatttctaaatattactcatctacttcaaaatgtaatcgtgggaatgacatgcaaattaccaatggaaaaaaaatcctcttgactctttaaaacactgagcaaaaagatgtagcaggattaaatcatcctcaagtccccttgcttgttacactgggtttgtgggagggaagggatttctgtgccagatacccgctctcctaaaggagccttccccaaagccagaagacttgctccagcattagggttactacactcaaatacacctggagaaagagtactatgaaaagtaaatcctggttctgtaaggtgggactttggatttataaatatccgtgagtggcagagcatccacactcctcaaacttctggactagaacctacctgttcctcttgttgcccttcaagggtagtgtttatgtgtgttataacttctttctcattcaattctcataacgacttcataggtagggatattctcattcccattttatagataaagagcccaaggcacagagaagttaagaaacttgcccaaggtcacacagtggcaaggtctgtatttgaacctgacaactgagcatcagaggtcgtctgtgaatccctgtgtggtgctgctttctatggctaagtggcgttttttcactttcccctaaatacagcatgttttcttacatgaatagtcaataatctaaactagagaatagattgaaagttttcagggcacttggctggctggtgagtccattgcaaatgtaatagaaagaccggtgactttgaggttaaacagttaaactcatttttatttccccaaactttaaacttttattttgtatttgggtatagctgataaaaaatgttgtggtaatttcaggtgaatagcaaagggactcagccatgcatgtatatgtatcctttctccccccaaaccctctcccattcaggctggcacataacattgtgaactcacctattttttgcagccattttctaatagtgttaacttgtctacttggttaactttaaaagcctcaactttctcctttgtacactagtgataataattcaatgacatgtcccatgaagaagtcatggtaggatgaaggatgtaggtaaagtttcaggaagaggatggcgtgcagcacactctacatggaacacaagtgtacacccgtttccccctcaccctcactccttcccactttaccctttctgtcactcaaatgcttagataagcttggttagtcctccattgaaatgaatggccccgcatcacctgtagcttaatagaaggagggcaagggtaaatcccacgag

SEQ ID NO: 49818 - DNA, 2188 bp, Bovine  19866880643318
acaaagtctgccaggatttcctctatgtcccaccatttacatatttttaaaaatcttgtctattaggaaatgtgaggaatgtggggttctcatagatgttcatctatccaccatttattgagtgcctattatctaccagctgctgtgagaggaacacatttactgacacaaattcaaataaatagccctggcagatgagggctttctttaaagcacaggaaacataactgaaacctaatttctttaagtctgatttgagaaaatataattccactcattgctcctaattttcccatttcttgtagccttttatacttgtattttttttttacattgagatataattcatataacataaaagtcaactgttttaaattgtgcactttggtggtttttagtatagtcattatgttgtataattatcaaaactatctaattctagaatattttcatcaccctaaaaggaaaccccatacatactagcagatttgaaccccaccccttcatcccttgtcaaccaccgatctattttttgtctttatggattagtccattctggacgtttcatattatgaagtcatactgtgtgtggtctgttgtgtccggcttttttcacttagcataatgttttcaaggttcatccatattgtagctaatagcagcacttcatttttcattgccaaatgacatttcattatatgttatatggatatgccatattatcttcatccattaaccatctgatggactttggggtcatttatactttttggtgggacttccctggtggctcagaggttaaagcatctgcctggaatgcaggagacctgggttcgatccctgggttgggaagatcccctggagaaggaaatggcgacccactccagtactcttgcctggagaatcccatggaaggaggagcctggtaggctacagtccatggggtctcaaagagtcggacgcgactgagcaactttactcactcactcatactttttggttattatgaataatgttgatatgaacattggtttataacttgtatgaatgaatattttcacttctcttgggtatatatctaggagtggatctattgggttatatggtaattctactttttaattttgcaagaacctaccaagggtgtttttccaaagtggctataccattttacattcccatcagtaatatatatatatattttttttttttttggttgtctttaatagaaaatatttgtaaccaccccaggagttagcttagtagttttcttcccagtttattggtgagggcagtagagcaataaactgaaaaatgccttcctggggccagatccttgtttcttcatttattcagcatccaccgattcactgttctgttcccggcattgttcccagttctgtggatgcagagatgagtaaaatatgctgtctgtgaagtgttgaatcgagtctgtgaaacttctgttgaaatatttaaaatggtaaaagctctcattcatgtgacttggtttagatggaatctgctcagagtcttaaggatggacctaaacaaatatcccttgattggatgatttttggacgatgttcctagtacccatggtaagctatcagttcacgttttcttttcttagtggagaaaatgtgttagcgtctggcatttgctgtgtctctgaaatgaacaattttatagtggaatcatctaatcccaggaatttgggaataagtatataacttacgttgaaaaaagtaacaatcctgaacacgtgtgtagtttttcaccatttccagggctgttttgtatgtgttaccatgtcttctttgaccgcagtcctgtgaagtaggccaggcaaacacacgttatttctatttcatgggtcactgaacctcagggaagcagagtagtttgccctggctcacacgaatgagccagaagacccttcgctagagcagtcattcccaaatactatttcttggactggtgccaggaagggatagagttcactgattcatgagcaagtgagaaaagtaaggcaaagtcgtgaggttttcacatcactaaatgtatttgattttaagaaatgtcttttagtctaaaattaagtattggcttacagaaaaacccaaatgaaccctttggccaacccaatacctcttatttctatattagttagtaaaatgtctgtttt

SEQ ID NO: 49819 - DNA, 840 bp, Bovine  19866880930424
agacagcgaacggacggatgatgtgcatgtagctgtcgagggtgattggagaaacaaaataactggtaattaccgagcagttcaggtggacatatagagtgcagaaaaggttttctttccagcagtaaaatgaagtgtcagtgtaagggcggctggccttgtggaaaggctgtaactttaaagggatactggccaaggctttccactggacgttcaggcttggttacttgcctttcccccacagttcaaagagggatagagatattccatgaattgaattttcttgtgaattaaaacatcgatgtcctgatttggggtaacaagcattgccaagctagtgctgagcaggcagaaaggagggataggacgaatgtgttgccttcggggcaaggcagaaaaattgttcacaaaagagcatcattccactgattgttcaaggtcaccagactgtgcatgctcaaaatgggactcaagactcccaaatcccagtgtctgattaattgtcctttgactaaaacaatgaaagtaaaatggattaacaaaaaacgattgctccaggccaaaaagttcagaaagcaaacagagcctcaagcgaagtaggattttctttaattaggttgaatgccttggtaataatgctgtaaatatgaaattgtcttgtgaacagtaagtatactggtgattctgttttatcatgccagttaaaaaatggtgagtgttgatgtgctgtggtgctggcactgaggaaggcattttccctatgctgtgtgatttaaccctcacaagtacctggtaagtatgatggccactatattactgacggggctaatgcgattaaag

SEQ ID NO: 49820 - DNA, 1104 bp, Bovine  19866881155408
gggaaaaaaaagccttggtatgcatgctcaatccaattgtataaattaatttctttattggaaccatcttctttagtcaatgtgacagcaattcaccctgatgaaagacttacaaatgggtctctctttctcaccaaaacctgtcaacacggccagtatctgctttaattagagtgaccaaacagtcgggtttccctgactgtcgtggggcataatgcctcttgtctcaaccagtaaattttcatagacccccccttcattctcaaaagtgtcccagttaggacaatacattatatgggctttcccaacatgaatgaaatcgaggaggagccgtccaacagacaggtctgcttcccttttcatagtgttgctttgcttagaaaaattcccaatgcctcagcctaaaagcctcttggccctggggtcacagtttgacttctttcattctccagtaatattccttcccaagctttttttttcagcagcagaatctactttttcagatgagaagttagacagagactccagtgtttaacacagaaaaagtagggcctttgctgattgcagtgagggtagcaagctcagatacccccatatttggcccctctctctttccttctggtgtgggtctctgatgaatctcaaggctttgtgaagcatagattaaatctcctgccagagcaaaatgttaccatcaatttaaagtgctgtcgctgcatggattgaatactgtgctctggttcccgagtcaagttacattagcaatactgtatgtgtttaaagcttggcacaagttgatgatcatcaggctctttaaaaatattatcttagggttcagcctcaattctaggttaggctactcctgtggccttaattcttctaaccaatcaaattttgactatcaactttgttgttctgtcatggatcatggctgaggaacgaccacaccaaccattgatcctggtaattctctgtctcacctgtccccttttggggccctttaagttaactctggctttatggctcttcccctgtaacctcatcctttgtttgtgatttgaaatgctattctagtagactaattttctcttcatccttgcaaat

SEQ ID NO: 49821 - DNA, 1469 bp, Bovine  19866881639463
aattatcgctttatccaagttgagagccggagaactgtcttaggccacaatgatctttagtaattgaaaatgttatctattaccatgtcacaaacaactccaaaatgttgtggcttaaagcaactgttttattttgttcccactttcgttgggaatttaggaagagttcactctggtggtttatctctgatcccagctggggctggaggatctatttctgagattctagaagtgcttctcactcagctaatagatgccacagtgctttctcactctctctttctgtctctttccttccttccctccatctctctcatctccctctcactccttttgtggcaactcacctgccaggaccctcacacgcctcctgcttcccacagcctggcaaccgccgtgagggcggacttcccacatgaggccttgatcttccaaaagaccaaatcggaagctgctgatcctcttaaacacgaggcccagagccagcccagcatcacctccacacactctgttggtcaaaacatcacaagccaactcagatttaaatggagagctagaaccctctgctctatgggagaagaatcagaaaataccaaactatcttcaatcttccacagtcagcattaaatagaagtcgattcccaacatgattaaatctaccccatggcaatgactcccccccaaaagaaaagtttgttctttcacaaaactgctaagattcagatttcttaaaagaagagggctgttttggatatccattgattgttctttggcctcttcatacccagtcaagaagccaagtgtgtggaagttcaggttcatgaagacactatttccagaccaaaaagttgtactaaaatagatactgatatctgtcttttaaaaagtgttttaaggattcattttagcataactgacttttatctttgataatgctgaatccttggctgtttcagaaagagcagcagaggaagggctaagaaggatgcagaaactctatctatgagacattgttactgaggaccactcccatgggcccaaggagaagctcatttctcagtgctctgcttatgctgttcagtgtgacactgttgctgcccttgcagtctacacacaagcagatctttgttgctctgggtgcagcaaattctttactatgaataatctatgataacaaatgctccctttagttccttctcagtcttgagagtattggagctcccaagaggaaaaaaaatcagcgctcaattggaattagatgctagaaatgctctctttaagcattgctagggagagaaatggaatggcaccatttgacctatgaatatggtacggggaatgaatggatgaatttgggacatagacacaaaatgccagggcaataacaaggcagagtgttggagtctgggggcatctgggctctggaatcaccttgtctgggaacctcatcacttcccagtcaaaacacc

SEQ ID NO: 49822 - DNA, 932 bp, Bovine  19866882263133
gagttaaaagagtgtagtggttcttattcatacctgacccactaagttcattgctattataagaatactagagatgtgcctcacaggatgaaaagaaaatgtgcaaatgatggctggactgtgctgactcttggtagagtgcagaaaaatgatagaaagagtagattacagacccagatttcacactgagcctaggcagccaacaagagaaaggtgtgaggtatgattcacaacacaatgcttcctgccacaacactgagaacccattttcaacagactctgtgggcatagcatccacaaagtccccttctaaacccaaaactagactctcagatgctgcgtgaggccgtaagaggtccttggtcaattcttcctcttagcactggtctcttaaatactcgatattacacgtcatgtaaagcgccttccctcagaagctgtgaaatagaaactttcaaaagataagctcatgttgaactgcacaatttgtctcatttcataattctaaactttcataacctgcctttcctgggtgtaactggcatgacgaaagccccatgtgatttgctcaacacagtgctaggaaggactcaacaagattcttaggtgaattgaatccatctttgaagaatacacagagcttgatttgggataagtttcagaattcagggttttcctttcacatcctcaaattttcccttgactctccatctcctccaccttccccactccaggctgcccgtaacccacctgcctcagaggaccccagcttattttctacagctggggacccttagctatctcttatcttccatctctcttgtatcttcaatcagattatctcccctatgacctggaaaaagagctcagatctcctctattctaaaaataaaattaaagggaaacaaaactaccaagaaaacttcctcagc

SEQ ID NO: 49823 - DNA, 2005 bp, Bovine  19866880271105
taacataggttaaaatactttagatgtggcagaaagggaaccatcatgaatgaattgccctcctctgaggcctggaaaacagcaaacaacaaaaggtattactctgataaagttgatattctatggagatgtgtgtctctgatttgaagttctatgctgctgctgctgctaagtcccttcagtcgtgtccgactctgtgcgaccccatagacggcagcccaccaggctcccccgtccctgggattctccaggcaagaacactggagtgggttgccatttccttctccaatgcatgaaagtgaaaagtgaaagtgaagtcgctcagtcgtgcccgactcttagcgaccccatggactgcagcctaccaggctcctctatccatgggattttccaggcaagagtactggagtggggtgccattgccttctccgtctatccttctagatgcatagaatttttttggttctggcctgggggctcagtcttcaggcctactttcagttaactctcagataagaatatagttttattacaatttgttatgtgccaaggtcatactgatatgtatgacatctacttacattcctatacaaaaagtgaatccataaattcttttaatcagttattaactatgtaggaacaattatatgcaaagcattgtgtaactatatgaatatgtgtgcttacatacaagtacttggcccattgggatttaagaaaaaaaatagaaacaaaaaataaaatttacccctgaaaatataatcaacagtgagttataatctattgattaactcttttgtatcacctttggtttctaaaagaaagtaaaatttctgaacgtaatatagaattttccgaaaagatctcagtagttctcaaaggaatcaaactatatcctaacaacatggctgaaaaataaaatcaaaattccttagtaatataagaaaggaaatacctttatagaagaatttcatcaagtaaaggttttctttccttattgaatcagagctgtatttaatcaaggcctgagtggactgccaacttccctttttatgttttacaagagaaaaggcatccaaaaatagatttctgtatcttagtacactctaagtcactgatgtttcaaatctcaactaaaattgtagtttcatagattaattcaagtggagggatgaagaaatattccttataactgaaacaaaataacagtgaattatcagcttgggttctatgtatggtaaaaaaaaaaatagagagatgataatagatctggttttattagcttaactgctgtataattgatatacaaatactgcaaatattttaatgtgtacagtgtaatgaatctgaacatatacaagcaccacagtcaaggtcatgaatagatttaacacttcccagattttccttgtgtcctgtttttattgttgtgtttgtttttgatgtgtgttgtgttaagaacagttaccatgctacttgccctcttgacacattttgaagtgaaataggtctattctttaacctgtatttgtaaagatagaagacccctctagatgatccaaaatcctccccagagtgtgacaaactgttggactatctcttgattacccatcaatgacaagcaaaactttacttgccatcacccttctgaagtttactgaaatgaaatttcaaggctgctcctaaatgaacatatggctaaataagttctacaacagcaatagattagatattgaactttgcacaacaataaattacaggtttaactgcctcaaacaactgtatgtatgaccctattttatggcagttatatttatgaaaccaattcaaatgggaaatccaggatatctttttgaatgaagaaattgagcatcttcaaacctggtttaatcttgcagaagtgtacttggctgttcatagatttttttttccacatgagagaaacatatgtggttaaaccggtgttaaattcaacaagcaaaaagccttgccatggcttttcaca

SEQ ID NO: 49824 - DNA, 1853 bp, Bovine  19866880351884
gaaaggctacctactccagtattctggcctggagaattccatagaatgtacagcccatggggttgcaatgagtccgatacgactgagcaactttcactcactctctcccctggaaatttgattcttgccataatttcaatcattgtccagctactgctgactccaagattggtatttcagtccttgagctgcccttaagtataggtctatctattcagctgtcttctggacatttctccttagacttcccgtgtgtgtgtatgtgtgtgtgctcagtcatgtcagactctttgtgaccctttggactgtagcccaccagcctcctctgtctgtgggattctccaggtaagaatactggagtgggttgccatttcctctaggggatcttcctgacccagggatcgaacctgcatctcctgagtctcttgcattacaggcttattctttaccactgagccatcagggaagccgctctgcttctactagatttcccacaggaatatagaattcaatatacaccaggaaaaactcattttttttcactcctccttgccaaccttgccagtacttttctcctcaaggaaccactgtcttcctgtattggttggtgatacctctgtctgcccatctaagtaggaccccagagcagcatcctcaacccctctttctttcgtaactatgcatacaatcagttctcaagtcaaaccgcattttgacttataaataactttcctatcacccttgctttttgtccttattgccaaggccccagctttggactgtttcaggagacttcaacaggttcctttgaatcccagctcagttcactcccaattgtgctcaaccttctttaaaaacattctttctaaaactcaaatgttcctattttgtactccccctatgacgcccataaaaccttctattacctgcaacctaaaatgtaaatctactttcttactgtggatctttgtcactgaagctctgcctactttcagccttcttcctgtctaccatgcttttgggtatatacaaatagggaaatcaaataaaagcatggatacacattaatagaagtgtgtaccactgtggtttcctttatacatctaaacaaaggttttcaaaactaattacatacttcctttgttttcaggttgcagacaaatactcattgataatgaaagtacaagatatggatggccagttttttggattgatgagtacagcgacttgcatcataacagtaaaagattcaaatgacaatttgcccactttcagacagaatgccgtaagtagataatatcaaaattgatctctattgctgtttttaatttaattggaattaaagtatttatcatccttcgaagtatctatgcttatttgatcaataaaatgaaacatatggcatataaatctatttattcatattggtatttatattatctttcttttgttaaaggctatggtattagtcttcatttgtatcaaagttctacgttcatgtaaaagtaactcttaataaaacaatgctttcatgattcatgttttgaaataatctaggcaaaagctttaagaacaagtacttttggagtgaaagacgtgttttactttctttgtagaagtttcccttataagataaggttttaatgagttctctctgtttcagtatgaagcatcagtcgaggaaaacacggtcaatgtggaaattctaagaatacccgtagaagataaggatttgattaacactgccaattggagagccaattttactattttaaagggcaatgaaaatggacatttcaaaatcactacagacaaagcaactaatgaaggtgtttgtctgtgtaaaggtacag

SEQ ID NO: 49825 - DNA, 607 bp, Bovine  19866880468662
ctccaggaggtggtgaaggacagggaagcctggcgttggcatgctgcactccatgggatcgcagagttgaacacgactaagtgactgaacaataacaaatcaggttttatttgttaatatttgttacctctctgtctagcttagatgacgatgtggtgatcacgcctgtagttggatgcatagaaaagagggtgggtaatgctggaaactgctcaatgatggagtacttcagacgcgtgtggagtgtgtcaggctcatcttggtctgttgcacaaacctgtcccacggtagtacctacatacacaaaaatcctctttactttccaaaacctttacagtttcaactttccctttgactcctatctatcacaaaaaagtttcacacgacaaaattaataataagaatagcgtttgtacattttcaggattccatataaagtatcacttctttttaaatatcccaatgttccaacattttgaaatttggtgaccatatccatatttactacgtttactgtataattttataaatgttgataatatccccccatggccttagtatttcttaactaaagaattccaattattctttaagctttttctattta

SEQ ID NO: 49826 - DNA, 2044 bp, Bovine  19866880468955
ccaaggtgatggctattaagagagggagcctttgggaggaaattagatcatgctcctcattgagatttatgcgtttactaagtagaccccagatagctagctcatatgatccaccatgtgaaaacacagcgagaaggtagcaatctgcagcccggaagaggagtgtcaccagagcccgaccatgctggcacctgtcgtccattcttattctaccttggtggttgtaacttagccttgtatacaatttcattttctcttctttcttagcatatcaattgcacttctttttttactttttttagtggttgactttgcaatagacattttagtggttgactttgcaatatacatttataactaatccaagtccatttcatggtccatttataataaaataatcctaattcttgccttccctccctcatatcactgctgtcattcatttcacttgtacataagcatacatagttggatatattgctggtattattattttggataaatgtgtctcttagatctggtattattattttggataaatgtgtctcttagatcagttaagaataagaaatataaaagttttattttaccttcacttattccttcaccacagcttttcctttcttttttaatgtacatctgagtttctgacctatatcatttcccttctctctagagaacttcttttaacatttccctgcaaaacaggtctattggcaacacattccctcaatttttgtttgtctgagaaagtctttatttccactacactttaaaggataatttcacagggcatacaattctagattggtggctttttatctcgacactataaatatttcagtctactcttcttgcttgcaagatttctgaaagattagatgtaattattatctttgttcctctgtagatatttttttccatctaggttctttctttctctttgatttttttctttctctttgattttctgtagtttaaacatgatatgcctctatggaggtttgtttcttttttgttttgcatttagtatcctattcagtgttctctgaacttcctggatctgtggtttggtatctgacattactttggggaaattctcggtcattactatttcagatatttcttctgtttttttttcttcttctggttttatcactgtatatatgttatattccttatagttgtcccatggttcttggatatcctattctgttttcttcagtcttttttcattttgcttttcaattttggaggtttctattgagatacccttaagctcagagattctttcctctgctgtgtcgtctactaataagcccatcaaaagtgcccttcctttctggtaatattttctgacctctagcattcttttagactccttctcagactcttttccattataggatattataagatactgagtctcatttcctgtgctatatactatgcccttgttatttacctattttatatatagtactgtatatatgttaatcccaaactgcccatctgttcttacatgctgtctactttatccattagagcccttagaatattagtcatagttgttttaactcctggtctgatgagtccaacatccctgccgtatctgagtctggttctgatacttgctctgtctcttcaagctgtgttttctgcctttaagaatgttttgtaatttttttcttgatagccagacatgatgggctgagtaaaaggaactgtcttaaataggcctttagtagtgggatggtaaggaatggtggcagggggaagtgttctagagtcccatgattttagtgagcctttgctgctggactttgaacttgacatgttcttctcagccccatattcccactccttttagatgggaccggatggtcagagctgtctagagttgtgtgtttcccttcttccagattagttaggctccaataaatccctaacaggtttggttctggttaaataatttctcctgagggcagatcatgttaagaagaacagaatgctctagcatattttgaaaatggctccttctcac

SEQ ID NO: 49827 - DNA, 1576 bp, Bovine  19866880648273
cttgaaaaatgggtcgtttaagctgcaagagcttcaaatgattcgccttttgagacagcaggtgttagattcagcagggtcctaatgccaggaacacatttacattcaaattaaactgaatataattcgaagctatttcttcaaagtaggaacccctttgtgtaagaaaataattgcacatatgcaaaatttgaaataaattttttatacttaaaacacccatcttggacatactaaaaacgaactgaaaatcgattcagtatttcccccttttgatactaaatggtgctgcatacttatccttccattaactttcccatcatttactttgaattctaacttgaaaaatcaaaagtgtatgcccatattcaaaataaacatgactgaaaagcaaatttccattataattgcctaagttatttaaaacactttaaatgaagagacagatttctataactaaagcaaaccccctttgcccaacctacctccctgacatgtgctgctctcagtgtctctactgaaacaggtaaacgttccttcatgtaaagtctgattgtggtttatctgatctgatccccttacaacaatgacaccatgaccatgccttagaaaacattttctccttcagtgaatatcaatgatgctacagaaatatcaagaggataccaggaaaaaaagggtttctcagtgacattatgagactttgagtgaaaaaaggcacatctcccaagctcatctgcaatgacttcaggaagaaggaaaaatatactggcttctggtttttattgtcgttacaaggtaagcacaagttgagggatcccacgtgtaggtaggagcttgtgtggtttgaatattccaccaaaagagggagaatccaggctttcttagcttgcacaaatgtagagaggaaaagggagggatggatcttaaaagctgtcatcagccaagcatccaaagcatggagtcagattatttattgcaaagggatttgtacgatttgaggaagtttaccaatgtgtgatgcaaggaatttgcatagattattgtaaagacctatatctgaattattacatgcaccatatctaggtttgcattatccactcaactcccaagagcacccagaaacacaaataactgtggatttaatgtccctatttattagcactagactttgaataacctgaggacaagaaatatattttataggcttggtatttccagattctactatgtcatctggcacatagtgaatgatcaataaatgtttattgaataaatgaatccattaactctactatactataaaattcattttaaaatacttgagcataaatgatgcagtagctggcataatagtttgccctaggggcagttagataaaatgtgcaatactttcatcaggattataccctccaaagtggttggttaacattttaaagactcttatcagaagttctcattctagaggaagcttctacaaaagctctaattatctttatgtatcataaacatttatagggtataaattaacaaaaaggatcagaaagtggtatttagctgatagaatatgttttgt

SEQ ID NO: 49828 - DNA, 1643 bp, Bovine  19866880650046
gacttatttgtttagatttatttatttctcacacagagaaagatttaagtctaaagggccacctgacctctgcaattctttagtttttagtttaagaggtgtcaagaatatatgcctttctgtgaatttcaaagaatgtgtcttatagaagcacagtgacagttttcataaaaaatatttattcacagctgacttgcagaaagtactgcttatgaataaaatctaggcctcaaaatagcctcttgcttataaaatattatctatgtcaggctacccagtttattctgaaagactctggactggtaggaatgctttacatgttaatgaagccctcacaaagcatatttaggttaagtgtataggactgaagaaaacagaaactacaggaataaaacagagcgtgtgggcttaatgtggaagattagaaatgtataaaggagttaaaaagaagttaactgtagaaagccatctgggtctcagagattcagtgtgccatggaaagtccctacaattccagtgaactcatggacttttatctgggtaaagtgttactaaaaattagaagtaactcatagctattgacaattactaaggaacaatttcttaaggctgtttgcatagagtactgactaattttatgaaaaatgaccacttcccattatcatcaaaattgttggcaaacttatgaaaagaaacatcagcataaatatctgtataatttggaactctctctattcagcacacacacccaacttaaattggcttaagagaagcaaaacaaaacaaaattattgaggataaaggcatttgttaggtcatgtaattgggaagtccagggatgtcctggattcaaacatagttcaagtcaagcgatcaaatgatgtcaccaagatactggctgtctcggacttccctggaggcccaggggttaagaatctgcctgccaaggcaggggacaccagtgtgacccctggtccaggaagatttcacatgcttcacagcatctaagcccttgtgtcacgactaccgaacctgagcccacacatcacaactactgaagccctgggcctgaagtctgtgctcttcaacaagagaagccaccacagagaaaagcctgtgcaccacagtaagaagcagtgcagccaaaaacaagtgaataagtaaagctatcggttctctccatctcttagctctgactttctgttggtttcactatcattcagtgtgttctcagtacagagccaaagatggcaaccagaaactctcagactgcagtcagttgttcagtaatccatagttggaagagcatgtctcatttttactaattggagtaaacacaatcccactggagagtcttgccccaaaggctaacctcaagggaaggccagagcacatgggcaagaagtggtgaggaaggtcttgctccaagacagttgtcagctattgacagaaaaaggtgtctggaaaaacagattatatgatgcccagtaaactgaccttttctttattctcatttcaacagtgtcagtggattatccatcaatcatttattaacaccttctgtttcctaagcactactcatggtgctgctgaatggaagctggaaaaaacaccatctctgccctcatgaagcttacagtcta

SEQ ID NO: 49829 - DNA, 951 bp, Bovine  19866880732469
ttacttactgttggcagttccatgtatggaatgttatcattgacatcgaggattttaatgttgcattcacactctgctgacataccatctgccccaccatctcggtctgagcctcttacagctagagagtactggccatattgctaaaaagacacaacaaacaatatcacagttgatgcagacagttcttattttgtcctgtacaaagatcttttaaaatgttggctcaacatttgcataaatctatgatgaagatagaggtaacacagaatgttgaaaattcacaaatctcacatcaatttatatgaagttgccacttctattcccaacaatgtctatacagcattatttaaaagaagataaaatatttaaaagccctcattccttattatatgctgaaaaataatataaaggacgaagcagaccaaaattgtcaggaggggagagattgtttaccaggaatttatagaatgaaaattctgtacctaaattattagcccctgaatgtgcaagtagaataaagagatagcaaatgtttgcatttctggggagtgccaggatgtggcagtacagttactgatgatctgttttcttgattctatttgatggtgcttaaatttttagaagctgataaaagccatgaagccttttctagatatatgtatgtgtgcatcctcactcaaagttcatatacttttagaggattcatagttagagatgtcttgagggctctccacaaatcccaggttaagaatatctgctctgaaaaaaagggagaggcctcaaattaataagattagatatgaaaaaaagtgaagtaacaatggataccacagaaatcatgagaaagtactacaagcaactgtacaccaaaaaatggacaacctggaataaatggacaagttcttagaaaggtacaatctcccaagactgaaccagaaaggaacagaa

SEQ ID NO: 49830 - DNA, 1029 bp, Bovine  19866880758983
tttgaacctcaaagtagcatagacccagtgtcaaattctcctcttatcttgctttaaaaaccacattgaaataaatcaccatattcacttcatctgaaggaagacaagtacaatcccgaatgaacccaaatcaactataaactgtgtcttttaaacaaatcaaaaaaacacacaattctggcatactttaggttctgtgtttgtaagtatgtccttctaacttggttgcaaaacaatttatgtgattcttttcatgattttgtgtccaaagtgcaccaacatgaaaaagtccatctaaataaatatcaaaatatattatcaaaattacagttaatttctaaccaaactctttcaagtaattacataataacttctaaagagtctgtggagaaggaaatggcagcccactccagtatccttgcctggaaaatcccatggagagaggaacctggtgggctacagtccatggggttgcaaagagtcagaaacgactcagcaactaaacaacaagagtgtctggaagacgttagaattttgctttatgtgtagttttctggtaaagccctggaagaagaaataatgataaagacctctattactgttaaaaaatgtattcatcattccattttctctttcgcctacaaattcagaaagcatatgcttatgcggatgaagacgaaggacgcccatccaatgactgtctgctaatctacgatattgagggtgcaggctcccctgcgggctctgtgggctgttgtagcttcattggagaagacttggatgacagcttcttggatacactggggccgaagtttaagaagttggcagacatcagcctgggaaaagacgttgaaccatttccagactctgatccctcttggccacctgagagcactgagccggtctgccctccacagggaacagagcccactggtggtggacacccacccatctccccacgtttcggcaccaccaccgtcatctctgagaacacctacccctcgggacctggggtacagcaccctacgc

SEQ ID NO: 49831 - DNA, 1157 bp, Bovine  19866880796233
tgttgtttacttatcggaccacccccgctaagacccctcctctgaggcagggctcacagcttcccagttcagcactgtgtcccctcatcctaactccaggcccagcaaacagctgttcaggctctccataaatatttgttgaaagggcaaaagtatgctcagaagtataattctacagtttgcgaaggcaatttctcaggggaaaaaaatggcatttatgagcagagctttccagcaaattatattcagccataatactacaagcatgcgtataattatctctgtatttcttgtttttgcgtgatactagttatttctgcaagatctgagtgtttgcaccaatgtgcaaaaatgagcactcttaaacatgacagtagatggctcctgtttaaaagttctgacagttacattctagaatttaaggacttgatttgggatcttctgttttagaaacaatatattgtggaaagtgaaaggaaatattttacttcaaaaaaggagaagacgagcattttctaagcataaattcaatgaacactgtgtttggtctatacatgataacatttacaaataatttcaagacatgttaagaaactgatttaaaaaggaaacaggtaggtaaacttaggggcgaagtgcctttcctggttatagaatatacatttccctaaaatattcataatttgtcactgtagatgattttactttagaaaagtatatttttaagacagtgtgtctggaatattacatctagtgtgtcaacactggtttctcttgctgtgtattctgtacttttatgataccatacgttctcacgtggggaagcaataaaggcatttttctctgccaagctataggtcaaggctaatataaacaaactgtcaacttttatataagaggcttcctaaagtttgcagagtgtaaagttccaagacaaaccccatggtatctaggtgaggccttttgatacggatagaaatctctaggaaggcattatggaatccctcaattataatgattgaaccaccaccactgcccagctgagaagttacaaaacacaataaagttattccagattatctcagccagcaatcaggactttcgcctgcatttagtgcgacctcggaagactagtggggcaggtctcaacatggagg

SEQ ID NO: 49832 - DNA, 664 bp, Bovine  19866880892036
ggaaaaccagaaatttttacttctttgaggttctgtttcggtgccttgggaagggtaattgattagcgtgctcatcagaaacaggatatttatagttttcttagacatcctctcttcaaggtgttgaagtgctgccagaatacataggaatagttgttgagtacagtattaattttagaggaatttcatagagaaatggtgatttagacatgactttgggcagaatgatcactgaaatatcctgtaagtataatagtgcagagtaactttaaatatataatttctgaaaatgcagttacccatgggaaaaagtgcaaagtagaacttctgtatatgttgctgcttctgctggaagaaggtagcaattacatagatctatggtctgtataaattgtttcttacttgcctacctggttttatttaagcgaccccatttttttactcatctaaccctaaatatttagagccgaaccttgtaatgcatcatattcatgggttcagttcagttcagtcgctcagtcatgttcgactctttgcgaccccataaatcgcagtacgccaggcctccctgtccatcaccaactcccggagttcactcagactcatgtccattgagtcagtgatgccatccagccatctcatcctctgttgtccccttctcctc

SEQ ID NO: 49833 - DNA, 1289 bp, Bovine  19866880959157
ttttttttttttttttttgagttcagaatagcaggaaaaaatgtatatatcttatgcattcttgaaaggaaaaagatgaatactttaattcaaacaacagatatttcccccatttaatctttgctgttattttttgatttacaataaatggctccaataaaagtgaaatatgattttcgccatcatgctgtggttttcttctgatgttcaggaagccttgtgttgcatacaagttatttaactgtccccctaaggtctattggcattaggtagatatcttgattgataactgtttctatgcaacactaagccttcttgtgttttgcttatttctagtaaatgaaagcaagtccctccagaccttgaggcaaaatttaaatcagtattttacctcatgctgtactatctctcctctcatggatgaatctaatcctgtgacagcaaatgctctttttctttcacagtccaagtgatcaagcaagtttaattgcttcaaaataatgcaattgaatttatacttttattgtctaatttcctttttggcagtggatggacagaactggtagttgaagcacttgttatatatgtcaccttcatctgagggcttatatgtggttttatagttttcttctttaaactacaatacaccagcatgtctgtcacagtgccattaaataaaagatgtaagaatgggcattctttaaaggctctttcatttattctgattatattctagcctccgtgtttttcattttagacccgttaggggcagtagaacacaattcacaagactgcattataaaaatactgcctttttcatagaaccatttagttcaacatgatttgtctgaaagatgaatatttcagaaagagatttcaatagaaatcaatgtgtgtcaaatgtaatgtgtaggaaagaaaatagcatttgtcaaaaagaatacttacaaagcagaatgtaaagaattaatggcttccctggcagctcagatggtaaagaatctgccttcaatgcaggagacccaagtttgatccctgggtcaggaagatcccctgaagaaggaaatggcaaccactccagtattcttgcctgaagaaccccagaattaatatgtttacttactagtaatatgatactctatttttaaaattaatagtactgacttttattttcattttgtcaactggtctttcttttgagtgtcatatagagtttccactataactttagtatgacattattacttgatttctgtaagagaatgtacttgacttgctggttcaaactg

SEQ ID NO: 49834 - DNA, 1356 bp, Bovine  19866880964985
tagacagagttcttagaaattactttaaagattgtttctatttatcttaaccataaaacaaggtgaaactgcttggtggcatgaaaccatgccttctttatctttatgtccctagtatggcaacatcttacaagcttatagatctctgtgtcagagggcaagatgaaactcaagtctaggactagatgaaatggtctcaccagactcttctagatctctttatgtctttttaaattaaatcattaaatagctcagctgactatagagttaaaatgattttttctttacattctgttccttaaggaaacccagaatttctcaaccctggctaactatgaaaataattggcgatgtttaaaagtaatttcaaggtatagacactatctgagaccaactgaattaagaatccctgatctaggagcctggacatcatatatatatatatatatatatatatatatatatatatatatattttttaaatctgcctagatggttaaaatatgtaccaggattagaaaagtttttctatggtcactttactctttctgacatctgtaccaaaaggaacccaaggaactagagagtttgaaattcagacatttatttttattttttggtaaaaattctggttaaaggtttatgggcagttatatctgatactatcaacagcacagtagtcattttagatgctctacaggtttcatttatccatctaccttcttctttgccattttctctaattatcagtttatttatttaaaaaaacccaggagcttccctggtggctcagtgttttaaaaaaaaaaaaaaaaaatctgcctgccaatgcagggtactggtctgggaagatcccacatgctgtgggacaactaggtctgtgtgccacaactattgagcccatgtaccccagagtctgtgctctgcagccagagaatccattgcaatgagaagcccgtgcagtgcaattagagggtgatcttggcttgccacaactagtgaaagcccacgtgcaagcaatgaagacctggcacagccaaaaataaataaataaaattaaaaaaattaaaaagtccatgcatatttagaatctagctgatttttttttcccttaaaaaactgtgaactacactcaactttttttctttcttcctagatggtagatcatgtactggaaccctcgcagttagcattgaagatgtgaatgataacccaccagaaatacttcaagattatctagttatttgcaaaggaaacatggactatgttgacatttcggctattgatcatgacagttccatcaacggtgctccattttacttcagcttggcaaacacttctccagaaatcaacaga

SEQ ID NO: 49835 - DNA, 2196 bp, Bovine  19866880975305
ccctcctccccaaaatccccaaaaaactttcctgccactttggagatggcttttccatggttggctgtttgccacatcacaaaccattgtttccagaactcttacaaagctggtgtagataacttctggttgttttcttgatgtttttaggtaggaaggagagtttggatcttcttagtctgtctctgatgttagagtctacggagtttgtaagtacccaaatgatgccaattttccccatgtttctccccactttctggcatttcatttgccagacaggctaaggaatgaaaaaaaattaaagaacacattgtttattgtctgaaagttgagttttatcccccattgtgttataagtaacatactaaatcctaatagttcaggctcaatgagagaacttgcacataaaaatatttataaaatttttctgacttgggtaatgcttatatagaatatcttatggtgctatgtttgatttccctgtacagtgggtaaatatctttaaatttttatatacttcaagtatcacatttgatctcgtcataaaattgtttgctatcaatttaaaacaaggaatagtggtttctgctttttaaagtgcaatttaaaatatctagtatcattgccttcatttttaaaatcctattttggagatttcttatggttttcattgtcaaagaatgatctttctcttctgataaaatgtaatatgtggacataggaattgtctttgtgaagataattttcaacattgtgttgatttaatcaacccaattaatgttgtaattatgagatatcctcacaagtaggtttcaaagttggtttttactttcaattaccttttcaattaactaagaagtgcttcatggctgaaaatttgttcaaataagacctttgagaataaaggggtcattttgagagaatgaccaaccaaggacttttaacgaagaaagagtaaacgttacagagataaggtgttttaagtttttgacagcgtgtaagaacatgccaagaactatatttaaaatagatagtcaacaagggcctacagtatagcacagggaacttggcttaatattctgcaataacctaaataagaaaataatttgaaaaagaaatggatactggtatggggataacagtatccctctgctatacacctgtaaccaacacaccattgttaatcaactacactccaatataaaataaaaatgaagaaaaaatcatgccaaaatagtaaaggccacatgagatgataactgctaatatcatgataaaccttctagtgcttgtgttttgtgaatatttttgattattccattatactttttatgtttctggcttcttaaaaaaataagtattgcataataaaaatgatgcaaactcattattcaagaatataaacattgacatgaaagtacaaataacaaaatacatattcatccccaaattatatcagtctgaactatcacagttaaatgtcggttctgttcttatgatagcaaaatttcatcatccacacagcttcgtgtcccaaaagataaaagctgcgtttgatctttctatcaaagctgaggtttcaaggtgacccccaagaacttctactcacagtggcttttcatttataatttccaggtctgctcactcaaattatcagtccccttatatcagaactgaaggcttttaatgagaatatttgggtttccccaatagctcagcaggtaaaagatgtgcctgcagtgccggagacacaagagatgtggattcaatccttgggtcgggaagatttcctggagaaggaaatggcaacccactccagtaatcttacacggagaatcccatggacagaggagcttggcaggctatagtccacagggtcacaaatagttggacacgactgaagggacttagcacacatgcattttcccccctctcgtttgatatttgatgcatctatttccccaggtacttttgaacttctttccaagtgagccagctgtaaaaactctactttctctttctctctccactccctactactactggctgcaatgaaggaagatactcagtctatctttgaagggagggtaacactcttggatacaataaataaagtcatccatactgggtcagcatcattttgagtgttaccactgtcactcagccctttggtatttgtgtggggagactcccagg

SEQ ID NO: 49836 - DNA, 1095 bp, Bovine  19866881078042
tttttatgctggaatgtacattagaattacttttataaatacagatgcttgggtctcctcccaggccatttaaatcagaatctctgaggtctgatcagagtccctccatgtgattcttctgtgcaaccggggttgagaagtactgctttgtagacactggaacttttatttcttcctcaccatgtgaagaaaaccaagatacctgttttaacaggtatattttttatatttatataaatatatatatatttatattatatatatatattatatatattatataaataatatatatttatatatatattatatatatatttatatataaaaaatatatatattttaacaggaatattaagtatattcatgtgtatctggatgaacatattgatcttgggaatgttatttctataatatcacaaaaacctattgaaaggagaaagaatgatcataggcagaaatttaggactgagataattcctggaaaggaagtgggaattaagataggagacagaaatggagaaggatctagaaatatcgtttgaagatctaaaaggctgaacagcagcttgaaaagatattagaatcaaaccagaaatacctggaagagtgataatgaaacttacctaggccaagaccacagggaaagataacttcatcagattgtgtatttataatgaagggaaagaacactagcagcctggagtgtcaggtggcttttaggaaaacagtctctacttgaaatgtgaagttacatctgaattacagacaaagataaccttgttttatcaagaactcaagacacagcttaaccaggctggagctaaaacattttaagcaatgagaaagcaaagtttactgaacttttataacctggctcttttctagtaacttgccaacaacagctcctcatttcagaaaataatgattcatgttaattctgcatttggggtatagtgtaagtggaattatacttaaattcctctgtctgtgcctgtgaccactggttaatttgaagagatatttctgctatgagaatagatgacccatcagtcagttgctacatgattatggcaatttagaccttggcattca

SEQ ID NO: 49837 - DNA, 1313 bp, Bovine  19866881108199
ccctagtctgttccgttgacctggaatgccttcctatttctttacttggctatttcctgtggtcttgctacactcagcccaaaggtcatttcttaggagaagcctttctcgactattcagctgggcgacccttctctttctccttaatcctcacattcataccccttatgaaacacttgtcatactgttttatttttttttctttaaattttttttttttggatgtgaaccatttttaaagtctttattgaattttttactatattgcttctgttttacgttgtggtcttttgcccgtgaggcatgtgggatcttcagctcctcaacaagaattgaaactgcaccccttgcattggaagtcagtcttaatcactggatggccaaggaagtcctatgtcatactgtattttaactcttactacttcctgcatctgactgtgagggccttaatggcaaagaccctaattcaacctctttattcctagcactgagcccataggccctggtggctcagctggtaaagaatctgcctgcaatgtagaagacccgggttatagttagaactaaagggataaatacaaaagtaacacagcatttatttcctctaaaggattgagtagggcttccctggtggctcagatggtaaagaatctgcctgcaatgcaggagacctgggttcagtccctggatcgggaagatcctctggagaaggaaatggcaacccacttcactattcttgcctgggaaatcccgtggatagaggagcctggcggactacagtccatgggggtcgcaaagagtcgaacatgactgagcaactaacaaaaagacatttttaataaatggatgaatgagcattggaaatagatcacaagtgactcccgtatcatttttctttttctcacttttcctcgtcttgaaaaggaagatcatagagtagattaaatgagaagatttttgaaaagtaactaccatgatgcttggtgcataataataataaatacttgttctttcactcttctttctgtacagctcttatctacgagttgtaaaggtttcggatttcccacacctggtggttatgcctcactggtaccaaagtttccaccctgtcagtacctccttgttaaatacttaaggaagacttcccagtcaaccagtgtttatgctgatcacatgtaaacactgtgacttttgtactaacacctcatcatcactcaccacacacactcactgcctctattaaacacacattcagcatgtctcttacctttaactcagtcatcttattaatcacagggaaactcagctcg

SEQ ID NO: 49838 - DNA, 970 bp, Bovine  19866881110495
ttaaattgtgacttggatcacatttttttaaaatattcctttccagaaacaaaaggcataatcaggcaatttgtagtcagctttctattatagataccaaatcatagtcttggaaagcttgaaggtaattgactttttattcatttttaaatacctgaagtcataactttaacctaccttataaaacaaatgtggctttttattttcacatcaggatatttttaaaaggttagtgtgaagtgcctataaatatgcaaagatttcaacagctaagacaaacatctcagtaaataacttaattgagctgtgaatatttagtgattgaaatccgattactttgtggcttaatttgtgtactgcttgactgctctgcagtttcaggcaatttaacaatgtagacagtatatgaagatggaatgttaaatagtgagtgagacattcaaggcaaaaatgtcttgagttgtgttcattttttaaagcatctcgctgagtgagatgcaggctcgatgtaaagactccaagtaggcagattatataaaagtcagggaaggcacaggttctttccccccacatctctggataattagttttaccctcttgttgaattttggtgcctattatgctcataaagattaataacatggcgcacaaaatcaccttccctcctgtaaactgcatttctctctatgactgcaaataagaagaatcagtgagtttttgtgatgatctaatgctatcagaagacacatagagtacaggcccttctgagagatcccttgtcatcctaaaacccaactaaatgggattctgatatttcatagagctctattcccataaacaatgaattttaagagattgataagttgggtcaataaagaaaacaaatttagatattgtgtgccaaacactggagtttctcttccatatgtcttttaacaagcacattccagaatactgctcctgttatctg

SEQ ID NO: 49839 - DNA, 1034 bp, Bovine  19866881239825
ggaagtattttcagaagaatggtgcaagtgtctgcatttttcaagatatgtacttttctttcttcatattcttcttgaatcactgctcacagaaaggatgtgtttgcagaaagagccagcactgatctccttgattacttattttcagagagttgatgtaatggtgttaccacagtgcgtttctgacactgtgagactgtgttggggattccaggctgacgttttacagacatcatcctggggactaactgtactgttttttatttctttttcttcttttagagttggcttcagggcctacttgctatggaatttatcttaaaaagagaaaattgttccaattgcttatcatcctctgagaatcacagatttctaagatctcatgtctagtctagggttaggtgtgacagatatttatggttgagtcagtataaaaaaacacacaatatacttaacctttattcagtctgcatgtctgcattataaatgtggagcccaggctttttaccaaggtagggtcaagaatcagagctgccaactaccatttaagtatttaaaacaacctcccttcctctgtgaagtgttaatggactcagtccagcacctggcatatatctgtctatatcacacataaaataaatttaaattggcagtgccagcagagaaaatgagatttcatgggtgttgaaacaagccaaacattcaggtgagaagtgacctcagtactagagaaagatactcttctcttgatgcgttctgagaagccaaacattttaaacacgtccctcactgttttctaacccataaagagcaggtacaagaaacaatgccctcagacctcccacgatgagaaacacatccaattccacaagcatgtgtagctattgtgtaagagtagtgattacacacttacaggtttatttctacttctgttttactcatttaaaacgcatttactctcataacagtaggtaagtgggagtgcataggtgtcaactattgttatgctttttccacttttcaaacagagatat

SEQ ID NO: 49840 - DNA, 1205 bp, Bovine  19866881333514
aaaaatttcaatattttcctactgcacgcagagatttattgctagaattgaaaaggtaactgtatataacttagtctacccctgtcatttcacaaatgagaaaactaagagaattcagcaagtacactgaaagctctctgaccctatgaagtacttgatttcattattttgcctttgaaagtccaagaatggctatttcagagttttttgggtttttttctggactctgagcaaatcacagtaagattatgttaacaaaacataattttaagcagacttggcagttttttaattactaatccagttgagagcctgactctgtggtgaaacttgcttggtcttctgcctgagttgctattcatgggaaaaagaatgacccagcttcataaagttggaaggtttcttagtcatctggcatagttctccaaagcaaacagcaagcactgacacttcggtgtggtaagggaagcgcaagacaaataacagatgcatacacaattctgtaactacgaagaaatggctcccagacaaataagatacccccacaccccagttccacacctacaaattagaggaaaaagtgttcatgcgttcacaggtagcaagaaatacatacctgcattaacattatttcaatttggtgcccaagagggactctacaataacaattcagttacttgtccaaagtaacttggaccatttgggtcatttatttttctttctcttcccaccccacgcatagcattactgttattgctgttattattgtatataagtactcctattaataattcacaaggatattatgagattagattaaaatcagaattattttgaattctcaaagttgtaataatgtcaattcttcatagtatattttacttcgaaatttacttggaataagccatcttatattacacataccacaaacacaaatttaggctgaattgttttggattgtgagtgtgtgctcgatcactcagtcatatccaactctttgtgacccagccaggctcctctctccatgggatcttccaggcaagaatattggactgggttgccatttcctcctccaggggattttcccaacccagggatcaaacccctgtctcctgactctcctgcattggcaggcagatgcttttatatttagccctaaattaatatccaaacctcaatttcttcatctgtaaaaggaaagaatt

SEQ ID NO: 49841 - DNA, 748 bp, Bovine  19866881386756
tctcttgaaaagaagttgcttatatccttttaccaactcaaatttcagcaaagtcacaattaaactcctccctcaagagcagcatcgactcctaatataggaaatctgtgtggcagattttagaaagttaactacagctcagcaagaatattgacacctcatttctacataacttttgagataggtgtaagaaaaaacatattacaagatgttaaacataaataggcatttacatctatgctgaaagggttcatttcataaagttgtcatatagagatttattatctacttatttgtattttctttgtaagtagttgacagtttctgcttgatcctgacatcatagaaattcccttgtctaaatcatatcactaaaagaagaacactgaccacaaggcaatctttactagtccattttatttcccttcttaaatctctaggttagtaaaactttgagggagaagtttggcatgaaaattgcaagccgctctgaagataaaatgttatatagtaccatgaagggagaacaagaaaaagatttgatgggatatatcagaaatctgagacataaagcacacacacattccctttttcagattttattggcattctggacctaagagatccataatgctatactggagtccttcatggattatggagtattaagggccaattcttcagagaaagagttatgagtggacttcattacaacaactgaggagatcatattttatcagcaacaacc

SEQ ID NO: 49842 - DNA, 1320 bp, Bovine  19866881394603
ctggatctctgaatcagttctcaaaaagagagccataataagaagcacccattacataccttagtagctgaggaataagtttttgtcttgtttcagacactggaatgtttatagtttatatagcttcctcatgtcatcaaatctgcattcattctcccctaccccacaaatctaacacccctgaagacaggatgcataatacaatcaaaggtgttttaagattgtctactagcactttttccttcatcaaaaagtaatgtacgtttttacaattaagtgtcagatttaatgaaatatagtaatccacaggtcatcttgatttcaaaatccatcatcttaatctctacctacatgtgtacccccttaaattatggacggcattgggtatggtatctatttggttcatggtattattgtttgttaccagatttcattttgttgtttcttccttcctgctcagtaattcatgtggaaaagaacatgaaagtttttatagacatatttttaaactgtatcccaggtgtgtaggcaaaaaattgatttttaaacgtgttttctgctctttagaaaatccaaagcctgtgatataaattgaagatattgcacatattttccagagaagaagctgccatgtggtcacacgtgaaataaggtttggcacaaattaaaatgatttgtatcataaattaaagtacactttatggtaaagatcacaaagggatgaaataaacctagcaataaagatcaagtgaccatttgttacaatggacttattctatgattgggcagcagaagcatggttagcatgataagaatataaatcttgactcttggctctgtaatgtcctagctttgtgaaacggggtggtatttaagcctacaaaacctacttttactcatctgtaaaattttaataatatttattttataagtttattgtgaagattaaaacagatacattaataatagtttcctaggaaatgctagattcttctctcttttatcttacaggattttcagttgacttttacatctatctgatttatgacttaactagatgaaagtgaatgcaaaattagctgcaatctcacattgcttgcttcaataaaaaagtgaaagcaaatctaaacttttccctgtgtgcctcattagctcagtaaaatctaattttcactaatttctttctcttcctatgggaaagaccaagtgattattggaattcatggtcacatttcggaattttttcatacctctctggacttttactttgtaacagagaaccgaattgatttgattttaggctgcaggggtaagggaaag

SEQ ID NO: 49843 - DNA, 2022 bp, Bovine  19866881720817
tgtagatggttaaagttttttaaattataattacagaccccaggattctgaatttaatggactgttactctaggttcattaaagtaggactaattttcactctgttataatctatgtctctaatttcaaaataatggaaactcctggaaattgctatcaaactttgaaagcattatctgctactgaaatatgtacttccaaagaagactctgtgtctgttgaaccagccagcctcaccgtattaccattaaccctcacacattgattaaatactagtgtgaccccaaggcaatttcaactaaagtttttttttttttattcctttctataagcctcatgcttccaaagctattaagctactctattcttctgctaattatctgaaatgttattaatctgaagcctaaaactcatagaacttcttcaaagctattctacaatgacaatggagttgaagttaaaaatataattaacagattgaagaaagagattctagtggttaatttccaaacttttagaccttaacacacatgctattatcttcttttgtctgatttttttcttccccactacaaatcatttttaaatggtgaatttgcagtcttttgaattttgcaaaaagatcaggaaatagtcaccaatgaaaaacaaatgaattattttcagatgctagctaatattttaatacttcgattcgaaaatctgggtaatctataacctactttatcaccttcccagtggaaccctcaccccgactcggcttgcactcctcaagttaacagtgtcctctggagagatgaaattctagtagccccaaaattctatagaattttatttatagaattctattactcttctatatagggcttgagccctaaggaatgcaaagataaaacaaacatgtattgtgtctacttgtaaggggcttctctggtggttcagatggttagctcagaaagagatataaagaactgttaaactgtgtattcctataagttgtgtgtgtgtgtgtgtgtgtgtgtgtatgtgctcatgtgcgaccatgctcagtctcctagtcgtgtcccactctttgtgacagcatgggctcctctgtccatgggattttcatggcaagaatactggagtgggttgccatttccttctccaggggatctgggtttgaactagatcccacatgccccagctaagagcctacatgccacaactaaaacccagagcagcaaatacataaattatttaaaaaaaaaaaaagttaaagttacagaaagaagattacaattcaaatgtattaaaagattttgctagattttatgaacacaaatctggaaaacaggtgtgggaatgtatttttatgatgttaaagcagaaaaggaaacaatttcaaaaatactgttgtgagtcaagataaccccaggctcacgacctatctagatcctaagataaagtctatgggaacatctcttcaccatgattttcagaaatattctgatgcaagtagaaatagaacctttggtaagcgttgtaatgactgatttccatagtccaaggggtaacgaaagatattgctaatggaatggatatttattttcattatcaatcctggaagcaatcaagaagttcctctaagttctaggatgaagatatagatactctactcaactagataaaccattagtagttccttattgatcatggagtccttagcaatacatttagtggctactcagaaagttcctacataaatctggtactggaaatattttatgtgcaccaatcaaagatctgatttgagccattacaacaaccatatcctggtacccgattcacaaagctgtatcaaatcacagaattcacgacttctgaagtcctctgggtgcacttgtgtaaggaaactcgtgataatatcataaaaatatattttaaactttcttaactttttcttacagctacttttcaggcttattatgtgctgagtaaaggaaaatatccatactgcttgagggtgattgaatattgatt

SEQ ID NO: 49844 - DNA, 1000 bp, Bovine  19866881911226
ctttatttatttttaattgaaggataattgttttatgatattgtgttggtttctgccatacatcaaacatgaactgttggtactatacatatgtcccctcccttttgagcctccctttgagcctcccttttgaggctcaaaaattctttaactgtaaaattcttaaatatcctccgacaatagcaacataagactacaaaaagaaaaacatatagcaagcagagatacaaacagacaactctaagaagccatctagacatccatgggattactgcaggtaccatcaactcagctaaaatatccctctaatcctgcactaatctatttggatgcttagccagggcagtgtccttatcaagagaggagaaaaaaaatcccttcccactcttagctgagcatactcaccagcacaaagctcttttctcaggggatatactcacatggaacactgcagtttttacactccggagaccaggaaacctggtcacagcagagtgaagggtgaggtgggcaggactcctaacctggcgaggacaggttgaggaaagaaaagccacacctgttacccattagaacatactatacgctctatacacagctaagaaaatttgtttcactagaatcctatagttagaaagagagaattccaagggaagttgctaagtcaaggtgaccaggctatgtccatccagagttgtaaaatagttaatactttctttgtttctcaaattcaatactgttgcttcctctgggtgcaccttacagtgttgaataaatgtccttactgagtaaaactgctctaacactgtgcaaaatgggaatgttttttgcttaaggtgaaggaattggacgcggaaaatggcaccgcaaaatggcaaacggtcagaagacagaagcgggagtggatcaagtttgctgcagcctgtcgagaaggagaagataactccaagaggaatccgattgccagagtaagtgatgaaacaaacaggaggaggctgtg

SEQ ID NO: 49845 - DNA, 1140 bp, Bovine  19866881958731
ccatgaccacaaagcttgagggtaagagttgtgggtagtggtaacatttgatggtaggtgaaagattagatcatgaacaaggacatttatttactgtaaggcaaaaatggagataatccttcggagaccaacaatttcaggaaccaggcaagggcatcagatgtcccaagatactggctggcattaagggcaacttcaggctctgactaccttggatgtgcacatgaggtagataggaagggtgaggggaagccgacagaggcatgagaaaatattgagcagtaggaactgactagagaagtcagagaggaacacccccccaccacaaaaggagaaaggataagacgtttattatgtggtgctctaaacaaacttaagaggttgtttataaaacactaagaaattgctccatgtccatacaggacatttctagacctaggatcgcatgagagcatatttactgttatgccacgaaggactgacacagtaagtgaccgtgatatgtgtaagagatactgggacaaagcaaggatctaaatcaattcatttattcattttataaagaagcattaagcacctactagatgctggaaattgttctaggtactggggataaaagaatgcaaaattaacaaaccaatgatgaaaaataaatgttcctcccttttgaagcttaccttctggtgaggaagacagacaacaaatacacggaactagtaaacacataacatgtcagctgtaagtgctttgaaatgcaatttaaaaattccagtgacatgtctccctggtataattctgagcccaaatgcacatgtaaggaaggaaggacagaagagagtatatgattcctgactgtttggcaccaaggctgaatggaaggaaaggtctttaaaggttccagagcaacccacattgtcaccaagtcacttgcggagcaggaagtgaattatttgcttctcagcatgccacctctctgtcatttctaagcagtaaatgtactgatgcaagactgtgagaataaatccaactccccctcctcaggagcagcccagcacagttgctttgtcactttaaataagagcattgttttattttttgagtgaaaccagcatttatgttattaaacatgtagatggttaa

SEQ ID NO: 49846 - DNA, 1219 bp, Bovine  19866880547452
atccttgggttgggaagatccccaggaggagggcatggcaacccactccagtattcttgcctggagaatcctgtggacagaggagcctggtgggctacagtccatggggttgcaaagagttggacacgactgaagcaacttagtataccatgcaaaccataagctcactgttacaattccccagctctgctgtcgtagacaatagctaagtgagtaggtgtacctgtgttctaataaaacttccttcacacacatacacacaaaaaaaacaggtggcaggaggctctggcctttgtgccacaatttgctggccgctgttttcgagacagagctcaggggccttctgctcactgagcactccgatggggactcccagcagagctgagtctttggagaggcagaggggtggctccccgtgtgtgggtgcctctgagtgtggctcgctctctctgtcctggagaggctgttaaaaggctcctctttccagcagcggagcctcattactcatgggctggaaagcgatgttaatttcccccaagcgggaagcagctgcacttgtgagccggggctcattttgctgcatgaatatttatggcatgtcccttaattaagcccagaaatcaaatttaccctgttcacgggggccacagaggactataaggccatatcaggaaccagcctcttgcacttgtgaagtaaggttgctaacgaaacatttatgtccagaagcgtgtggtggccagggccagtgtccacaggcctggcgcaattgggcgctctctggcaggtcaggcacccttgctatggtcacatgcaggggtagagggatacctcagccaccttgctgagccctgctgcgtgcctactgtccccagtctttgtgggtgacatagaggtggccccaggccagagcccccaaaatgctttttgttttctgactccaggatttacgattggcctcaaaggtcactctagtggcaacagctcggggagggagagcccctggctgggagctgggtgtgcttttcccctgacacttgatcctgtacaacgtgggcaggctcatcagcaatctagcctcagttgccccatcgtcacaatgatgaaggaaatcatgggatcaccagcatcgtggagtcttcactgagcctcaaggcaggcaaggaagagaaaatatttaggggaaggttccccaaaattctgggtttcctttgcctcc

SEQ ID NO: 49847 - DNA, 1796 bp, Bovine  19866880574096
gcccccaaggacatgtaatcctctggagcttttctttccgaagcttcagagatgagttaattagcccatttcacagatgagaatactgaggcctgcagagagaaagaccaagccacagcccaggtcttccccctccccatgtgatcctctgtgtggctctcagctagaagccagcttcctgcaactccacactggagttgcactccacggtgcgctctcccagagtccacctctgggagaatcacgatcctgttccttcagtggacagagagacagcctaagaccacaggagtcacagaagggcactgctatacatggaatcgttcattcatttgctcacaaatcctggacacaccctgctctgagctccggctgggcactagagacacaggagaggatcaaacagtccctgactcctagcagctcagaatctaggtgaacgagctacacacccactattctaaacccagtacagtgcaagctgcaataggtcctctaagacccagaggacacatcgaaggagcaccccaccaccacccccagactgccagcaggagtcaggggaggcttcacaagagaaagaagcacttgagttgagctgaaggatgagttgactttggtcaggtggccaagctggggaaaggttgcccagacccagggcacagcatatgctgcagcccagaggtgggagcggtgatgtggactgctaggcagactgtggtgtccagagcatcgagtgaaagcctgggcccaaaatggaaccaaaatctagggaccatctcctcacccaattgtccatagcgagtcatggccacaaggaccctcaggaggggcaggttttgagaatgactgttaactttttaagatgttacgagcatcttaagtaaatggccgcaccaaggagaagacccttctctgccctgaaatccgggcagccccagtggcttcggaccagccagtgacgacttcttttggtcattaatcgtagcatgtgctaatgtttgataaattgcccaacagttgcattagctaataactccccgaacaaaaccagagagttcatctgtttttataagaggcccaagagcatcctgggaacaggcacggtggtcgtgaataaaagagaaacattcatttatggtaattggtttcagctcctcacttggctgcttgtcctgacctaaatgtatccagttgttccctctgcctcactctggtttgggggtcactcctaatggtttaattcaacaaaaaatgtctgccatttcctgtaacctctgtcttttttcaccctccctcccaaacggttttcttgcaagcagcatctctgcaagtccctcccggagctgtttccttctcagggaacaaagtcaagattgttgacagagaaaaaaggtcttaactccacgccaagaaaagaaagtgggggaggggatacatgaaggtaataagcatttgtttgtcttccacccggacttcacaaagcaggttttgtccgaggccggtggtcagggactctgacacagtacatggccctggtgaccaggggcaatttatgggagggaatgaacacaagtcctcattcatggagccaccgcggaggaagtgactgaggaggcacattctcgcgggcagccgggccctcccctgtccctcccgcgggtctgaggctgtggagggctagggagaggctcgaggggtgctgtgagttttggccaaacttcaaaacccttggggtagccctgccttcctccggacagcttatttccacacccccggttatgagcacagatcat

SEQ ID NO: 49848 - DNA, 1334 bp, Bovine  19866880743946
ctttgtcactcagaatctctgcattcttccctactcccaaccttctcctggttaactcctatcctgcaaaactcagctcagatggtaccgcctcctcaggctgggtggaagggagtttcttgttattggagatgtctgagccaaggatggaagatcagggcagggaggcaaatcacttaacctctatgggcctcagtttttttctggaaaatgggcccaaaaataagcctaactataggaggataaaggccttgttagagggggaagcacacagcctgtgggggctaagagaaggaataaaaacagcctgtggggtcagaaaagcttcctggaggactcaaacaaggggaagactcagatggggatatttttatttgtagcgaatacgcacgtggtgtgtttttatgcagagagctgctctaggcccttcctatgtgtaacgtcattgaatccttgtgatggcaatatgaggtggccactgtcattatccccattctacacgttaagaaactgaggcactgggagattaggcaaaatgtttgggggcatccagctaagaggggcaaagcctgaattctaatccaagcatgtggctccagtgttcactctcaaatcaccttgtcattacaaggagagcaacaggagtggaggatgggggtccacttaaactctggggcaagcatcactgtacttggtaacacagagtagcgtgaatgtctttgtcctccaggaaacaggcatgccctctggaccctcacaggccagggaactcttgctttgactccactcacccaagggaagggaaggcctctcagtaaggtgttcacccaggtgtctcctgctctgcctggataatgaggcttcatctggggggcagtggctggactggcactgcctcctggtaataaccacccaacacaggcagaagaaacatttttctcctcatttcacaggtgaagaaactgaggcccagcgagacaggaaaggatggggaagtctctaaaaaggcaactcgaagctgagattctggcctcggaggccagaggatctccttagcaacggtggtacccaacatcgccatttctgggggattgctacgtggtgtgcatcagatgggaaaacctttgtcagacgtctagtgctacacctgcccatgacgcctgctcagtccctggacattccccttccttccctcaggaaatgagtgaatagatgagtgaatgattgtagaagtcacctagaaactggcaggaggtgggggaagctttcttgcttctgtgaactcttctggcttctgccccacttgctgacctgggcagctagagctggtggca

SEQ ID NO: 49849 - DNA, 3158 bp, Bovine  19866880918810
gccatagtccatagggttgcaaacagtcagacacaaccaaagagactaacaccggcagtagcagtattgatacttagtaagtcagcgtctgtgagatccacacacacatgttcttctcgtttaattctctccatgtccctatggagttggaagtatcactctgcttatggttgagcatgatcacctaaggtcacgcacctggcaagtcacagagaagggctccaccagaagtctctgactctagaaaactatctggcatttcttcagcttacatgtcactcaaaagaagacttacatttcttactgagtgtaatgtcaaaaagcaacttctccccttctctctctttacttcccttcctgtcccttccctccagtctgtgactctcaagtctgagcagaccctgagtgaaggatttgagtacaagtcatgtttttgagattggacccagggcgttggggaagtgagcttggcagaggaagcccaatctgctgggataccctgagaatcacattaacacttcacaatggcaatgcacctcacaattatacacccacaaggcaggggagttgaggtattaataccctggctcttgtccatcactggtccagaggatagcattctttcccctgcactggctggctcagggtggggtagacctgagtggtcagagaaagcctcaggcaaaaacacgcaggggcttggaagttggaagttggccaggagtggagatatggtgggacgtgggcagggaacccaacccacggaagtgtcttggacgtgtgccactgcacacatgattctggactataatcgtccacttccctctctcccaccagctccttagggcagagtctcatatgtcacagtgcatggcttcagcactggatgaatgttcatcgaacggatgaatctagattcctggactcctactctctccaggcccggaagaggtcttttggggtcatttgccaacatactgtgtgatgtttggcaaactcagcacggccaggggcagcctgctctgtgataagatagctcagactgcaagacagtccttcgtcactgtcttctgtgtccactgactgtgtccaggcctttgctccgtgccccagcaaaaggcctggactagctctggagcaaagcttgcagcatcctctgatgacttgcaatggcagaagtttccctaagaagccgtccctcctctgccatggcccaatgacacatttgtgtgtgtgtccagccgcctccctgctgagggtgggaagtaggttttcttctgtataaacaagtagctcagagacccaaggccagggaatttgatctggggtgaacgcctgggttttgcaattctcctgtgagtctgtgggccagcgttggccgggtctgcatctccttctggaaggaacaggcctatgaaccctacattgtgccaaatgtcccatcaggggattccactttcagctgcaagcggatggggactgagtgagaaggcagttgtgtaactccgggtgtcaaccgcaactgtaacaaaggcaaaacaccaggcagggaccaagttagccttgaggggccaagtgtgccctgtccttcctcccctcctccagttccaagagcagccccatccatctcctcatccagcaaacaaaccttacaggctcacggttcaacaaagcagcagagactcacgaagcccccacttcgtgatggtctgccagatgatggatatagcgaagcaaagacgcatcttctcttgtctaagaactcacgttctagctgcttggggcatcaagaggtgcctgcttggtcagtagggaagaatcagaactaagagtcagaagacttgggttcgggtctaggcaaatctcaggtaaacctctctcagtcagtgtgggctgccgtaacagatatcgcagactgaggacttcagcagatggctgctttcccatggagtcagggatcacagggtgctggcggggttggcatcctctgaagcccctctcctgcacttgcaggcagccaccctcttcctgcctctgcacagggctatccctcgatacacacgtgtttgccatgttgcacgcacgtgtgcagcctctcatgtgtcctcatctcttcttactagggcactagtcagtctgaactaggacccaccttgaagaccccattttaactagctactgttgttgttcagttactcagtcatgtccgactctttgcgatcccatggactgcagcacaccaggcttccctgtccatcaacaactcccggagcttgctcaaactcgtgtccatccagttggtgatgccatccaaccatctcatcctctattgttcccttctcctccttccttcactctttcccatcatcagggccttttccaatgagtcagttcttcgcatcaggtagccaaagttttgaagcttcaacttcagtaccagttcttccaataactattcaggggttgatttcctatagaactgactggtttgatctccagcaccataatttgaaagcatcagttcttcggtactcagccttcttcatggtccaactctcacaacggtacacgactactggaaaaaccgtatttttgtctatatggatctctgttggcgaacttatatctttacttttcaatactccatctccgagtacagtctctttctgaggtcctggggtcagcttcaacatgaagttgggaacagggatacagttcagcccatagcagccacccaactactctgcttctcagacttcctgcctctaacccaggtcaaagactaggcaacctgtgagcaccacatctgtgtgtgaaggttgctgattgtggacccaaagggacagaggcagccggggcgtttcagaaagccatggccctaggggagacatttggggacgtgtgatggattatccgggaagacagacaagctctccctttccttctgtcccagggacacagggtcaagaagagccggagccaggaccgtgggccaggctgtgactgcacatttaccctcatcctctgttgcaaagggagtgtgggtggtggagaaaccacaatgggtgggggcaggtgggctttggctcactctccctgcatccagggatattggtgagcccttcatttcctcatttgtatcatgagcaaggagataa

SEQ ID NO: 49850 - DNA, 802 bp, Bovine  19866881020298
cttgcagcagctccaggagcccaggctcttttgctgaggaggaaagaccagcggccctggcacactacaagccgaaacgggacgtctgtgctggtcacttgattcagtttcaacttaattcatgtactttgtagatgaagtgactttataataatgaaatcatcagttcagttcagttgctcagtaatgtccgactctttgctaccccatgaaaaatattggaattatgagtatacaatattaaaatcatggaactaagaatcgtgtaattatagattcttaaactatagaatttggaattaaaaatatctttgcattgtaggatcttagaaacctagactattagagtatattcagaaatatagactgttagagttcttttttttagaattcttaaagtaatttatagagttgcagaaatgatttagatccttagtagcataaagctttagaattatgcaattttaggattatggacacagcattctacaatactagagcactgtagagattggaaatatggaagataaatttatggaaagctagaatcatggtcttttagaatcatagaaggcaggaatggtggaatgttagaatattaaattaaggaaacactgaatgataagatcttagaatcacagaatattgacatcatagaatggtgaaattagaaagccatagacttttacagtcatagcagtttataattacagacttattggattatagactcttagaatcacagagaattagactcagagtgtctgttttgttagagaagtataggatctgtgaattacag

SEQ ID NO: 49851 - DNA, 786 bp, Bovine  19866881037410
agggatctggggaacctgcctgtggtcaggggcctggacagaatgacctgtaaagttccttctaagaacctgggattgggctgcttgttgcctcttgacgacgaactactctaggccaagaaaggcagctagatttggccctggcgcagagcctggcactgtgcgtgtttgataatcacacactgcgttaatttacctctttggccccacgcctggcacagatctgggcatgcggtcaggtgcttggactatttaccaaatgcttcatctttaattaacctcgggctccatctcaatacatctcatgccacactctgccctgaacagagggaaatctggcctctgtgtttctaattcctttacacttatctcatccaaatagcactccgcgccatctatttgatgtcctacaggccttctgagcctgcttaaaagtcagctaagccccttccggctcagaaataggaagtcacatttctgccaaggataaatggactccagccttggcccggggtcaagttcagtttacaggtgtggtacccacggggctggctggaccctgtggaagcagagctcagggctcctgccaggtctcaagttcaaacatattcattttgggtcagaactgaaaagaattcagctgtctgccaagacgcccctgggacttctgaccatccaatgagttgcccagaattctactgtttcagacaggaagcagctgccaagctgggcacaatggcactgatgctaatcaggcctgctagggaagcccatggtgtggcgttg

SEQ ID NO: 49852 - DNA, 1014 bp, Bovine  19866881191094
agactggagaggggaaggaggggagcagcattcggtgaagctggggaggcagacaggagccagttacacaggggccaggctggactctggttttgttctcgtgtgtgatgagaggcttaacccagttacaagcagagtgagaagagaagactatagacaagcaggcaggggcctgagggcaccggcggaggctgccttggtcaccctcagcctctactgacccacccggagcagcagaaaggcaccccctcctccaaatctcagtcaataagacctcgacgtgtgcacttggcaggttggctaccctcttagagcctccattttcccatctgtgaactggcagaggtgcggggccaccagggctcatccgagacctgaaccttggatctcaatccagcagggagaagggcttcacttctgtgggtacagtgcctggcacagagcatgccctcaacacacaccaagggactagggctccagagagaccggaggaccacaggggcatggtggcccctgagagcctgctaggctgggctgggctgatcagctagggccccaggcgtctccttcccttccttcccagcagccaagtcaagcgggcagcagcaggcccactggaccaagggcagacaggcgggcgggcaggcgggggcgagctgtcgggcacagggagaaaggagggcattgtctgctgaaacccaactaaggggccagggccacaatgtgagggattctttcaggagaaacagacatgcctttctttctaccaactgcagctaaaacagcccgctggatttgattctctcccatttcgccccaaacaaatgataaataaataaacctccgtgagctcagagccaggaccctgggcccagagcaggctggccgctgtcctcccagggcgaacatctctggtgccaggtggcccgcctgtgctcccgctgccaggcacgtggaccagtctgtaggggcaggctccaggcagcggcctgaggaagtccctccggacgtacg

SEQ ID NO: 49853 - DNA, 1806 bp, Bovine  19866881475316
attctgggcccccgttcctttgaactgcaagagcagctgtggagaaatgccgctttccctgcagggtggttgacagctggctgacagcccccagccaggctgctaccaagtggggttgcaacaaagcgagtccagacttgggcaatcggtcctgtccccacagggaggttggatggagccctgtcgcactcagaccccatcacggggcaatagagctgagaactggaggagaagggcagcacaaggccttgatcagagaggtactagcaaggacttccctggtggtctgctgctgctgctgctgctgctaagtcgcttcagccgtgtccaactccgtgcgaccccacagacggcagcccaccaggctcccccatccctgggattctccaggcaagaacactggagtgggttgccattgccttctccgccctggtggtctagtggttaagaattcaccttgcaaagcaggagacacaggttcgatccctgattggggagctaagatcccatatgctgtggagtaactgagcccgcacatcccaactagagagtgtataggccacaacaaaagatctcacatgaagcaacaaagatcccatatgctgcagtaagacctgatgcagccaaataaataagtaaaaatattgttttataaaaagaaaggtgttagcacaccatgaccaaggacatggagcttgggctaggtggcccatgctaggtccagctccaccacccaccacgtacttgccgttgaccttaccaagttccttcaccttgctgagcctgaggttcatcctctgtgagatgagggagatactgatacagtatccacctcctagggtcattttcaagatgaactgagtcacaatcttctttgatgcaaagcagtgagtccagggcctggtccatggcaaccgaactccactcagatgtttccttcatgggggtcttagtgccgtaggtggggcccttggggggaaggagtactcagagctgggagtcaggacacctggtttctgatcctggctctgccaccatccctggtatgacctcaggcaagtccaagccactttctgagcccttgttaactttctcctggtgatagaaaattgagagatggtggtagtgctgtgatgacctctaggcccaggagtaactgggagtgcctgggtctaagaatggcaggtgcaggggttggggctggcagaattccaggtaggattggacctcccagtagggaagccatcctcagaattaaagcttttccttacacctgctcttgacccctaaaaatggctcagtgttgaagacatgtgaggtatgcctcccagtatgactgtctgatgctttctctctctctctcacacacacacacgcacacacacacacacacacacacacacacacacacacacacatagcagagagagccacgggaggcccggggaaccatgtagatgcagggcactgattcatttctgccgggaatggggaggtgatggcacttactccccaggaaactctgaccaggaacaggctcgaagagggaggctgagctggggggatcttcagacatcttccggtttgtggggctagtgccgcttttcatgcccagctgctacttggccaggcctgctcctctgggaagctggttctcattgctcctcccaccatattcccccaagccttggactctttgagaaatgaaagagtacagtttcaacacagcaaccggaaacttccctggcagttcaatggttaagactccaagcttccactgcgggggacaaggggttcaatctctgg

SEQ ID NO: 49854 - DNA, 2540 bp, Bovine  19866881606056
cctagatgtccatcagcagacaaatggataaaaaagctgtggtacatatacacaatggaatattactcagcttttaaacaacacatttgaatcagttctaatgaggtggatgaaactaaagcctattatacagagtgaagtaagtcagaaagaaaaacaccaaaatagtatattaacacatacgtatggaatttagaaagacggtaatgatgaccctatatgtgagacagaaaaagagagagatataaagaacagatttttggattccatgggagaaggtaagggtgggacgatttgagagaatcgcattgaacatgtatattaccatatgtgaagtagatcaccagtccaagttagatgcatgaaacaaggcactcaaagatggtgccttcaggacaaccctgaaggatggaatggggagggaggtgagaagggggttcagcatgggggacatatatacccatggctgattcatgtcaatgtatggcaaaaccactacaatattgtaaagtaattagcctccaattaaaataaattaattttaaaaagcagttttagtccaacacagagccatttcactaatactttgtttccccacttcccttgtacttgggtattgtcaggagactaaatgaactatttctcagttttacttgaaagttcaattaaaaatagggtttgcattttcttcattgaatagcagtttaggagagtagaaaagtcacatgatgagaagttatgaggtctagaaccagattcaccaacttttagccagttgtgagatttttttttccctagactagcatcagtttactcaattgtaaatttacaataatgatatttactcttaattctccttaaggttatgagtggttaagtggtgtggttagatattttgtaagtattaagaattacagatctaagaccattttttatggtttttataaagtactcagtgctgtcatttcacacactagggaaaaaaaatgaactgaaaccaaaccaaaataatctctgagtcctgtggagttgaatgatttgctcaaggtcataagaccagttggactatagagaaagctgagcactgaagaattgatgcttttgaattgtggtgttggagaagacacttgagagtcccttggactgcaaagacatccaaccagtccatcctaaaggaaataagtcctgaatattcattggaaggactgatgctgaagctgaaactctaatactttggcaacctgatgcgaagaaccgactcattggaaaagaccctgatgctgggaaagattgaaggtgggaggagaaggggacgacagaggataagatagttggatgtcatcactgacgtgatggacatgagtttgagtaggctcgggagttggtgatggacagggaagcctggcgtgctgcagtccatggggtcgcaaagagtcagacacgactgagcaactgaactgaactgaactgaactaagcaccagctactttaaatgcttcaagcctagtattttgctcattgctaatcacagcaactctatgaggtatgtgttcctttccccatgttcacagtgaggaattaagattcagaaaggccggtaccctgttcagaggtcagtcaatgctattagactccacagactcatgagtgacaggggacaggaggtatcagcataacacagttaacatgcagatgtacagagccactgcggcaagtactagggtagaggcatgaatggagggggagaaacagggaggggtgatcctgatttgggctctcatgaaaaacgcattggaaagcaggaagacagtgaaaccaggcgagaggggtgggggaattggagagtggattgagttaaaattctgaataaacagcagggtagacacggcccacggagtaaatggaagccaagacaagcagggcacgtagctggattttccagtgtcacgatgctgacgctgagcagggctgacaggcactgaaaccggaatagctcacatctgcgaagcactttccattccaacacgttatcttccaagccctggccagcgtcctctgaggctgtttgttcctcagattttgaaggtgaggaaaccgagccttatccaggtgaacagcttgttggtgacgaagccctgctgaccataagccccgggaccagacctgatcttggtccaggattctgtcagggccaggatgacagggacggggcagactagacaatagggatgtgaagtcaaggaggcacctgaaaggctcccagactagtgatatgggccctgaaaaccaaagcacccaaagttatggaatttgagggctgtggactttggaatcttgaggtcaaaacttctgaaattctaatgaaataggctctacggtcaaagacgatgaatgtcgggagtgggctctgagattgtggggacaaggatgcaggcaccctgtgtgcatgctgagtcgctcagtcctgtctgcctctttttaaacctatggactatagcccaccaggttcctctgtccatgggatattccaggcaagaata

SEQ ID NO: 49855 - DNA, 757 bp, Bovine  19866881891048
aaatgaggcaatagaaatatattgacaggggagccagaaatttcgttaattggacatgcacttcaaaatagttaagattaatgtgtctaaggaactaaaaatcaggatggagaatttcaaaagggaggataaagcaatggaaaagaattaattggaaattgaagaactgaaaattaaaatatctgaaattaagaaacttcagatgtggctcagcttcatggcacattagatgtagctgaagatagcattaatgatctagaagacaagttagaaggaaatacacagaatgacatacagagagatgaaagggtataaaaaacaaaaagaatgcaagacaagccttatacagctctaatcacagtcccagatagagagaagagagataataggacaggaacaagccacagaatcaataaactttgcaaaaccatagcaggactagctgaaagtgaacaacaccatcttagagttaagctgctgaaaaaataaaaacagaaagaaaacctaaagcaaccagataaaaaagacatattagcttctaaggagcaacaattagactaaaagtttacttctcaatagaaacagtggaaacataaaacagtgaaatgataacatcaaatagctgagaaaaaaaaggtctaatctagaattcaattccaattaacacggtcttcaaaaacagagataaaataaagacatttttagacaaattttttaaagtaaaagagtttatcaccaggaaactgaactacaaaaa

SEQ ID NO: 49856 - DNA, 1603 bp, Bovine  19866880154481
ccaacaaaggttcatctagtcaaggctatggtttttcctgtggtcatgtatggatgtgagagttggactgtgaagaaggctgagcgccgaagaattgatgcttttgaactgtggtgttggagaaggctcttgagagtcccttggactgcaaggagatccaaccagtccattctgaaggagatcagccctgggatttctttggaaggactgatgctaaagctgaaactccagtactttggccacctcatgcgaagagttgactcattggaaaagactctgatgctgggagggattgggggcaggaggagaaggggacgacagaggatgagatggccggatggcatcactgactcgatggatgtgagtctgggtgaactccgggagttggtgatggacagggaggcctggcgtgctgtgattcatggggtcgcaaagagtcagacacgactgagcgactgatctgatctgatctgattgacttcaaaacatttctcttgaaaaactgtcactgctatacaaaataaccctggaaccatctgaataatctcagtataatacgaaataatgtgcaaatgaaatggtacagtttcagagacagcatgagctgttttttttaaagtaagtgataaaaggactgcagatatgagagagagcctactgaaatggcaaattttaatgtacactcagtgattttgtagaaaaaaaaaaaaagacaagtattttaaagtaagtggcagagttgaaattctgctaactttccctcatctattttcacttttcccagaacatatgtttcacaatagttttattagcaagtggagaagatgctactgtccaaaatatgtggtgtgattagcgttattgagtggcaggttttgtgttactcatgtttattttatgcctttccaaaccatctgcttccttgtgctatgtcttactaagataatgagaaacagtgactgtagaggtgtacagtgctactacagttctaacattttctgacattttgggtttaggtttctcttctgagagtcctaaggaaaactgagtcatgtggtcacttcttgagaaacaaagcctagacataattcactcattcatttgactcaaatctgagtatttactcagtgtcaggtagtagacaaggacctgtggttactgagatgcatgagatgctatttctaaaacagtctagtcagggaaataggaggcaaacattgtagtgtgagaaggactatgatagagttaacagtattaaggcatcgggaagagaaagtgaaaacatttatcccaagtatgcactggaatcttgagcatttaattaccaatataagaagaaaaaaagctaccagaaagtattacggaccaaagcacctacactggccatggtatccataaaactgtgagaaagattgttgttgataaattttagttactttggtttcactggaatgcagagtatgcatatgataccaagagagaatcatactttgcaacctgataataatctctggtacctattgattccttagtacctggcaactattgtacacttttttttttaacaatttaatctttccaataagtcattagattaaacaat

SEQ ID NO: 49857 - DNA, 1197 bp, Bovine  19866880344737
tttacttacaagattttacatcagattttaaacctttaaaagacccaggtctgggaaagccatatttggccatgtgccagcagatgccaaaaaaatcagaggtaattgattgtggagagagatgaaaaaaaggggaagatgtaatccaactgtacatgcatgatgcttagaaatctctttaattcgattgcttttcagggtttttttacccttaaattcataaaattgcactgataacacatatatcattgtatttactgtggatgatgctatgtgtgtacaatatgagaagatgaaagttctgtaccatgaaagcaaaaatgctaatgtaaagtttcattttcattctcattattaatattatgaaagttcattgcaaataagaaattgttcacattatttatactggtttattcttacgtcccttatttcaggtatgctgggtatgtgtatatatatatatgtgtgtgtgtatatatatatatataagagtttcatgacctttaaactgttacaagggatttccattgcctttctcctcctcctcttcctcctcatcatagtaggagtgtgataataaattttatatcatgacttctcaaggaaattataaatgtagaaaagattgagttgtttggtaatggggaaagctagaattttgccttatctacacctgcataccattgccaaagacccctatcactttagactctgtttttgagtagtgtgatactgattgccatgttgcagaagccagcccagcagcctgcatcctctggagaactgctgtattgtggaggcaccggatggatgactgacaggccagcacctagttcttttttctgacaatgctctcacttgtcattaattctccatcttccctcccattagcggctgccggtttccaacctaatgcccagctgccaatcagctaccagttatttttaattaagaccactcacaaatttccctcacgtaatgtgcatggaaagaaggggaatcctttcattagtaatcgaatttcccgtgtaaattgccttaatcacacttgtctggcagtcctgtaatgtgctacaggaaagcagcactttttcttgttcagtcatgcatgaactccacaccttacctctcagattcacagccacaattatctgtttttatttttgtctcattaaacctgcaatttcttttcagaaa

SEQ ID NO: 49858 - DNA, 1452 bp, Bovine  19866880412486
tacatacccacatatggaaccttacatggaacaactgactgattcaaaattgggaaaggagtacaataatgctgtatattgtcacactgtttatataacatctatgcagagtacatcatgaaaaatgctaggctggaataatcacaagctggaatcaagattgccatgagaaatatcaatgacctcaatgtcagatatgcagatgatacaagtggtaaagaatactcttgccaatgcaggagacttaaaagacaagggttcagtccctgggttgggaagatcccctgaagaagggtttggtaaccctatccagtatttttgcctggagaatcccaaagacagaggagcccggtgggctccaagtccacagggtagcaaagacgtggcttagcgactgaacaacaccaacaatctaacagtattatggaatgtatcttggttggaactgcaagagtcatttttctgctgatgataacaagagggtcattcgacttatcacatcagatttctatcacctctctcaactcctagagacacagcaaagtctctatttatatttattctagttttatcatcttatgaaacatgttttttttttttttccttttccttctcaaacagggtgagaggaaaataaaatagaactaataaaaaacagggaggaagtcttttctcctacatgaatacacatactgaagagattcatattctctatagtcatttgcaattatcaagttacctgagcattttcacattctttgtatccctcagaattttaagaaccaaattgatgatatcagtggggggttaatacaaatacactttttgaagagatggggacattcggttcagtgatttcagttgctcagtcatgtccaactctgcaaactcatggactccagaacattaggccagagttctacagaacaccatcacaaattccaggagtttactcaaactcatgtccattgagttgatgatgccatccaaccatctcatcctctgttgtcccttctcctcctgcctttaatctttcccagcatcagagtcttctcaaatgagtcagttcttcacatcagatgaccaaatttttggagtttcagcttcaggatcagtccttccaatgaatattcaggaatgatttcctttatgatggactggttggatctccttgctgtccaagggactctcaggagtcttctccaacaccacagttcaaaagcatcaattctttggcactcagctttctttatagttcaactcttaaatccatacaagactactggaaaaacaacagctttgactagacagacctttgttggcaaagtaatgtctctgcttttttttttttttaattttattttatttttaaactttacataattgtattagttttgccaaatatcaaaatgattcatttttgatgtctctgctttttaatatgctatctag

SEQ ID NO: 49859 - DNA, 1647 bp, Bovine  19866880481075
tgttctttctctaggaacttggaatccgtctaccttgtttagtcggctctgttttgaaatcgaagaaaagagtagccaagtatgggaaagctttatttggacattagtttgcagaagcagaaaaaaacacaggtaattgattgtgaagacagatgagagagagaaagagagacagaattagagataggaggttatggtgtcctgagaacagcttgctgctgcggctgctgctaagtcgcttcagtcgtgtccgactctaggcgatcccatagatggcagcccaccaggctcccctgtccctgggattctcaaggcaagaacactggagtgggttgccatttccttctccaatgcatgaaagtgaaaagtgaaagtgaagtcactcagtcgtgtctgactcttagctaccccatggactgcagcccaccaggctcctccatccatgggattttccaggcaagagtactggattggggtgctactgccttctccagagaagagcatagttaccttcaattcaacagcattttgcttctaggctcctggctcaagggaggcctaactgacttgccttacttgggcctgatcccattataaacctttgtgttttgtttaaactcttctgtaaggattatgtaccttatttcaagcaatttctgaaagaaatgacattagacatggagatgacaaagctataggtttggttcacataaatttctatccctgaagaatcatgttagaaaaacatgttaccatttcatcaaaggctgctttgatgcatcagcagaatgctttgtgaaatatttagactcatatgtcagcaattctcaaactaaaactaaattggactcctcagtagttcagtaactagagttggatatctctatctataaaatgacaaaattggataaataggccagaatttgagaggggagggaatattttttaaggtgtgatttgtttggacacagaccaagccagatacaagatccaggtctcaatgaaatttggggcaagttgtttaatgatcataagtcatggtttcctttccataaaacttacataacagtgttcattttttaggtgaggattataaagggaaaaaggcagagaagaagcaaaaagagagtaaagagaaaataaaaagagcacaggaaaaagtttgaagtggaaaccagatatgagaaaagctccatttgagctgttatgcaccacctcagtctaaagcacttacagactgatgtgtatacataagaacatttaatccatacacttgaaggaataggtatgattcatggctttcaccattcattctttccacatggctctttctaagcacaattttcattcctgccctagttattttattttgctcatatattttctttttagtgtttgatggtatagacagatcattcacactcatagttgttcaaatcttactgaccctatctgagtgtttggatactctgggatttatttcagaggaaataaacatctagttcactgatatattctagacagactgtataaattcagctacttagttattcagcaaccttgttaaatagctaactggtttgcaatttcatttcctatttaatatatttcctccagcatttctaggtaacagaagtcccctagaaa

SEQ ID NO: 49860 - DNA, 1375 bp, Bovine  19866880546654
actgataactaacacttttacttcactttctatcaccttggtagactgacctaagaaaacattggtgcaatttatgtcaaagaatgttttgcctatgttcccttctaggagatttacagtgtcatgtcttacattaaagtctgtgagccattttgaatttattattgtgtatggtgtgagggtgtgttctaacttctgatttacaggaggctgtccagctttcccaatgccacttgctgaagagactttcatctattgtataagcttgccttctttgttgaagattaattaaccataggtgtgtggatttatttctaggctctctattctgttccattgaactgcatgtctgcttttgtgccaataccatgttcttttcattattgtacctttgtagtactgtctgaagtcagagagggctatccctcctgctttgttcttttttctcaagatcacacagctcaccttacagagtatttacaaaggccaacataaaccttacgtgatagcaacactcctagaaaaatcatattcttggtcagaaaagtcctcgtgcctagcctgtcatttctagataggaatgtccagaatgattatttttatagatgattctagtaatgacttatccatccttaaaatcactgaatgtcttaactaaataaaagtaacaaaatttaatgtccctcacacaatatagaaaacgtttaaggactcaatcatgcctttcatccgccccccacccccacatcgttagttcctcccaacttctgtgggcctccaggcctgagttcatgatcaatcttctatctggaatgattttacgcttccttctccactgggtaatttcacctgacatctttcaaggccaaactaatatacctccctctctgagaaagtgtattaattgttcttatctctgtgttctcagaactctttattcatatctttaaaaagcattcattcctttgtaacatcattaattatgcatgttttgttccttacttcatgacaaagctatgatccttagaggctagggaccataaatatatcagttctctcattagagaacataaaatatactaggtattaagtaaaaatataaggaatctaatctataacacttaaaaaagtctaatttggattttgcagtgtgaagggatcttttctttaatctcaattatttaaaaagaaaaaaaaaaaaaccactcctttaaaatacggatcatcaaaccctttgttttgccttggtttccttgtgtccctttgcatttatgatgttgttaattagtttcttctccctccaggtttataactagctattgggtagttatgtttataaaccaaataatgctgattttatgtcatcaaattatgt

SEQ ID NO: 49861 - DNA, 2011 bp, Bovine  19866880569205
gagagtaaatgctcttttcaacatagattctgaacaacttgaaaatagagcaggatatacatatagagaccaaaatatcttttttggctatcattaacaatgggtaagatcagaggattgacattagattaattagttagatgaacttgatacttctatattccagaatttgatgtggaatcactcagtcccaaatgggtctggaccagggcagcaatattaatcacttggagtgggtctgcccaggtaagataacttgaagggtccctggacatatgtaggcttgagccccaagaggaacaaaaacaatgcagagttgaacatttcagttctctcagatttgtgtgtgtgattgtcattccaaattctctaagatgaagagtataaataaatgtaatatacccacaagggtcacaacagtggagttccctatgcctaaaagaaaataagatgcaaagggatgaagtattttcctcactcaagcagtatttgaaccccgatggtcactgtggaccccatgatgttttctttatactgactaaacttaactctgggtcattgattctcattttttcccctccctgaatcaccaacagggccttgagataaaaaggaagccaaagtcttctgactagaggacagctgagttttggaaagacagcagttagtttatgactctctgcacttaagactcctggaatgctgttccaatataggcattggctaaacacagctgcgtagagaaaaataatctatggtctttgtgcaaaagctctttctgagtgaaagctgccagtgagccattagtggtatccaagcgagagctaccatgcagcctgctgtgccttcagagaggaagattttaatgattctactaaaaaaaaaacaaaaaaaaaacagactttccctcatcattgactttgtattgttgaaattttaagtctgatattatgtatttatgtggactttgccattttgatgggccaggagagtcaaattatatcattggtgatatcttcattacatcaactggggagttaatcaaatgaagacctactcttcttcctaaataattatacctctctgcatatcctgtgctgcctttgctgagaaaatgatgttcttttttaacttagccgcacaatgaacttggtaaaatgtgcacaataaaagtggttcctattttgagctgctttttaactaagaatattttatactactgcacctctataatctttaacacactgacattatgtaaattaaatatgttaatccccaactctatgcagtcttattccatttaaacttttttctccttttgttaccagagagaagaaacaaaaagaaaaaatagtatgtaagaaaagactcctgccaaaaataatagctatgttcaatgttttccctggttttttattgtttaaaatgtgcttttcctgccaaggtcccattaaagtgcattacctccacatgctaatagactaattaaaatatgaataaattaaaaaaaaaaacatttcctataaactttattttttaaaccttttctggtgaacttggagttagagcttttctgaacttggagtgatcaaaaatatatcttttttactttattgttttctagctaaggaaacttcaactcccgttgttgtcttctgtataaacctaggagtggatggtactctatagaattagaagaaaggtgttatttaggatcaataagtctacattggaagcttggctgtgtaatcttgtttttagtgtcttttaacttctctttgccattcttttcttatatatgaaatgggtatcaattcactccatttcaagaggaaattataaagaagagatggtggctttgacaaggccttccttgaatctgtctagccctggtatacagaattacatctgctttatcttttatcctaatcattcagcccaggtatagagcaaaataggacttgagaacatgttcgtcactagtatatagttttgaggattatgctgtagg

SEQ ID NO: 49862 - DNA, 1591 bp, Bovine  19866880675456
tgactcaggaattaagcccacatctccctgtagctcctacactggcttgtgttttctttatcgctggaccataaagaagcctgaacatcaaagattttatgctttcttaaaatgcaagatgcagaaaactaagatcatgttatctggtcccatcacttcatggcaaatagatgggcaaacaatggaaacagtgagagaatttattttcttggtctccaaaatcactgaagatggtgacttcagctatgatagtaaagatgctttcttcttggcagaaactatgaccaagctagacaacatgttaaaaagcagagacattgtcaacaacggtccatctagctgaagctatggattttccagtagtcatgtatggatgagaaagaaagctgagcacagaggaattgatgcttttgaactgtggtgttggagaagcctcttgagagtcccttggattgcaaggtgatccaaccagtccatcctaaaggaaatcagtccttaatattcattggaaagactgatgctgaagctgaaactccaatactttggccacctgatgcaaagaactgactcattagaaaagaccctgatgctgggcaagattgaaggcaggaggagaaggggatgacaggatgagatggttggatggcctcatcaactcggacaggtgtttgaacaagctctgagagttggtgatggacacggaagcctagagtgttgtagttcatggggtggcaaagagttggacacaactgaacaactggactgaactataacctggcatgaccctaaattaaacaataatggtctctcattttaaggtaaattgacaaatttttctcaatattttttttcaaccataagttggtaccatggatgtaaggtgttcctctgatagtagaaaacttattttgctttaccatgaatgttataaggtttttgattctacagggccctttgtggtatgtgataatttttgtaagacattggtctgtttgtgattcagttaataagaaaagtataagatctggataagcacttatcagggtttcaaatcattttcccagtgtagagcctcccagttggtgtgctcttgattgagacatgtaatcattttcagctccaccattaactgaagctagttttgattcagtaataaagaagcattctccaatatttcacctgatgaaaatggaatcttcagctcctgattgcccagaatcaagatactggagttctggagttttatgaaaatatttcacaagttttggcatttatcattatgttttatgaggtgaaatttttactagtaggtagttagagcaaaaggatgaaataggtcaaaaaaaagcaaagctctgtgagtgacaataaatggattttaaattagaatttgataatttcattaattttggaaatgggaaagtaagtgcaatgtcttaatacattcagtcaaaattatctactgctaccccttgctgctgcagttagtgatggagtctcccttttgtgggtaagcataacagccattaattttaatgagagtaatgtttttattttaatgtgggggatttgtttggagtgagcatgccaa

SEQ ID NO: 49863 - DNA, 3771 bp, Bovine  19866880717980
tttcaatacagtatttcctgatggcatgtcccatatacatatatacagataggcatattatgttaaaaatagtaataggtacaacttgacaaaaatggaatacagagtaaggcagaaatctttgacaggtaattattgtgaatggcagtaatgccgtatacatttaaaaataatcaaccatgtaaccaaaggcagaatgctgttcccattcaaaattaattttgcaaaggaactctgttccgctttctgaaattgttttcagagttgaataataaaaatggcaagtgctccaattcctctcctttgcctgtctatactttaaaaaaatccatttggctaagacccacagaacttaacagtaaatgttgcatattatcattgtaattggaaataaataaattagaaatctgctaatagaagatgtgtttatgaatagagttagttggccagaaaataattagtttttttaaaaggctaaaaatataattactaattttcttattacctaatgaaacccatgttattttttaagatactttttctagataaaaattgtcaacatgaatttcagtttgcaacctggaagcaactagataaatttaatgtgcaggaatctctagattatccaatctgcagtaatatatggacaaatagtatttattttatgaggttttttaaatgttgaatgaacttttacacataaatcacctaagatattatgttgtgtattattagtgctcaataggtattagctgttaattatcactgttgttattaatattccaggtctgccttgtgaggtaatggtgtcatgctttctagtctggtttacagagcatgcagtattatgatctgtttttagttttgccaccgagtaatgtctggccttgagcaagttagcaggtcactctggaggtattttacttttcttttttaatggagaatcttagtgtagataaagatcatatccgttttcagatactataactaagtcagcgcctgattggcatcaaaatgttcccagaaccaaaaatacatttctgcttctaatagtactcgtgatgatcttatacaaaaggtatctgagtatttcttttatttcaaatgttataaatgaacaatgcctttgatgtttggtgttcccatgtcctccaagtcacatgctgcatccctcgtcagcagatggccaacctcattatttattctcgccatgtgaaactaagcccaatagatagtgagtgccacctgcatgccaggcaaatgttagttcgatttggaatatgtgtaaacagaggcttatagagatcaagtgagttacctgagcactaacagtcaagtatcagtatcaatagtaccgttctctttgtaaatgttactttaactcattttaaaaaatatgcattataagtgtaaacaaagttaaagttcaaaccttcacacccctaccttctctctttaaattctactctcccagtcttccattttatttaaaaacaataacaaatatagatatgtgaaagataaatttagatctagatctatataatctttatctacctatacgtctttgttgttattgtttttaaataagcataaagggtgaaagagggataaagcaggctaagtggtcctcctggcctcctatttgtcgaatgtatttccaagtatacataatgctatttattatactatcagtcttgtttatgttcacaacagtcaatagtacctgtaagctccacagagcaactgtatcctcatgactagcatagttccagaacaaagaaattcttagagatggcttgggaaattacaaggagatagtccctattgaagactccctgtttgactcatttagtgcagtggactgactgtaagtaacataaaatgttaggcattatcaaatttaccaaaatttaatttataaaacacatcaattttgttttttataactacataattcataattaagcttattttcattataaaccatacaattttggtcacactaaagttagcaaagtgttttctttgactccattagctatagctcttgtcttgacattaagacaagggcagacaaagaccctgactcgagtctttgccttgttttcagcaaacagtgtagctgaattccagttgggatcccaatacactgggattggaaccagtccattaagcagtcagttgattaaccagtatttttaatcaatcgtagattatcccgatagtactttaattcaaccactaaatcacaacaattttttaaaagcctataacaggaggtactgctgaaaggaagatctatctactatgctgccagttatacaaactaacttgtttttggcagtattttggcatagttaagtaatttggcataattaactcctagtgattgagggtgtgatcatttgggatggaatgaaagacaggcttggtgtcaggcagacctgaattcggctctcataactttgacttttcaggctagttcacatactctgccagtctttcttactttaatcatcaaaagggacaataggatttacctttcctgctttccttaacaaatacagatatttatattaaagcattgcacagtaatatatgtattaggtgtttaatacttaatggctgctatattttattgctgttactgttaaatataaacaatattaaataatacacaggttgttactagatattccatctgatatttaaattgtaattgaatcaagaaatatgtagtctatagctgctttaatgagacatataggggaagagttttgcgattgtgagatgaaattacaactcctctggaataaataaaaccttgatgtagttaatgagtgaaccactgtgagagagaaacactgggagagagtgggtgggtgtgactgggagaaagtactggggaaggaaccaaccaagagaaagataaaaaatgtattaactacagtttctgaatagttgcatttaaagaatatagtgctaaacataattaaatgttttgtctcaaggtatgagaccttcaatccatatatttctcctaagtccctgcttttgtgttattttaaaagtaatattaataataataattttcaaaaacactgtcaccacattattctcaaattagtgctcagtggattgtgacagtcaatgaactaaagtaattagacctcctatgtgatcttaaatatcttagaggtgtgcaaaaccatggaccatggggaagccatctgtaaacactgagaagaaaaaggcagattggggagagatactcatatctctttggtactttcttctgactttttatgttttgtttcattaccttctcaaaactatgcaaaggttatttattaccacgggtatatacatgtgaaaatgaaagtaaagttgctcagtcatgtccgactctttgcgaccccatggactgtagcctaccatgggattttccaggcaatagtactggagtggattgccatttccttctccagggggtctttccaacccagggattgaacccaggtctccctcattgtagacagacgctttactgtctgagccaccagggaagtcctaatattaaaccctaagaattgaagaggtaggaaatggcagtgccatgacaaatacaagtctctgggactccctttcttttttcctctattgtcttcactctatcatagctgttgagtgagaacatcaatatgatgaataaaacagaaaacagagtatcttgtgtgctgagttggggaaaacttcctaaaaagaaca

SEQ ID NO: 49864 - DNA, 1379 bp, Bovine  19866880789670
ctgcagtttcagaaaacagaaagacagtttctcaaaaaaattaaacattgaattatcatatgtttcagcaattgcatttctgggtatataccccaaaagaactgaaagcagggacttcagggaaatacttgaaccacccaatgtcttgcattattattcacattagtcaaaagaaaggaaacaaataaccacctatagatgagtggataaacaaaaagtggtatatgcataaaatattttatattattgatttctaaaattttatattttagattatttaaccataaaaggaatgccattctgatacatgctacagtgaacactgtggaatttgaaataagccagtcaaaaaaggacagttactaaatgattccactatctggaagagtcaaattcatagaaatagaaagtagaatggtttttgtcagagtcagaggagagagaagaatggggagttattatttaataggcacagagtttcagttctgcaatatgaaaagtgctggagatggatggtggtaatggctgcacatctatgtgtgattaaagccactaaactgttcacctaaatatcactagaacaataaattttaccaaaatttcaaaaaactttaaaataattatatagtattccctttacttatgaattaaatttaaaccaaaaatctctgtcatatagcatgtataatggtattaagactccatgatataatcagccataatgaatgctatcaataatatatcagaaggtcaaattttcttgcaaagtatttatgtgatatgcatatgttaaaaacaatattatgaaataaatgttaactttttagcacagatggagaattataaaccctgggatgttctctgtccccactaacagaagcataacaattagatgctgagattagaacttactaagacttgaatgcaaaaaaaaaagaaaggaataaaataaaagtaaatttataagcaatattggtatgtctataatttatataaatatttcagaggatatttagaaaaagcctcatggtaatgagtttcaatatatcaaagcagaaataaacacatatgttcacagtgtcttggagaataatacaaataaattattacaaaatgagaaaaagattgattggactgagactctttggagctgctgtttctttttggctaatatcatttattatatgaagttgcttgaaacttcttaaaagtctgtttaatattagcttgttaaatattgtcataaatgttttagagtttggttattgctttcttcagatccataaccttgctttaataacccacatatattcacatccacttagtaagcacattacattgtgtcattaagttacacaatgagtataattgctttactt

SEQ ID NO: 49865 - DNA, 1107 bp, Bovine  19866880937556
agcagatgcctgtataacaggaaaataagacaactgacccccaagatgatgaacaggatgagaagttaatggttggttagatagattcactttggatctggtacacatctctctttctgggaaaggtagaatgttgttgaaaattattcctttcctccattcccagacttacatgattactgaaccaactgtgacatgaaatcatctgcaaagttggttaaatggtgaaattccatagttctaagtatcaacctctttggaggagggatggaatcatagcaggaaatattcatttctgtagtgagaattttttaaagataggcaaaatgcttgagggccacaaacatgtattagaattctggatagatctctgctatagagaagaaccatcaccttggtcatggagacttaaatagaatcccggtcctatggaatgagccagacatgtccgagatgaggctccacaccataaccatattccccatttagctgtttactcttggagggagagtgccaaagacatttttctgatgggtgcctaacccagggcaaagtgcagagctcaccaaaagaaattggagttaggaataaaatataacaccaagacttcaagtccaacttgaaacaaatgacacattggattgttctctatgaactctgaacatcccataactgaacaaggaattcagtgttttaaatgcaagaagtgtttactctttataatagacttgagccagatgattttggacttaaacatgtaaagctgcatattggtttgaaatattgtagcttgtattcttttaaacagaagcactatattaaaatattccatacttctggtctttaacagagaaagcttagaattctgcctctgtcagtagctgattctgggcccatgggcaaatttcataacatttctgagtgtcacttttatcatttgtaaaacagggatactagtgatggaaatctcacagggatttttttgagattaaatgatataaagtgaataaaaagggcttgggaatacatttgtagaaaacagaataggtttttgattaaggtgaagtgagatgactcccatgattccaaaattcccttgggaagatg

SEQ ID NO: 49866 - DNA, 1821 bp, Bovine  19866880950573
aaaaaatagtgatggtttttgtatgtaatgatatctgatggaaaagttatttagaaaacccagagaataagatgtttgcttctccaactatttaataattatgtgacctgaagcaagcactctaccttctctattcttcagatgtttcacggtaagatgatagagttgaacaaaatgaactctaaatttaagccagatctaagatccatattttaactgaaatgaccatttttattttatcttggagaattcaatttattggatgattactcattatttgagatccttatatgagcataaagttcatttcatacactattacagaagcagattttaattaaacctgagaactgagaaacattgtattaagttcgatttatgacagcaacagctaggaatgactattttacaatagagtaataaatagattactgcatagttagtatcttatgatctcttatccttgatttcccttcctgctagggccccagggcccttagtttgtactagtgaggcctgaatcctgtggctctagtagactgggctgatcaggaccattgttttagtactctgagggctcactgtacagtaaaccatcctgataatctgggcctaattgtagaaacttaatatctcctttatatttgaggaaaaagtctagtcctgtgagtgtaagatagtatctcagtcaagttctctgtgcctgaatctgattcaccattatgtacacagcaccaagcagaatgcctaggacagggtagaagctcagagtttcattatcagatgaattaatgctatctttgcattgattacttgtccagggagcaaacaatattttaaatgtgcttaacgatattgcccggagaaggcagtggcaacccactccagtactcttgcctggaaaatcccatagacggaggagcctggaaggctgcagtccatggggttgctgagggttggacccaactgagcgaattcactttcacttttcactttcatgcattggagaaggaaatggcaacccactccagtgttcttgcctggagaatcccagggacaggggagcctggtgggctgctgtctatggggtcccacagagttggacacgactgaagtgacttagcagcagcagcaggaacgatattgccactgctttaattctcttcactgaattccttgatcagcatcaacttactttgtagcactctccacagtgagtgttctaacgtcctatatagggccatggatgttaatagccatatacacttctatcttgacttttctcctttagcatagtctgtcctaacttgtggttttgagggcattctgtacttgccattttaattgtatgctttagtttatttgtttagtttcttcccaaaagtacttcaaggcaaaactcaaattagtttgatttgtgcaatctgctctttgctctgcttctaagcacttttttttttttgtctaatgtgccgaatccttggaatggaaactaggtaagtcccagttcttacaggactagaaattcttaacacattcacacctcactcagattgtaaatgaaataatcagcaggctagtatagtgaaatctatgttgttcagaaaaagagcaaattgactagcttttaatcagttttgaaacttttgctttcgttccgtttggttttccctcaattctaaaattaagagacgtgcttagatatttctagattccttttcacttttaatttatatacctaaaagatactgcttgatacattttccaagtgatattggagcatatgtttttactttgtttcatttttattgagaggctcaa

SEQ ID NO: 49867 - DNA, 1518 bp, Bovine  19866881049956
gcctggccaagtttgatgttcaaaatgcttccttctctattatgctagctgtgtacctccctaatcaaaaataagaaaatacaactgggggacaagataggatatttgaaactggatctgtcccagaaaacctagggtgtttagttgccataatgatacggcaaaacctgatttccactcattcaatctctttgaaaggcaccaaaaaccatttattgatttttctaaaaggagaattgagtaaaaaaaaaaatcttccaattgaaaatgaagtcaggtcatgcaatttcagttacaaatttgggcactgggcctgccataccctctcattggactcagctatactgaatataaaaaattataaaaataaacataaataaaacagagcaaaaacacccacaattgagaagtcccttaacaaggggaaggctaaagagcagcattaaggtcacatgagagatggtcattgcaggccctcatgttgaactctgctgagatagacagcctcatgctagggttaaccttatgtgcattcctgtatgtcccatagctttagcctacagaacctagaacctaggaagagaagggtaatgaaagtcacaaagcccagtcaggactgtttaaagattttagtggccagaactgagaataaaattctatgaggagaacaaattggtggcgaagtaggtggacgtggagtagtacatctctctccctggatacatcaggaatacaccttcagacacagaagtgcatgcagaagaccagctgaaagcggagaggagtacctgaccagcagaaaataatatatagaccaatgcaaaacttggtgggatgaaggaactagggggaaaaacaggagtgttagtaggactggacctgccctcggtggatgggggagctgaagcaggaatccaatccccacatcagggcagttgtctgagtcagaggagaaacatttaaggctcagagtgaaacagctgatctgtggaagcctaaatggaatgagaatcagacagtccttgccgtagccatacatacctcagacagggctgtggatcccctggaaggcacagtgggggaattggagtttagggattgtggagaagtcccctggcgagggctgctattaactatagagagacagatcctagggatgtgagggaggagattgtggtgggaaattcctgtggagaaaagccaggcagccatggaagcaaggcgatacagatgagtcctgtgcaggggggtggatccatcaccataacctctttctctccacacacccagcatcggcagctgaacatagagagtctggcccatcaaaggctaaaacactgaactacagagtagggcccctctatatgcctgatgcactgaacaacagagaaggatcccaggcaagggagcccccaagttacctgaatgggtggagctacagataaagactggccaatgaggccttctgattgccagctataagaggctcaaaaaaagactctgatagggccatcactc

SEQ ID NO: 49868 - DNA, 873 bp, Bovine  19866881087953
ttttctaatattgttttatattctgtttccttaaaataggaaaaaaatacttctagcatatcactaccccaaaatatgttgatatttctccaaacatatttagtttttaaaagaatattctacttctaaataaaatgtatgctataaatccagtatgtactaggatggcacaacttaaaagtagtataaatattctcacaatatgaaagtgcatcatattgtctgataaatacctcaataggtttcacccactatttccttgtaggaaatgtagaagtaaaactggaaaaaaaatacgtcactaagcctttgatgaatgtttgttattttgagatttacagtagaggattcttgattcagaagaggtctggcccacccactgaactgcagtttctgtctggattctggcaccaagctttaactcaacaataacattcaccagatgggggataaaaaagaaaagtcatcaaaatcaatatgagcctatttttatagaaaactgtacttcataaatagcactcccttaatcttacaaattcagaaatcagaagtttcttcattctagagtttgtcaaatcttcccttgtcaaatctcctacattttttttctcctctttccacaaatttaaaattcaatttgttaaagatttgtgaagatcagtacaactatttaaggatagtggaccaaaactcatgttttaaaagtccagtacatcaagagataagacatatttctatatcctttcttcggtcacatatgaaccattaggtataaaattctatctaggcataaaattacaaccattaagtataaaataacacttagtgaatggtgctcactctatacaagaccctgatttgtagccttaatct

SEQ ID NO: 49869 - DNA, 2028 bp, Bovine  19866881110929
gaggaagaaggcaatagaaatttacagaagttggcagttgaagaccttggtaaagaaatgaattactttgctttgtaacaacaaaaacaaaataaaacaaacaaacaacaacaaaaatgggaattcagacttgaaacatgatgctctccctaagtttgtttcactgcctgtggagagtaaaatcatctcttgcttataccttctacttaacatagagcagaccgagagtctccgaatttcaagcctttttcagagaaacaacatctaaaatatgtcagccacttgaagtggggataatacctcatctgagctcagatacttgacatcctttactcttggaagaattagataggggcatgaaaggcctcaggtgaagactttggttttgattactgaaatactctaccttgtaacaatatgtgttactcaattatggaaaacacattacaaaactataggtcaatcaataatacgtgcttcccagtttgtgctctagggattactagatgccagggtttatctgatgtgccctaatgaaagtgtaataaaagactttgaaatggaaaagctagggtgccaagacctaacacgggacagtgattcataatcactgttaatccataaaataatccagtgattatggaccactattatttatagctcagtgcattcaacatcagctttatatctaactgtgcatcaaaaacaatatccatgatatatttatatgttttctcattcacaacatattctatgcagtttgccatgtaaatatgcatctatattattattttaattttaactgatatatccttcacactcagtatagattcttggtacttattgaatacacaataatattttttgtgaatagaaagcattgatattcttttttattccattgctagaatttgctgcaatttatttaataaaatacatttttaagcacaacagcagtggatgaatgtgaacctatatttatctgattattttctaaaattcctacacttctaagggcatatacgctagactttgattacagggaaaaatattttaagggccaagaacttttttccttcccaatactgcacagtattgcaatccagtcaaacttaataaaacataattaaagcacaaacattctcattactattaaagtaggaaaactccatttataaattccattggattctgtatgatatgcaaattttatttcttcactatcctcaagtaataatttctccttatactttgtctgaaacattgcccatagcacatacacgtttagaaatattaaaattcatggttccagaaaaccagaaaatgtgcagaacttgatactgagaatgcctaatacacagtaggtacttaacaagcagaatgtcttgctatttattttggttgggtgactttttttggttattattcttaattatcttaacattattacttatgtcataattcttacataaatgtaaggtcacaataaacagtcagcagatgatgaagaatgctcaatgataagtattcatttatcttaacccagctaataaatgtcaattcttagatctcagcctaggggttagttctggtaattctacccttataccatctgttttgtggtattctttttctctgggtcagtactctgcctaagatcacttccttcctactacttatatgctcttctctccaagagaatgcttaccaaactttccacttggatgtgcaatctaagagagaagtcgctcactgtatttatatatatatatatttttagagggtttgtaccactgatcattgtctgagttgctcatggtagtatacaccagcagataacgctcaggttaatttattttaaccacctgaataagtttcaaatataagtcattctctcatacacgacctttcccaatgcactattaatctttcaataattgagctttattagtacacatgtgtcaagccaactttttaagaaatgtcagacatctccaaataaacaggcaccctcccaatggtgtggca

SEQ ID NO: 49870 - DNA, 2193 bp, Bovine  19866881122690
cttctatactcttattccaatgattctcttcaaatgatgaagagaacttttttaatgaacttttagcccagcaaggcagtaaaccaatgccttcattacaaataggctttgtatcatttcaatggaatgcgataaaactggaacatatagggagtttccctatgtttcaccagcactttgcatgcatgcatgctgtcacttcagtcatgtcctgactctttgcagacctatggactctcgcccacctggctcctctgtccatgggattctccaggcaagaatactggagtgatctgccatgccctcctccaggggatccccccacccagggatggacccacatctcttacatctcctgcattggcaggtgggttctttatcactagtgtcacctgggaagccctcaccagcacagacttacgttcaaacttagcattacagttaggctctttccgttattttactaacggaaagtaagaaaactatgtatgaagtgaaatcattactcaagtggtaatgcttaaaagtcaagattttgaatgctgtgtgtgctgtgtgtgtgtgtgtgcgcgtgtgtgtgtgtgacttacaaccactgctgatccagcatttgttctgccatttgactactcagagacccaagattgatactacatgaagcacttgacaattcaagtaaaaaataatgtgatatttttccaaaactggtcaataataaatgagttttagaatttaaatcaaaacaatggatttctcacagtacattattgataaggcacactttttctaacaatattttcaaaggataatgtattatatactgccactactaataaaaactccaatataaatgaaagtattaaactaaaaaacaaaataaaataggtttgcacatggtaaacattctgcagggtagtttatttggaatttgggtagagataatgtgtaacatgatttgtttcacaaattcccaattctattttttttttaccctggtgagtaaaacataagtttcttataatggcttaagtgctatagccaaacactaaaatgtcatataactattccatatcatttctggtacatattgctgatctgaataaagcaatatgagaaagtgacaagtaactcttcacagtaataaagtatatgagtagagaatactactttaaagatttatttcataattagatattttactatgatttttagttaggagtgttttcagtttttcactttaaatactgtgtctaaagaaatgcaagattcataaaattatgctaactggacttgtttgttgaatgaataaattaatgcatgcacagctattgaaagaagaaaaacaacagaggaagagagagagatttcaatgatatacaatcattaaacatacaaatttagcataaagtgatgctgattctctcacacagctaaaaattaactctgtaaactctcactttatactatatcccatactactgaccattagctcctggcaatcactaactggttctccatttccaaaaatgtatcatttcacacaagctttataaatgaaattctttggggattgtttttttcatacagcataattccttacagatgcatgtcaagtgtagtgtttattaagtagttcattgtttttttcattggtgagtattattccatggtatgtatataccacagtttatttaaccattcatttactgaagggcattaactgattccagtattggctgtcacaaataaatctgctattaccatccatgcacagtgatttttgtgtgtgattgtatgtaaataaacttccattttaaaaggataaatacaaaggagtgatggaatgttatgacaactgaatgtttagtttcatattacaaaaatgtgttccagagttctgtattttacattcccacaagtaacatataaacaactcagtttcttcatattcacatcagcatttaatgatgtcactatttttattttaaacacggatatatagtagatgtcattatgatgttactttgtattgttctgatgactaaggatgttgaacaacttttcatgttattatctgttttctatatattcttttcagggaaaagtctgttcaaaggggaaaaaaagtaatttgttaaggtttgagacgtttaaaaacatatattttagatactaatcctttgtcagatatgg

SEQ ID NO: 49871 - DNA, 1475 bp, Bovine  19866881233912
tgacctttctcaaatgcacatttcaggaagaagcctccatcaacatttccttcctctttcatggaatctcttctgcaaacactgcttctctgccctcttaaccaaggcagctcccgggctgatgtaggtccctggaagtccagacatcaatatacttttctttacttaaccattcttattctccatgtgaatctattccaaattccattccctttcctgattcaagaaatcataaatctaatatggcactccctccaaagtttaaatttatataatggagctactgtcaccttacttgttacatgtgtgatatattcatggggattttgatattcacctatctcaatcttgtcagtgaattatgctatttaaagaacagaacaaagtctaagattgaaaggcatggcgttgttaaaaaaaaaaaaaaaagatggaatttgttgtatcagaagaaaattccacttcacccaaaatatcctaaagtgttcagatgatccttgaccagagataatgccataattattccaaaaaagattacatgccagcagagtctacagtaaactttgctgatccaatgaactttaggtaactcaagaagggaatggaacctagaagtctttagagaaagggcaacagagtacaatttagaataatttacaaaacctaaagaaaataaattaggtaatataaaatatatagaaagctaattggaggggtcttaaaaattcagtcaccatagaagagaaatgcatttttactgagttctatgcttagtaattcagatatttcacatactagaaatgtggaaacatatataatgttcttagcatagggggttgcatgtagtgaatgtttaacagaggctgaatactattatctcagtcaatttcagaaacatttctgttttgcagaggaagaaaattggtatctgaatatttgggcagccaggcaaacttcacaaagagagaatgtggtgaaatccggattctaagtgaatcttccagacattaaattttttatctcttttttcctgtggtgctacatgacttgccatttgagctaagaaagaggatttttctttcaaataatgtcctaatactcatccacatcctatcttagcagatacaaacataattctatcacaggtaggggatactttaaatctgcttccaagttgtacttaagcccactgtgagaattttagtgtacttcaaatgtattcactcattcaacaaatatataatgaacaccctactctgtgtcaggaactattctaggtatggggagtaccatgggagagaaaatatttactctgtatatggaatgagctggactatccattgctattcaaaacttatgactcagagtaacagttcctttactagtcattggttatactcatttttggtataatacagactgtaaaagatcccatgcatactgaaatccaatataacaaaaacaaaattcctgca

SEQ ID NO: 49872 - DNA, 1257 bp, Bovine  19866881256370
ctttccccatatcattggcaggcacctttgaaaagaacaaatggctcttggatttaatgtctagggaaatgtttctagtttaactttatttcaaaaagataacttgccaacaactcactaaaatctttgagtcactttctttggtgtgtggctaagcaatgttcatttgggagaagaaaaagaaaaacttcataacaatgtgtttggaactgtttaaagcaaacatatgcaaaacccgggtgactaaagatactttttttttttttattggattgaaacaatgcaaactacacactgtgtctaaatgtttaatataaacatttacactgaatatatttgcagatcaacagctgctcaaacaaaagcagcgaatctaatggatttcatagttgaagcccccaatcaaaatggagtttacgttcacatagcttattcaattgcacttgtgtatgggcctttgtttcaaaattattatctacttttaatcttcttccaagaaacaatccaaagaaagttacttagttcacgtttctagaccaaatgaggtacagggcaattaattttattcctcaaacaaaatccagctagtattattgatatgcaatactactttgctatcataatgcaattatgctatgtatgctcatttcaactgaacatatacgaagacattccaaatgcatctgaattctctatcgctgttctatgtgcaattcaaagcatgtcagttaagggcacttgcaaatgcttagggaccatgcactgaacacttccctttgtaatcaataaggaactccatgaagtaaattggtttataattttgcaggaatttgaatcttactggaggaggctgatgtgtaggagtcagtcacttagaatatgtacagattctgaaatatgtataccatttcagctatattatactttattgtttattgtgcacataataatctctggaaaagtgatggaaatggagtttgtttctaaaaatgagtaacgagtgacaactgttaatgttagcaataaaattcagaagaaaataaagatgtctttatgagtaatggtactctaagaagaaaaaacagcactccacccatacaactactgcaagaagggggattatagactatgttggtagtcattaagttggttattcttaaatgtagtagagtgtattcttcataaatgaaaattataaaatcacataataaatgtgattaaatgaaggtataactatttagttttatataacatttc

SEQ ID NO: 49873 - DNA, 1686 bp, Bovine  19866881275811
gaagagtattactaactttgctaagtccgtggaataggaagtgactttaggaacttaggacaactctcataccacaatatcaattttgatgacacagcttttggtaagcaaaacagggtgcccagatggttcccagatcctacatatgttgtagtaactcaatgctccatagaaagatagaaagggtaggagtgcgttaaagcatttaaaagcatcccacctttgccaggattgtctcaaggaccaaggtctgagcctgcagggagaggtggaacaaagcccacagcagagaactaactgtgaaagccagaggaagtaaatcaagatggcctggatctctagctggattaaggtgttttctcttccaaaactagtcaaaactttaccaattttataaggcacttaaaaaaaaatctctctctctttctttttcacttcaacaaagatcaagagtcaaagaaatatcaaacaagcatacagcagacaacccaaataaataagctcttctttttggagaacagcatcttttgttgtttgtcagagagcagtgctcaagccagggtgtacaaattagcctctggaaactcagagctctccctggagctcacctttatttctgaatgtttagtctagcatttgtggcaagctgtgtcttgcaaggggaatctagatttcattctaccctgaaaatgggaaagaggaactgttgatattataaactcttttcaagataggcctaaaaacatgcaattgcctttttcatttctagcacaagacaccgaagatctttttatagaatccacacaaagcatgattcagaaccctgtgctattttactgaactaatgtccagcagggaaagacaatttggcctcattattcaaaaagccagaccctattcacatacaatttagtaaagttactctttccttcttgacctcttccatattaaatatataaatacttatttcaaattattactatctatatttaatattttgtaaatacatgactaataataataataataactggtccactgttaaccacattgacagaaacctgagcatttgtgtttgtgtgtgtttcacactgaattggtgctccgtgtcagtgtcccttattctatctaaagtctgagaaggatgaaactctggtaaatgtgtgcctagtcaaaaccataattctaaccaaactgattcaactttgatctactcagaatacagctagaagcagtgtctcagaaacctgaccatggtcaaattcagcaacattctggctcttctaggtaagaaactttgggtaagatccttaaatcttactgtactctagtttcctggtagtgtttcatgtgtcagtatttgcaactatttagcacatttcctgacattgttttgtcttatatatattataagcaagttttacatgataaagttagttattattattggctaaaaggaaaagaagtaaacaacatttgtgtatttcaatcttgctcccactatgctcatttttttagtactaacctgaatcacacctttcagaaattcagaaaataagtccagttctgtgcaacaaattttactggggagacataccaagcaatgagaccactaaactggatgttgaagttgtatatatatatacagacacacacacacacacacacacatatatgcctttgtgg

SEQ ID NO: 49874 - DNA, 2506 bp, Bovine  19866881297721
agtgacagtatatacgccttgacatactcctttcccaattttgaaccagtcatttgttccatgtccttccctgtaaagaagaacaaacagaggaaactctgtggtcatccacatggattctcctcttccaaaataccctttaaatctaaaatgtttgtccctgattgaacagtgaggctttttagaaacagcagctccattagtacttgttctggacactgcctttgtgaaactgtctggcattaaattgtctaatctcagtcccttctgtccctacccaaccatgttgacttgtgattttttttttttccccagtcacagattagttcagctaggatgaatctgattttcacttaagtctgtgcagatttcctcctgtgagccactgctgggtctgctgggatcctgccaaggacacttcctcacctggaatcttgtttagagtttcagacagagagttggcagctcaggtgtttgtagtcatagtaacgccaggggaaaattagggatgtacacagttgaatgtctgaccctgtgaatatgaggctgtctttctctattcatccttctatccattcattcactgattcatccccaaaacattcatcaagaatctgctatatgtcctacattgtgtttgatcccagaaatgccaagctgaaaattatttagctactgcttttgaagaggtcattcatcattcgttcaatgagtaaatgttactgagacttttacacatctcctcactgagcaggtccttgaaatgcagagaaatgatagataggaatttgtgcccatctttatagtatgtgtcatctataaaatccagaaaaaaagatgagtacccactaggcagtgctcagtgacatatagattatttctaatgtgttcatataaatagaaaaacaaaaaacttcaatacagtgaaatatgtgccacataactgtgtgacagtgctgctggagctattttgacctaccaggcgaaatatccagcaatgtctgtagacgtttctgactgtcacagatggagagtgctactagcatctaatgggtagatgacagggatgctgctaaacacgctgcaatccacaggcgcccccctacaacagagaattatccaacccaaacgtcagcagcacccaggttgagaagctctgtgtgcagataaacataaacatacaaaactatgagtgcgaaagaaagtttgattttatcttgagggctagaaaagtctgtccaaagaagaaatcatttcagtttggttgttgactccatcacaaattactatgagtgccatgaccctgaagtattatagactaaacattgaataacagaaaattcttttttgtttatttattttcacccaaaactactggagaatatttttccatgtaattttgttagatattcccaacaaccctatgaagtatatagaacagatacaattctcctgtggaacttaaaactcacaaagattgtgttttgtttatttatatcccaatttcctctaagtcacaacctatagtaaatggcatttctcataaagtctaatgatattttaaaacatatttggttactccaacagcaaagagagggggaattctcagaaattcttcacaaagtaaaatgatcatatgttattggacagaaagttgcattttgtggaattaaatgttagatgctttgtgcatttttcaattttactagagtccttctacactccaggtatatacctgattaagtaatatgtccaaccccatcattttgaatagggagggcaatcagtgatacctattcatgtttttgataagggtgttcactccccagaaatggccaagaaaaacaacatatgtcaagaatgtacatacagagagactgtggtttctcaaataagcttcttgcctgcaggcaacacccgcattaatcaggtagttacctcttcagatactctgaaccaactagagatttggctgaggctcagaatcacttgaccactgaccatttgaagctcttccctgactaaacaagtctctaacttctacttatcttctcttctaaatgtttctctaatctgttacttaatctctgctgtcagtgcatacctacttttggacattgattatcaccttgttgatgttttctgtactcaggtaacacagtaaactattacctaacacatttatctaaatatacagacttaagtgcatttgtttaaaaaaaaaaaacatatatttcaatcatgaatgttaaaaaaaaaaaacacaacagttcaggaaagaaaagaagataaccttaaagtaattacaattaaaaaaaaaatgaattgtttaaactctacctgaaagccactaccctagaggtcagctctgactgttgagatgggggattagcaagttttaaagagatgtgaactgctatcaccaaactgagaccatctactttctgtaatcaccaggactgaaatagcactagaaaaggaaactcattatgcaaataccattgtt

SEQ ID NO: 49875 - DNA, 1815 bp, Bovine  19866881448372
cttatataaggtgtatctctgaagtcttcaagacatcctgctttttccgcctctagttttcactcacactattgcctatttcaggatgaccctttgccctcatctatttatgggtgacttcttcccatccttcatacctctgctaaatatcacctactttaaaaggtcattcactcctggaactctctctgagatggtctactctccattgttttgaatctatacttgtttcattcaaagaaggggttggtaaatgtttttctgtgttaaaccagatagtaaataaaacagggcactggcaggattcagctgcccagtataatctcctgaccccctgcttcatggtatcaatcacaaggtttcagttgaaacatttattttgttttatggttgtttatgatcaacatggccattatgggcttcccttgtggctcagacaataaagaatccacctgcaaagtggaagacctaggtttgatctctgggttgggaaaatccacgtgaggagggcatggcaacccactccagtattcttgcctggagaatcccgtggacagagaagcctgatgggctacagtccaaagggttgcaaagagttggacatgactgagtgactaaacacaacacatgcctgttataataaaagcttcataaggacaggagtcatagtggacttgtttattattgtattaacactgaacatagtagatgctcaacaaatatctcttggaagaaataattaattaattaaaagttgagtttggtttaaatatttagccttaatgattctctatagcctgcaagattaaccctaatttattacaaaacatattcccatagattcttgacccaatgacatttttagtgttaacacttgctaccatctttactgtcctaagacaagagttgcagttcactcatccatttactctttcatttagtgtcatgcacaataaataaggtggcttatggtaaagaatccacctgtcgatgcaggtgacacaggttttatccctgggtcagaaagatcccctagagaagggaatagcaacccacagtagtatctttgctgggaaattccatagacagtggagcctggtgggctacagtccatggggccacaaaaaagtcagaaaccactttatgactaaacaacagcaacaacaaagtgaaatgatattcaaaatctagcactttgggttcaaaagtggagactttaccaagatggaaaacttattaaagataaaattatatagtgatgcttttcaatgaattagtgaatctgacctggtgtcttgttctctggtacagaaacagtcatgctgttttcatttcaaatacattatattataggagtttttgcacaggattaaaagtttcactgatttatttgatgtatctgtttgaagatttaagtactaaacacacaaaactataaaattttacaagtcaaaatgaccctttagaaaagtcacaaagcaatgtttatttgtcaggaagcaacagttagaactggacatggaacaacagactggttccaaataggaaaaggagtacgtcaagccttgtatattgtcaccctgcttatttaacttatatgcagagtacatcatgagaaacgctggactggaagaaacacaagctggaatgaagattgccaggagaaatatcaataacctcagatatgcagatgacaccacccttatggcagaaagtgaagaggaactcaaaagcctcttgatgaaagtgaaagtggagagtgaaaaagttggcttaaagctcaacattcagaaaacaaagatcaggcttccggtc

SEQ ID NO: 49876 - DNA, 991 bp, Bovine  19866881632460
cagttcagttcagttcagtcgctcagtcgtgtccgactctttgagaccccatgaatcgcagcatgccaggcctccctgtccatcaccaactcccagaactcactcagactcatgtccatcgagtcatcatatatagcgatacttgtgcagtgtccgctacatgccaaactctatgctaggtctttccaggcgttattccatttactaatcagagcagcccctgaattaggcattgcaaacccagatgaagcaattgaggctaaggaaggtaaagtggaagaaatgagagaaaaacatgtataaaaactttcctcatctggaacacaaatgagaatgaggcatcagttttaaaaaaagtactaagctttctctctccaccctctcccagttttttttaatgtcctcaaaaggctgggattaggaatcctcccacagctcatctctcttgagagctttcctagtgctgcttctgattaaactaacagattagacccaatggcataaggcgcagcttctctcctttgagaaagaacaaataagaatgaagtgttagattgcaaagctaattatatattctgttcaagtgtcaaccatctgctgcaattgttaaaaaagcaggcataagtcaactgttgtggtgagatgtttaccattgtgaacagacagaaagtttatgacactggtggagattcattgttctagcatgtgcctggaggctgcggtgggattccactgttaccttgggaagcccacctaccagtgagggttcaaggtggtagctgatgatcaagtactagtcataactatttcagaactggaaagccttcttaaagtaccaacactctgtttacaaatggaaaaactgagatcccgtgagggcaaggtacttcttatactacacttaaaatttcagcacttgtctttctgtggaaattttatgtctgcatgtagggtcctccctcaggtgtagtaagtcccgaaagaagggaca

SEQ ID NO: 49877 - DNA, 925 bp, Bovine  19866881938702
tgtagtgatggggcaatcatgcttctcaagcagtgtgtacctatttgtttagtaagagagaggtcaatttttatcagcttctccatgaagagaagagggaattttgaaacatgcctgatgtcttacttcctttctacttttcccccacaaaccctaaggctagagactccatctggctgggttatttcagaggagacatgaatgagaagagttgtatgagttggttggtagaaggggaaagcctctctgggaatcccattgtgagtgggaaaagacagatgtgttaacagctgctcagctagataatgagtcagctcccattgcaggtagataatctccaagacagctaatccatttgcagataatcaagaattgaccatatgccacagctggattgtgtgtaaagggaacacatgaggaaagaggaaaaacaggaatttgatggttatcttaaaaaaaaaaaccccataatatcatatggataataataatggtccattcacttaagtaacatttttatttatcaaagcattatcacagtctccctttaatttactttcttgtgaaataggccaggtaggtctatttccatcttttagtggagtgcttaaaaagaatgcaaagcaaaaagaggaaatgagcatttactgctcactaactctgtgttagggaccaagacctgctcagaaccacagaaataattagttatatgacagatagaatattggaagtttagctagtagtccagttctcaccgagtgcaatgttaattatgtattgcaaatccaatacaaatgccttttagttataaatatttttcactctatgcatttgtaaatcagaaaaatatgtgctaacctcgtaaaatcattatcttcactctgcttcagaattgaggtttatttgtgcttatctcacagcatat

SEQ ID NO: 49878 - DNA, 1548 bp, Bovine  19866880439218
cagagctgcttcaggggagccaggccatcgtgctccgctcggcggacctgacggggctggagcagcgcgtggaacagattcggaaccacatcaacggggcgcgtgctctactacgccacctgcaagtgaggcggggcctcgcccgcccgcccccctttgtctgccctctcggctcccggggccctggctggctggcagttctttcctgctccaggagactcttacgcagcctaaagcacagccggaactacccccaggatgcagctgagcctgggccggtggggcagctacagctgggtgacggcgaccgtggaggcgggcccgtgtcaccatgtccagcggctctcgagtgcagggcgcttggctgggcagggtccttgcccttcattctccactgaggctgaagtcctgggcccacacagaactgtaactcaaaacgttgcacaagggaaaagtccaataaaaatcttgggaaaggagcctggaggtccaaagaggggaaatattctgtctccctgttacataaacctttctcgcctgtttctgtctctggtctggggtccctgggtgctcccctgctcaagcccaaggcctggtggcatatgaagcataggctgacactctctgcccagtctagctggcgcaccacccagactgagggagacggggcccatttgctccaggaactgactgaattccttccttaagaggccagaggagctgttttcatctttgaacaactatccagtttctcatttgtagatggagaaatagaaacccagacatggggaggaagttgttcgaaatcacacagctccgagaggcagaactaagactagactttgtgtctcttgggattttaaaaagaagctataaacgtgtgtgtgtgtgtgcgtgtcggcagatatgcaagcggcacgaatatttgtgtgttaactgtggttcaggcgccatgctggtgttctgtctacatggagcgtgtgcattttatttcatgatatgggtggcagtgttgttcccatttgataggcgaggagaccaaggccccagaggctcacagatgtggcaggcagggctgagctgagcctcaaacccacgttcatctgttacaggcattaggatggatgctgggccgggctgtctgggttccaacggcgcctacttccaaggggctgttggagaggaaaatgagtcgatgtgtatagctcacgacactgggtgcctggcccaccccacagagctcctgccctcgccagatcctgcctgacctccagctctccatgcgtcttccactccgcaaagcccagaagcccctgagctgcttctgacttagagaaggaccaaaagaagtctcatagagaaaaatatgtccattttattcagcacaacacagagcaggaagccggagggggcggaggacaagaaaacaggggtgggacaagaacaatgagcctgattttcagggagagaaaggagcagaagcaggatttgaatgacaggctgaaaggacaacagtcgacttccaatttttacttaattgagtgtgtg

SEQ ID NO: 49879 - DNA, 1717 bp, Bovine  19866880533988
ctttggatctccttgcagtccaaggactctcaagagtcttctccaacaccacagttcaaaagcatcaattcttcggcactcaactttctttatagtccaactctcacattcatacatgactactgtaaaaatcatagctttgactagacggacctttgtcagcaaagtaatgtctttgcttcttaatatgctgtctaggggttggtcatagcttttcttccaaggagcaagcatcttttaatttcttggctgcagtcaccatctgcagtgattttggagcccaggaaaataaagtctgtcactatttccattgtttctccatgtatttaccatgcaagtgatgggaccgaatgccatgatcttaattttctgaaagttgagctttaagccaactttttcactctcctctttcactttcatcaagaggctctttcgttcttcactttctgccatgagggtggtgtcatctgcatatctggggttaatgatatttctcctggcaatcttgattccagcttgtgcttcatccagcctggaatttcacatgatgtactctgcatataagttaaataagcagggtgaccaatatacagccttgacgtactcctttcccaatttggaaccagtctgttgttccatgtctggttctaactgttgcttcttgacctgcaactattggaagacaaaagtgaggaataaaagagaaaatgtcctgtgtgaccagcaacacctccctttagttcaaggacagaaactgaaggtcacagtagtttcttgcgaatggtgagcaaagtccatgcggcaggctctgaggagttcgaaaggctcccctctgtggctgagactgaatgtgaagcctttcccagatccagtggatttttcttggatagggatgacaatatctaactgggcagagcacacagatccacaaggacataggatgcctgtttctggatctaaggagcatagaaaattggataagagtgagctgcaacaagattaatggctgctacaggattatcgaatccatccctagagagtcggcgggacatgaagaaagaacatgagctttccttgctaatatcagtacttcccttctgcaggtccacagcttagaatcatatcttctctaccatgtctgggtaccacttgttccttcgcaattcatcttgcaaaacagcttaattctttttactcaccttttcactaattcaaaacttgtttgcctactgcctgctggtttctagggaaacacaggtgagcggaactggaacttacattctgcctactgttgtcactgttctcagtcactttgttcttctatttcttgtgattgtttcaggaagcttcggtgaggagaagagatcgatgtgtcatcatgccaccatgcttactccaaagtcctacggccaggctaagggtttactttcctgacctagatataaaaatatctctgaaaggactttgaggtcacataataaaacacagccccaaactaatggactacaagcaagaacattaaacttagtgtcatggtttataaaaacccttttcaatagagacaggatatgatgatttcattctccttttaatttataagaaaattccccaactttgcccaagattttctcctactttgatatttgaggggctgctgatagattctctctcctttggaaagaatatccctctagcctgcaaagtccaaactccctcg

SEQ ID NO: 49880 - DNA, 2571 bp, Bovine  19866880558594
ttttggtttcagacgttttgcggatgctacttggatgagctctccaagcaagagttccaggtcctcagaacaaggcccgagccctggtgcaagtgcaagaaaggggtctgctcacagccacgtatgctcgactgccccttgaggccgtagactgacttctttcacaaaagcctggactccgtacaggcagtttcgggggaaggagtggagctggttgctggtgttttctcttcggagtatttagccttttccatatggagtccccaaaggccacgtagggcttccactggtgacccgcagtggagaagtgccaaatgcctacctccagactcaacatcactggctcaccttggctctcaccggctctccctttaagtcttaaagggagagcagaaggaagaactgtctagcaggtgtccttcactaacaggaagcagactgcttcacacagtggcagcttcctttctagataggtagttattgagggagagtctgaaaaggcactgaccgggagtgctgtaaagatgacttccactccagatggagctcagttctatcgacaaagacttggccaactctcaatcacgtgaccccatgatcattctctagaggctgagtctgaggggcttatagtaaaatgcagccatggataatcgatgggggaacagggtcttaactagtgtgatcaaagataaaattcaagagcttatagaataaagtaatggggatttccaaccactggcagtccagtagttaagatttagctctcccaatgtagggggcccaggttcaatccttggtcgaggaactaagatcctgaatgctgagcagccaaaacagaaaaacaaaacaaaatagaatcagtcatggaagtgggtaaaaaagacatgatttcacaaaataaaaacccctgtgtcccaaatccacagaaatcttaaatccacaaacatgtgagattcagtacatacggtagtcaaaatagattggcttcagttctgctagagagcagagggtcagattaaatgctgcctccagcctttcccattttgaacatatcacttctcttcctggtccagtttgccattgtttacacaaagctggtcatttgtgcctcccccggtctcacccctgcatttccacttgtcggtcatgagcaaggccaggcgggagaagcagggaattcgatttggatgttgtttctctgctgctggaaaatctcgagggactttctttcatgtagttaaaagtcacaactcaggagggatccaggtcctcggggagtgtgaaaactccgtgcgggcagcttgcctgttggcagctaaacccgtcgctgtgagagggcagggggccttctggaaaactgcactagacattagacctgaccgaggggttttgttgttgttgttattttaatcatgaaatcttagcactaaagtctagtaagatggtgctgatgaacctgttcgcagggcagccgatggagactcagacagaggaaacagacttgtggatgtggggggcagggggaaggagagggtgggatgaacggagagagtggcatggaaatgtataacgatcatatgtgaaatagacagccagtgggaatttgctgtatgcctcaaggaactcaagccagggctctgtgataacctagagggccgagtagggtcgggggtgggagagaggttccggagggagggcacacatgtatacctgtggctggttcatgttggtgtatggcagaaaccaacacaatgtcgtaaaacaattacctttcagttaaaaacaaataaataaaacaaataagatctagtagatcctggacatggtttgtctgtggttcttctatgcactcagcagactgaggccgctgctttacacaagtacaatgaaagggcttgtacttgaagcgtacgttcagaggtggccggatccaatattcctcacgttttctcttcttccatggttttcctgttttcatgcccacgctgtagcaggtactaaaggcataaagaccagggagtttttcaaacactctgtcttagggtaatgtctaagagctcttccttctccccagggccaccccactgaatccatatctcaaaaaagaaaattgcaaaatcagaataaatgtttaaatctctgcaaaacaaaacatgtgcaccaaactcaaaaattactgaagtcttagatggttacacatcaatttctagtacgcgctgtaggtacattttaatatctttgatgtgatgtaggatgtgacctctaaataagcttacctggggcctgcagaagctttacagcatccttttctgtagcttcaggacggctccagtgcctacagagcctgcgacgtgtgcgcagccttcagtggcttcttctggacttgctctctgaacactgggtggcagcacggatcttcctaagctttctccagagtctaaatgcaaacctgagcaattccaccttaagacgggccatgcgaagaagcatgcaaaaagtgcagtgattctggggacgtggctaatctctataattcacctgattgcagatacaagtgacagctgcaat

SEQ ID NO: 49881 - DNA, 1461 bp, Bovine  19866880568794
gcctggtgtgctgcaattcatggggttgcaaagagttggacacgactgagtgactgaactgaactgaactgaatgtcttccttgtagtagcatcactgggcagattttggatagtcatctgtttcttagccaaaaaggaacattggttcttctgaagacccgtctactccttcaatatctacacgtatcattatctatgggctcccaattcttaaaggatgaggacattttagtcttatttttctttcaggagccagttgttttatccggagaaccattaagttctattgatttctagcttgctgctgctgctgctaagtcacttcagtcgtgtccgactctgtgtgaccccacagacgacagcccaccaggcccccccgtccctgggattctccaggcaagaacactggagtgggttgccatttccttccccagatttctagctcacttacattctaaggctctctgaaactgtctggtcacatacttgggtattttctcaacctgccaggtttggatttcaattattttttttctcattaaaattcctaattcatatttgatctcataaaaaaaaaacaaactatgaaaaagacaagtctccttttatttcaactgttgggtctactccagaatgctctttgaaaatttcctgaagtctgttttcatttttaatttattatttttaattttttgtccactatatctttaaaagaaaggcttttagaattgttttttttgtgctatgttttctatttttttcttgccttcttaaggcactttcttttttcattttacacagttgagttatttaaatttttcctttcttggccctgctatttttaaatatttttctccagctgaaggattaacaatttactgaactagttggtaaagatctagtccagaacaacaagtacccaataaaatcctaagttatgtaaaaaatttttatgtgactttctaagatttaggaaaatccttaattttaactcttaatatggctccaggcctggattttaaattttaagttctttaagactgccttttggcttagcaaatttacaatgtaattatttctttttcaaataaaactctgaaaaaagggctcctatagaaggtcagggaaaggtgagtggaagagacagaaatgaaataaggttgctttcagaaaatattagagtctttgaaagagaccatgctggattggaattttgtttttttgtcctcagcatactaatcaaagtaaactattgattctttaaattcctggagttcctcttaaatgtactaatttatttaggtgttcctctaaaatgaattaatttatttattttgatatgtcaaaagtaccatgctgactattgttattctatactcaaactttttgccctttatcaaagtaaatacaagagtagggattataatgcaacaagaaagcgggaattcttccaagagaag

SEQ ID NO: 49882 - DNA, 1569 bp, Bovine  19866880620265
cttctccccactaggctcctgaacttcgctttctctgccgctctttagccgttgcgtttctgcggccccgtctgtctcgctctcctcgcggctccgtccttggctctgtctcctgccgtccatgcttctagtctcctgctttgctccctctccctttgtcttccctcctcgtcctctttgccacttcactgcatcctctgccttgtttgcctcctttcctttcatgctctcatttttgatgctcctctttacctttctctctctctctgattctgattcataacatcttgaaagagcgtttgataacgcttgcctgaccctgcctgacatcgggtgagtgattctcctcaggcagcttttgatgtggtctgtgtgagattgatgaaagctgctcaatttgctcttcaaagctctgcttatggaaagcccggatgcatctcctcgggatgccactctttcgctttccagaaacaaggccaaaggatcggaggaacccatgctacttcccacgtgatcatcatcctcacagaagccttaatgctcgcaagagatggagcacattgcataatccaccttttaattttttctttaactgttgttactcccatagtcctcgtatctgagatttttacccacaaagaagattccttgggcaacctttaatttgaatacgactctcagcccagaaaagaacttaggtttggacactgagtactaaaatagaagaaaaatgtcatctattacttccagagtctaaggacattaggtatcctggctaattaggatagtcagcctaaaatgagaggagccataatcaaaagaattgtctgcagcttctggttctagaaagaacagtgggtcaggttctttctagcactaatcacactggatcccaaaagcatatgagaaaatgaggtgtgtttttcatctggttcaggttttctgaagcactgtttctgtttttcatcctaagaagaggattcttgcacctgcatgagaaggcttacatgttcagctgcttgaagaaagagggatagacaaacaatcaggaggagatctttctagctctgagatgctctgattctgagaatctaatactttagatatgataaatatagtgtattgaaaagattgctgagttttgtgggataatacttgagtttaaatgcagatttggacaattatttattgatgaatgatcatcaatacatttttagtttttttcagttttttaaaacagttttactgaggaataatttacctaccatgaaagtcagccattgtaagtgtgtggttcagtgagttttattaaatgcatagacttgtgcaaccactgccacaatgcagcttaatgacatattttataaatcttttaacctccctccattttccccttcatcttattaataaaattgagctcatgtggtggattgattacaaaaattaccacagtcctaatccttccatccattgcaacatgactttgttgctccttccattgagaggtgggattgatttccccagcccttgaatctggggctggtcttgtgacttactttgatgaataaa

SEQ ID NO: 49883 - DNA, 1115 bp, Bovine  19866880723578
ttgacgcagtacttgttgaacacggagttgatctgggcatcctgcagggccccgaacagcagggtctggcgatagtacttggaccaattgttgaggctccacatccgcactcgagaaaagtccaccccatgtgaatccaagggcagcaggttcatgtggttcatcaaatgctgcgagcaggaatactactccattagtgcttactgagcacttacctggagggcattgctaagcgctgcataagccttttgtcttacttaaccctgagaaacgcacactatcatctcccaagttacagcaagaaaactacggctcaggcgggagagtgacttgtccatagtcaggtaaacattcccaacacgaaaataaagctcaaactggctacctcctggatctttcaaaaaggactgagatagtatctatacagtgtatttctgaaatgccaccctggttactttataagcaacctggctccagacttggacaagaaggaaaatgacacagaaaacagaactgctgtccttccatgacctggttctcaaaaaagctaggagattcccggagtgactacatgtcaacaaattaaatatgactcaaccattagcttccctcgtaactcagtcggtaaagaacctgcctgcaatgcagaagacctgggttcagttcctgggtcgggaagatcccctggagaaggaaatggcaacccacccactccagtatttttgtctggagaatcccatggacagagaagcctggtgggctaaagtccatgggatctcaagaactggacacaacttagcaactaaaccaccaccacaactatcaacatgccttttctatgttaatcatattttttaccttgtatactgaagggtaacaaatactataaattgattccttactttataagtactcccctttatttgctgcaaacttactctaagtcctggagttgtagaaaaggtaagttctcacttgccttatactgtcaaaatgaacctatggttccatgatggggactgttccaaagcacaatcctaaactcaaagacactgcagagtatgggagagggagaaaaaaatcacagcactaattaggtaggaggacaaaaacac

SEQ ID NO: 49884 - DNA, 1738 bp, Bovine  19866880780877
ctgtggagcgatggactgaaattccgactctgcaatttactgtgcgaccctaggaagttcagttaacctattatgcctgtttgctataaactggggctaatagtacctattatctgtcttcaagggtaattgggaggattaaatgacagcaagtacttaaaactgtacctagcacatggacacaccactcaagttgaaagtaaatgaatgttatttgttttaacttcttttactaatgtaactattttcagagattataaattaaaattattttaactagaattaaaccctagttataactgacgtgtaaagcatggactacttagataaaatttttagaacctgaaaattttaaatctgagatctcctttcctaacagaacactaagcctttgctgtgacctgtgtcagtcagggctcagtgaaggaaaaagaaatgacttcaggtattttaagagagagatttaattcagttaagttaggtgcttacagaacagtagggagagctggaggagcagagtccaggccggtcctgcaggaatgactccttagaacacagaaaaactgactcaccaaaggatctattacatttaccaaaaaggtggggggagatatagtatgagttgaaaaacataactattttagcttcattaagggatcaggaagtcatcactgccattacaattactccttagcatccacgaagctgaaaactagctattagaatgttgctagaggggaaaaaaaaacatcttcccttgaacttgccggcccgcagcagcaggaagatggcttctgtctcacttccaccttgcatgaatgcatctaattgggagaatctgattagcatcagaactctagggaatctgagaggcacatcctctgaagcacaggaaagtagaaaagattgggatacttgcagattgactctggggtagtcaaagtccctgaagtacctttttctcattggtaaaatggggataaataatgatactcatagtgggcttatgatgaggatttaagaaagcaataaaaatgattcttttgcaattttgaaaccttaagcttccagcatctagcattgcagctgagaagtctgacgtcattctgatcatcattcatttttctatgttacctgggcccttttaggatcttcccttgatgttctgaaatttcactatgatgtgtctaagtctggatgttttcattgcttgttcaggctctttatttggacactcaagtccttcagttctggcaaattttcttgtattttaatacagcttcctctcctctgttttttttttttttttaaatgatccaccttttagtcatatgttaaatcctcttacatattgtctctcattttttttctttttttggtatttatgtctattttttctatgctttttttttcttctctatttctggaaatttcttatttctatcttctgaccaatggatcaacaacatttttctgtaaagagccagacagtaaataactttttcttcacaagccatatgacctcagtcgcaaccaggcaatccaccgttgcagtcccaaagtggccatgggcagtatgtaaacaacaggagtagctaagaattctcatcacaaggaaaaaataaattttctatttctttcattttgtatatatacaagatgatatgcactacacctattgagataatcattttatgatgtgtttatgggagtcaactcaaaacgctgtacatcttaa

SEQ ID NO: 49885 - DNA, 784 bp, Bovine  19866880794957
aataatatcatattagtctctgattgaaaacagtgttgttgaaagatcatggtttgcacagcatagtaaacagtttctgttttaatccatacaagtttctatgtttttttttaataattattctaagaagtataagatttaccttataaatttttttttaccttataaatttactgctcacaaatgtaatccatttttcccacttttgactgcttttcattcagttttttgttgttgttgttgttaattacggttttgactctttgaagctcattaatatcataaaaccttgaataggtatacttcccaagaaggtttctacttaatttaattttctatttaatggagaatacctttttttccactactgcaccagatcacttttttaaagctacaaatactcgttattgcattagtaagttcagaatattgaagataatttaatatttcattaaaatcctctatcttttgatgactcatactattactgtgaatatcaattctaaaatcagccctaaaatgtgagaatatgaaactgaactgaatacacatatggatcataggagtttgtttttaaataaattcctaataacagcttgctgtgttgtcactatctcttctaaaaaatggaaaatccagtgttccaatttttaggtttctattaaaattttactatatatacaaacaaaatatgcaaatattcatttattcaaagcttggaatgttttttatttatagtagttttgatcagccttttgctattcctaaatataagttcatatta

SEQ ID NO: 49886 - DNA, 1029 bp, Bovine  19866880853350
ctgcagttatttgtgcatcagattgaagatggaaggggagggacagcaaggaccacacgcttcaaatcatatgccatcttcctttttattcttgttatataagcaactcatgtcaaaaaaaattaagtaaaacaaattatctgcattcctgctttcaaagttaccattagtatcttagtgtatatttgtttcagatgtttctttattttcagcccttcattatggccattgtagtcaccaactggcaccaatgcttgagataaggctcctctttgcacaagattatatttgcatctggtttaatctcactccggccctccctcgcctggtccgtcaaggtggtgcttcctgctgcagcctctgtacactggggttggtcctccaaggtggtgctccctgctgcagcctctgtacactggggttgggccaggcaggcccacgtgtgtccgtgcctgcatgcgggagggtgggcacactttgcagcgtgtctgggcaacagcaggcattcactgcagtttcctgttcttcaggcctgggctgtggagacagggaagtaccaggaaggggtagatgaccccgacccagctaaatggaaggcccagctccgctgtgctctcaacaagagtagagaattcaacctgatgtatgatggcaccaaggaggtgcccatgaacccagtgaagatatatcaagtgtgtgacatcccccagccccagggctcgatcattaacccaggtgaggccccagctgctggggagaaggtggacagtgtgctgggttcctggctagacccttcaagagatagtcgacttgaaaattgccttgcttagaatgtttatgactgctgaacaagaaattctgtcgctggaaaggctcagagaacaaaagatataaactcaccaaggtgttcctgctcacttagtggaacactgaagccttagaaaatggagggagcatagagttctgtaaaaatagcttctctctgggctcaacactgagaagagaggccaggtagtttagaaggaggag

SEQ ID NO: 49887 - DNA, 1515 bp, Bovine  19866880859443
ttggacacgagctggttatctccccgcatcctccacacttccttccgtagtgaatgcactctctttcatttcttggtttgggacgtgacccattgctcagctctagggttaaaactaatccatgcagcccatcactgtagccatagtgattggttctgaatgggcatgtagcctagggagacacatgaagagagctgctatagaaaactgattatgaagttgacatatggagcacacactgggtagggaagtagaaagggaaagaaactagacccttagtgatcctggtgaaactgagtcactggatgaagccatgcccgaagacacacccgccatctgaatgttcccttactgctcaagccattttgagtttgttgcattctcttgcaactgacagaatcttaactgatgcaaacatttactcaatgtaatcactggctcctcatgggtaatttcagttaatgaaatcaaagtgtgggattttccaaaaaggcatcttctcttcatatttttactatcacttcactgatattttgttataattctactcctccaaattattttttgaatgcccaaagaacatacattggtaaatatttgaaaaggaaaccaaagacaataaaagataaagagatctgatgaaatacaacaacaaaaaaatgtatcctttgaactgaccctaaagtaaacaccttatgtattttattattaacattttctatataagtggtctttaaattttaatgtagttaatgaccacttggggaatttgattaaagattactaggctgcttcccagtgattctggtttggtggacctggtgttgagcccccaacttgatgtgaatgactattagagctcactctgagaaattttgcttttaatctacaggactaattgagaagagggttaggtatttgatttgcttcataataaatattttagattttaattttgcattttaaacattcatttttttggagtggcatttataatatgtatataaaaatatgaaacaaacccaaaggttaaaaagtctaagttcttattaagagaagatgaaaacaattagggtgaagggaagaagaaatgcttcatatgagggataaactttttcttgctttaagagtataagacagctgcttactatacagactacatttatacatccactttgaaaataattagtggctatatacatgatctgatcatcagattttaaatatgcaatactgcatacttggaaagagagggaaaatttaaaggagaaaagtttcattttacacatattcttccaaaatgaactcatgaacatacaaacttgaagtcagctaccaaaactcctggtagtaaaccacagtgaatactgtcaactgtccattcaacagtcactccccatctttttatttcttgcttggagagctcacctctcactatgaagactaaaatgccagacacttgcacttctagtctctcttgctgaggctaacacaatttagtaaactgttaaactg

SEQ ID NO: 49888 - DNA, 3097 bp, Bovine  19866880918640
ggaatggcaacccactccagtattcttgcctggacaattccatggacagaggagcttggcagactacagtcagtggggctgcaaagaatcagacacgactgagcaactaacactttcactttcacaccgtagtaggaagggtaactaacaacactctaactattgagtatagcttaagaaatgagtatagcaagtaaatactataccatatggctacttcaaggtttccagtcagggttcttatttgaaatcactggaagctaactctaagtgatacagcaatttattaaagggactggggtgacgagagaaccagacttgtggttaagcttctcaagagcaaaatctaaaatcatactgtggaactgagctggggaggaaatttgctactgctcttactgcgcacttgaatgccaaggtcttttcttttctgcaattattacttaacattgttcagcaccaatacaatttctgcaagagcaaaactatttcagaattactactgactcgttatcagattcctccaccatcagcctcatgagaacatgaattgagtgcagcatctgcttctctgttcagtctgtgccgaggtttcctggaggtgagtgtgagtggagtgtctagttaacatgactcccgccctagctaccagtgagactgggaaagtgaattaaacagcttaactgagggaggtgggagtattagttgggacttcctcagacataagaaggttgctgaaaaattatgaaaaagtgagaaaacataataaatgtccacaattaacgcttagtcacatactaagcatacaaaactcacctaaaaatcattaacttccccccctaatatatattagtagaatcagagaacaaagtgataggtagaaccttagagataatttcttttaattctctcgttttactaaaaagaaacctgatgccaaaaattattaaataatttatccaaatgcactcaattagttagtaggaagaacacatgctttttaaccctttgtatattttctactgttcactgatcaaattatacgcttatcttaatgttaaacttaaatcttaccctcaaggaaactcagggcttacttctcagaaagttagtttggtgatactggtcatttttctctcaatgtattgtttggatcagtttctgaaaaattagctataaaactaaattatttatgcagaattctaattttctatcattactcatggaaatgaaccataattaagcttcaaatatgctttaaccaaagtttgtaaattttttgactagattagaaatttcccttgccaaaaggctaataatattctttcaacaagaagaaattattcagaagctctaagaataaatgtttaattatgaaagtacctctcactcatatattattacatcttacaaaagtggagctaaaatcacctaggtgatctacaatcacatgatttctttacacagttaatatccaaacttcagcaaagagaacattaactagagaacagccagaatatatgcattcttttagtcttttatttttatgacaagaaaactgatcgaatttggagtcttaacctcgcaattgtcaaacgctagctgtttttggcacagaagccaaaaacaagcaatgagatttcgagcaggcggagaaaaaagaagacagagagcgtaacaattcaacacaggcacagacttaaagaagcagcagagactttgagaagcatggcaatgcagagaaaaaattctctatgagcagaagataagttttgttcagattaaaacgttacgtcttagatgctatctacttagcacttttttctttttgtgaacactccacagaaattaattgtactggttgtcagaaatatagaaatacagaattaagtttaggccaatacatgtaatggaggtgtgtacagaaatcatttagtttggtcagaggaaaaaaaaacatgttaaaaacatattattttgtatggcttcattttctttgtgaaaagtatataattaatacagaattgggaacagaaaagtcaaagcaaataaaggaacacaaaatacatacctcttgatggtacaggcattctcttctaatataaatcaggtatttctatatataagaatgcattttccacagattaactagtaaccgctcagaccagataatgagaaagtttaaaaaatcacagtaagaattacagaatatttagttttattaaaaagttatcttttcccctgtgaaatagcacttgcattattttttttcctgctcccttctgataaactgctggcatctacagtaattctaaaatttaaagtgaaaaaaagctatcaatttatccaataaaggataaatattatcttaagaacccagagagatacactaaattatgaccttttggtttttaaagatgctgaaatcatctagttgaaaaggtatggttctactggggatgaaggtcccatgagatcaaatgctgccggtagaagtccaattaaactaatcttggacttaacgcttgacatttaaaagcttagaaacaactctaaaatagtatagtttcattttaatacacagatttattccaaacctgtgtatttatgggtaaaaatacttcttattcaattgtaagaggactaaatataattcaaaatttctatttatagcatatcatggattttctcataatctaaatagctatgtggcatagtatatcttcttggtttaaataagttgtacagctctcctgtgactttcaatgccttgtggcaatttagtttaaaatacaaagagagacagacagacagacagggtatgtgatcagaacctggaggaaaaaagagaaaacggagaagagcttatagtactaaacacaaatattctcccagaaacaccgtaaaatctttgttttaaaaaaaaagtagaaagtataacaagggcaaggttttttgaacccttaaagataatttcacagccgttctggaaagacaatcagttatgaccgaggcagcagcatatactctgtaagaataaataatttctatagtatatcaaataagatatggggctagatagttgttaacatatcaa

SEQ ID NO: 49889 - DNA, 1469 bp, Bovine  19866880921267
gcccgagtcagggttgtggggggtcttttctgttgtaggagggttggggaagatgggtagtgagaccagagttcctttccttattgtcctgccctaggagactctgtgtctaaattctgttttttttttttttttccttttccccccatacctgccccctccctccttgctgttcgttctccgcagagctgggggagatcaccaacttgagggtcaacttcaccaagctggcgcctgtgccccagaggggctaccaccctcccagtgcctactacgctgtgtcccagttgcgtctgcatgggagctgcctctgccatggccatgcggaccgctgcgcccccagttccagaactcctgccagcccctccagcgccgtgcaggtggcagcccagggcaggaagggagaggggagcgggcggggcagactgcgggcatccttgggacccctggagaggggtggggcacttgattgaagacttgagtactgactgttttagcgatggcgaagatgagtgtaaatggttatcgttttcaaggtcccatttggtagcacttctttggatctgctttattatttgagatgatttttattcagtaacatagatgtaagtataagtatacgtgtaagtagaagtacatgcatgggtattgcagggagctcaaggcattgattcttagccctggtcatatatcataatttcctggggagctaaaaagatcaccgggatccctacctcagacactctaattgtattattattatttaaagctcctggtgattctaacagcttgccaggattgagagtccctggtttgggggactttgaattccctttagaggtgagatatgggacaggaggagagaacagaggctaacacggatgctgagttcaccccagagcagctgagtcagatgcgtcagggatagaaagggaagctccagcttaacaagtgacccaggggcgtttgctgggaagccaggcttgagagccatcagcagaggagagagacccttggaccaagaagcagagggagctgtcatttcactttcctgcttctacaatattaacaaccgggagcaggatacttgttctagtgataaaggcacacgatgaaatcctatcaggtggcctgctagggaaaataaggggacaggaacattgcgcagccttttcctttccactttctgggccagtgcttcccccaggctgcagaggaggccagagggagactggtgccagggatgtgacagccgttagggccccaaaacacaagaccagaacacaggctgagtgtgatcactggcgtataaggatgtagaggagggcgagggcctgcccagccccggtggttcttaactctggctactccatggaaacaccagtttataaagtactgatgtctgggccttgtccctgagattggatggaattcggcctgagcatttatatatataaagctcctcaaat

SEQ ID NO: 49890 - DNA, 2880 bp, Bovine  19866880927493
gatgcgtccataccgaggaatgtccatttattagcttctgtaagaacacacacattaagaaaagtcacattttgcatggctctggagctgagggaatggcttgttaaaaatttccactcaagcaacctcgagctaaggatttgtattccaaagagctggacctatttcaccaaaagtatttacttgagaagtagaaaaatcccacaagctcaatgagcaaaaatgactttgccttatataaaaatctctgtgggaaagttagccttagtggaggagaaacgctggaggtctacagagaaggcaaatggctgacatactctgtcttccaacataatgtcaattgttgttttttttttttattggcaacaggagattgacttaatggcctctgaggttactctgggagcaagaactgtcttctgtcattggaagaagtagctacttacttgatttcagggactgggggaggtgtccctggtccttctcagaagcccctcttctgctcaagagatgactaagatcccacatttcagatttgttccttggctggagatttgcctttgcctagtgcaaggtatcaccaggaagtgtcacccattaagcctcttagaattgcacagtgccagtctgcaaggttgtatatggcagctctgttaagcgcttatcagcataagagatttgagactttctcacaaatgagtttggatggaggccctgggacccagtgaaaatagaatatagatgtggtagagttaggatgactgtggttccagaaagtaaaaaaagtgggtttgaagacgatattgccagttcatagtctgacaaaggaaaatttagtaagtagaagttccagtccttgtcattaaggagcttccaaacctgcacactccgaatggtacatctcacacagcccagacagttggtctccacaagaccgagttaacagccttcagggtgtcttcatggtagattttcttctatttgagaaggaaaaagaaaaagcatacacgaaggtgaagattctgaggtgagataaacccacctcttctttctcagcacagaggacccgaagtgatcttgttgaatgactgcccattcctctgtgggcctttcaagccatgtctaccagagaacaaagtccctttggcaccaacttggcatttatagcagtcagcttctcgtgatctggcgacattatccatgttgcctggaagacgataagtccgttcagctcagaccaccaggtcagaaaacacggaggtctcctgccaggcaagcactctctcagcccagctccaggggccttacatccccttccttcatctcccagaagcccctccacgctttaccagctgtccttcatacctagtcttcgcaggcctcttttctcctcaggactgatttcttaggaggttatttcctcattaactacactcttccttgctatcctcaaaggcaaacagaagggctcttttgtttgtttttatcctgttgccgccaggaagaaacaaccagggtaccaagacgttcccaacatggcgttagcagagaggttccagagttgtatgagctcttccacacactgtcccacacactgtcctccctaagtgctcaatccttgtaccctttttgcctcagatctggataatcacacaatctcacttgtgccatctttaggctgaaaccttccaagtctttgtctctggtctcagctcttgttctgagcaagaaatattcacctccaatggcaggttcaacagtcttagttcagtgttctccactcaagacctacttagcatgtgcaaatcaaaatttagtaagactcttctgttcttccacctgaattatttatattggctccagcatccacccaatcactttaaacgccaaacctggaaaccttctcagacagtttcttctgcttcatccccataccccccacctccgtgtgggtgtgtgtgtgtatcctgtctgactctttacgaccccatggactatagcctgccaggctcccctgtccatggaattttccagccaagaaaactggagcaaattgccatttcctactccaggggatcttcctgaaccagggtttgaacccgtatctcctgcatctcctgcattggcaggcggattcttttaccactagtgctacctgggaagcccgggtaaaggaataaacacaagtaaagatatttgatcttagaacagtgcctggtggagaggaagtgttcagtaaatgttagctattgatgttgttagtggtagtaatagtggaattccatgctgctgctgctgctgctaagtcgcttcagtcctgtctgactctgtgtgaccctatggacagcagcccaccaggctcctccgtccactggattctctaggcaagaatactggagtgggtcgccatttccttctctgtggaattccatatgccctatcaaatcgtcagagggatttttacccttataactactgcagagatgaggggaatggctgtgtgactcagccatcatgtctatgttttcattcatggcaggaactgatcaacagatacagcagtacaaatgaaaacaccaacccatccctcctcactcaccctgctttataacataccaaggaattcttagcccagtagatctggtgtggggtacaagtactttgtgcctctatttaaacttaccgcaccagagcctcccacaattcagccagaggccaggtactccaaatcatttcatggtcctccatctccaggggctagattttataaagcgtatccacctctacaaccccctgtgacttctaccgtgacccccctgaggttttaacttccccacgcacagacaggatctgtcacatgcctcggaaatgcattcgtcg

SEQ ID NO: 49891 - DNA, 1333 bp, Bovine  19866880976773
agcagagaggctgggctattgggaaaaaattgtatttgtcatttttcacaggaaaaatatttgtttagtccaagaactagcaaagaaatgttgaaaatttcttttgcagggactttttgacatcattctttttttttttccctacaattctatcccctctgccttagagatacattcagcatgaatatgtaaacattccacattttttttaaaaaagattatttttttaataaagaaaagtccacaatgtcacaattgtgcatgagaatgcacaattcccattaagcactgtacatgtccaaatatggtggaaaattcagagggaaacaaattcaaactccagtttaatttctgttttcctgtttagttccaagctcagtgtgtgctcttataagttgacaaggagtaacattgcacctattagcactcgtcaacagaaagtagattgttcgggtttcaataaatgttttttgaattggattcaggttggtgagaaaataaattaagtcggaaagtctttgaggcaaattacatattgaaatgaacagtttgatgcataacccctccatcacccccagagtggggggcggtggaaagaaagaaagggaaaaaagcagaagtcttgcttttctgagctgtgagaatttcttctgctcttgcatctgtgaacactttacaaggcgatgtctacagttggatttttacagcctatgtttgaatgggagcttgcgtgacatctggggctatatttctggagaaatttcaaagctagtgatttccagtttttaatcaccagagtatttattttctcccaaagcataattatccatggctccacacttattttctatgggagcagagcaaaatgagaatcaggctgaattagtaacttgatcttgcatctgtcaaggctcaatggttcttacctgctccagaggttaaaagccagtgtgctgacctcacctcaccgtgttggaaaaattgaacacatggccgttgtcaaggacaagacactctcagtcataagaacaaagggaacggcaaaagctaatgagggaagagaccgcaccacccagacaagtacagagcatcctgccccctccgctcagaccctggtcatgtttgtggctacaggtgccacggagagaggtaggctgtgcagacgtcattttcaacgttctctcctgagaaaggaaaacctcacaatgcagcaggctgctcccctgtcagggaatgaataagagcttgcttttcactgaggtttaatccaacagcctggtgtgcatgaaactaagaacaagaacagaggctgttcacccaccaactcaccagg

SEQ ID NO: 49892 - DNA, 1241 bp, Bovine  19866881007048
agacatctcttggggctgatttaggtcagtgggtccaaccttttttagtatggagagcatattttaatctctaaagaactgcagataaagatacactttaagaacacgttggtagaacaaatacttaataacagaacctattacctttaagggagtttgaatgctattaattactgccttatctatgtcatgcatgctaagtcacttcactcatgtccaactctttgtgaccctatgaattgtaacctgccaggctcctctgtccatgggatttttcaggcaagaagactggagtgggttgccatgcactcctccaggggatcttcttgacccagggattgaatccacttttcttaagtctcctgcattggtaggcaggttctttaccgcgagcgccatctatatatgatcccaaatctgagttattgctttctttctgtgtttctgtaactctgtcttcaccactggcctgaacatgccaaaggccatacttgaattgccccttgttcactatctactgtatactcagcacctagcacggttcctgacacaaagtatgcgcgttatgtatatttgtagaatgaataaatgaataataatatcaggatcttttgactaaatagcatgattcatgtacaactataggtgctgattcacacaaaaacagtgtccccatggggtcctaggctcacagattggaaatcatggatttaaatttccatccttgggtccagtatgttctccattttcccctgagggagcttagtgttcagtaggccacagtgattggtctgtgggtttagagacacacgataactaaaagtgggagcagttgacattccaaaggccacacgaaaagtccatgaagaagacagaacacagagcttaatcaaggctgggacttcccaacacccacggaaaccaggaggctgatgagagctgccttcaagagcctgtttctaacatttgtaggaagaaaaagtaagctgatctctgggaacctctaggctgtgtagttgttattttagacccaaacaggcttgcaaaggtatcttgcctgtttcctctgtcaacctatttgtgtggagtgctgatcactgaaatgacgcgcagtaaatgctctttgtcctgtaagaccttggctgggagtggaggtgcactatggagttaaaagaaagaaagattgatttaaaagatgggaatgtgtccctcctgcatgcagggtgtgtattaatatttaa

SEQ ID NO: 49893 - DNA, 3934 bp, Bovine  19866881023423
agcctcttgatgaaagtgaaagaggggagtgaaaaatttggcttaaaactcaacattcaaaaaatgaagatgatggtatatggtcccatcacttcatggcaaatagatggggaaacaatggaaacagtgacagattttattttcttgggctccaaaatcactacagatagtgactgcagtcttaaaattaaaagatgcatgcttcttggaagaaaaactatgaccaacctagacagcatattaaagagcagagacattactttgccaacaaaggtctatctagtcaaagctatggtttttccagtagttatgtatggatgtgagttggactctaaagaaagctgaatgctgaagaattgatgctttggaattgtggtgctggagaagactcttgagagtcccttgtactgcaaggagatcaaaccagtcaatcttaaaggaaatcagtcctgaatattcattggaaggactgatgttgaagctgaatctccaatactctggccacctgatgcaaagaactgactcattggaaaagaccctgatgctgggtaagattgagggcaggaggagaaggggacgacagaggaggagatagttggatggcatcactgaccggatagacatgagtttgtgcaagctctgggagttggtgatggacagggaagcctggcgtgctgcagtccatgggggttgaaaagagtcggacatgactgagtgactggactgaatggaaggaagaactgattgatttaaagttaaagcaggaagctctgggagagtgtactcaaggcttcagagccaagggcagaagcaaggggatgagggctgcctgtctcgggcccaccctgcacccaggccttctcggaacagctgaggcccggtgctgaacacagggctgtgggaagactctgccccggtcctctcctccatggacaggaacaagaagtgctcatttcattcctttcaaacatctctttattttcattttagaaaagttaaagaattgaaatagcaaacgattcataagtttagcagccaattagcttagtgtagcccaggtctcccaccacccctctctctttctctcagcacacctacacacacacacacttttattcagctacatttcgcttttctcatttggcaatacaatcaaacatctccctttgtttataaatacagattgatattgaccgaagactgcaggactccaagatggcggcagccactccagtgaaaagaaagaaactcacagatgtcaaaataggggagctgccaagcaggatatggatgtgggatttcaccccagagacactgttggagcgtctcaaagcagttactaccggttctacaacaggtatgtctagtgaggaaaaaaaggtgtaactgggtttttctggtctggcggcttacatggtttccaactatcgcctttctcacaaaggagctcaaacgtgagcagccacgcaaatgcctctgaggcttggagggtgccctgtgaatcccttactgtgaccttcattgcctggcgcccctgaatcctttcatagcctaactgagaattaacacccgacaaaagatgactggtaaaaaaatatatatcaacatgctcatttttaatggcttcataataattttattgtgtgaaagaagcataaattacttaacaattccctattgtttgaagtttaaatttcttaccttttttattctactgttataaacaatgctttaatgaacacggtgttctgcatagatcttggcacacctacctaattatttcctcgaatataatgatttcacagcttctgatgtatattaccatgttactctctggaaaatttgttcctacttattccctataggagcatatagatgtcattcccccctacttgctgactccaggcattattctttttaatttttgccatctgaaaagtgaaaagggcatatcattgttttaagtcgcatttcttttattaccgttgaggttgaacattgtttatattttaaaaccgtatttgcatttctttcatgatttactttttcaatatcactttgccattttacgcccatggtgtgtatattagtttcctagcaccgccgtaacaaatcaccacaaagtaggtggcttaaaacaacagaaacttattttctcagagttctggagggtggggagtctgaaattaaagtgtcatcagggccaggctttttctgaagactctaaggaagagtcctttcttgcttcttttggcggggagaccactgcgctgtgcttttctcccctattaatttgtagcagctctctacttcaccctttagctcttctgactcacactcggccctcagctcagccagagagagacagagatcggattagatttgaggaagggaggttttgatacctagacaccacgtgagtcatgagtcctgagggtctcaggagttctgtattaacgagaagctaagagatggagttagagaggttatcccctcggccccgctgtgagggactcttggcagcgccctcactagaagctcttgaagctagttgtttagaggcatggtgatcaggctgggagagactgagcgctcagtgacagtctttgaatcataagtaagtaaatgaatgacctctggggctgggaagaaagtcatccggctttgctggggcttccaagcttgtacgaggccgtttgactaacactggtttattaagaggatcatctggctgttttcctatttctcaagcatttaagcatttcaagtgtcagcttgaccctgaacttatagtttccttgcccctgaaaggatcctgttcatcctaagaagaaaaactgttaccaaattagaagactctccgctctccatggcctttgcaatgtccttctctagatggataggaaggtggagaagaattggctccactttccagatgaattaagttggagccatagtagtctagtggaaacttccacagggctcaaacccagatccttcctttctgcaacgtcacctccaaggagcagctctgcagagtcaagagaaagacaggactctggagaggttctggggtctctgagagtgggaagtgccttgtcccaaggtggtgcgggggcagtgtggcaggtcaaccttccctctaatgggcctgggggcaagaaccactgtggctggaaaaacctttatctttcagtgggacatcaggtactgttggggccagaagtgagtgaggatgaagaaaagtgtgtcatgcccaccactgcctgttcctgctcaggaaacaatacaaacatcaagacaagtgtcttccagaaggcaaaggccaaccatgggaagtgtgctgaagtagaatactcctgaatttagggaaagtataggtgcaggtttgaatcttagctctgcaatttactagctgagtagcgtggcttaattatcttaaatctttccatttcagttttctttttgtaaaagtaagacaatcttttggtaagttgtttacaggataagataaaatactatatgaagaagagtccttcgcgaccccatggactgtagcccaccaggctcctccgtccatgggattttccaggcaagaatactggagtgggttgccattaccttctctaggagatcttcccggcccagaaattgaacctgggtctcccacgttgtaggcagacgctttaccgtctaagccaccagggaagtccatggcacatagtaggtatcaaataaatgttactttacttcttctctgtagcaagccaccccagtagacttgcttgggaaattccacagacagggggaagcctggcgggctatagtccatggggtcccaaagagttgggacatgactgagcgagcagcagggcatttttgagaagccagagcagttccaggaaagctgaggtgcttgccaaaggccccacag

SEQ ID NO: 49894 - DNA, 781 bp, Bovine  19866881103628
cggaagctgcacatgaaccttcagagcccgggggtccggcctgaggcggagaacaggccgcccgtccctgcagcctcgagacccacctccccggagatcaccatcaccgagacagccgccgccccgggcccgagcgcggcggcccccacgctgacccggctgccctgccggcacggcccccagcccacggcccccgggggcaggtccctcaactgcctggtcaatggctccctccgcatcagcagcagcttggtgcccatgcagcaggggcccctggccatcgggccctgcggctgctgctccagctgcacgaacgtcgggaccaaagcaaacgcctcctactgctccgagcccacgctcctcaaaaaggccaacaaaaaacagtacgtatttccagccccaggcttagtcctgctcaacctggggctgaaagaactcaggacaatgcagctaaaaaaaaatagacctgggagcctctcccacttggaagcagctccgtggtgtagaaaagctctggaaagggtcgggggcgtcaatggagatgcctccagcccagtccccacccctcaccagctgtgtggcccccgacatgtccatctgtgtctctatttccccgtctgtaaaatggtttgattggatcacacctgctcagtctgccccacaggaaaagtgaaagttgctcagtcgtgtctgactctttgcgaccctgtggactatagcccaatgggctcctctgtccatggggattctccaggccagaataccagactaggtacccatt

SEQ ID NO: 49895 - DNA, 1121 bp, Bovine  19866881111702
aagtctaatacagaggcagaagcaagggcaggacctggcagggaactaaaagcaagctgggcactgctccgacagcctcccctccacgtctccttcctctcctgccacccaccatcctgccccagagcccccaccctcagctccccagagccttggcttattagaaccaatgctcaggaaaggggttctccttgaccccctgttcctctcgtactcacgtctgtccatccagcaattctgttagctcccccttccaaaggcagaggcagctgacagaattaatctggtgactcaggcggtaaagaattatccacctgcagtgcaggagacacgggtttgtcccctgggtcgggaagatcccctgacgaaggaaatggcaacccactccagtattcttgcctggaaaatcccatggacggaggagcctggagggctgcagtccatggggtcgcagagagtcagatgtcactgagagactaacgcacacacgcccccaggttacagaaacgacaccgtgtcagggcaggcaagtctccccctctgcctgcttgtccgccatccctcacgacatctcaggggtggcctgagaagctgccatctccatcacccatctgacaggctcaagccgtccatgttgccagggcgatcagccagggtctgatgagtgagagagaaaggccaacgaagcaaagaatggagggaaggagggagaagagaagagaagaggttgagaaggtaagagaacctggtccaggccgtgaatgccaaatcccaggtgtaagaggaagggacaccgggtgactcacggctcgggcaccacctggacccagtgagtcatggctgagtcctcgtctgtggggctgggtgagctccaggaagggccctgtggatccgccatgtgactaaagctggcgtgtctacactccggccacagctgctcagccgcccagacagtcggtcactcctcacgcagagagaagaggtagggctttctgaactcaggctggagcccagcctcgggcggggacccggagaaggcagaacggggccctgggctgccatcgtggggtgactctcttccacagagtctgtcttcctcctaactcagggtttcagaaagt

SEQ ID NO: 49896 - DNA, 1454 bp, Bovine  19866881119144
ttgcaatgcaggacatgcagattcaatccctggttggggaactaagatcccacatgctgtggagtaactaagcccaggcaaccaaactactgagccctcgagctctggagcccacccaccacaattgaagagtccgtaggcctcagcgaaagatcccccatgaagcaatgaagaaagaccctgtgtgccgcagctgacacctgacgcagccaaataaataaacattgttttaaaaaaaagaaatagaggagcataacagaagcatcggcttccctggatgcccccagatccaagagacaccctaggatctgcacactggtctaggtgtctgtggtctcggcagtaggtatcagcagaggcgccgagagtcagcggataccacctggaatccaagggatgtgggcgatcacgtggggacagagacgcagggatgctgttctaagacagacaatggagtccgagaaacacagcttactttgatttttattctccctctgcactcaggtcagagaaacctgacattatcccagcgggtagaaggagggagaaactttcaaataggtgtcagctgcaccacggaaagttttgaagaagtttggcaagaacccccgttggcagttacatttgcgttcccgacgtcgggtctgtaatatttggattctgggcccgggcagatggaccatttgccacgtgtctgcttttcctggcttctgttttccgacagcccttgctcacttggatcaggctgttaacagatctgactcctatgcactcggcactttatacgtagatgacatgtgtccttacacacgtggttttctggttctcagcgtaaggacgtgaagaagtagagggatgagttgcttcgtctctagccccatgtggggtccttctgcccctctcaagtagaccttgctctgcgtcggagcggctggcacaattcgtctgaggctcttaacgctatgcggccacggagcagtgcattctgtggtagtttaaggagccagaacatccatcagagatccataccctgacctttaggagctggtgggaactggtggaggggagagaggatggtccccgaaaggccttgagttcatctccaaagctgccgggcagcaaatccaactacagttggtgcatactggctggtaggtagacctcgcatgcattttgttccaaagagttaatggcatgtttcagaggaagaataaagacacacatgtataagtcaaatcttgatgggaacctctggaacagacagccccgatagtaggcgccacggctacccagacaaacccggtttcaaaaggccacggtctcatcagaccacgtgcacagccaatatgcccccactgggataatgaaggcggctgcactcacatggccccaggcaggtacccagttgccctgtgctatatttccatatgaaggaacagcaccacatggaaaga

SEQ ID NO: 49897 - DNA, 2069 bp, Bovine  19866881128796
aatactggagtgggttgccatgccctcctccaggggatcttcccccccccaggaatccaacctgggtctcctgcattgcaggcagattctttaccaactgagctataagggaaggtttcagatcctctcctaggacttttaaaagttcaacaaaagcccactccatgctaatctaaggcataaagatagaaatggggagaaaataatctgctacaattaataagcctgagtttctgcatacaaaaaatttgtgtcttttcttattgaaaagattttgggtgtcttttcatatgaagtagcaggaataaaaaaagaagaatagggggtaaacaggcttctacctcagattcttactcagtctcttaagttggaatttgtccccagcactctgtctcttggttcctgccagaccactggctaggcagcctctttatccatgcacccaaggggcctccttggttcagcagtccaagctctaacctgtatggaagagaggacacctccttcacagcagttttatttttttaagagctataatctgagatcctagaggctggatagtgcagagaagctaggaatagtccccagaacactaactgccactatttagctgagtgacctctggcaagttatttaacctttcaatttcctcacctataaaataagagacattaacagtgtgagcctattggggaattaagtgtcttagggtatgtaagggtatgtaaacacttggagtagtcgctggcacagaggaagggacatgaagtgattgccagctttgttgttgttcagtcactaagtcgtgtctgactctttgcaaccccgtgggctgcagcatgccaggcttccctgtccttcgccgtctcccagagtttgctcaaactcgtgatcattgagtcagtgatgctatccaaccatctcatcctctgccacccccttctcctcctgccttcaatctttcccagcatcagggtcttttccagtgaactggctcttcacatcaggtgcccaagtattggaacttcagcctcagcatcagtctttccagtgaatattcaggacggattttctttagtatggactggtttgctctccttgctgtccaagcgactctcaagagtcttctccagcactgtagttcgaaagcatcagttctttggtgctcaaattttctatggttcaattctcacatccatacgtgactactggaaaaaccacggcttcgactagatggacctttgtcagcagcattatggtttagtaaatttcagtacagaaaccaacagaatactataatctcatcacaatcactttatgaacctttctaataacatggaaatgctcaggcttaattgctaaatttgaaagccagaattaaaatgtttatatactgttttgaacgatgtttaaaaataacagcaactagaatgaattctaacaaaatgttaattggctatctttggtcatcagattacaaaaaaatattttattttttctttctgctttcccacgtgaacgttctacaacagaatgtattcatttaaaaactgttaattttgattatttaaataattctggcatcaggggcagatatagcaggcaagccatgtctaacaaaatgttgctcttctgtctggataaaccacacattagagtgacaataaattctattttcgatggaagcaagacattcctttgtcagtagtaaatcactctgttgctaccccaccccaccagcattataaatgcctctctccttggtaggtgtttctcctggggctgcattccacaaccccatggcaggtatcaagttctgccattcctttgaggatccatccatcctgaagacagttgttgcttgaagcaagaagccttgtcagccccacctgctccatcaccccacccctcacatcatatttaccaacgtattaagtatttgatgacgggatgtgcttaaggccaaagatgacagctaggcccactcttctactgctgttccattacccttccacctagaaggtagaacatttttgttgaataatacaactcaaataattccagcccca

SEQ ID NO: 49898 - DNA, 1864 bp, Bovine  19866881171424
tgaattgctgctgcctctcaaaggctcataaagtgggcgacaaatacaggcgtctgtgggaaatgtccacgttgggcatggctctgagaagtgcagactggagcctacatgcttgctgcccctgagggggctaccagggatggggtgccttctggctgagggtcgctaactcctgcagcatgtgtgcggtgaccgaagccctgtgattcccagatcacacctccctgtggctgggaaatgttgctcgctccccacttggcctttgactttgtggatagtgttagtcgctcagtagtgtctctctgtgaccctgtggactgcagcctgccaggctcctctgtccatgggattctccaggcaaggatactggagtgggttgccatccccttctccagggatcttcccgacccaggaatcgaacccaggtctctggcattgaaggtggatgattttgtggaggtgaccttgtaattatttgaggacttggatgtctgtgtgccgttagagtctttgcttcctattaaagtgaaaacatttatctggccaaatgaagccaccctagactattctaaaagcaaatgtcctttagctattttgtgtctgatgtttgtcttcctgtgttttctctcttatctggggactttgtggatttcctaaaaatcaatataagaggctgaaggaagtcagcactagctactcagaagagccacattaaaagagaaaaaaagagagagagagagaagtaaaggcaaacagctgcacatttcgtgaacctctatgtgcctggccctgtgttagtgccatgaaaagacagaaaataaaggcgggcacaactttcacggttctcacaggtatctgagagggcaaccagcgaggcaaccagaaggatggattctgatagaaggacctgggtttaaacttcggctctaccatctgaccagttaagtatccaccctgagcctcgttttcctcttctggaaactggtgataagaaaggcatcttcttgagagtaagatgaagttatatgaaatctctttacatctgaaaggataagctcggataagcagtataataaagtgattatgaataaggactcttaatttgacttgaaaatgaaaatttgtgtatataataaacttacaaaaaagtaaaaaaaaacaaaaaacacctcataaattgttttcaattcagatcataaaacacttgtttcccgagtatatcaagaatgcctacaatttaataataaaatcacagtttatttttaaatagttcatctcagtagagaaccacacagaggatatgaccagaaaattcacacacacagatgcacacacatgtgcaagcacacacacagggagaaaggaaggaaataagaaagcaaatggtttccttgaaaaacaggaaaagatgcccagctttattcataataagagaaattcaagttaaaactaagctgacacttatttccaatagcagttagtaaaggttctaaaggttttgcatacagagtccataagagtggggcaaggtatccagcagacagtgttgataaggaatttggcaaaaaacatcaaaattataaacataaacatgtgtatccttgactctgcaattctgttctaggaatgtattctgaagctgcagtcacacaatgataagtctataaggcaaggctgttcacatcaagaggtgggaaacaatctgaatatccttcagtgcatgactcattaagtacattgcggtgtatctatacagcataatacagtgtatccacaaatagattgtcaaggatcttagagctgccttcaagattgaaaaattaagtaaaaaaaatcaaggtgtatatttacattcacacattta

SEQ ID NO: 49899 - DNA, 1541 bp, Bovine  19866881215167
cttgccttctcacctttgttatgtcctggactctgttgagcagggccacttcaaggacttatttcatacaacccatgcagttaaaccaggcccagtgctcagaagcttcctgcattcggtttaatcctctgctgctgctgtcttaaaattatgaataatttctaaacaaggactcctgcattttcactttgcagtcagccccctgcataaaatggccagtcctccaatggagaagtatcgtcagaggtagattttttcctaaacctgaactccattctctcttagcctccttcagcagatggcttagcttagaattgggaatgcacacagcatgacttttgatcagatatactggagtgctggtgtggagcccacctcttcacgcccaggtgaccgggaacatatttgctaacctctggaagggttcctcagctgttagaaaggtctaactgtgcttacatcattcacaggatgtggtgagtatcaagtgttagggtctgtgtgaaatggcctggcacagtacagacactcagtaaacattgcttgtccctttggccccttcactcctggaagtctacactgattctttcttgtcatcttctctccccagaacagcgcactccagctggagttaaggcttggttttgtttttgatggaacaggtctaaggcaagagttctgtccataacctgattccttgtgacttgaaagtcatttctcatcctgttcagagctctgttctgaagaagagatgcatgaccaaatagtggttatgatttctgcatcacaggaaaagctggctttacagaactacctactgtttggggagcctctaaagacagcttctgatggaaatatgtctccaaggagtttgcccggtaataattagcgtaatatgttgcacttttgcaatgcctttttctccaaggatctgcagacatttggcaaacaaccattaatcacatcccgctgccttgatgtcaattaactgtcgggctggtctacttgtctccccacctggatgtagatctggaaggtcctgggtcctaggcctgcttctgctccagacttttgtctggtattgaacaacttttctggacctcgggttacttaagatgtaaattgaggttaataatttctatttgatctcagaaatcctattaagacaaaatgcctccccgaatggaaacacactttaaaaagtagaaataacttcccaatgcaagggatggcaatattacatttggacagttgagttcaagtttaagatccagcgctgtaccaaacaatagatttttgtaggcactgaaatttcctgttgctgaaactggggtcaatatgtccaagaggcagctgggaaattgcttagaacactgagagcataattggctttataataatattctgcaagcagcccacttgccctaggctcacaaaatactgagcaggtaccagaggctcaaagaattctcaaagaatttttagaacttccttaatcatccccatgtcagagagatttttccctcttctgaatttgtata

SEQ ID NO: 49900 - DNA, 720 bp, Bovine  19866881272691
tgaatgatgttttaatacaattatgaaaacagttgtgacctttcaaacttccaagagggtctcagggacccatggggaccacccttggatccattacttggatccactgtgtgtttgcagttacacggctggtcctctcgttagcttgggaactcctggaggccgtggattatgtctttttcgtctttgtctctcttcattgccttctaactttgctccaaaataggcattcagtgaaattttgctcttttagtgtttgcaaggcactgcagcaaagagaacattgctatctttctggagcctgatttaatctagggaagtcactgagatttagcattttgtccagaactgatcaaccccctgccccctaatcctcttctgtggtgctcaacaatttgaaaactaacaaataataaaaatgaaaaagacaaaaggagatatgaatgtttcacctagcacttgtttggactagattttcacaaatcaagtaaagtttctttcactgccatagcaacgaacctgaactgttcattccttcatgctgctcctccttcgtaaggcactgaccacctacacttcagagtaggctttcagtgaaatgccctcggcaagacccacgcatggtcaaaaacccacatagaatgagtcgctttcagcggaaggtgcatggctgagcccagccaggaattctctctgacttgattacccccatcttaaatg

SEQ ID NO: 49901 - DNA, 756 bp, Bovine  19866881300201
gagtataaatacccagacacatacttcataatctttgaggacttggcagctggggtggaggtagggtccttcttaaaattttaaaaagttgttgattaaattttaggccattctggatttgatccttagagtagctaaacccctaaggatatatccaagcacacacacacaattctgggcacagtctgaagaaagacagatttaacaagtaacatctagttagttctttacttgctgaaggagaaagcaccaagctggtctcataatgtgtttgactaggctttgttacagctacaaatgagactgagaactcttttaattattaggccaatcctggtgttagcagtgcacttagttgtttcaaagccaaaaaagttacaaatgcctaaatccaatttctcagtaaaacctacagccccccttctaatctctttccatatctgttgctaaaaatactttcatgagatattttgcctttgattcacgttttaactttataacctaactgagccacaaaaccctggacaatgctcattaatataataagagaatgggttcttcgttaatgcgtctctgtaacgtacattcttaaaccccatgtcacctgatacaccatatgttttgtatcatataactcatgtatatgaatgcagagagctgccatttttttaaactaaaaaatattaggagttcactgtcttttggatttcttttaaggcctttcagtacagccaagctgaagtaataatatctatg

SEQ ID NO: 49902 - DNA, 1412 bp, Bovine  19866881306859
ttagaatatgatgagaagcacattcactccagagaactccagaaaggctcatgtactatggaagggagtgggtgaagtgtttgcccaaatcaagaaaagacagacaaaaactgcatgataagcaattaacacccctgatcccaaactgcatccttcatactaagcatccatgcatccattaaggaatgccaatataggcacaggaagaagagggtcatcatactgagaatagagtcaatgaaaatctgtatgatggtcagcaagacactcagctgcctattgttactcagttccaagaaggctggcaatcaagccactaccacaagcctaccgaaagaagggtgatgactccatcttctgaaaaactgaatggcctccgaaactctgcttataataacgtagtgcccgaggtgcatcattacaaaattgcacactataagaggacagtgtcctaaaatttccagaggaaaatatgtcaccgaaaaatgactgagaatcaaaatggagtaagacttacagcaacagtgtaaaatgaagacaacagagcaatgtcttcaaatttctaaaggaaaatgacttctaaactagcattaaatatcaagccaaaccatcaatcaattaggaagttagaataaagatattttctaagtgcaacatttcaaaaaagctcacatcaaatacatttctctggaagccaaaaagttaattcaggttctcctgtaacaccttagggaaaaacgtgagtgaatgttttggccaactcaatatattctacaccaaaatgtaaaaataaaccagagaagaaaatggttgattttttatggacttatctacatgaattagtttcataaaaactaaaaggtgctctgatgacaagaccagggttagaataatggctaatggcttttaggttttaatgagattggtaccagaagttgaacacttaagcactcattctacaaacataatatacagaaccgcctaaagaatgctaggaactgttagctttggctacttggcaagattcctgttactgttgaggtaaaccataaaaatttcttgcctgaacagttaccttatcttcctacctttaatttctcacatctctaacccattcttcatagactctgcagtgctatcttcctagaacaaatgtcaggtcatgtaatgatcctatttaaaaattttataatggctcttcattgctgaaaataaagtctaaattgcttagcccaacagctaagacctaaaagacccataccaataactgttcagtcgcatatttcactgctgctactctagccacatatgaccacttgttgctattcagacacaagcaaaagaagttgattttctctttaaaaaaaaaaaaaaaagctattttctatacgtagcatagggcataaatcagt

SEQ ID NO: 49903 - DNA, 1095 bp, Bovine  19866881324542
ggtgtgctgatagagtgtgatgcccagatgaagaaagtttattctcactctttatttttggcatttcaagagaaaaaatgataggtgggagtatgctcaatcacaggaggttaaatagattgttgaaaagactgagggcaatgccacaaaagagattggtgctggttgcatttataatcatgaatcacacaatgcactcacacatgcaagccttatccatgaagaaagaatccaatagttgtcttccaatattgcagggattataaagcataagagtaatgggacttattctgcataacttcagagggcagaaccaagaacaaagtttagaagttataggaaagaaaattccattcaatataagaaattctaagcatctcttaaatttatgtaatcttgcataatccacatatattctcatgcgcatcatctcactttaggaagaactcctgaacaactggtgataaaatgaggtgccaggtatgtttaggcagagactaaggcatcacattagactagatgaactcgaggattgttttcaactcacactgtgaatcaacccagagatgcttccaaggcagtttctaaactgagaaaaaacaggctacaagagcagtagcaccaccatcaattcatccttgtctgtctcagcttagacttttcaaagtaaaaagaaaagaaaatgaaaagataaaagtctgtgttcatcatatgagaatgtgttgagttaataccttggttctttagggtattcaagaggatattggctgcttctcttctggggatttctgtgttgagtaggaagatgaaccacatgacctctgagttcccttccaaaacctaggttctatgaaaatcatgcttcacccttcactttgttactttttaatctggctttgagaaagtcattttcactttctgagcctcaactgacttttctattaaatgagatgattgaagtctgatcttttcagggaactcatattctacaataagattttatgaaggatttgtggaagcttcatccttccacattctatcaaacaataattgatcttgagtttcggtcctgatgagatcgtgatggcagtgcag

SEQ ID NO: 49904 - DNA, 1277 bp, Bovine  19866881415398
tgttttcacgtcttattcaagattctgttctgtggccttatgttacgggccaccttgggtccgttatggaaacatgtgaacatatattaaaaacgaaagtaaaatgggcacatagatttaaccagacttgtacacaaaggatcaaagaaacattaacctctgtgatgtcagagctgttgggcagagaaagaagagttgttgaagaatagatgcataaaaggtgaggttaggaggagaaatctgaaaactttggagtgagccaactttgacaatagcagggaaataggatgggtttttcattctctcaagttcttttcactttgctactatgggacttaaaatcaagtcatttgaccttttgagcctcagtttctttaattggatactttggaataaataatactcttacatggtttaaattcataatgttacaaaaaggaaatcagctgaaagattttccttccatcctttctctaaacagttcctttcctggaggagacagatcttaccagtttcttgagtatccttttagaagtttcatgcatataaagtatttgtttgtttttaaatgaatttctatgtattaacactcaaagttaatcaatcagtttagttgagtttattttacagaagacaaccaacttctatttaattgctgggcccaaattttgcaacagggaacctcacattcatacccattctaatttaatcccagagaaaactcacttgtctgttagtcatcagcaaatgtacattgtcagaattatgagtcgatgcaagaactcacaagcagttatagaagcaggagaaccttgtttctttttggtgtttgttgggggcattattgatgggctgctacactgagttgtggtccagtgttagacctttaaggttttagagcctccaacccaggtggtatgtgagtggtaccccgccagctcacccacagctttccgttttaggttctcccatagcaccagccagtgtgggcaactgcagtgtgggcaactgcagccctgaagcagtgtggcccaaaacggagcctctggagatggaagtgcctcaggcgcctatacagcctttctatagctctccagagctgtggatcagctcactcccaagtaagtaagccctcggtttcctaactggatcttcagctcctattatagtccatttcctgccccaccttctgcctccatttctttgccttgtatagaatagtcccccaggcagcctctgtgtctggttcctggctggctgatgagtcactggggaag

SEQ ID NO: 49905 - DNA, 1226 bp, Bovine  19866881463683
tgttggcctggcaaaaaaaaaaaaaaaaagtgtttcctgctgcaaaacgctttcaataaaagattgaaatttctctcctagctgacaagaggcatctcccgatcataaggataggagtctgaggcctgcggtttctttagacagagaacttgggcaagggctctgaggatggagagtgtcaaggagtttctcagtacatacttgctctagcgtgagtccacgttcaacatgtgatgccccatccatgacccaactcttgctagtggcctcaagaaccgtttgctagtcaccgcctattttcccattgactcccttgggcgtattttagatttcccaccctagaggaggggaaattgaggttaccaaagttgtgacttaaaaataactctttgtatgtacagcgttctaccttctcaattaccatgatatccattaacactttgagatttaccataatgctgctaggtagggggtaaactcagcagggaagctatacccagtttatatctgtgtgcccagagatcagaaaactgcacattttataaaactgagtcagaggaatggagagatgtatcatacctggagaggtggggaagtgaatgaattctcatcttagagctgagaggctcggagagtctaaatggcttgcccaagactgaactatacagcgtgggagttgtaaccaagcatccacactttcaaaaactcaaccctgggctctttcaacacaacacgttgtctctcttcaaggtcacgcagtaaactagatcagagcctggactcacagaagcagaaaaaggacacgtttttctctgttggggctgtctttctgatggtggagtagactgctgttgggtatttgaaggaccttgagggtctctctatctgaaggaagcttccagaatcctttggcagaagagccacacagaagccaggccactacacagtaaggctctccctttccttgtttccagggatgtttgctcgagtgttggcagaaacacttgctgccattcaatttctcagacatgctcaggccccaagccccagtgggagaagtgtgtgcatcaacacgccaggggaataaagtcatggcagagtagatttgtttggacaggcaggcttagcagtctaacagggtgtgcaagacagccatgctaccctgcattttaaaaatgagctacttggcaaacatgtcaggcagccaggggataagtctatccagg

SEQ ID NO: 49906 - DNA, 1782 bp, Bovine  19866881749188
attgttggagagcagtgttcctggcctcggcccatgaggtgccaggatcacacccttccgtggatgacacacaaaaatgtcttcagtcattgccaggagtcccctgagaggaaaacgtccccagttgagaaccactgttagagaagaaaaagaatattagtattagtcccttatatttttgtagcttttcagtttaaaaagacttctgcatgttttaactcagttgagaaaaagagggaaaggattaaaaagattagaagaggaaatgagaggggaaataaaaaaaaaaaacagaaaggagggagggagaaaggggaaggagtgaatgcaaagagtctgaagagacaaagaaagggagacgttcaactaacgaaggagttaggaacaggtgtgaaccttttcattggcatgtaattgcttcacgacgctgtgttagtttctgctgtctaatgaaatgcctcagctctaagtataacacgtatccccgcctcttggatctccttcccaccgcacacccacccacacatccaggcagtcaaggagcgctgagctgagctccctgcgctgtgcagcagcttcccacctgccatctcttttccacgtggccatgtctacagcgaaactgttagtcactcagctgtgtctgactctttgccaccctatggactgtagcccaccaggctcctctgtctatgggattctcaacgcaagaatactagagtggactgtcgttcccttctctaggggatcttcctgacccagggatcgaacctgggtctcctacattgcaggcagattctttacagtctgagcctccagggaagccctgtataaatgtcaatcctaatttcccaattcgtctcaccctcctcttccccgcttgtgtccacatgcccattctctacgtctaggcctctgttcctgccctgccaacagtacagatgagcccgtttgcaggtatgtgctcttatgcaatctcccactagtgcacgcacgtctgcatgtcccgctagcactccatattcaacatgttcaaatctgaagacgcagcaggtcccccgcagacatgagccttctttgttgctgaagtttctgttactgacctcaccattccccgagtcacccaggtctggaaatatgtgtcttcttaaaggggtacttccttccaaccctccctgctctaacgcctaattagttctaaggcttgctgattctacgtgttacctccctcgggtcaggggcttcccttgtagctcagtcagtaaagaatctgcctaccatgcaggagacccgggttcgatccctgggtcaggaagatcccctggagaaggaggtggcaacccactccagtattcttgcttggagaatcacatggacagagaagtctggtgggctacagtccacggagtcccaagagttggacaggattgagcaacgaaaccaccaccctcagggtcagagccatacttccacctgatgtgagagcagaaagaatcttccacctagcccatcactcatttatttcatggatgaggaaactgaagcccccggaggtctaggccatgaccttggggaggtctagggcatgacctcggacagattgctctgagtctggtttccttgagtgtaaaccagggataataccatgcacctcatggggatgctgtgtccagacctatcactgggtataccttgtctcatgtcagttacaggttggaacccggcgctcttcctcctcagtctacccccagattacggtcctgtccacttgaccccatcatc

SEQ ID NO: 49907 - DNA, 1109 bp, Bovine  19866881889656
ctcgaaactttgagagcacagtcgccaaggtggagacaaatgaacgctgagtggcagagactgctttggggaagatgagatattagaatagagggctatctttagccaggtactattctgcagattcttagccccaaatctagcagcttccacttatcacagttattggcagctggacttggaccaaatgcatcttactgtctagatacacaacagctgagaagtcttgaaggctgtaggggatgagggtcaaggcttggatcttacaaggagcaacagcattagtttgtgcgactccctctgtgtctccccctccatagaacaacaggccttcagacgccccttttccaagtaaggagccaacccagagccttctttccagtgcacgtccatccatccacggggcgcgcgtcactcccctttctggaaccccttggattgatggtctcactctccaggaggcatcaccgcctcattagcagctctgtactcactgttccttctttcccattgctcttaaatagcttaaaaacacagtattcttagcctaagctcagctatacgaaaacatctttcccgcccacccctactcccatacactccatcctaacgattcagttccatcttccaagccacgtggaaagctcagggcccccgtctgaaaccccactgaagttccacttcattccctccttgatcgtggagaaatctcaggacctcgctgcccctgtgcactgggggcctgactggacactgagctggggcggggcaggggcagcctgctattgctgcctcttgcttctttgcctggaaatcttccccctcctctctcgacttctgtaattgaggccctttcagtggaggaaaaaaaaaaaaaaaaaacaaattctgaggaggttgaaacttcagtattgttttcacttgcttctaaagtgattcctgcagaacaatgcctggcttttagttcctgctctgtggtgtggtcttccacaagactgatggccttcctgatctcttgggagaaaatttcatagcttgggggagtgggggagcagggcgggaagaccacggatggaaaagttcttcctaaaggctgcacaaccttctgg

SEQ ID NO: 49908 - DNA, 932 bp, Bovine  19866881965020
cattaaaaccctttccaggaaaacaaagagaaggacagcacaggcaaagctgaatacatacctcctccctcaggctaggttgccctgtccagcttaaaccaagtctatttgaggaacttctcattttagtgaaagggggccaagaagatgaatgcaacagcattcctaatgcaggactcaatctaaggcccattcaattatgaagagatactctaacttttataataaatgtaaatgcaaaatctcaggagtgttcttacctctgattgaggaggaagagaggcaggtggcatcacagagagggggaggagccatttttaacttaactttcagaatataatgatacacttttaattttaaatgctattcttgctccttctgaaacctttaaagaccacagaatgacaaaacataaagtgaaagtctgtcccatgcttccagcccctggaagagacaaatgttaacagttggatgtgtatctgtccaacactccagtgtctttaaaatgcgttattatatacgtgttagtcagggttctccagagaagtagaaccaatggtgtgtatgtgtgtccagatatctgtatctttatctgtatcacctatccatataatacaaatgagagtgagacggggagagagagtaaggaactggctcacatcattataaaatgtccttagatctgcagttggcaagccggagacccaggagagctgatgatatagttccagtccaagtccaaaggattgagacccaggagagctgatggtgtaagttccaatccagaagctggcaggctggagacccaaggagacttgatgtttcagtttaagtccaaaggtaagaaaagacccatgtcccagctccaaggctgcaggcaaaatgagtttcctcttgcttagcctttttgttctatttaggtcttcaagtga

SEQ ID NO: 49909 - DNA, 515 bp, Bovine  19866880381013
actgaaagactttgttacagagagaaaggctatcaaatattctgaacagataatatcattttatgttagctaaaatttgtcagcaggtttaaacttcagctcttgcccaagttgtctggacttaaagttatgaaggctgaagggtccattagataatgactagtcatgtcggagctgatggtatcacttttgacccactcctcacagctcttggataaagcgaccctgtaatcataggcttagccttcttcaaggcagcacacagagccactaccagaaagatggaggaaaaccagaagctggggctgaggtgggggttagttcatcctgctagttctcaaggaaacttttccaaatcaaaaactgcaaaggtcacacatcagccaacaccagagaagatccacagcaattcaggaagtgaagatgaaaactataatcaaattctgccacctgagtggcacattgcctaatgcacagataacaaaatagaaacccctaatcaagaagtcagcatg

SEQ ID NO: 49910 - DNA, 1103 bp, Bovine  19866880403016
cgactctgtgcgaccccatagacggcaggcccactaggctccgccgtccctgggattctccaggcaagaacactggagtgggttgccatttccttctccaatgcatgacagtgaaaagtgaaagtgaagtcgctcagtcgagtccgactcttagcgaccccatggactgcagcctaccaggctcctccgtccatgggattttccaggcaagagtactggagtggggtgccagggccttctccaaaaatgtctaataggtaaattccaatagccaaaactcttctctggctaaatgaacaaactcttttaatttagtcttcataaaattaaacactacaattgtttttcacttttaagattcagttcagttcagttgctcagtcgtgtccgactccgtgaccccataaaccgcagcaagccaggcctccctgtccatcaccaactccgggagttcactcaaacccatgtccattgagtcggtgatgccatccagccatctcatcctctgtcatccccttctcctcccgccctcaatctttcaaagcatcagggtcttttcaaacgagtcagctcttcgcatccatcaggtggccttttaatattaaattttagaattttattaaaccaaaattactggatcaatatttttaattacttatacagtactatttcaaaatttcctttttaaaactggctcatggctttaaacttgttaatgtatttgctgtaagtactttttacaccactcagtttcttcctttaaagtgaacagtgcaaattgccatggataggcgataatgaaaaagcaacaccaattattaattttgtgtaagttaccctccactcctgagattccttggaggagaagagcatgtctgcatttccccatgcagtgccacaggcacaaagtgagaggaactaaacaaatgcatcctgagggaaagaaaacgcctgaagcagcaaatgacccactacatacctcgctatgcaggctttgatgttataatttgttaatttccaggaaaaaaaattaccaatagttttaaggttgttctgatagacacatttaacttctgtaagtttttgatcacaaacaacataca

SEQ ID NO: 49911 - DNA, 1678 bp, Bovine  19866880434056
cccaagcatccaaatctgccgcatacttttggttatgaataataaccaatgaatagagatatgaaactagaaacatataggcttatccaggtataaagcaccccttcttgaacagaccatttagaaatcattatgcaggccaattttcatgtagtttagtggcataagcccttagtatacttttcactgattattaattataaatctaccttaccatttttataataaaagttgttttaaaatatatattagtatataagataaaatgcaaattgtttcttaattttacttttgttctctgtgaatctctaattcctaacttttaaattataaaaactgtttattttctaaatgacaaagtattagtttatttcatctataattatgatctcagctagttagaattgaaagaatattttccagggtgctgtttataatatttttctaatttaactttattgatgaaactaacttgaccaataataaaatacaggtgtgtcttgattacctgaaatcctcatttaactgggtttatttatttttttttttctattgcaatttcatattctaagaacaaagtctcgttgtgaaaatgtgctaaaatttaggacggtgttatttttttcaaagctacaagtatgacttctttccaaccaatatgttctaaatttcaaggaggaaattgacagaactttcataaaaccaaagactggcagaaacaaagtaaataatgatgaaactgagcaatagatcacccagacggagtgtcccctgccagaaagaatgtggcatttcaccctctgagaaacaaatggacactgtcccccagaaagccagggctcgcatgtcagcatcactcacttctttatcctttcgccaaaggaagccacttcatctaggatgttctggacactgatacatacctcctggatggcataaattttatttataaatccctttttttcactgtcctaaaacacaataaaaaagagattctatgtgagtaaaggtatctatatccttcagggcttgaattcttttcattgtcaacacttacattcttaaacataaatgaacttcatttttccatggatataagtggatgcatgcagcccctgaaaattttagacaagaagggaggtggagcaggaagagcactcagcattggagacctgtgtcagtgtacaggtggctgcaaagcacaagactcaaattctgtggctcttgccctgatgaacagaaacatttcagcagggggacaggaagcgtgaagttgtaagagggaagtcaggtctcagaatgaccaaatctggaatctctgctgaccctgggcccaccatgacatgatacttagcagacccagttttctggcctaccacccacagacctaagttcggtcttggctccagattattttaatagcagggaatgctgggtgcaaataagccctgtaagcaatgaaaactgcacacaaaaaaaatttttttttaattaaaaataataaaatcaactgaaatccagtaagtggacacttctagacagcaccttagggacagcaaaatacatagcctgggccctgtcttaagaatagagctacatacttcatgctctattagtcagggttctaactaaacattttccccctattgtatttattcttccttttaaaacgtgtgct

SEQ ID NO: 49912 - DNA, 2118 bp, Bovine  19866880459690
ttacagcagcaatagaaactaaacactttaaacttcattttctatacttctccaaaaaaaaaaaaaaagaaagaaagaaagaaaaatactgcatttcaaagccctaaatctgagctcctaatttttccttattatcttagtcctactgtgctatataaatatggctatatgatttttcatttaatgtggaaactaaaagcagaatctaacaaaacaaatatttttattcaaattgccttaattttgtttcagaaagcttgtgcaaatcgagtgtgagttagaacccatctctagtgcagtgggttactttcctatttaggaaagtattattattattattcattggtgagtagagcaccaaagcatagttaacttcatttttcaacagatgaaatccacttcctcacagcattcattctatttcttaaaatgtttcattctacaaagcatggggacacagggtactagccttatttaggtcacaaaccctttcagaatctgaagacagctgtggattttctccccagaagaaaacacataaacacatatataaataactttttgtgccatttttttttgcaacggaaattgcattattttccagagactataaattatctttcataaagtcttatctctgttgctctcaccacatttctcttgacattaatgcctattttcctcaaacacctgagatatatgtaaatttttcaagtaaaaataaagtttaattcagctcagaagtaaaattctacgagaatgctgatgtttggctttgatattgaaattatggagtggttttttttgacacagcaataggcttgttatttttgacatctgtttgactatgacttttcagtttcatggcaataagtgcttgaaatactcacttggcagaagaaaacagtaacaaataaaatgggagctgccgtggctttattagatgagggttagacacagtgaaattcctagagttctccaaaattcttgttgagttcatgctttgaaaagtctgcatcattaatgctttgtcatttttttttttaaggatcaaatattcatggttgcatgttaagttcatccgaggcaggattagctttgaaagggttatctaaggactccagctgcctgtcggtttctacctgtaaacaaattggaaagctttgttactcattccagcttgcggaagcccttctccagccttgaactccttgggtagctgtctcccacattgcagtgttaaagaatccacctgccaatgcaggagacgcaagagacacaggtttgatccctgggttgggaagatcctctgaagaaggaagtgggaacctactcaagtatccttgcctaggaaatcccatggacagaggagccttggagggctacagtctgcgaggttgccaagtcagactcacctgagcgacctagcaagtagacacacacatattgcctcccacatgcccttccagagtggcaactgagctgaaaaaaatttaaatgaaaagattgacctaggtaacttggcaagaatatccatcaagtacgacagaggatgagatagttagatggcatcactgactcgatggacatttggagtttgtccattggactcagtggagtttgagtaaactctaggagttggtaatggacagggaagcctggcatgctgcagtccatggggtcgcagagagtcagacacgactgagcaactgaaccgaactgaaagtgaactatgactggactctttcctgttgtgctattctaatagttggatttccgtggcctcaaaaaaaaaaaaaaatgtggaacttgcatttgaaggtcaaccaaacatttgaagacaggtcctctggaaagctagttaacttctgttttgcagcactgaactgactcttctactctcatttcttgacaaaacttcttaaaatagcagtgtgtcagccctggctctcaggaggttgataacgttcatagaaatagacacagttttttcgtgatcgctggcagagccgttgacatgggctgacaccactgcatgttgagatgaggagcgtgtttcttcaccaaagcagcagaaccagatgtgttgccaagcgtcacagatgctccatctgagcg

SEQ ID NO: 49913 - DNA, 1251 bp, Bovine  19866880479141
atttatgttgctttaaaagagatacatctgtaatccttgcctcacagtggcttttcagtaagcctgtgtcttctggcataatgaaaaataatgtgataatacagtgacatgttgctgtgactccgggctatttccatacaggcagagcagtctcatgggtcctgtggtggaatgagattcaggagacagagattctaatctgagaaatgcccctgatattgtatgtgacctcaaaacaagtgactcaacctctcagtttaagttctgtcatctgtaaagtaagcttaattaaacttgccatcatagagacattatgaagtctagctaattaaagcccattaaatgttttgaagatataaagtgcttgcttcacagtcataaaaataagccaaaagtagagtgtccttttattaaaatactaatttttgtacagtcatcacacacaatgatactgatgccctccagagcctagttgtagcggtaggtttgccctgattgactcttcctctctcatttggttagtgactagttgtacttaagacagctgagtaagatgaggtatctgcctgtgactatcaaacccagtaaaactaagtggctactctggaattgaaccaatgatctaggtctcattagcaccatcagctagtcaactgagctaattggattccacattgataataatgtaacagtacatggtttgacttatttttttttccaaagctttccgtagattgaatttcaataaccgtaaaaaattagtatgagtaattagaggcaaagacaataaactggactttattagatgtcactaacatccaagggattaactcttgctgtccctggcaggcctgagtccttaataggctcatgactgccccccaagaaagtgaggtttccagatgaggagactaataaagccaagaccctcctgatgaggtggggaagggtccttgtgcatctcttgcttggtgagagtctactggcaaggattagaaattgttcgagtgtgtctgtcctttggaggctaataaagtgacgatgaagatgccttgtgctacagaaaacagtcctaagtactaaataaaaaatgcctcgacactgagctcataactttgcctcttgggattgattatatctttcggcagagaacatgaggcaagccttaatgaggaactgatattaggtgggaccgtttctgtaattcttagttctttgaactttcaggcaaggttaatgtacatgctattt

SEQ ID NO: 49914 - DNA, 2897 bp, Bovine  19866880500680
tgctagtgtgtgagatgagtgcaattgtgcagtagtttgaacattctttggcattgcctttcttagggattagaatgaaaactgactttttccagtcttgtagccactgctgagtttttgaaatttgctggcatattgagtgcagcactttcacagcatcatcttttaggatttgaaagagctcaactggaattccatcacctcccctagctttgttcatagtgatgcttcctaaggcccacttgacttcacattccaggatgtctgaccctaggtgagtgatcacaccatcatggttatctgggtcatgaagatcatttttgtatagtgcgtctatgtacacaatcctgtattcctgccttgataattccatggacagaggagtctggcagtagtcacggactacagtccatggagttgcaaagagtagaaaatgactgagcaatcaacattttccttcattttaagttaaccaaccctttgtagtggtagcagtgatttatatagaattttctgtagatctgtttcttgattacccttaggcactgtgttacatggttgaaaagtacagaatgtactaccaacattatccacgacagagactcctgatagctttcatgaattgagcctctctgtaattttgtgagctttctgtggctctgctgcaatgccctgcggtgtggtgggtgaaggcacagtctctgaacaccagttttgccttaaatcctgctttgccaattatgaggcatgtaacgtggacaaatgacttgatttctctgtcttaccttatgcctctataaaatggagatgataattgtacctgccacacagagttgttttgaggattcagtgagtgaacatatttaaagtacttagaggcagtatctggaacatgttaaaaattgatgtattttctagtttgctgtggttgttatattacaactgaaaatcaccagaagccaagaaattttactgaggatcattcttggggcaatgggcaaaggaaagagggttagtcacacttcattcaaatgtcactagcaggaaaaggccaactgctaacaactgggaaattgccagaaatttgttcctttgatgtcacaagtcagacactggttaaggccacgtggcctcagtgaggtaatgccaaaacaactgccttgggtttttaacatcaataatccaaaataatgtcttatacatttaaaatctgaggtttcttccttcaaatttagaataccccatcttaaaaataaaaccaacaaacattaccttctcaagtccactgaaccttagccaaacttcctagaagcttgcagcctatgaagcacatactataaattaaaagtttactatatatttatttattaaattttgctattttctgacactcagtgagttgtatctcatattacaaaaaagttgtttctgtatatactctgctgattctttttaaaataaatagaaattctggtaaatcattttcatagttcagttcagtggttccgccatgtttgactctttgtgaccccactgactgtggcacgccacgctcccctgtgcatcactaactcccagggcttgctcaaactcaagtccatagagttggcgatgccattcaaccatctcatccactgtcatcccccttctcctcctgccttcaatctttcccagcatcagggtcttttcaacaagtcagctcttcccatcaggtggccaaagtattggactttcagcttcagcatcagtcttcccaatgaatattcaaaactgatttcctttaggatggactggtttgatctccttgctgtccaagggactctcaagagtcttctctaacaccacagtacaaaagcatcaattcttcggtgctcagccctctttatagtccaactctcacatccatacgtaactactggaaaaatcatagctttgactatacagacctttgttgcaaagtaatgactctgctttttaatatgctgtctaggtaagtcatagcttatcttctaaggagcaaacatctttaagtttcatggctgcagctaccatctgcagtgattttggaacccaagaaaataaagtacgtcactgcttccattgtttccccatcaatttgccgtggagtgatgggacagatgccatgattttagctttctgaaagttgaattttaagtcaactttttcacactcttctttcacattcatcaagaggctttttagttcctcttcactttcttccattagggtggtgtcatctgcatatatgaggttattgatatttctctttggaatcttgattccagcttgtttttcatccagccaggcctttcagatgctgtactctgcatataagttaaacaagcagggtgacaatatacagcctgatgtactcctttcccaatttggaaccagtctgtagttccatgtccagttctaactgttgcctcttgacctgcatatagatttctcagaaggaaggtcaggaggtctactatttccatatcttgaaggaattttccagtttgttgtgatccacacagaaaaaggctttagcatagtcaataaagccgaagtagatatttttctggaactctcttgcttttttctatgatccagtagatgttggcaatttgatctctggttcctctgcctttactaaatccagcttgatcagctgaaagttcttggttcatatactgctgaagcctagcttggagaattttgagcattactttactagcgtgtgagatgagtgcaattgtgtggtagtttgaacatttttggcattgtctttctttgggattggaatgaaaactgacctttccagtcctgtgaccactgctgagttttccaaatttgctggcatattgagtgcagcactttcacagcatcat

SEQ ID NO: 49915 - DNA, 1624 bp, Bovine  19866880521624
gcattttacccatggtatatattcataattttatattaatataagttaatataaaattatgtaattttatactaataattttgagataaaaatttattgagtaattaatgaaacatttatcaaatgtctgctatgtctccagtactattctaagccagtactggggaaagagtggtaaacaaagcaaggtctctgccttcatagatctcagagtccagtgtaagcttaaaactttattgacagaagcagacacactttttgtttgggccactgctttccaatttgatttttagcagtacatttttaatatctatatcacattaaaatatcacatactttgatcattgagacttttttggcatccagtgtaagcgcctcattcaggtcaccatagtcccagccctggtgagaaatatctttgaaaagttgacaaaagaaagaaagaaaaagaaattgaaatcactcagtcgtgtccgactctttgcgaccccatggactgcagcccaccaggctcctccatccataggattttccaggcaagagtgctggagtggggtgccattgccttctccgcagattggggctagcagttcataataagtgttcaagaaatatttgttgatagactgaacagagaaatacataatctatgcttcatatctttgtacaactggtagaaggcctgtcattaatttgacagaactcaactagctcacctgcaaagacattgaatcaatgatgcagattaataaaagcaaatattcaaagtgttttcaaagatttgccaggcaagagaaaacatggatatctaactatcatttcaagatttggagttctccaatatcttcaagttaattttccaaaattaaaaatattattgaaccaggaaacaaaccaagaacttaatttacacatttcacaagtcagctgcagaccttatgttcaagaacacctcaaaagaggtctacagaatcagacccttcattcgcaaaacccaaacagttcccaccctgcacaagtcggtaattggctacgcacaattgctccacaaatgtgcggccagaaccacccaacacaaccatttgctttacatttggcagcaaagtgctgtgttcaagagaggctgttgtgttgtattgcagccctcgagtgacggcttttcccctcctccagtgatattttaatgttactacataaacatctacaagtgaggatgtataatacagatggttcctagggatgcctttaagcagcttcagaatgtataccacgggttacattttgctcagatgatgcttacttaaggtgccttggaaaatggagacgatcatagcacctaccccacagcgttgattaggtatccaatgagataatgtattaatatttaaagtgctcagcacaatacctgtaccaaagtacttaaaaaatgtgtatgactaataaaattagaaaagacatccagttaataatatttaaacattaatttttggaacttaaatgatgcatttattttcctggacaaaaatattcagggttctgaatgacacatacaattctgattcatatttcattgaaactaagaattacataaaggggcacaggtagagctgcggataaagattcc

SEQ ID NO: 49916 - DNA, 1456 bp, Bovine  19866880547554
tgtgactctgcagtgagtttaccggtataaaaatgattctcagactgcagatacctgcttcagtcacagtgaaacttggtctaaattgttcctaaaaattaaaggacagaaacctttttgataaaactcctctccatggttagattaggagacttacctggtctttaacagtcagtaagctctgagttaagaagcagcttcccacacctgaccattaccaccttaggaagacaacaagtctacagatctctgaattataatactcggtctaacatttccactcttaaaccctcaatttacaggaatttaaatggagagagaagtgcatttttattaaaccctgtcatctgggtagcttaaaaagagtttgggtgataaacagctgtttaaaaacaataaaagattaggagttaatccttgtgctaaacactgttttttttaacaaagttaggctatgagattacacatctatctgtgtttcctcctctcagtgtaccaaggtcagagcttcagtctaaacaatgactagtcatacagggctgataaagttaatattgtggtaagcttgtgcttctcagtattctcacattctcaacacaaagatgggaatgatctttagtaacattttaatagataactttattatgagaaactgtgttatgctttccagttttaaagcatattaaagattacgataaagcagtgcctttgatttactgaataaaaatactgattttgtcatgagaaaattgcactgaagtgcaaataaacaaatgtgtgtgtgtcctgtcattcaatcacgtccagctgtctgtgaccctgtgaactgtagcccgccaggctgctttatccatggacttttacaggcaagaatactggagcgggttgccatttccttctccagaacaaatgtgcatcatgaactattggttgattttactctctgtttaagttcatgagagttgtgaattattttcttggtatcccttcttttaattcctttaggtattacacttattcatactctaccattattaattcatgaaattaaattggttttagcatttgagtctgattcttctatcaaaatttctatacttttatacctacgacaatgacataaatttacaaatttaagaaaagattatccatcacttttgaatttatttttagtaatcatcttgatttattttaaaagattatatattacctgaaaggtgtgtggtgttttctaatatttaaaccttttgaattaaatattaaaacatagtctttaaccctcatctagcacctatagtttccaaagctcaccaaggagaaaatatagtagaaaaataattaatttaatgttgtcttactcccaaagccttaagtgtgtgtgttacttaaccaacaatctaagattcctattaagaattactagtctccagatcatcatgcctatagataaaagatt

SEQ ID NO: 49917 - DNA, 1244 bp, Bovine  19866880558484
aagaaacaggctctcacccggatcagtcagctccatattagaatgtagcacgatttcccatctctaagcacccaaacagtttgatgtcatttattaccaaagatacttgtcactacttgaagactaaataaggaagcttccggagtgggtactaaataggaaaaattaaaataaaatagggaatcctataggagttttactcagatagctctaatttttgcaacacaggttctgatgtgtttgaaataattaccactgagtaatatttccgtttcctatacctattaataactagctccaaaagttattaagtcatatttcacaaaaagaaaatctaacttaataagagctggaattttcaaaacaagctaaacccctttcaccagaagagaagcaaagggctaaagccacaaataaggcacgttccccacctagcggcacttccaggaaacagcaggtacgttacacttggtgtgttctgatttaactcatggaacacatcagaggtgttaagagataacttccatcttctgataatttctcttggtttagcccctagcaattcaacagaataacctctctttttatccctcctcaaatctctactgcaatgtccacactcaattgcccttacctctcctggcattgggggtactagacaaccctgactggaccgtccagtgcctctcaaacactgccatttagatcattcctccacttaagaaacagaaaataattttttttttttttttttgcaacacatcccgtcgaagcacttggggctgttaggaagtgctttttaccgaatttgctcggcaagctgaactctagcaggaggttcagctgtgatcactctgggcgtgcatcacccttcccagtctgtccccagactgaactccccactggaactcccctcgccccaactccacctggggaacagctacccactccctaagacacagttcaaagcccactgcttgtaagaagacttccctgacaactgcagttcatttctctctttctgtgatgaatcttaagaataatgatggtctgcagcccgagattcacccttgacttgtttttttctgccctttcatcattgggtctgtagattcatagatggtttctctgctaatgagggcaacaccctactggcagcaattcttcgtgtgtatttttaaatattccctctccactggacccagccaagtgaaaaactgagactcaataaatactggagggct

SEQ ID NO: 49918 - DNA, 1674 bp, Bovine  19866880565547
tgagatactgcttcacacccactagaatggctgtaatcaaggcagaaagtagtaaattgtgaagatacagaggaactggaacactcacacattgctggtgaggatgtaaaatggtacagtcactttggaaaatagtttggtagtttcttaaaagggtaaatgcacataaacttaacatacaaaccaacaattccactcctaattatttacctaacagaaatgaaagcatgtgcccacataaagtcttatatatgagtgctcatctacagcagcattattcatgctatccccaactgcaaacaacccaactgtttgtcaatgggtgaacgggtagtcaaaatgtactatctccacacaacggtgtactacgtcaataaaaagaaggcactcctgacacactctgtcatggactcagaatcacctgctaaatgaaagaagtcagacataaaggactacatttaagtgatttcactcatgtgtactgtctaggcaagtcactagagacaggaaaccggccagtggttgctaagggctgatggtgcggatgactgtacttgacgtgtgtatgtgtgttagttgctcagtcgtgtctgactctgcgaccccacgaattgcagcccgccaggcttctctggccatgggattctccagacaagaatactggagtgagttgccattctcttctccaggggatctttctgacccagggatcgaaccctggtctcctgcattgtaggcagattctttattgtttgagctacagtagcgacttagcagcagcagcagcagcagggaagtccttgtagttgacacgaggggttgtacaactgtaaatttactgataatcagggaattgtacacttaaaacgggtaaattttacggtttataaactatacttcagtaaagttgtttaaaataaaaagacataattttggtggcggtaattctaatccaaagaacagaaagaaactaggccaaggcaatgaatgatcatagattttggatgtagtttgccaatccactcaaaatatttaaaatgctagctgatgacaccatctacgtgatggttcttctaacagttgctgctcctttgagttcagagaagttccacaaaggctattaagaaacagctaaagcgactatcaacatcaatcatggctaattataatcggaaaagcaacatcctagaggtaggtgatgaaatgcttgcaatactaatgtgagacttattacaatgagttttaaattcccaggataaaatatgatccattttgaaaagaacatgttgaattccttaccctatgaataaagaatggcacaaagtatgaacaaaaaaatgctaaggaaaactcagtccgagaagatagggaaaaaaggaaggaaggaaggactgcttagagcaacaggttggaaggaaaaaagaagagtcagagcaaaacagaattaaacctttgtattggaaaatgaaggagaaggcaatagcatctcactccagtactcttgcctggaaaatcccatggatggaggagcctggtaggctgcagtccatgaggtcgctaagagtcggacatgactaagcgacttcactttgacttttcactttcatgcattggagaaggaaatggcaacacactccagtattcttgcctggagaatcccagggacaggggaac

SEQ ID NO: 49919 - DNA, 1429 bp, Bovine  19866880656662
tactcagtagctcccatgtgggctggtgcgtaatacggtgtgttcattcccatgattatttaaagtaaaatgctaaattgttaatgtaaattcaactgccccttttttgttaagtaagcagatttacttttccccagttggtcaaccccagggagtaactttaaatttctttaggtagctaaaagctaagtgattttcatttggagtatatgtgaatagttttaaaaaggaattcctgcagattcaaaattgatacttggagtttcttctaaattttatgtgccgacttatgtaaattattaagattgaactagcttttgatctcagaccatcattttataatcattttatctatagcagaagcttgactttactatttcttcacaataattttgttaggctccaaattcaagatttatacttctagtgactctgaagtgattatcgtctcaattaattatttgtaagcctccaggcttatcagtatggtgaattttagaatgcctccagtaagaatgtaaaaatcagtcatgtaacacacactgtattttataacaccactgttaaaccatcacctaagtttcagggtgactaaaatgttttctaggggtttctatgttgatttcaggtagtatcccgatttacggatatattagcaaactagtgacttagactgatgacatgatgttttcaaagtttctgttatataataaactattttaaacataactttgggagtagttcatttatttaaatgactcctaaatcttggaaagattaagaataaaattttgtcagtttcattttttaatagttttcaggtgcctttctttgatggtaatctaatataaattatcttttaaatgtaccatataaatatattttcatgcatatttattctaagtagtagcattactattatttttatatttacacatatttattcaaatcactcagagtgctattaatggcccatgtagtgaaatatcctaatttgttcttatgacttataattggtttaaataaaagttaaatataaagtgttttgaagtttataaaaattattttttggtgtgttacatccatgtccagagatataaaactcaaaagattttctttctttcataatatactataatatggttacaagtgcattgaaattcatcttgttagaatggtagtaatatatcccaccaggactactgttcctagtagcaatttaaaataattattgtgagacttgatgctagacatcaggtttgcaatagaattacaatgagggaagtgtattagagacaaaacattgctggaagaaaacttcataatggcgcaatttggaactaagcctcaattttacagtaatagattctctttatgatggcacaaaggagtgaatgcacttagcaaatttaaatctattatagtcaca

SEQ ID NO: 49920 - DNA, 1502 bp, Bovine  19866880667305
catatattttggtattgattactttatattaagtttttccagctataaagggcctttgctatatccaggtcaaatctttcttcaggaaagttttcttacatattagatcactttttgttccatttgtctgctcttttcttcagaaacagtaatattttgattgttggatatcctttgtctgccacatctataatcttctttataataatttttagatcttttttcccccctaatttggcttgtgcgatttattctccatgtttttatttcccagttctgacccacatgactttgttctcacgagcatctattctgacttttattgcctttaatagggcacttatgtccataatgatttctgatttctttctcgttttattcctgagttttctagctcaaattttgtcttctgttattttattgtatcaatttttctgaaatttcttttgatagtttgttttcaagaggtcatttatgtgtaatttctttgagactctggagaattgtctttgacactttctgtgtttctctgtaacagtcctcttcaaatgtacattcttcatccatctttacattatgttctttttttacccccaggttttatgcatagatcatagttagtttctttgtgttgacagggcaggtaagataccttctgaagaacaggctctcttttgtttatttgtactctgtggattcttcaaagaagtctctctgaaatataatatcttcttcaagagttcttttaattctttcatcaaactcacaccgtgggctggcagattctcatcatgttcccttttccaatgcttctctgaaacactctttcagactcctctgtaaagcctcactactgttcatcaaccattgtggactaacctctcactccttctttccccagctgatgtctgatgtttgtgaaatacacctctggaatggaggaattaacaacggatcaaattagctctgttttagaaaataccggattgctgttccttttttggctggagaagtatagggcatctttcaaaggtagtaaccttttgagttatttattttgaaaggattttatgttttatatcagggattattatgtttcttttactctccaattcagaaattgagtcagcaatgttcttttctcctaattaggttttagttatagctaggggctccctaggtgcccgtggccaagaactctaatataaataaaaatgcggtatcattctctgttctattataattatcaactgagttaaagcaaaacccttggagatgactgttaagctgcagtagaaactttatgaaacatgtggttccccaaagcactttttacatcagtcctttctgatacgaggtgtcagaaaaaggtaatcttacatatcaccttccctttaaaagcatactaacacagaccttcagaacttttccaagcagcactgccctgattctcgtctgccctaattatcttggcacgaagaaaaatagagacatgtcctcag

SEQ ID NO: 49921 - DNA, 3252 bp, Bovine  19866880716673
acttgtattgtctttatagcgcttgaacagttggctatcccattatttagattaagcatatgcaaatttatacaagctctatgtttattgataagtaataatctcatgttttgcattgtttctgtgacatatagacaacaaaatataaatcctttttatttctatgaaaggcactcatagggatttgggttacaaaaaaatgcatactttcttgacatttatgattatatttaaaaacagtattactaaatactaaatttggtgacgatcactcagttatgcaccaatgtgagtttgtttttcagtttttgttaaattttaatcatgtgccaagttttctgaggcacgaaaaggaaaccagagattagaggggagggttaaaaacattaaatacactgataaggtttgcatccttgtggttttttttttcctgctgttctgatagttctttaaggggtctgtcattttcaatcaacagagagtacatgtgatcagtatatctgataaacttgtcaatgcctctttaaagcaggattccccaacctattcaattcagatccccctgcttcatttcaagtatcatcttgataagacagagctatgtcacaagcatctgtgtgtagccagctcagtctacaactaatttgtgcaggaaaaaattaaatcaggaggtaaaatattccatgattgctcattcccaacagagttgggcatcattctgaagaaaatatcaaataattggtttcaggccgtgtcagacacatgcaattcccttctctaatggctgtgtgtggtagcaccaggcctcaggggtcagcaaagaactggaaatagcttagtgccaggcacggcaatagagagtcagagcacataggaaatgaagtggcaataagtgcaatccataggggaaatgtgcttcacttggagtttaatatatcggttcagaatctggcaggaagccatgcaacaattgtttacctttttgtcagcatctgcatctgttctgttttgtaaacagcacttaactctcagtcggtaaatgctggaatcaataacaactgttaagggatttcctccccccccctttttttatattctataacaaatgcacactacaaacaatgtttgccttagattaacaaggaacagacattaacagggtcaaagggatttggttgggaacattttatagcttcttgggtttacagtaattatatctgtgtgatttgaatgtattttgtaacctatccaaattaaactgttaaaaaaaatgctagcaagcagtaatgaagatgattttttataattatcttaagtactgtgtatagaaaactgctggcactgtttgtaataatttagttctgtgcaatattgtgtattacagctgctatgcagaaatattaagttgccttttgcagttttaggaaattagtgattatatccagcagtactaattattttaagcatacagttattaaaaaaaaaattacacaccacagtgagacataaaaaaggtttgatctgtgactagtgcctataaaactaaatatgtcattagtaaatgcaaaaaaaaaaaaaaggaaaacactgctttgaagttcactgtcttcagggactgaatagatgaatgctgtcataaatgcaggattgttataacagttatagcatcactgaaaagtgaatagcaccaggatcagaggaacacattattgctgatgggtttatgcctgcatctttccactcactacttaaaaattttactccttaaaatttccctatatgcaattgcttagttgcctcattttcattttatttgattacttcatatctgattttaaccaaatctgggtttgttttcttctgcttttacttatataataagcattaaatcttaggctgtcctagtaatttttgtcaaatggatgatttctttgaacctttcgctggataaccataaaccacaaataaaatttgggaattatttggtcagatcaccttatcaagatttctattttcttgtcttttcagaattttatgtctaagggtttggtgtgaattctttaacttcctcaacagttattttgctatttgacttagctaaattattttgaccaacattttttgaaagtttattgtattttttattaaaatcttattttgaaaacttgaacagtaatctcttttgtacctttatcaatcctgaaaagtactttgacttccttttcttcactgtgtattatttgcttctttgacattctgtgactgtgtacaaaatcaattaatatatggtaatatgcataccaccacaggttatatgtgattgtataatataaattcctttttatcacctagaatgtctagaattttatttttcattatcctcagaatcacaatccagattttgtaaatttccatttaaaatgtttatttgaatgacgtgtaacttgtttttaggctcagaaactagaaaagagttgtcttttgtaatgtacattctatccaatgatagagaacataccttattaatccattccattatgaaattatataattctgtaaaaaataaactaatccttaatactgctgcatgttctgatctataaatagaaagagaaaaaatcttgatagaaagttttatttccaaattagaatctgtctttgaaaaccgtagtcgatgtttagatgtgatttaagaggtaaactaacaccttttgtaattacttcctttaccacgggaaaatggttacatggctccaaatatctctctagaaatttaaagaatataaaaatgaaactttagtttccattgtttgtactttgtatctttaacatctacttgataggtgaagaatccacctgcaatgtgggagacctgggttcgatccctgggctgggaagatcccctggagaagggaaaggctacccactctagtattctagcttgcagaattccatggactatacagtccatggggtggcaaagagtcggacacaaaggaacaactttcactgttactgacaggaattagttccctgatagctcagttggtaaagaatccacctgcgatgcaggagactcctgttcgactcctgggttgggaagatctgctgatgaagggataggttacccgctctagtattcatgggcttcccttgtggctcagctggtaaagaatcctcctgcaatgctggagacctgggttcgatccctgggttgggaagatccccggagtaagggaaaggctacccact

SEQ ID NO: 49922 - DNA, 1020 bp, Bovine  19866880726723
cctatattttagtgtttcagagtgttacctttttattagatagattataaagtgaatgaatactgtatgatgtctgaaatatcacttgttttggagaaacatataaaagagtttatttggggaattatccgtaagatttctggtgagaactttgtgtgtttttatttttttaaggtcaggttaaacctaagaatttgagttggcactggttgtggtaggaaagtaagtggatggcccccactcttgcatgaaacaaccctgagaaggctctcccttgctgtcattcagtggttcattgtgaagcattgaagacccacaaattaaagacattactgtgtgagccgttatttgatcaccacgttctgaaaagatggctaattccatttttatttttttttcccctcctttttggagggaggaaagcagggaaggtcaatagggggcagatagtaatgggtagtagaccaagagcgattgtatgaccttttcagaacggggatgctgaacccttgctcccccttgtcacagtttaaaaaccagaggagctagtttaagagaagaagttgttagcattccatttttattatgacatttcacagtcatctgatttaatgtcccttgaccggattgtccaccgtgagacgatgggcttgaaatgttatttagagcattgataaaaaggtgagcggttctaagatgacagcgagtcataaggctggtggtgtgacattaattttctccataacagagatggaataagacgtcacggggacaagctgtcaatcagcgctggcccctcagagcatcccgatgccataggatggggtgttgcctctcctgtaatagagctgaactgagatgctctcctgacagctgctgcagccatagagaaaatatattatacagcctttcattaaaaaaataaagaggactcctctccagagcatttcaatcttttcccatctattgagggctgaaaggattcacagcaaatcatagattcctctgctatggaaattt

SEQ ID NO: 49923 - DNA, 1711 bp, Bovine  19866880738502
tacataattagcttccataatcataaaacgccgtcctcaattttataatgcatcatcttatttgtttttctatatgatgttcatatgaaaatgtcatgcttttttcaaccatacatcagatactccttacttccaacaatatcactatgtttttattggtaaaaataaaatatattaagactatattctaaccaaataatactttatcattttttgttgttgttgcttttaactttgaaaagttgatctgagatttcgtctttactgtgttacaatcctgtgagaaggatcctattaattataaataaatgagtaaataggcacaaaaagacttggtcaagtcagagagttagggactagctaagtatctgtggtgccatgtctggggcatacatctcctgtgtcccacatccagactctttcagctaaaaaatgtgatttgagtggactgtactctctcgtgagcttggtcctgctgacagtcttcatagaaactgaatgcagctggaatcctctctctctctgtgttaccttttctcaaccgtttgccacatgttctgtccctacaagcccctctgaaaagacaggagccacacatgcaactctgtcatgtcaatcatgtgacaaacattctccaagtgaaattaacatgcaagactccacgtacattttgtaagcttccctacagtgtacaaatatgctgagactgtcgaagatagttctgatccagaatgtattgtcacaggaacaagtaaaactatattttcttttttaggaatcattaaagacttcttctttaattattacacaaaatatcctctaaccgacaacatagcaactcatgatagttttctaatgggaggcatttgaaatgccttagctaaagattgatttaaagaaaagctttctgttggattcatctcaacatctatcaggtagtattatttttccaatagtcttttgctccgtcctttgccttctaaagagctatgcccaagctataattattttctgctaattagagtaatccatgattaattattcaaaatgattcctttccaaaatcaaatccatttcctgtcatgacactaaaaaaaaaaaagatataaataaagtattatcagaatcagatttgtcagaaaggaatactttttaaagttttctttagttagcattaaaatcttttctgctgaaggtgctgtgattcccttcatcagttaatgtggattagagaagggcaactggaccatgaagtgataacaacgaatggttgtgataattactaaggattagttatactgatgacataggagtaagcaatttacaatattctgaaagaaaagcttcaaagcagtaagacctagcaatgactaaggggaagtgataaacgtgttcacttgggaaaccgggggtccaaagatgtacttctacatggctcatgcctttttgtcgacactcatttgagtcctaagcgaagctaagccacttcagttgtgtccaactctgtgcgaccccatagacagcagtccaccaggctcccccgtccctgggattctccaggcaagaacactggagtgggttgccatttccttctccaatgcatgaaagtgaaaagtgaaagtgaagtcgctcagtcgtgtccgactcttagcgaccccatggactgcagcccaccaggctcctctgcccatggactccccaggcaagagta

SEQ ID NO: 49924 - DNA, 852 bp, Bovine  19866880755201
tcatttaaaatatgatgaaaagcatttcttacctaattttgtttcagaagattctaagaatgagctggtcttctaatcctaacgtaggtggtaacttatttccttctgaagtgtcagtagaagagctgccttttcgtcagtgtcttcagcagcttttttcccaaatatacaaagcacatctataaaataattagatatagctttatcacccacgtggaggaggcacagttacaacattactgatttcattggcagtgacagcactactgttaaggtatgatatacagactcgatccaagagatgctagaaacatataaagacatcctgaagtcggggcaccttaaagaagcttattaacaagacgactcatagagtattggcacatggataacagacgcaccttaaaaatatgcacaaagtagcccttttattatcactgagttttcaaatgttcctaaagaaacgtagatcacagacagtaagggatggctgcaccatatgaatcaagcaatacctttcagtacaattagagctttcttgtttaattaccagttgcccagaactgtttcttaaagccatatttgggacatccctggaggtccattggttaagattccaagtttccaatataggggactatggttcggttcccggtcagggaactaagattccacatgccgcatgatgaggccaaaatattacaaagtaaattttaaaatttaaataaaaaaaaaaatcatttccccactcttctaggttatcttgataaagcagattccgactcagctgatctggggtcaggacctgagattctgtgtttctaataacctcccaagtaaagtcaccaaaga

SEQ ID NO: 49925 - DNA, 1694 bp, Bovine  19866880822983
gtattgaactttgcccctgtgccttcaagggtaccacattcaaatagggagatgagttggtcttaataaaatggataatccagggagtagatatccagcccatgcaaacctccattttaaccctgtggttataagcatataacaagatcttaatgctctttaatttggaataaggtttaagacagttttaaatacatttttataaggctcaaatctcttcattacatgaagtgctacagccattacttgccagacacaatattttcttgaatcatacatatattgaatatatatatatatacattgcaaaaataaaattcatgttgacttatcattcctaaaataactttctctactcatatccatttatctctagacaaacagtcattgcaaatatgatttgccaaggatttgaatttgtgtatctacagcctgcatattctgacaataaaaaagtagaaaaatcgacttacacgccttcagttatctttttgaatttgattttttagatataaataaccaaactctctcggtgaaagcctgacactgataatgaatatgtttcagatggcaacaggaaaacagactactgctgcaattaaatgcaaatgtttggagtgcatgctgtattaaagtcgagtttaagacactgaatgagaaaattcagaagttaagtgactcaaaagaaataacttaaaccggctgagtcaggttttcccagtaaactagctgccccttgggattaaatctgctgcagtttttagtggcagaaaatctgtctgtaggatttcataattttaatacaaatggagacattactcctgatgccttagccattcttatgtaaaatacacaggcttccgtgagaggcccagcctttgttatcttgtcagtcagtccttatttcctgagcacccactgtgtgcagggcgtcctgaatcaggcatttgaagatacagtggacttttgtacccttgaggagctaaagagtccctataagaaaatgcttccaaatactagagaatcctcagtgtacccatcctggggggagtgattatgaagaaggttggatgaatctaagaagacttcctagagaaggtggggacgcaggatgcagaaacacacaagttactgtttgaggataagacaatgtgaaggattaaagccaaggatctacatcaaggagaactgaggttactagaagctggtgggaagttgcccagagcttcagtgatcaagggctcctgttcagccaccttggtaccatctctttcccccttaagtataacccgttaattacccatcctcagcctacgcatttagtggcagaactctgagaagcaaattaattagtcttatacaactctgttgccaaaacttatgatttcaggtattcacagaaaatacttggcttccattatgtactcccaggagtgattcttgtaaatcaaaatcttaaaagatccttcaccatagaaatataaggtgaaacgctggtttatgcatttctaattgtactttgcttcctaaacaaaagtatgagagaaaacataaagagacacactggttttaagcattcaaatatttgtatctgcttttggtaaaaaaaaaaaaaaaaagaaagaaagaaagaaaagactgtatttctgtgagagttggactataaagaaagttgagcgccaaagaattgatgc

SEQ ID NO: 49926 - DNA, 995 bp, Bovine  19866880823105
aatttttcttccttctgcataccctcccccctccagcttgtcacccctggccccaaaattcaaataaaaaagtctggagtgttggcaaattttgaaaaggaaatgctttgggataaaattttttattttaaaatctttcatcaaattctatattcctccactgaggtctccaaccaatgaagtaattactctttatatacagtatatgaccccaaactgcaatgggtaatggaattgctctgtgttgctttccaatatttcacacttttttcattaatgttcaatactttattagtagagaataaattggtacatttcttttattgtcatttttactttcctttataaaccagcctggatggaaaaaaatatcatagggtagtgaatcattgaaaagcttggaaatgacactattgtttccttttttttttttaatgcattattaaggtttcttttcaagatgtaaaaagaaacttacccataaaatagaactataactataaatctgaaaacatgtgagatgtatattatacaagttttttttttaataattccatatgatttttaaaatctagttattttcagtagtccacaaaatatccataactgcacacctgaaatatagtgactctttcatagtcacctattttactatcatgtatcccattagaaaatgcactggattttccgaaagaactctctggtccctagctgtgagatatttaggaaactctcaagacctaaggaatcaatatgtgctcccattcacagattctgttccaaaagagaacaagaagccaaggtgataggtgtcagaggatgtgtgttctgtggggttgggctccttgtgcacccagctgcatcctgccagtcactcacaccaacgaggtcactgtcggtcctgttcacatcagagaaaatgaatctgttggacacctgtgctgtgttcaacacagcaggcgtgtagaacatgttgctcaaaatattgatgttat

SEQ ID NO: 49927 - DNA, 1084 bp, Bovine  19866880826212
actagagagcattttataatcatttaaaaaatcttttttattagagagaatcatttatatcaaattaccagacatttttagaggagcataaaggcattgggatatgatttattttttcacagacaaatcaatccatgaataaaatttgagaatttaaacaactcaaataatgatgctcaaaacattcctgcttgtattagagccttatcaactgaacaggatcaatcgatagagaaatatcacattattaggatcaaataacttctagaatgaagaaatccctgttggttagagttagttttgtaaaatggttcaattcacaatatcacaactgcacttcaataaatttctacttgctacttcacacaattcagtaagctgcataaaattacattattttccatatcatagtagctaaaaagaaaatacatttgatacttactggtgtaattctgttaatggtgaagtcaacataactaatgttgtgaagagattattacagtgggtatgaattttaaaaattttatcatctacatatgcatgaggattcaaaagcttctgtacagatgtgcaaactgaccataacatgttctcagtgcaaattaaaattgttgtgacatcaagtctgttggaaagaaaaagaagaaaatcatgttaaaattgttttctctgctgggtatgcacactatcatttatatctattatattaaacatatgtaagaatagaaatatttgcttagatatcagagattcagagatcaaaaatagacaaagcatcaaagatagattttgagtttccaagtgttagctgacccataataccatgcattgggcttccccgatggctcagcagaaagaaactgtcttcaatgcaggagacaggagatgcaagttcgatccctgggtcaggaagatcccctggaggaggaaatggcaacccactctagtattctggtttggaaaatcccacagacggagaagtctaacgagctacagtccaaagggttgcaaagagtcggacacgactgagcacgacaccattcattatctttagagatgatgacgtccatagcagtgaagtgtt

SEQ ID NO: 49928 - DNA, 1611 bp, Bovine  19866880869406
cataaataatggtttagtaacccaagaaatgaattttggacagaattacatggtaactatagattcaagttcctgaataagaaaaatctcaaatatgttaatgcatgaaacatgagccatatcttctctttcaccagggaagtataaagatttccagaaaaggaaaatatttccatttaatttttgaaatatatgtaatatatttaaagatgacacaaattataactgatggctatgattattctattaaaatgcatcttaaaaatgtactttattcaggaagtgatttaaggcaaatttgacagacatcaacacatataaaagagagaattatttttggctaggattcgtattaattctttgcatatttattagtaaaatttagacaatcactaaaatataagctctttaaagatagggaattttccttttagctcacattctatccccagagcctagaatggtgccttccatttatttgtatcttcaatttctttcatcagtgtcttgtagtttttagtgataggtatttcaccttaattaaatttattactaagtattttattctttttgatgcagctgtaatgggattgttttcttaatttctgtctctgatagtacattgttagtgcattgaactgtaatatatttttatatgttgactttgtgtcatgcaactttactgaattcatttaacaatttttttttttttgaggactctgtagggttttctatatgtaaaaccatgtcatccacaaatagtgacagttttacttatttcttccaatatggatgacttttctttttcttgcttaattactcttggtaggacttgcaacactttgtaaaataaacccagcaaagtaggcatcctagtcttgttcctgatcttagaggaaaaagatttcagcttttcactattgagtatgttagctgtgggcttatcatatatggcctttattatgttgaggtatgttgcatctacactcactttgttgagagttctttttatcatatatggatactgaattttgtcagatgctttttttgcatctattgagatgatcatatgcattttagcctttattaacattttatatcctattggttgatgatttatggataccgaagcagccttgcacccctggaataaatcctactcaatcatagtacatgatctttttaatgtattgctggattcagtttgctaatgttttgttgagaatttttgcatctgtgttcatcaaggaaactggcctgtaattttctcttcttttgggaaaggaaagttccttcagtaaatgttgttgggaaagctgaacagccacaggcaaaagaataaaatcagactatcttacaccagatgcaaaaatcaactcaaaacaaattaaaaacttggatgttaagctctataaccgtaaaaatgcctagaagaaaacacaggcagtaagctccttgacactgatcttcagtatgatttttttgggtctgatttctaaaacagaggcaacaaaagcaaaaataaacatgcaggactatatcaaactaagaagctcagcaaggaaacaccaaatcatcaacaaaatgaaaagccaatcgactgactgggag

SEQ ID NO: 49929 - DNA, 1366 bp, Bovine  19866880870906
agataaaataagtttttctcatttaacttttgatatagtaacgtaatcggatagttttagaagaacacattcttcaaacttcaaataatgtatttcaagtaatcttttaatctggtctgaagaaaatgagcaaactcctagcacacctccctgagagcctgttaactaattattggttgtaattcacttgaggtgaccttctcatttctgcctgtttccccttagctttggctgctgttgggtctcactctgtgatgagggaaaatttgacacagaaaagaggtctgtcaagaggtagaaaggaatgagaacctggccctttggaagtataaagtactgtaaaaaatactaagaaatgatgataccatctgcctgggctttacgaaatcctgcaaaatcagacgattttaggatgtgtttctagtactgttgttgaaactccatgaaatttcatgagtacttcatgatgaagtagcctaatataatcatctttggtgactcagacgcatgttgataagtacacactctgcaagtttatgtttgctcctgtcatttcattgtaatgtgaaatctaaaccatttttaagatgatgtcaatgatgttaataagcccagaagaatatacatgtttgatttgaatgattactctttaattttagaagaatcagcccactatcttagactatgcaagactttgtttagcagctacaaagatgatcattttaaagtaaattttaaactccagaccacgaggtaggtaaatcaaggctaccctaggttaaatgcttgtggtctggatttgcactagaatatctggtctcgtaattgaaataaaacatatgttcctttgtcaataagaatgttttacatcttgtcaaaaatctttcttggtcatcgagtgcgtcaaactctccagctatttcctttcagcctgaactaattaagttcataggaagcaaactgacatttggtaagatgcgatcctcttgtttaatgtatggtggttttgccagggggaaagatgctccttctcgctccagatgtggcattatttcttctgggcgcttcatcacgatctctggaccatcctgccccctaaattagcccaggagatactagcagaagtgctggagaagtctttgggtctcctggcctccagatatgcccaggcccatcccagttataagagaaccctacagataaggtaattgaagttgtgaaaaccattacttttcaagaaaatgtttgtcaggtgtataaagtagaatgtgcttctgaatctcatgatgtaactccttgtatatttaatgtttctaacatcgaaaggaaatcatattcaattctcctagatacttaagtgcaaatg

SEQ ID NO: 49930 - DNA, 1312 bp, Bovine  19866880893820
ttacggacagtgaagtaatttcaaataactaaagaaataaacaagctaaccttaaaactcccagcaaccagtttgaaaccaaactacagaacgagcactgaaataccttggaatttagtgactcaaaagtcatgtgaatgacatcaagtgaaccccaaagataggtctgccgttccctggctcagtgatcaacattctggcctatttctgatgacccagcctttgcctagcatgttggtacttgcactgaaattcattctcccatgttattaaatgaggtaacactggagacaatcaactttcaaaaagtttccacttttaatttttataggacgcatcaaaacattttgaaatatatataatgttcaattttaacattaaaaatcttatcagactttcctataacacttgagggtgaatatttcaacttgctccctgatgtgacacctgtgtttaatcctggtgcttaatcatagggcctagggaggcaagagtatttaatgagttgaaactgaattgtatttacctaaaattctaaaaattaactttaatttgctagatagaaactaaaactaacattctgtgcaagcaaatgtaacacatgaaaccactatttcgtatgtgtgtgaacgtgcatggagtgcatgtctgaaagagcagcgtgactgcctttatgaaagaagataagcataaccacaagtgataagcatttcggaaaatatacggtgaatattttatgtttcagcaggtctctttccctggaggacaaacctaaagtactccttttacaacatcctaacagaaatctacaaaggggagttaaaaaaggacacacgtattcgcaaacacatttcattctttctgaaaagatttaaaaatcatatttctgccctgggatttagtagtcctatgctaagctcggagaggaaaatacattcagtttatctgtcagaactacttggaataaaagcagtcaccttcaagaaaggcatatcacatagagtgacaaatgtcaggcatagtttataaaaatccaatgctatcaacatctgattgctacttttaaccaattcctcaaagcatataacctaatttttaaatgtgagatagatatacaatttttttttctcgaaatgctaacaatatgacaacttcatatcctggctgtgaaaagaagctaaataaatcaatagagttcttgcagcacacacactttttttttttttcctattaggtgtggaacatgttgccctgtaaatttcctttgtcaatagaaagcaaaatatattttaaaaattagatttatactcta

SEQ ID NO: 49931 - DNA, 1119 bp, Bovine  19866880942180
tattatacccatactaacttaatttgtgtattatctttaaacagaaaaaagttaatctacaattgtggattacactattttggaatgaattttatcaactcaaatcattttttaaaatactgtgaaaagataaaatatatttgtggtgaaaaacgaggattttacattcatttatgttttcaaataacatttaaatgtgataccttaaaagtctttctagtttccatctaccaaaaaaggaaattagataaaagtgatctgtaaggacccttctagttttaaaattctattattttaatcatgtgatctacgtctttaatatttaattttctgttatactgcctttgcagtacactttctaattctacagttcaatagacggataatgtgttgttggttataaacaaattcgcatgaaatgacctgaaaatctatttaaaatgcaatcagtgaaagtaaatattgcatttcttcatgttaaatctgagaagccatcactatacttgctttttactttatttgctgcttaacatatctcaacagtgaatctatcatatcaacatagtcatcatgatccaagctgcaaataatagagagtgtcagtgtcaattttgctttctcacacttgcttcccttcacttcatctgattttaataatccctgtcaaaccacaaacagtccaaattaccttcatgacacagaagctttcaaggagcagacagaatctcaactttcatttagcaactacaaaagaaagctgtccagctggacaaatattatttccacacttgacaatctctacagttgagcatgcattttaattttaactaaacctgccaggagtttgatatgcgcttcttgtttcgtgtagattgactcataggattatcagaccaatgactgtaattgtgatgaaagaacctggtatttttctactaaaagacgaattatacaccaaaacagagggaccaaaacgagcatataggaggcaatgtgggaggtggtggattgcagaaagaactctacttaaattaggtaatttaattactaaataaagtctaaagataacagaacacattctttgaaaagtaagaactaatagtaaaaataaaatgcaaa

SEQ ID NO: 49932 - DNA, 1320 bp, Bovine  19866881086161
ttatctctctggggtcctttaactattactggttcttatctgctgctgctgctgctgctaagtcgcttcagtagtgtctgaccctgtgcgaccccacagatggcagcccaccaggctcctccgtccctgggattctccaggcaagaacactggagtgggttgctatttccttctccaatgcatgaaagtgagaagtgaaagtgaagtcgctcagtcgtgtccgactcgtagtgatcccatgactgcagcctaccaggctcttccacccatgggattttccaggcaagagtactggagtggggtgccactgccttctctggtccttgtctaccacataataataccttattagaggagttcaagaaaggtctcttctgacatcacacttctgatataagaccccacgagaaagtagttcaataatctttccactttatcacacttcgagttggctttttaacatgtttggataactgataagatctgccactttctgaaacatagttctttcctaacacagcagcattgaatgactgttaagtaagcacttacgtggtgggtgccgtgtaggcatctagctaattaaatccgcatgactctgtcatgggaatatctcagaagctaagaaaagatgttacaagaccatgagaagtagaccatggtatcgcaccctgttttcaggtggagagatatgatcatattgtatttatatctcaatttcctcacaaagatacaagctatttaactttccaaaattacaaaactatacaagtctgcaaacctgtctgactaatctgaaaacctatagttgtcttttatcttctcattgctggctccattgctatattcttttttatataatacattcaagccataatagaaaaggaaagatatgaagaaatatctagcttcatcaagtatccagctcacctgacactttcacttcttttaataactgctccccaaacatggctttttctctgaaaatcttttcaaagatccagctgcttgtccatccacactctggaacagccatgtaagagctttggtgttcaaaaatctctcattacttctcccctgactgttggctctatgtcaaagcttggcatctcatcagagtacaagttctctaagcctttttcttcagtgctgtggaacagcctgacagcagctgctgggagaccaaagttctcttttgtcctcctccccagatgttcagccctaggttactagaagacacctcctcagtagaccatttttcccatcactgagctttaccactcagatcaaatgtttaaaagagttaaatgtaccatttaa

SEQ ID NO: 49933 - DNA, 3321 bp, Bovine  19866881112225
ttccatcacctccactagctttgttcacagtgatgcttcttaaggcccattttacttagcattccagcatgtctggctctagtgagtaatcacaccatcgtggttatctgggtcatgaagatcttttttgtatagttcttctatgtattcttgccaccttttcttaatattttctccttttgttaggtccacagcatttttgtcctttattgtgcccatctttgcatgaaatgtttgcttggtatctctaaatatcttcaagagatctctagtctttcccattctattattttcctctatttctttgcactgatcagttaggaaggctttcttatttctccttgctatgctttggaactctgtattcagatgcttatatttttccttttctcctttaccttttgcttctcttcttttctcagctctttgtaaggcttcatcagacaaccattttgccttttgcatttcttcttcttgttgatggttttgatcactgcttcctgtacaatgttatgaacctcggtccattgttcttcaggcactctgtctatcagatctaatcccttgaatctatttgtcatttccactgtataatcataagggatttgatttgggtcatacctgaattgtgtagtggttttccctactttcttcaatttcagtctcaattttgccataaggagttcatgatctgagtcacagtgagctcctggtcatgtttttgttgactgtatggagcttctccatctttggctgcaaataatgtaatcaatatgatttcggtatcaaccatctggtgatgtccatgtgtagagtcttctcctgtgttgttggaagagggtgtttggtatgatcagtgtgctgtcttggcaaaactgtgagcctttgccctgcctcattttctactccaaggccaaactctcctgttacctaggtatctcttgatttcctacttttgcatttaggtcacctctgattaaatggacatcttttttgggtgttagttctagaaggtcttataggtcttcacagaactgttcaacttcagcttttcagcattagtggtttgggcatgggcttgaattactgtcatatgaatggtttgcattagaaacgaacagagatcattctgtcatttttggtattatccccaagtactgtgttttggactcctttgttgactgtgagggctattccatttcttctaagggattcttgcacacagtagaagatacaatggtcatctgaattaaatttgcccattccagtccattgtagttcactgatttctagaatgtcgatgttcactcttgccatctcctgtttgaccacttccaatttaccttgattcatggacctcacattccaggttcctaggcaatattgttctttacagcatcggactttacttccatcacctgtcacatccaccacttgctcattttcagagagcaagacctaaagctacagacacaaaccccttatattttaatgtttataatatatggttgtctatccaaaaaaagaactttacctaacagaatttaataattgcttattgggtgaagaggactttgtttttaaaatacattcaataaaaatgtgtatttataatctccattcttattcctgagccaatttaacaaaagttaaattttatcaatttagactaaaaagagactattcataaagaaaagtctcccataaacaggccaatagttatgttgtttgaaacacctaatcagaacattttactctaaaattttgctttcctaaagatatgatcaaacttctaaattaccaaatgatattgaatgaagagaaaatctctgaaaaaatattacatatgtatttttaggtgcataataattttgaccttagtctagttaataagattccctgagcatattgtttctaacttaaagtgacaaggtttctaatggagtttaataagtcagtcaatcaattgatcagtaaattctgtcacttcatccttacgctaatgaagtagctaacaaaattaatacaagacaataccaaagcagctaagatcaaacataataacctttgcaaaaactggtaagatattttagcaggctgggtaaatgcacttctgtattccatgagaaccagaactgaagaagctacagtatggtaccattgataacttttaagtccctcaaaaacaacatcatgttatatatacaaaaggtagatgtaatataaatgtagaattcttttgcaagaaaacctggttattcatttaaccacaatcactatccctgtacttagtggctatattagaatagcccagtgttttatcacaattgcttttctaggctgaactatataactctattaaaaggagactatttctcttctaggcccatgttcatgagcttcaatgaccatattaacattagagtaactctccagccatgtcagatactatccatgttgagtagtcaccttacctgaaagttcagattataaagtttaagtgaaactccatattttatatcccaactgatcgctgagcaatccctgcactttttctgtaaaaagcaccatgctatcttgaggaaaatataaaaataaaaatctgtgatcaccactgactacctggctggcaagagcagttacatgcatgtgcattggggtgtctggattgattcaaccagagactggacagattacagttcttccagatacccgtggcccactctaggacttaatctgcaagaatatttgtatagaattgtaagggaaagaacgtgccaggttgggttcagaattccaggttacccaccatttctcagctacatgtgtctcttggcaaatcacagtatcttaaactctaatgctatttttaacatgatgaaaataattatacttactttataggttttaagagtcaaattagatagtaaatgtgaagtgccttgcagagtgcctaagagttaacaagtgaacaatctatgttggctatttgaccaattaattcccctagcacctgtttccctttaagagagtggagttcaagatattgaagctgaagatcctgctttcagttgaactttgtgagatttaaggctcgggggctcagagaataaagtccgattcagggttggaggagaggtaatctccaaacctctgcttggaacatggtgaggctggaggattcacagtgccctttggcaccacaagatttctggatttgggagcgccaggagagaagcagagggctcagagtagggtacctcctctatgtggtttttgggaaacaaacctcaaggcatgcagaagaaaaaactatgggga

SEQ ID NO: 49934 - DNA, 1168 bp, Bovine  19866881176634
ttattctttatcattaaagttaataatatgcacattaccctcttatgtagtctaaatcaatattgtcgtttaaaagagatgacctctggacagctttgtctaaatattgatttcattgtcatttgtataaggtatcaaacaaattacatgctgcactaatatcattaatactgcccccacagagcctctgactttacaggttcttataatataggacatgacattacaaaaatattgaggacatcacaaggtataattactgaatagatgaggtttgactatggttgcgcagagtggctgtaaacatgtgataacttccaaatcctttactctccgtggacaggaaaaatacatctctttagcatgcagattggtttgttgaggttaagtttcaaatggcagaatttttttctgcctcagagggtctaatttacctttttgtgatgccatagatatttcaaaagagaatctaaagtctgattaaaatattgtagttctgcaatatagcagttttcccaaaataaacttgtttaggaatttctattacaagttcctagtgactcagatgagttggaaaatacatgcaactttatgcatgtaacgtgaaggggctgaacctttcaaatgatcattaaattaaataaaagctgatttagggatgggcacatatcacatttgccctcataattggcagttacagtattatttttgtaaaaacaaaatatgcaaattaaaatagccatataaattagcgcgttaaaacttttttcaagttctaaattgctctgaatcacaactgttaacctcaccctgttacatctaactctatattaatgtttgttcgttttttcaatttttaaaattgtactttactttctgttttctataaaactttttagaaaagagatgtggtcgtggtcatgatactgatagctatgggtgctatttacactaaaactgttcccccccatatttcttgtaggtaaaagtgacccattttgtgtggttgagctgaacaacgataggctgctaacacatactgtctacaaaaatctgaaccctgagtggaacaaagtcttcacattgtaagtagctgttaccttgagcttgcttcaagaatgatgctaaacgatatttattttcgagatttttgtgtgttttttcttaa

SEQ ID NO: 49935 - DNA, 1045 bp, Bovine  19866881313406
actgtgttgaataagagcgttaaaaatttaaatcttcgacctattcccaatcttagggagaaggcattcagtcttttactattaagtataatgttagctataagtttttatgtatactttttatcaaattgactaatgtaactgaataatgtgattgcatttcagtttcaaaaaggaagtatttattttgcttttgaactgattattttttggcttttctgtcatggtgccagcagttggcatttatgtataattattaactgcccttacaacattgtttaaattgtccaatttggaataaggattccttaaacttactgttgatactaaggacactgtggaaaatgttgctttatgtgtgtgggtttgcctccctcccaatattggtgcctgatgctgtagataccttcctttggccttcctactgtagttggggatgcctaatcttctcatctaaccatgttataaatgtgtatttaagattaatgatatgctgggccagatcctgctgtgtatttctttgaaagtatattagctttctgattgcctataaatcaaaatttcacaagttatttcttttagtcactagatggaattttatgattttaaagagttgacatagatttttttaaaaaaggaacattttctgggcagcttaagggcttctttctgtgaaatggtttgaatattttagatataataaactctgttatttaataaagttacagtaaaatttcttgatcagtagatcaatgcattgctcattagagtactaaagaaccagtgccctctgaatggattcactcaattcagacatttgatctgccctttctaacccttgatagcactccaaggttttgctgctatgtgtgagaacccaagataagcctcaaacttggattctttctgaaggtataatgagctaccaccccagccatttggcacatcacccatgttattttagaaaaaaaaaaaaagcttttcagtggaatgggattattttactttagcagttttctatgttataaagtttaattgcaagttt

SEQ ID NO: 49936 - DNA, 3280 bp, Bovine  19866881420490
aacttggatggtgttgaccattgcctctgggtaacatggtgtaaacactggagtgggtgctcctgggacgtgttcacatgcagagagagagttttcccatctcaattgtcattattagccccttcatcctttcaattagcctgaggggcaggtggaaatgtagtgtgtagcatctgtattggccccttcctgaacttgtggccatcttgcattgctctacagctccagtaagcctttgtaacagcttgcacctgttgtggggcttccctgatagctcagttggtaaagaatctggctgcagtgcaggagaccccagttcgattcctgggtggggaagatcagctggagaagggataggctacccactccagcattcttgggcttcccttgtggctcagctggtgaaaaatccgcctgcaatgtgggtgacctgggttcgatccctgggttgggaagatcctggagaaggcaaaggctacccactccagtattctggcctggagaattccaaggactgtacagtccatggggttgcacctgttgtaacacattgtagactacacgtagctattattatgcagtatcattgctcttcccacttccatagctaggagcagaagcccaagggtatttttgcagttgccatgggccccaaacccttctggttaactggccacctccaactcatgagcctgcccctgagataacactcctaaagcctgtgtctgtagccgtttagggctggtggttgggggtatgcttgtcttacctgaccagctaacatcctagataatccatgtccttacactttgtctgtattctttagccatccccacatagtcacaagagccaggagcatgggacagctacctttaaacttgtaagaggctctgaggttagcaggagatcattagtttaacggaagagaaagacatctctcatctctcgtggcggtcagcagggtcatacatgctggtggactgcctcctccgatcacttcctcaacttttcacacccatccttgttttctgatatcttggggctcacaggagttttttggcctcttggctgcctcaccagtgattgctgtcgttcgttgagccactcagtcgtgtctgactctttgtgactccatggactggactgtagcacaccaggcttccctgagcctcagtatttcccatagtttgctcacactcatatccattgatttgatgaggccatctaaccatctcatcccctgtcatccccttctcctcctgccttcaacctttctcagcatcaaggccttttctaatgagccggctgttcacatcaggtggccaaagtattggagcttcagcatcagtccttccaatgaatattcagggttgatttcctttaggattgacagagggctgcactttgtaggtctacaagccttgtagttgcccagccttgggacccatgaggtataggagatggcaacagagactcaggtgtttactgatgtgggctctggagtgataccgcctgccaggagctggcaggcagtcagggtggggcagcggggtggggaaagctgcgacccttcaaaggggaatgacgtcatgttgtttcagtcaccatgttggtttggttaccagagaaaccagcagctggggaagagggcaatcatgtggacagttactaattaggtcctatcattaaggggactggatattcatgtgagagaagtaggctctggtcaagcaggggatgtacagaaagcaagaaaataaccattctgagaagcctgaccatacaatgctcaatatacttgtcccgccccgaagtaaagtatattcaatttacatattagtgtgccaggaaactcaggatgtaaactgtaattttcaagtatcatacactgatcatgatgcattgtttttgattgacttcaaagcccactagtaaattaaaagcatacatatatgtatcagggcttccctggtggctcagtggtaaagaattcacctgaatatgaaaagtcctatgatttcacccctgagagaagcaggatgtatgtatttaagtcaaactttaaaatatttaggtagaattcaatggcatacaagcattaaaacagtctataaatacccacaggaatttaaaactgtaggtttatgattttagtcttcctatacatgttattcggagaaggcgatggcaccccactccagtactcttgcctggaaaatccatggacggaggagcctggtaggctgcagtccatggggtcacgaagagtcagacacgactgagcgacttcactttgacttttcactttcatgcattggagaaggaaatggcaacccactccagtgttcttgcctggagaatcccagtgacggcggagcctggtgggctgccgtctatggggtctcgcagagtcagacatgactgaagcgacttagcagcagcagcagcagcagcaaggggttgttgtctgtcaagagcagggattctgtctatggataccaatatgatggttgcctgaccaaggtcacttctattaaggctgccaactcctcaggattttctgtgaccatgacatcatcattaacattcttagcagagtctgatttgcctccaggctgtcttactttaaacctcttgctctttccttactatagttcttccatctggattataggaagaaagaatgaaagaataaacccatcggtacatctgctttatgtcactgagagttgcccaagcttcatagagtaggacctggtcctcaaaggcttactatccagctggggagagaagatacacacacagaactgatttaataaagaaaacatgatatcatgctgtgaagcagcagaatgaacagtaaagacagaaagcacttgaggagttgaggggttttcattgctgttcattcctccagtctcctgtgattttctggttaccatggctgttggagtcaactcagattctttataaagacactcagggttgagacttaatgctggaaggtttatactatgaaattccttttccctggtgattttatgatcttgccgtctaagcctttgtctttggagcagatttaaaagaccccctgaattgctcatggtttggtcctaagtggcaagcttagttgcttatgtaacatacactggagctgataaaatctaatttcccatttattatatctttgcgcctcttgaacaaaaggacaaggtattattggatcctgccgtatgctttaaaaatcatggacttataaatgagggtcatttgcatccca

SEQ ID NO: 49937 - DNA, 1130 bp, Bovine  19866881553076
cttgggcaactgagtagatgcttcactaagatgaacagcacctggggaaaaattacatttgggttcatcaagaaagtagatgccaaattgaatttgcagcaccttaagtttgagatgcatatggaatgtctgtggatagatggatgctccataggtagatggatgctccataggtagatggatgcatgggtctgaaactcagtaaagagacacatttgagtcattggcaaatgctagcggaagccgtgggcatggatgagactgcccagtatgtagcaggaaaggcaagatgtgatgccaaagtatataccacagactgagaactgggaggaaaactggcagagggtgatgtctttgatgtgaaggaatgaaaatatattttttagggattaactgaatgttggcaggtatgaggctacgtgtatacaaactactaactggaagcctgatcaaagtgtactcaaattattagacagaggcaactacagttacagagcaaaacagaatcataggaaagcaatcttatgtgttaatatggcagcaaatgtgaataatttataagaaagtgctttttagtaatacctttggactatttaattttatttatatctgccctgtttaggtcgtgtagaactttattttatgggtgcccattcttttttttttgtccttgctttcttatcccatcaatctacctatattacttttttgtgagtatggttaacctttccccagtcaactggctgagtctacactttttcacagataaatatttatgcgaaacatctcagacaagaattttgtctcacacttcttaaggattacagcctccttcctaatacataatacagtcaacagcatgatggaaatattatgttatcttaaaactaaattgtgctgttgtcaaatattctactcagtattattttaagatgaaatacaaaaaatggatcataattaaaacaaagctataatgtcttacttaacttgaaaatggaagcttggatttttagtgttttgattttatactaaaaatacttcctgaattcttactgttggtttcctttgcaaaattgcctgctgaaactcctttacatagatgggtgccaaatcataccagcttaacgccg

SEQ ID NO: 49938 - DNA, 1051 bp, Bovine  19866881568571
ctttccgtgaataatgaaataagttatagcacatagtaggcactcatgtatttgtcaaatgaacaaataaatgtgttcaaagatgcataaattatttttattttgctccatgaaactaaaacatagttctgtgaaatgtaggcatggttattttgtatcagttttaaaattggcaggctaccaaatgttaatttgcttttagctagtagagattaaatgtaattccttccctgagcaaccctgaagtaagcaagcatgaaagcattttcacagtaatctgggaggaattgacatttaaaggagttagcattacatctgtactttaaagctattaatttcatagataaattaacttcattactccatctttatcttgcattttgaaaggactccatcagctggacgactgacagccgagggtcaactgaaactgctcttatcccagccaggttgtaattggaacctgcttctggaaaccctactgcatcacgatggtcttttactaagaatcttgctaaagagctcaagtgagtatttgtagttttgagaatgtcctgaaaaaactcagtcattgttcaagtcgaatggaatgttttttcctacttgaatgttggtagggcacgtgataccaactgtgttataccaataggcagtggggttagcagcagcaaaaatattgaatcactttataaacctatcagaaaggtcttctttcagggatagtctgaatgagggaaaatgatatttttatatgatactgttctatcgtaactgtcataatataagagatgtgtcaatatttggggtttgaaatgcctaagaacatattatgggaacacagttatatgtccaaaacaagtctcagttagacctgagagagagagattacgattgtttttgacccacattaagcacttcagtggatcatgaaaaatgcttatgtaacttatgaacaagcaagtgtggcttgcctccgcgtccactggggcatggagaagtagtcgcgagaaaattatgaatggaaattgaggagtaatggaagcccatactt

SEQ ID NO: 49939 - DNA, 789 bp, Bovine  19866881727413
cataattattaaaatagtttcttaaaaatataatttgacatctcataaattgcttattatctccatttgctacataacatgcctgcttttttaaaagtgcttcaataacttaaacctttctaaggcagatgtactgttttccaaattactaaggttttactgtacttgaaaattcataagttaatcataacccataatttgtgacattatttagttctaatcgcaaaatatataattttatgacttttaaatcatgtgaaatatgaattctaagctacaaaaattgcttaaattaaattcattttcaattatcttgattttactgtagtattaaagcaagagatgcttaggattgcatgttgaaaattataaagagttcttaaaatgaaaatattttctggaaagagaggtgcactaaaaaataaagcaatgtcaatttggtgagtaaagcatatgacaattaattctgtttgcttgtcaagttacaatagtgtattctgactgatcctgtcaatttctacttcatacatacacatacataaattactaatagaggagttacaatgaagtattttatatattttatcaaaggggattttaatagctgtaatatgttaatatgagtacttactggatgtatatcaatattctagctcatataattatgataatcagaacttccacaataattagtagaaagcacagcagtctggggaaaagctatatatagctgagagttgcaaaaataaattgaagaagataacaagttcattttttcctgttataaga

SEQ ID NO: 49940 - DNA, 678 bp, Bovine  19866881748186
tgtattatcctaccgcaattccttttaacctacaaagtgaattttttgacagcataatttgatttccaagaaacagttaactattcaatgtcttcagttttgatatcaccaggcacagtgtaattccaataatgccaccactgactcaatccacatttgctataaaaacaattatcattctgaagtttgcaagctccacatcagcaagaggtgcgactggtgtggaagctacgtgataagcgcctgagggaaagagtgcctcacgtcactcaaagatgaccccttcctactgattaaggagcaccagtgacaggctctcatcaagttcatcacttaactgggaaggtgtgtaaatgcatatggattacacattccaccagtaattttttcatgcaaagttattaactttctataaaagaataaagaaaagtggcaaacatttcttagtgtttaaataaagtatcctagcattaatgcatttgcatttagctaggggaatgagtactgggtttcactaatactgcaaaagcaaacatgccacattctattcactctaaaatggtaaagtcataatacttcatcaaaggattaatcagacccttgtaatgttcacatttaaaaatgaaaagaataccaattactgcaaatttaagaagttaattttcttcaaaaggctat

SEQ ID NO: 49941 - DNA, 740 bp, Bovine  19866881748242
tgcgcatggtatcttgaaaatggaaaagaattcagcaactttgacctgatttttaaatgactactgtggtgactacagctgctgtagcttagtaattatttgtgataggttgtttttgagtcccatatgtataggagctccaggcccagctacctcatttgctggcacacaaacagattcttccaggtgctgaaaattaaattttaatatattatttaaatattaagagaattacagcttcagtaattttactgctacagctggagtgcaaagcatgcctgtagaatgcagagtgttggacaatctaacatataggaagttgacagtgattttttaaaaattattagcttatatgtttagtaggtgatagccttatttggcagttactttatagatgggtaactttgatttctggtagattgggcaccctttaaattcttgaaagctattattttttggtctttttaggttatgtaccttataaagaatgtattttttttaattgagtattaagaagtcggacacgactgagcgactgatctgatctgatagttgctttacaatgtgttagttgctgctgtacaataaagtgaatcagccatatatatatgtatatatttatacacacacatacatatatatacacagatatgtgtatatatcccgtcgtccttagattttcttcccatttaggtcaccacagagcactgagcggtgttccctatgctatacagtaggtt

SEQ ID NO: 49942 - DNA, 673 bp, Bovine  19866881828171
tagtacattttctatacattaaagaaggcaaattatcgtcaaagctcaaatagtataaagctctaattcattaatattgttttaaaaatcagaagatgaaagttgagctatattgaccatgtaattatactgtaaatctgtgtagcatgaaagtgaatgctatatttcacctgagaataagcactgaacaattttaatttttttctagtttttaacaaggttgagcaatgaatctatattttctaataatcttgtgtagattattcttgattattcctaaccactataggagttagaaataagaccagcccattgaattcataaggtggttctttgaaggattctaatagccagagatgtaaggatggatatgaacaggagggaagacgactgtattgaaatgaaaagcttgtattggcccatttccagggaatacgcacattacaccctgagtttgctgctgaatctgccatttccttcttggatcacataggtatgaagacctatttccgaaacagctcatcatgttacaacgcaacaccaatagttcttgacttaatccttgactaagagaatcaaatccaagtcaaattacccaaggggaggaaaatcttttacaggcatactttaactcagaaaattgccatatttttgaagcttgccattaactcca

SEQ ID NO: 49943 - DNA, 765 bp, Bovine  19866882047297
aatatagagggcagtttaaagagtcctgcttccttaaggcctaggtgcgtatgtttttggattcagtcgtctcaggaaataggcaataactctggttcatattgatatgtcctgagacgcggaatccaatctcatgccatatacttcgttttttgctacagtataatttccagagcagaaatttccgttggcaagtgtgtagaaaaaggtaaggcagcagcaaatggataccgcagcctagctcagcatcactgaagagccacctccatatgctttggttcagtgatgtgcctttgcacagggctatttagagcacagaagcagtaacaaaatactctgtactaggaatgctgataagacatatgctcaattttaaggatgccaaatctctcaatgtgttccgataagaccgccttaaaatgcatgcatctccttcattgccacacaactgagcactttcccacatttcttgacacctgggcagaccttttaaaaacttaaagcttccactgacttcaaacgtgatccacaagttggcccagtcaaagcagggatacttgtcgtctccttcaaagatatccattgtcagcagtacacactgaaagttcaaagtatacttcacgtaggcattccattcattttccctagaaataaaaaggtgttaatgtgagaacagacatttccttgttttaaaagagctaaagaacaatttttcccccttcaagtcattcacaaaagcaatacattaaaataaactgtctagac

SEQ ID NO: 49944 - DNA, 944 bp, Bovine  19866880472477
ttagagaagattccaggccctaggaacagggggtatgagggtgggtgatcagtctggcattccttttctacttatctgctcagaacaggggcagagaagacgctataatttagcctcacctgggacactggctctaggtggtaaaacccctgcctttagcactttgtattcaattattcaatctcgggaaatgattttagttccaatcccttcctgccagatggccagcatttcccaccccatccccagagccccacactcacgtgatcagcatggactggttctctcggtctggaagaaaggggaggagacagagaagttagccaaagtgagggaccagccacaggtggaacacctgggatatccttggtgctgggacagcccctccgccacccagagccagaaatgggaaggaccaggtgggaaccttcagactgcaggccagctcccacttgaagacacagaacgactatgcttcagtgtccagcgggatggaaaagagggcagtgcgagtggagggaaggggagccgggagccgggggaagggtctcaggagagaaagaggactcagggagaggagtcaaggcagcccttactgcgcagcatgtcattgtaggcgttatccgccaccgcgtatatgtggggcggggcctccgagcggcgctttcccttgtaagctgctaccacggaggctgtatagacagggagccatttgtaggggttgatggtgacacagaagaggcccgagtatgtctggggagagagagtatagatgggttattggaggccaagttcccgtcctcaagctctagccctcgcaaaactatgatctttgcaaaaattctccaaaatgagctgcctaaggtgcgacgccacacctctgtggccgtcctggccccgccctagctctcactcctgccctcagccctgtggtcccacctcca

SEQ ID NO: 49945 - DNA, 1997 bp, Bovine  19866880506503
gacgctggccaggccgagaaggagaagcagcccggagaataaggtgtgggtgcggggtggggtggggaagagctgtggggccaggcacctgcaagtcccacacctgtgtggccctggacaggtctcatcctgtgagcctcagtttcctcctctgtcaaatggggctaatagcagcacttccctaattagggcgggtgaggattcagtgtgtaactaggctgtgcgagcactcgccaccaagcctcacacatagtaggtgctcagcagatgctcggatcgtcatccaccagctccatgtgccccaggggccttccctcattgaaccctctcgagagcccattggttcacactctggggggactgactccatcatacaggaggggaaggtgaggctctgggggagggtgagctgcttattcaggttctcacaggtgctccctgaggaagccaggagtaagaacagctgcttaaacacccctgaatacccaaatagctggcatctattgatctctcagtgccagccagacactggggtagggctcagtaatccctcgaggaggaagttacaaccatccctgaaggatgaagaaattgaggctcgggatgaactgactcacctgaggttccctggctggaaggggcagctgctcaggccagagttgggggaggcagccccacagtgaccttggccccgacacaggtgaagaatctgacggaggagatggcagcactggacgagtctgtggtccggctgaccaaggagaagaaggccttgcaggaggcccaccagcaggccctgggtgacctgcaggctgaggaggaccgtgtgagcgcgctggccaaggccaaggttcggctggagcagcaggtggaagatgtgagttggggccacagcagggggctgcatggaggggccgggctggccaggacaggggggagcccacccaccctgtcctgcccaacagctggagtgctccctggagcaagagaagaagctgcgcatggacacggagcgggccaaacgcaagctcgagggggacctgaagctgacgcaggagtcggtggcagacgctgcccaggacaagcaacagctggaggagaagctcaaaaagtaagtgtggggagggcccagccccgacctcctgccgcgggggcctcctgagcctgcagcccgcttctcgtcgcccccaggactctagtcagtgttgcatcacagcagaggttgaaccgtagggtgaagggggcccacttagggccaggctctagggctggggcttgagagggaactctggggagatcttgagggctactccaggcacagtgcctcagcacagcatgtgtgctggggctcccagcaggttggcggcagttaggacctgggccggctcatgcccaccctctcccccaggaaggattcggagctgagtcagctgaacctgcgggtggaggatgagcagctccttggagcccagctgcagaagaagatcaaggagctgcaggtgcgtgagggacgggggcgggcgaggacccggctcaggggcccatggaggtgaccctgctgcctgcctgcccgtccccaggctcgggccgaggagctggaagaggagctggaggctgagcgggcggcccgggcccgcgtggagaagcagcgggcagaggcggcccgggagctggaggagctgagcgagcggctggaggaggccggcggtgcgtcagccgggcagcgcgagggctgccggaagcgcgaagccgagctgggccggctgcggcgggaactggaggaggcggctctgcggcacgaggccacggtggcggccctgcggcgtaagcaggcggacagtgcggccgagctgggcgagcaggtggacagcctgcagcgtgtgcggcagaagctggaaaaggagaagagcgagctccgcatggaggtggacgatctgagcgccaacgtggagaccctggcccgcggcaaggtgtcggcctccttcctaccccgacct

SEQ ID NO: 49946 - DNA, 2165 bp, Bovine  19866880550679
acttacccagtgctcagaatccaggctacccactgcccaaaaggaatcccatgctgcctggtccccgccctcagaatccagcttgaccgcccctgtccaactgctaccctgacagacgctcccccacccctggggggtcctgcacatgtatgctcatcagcaactcacgtccgcacctctgtgctcacccaatgtcttccccaccgtgctgtacctgctcaggcccctttccaggcccagttcccctgccaccatccagctttcagcactggctggccctgcaagctacattggcagctgcactgccttctcttgggctcactggtacatggattataagtagcttgtgggtaggtcctgggtcgaataagctttgcttttgttaactcaggagtgcctgccacagctctgagtttgagagttaaagtgaacagcaatccctccgtccgggtccactggggtggacgcttgtcggctctgacacataggaagtagagaaaaccatgaactcaccgcctcctcagcctggcgcttataggccttgaccttcagctgcagcttgtccaccaggtcctgcagcctcagcaggttcttcctgtcttcctccgtctgggggcagatgggtggaggaggccagtttgggggaaggagcaagagcaatcatctttccctccctcacgaccccattctcttcccatgcctcagctgcccctccctcccatgggccaggccgaagaggttgtgcacaaacttcatctctgatgagacttataggccaaaggtctcacaacaggatctaaaaagcaaacagggctgtggccctgaggtaagaaacaggagaggcttggaaccaaacgggatttcttcatttgataatgtggagacatcagggctgttccagatctaatccggagcaccacagatgctctcagcagtgggtctagagtgaccagagaggacccaggaggaaagcagaaagaagggattatcataatccatatcattctaattatcacaacccagtatgtattgttctgggtcaggtattgagcaccaggatcaatggttcctatgtcgcttgatcactcctgatcactgcttctgctaggatgctatttctatttacacccacacaacacacctgcagttctccatttgtacctctttcccatgcctctcatatccagctgtcaaaatgaaccaacacctctttttttttgtccttcctgcccaggcatattggaaagtaagaacaaaagccctgagctatgcagatggaaggcttagaacattctggaatcttctttctctaaggccttctatctgttgtcccaggagttccatggaagatctgagtcttttcccatccctgattttatcactaaatgccacacaacgcccctgcctctgaggctggtggaaagatgccttggacggttctgaagccttcatggtagcacttcaggttattaaacatctgggaaaattctggttcaggagctttcaagaagtagaagcagattctccctttgctaaaaaaaaattcatagactcaagccaacttgtcttcagagaatgtgaaagaaaactaatcccaagacagcttttcaagaggcaggtggcaggagggctctgcgtggggcccatgtgggtcaggaggtggggcaaggggatacgttttcacgtctacttctaagggcgtggccacagcgcccgcacctggtacgtgagctccttgatgcgccgctcgctcttcctcatgcccttgaccgactccacgttgcgcttctgctcggcctccagctcgttctccagctcccgcacccgggcctccagcttctgcagctgcttcttgccgcccttgagggcgatctgctccgcctcgtccagccggtgctgcaggtccttgatggtctgctccatgttcttcttcatgcgctccaggtgcgactggtgtcctgctccttcttcagctcctccgccatcatggcggcctgcaaacgggagagagtgtaaaagaacagggcctggggcggggggagcctcttctttcccataagagtcacctctttctcattctgacatttggtcctggaggccctcaagcccacagaatggcagagtcactgttgttacagcacagtgccctggcctggacccagagc

SEQ ID NO: 49947 - DNA, 1636 bp, Bovine  19866880621272
actgaacccactgaacacatcagttttcgtttaacagcagctttctccatcctgtcttctagggacggccaggagattgctgtggtttacttcccgggatggctacatgccaggccattacagcctacaggttggtgctttccattagcccactctctgcctcctgggacccaccactgggacccacacaaggatcgtaacaacctgggtttttctctgggccctggcttcagttcttccttggggaacttccttctcctcccacaaggctttttgctacttctcactccctaaacacacacacggtctgccagaatctaaatcctcccgaatccacaacgcttcagccattcaccttagtttctagggttatgctggtaaatatgtaaccataatctctctgtggaggcacgcccttatttatagcatttgctgatttctgttgtaactactcccatcatgaccaatttcaaagctacccaacttaacatctctgaacagaattgggaagagatgggcccaatcagctctcactagccaatgcaaaccagtttcactgcaccattgaccagttccttcttgccagctcttttttctgttttatctgcatccaaaagtttttatctgctgtccattcatactaaggacactaatgatatcaccttagcttactatcttaccatgtagtttcaaaattgcattccacatctactgtttcatttaatccttacaccgtatgaggtgtataattatccccatcatatagatggagaaactaagatttgtaggagcttatctaaggtcccgcagggagctcccagactttctgactctcagtccagtgtctttcctagcatatcagtctcttcctcctgcccctgatccacagcatggagaagctaataggaagcccttctttcagttgggagaaggtaaaggagaaaataagttagaaaataccatgagcagtagtctggggattctgagcgtttgactccacctttgggtgaccatgggcaggatcctgcatctttctgggctcagcttctgtaaactgagaggactatactagaaaactgagggaggtccttccagatctataattctttgagtgtaagatcctctctgaggcccagcctgtacagggagcagctccacagaggtggcagctctatagaaggtcctttcctctagaaagtggttagtggtaagaacttgctgactagagaagagagaaactgtctattgggaaaaatggatccagattctaggataaggggcttgagggaaagggccaaagaaaactttatttagagttaacaggaaggaaattaatgcgcaaggagaacgtttttagggaactgagaaactcagaccaggtttagacatggagacaaatccactaggcttagtgacttgctagcagatggtgagcaagccccctgctcatctctgagttttgctttccctcctttccacatggggtacttccctgggtttatctccgacatgcagggtacctttagctctacccagaacactagcttagttgttaagtgtctgcggttattgatgaagaccaggcagaggtgctgcaggtgaacatcagaggagggacatcacgtgtgggggtgag

SEQ ID NO: 49948 - DNA, 706 bp, Bovine  19866880756950
acctttcctgttcttctgttagcagattccttcttttccttgtcaacctcccccaagtcctcagatacccccaggctgggctcttcagtcctctccctgtatcccctcactcaccctgttttcggagaacattgctgaaccgacacacttggaccagaagctcttggtatgtgatctgggtggtttcctctggctcattgccctccctgagatgtatcagaaagagccagtcattagggaatatgacttcttccccaaacaaacaaacaaaaataggaacagtcataaaatccattcattaacaccaaggcctgggaatattctgtgagggtgagccatctgccaccacaccttgagctgactgatcagatacactgggcttacaagatatactttatacacaacctgtgtatcactggaaaatgcactgccatctctgaacctcatttgataaaatgggatcatggtcttctctcttccattcgaggcatgtattaaggagaaatggtatcacgaatgtgattcttcctgaaagtgatgtcagcattgcactggtgttattcaaagtggggtctctagattacttgtacccaagtcacctagggaacttgtcaaaatgtagattcctgagcccaaactcagaatcacaatcacaagatccaagaatctgcttctttactacaagtggtataaagaatcaataggt

SEQ ID NO: 49949 - DNA, 720 bp, Bovine  19866880769510
tggggatgtaatatacagcacaaggaatatagttagtaatactctaataacttagtatggtgacagatggtaactaggctttttgtgatgatcattttgtaatgtataaaaatatttactacattctacatacagtatagtttttatatagttctatattatataagccctatggaatttatagaatgttgtaagtcaactatacttcaattaaaaaatgaaaatctctccgcccgcccccccaaaaaggactaacaaatatatttacaacactctccagaaaatgggaaccttgaaaggaagggagattcaagtatcaagccctggggtctttgaagctggctaactttatgttcagctatttctccaaccataagagaaaaagtagatttgcaattgtttgtagttgtacaccctatctttgaatgaaatctcatgaaacaacccaatttgtaaaatagaaaaccacgatcatcaaaagccgatttattgttacagtttagtttcaaaaacaaaatatcatccagtggttatgaggaatctaggaaaacctgtcccagtaatgccagctttcgacgtaaaaggctgactagggcagctgagaagtgggattttctgcttggcaggcttcttttcccttgcctgctcatggttttcaggggagggagaatgttccgggccctgtttggggggttcccatggccccgagctcatagtttt

SEQ ID NO: 49950 - DNA, 609 bp, Bovine  19866880771074
ttgggagagaccaagaaattacctagtccatgcccctgccccgaattgtgtgacacaggataatgtcatagttaaatatgtgggggaaaaaaattgtggagactagaatcagcctgcctaggttagaattccaactccatcactcactagctgtgtgaccttgggcaagttacttagttcttggagtctatatcctcatctgtaaaatgaaaataattacaattatctcgtagttaggaggcttaaacgagataattcttataaaacttagcaccaggcctggcacatagtgagcgctcagtaaacgctagctggcatgattgttattattatgcttgtatccatgcaggtattatgcatgcatccatccaatcccctcccggagcttttgcttgcacatgtctgtgatgagcagctcatcgcctcccaagctggttgagcagctccgattgttacaaacttattccggtatagagcgaaatctgccttcttgcaacccttacccccgcccctgtgggccctagttctgtcctgtggggccacgcagagcaagtctatccttcctccacgtgacagcccttcagataggaagacagtgatcgagtcctt

SEQ ID NO: 49951 - DNA, 1221 bp, Bovine  19866880771700
cgggtggtggtcatgcagctgccgtggggccgtagcaggctgataggtgaagaacaggtatagacacatgagagatccaggcatggatgtaagggaagggcctagaagagggacagtggtaggaaacgtgagtgggtcacccagagcagctccagagaacagcctaaatgctgacacccggccaaggcagtccacacccacccggctattatacttcccagcttagttttggggttccccactggggatgggagtctcagcacccacagagattcaggagataagatctcgctcaactgcagaggggtctcatttaccttccttattcccttttctggggtccaccaccacgggtcctgtctacagaacgcctttgacgtgctgggcttcactacagaggagaagaactccatgtacaagctgacgggcgccatcatgcactttggaaacatgaagttcaaactgaagcagcgagaggagcaggccgagcctgacggcaccgaaggtgggagccaggggtgcagggagcagctatggagccatgaagccttcgtctgggaggaggcatcccttttccaattctcccatccgccctttccttccagaggccgacaagtccgcctacctcatggggctgaactcggccgacctgctcaaggggctgtgccaccctcgggtgaaggtgggcaacgagtacgtcaccaaggggcagaatgtccagcaggtgggtcatcttcagatgttaaatggcagaggggctggcccggtgcagccgtgggagctttgcaatttactcttcccaccactccctcattcgggtttctcccccaccttccaggtggtgtatgccaaaggggcgctggccaaggctgtatatgagaggatgttcaactggatggtgacacggatcaacgccaccctggagaccaagcagcctcgccagtacttcataggtgtcctggacattgccggcttcgagatctttgacgtgagtggggagcctagggtctgggagaacaggaactcactggttcacaggcagccgccgttggccaagccctggggaaggccgtgggctccccaggggtggagacagccacgtgtcttcagggggcactccctccctgccctgaccggagagaagccagccacacccattgccaggctggacgcagccctgggctgacccctcgggccacagacccctgcctgcctgaccca

SEQ ID NO: 49952 - DNA, 1583 bp, Bovine  19866880854205
tttgttgttttggtttaaaagcagcagaaatctttgttcaaatgaaattgaatgtagtcccacatctgtctgcagtacaggagacccggggttcgatccttgggttgggaagatcctttggaggagggcacggcaaacctccctccagtattcttgcctggagaatccccatggacagaggagcctggtgggctacagtccttggggttgcaaagagtcagacaggactgagcgatcaagtacacagcacaaggcctatagtcagtgaagagtagaactgctctatttgaagggaaagtttaagggcctagagttgctgcctgctattcctctctcctccataatgcagcctgagtgcttttctcatttattttctttgcttcctagaccgggaagcagaggcccagaaatttcagtatgtgtccatggccacctgaagccaaagctggggcccagggtgctccctgccttacgtaccctatcagtggcacagactttgccccatctcttagactctgtcatggtaatccaaacccacttttgacacgagcagccctccctccagcagtttcgagccccatatgactctggatgtgtttttggcctctggtcacttgtcagcatgcctgggcagtgaaggctgccctgagatgtgagaatgcatttggctgtttagttctgagactgcaggagtccttagggtgctctggacccaggtggagcaggaggacatcctgcaggtttagaaatgtccgcatgttctgttttgttttgccttttacccacctacatcagcaaagacacccagccccagggtctcaagacgttgttcttctgccatatggaatttggcctctgtcagcctctcaaatctgccatcaagatttttgtctgttttctttcaggagtttggtatgtgatgggaagaggggcttattaacacgtctgctgcaggttatgaagaaggagccagctgagtcatctttcaggtaggtctggacatgcacctcccactcctgagggtgcagaaaccaagtgtttaagctgttagaaatgccttctgtcatcaccagcttccaccccgcatagctggttattgtcagggagagggagtctgctggctccctggtgttgtacggaatctagcatgtactggattctgctgtgtgctggcagtgtgtttcaggaattgagccagcattcagcaagcacctattctgtgctgatgctggacaagcgggaagaaatgggagctacaatccctacccatatggaggcccctggcatgcaggaaataagcatgggaagacccctatgtgggggatgcggtatggaagggctcagagccaggacctgccctggggactgtgggagcaaaggaagggcttgtgggggagggggggtgcagacagggagggtgtcccggttccttagactcatccatgttgtcttagaggctgtggacaggacaacggctgagggaggcattccatcagggtgggtgtgagctgtcagcaggctccacgcccaagggttccctgtcagctcagcctaccttgtcccttgtcccctcacggatccaa

SEQ ID NO: 49953 - DNA, 1141 bp, Bovine  19866880923184
ttccggtcgccccaaaatggattcgaatgaatttcccctggagacatggagaaaagtggtgatgagttgagggagagctcctgtttgacacatcccttgaccaacccaaatcccaagtccaaaggcagggcccactcacgaagcgggaggagttgtcgttcctgacggtcttggcgttgccaaaggcctccagggcggggttggcctggatgatctggtcctccagggtgccctgcggaggtcaagaaggatggcaggtgagaggcctcctcctcctcctccctttctgcggtacaggcccttggaggacagtaggcctaccttgcctgtggcctgctcctttttgctgcggtcgccaatggcggcaatgaccgcgaagtattggatgactctcttggtgttgaccgtcttccctgccccggattctccgctgttgggacagtcgggcttattaggcagtgaacaaacattatttgagaccacaagcttcgagtcaggagagctttatttggcagggggagccctgcagcaggaagccaccagataatatgcatcccagccacaaagctgtgctctgacatacacagggtcaagggtagcaactaggaaagatgtgctagaagaagcggatttgggcaggtgggagacctgaatttgatctttgagttgggaagatcccctggaggaaggtatggcaacccactccagtattcttgcctggagaatccccatggacagaagagcctggtgggctacagtccttggggttgcaaagagtcatacacaactgagcgactatgcacagctcaatatggtcttggctgggcaaggtcaattaaaggagatgggcccaggccattttggaaaagaatgggcggggctggaagaatggggagggtttctgaagggaaaaatgaaggaaaatgaagaggggaagaagacatggtgttcccaggcttatggatagatgcgtgatgagttagaggggcatgagtaaagaagatgggagaggaaaaataagagggatggggaggagaaaggaaggagaggagaaaggaagaggaggagcaaggagaaggccagagaagacatcagagctgcaccagaaagtggagggaaaaagaactgggggtctgtgtgt

SEQ ID NO: 49954 - DNA, 1933 bp, Bovine  19866880932260
atcccggggccgactgccctcttcccctcgtctcctcatgttaataatgattgacatttgtagaattctttctttgtgccactgaactaagtgttttaaatgcattaatacatttaatctctagtcacctccatgaagcttcccaggtggcacagtggtaaagaatctgcctgccaatgcaggagatgcagaagacatgggttcgatccctgggtcacaaagatcccctggagtaggaaatggcaacccactccagtattcttgcctggaaaactccatgaacagaggagcctgatgggctacagtccatggggtcacaaagagctggacacaactgaacaactgagagcacacacctccatgaaatagatcctattgttactctccttctaaagatgaagaaattgaggctcagagaatttaggaataaatcactggttcgaggccacactgcaagtaaagtgaatttcaactctagcaggctgattctagagcttgagttccatgagggtgaattaatatacaatgagagagtaaagagacaatgtgttaaaaagagagaaagacaaaaagtaagcctgagaatgattaggatgggaacaaagccatctctgccttggttttgggcagcctggctaagggtactggaaaaatgtgtaatgatttgttggttacagttagagaaaagattggccccattgccacaccggattacatccagaatgcacctggattgcctaaaactcgctcaggtatgttcagaggcctctagggattgggattggatgggccaaggcccactaggggcgagtatgcatggatggaagcttttggcagggccggagtgggtcagtgtgttgtcaccaggtaaccataagcgtgtggacccccagggaaaatcatgaggcgggtgcttcggaagatcgctcagaatgaccacgacctgggggacacgtccactgtagtcgacccatccatcatcacccagctcttcagccaccgctgcttgaccatccaatgaataagatcctgcctggaacccaggattaccccctgcttggctttccaaagttttgcccaccctccctgcccccatccaggagtgctgagggccagtgctgacccacaacacttcccttgtccagctgtctgggaccgaggaccatctttgcttctgggtggaggcaacttcctgcgaccaccaggcagatgcgagagggcccaggtcagcctcaggctgtgcccctagactgcaaagagcccttggagccctgaagggacctgaaggtcatgtcccaaacccaagtgttcagtgggcaaatgagggcatggactgaaacagggaagcaactctaatcctatgtcatctctctcaggaagcaccagtacttatcttgggcatgcacttgccccgagaaatgcctgtttgtgagtcctggaagaatgattattttttaaaacgttttgttgcttctcttgtgcgtctgaattcccttttgtaccggatggcagtgcctgtctgccatctgttccaggggctctgcaggcagcctcagtttccggagggctttcagatcatttgtgtccttgaaggaatacctgtgttatgctgccaggaccagaggagctcacttttcttgtcctctgttcccagcccccctgaacagtcttgctcatgagagatgttctcagatgaagctcttttttcctacccaagttgtactcaggccctgtggttgtaggaataaagtctgtgacttcatgaaggtggtgacttgctttctcagtgtcttacacggtgcatacttactggctgctctgatttgtgtgggggatgggaaggggagtgattttcctcaggaataccccaatattccttccagaattttgggtctaggcagtcctaggcagggcaatgctggagacccaggtt

SEQ ID NO: 49955 - DNA, 1688 bp, Bovine  19866880968052
ctagttttatgacggaaattgaagctccaacaaaaaaaagttacctgcttaagctcatatagcaagttagtggtgctggacagtctgactctgaattttttttttttttttggccactttgcacagcatgtgcaatcttggttccctgaccagggactgaatccacaccccctacattggaagtgcggagtcttaatccctgggccaccagggaagtcctaaacagtctgactctggagccatatctatcagaccctcttctgccaagtttcctcttttttatccccttctcccctcctccatacactgaccctcccaggctttcttcttgctgctctttcctctctcctcctcccccaggctcacccaggtccagagcccccaccccctctcattcatatgctgagcatagtttggaggctggggataggtcaggtggatggtgacctccaggggtcagctcacaccctagagagtccttcagcccttcctacttccacccaggtgcctggcaaggaaagtcctggaggggcccaccagccagtcctcttacctatcggccatggccaaaatgtgtgtggcctgcaggacgcggtggacagagcgagcaggacccccctacctggtagagaggccagcgtgccagggaggggggcagtgctgggcctctcagggccgggtgtttctggaagctgatatgagccacagcaactgctggcattatctgggttctaagaatagcctgggctgaagagttggggggcggggccagggaagagagcaggagcctttttccactgcccccctccacccctgctgcttgtcctagaaactgggaagccttccttctggcttaccacgtgctctgggatgattcctcatggatacaccttgcccacctttgggtggaggatagggggcatcccagggattcagacccagggctgagagcactgagtccacactctgaggtccagccttccccgaggcccttcccatgggcagagtaggggcttgctttttcaaggactgatgttttggaggcaacctttattcattcagcaaacaataagaaacaggtagacatgattcagaattcaaaggtacaaccaccatgtgtaaaacggatatctagtgggaggcagctcagcttggtgctctatgatgacctagaggggtgggttggaggcaggtgggagggaggtcggagagagtggatatatggatacatgtagtgattcactttgttgtactgcaggaactaaggcaatgtcacaaagcaattatacttcaataaaaaaaaattcaaaggtgtaaaaggatacacaaggggaaaataccagtctctccctttcctggcctctagccacctagtcctctctgctcctcacttttctcacttaatgaaatatcctgaaattacagtaatgtaaagcacagtaatatattatgagaggaaacccacatgtcacactgtgagtctccactacgtgccaggcactgttctaaacacttcagatgctctaacccgtaaagtgctcatcggaatcctacgtggtaggtaatttgtctgaatctccattgttaagaggtcaagtattcttccaagacttcattgctggtaattgatcagagccaggattcaatcccaggcagtctgacatcagacaaggtattcctcatcactg

SEQ ID NO: 49956 - DNA, 1533 bp, Bovine  19866880968249
gagttcagagtctcataaatacagtaatgattggagcccaatattacaagagggcttccctgctggctcagttggtaaagaatccgcctgcaatgcaggagatcccggttcgattcctgggttggaaagatcccctggagaagggataggctacccactccagtattcttgggcttccctgtggttcagctggtaaagaatctgcctgcaatgtaggagacctgggtttgatccctaggttgggaagatcccctggagaagggaatggctacccactccccagtttctggcctggagaattccatggacagtccatggggtcgcacagagtcagacacaactgaagtgacttagcagcagcaatattccaagaactacactgtctataacaggggatttagggaatacagaagagggggaaagtaccgggctagggagtgaggtaagtcttccagagggaagactaaggtcttccttagggagacttcctaagggaagactaagcctaatttataggcttaaccttaaaataatgaaagatttttgccaaactaagaagtatgccaggcatacagggggaaaacatacaaaggcatgacagagattcagcactgggggaagcacaagaagtattgaaaccctgtgccaaaatttagaatgaaaaacaggttgtagatctctgatgaaagagtaaagctgttgctctcttggggatgttttaagactttattattctgactattttgttcttaatcagtcagatggatttcatcacaaggcagtaaagatgtgacagcctccttggtgaaataaataataacttatttatagtttctggtctgcctccttcccaaaatgatttgatttgacttgtcataacagacacagccacaataagatgttcatatagaaacaaagaaacaaaattatgaggacttccctggtggtccagtggctaagactcagcgctcccagtgcagtggggaatgcagggggcccaggttcaattcctgatggaagaacagaccccacatgttgcaacttagagttcacatgctgcaactaaaaaaaaaaaaagattccatatggccacaatgaagatggaagatcccacgtgccacaactaagaactggtgcagccaaataaataaataatattttttaaaaagaaacaaaactgtagatgggaagagcattaatacagcttcttaaggtcttttctcttcatttgctcacttggtgttcaagataatcttctgaggatgggcggcagtttccatgtgacttagagacgagcgtgtacgtgcactctctacaggacatgcttgtgggctccatagatgcacggatgttttcttcattttccaattaatgccacagatatttcccggtcctctaatttctagctggtcagtgaaaatactcatctttacttttccaaccttcagattcattgtctgaacttcttcatccaagctactttcagattctcttgcccttttaaagtttatctcctttttttttttaagactc

SEQ ID NO: 49957 - DNA, 704 bp, Bovine  19866880978641
cccacccccactaaaacaagagtaaaaagatggaggtaacagagaaaaactacatcaggaatttttctgaaattgagatttagctcggagcttcctcaagacacagtccagcacctttcattaacacactgtcagatcagccagtgaataagtaaactagcatagctccaaaagaaaggtaggtttcaatgtctctcaggaaaggaaaaggtcagtagttggcaacagggaacaggctgacttgcattcaatgagacaatggatgtcggtgtgctttgtaaaccgcaaaccattggatagatgttatcatttctgcaggtaaaggaaaaagattcccttctttcataaattaagttatcctataaacactcatgaattccagcttagtatcagataactggccacagtgatacagaaataaataaggctaacttccaacttttgctaggaaccagatggggaagggcagtgacctctgaacctagggtgaagagtaacataggttatattttgtcttctctcatctagattctttcaaaaagtgatttaaataaacttgaaatagaagcaatgccacctgaacttggaatacagatgtaaatgttaggaggactaagctgaggacgggtattattgaacaggatttgtcagagcaaaaaaagtaaaaacactcgaggcaggacattttatctcctagaaaagaa

SEQ ID NO: 49958 - DNA, 2742 bp, Bovine  19866880984062
ctgacttcaaagtcaggctgtctcctcatagtgtgaaggacagggactagcagggaagccaggtctttggcgatttcacagaagattatcagcttctttccagctcctggctcaatgagttagttactatcctctcattggcttcaccttcctagagctgacaggagaaaagcacagagctgtttaaagtgggaaggaactgggagagaggaagctggcaaatggccctgaatgccggatgcagaaaaagtcacttccttaattggctcacggacaagtggcaaacaggaacatctctagttacagttaaatgctgatgtacacctcacacccatgcatacgtgtccccatatgtatgctgacctatgtacccctgcatacataaaaacatatatactaatataaaaaacattgtagacataggaactgctcatttgcacacataggaacaaacagcattaatatatggatataggactcgaacatgggcccatctgcaagtatatgcaccacacacgtatgtatctacctacgtgcaccttccagaaactctctatcacattatcctgttttattttctttgtggaaccttctatgatttgaaattagctcatgtattttattcacttgtgtattatctgtatctttcactggaatataaatcccatgataacaatgaccttgtctgtcttgttcattgctacatccctagcgatgagattcaatacctagaatagacactggtacatagaaggtgcacaggcacagataagaacaaacctatacaagaatcagagaaggcaatggcaccccactccagtacttttgcctggaaaatcccatggacggaggagcctggtaggctgcagtccatggggtcgctagagtaggacacgactgagcgacttcactttcacgcattggagaaggaaatggcaacccactccagtgttcttgcctggagaatcccagggacaggggagcctggtgggctgccgtctatggggtcacacagagtcggacacgactgaagcgacttagcagcagcatacaagaatacgagaacagcttacttgagcccactttccagttacacacacacacagagtgtacatctctctccctgggctctgtgctcaagttatacattattgatagaggcaccttattcctttccagtgtcttctttctctgacataaacacccggctggggccacggctggttgggagaggggagggagcacgcatgcacacacacacatgtgcatggggacacacacatacccccaaaatgtagtattactcagccataagaaaagagtgaaaccttgccatgtgtgataatatagacagacttgaggatattatgctaaatgaagtaaatcagagaaagacagacaccctatgatttcacttatatgtggactctaaaaataaacaaacataatgaaacagaaacagattcatagatatagaaaacaaactggttgttgctgggggcagaggagagtggggaatgggtgaaacaggtgaaggagcttaagaggtacaaacttccagctataaagtaaatgtcttgtggatgtaaggtatagcatagaaaatatagtaataatactacaactttgtatggtcacagatggtaactagacttattttgatgatcatttttgtaatgtataaaaatattgaatcactatgctatacacctaaaaccaatattgtaagcaaattatacttcaatttaaaaaagatgactgaagtgacttagcagcagcagcagcaggtgaacacatgtacacccatgtcggatgtcagtgtatggcaaaaccaatacaatattgtaaagtagttagcctccaattaaaataaataaatttatattaaaaaataaaaaataataaaaaaattttaaataaataaataataaaaagactaagtgaaatatcagtacgtaataagcatataaaatgaacaagtgagtgcctataatataaatctctacattttatatattcagaatatttcataattttaaaatttgaataaaataagtaaataaaatattttactatatcaaaaaaataaaaagaaaaaaacaaacagcagcatgtgcacaatgacacttagttttagggggaaaaaatagagaggtgcggggactggaaaacttgagaatacgtgctctggaaaggaggcatctagcacttaaacgcagcgcctattaccttttgccctctgggaataaggtctcaatactgcccaatttttcagtttttcaagagagacctggaatctgtttctgaatttttaagtttgatgcaattaactttaaatttaaacactgtggtcaaacaaaactattaatcaaagatttagctgatgggctacggattgggaaccctgcagcagacccagctacttcccttttacctggcagccatatggtatgggacagctcaaggcatataatcttttttttttttttaattgtaatgttttatcgggtctatgtatgatcttttttactttttttttcacataccaaagaatcgaaatttttatatctcatatactcttcttttttttcttatatgatattatacatgttttaatgccattctcccaaatcatcaccccctgcacagagtccaaaagactgttctatacgtctgtgtctcttataatctttttttaaaggaaaacttctacaactagcttatctttacactctccatatt

SEQ ID NO: 49959 - DNA, 834 bp, Bovine  19866881048669
tgcccatctgttgtcttcccatactatcctgtgatctattattactgtacagaccacactgtattgtaattatatccatcccccagccagcctaaaagcacctttggtgattcattcagcagatgtttattaggcactgcgccaggcacgagggatgcactgataaactaggagctcttagtcgggtgcagagtttcggaaggcatgccaggaaacacgcgtccctgtgtcatggtccaataactttggggattagccactcatcatggctccccctgtagtgattaggtccatcttagtattttaaaagctctgaggagtcctgtagtaaaagaagctatttacttcgtccaatccaagtctgccagaggttatcagtatttgctgaatacatgtgagtcatctagacagttctctcaactccaatttgtgctttggtccccagctcaagaggaggtccaagtgacactgtgatgctcagagactgctctgggagtgaacagcctctggctgcttaggggccggtgggcttgctgtccagggcccccatggagacagggggccctgggttgaacaatatgaagccccagtccctgcagctggtgctggaagagcaagtgctggcactgcagcagcagatggccgagaaccaggcagcctcatggaggaagctgaagagctcccaggaggcccagcagaggcaagcagctctcgtgaggaagctgcaggccaaggtgaggcagccactctcttaggaaggggaagaggaggacccctggggctgggggctgagaggatgaggttggccggagcccagagccacacggggcaaca

SEQ ID NO: 49960 - DNA, 1947 bp, Bovine  19866881054569
tccttcacgcgctgcccgggaccagcacgaggcagatgtgcggtgtactttaaatgaggtgcctcaaagaagccaatcccatccaaacctctgggacatttggcatcaagtctccatgggcgttgcccattggtttggtttagaccctctgaggcctctcctgcccccaggccctggtgccccaggattgtgggaggcctgcacaaacccccggatggaaggcctgttcccctggaacaatatttgtctcccccaggatggaagaggaggacagaaagtctcctcggatgccacgcacatggctgagctgcagaaagaggtatgttccagaaggttccatcttctaaggctctttccctccctggtactcggacagcaaggctttggtgtctgctatgtgcttggtcccttgtgcctgtccagcagggaggggaagatagttcgtgcctcaaagaactgcagaccccatgggaggcaagcagagccgtcccagctctacctactacactgagtgcacttaacctctcctatgcttagggtgggagcggggaagaaagtatgctccaggccccagaccacctactgagaaagggaagggaagaaggctgaggagcagacagaggattctcacaggacagcctgaaccaagcagaagcacccgggcctcctccgccctcacatgcacgcttgcaggcaggactgtcatcagcacaccaggcagagcagcctggcacaggcgccaggatccataccccagagctcaggtcaagctccaggaacctgtttcaagtgccttcttgcctctgaggtctcacctgaagattcaccctgtcttgcaaggcccaggagtaattaaaactatgaagttctgatttcagaacctgtgccagaaatcagtagtcactactggaaggccctgactatacctcaagctctcgctttgaattctgttagactcatataaagtgatcgctgagacaggcccagactaggatgaggcagggcaggcctccctttggacctggagcacctcctgaagttttgcactcgacgaggagcctctcttgccccaccctcatcctgaatgtgccctgagctcccaataactccacctcagtgtacccatctgagaaatggatcagtcagtgattctcaacccttatacacattagaatcatctggggagctttgaaaaaaattactgatgctcaggcctcatcttgtctagttaagtcagaatgtttcttaaaatctcccaaaggggcatgatggagctttctatagcaattaaaccgttctgtatcttgattgagatagtagttatacatgaatatgtatgttaggaaatatgttaaaatgtacttaaaatctgggcattttattacatgtaaacacatgaatagttttgtttttttacaagctccctctttgagcctcctgtgcagccaggattgacaatcactggattctctgattcccaacagcccttgccctatatactgtaaagcctaatcctgagattcatgggtgtggagttgattcaaaggctggtctgacaagagccacaggagccaagcaaggagggggtgggcagcttcagggtcctccatggctcttgccctcttggttttcctgccccccaggtggccctcctgcgagcccagctggccttggagcggaagcagaagcaggactacatcgcccgctcggtgcagacgagccgtggagctggcgggcctgcaccacagcctctctcactccctcctggccgtggcccaggcccccgaggccaccgtcctggaggccgagacccgcaagctggatgagtccctgactcaaagcctgacatcgcccgggcccatcctgctgtgccgcagccccagccctgctcaaggcgcctccaggtagcagccacagcctgggagcacgcagacagacaagacggcg

SEQ ID NO: 49961 - DNA, 710 bp, Bovine  19866881111043
ccccgacccccacacacaggccctgccctcatcagtgctctcaacatcctcgagggcttcaatctcaccagcctggtatcccgggagcaggctcttcactgggtggcagaggtaaagctgaccccttcgctccacctgggtctggagacacaagagtcgggggatggggtgctgccataaggcctgactaaatcacctccaagtttcctcacacaggaagatcctcgtgtgggtgctgggaggggcttggcagcctcttcacacacctgctctgtttacagaccctgaagattgcattagctctggccagcagactgggagatcccatctacgattctaccatcactgagagtatggatgacatgcttaggtgggcccccaggagcaggaccctgagtactacagaggtggcggcaggtgtggggaaaggatcaggtgaagcagctggtggagcagtaaggcctgcagtcccaagtaaatgtcagctcaaccccagctcacagtgtgacgcaagttgcctcactgtgtgcctcagtttccccatctgtacaacaaggtggcctacttcatacagctctcaaattttcttgatcccagtgagtgaaagttgctcagtcatgtctgactctttgcaaccccatggactgtagcctgccaggctcctctatccatgggattctccaggcaagaatactgaaatgggttaccat

SEQ ID NO: 49962 - DNA, 1358 bp, Bovine  19866881113585
ttagagcctgaatgtctccacatcgttctgaatttgccttagttgattttacaattatttttcagagactccttggttatttcttttttttttaaagactagaggaacaccgtgcttggaaaggctgggctgggagactaacaaaggcagtattatactgtgcacggcagagccaataaatgaattcaggagacacctagatgtgtttctagaggagggcatgagggggaggggtctggtgcaaaggcagaaaggtgggattaagataaattaaaatggggccagcatgttggatcaggggacagcctcttcctgttcccaccatcgcttaagatttttcattctgcttcgtttgaaagttaaaagtagtcttgaccatataacctcatactctcccatcccccactgtctgtttaggaaaagaacttaagtctaagggctatttcagcctgatacagctatgtttattactggagtagtacatctatgagacattcctggggaatcttagactgttaaaactggaaaagaaccttgaagtaatctaatccaggattctcaaagtggcctccaaaccagcggcctcagcaccacttaggaacttgttataaatgcatgtttagggctccactctggatctgctgagcgagatactctggaggcagggcccagcaatctgtattttaaacttttaattttatattggggtatagtggataacaatgttgtgatagtttggggtgaacggcgaagggactcgaccatacatatacatgtatccgttctcctctaaacttccctccaggctgccacgtaacattgagcagagttccttgtgctatacagtaggatcttgttggttatccattttaaatgtagcagtgtgtacatgtccatcccaaactccctaatccctttcctccatcctttcttcccccttaccccacccccccgcaaggcaaccataagttcattctctaagtgtgtgaatctctaagcaatcaatattctaacatacccttcagtctgagggctactgctcaagtctgatcctgtcatttaagtggtggagaagctggctctgggagagctgagtaagcttgagttagaaaccagctgaagaacagaactcagggctcctgacggccagctcttactcctctccctgtgaagaagagcaggatctgggcatggactagtgacgtgtgaaaggggagggtttcagctaatgcagaaagagttccccaatagtaacagctaatgtttactgagcactttctcttggctgtgcattttttaagccccatttcaatttatgtttacaacagtctagctatagatcccatcctcattttaca

SEQ ID NO: 49963 - DNA, 1156 bp, Bovine  19866881145805
catacaactactgaacacaaagtaggttctcaacacctccacttccacctgtctctgttcctccactcattcttcacttatcagggcctccaagttgacggcgagactgaggtcttcttggggaaatttacctttgacgtggagaaatctgagattcagactttccacctacaggtatgttggtctctgggaggtgaagggtctaagagaatgggacagtaagggaagataagggaggaaggcagccccttgggagagcagacactggcatcatccatttttctctccagaatgaccccccagctgcctttcccaaggtgaagatccagattctaagcaactggggccaccctcgtttcacatgcttgtatcgagtccgagcccatggtattcgaacctcagagggggcaggggacagtgccacagggggcgcccattaaacatgctgattgttggagtagagtggaagtctgctgaaagaagctcatcagtgctgggaggtctgttgtgggcagggaggctggcactctagttgcctttggtacataaatgtggtggggggcgtctatcaaagtgccttcttggagaagcccagatcagtacagcagcagcagtagttagtgtgtgtggagtgtttaccatgcacctaagatagtactctggatgttacatgccttctctaactaatcttcacaaccacagagggagaaaccgctcagatcaggaaagttgcaaggtcacacagctagtgaagacctgagccacagtgggaccctgagcctacctttctctgctgctgctgctgctaagtcgcttcagtcgtgtccgactctgtgcgaccccatagacggaagcccaccaggctcccccgtccctgggattctccaggcaagaacactggagtgggctgccatttccttctccaatgcatgcaagtgaaaagtgaaagtgaagtcgctcagtcacgtctgactcttagctaccctgtggactgcagcctaccaggctttgccatccatgggattttccaggcaagagtggggtgccatggccttctccgacctttctctggaggttgccttcttgcagagccaccagtcggcatgaagctgtgctgtgcccctcacttttcaccccaactcttgctaggtgcagg

SEQ ID NO: 49964 - DNA, 1681 bp, Bovine  19866881249581
ttttaagtctaaattttaacttgcacagaacattgacattactacatctgcctactggagaaggagcaaagagatctcccttgtttcacgttttctactttcaggaaataatgtgttgtagcctcaggtatctgtgcctgaggccgtcctgagatgagagaatgtctactgtttcagggaagctgtgctctcattctcagtgctgaggggggtgggatggggtcacctggggccacacgtgttctttccccagtgctcaggtgctactgattgctcaagagaaggaaaggaacatatttgaccagcgtgccatagagaatgagctactggccaggtaagtaaaggaggggagacctgcatgtgtgtggcccctgggttgcagagagccagtcagaacagagcagccagtctctctaacccttgcccttcgttctcaggaatatccatgtaatccgacgaaggttcgaagatgtctctgaaaaggggtctctagaccaagaccgaagactatttatgtaagtgtccaaggagcattcccaaggatccagtagagggctaatttgggaaactcatcctgccgccctcttccccttaacgaccctttcttctgggagatatgatggcttgcttccttctctctgaattttagggcaaatactgaaaatatcccaccatcccaggcagttttggagaagcctagttctgcttctggagggttgtatcagagctattgacattctggatagccttgtttttcatatgcctctgggctcctcaaagttttcttgcccttcttggctagtcaagtcggacttgggcaattgggctggtggtcaaggaggaagaggagtagccagctcattctttgattggttctgggagttgcttctctgaggtcacaggcaagacttcaaggggcctggatttgtgctctaagccaggccgcatgcttccctttatgggccaccaccaggtgacttgactttatatttttaattttttaaagattgatatttattttattgttagctaagctgggtcttttgttgctgttcacaggctttctctagttgcagcgagtgggggctgctattcattgctgtgctcaggcttctcactgcagtggcttttcttacggtggagcatgggctctatggtgtgtgtgtaagatcttcccggaccagggattgaaaccctgttccttgcattggcaggcagattcttaaccactagaccacaagagaagtccaccaggtgactttagtattaatatcacatatttagacctggaaatttgtgattcttaaaattaagaacctcctggcatttcacaataccactattttcttttcttttttcttcttcctttttttttttttgaccatgccatgcagctagaataattttagttccctgaacagggatcgaaccccaggcccttgtcagtgagaacaccatgtcctagccacagggctgccagggaattcacacttaactgttttcgaaatgtgcttttatcttaacaaaacaaagtcattaatttactttccagatatatcaaacaatatcaaataaagaaaaggggaagaagttccaaaatacagtctgtggcttaactagattcgtatttttgcatctgcccaccctcacccccgttaccatttaaaaaaacctcagcctg

SEQ ID NO: 49965 - DNA, 1186 bp, Bovine  19866881252859
gatgacctgttgctcttctttaaaactgtgcatgttggtcttgaaccaatatttatcatcccagtaatgggaccacctcatgagctggtctgtcccaaaaccaaacaaggatacctgggagatggggtaagagagaagagggctctggggtagcaggctggatcccaggctgcctccacacccactgagcattccttcaccaaacattcacttaatgtgaagggcgacaggctgtttcctggagctgggagaagaacagagctcaccttccccagggaagactctgaacacacagagcccaggaaagagagttgattctcatcatgttgaaggaaaagagaggattccttggggagacaagaggagggcactgcaggcaggggaacagcatgtgaaaggcccaaggcagatgtttagggaaacgagaagcccatagagagtgctggtagagatgaaggggagtggaagggtcagaccacgccaggatcttgaaaaccagccagacaactttgggcttaacctgaagtccctgggaaaacaaacacttttagtggcaaagggatgaagttctatgagctgcagaccgcgtcttatacctggtcacaggtgtgcaaggcatacaacagagttatgaaccccagagatggaaagtgaccatgttttcccagccatctctgctggatgtactaaaggaagctcaggctgatcactgagacctggggagatggaggagggtggtgacctgatgtccatccagtggtcgcccaacccaactcactgcattttactccttccccttttccctcctgggtccctcaccttgtcttccttctcattacttccacgggtgacctggactatccgaaatctaaaacaagattgaggtgggggagtttcagcatcatttgacacagccgtccccaaacttaggtaagcctggggggtgccctgatagatagcaagggtctctccagagttcccactatcctccttacaatgtcctaccctccaccaccacacccaggattttctgccttctgaatgatgctgtctttctgcactatgtccatgacgcacttcagaccagatgaattcagaggaagcagcagcagctgggcaccagggtcctgagggctgtctatctcggggtatgtaacgcacacagtggtccttcttcccacgtccg

SEQ ID NO: 49966 - DNA, 1170 bp, Bovine  19866881264118
gtgatgggcttggggtagccagggtccgtggcccgccgctcctcgctgtagcgccagtaccgctcgcctttgaaaaagtaggtcttgcccacaggttcccagcgcagagctgtgtcaatgccttctcggggcagacagctgcccagctctcccaggctgtgggggtacccaggctccaccgtcacctccttaaacacccagtacttgtcacctgtggccaagaggagcccaggattagctttcctcagtcattcaatgccggagattgtggttagatccacttgcccatcatctattgggaccaaagtcattcatgaagccagtgtcaaggggaaacagccctaggccagcttgatccccgtggcgggggaggctggggcccctcggcccaggcagagcttagagggcaagaagccggaatctagtgtcaggtcctgggcagcttgcctcacgctgccccgcctctgtgccccaccctcttttcgtttcatgtgactcgctccttgctcctttctgggtgacctcagtctctcctggctttacacacacacaagtacttccaccagtgacacccagctctgaggctgtggcccatggccgctctcccagtggacctggccccaggcccgagaccctgattgcccaccgacctctgggaatttccaggtctgcttccagagttcctcatctccactgtgagggctccctcactacctctctgccctgcagcgtccccaagaaggtggcatccttggtcctctttcttcctcctctcagcactcagcctcttgcaaggacttttccatctcctgacctcactgctcctcccggcacaagccttagagacatcgccctcctcaactccagcaacatcctcaactccagaaatggcctctcacctctgccctgactgccacctgccctctggctctctgctgctcagacgaagagtgaatgccagcactgacctaatggatcgagaccacagtctgggtgggcaaccagggctctcaggactctcccctaaactacctttccaggcatggctctcacggggcactccatggccatcctgtgggttttctaaaggacttgaactactcctttggccatgctcttcctttcccttggaatgcttccctcacttctcactatctggatcttatcctt

SEQ ID NO: 49967 - DNA, 639 bp, Bovine  19866881300371
cctctcctgaggatggcggaggaggcagcccggaaactcctcccaggtaagacccatgtcaagacagaccagagaggaagtccaggaggtcctgctgctcttgctggagaagagagtggctgaattattataccagacacttgatatttctacctttcagcacccaccatggaaatcaggggagtcctgggcatttggagggctagactaggatggacaagctgacctcatgactgtgggcagggagcctggcggctgcaaggctcttgcccttatttgagtgagtgctgatgccccctcccaggcccacacaatgctgggatgaaaggattccaggtctgagcatttgcaaccccagattccagatttggctctgccagccaatctcttgacccatgtctctccttggttcaatttccccatctatcagatgacagtcatgattccttcctccctctggggagacataaaatgaggtcagaatggagaaagttcttggagaacctcaaacaccactgagacacgagagggacttgttttgtagctaagccatgtccagggctgcaggccaagccacagtgtttgtctggtggggcagtagctgggctcagcagcatcagctggacactgtgttttctt

SEQ ID NO: 49968 - DNA, 1249 bp, Bovine  19866881318566
aaggtgctgggtccgccggttagcaccgtggtgcctcatggacaccacggggcgcagtgaccacagggccgcctcctggcatgggccctgcctcctgacagggcctggcctgttccctggagtagggagcagttacccaggacagaaggctggcagctgggcaccaggcacccaccctggggcacagccaccatcactccctgccccatgctcagcccaggccaatgcaccaccacttcagctacatgacccctggcctagggccctgctggccccggtgggcagtggccagagctgcccctcagaccctggtgaggaagggcctggccggccagactgagtagacaaagagggctctgggctgctcacacccactcctggaccggccgcttatagtaggtgacaggctgagggcccgccttgttcttgaactggaagatggtgtagaccagcaccaggatgcagagggacaggatgcagggtataaccacggccaccgcgttgacagagcctggcacgtcgttgatggtcaccatgatgtccacgtcgtcctggggtagcctccgctccttgcgccgctccgcctccttctggttgcagcccatccagtcccgcaggatgttgcgtgggtagcctggctccacgctcagcttctggttgtcaaacttccagtagtcccggcccttatagaagtacgtgtaatctgcagaaacacggcccagcatcaccatcccagacactccctgcacctgctctgggccagcaggaagaggcaagaggctgtggcagtgtggaggagggggcgcctcccactcgagaggagcccacgagcagctctgaaggtgggggtgggcgcatgcgggggtggggacagcgtgctggaatacctggagtgcccggcacaccccgcagagggtgtggctggtcagggagtatgacctgcccagctgcagaggcacccagacccagaccagcccaccctgtcatctcagaggtgctgggaagccactgaggggctttaggtagaactggtgagttcatttagtgtttcctagacaaggacccttctcagccctgttgtactatgccaataccccctcttgccccccaccccaacatgggtcagatgcaaccccctactcagagcttgtacagcgctgcctccacagctagctccagggctgcacccactcctgcctgagccaagggagacaaggagccagaattctcttgtcgacagggacaccac

SEQ ID NO: 49969 - DNA, 1230 bp, Bovine  19866881527715
ccaagaagctgctaaacaggagacccagcacaggggaagaatttgtgggagggaactgctttccccatacctccatctcttgctgtgccacctcacacgcagcccccagccccaccaccaagggtgtgggtactgtcccagaccgcaataccccgctcctgcccccctccactctgcagggcctccacacgcacacggggccgccggcgaatgtagatggcaccgacccctgggaaacaaagtttgttacaaaaaaagagaaaaaggaaaaggcagatgaaacaaaatatcactttccaaaggggtcaaaaaattctttcaacttttctgttagctccaaaattttcaaaataaaaaatgttgggggtgggggacactaatgcaggatgtaccaaactgcatttattaagacatattccatttccccatgaaaataaaatcatattcaggtatctgacactatctgagtctctgcagttcccaagttcagagagtaagggctcagacactacatctggagagtgagggctaccatgtcgtctaaatctatttagattctgagtccaaaaagcaagagtttggatagtgagggatacttgcatacattttagtgctgaacagagcttctgctcaatatgagttaattagttttattaaaacaaatttatctacaataaaagccagtaagccaattttagttaaagatagaatgactgttgagcttttaaaaacaattaacttaaaaacacactgtttacaacctctggaagcacaacctctgggatctaatatctgatgatctgaggtggaactgatgtactaataacagaaacaaagtccacattaaatgtaatgcacttggatcctgaaaccatcctgcccccatccctggtccatggaaaaattgtcttccatgaaactggtccctgctgccaaaaaggctggggactactgctttagaagaagccatcttatgtactttcaggaattatcacaccttttcccatagggtgtccatctggatgacacaccctgcagacacagaaagcatactggcataaccaaccaccacaggccctcacccaggaaagagaggaagagttgttcattttggatggctacctccataaaacagaggacaacagtctcttcccaaaggctggcatgcaaaggcagaattccagctggaaaatattcctatgccaataggaccatagggacacagacaag

SEQ ID NO: 49970 - DNA, 976 bp, Bovine  19866881632033
gccagaggctgaactgaaggcctggaagctagtttctgacatcatgttgatttaggggaggagaggggaagattgtaaagtttatcttagatcctacctggtcttcagagggcaccaaggctcagagagaatacgtgacctgcccaaggtcacacagctagggaagtgaccctctgggctctaggtcttttgttcttcctaggcgaccacagttctgcccaagcccccttgcactcttctctggccaggggaggggactgggaggaggcctgttagctgagtccagaccccgctactgaggcaggaacatctggtcctcccttctaccatgtgtccagctctgtggttctcactgtgaagctttgaatcttttttctcttcctcccttctctctccttctctcccccatgctgcagtacacgctgtggagagtaagtggccctacccccagggaagccaagcccccatttctggggcagcctgtcctcccaagaagaggggtgggtgtgggtgggcctgggtggggggccttctctggcctgacggctgggtgactataactagcggtaagtgtatccattagctggggttccttgtagcgggagggatcagggttcaagggcaggaggaatttgttctggagcaggaggtgtagggtgcctgctgggctccctttggtggcttgagggtgggagcagaggaggcctggaaagaatttagaccacattcttaagtcccacctcgctttggggttcagtgactggcctatcggctctagtcctgaaagacctgagtcaatgggctttatctcctgagttgcagggcctcgggccttggtgggagcagaggtctggagtggtgcccatgaagggctccctgcacatgcgagggaagaagtgggccctgtagagggcatgaactctcacctctcatgcaggcccacagcaggcactcggctgccctcaagcagggccgg

SEQ ID NO: 49971 - DNA, 1190 bp, Bovine  19866881699247
tgctgcaatgaatgtcctgttgtatgtatctttttgaatgatggtattctccaggtacatgcagggcttcccttgtagctcagttggtaaagaatctgcctgcagggcaggagacccgggtttgattcctgggttgggaagataccctggagaagaaaatggcaaccctttccagtattcttgcctgaagaatcccatggacagaggagcctggaaggctacagtctgtcgggtagcaagagtcagacatgacttagtgactaaaccaccagatatatgcccaggagtgggattgcaggatctgactggtagctctgttttcagttgtttaaggaaatagaggtatacatagtagtcagctttggctaccataacaggatagcatagactgagtggcttaaacaacagaaattagtttctcacagttttggatgctacaggtccaagatgcaagtgccatcggcagtggttttggtgaggcctctcttcctgacttgcagatggcctcctcctcactgtggcctcagtgtgaccttctctctgcacatgcacagagagctctggtgtctcatcctcttaaataaggataccattcctgtcagattaggacctcattttatgatctcatttaattacctccctaaagactctgtctccagatacagtcatgttgtggattagaccttcaacgtaacaatttgtggggggacacagttcattccattatagtgtggaaggctaaagtgtgtaggatgttgccaaaaagtttttgttttgtttctaataaactgtggctgtgaaatagttttcttgaccagcaaaatgatgatttatctatcttcctgcccctcagttaataaaaatgttagagcactttataggctgctcagaaactaccaattatctcttctgtcgattcagatggaaacaaatggatccatctgtggggaaaaggtctttcaaattttagtcagagatgcaaataaagcctcaggcctggcaattatcaatttataggtgacactgagatgagaggggctgatttatacaacacgtgagctagaatggaattcagaatcctctcagagatctggaaagcagggcctcaactgcagcagaaaaatttacaggaatattttggaaatactgatgttttaacaaataagagagacaaggtctgcttttgcaga

SEQ ID NO: 49972 - DNA, 819 bp, Bovine  19866880359685
gttggataaagacttgttgaaatgaaggagttacactaagttagaagtaatgaaggcttggactaaggaaatggctgtggaaaatggaaggtatttgaaaggtgaaatcaactacaaatggcaagtggatagacagaatgggttaaagatgaaaaagacatatttttttgcctggatgtctgggaagaatcaggtatctaatcccttaagtagagcctcgtccttggatagtcaataagatcctgaaagaaagttcagtcatttataataattgacaaaaagaaggtagcatgaaatcctttctgtaaattttaggataggattaatgaagatctctccagaattttatgaggttctattatttaactaccatttattgtgttaaaagtttagttctttgactgttcccacatatcttgttacttctcatattgtacggttgaaaatgtcttgagtaagtaaaaatgttgtatttgctgaagataagtttatttcatttgaagtacttgatgactgactctacaagtgtagtgatatcatagtttcatcaagatgacagattgatcagggaattgtatctgcctcttgcatgataattaggtaatttatttaatcacatccaggaacatgatttagataagaaaatattgaattcagatcagtcctgtttatgatatcacacagtgtgcttgcttaatgatttaacagccaagccatgctaaacaattcagccttttaaagaagccatgtaagatgaatgttaatatagccttataattgcctttcaactgttaaggaaaatgctgattaaagtttaca

SEQ ID NO: 49973 - DNA, 1266 bp, Bovine  19866880380734
ccatgaaatagcatgagcatgatgccctttaaaggatgctgttttggaagtggtgacactgaatgtgcaaacattaccccagttaccagaaagaatgactgtgggcaaggtatttcatctctctgagtctcaatttccatgtcgccacactacttacaatacttatcttgagggctgtcataaaaatttagagcaatatgaaaataaaccccatggaatctctgtaagcccaaatacagtttggtgttttcctccacttacgggcatggtttctagatgagactgcctgatgactattttacatttggacgattctcttaaactctcttgagtcctagttttttcaactatagcatgaagatgacagtagtaccagattcatagtgttgctgtgttcgtgaactgcctaccaaggtttggtgcatcccaagtgtccaatgagtattattgccatgattttttctctgctggattttgtagctaaggtcattagacaggctcttccttcagctccatctgactccttagctctctaaaaattggctgtatttctgaagaaaaagtgaagatgcagagaacatctgttttccatttaggaggcttttaggctggatgtcttatgaaataaactgcattattgtcattatctatctgaagccttcttttcacaatgaagctgttcatacttagagtagaaaattacaacttccagaactgtctccccaggggaaatctaatgagtatgtttttgtttgtttgtttatttgttttttggtgtctctcataaatgatccctaccaaatgaagaaatctgattaaagtcatggaaacttttcgatagacagcgacagaaaaactgtggtacatgccacagccatttttattgtctcatcttcttttgatccatcaatccaataagactatttagctgccttttttatcgcaatagaagcacaaaaatgttagaaaatttctgactgcaaataattgcccatttggggagaacaaggtcaggtcataagaataaccaccaggagacaccatttagctccaggaacactcagagttgacatcctccactctcataagacttatccttttctatagcagacaggctttcaggatacaacctaaaagcacatttccattaagccctgagacatagcaatctttcttgagtaatgctacccaggccctgctgattcccatgtcaattctagaagtcataatggaaccagttaaagtaactatttaagaaaagggaat

SEQ ID NO: 49974 - DNA, 1118 bp, Bovine  19866880385538
cgtgtgcctctgtgtctctcgtttgttgggagagatcaatgtggcggtggcctgagccttctgctccccttcagtaatgcttcaagggtaagtgctgcgaatcatagatggcccttgtgattcagtgccagcaatagctccatatttgagtgtttcagcgcgatgtatgggaagaatacgtgtgttcagagttagataattgtatatttcaatcccgtctcgaccacttgctagtagaggaaccctcggaaatttactcaacttcctgaatcttagagtctgtaacgcttttcttgcaggagaagacaattcactgtaagtgaagtgtccaggacaaagcccaggctatagcagcagcactctccacggctattgatcacaataaaaataaattagatgccatgtatgaaagcatggccgattgactgttcattattgactgctgctaatagtgataaaccaaatgggtgttaagcactatctaggagagcaaagcggaggccactcctcttttccagccagcatcctttggcgtgtgactttaaacacagggccgtgtgaggcagtgtggcatattttgtgggagcaccctatctctgtcctccctaattccaggtttgcctcttcccaattctgtatctttaagggaagttttttctatcctaatatacttttccttctttgtaaaataaaagtatcccaatagctctctctgggtaattgtgtggattaaatgtgcagcatttaataaatacgagttgctcagtacaagtagattttctttatcttccttttcaggttttgtctgtgcaagattttcaaaagacagcgtttgtctttgacttgatttccttgcttctctgcacttttctctttcagtgtattgaattttctggtctcggaggcaccctacaatagtccattcacattaaggtgaaggtaatttcttactttgctgtctctttccatttggcacacagagggtgaaccctgcctctatgactgttaaagaggtagtagacattttatgatcactgaaacagtgacaggatatcagggtcaaggaaagaagtactttcagtcatttggagccaataccggacctccggatatgtcaa

SEQ ID NO: 49975 - DNA, 887 bp, Bovine  19866880455763
cctattataagcgagtatattatgtatcttttcactgctatgccgtctctgcctggaatagagttagtacccagtgaatacatgttgacagaatgaatggatgaaaacaatgaatgaactgtgctaactttcttacataaattgtttcttttttaagtcgtcttttaacatgaagacactttattattatcatcctttaacatgaagtaactacaggtcagaatggttaagtaacctgtgtgaaatcaaacggccagtaagtaaggagctgacatttaaaagcattctgttctattgctgtgatgatgagatttttatttttacatttggaaactcagtaattctgaaagtttagcatgaactcttctggaaggtgggtaacactgaacggaaccaacttgtttctaggacaagtgtttgacaaactcagatgggtagtttggatttttcctccagcgaacacccagagccagacctctctcaccccctactatgggaacaacacctcagatggaacaggggctctgggaactgtctgctgtcatgctgggaaatgtggacctgagtgaatcccgaattctcagcttactttcctagctaccaacatgtatacagtttttaaaattagaaaaggaagaagaaactaacaaagcctttcccttctcagaccagcatttttctgtatcagtaaaaggccgacagaaccagcgggcctccaactaactgactgttgtgttctgggctctcgctggctttttcactaaggcgttaagaatgagccccagatggtttctctaaacctaacctctgtgctccaggccttggccagtccatctggcctttcatgcttattaatagatttttcacctagcccaagaagtcaggac

SEQ ID NO: 49976 - DNA, 1710 bp, Bovine  19866880495123
actgtgacatattttacctgcctgatacacagtacactctcagcttttgcttgtttcactgaattaaactgatcagaacttttttctgtatatttcatgttgccccaataatctgaaaagtggttaaaccacaagcagtaactacctcagtcatatagcctggagattcatttatggtaagatcattgatgctttaaattgagtccctcttcctgattcacattattattttaatattaagttcattaccggtggccactgtattctatgtggacagtgtggggaaggaaggaaagaaatagtaggaaaaaagaaaaatcttagtactagaatgtcaactgtataatcgagtttggcaagagaaagttaggacccaaaccatcttcaagagctacttaaataaatgtcaattaaaatggcatatatgctgtgacttgcttaatttctcaaattatattttcttatttccaacatggagacaataatgccttatgttccacttgaaaattaaataaaacataagagaagcacctggagcagtgactggcacaaagtaggcacccaaaatatcaataacattagcaatatttattcctttatcccagtggttctcaaccaggggcaatttcgtcccctagggaaaactaggagacttttttggttgtcacagttgggagggtgcttaatgctggcatagagtgggtagagaccaggaacgctgccaaacatccacaatgtacagggtggtcccacaagaattatctggctcaaaatgtcagcagtgccaaggttaaaaaaaaaagaaaaaaacctgttttactccctagtttctgaaatccattatctcatggtctgagacagtcagggggacttagagagcacattctgacagcacatatacagacacagtctagagagatttccttagaaatctccccgtcttttcctcaagcactacaaggctctgtttgggtgccctgtgtttaccattcgaatgatatcactcctttgccatggcacctccaagccctttccttctgtacctggagtgtccatgtccttcactgtcgtaatgactgcattcttccctccctaaggccccagtctgtctccttatggtctttaaaatccaatttaattgggttgaattgccttttgactcctccgctcctctgcaatagcaagtccctttaattctctctcacactcagtccgtcttctcatttctactactcactaactgaagtcaatgtattacctttaatttatttggggactctaaataacacaccatagaagttagcatttatagcatgtattcatttttttgctatctcgttacaacactgaagttaataaaattgacatctaattacaactaacaagcatcgtcttattaaaactaaaacaataaagaaagcagtgaagattgcattacccgtgtgatgcattctcctacaggaaatactagctaccaaggctatggctcagtggccccacacgagggggtcagtgtcagacaccaaggaaagaaacctggagcttcactgaatgttttaaacagactggcaatcctagaatacactaagactgaagaacacttaggattaaattgaagaagccaggtcttgttagtatcaaaatacaaagggaggattcctgtgaaggagagacataggacaagagggagagataggaagaaccaggcag

SEQ ID NO: 49977 - DNA, 781 bp, Bovine  19866880521692
tattgtcctaatctacattattcatgacatgatagcttttacatcagtcctgatcctatgaaccttattcttctgcacatgaaaaaatctcaatccctagcatctatgtggtttattctgccacactctagttccccatggtttggaaatagaagacctgttctttcctcctctttgattctctaattaatctgcaataaatgaaggctccaagtgttttatggcacttcagtttcccattcccctctgacatttggagggaaaattgaacacacagcaagacctctgaacaagaagtaatagccgttaaattgaaacacgatgcaaggttttcctaaccatgagctcataatacgcgtgttcatagaaagtgatgtgcttgctgcctgcagcaaaaccagatgctctctgtttccagttgatcaatgttgctgtaaggtaggagtacatgtctgaatttgagaaagaattaaagggacaggatgataattctacctcaagaggccacgcaataatggtgatgaattacaatgcaccgagttttggattccattcagtgacacttgcatagcattatggaaaaacaattatccttgtaaattcagatttgggattgaattggaataggatttgctactttccagctaactgatctcaagaaacaggaacaaccaccacatagcaaacctgtgataagttaatggacacagagtgacactgcccagcacctgctcaatagaagggcgtttgcctaaaaaatgtgagcgacattataatattt

SEQ ID NO: 49978 - DNA, 1333 bp, Bovine  19866880536370
cctggtaggctgcagtccgtggggttgctaagagtcggacacgactgagcgacttcactttcacttttcactttcatgcattggagaaagaaatggcaacccactccagtgttcttgcctggagaatcccagggaaggaggagcctggtggctgccggctgtggggtcacacagagtcggacacgactgaagtgacttatcaggaacagcagcccagatcacagttccagaaactgtcataatttgcccttcactgtgacccaagaacatgggtatccttgaaaagcccactaaaattctcccaatgtgcagccaggtttgggaaccattagagataaaaagtatcttgtatcaggtttgttcctgtcaaccttccattcaaggtgctccagtccttacagcgaggaatgtaacaagatctggggacaatgtgataaatgaccaccttagatagataggaagataagccacgtgggtgtccctcaaccaaaaagactaaagcaaagcggctcttcgcattggaagtaacagaaaaagcttgtcactggggcaagagacaacctgtttcctgctaataaactctaaggtggcttttgtggctgccttgattaattggtgacgatgaaataaccagtgctcagggatacatgagatggcaaaggattgtaagtgacaatctgctgttaaaattcatcggcccctgcaaagcgctgtgattaatgaagtctctgtgcctgcctgggctccgaggaggtggggccgctgtgggagggaagggaaaacaaatttgcaaggatgctctcgctaaagaggttcggcacccggttgcatttaatctgtctgctgttccattacgccggtaccttctccctctcgattgttcactggcgctgccattaatcacagactattgtaaagagaaggagcgtagggaggagggaggggagaccgagctctccttcccggcttgtagcgggggaggatgatgcgtgagcagggggcccaggcgggggaccgctgggttatgaccaaccagaggaacttaaaatcagattcacagagttgagcctcagcaggccacagctggacgctccccgcctgccgcggcctctgcggaggttcttggtgcaacatcgccatctacagccaacatagtgaactgctccgagggagttgctgagcgccagagaaagcgcctatttcagatctcttgcaaatccgttggttttagcaaatccctgcgttggccaggaaggcaggattactacactggcttccatgacacaggactcccttccttacttggtgttcggacagcgtgttctcctgcaca

SEQ ID NO: 49979 - DNA, 2065 bp, Bovine  19866880547886
actttcattgtgaatgaatggatagatgaatgaatgaacaaggagaattgtgaaatgaattaacaattgactaagtatccaatagcttcccctgataggctaatgtcagattcaagtaatattttattactcaaaataaaaaaaataaaaatcttaccattaagcctaaagtattcctccctgtgtttttcttattttcagattaatagttgccaatcgtgcaacgagtagtagcaagtatactttttgttttgcatctgcctcctttccttcccaactcatagttttcaggtaaggtgtcctgatcatttttcttcacatatccccttcatcttatccatatgattaaaaagggaacagtcgtattttttctggctggactctgactcctggatgcgatttatagacaacagacagacaatagacactccagactggattaatcgaaagtcatccctgaaaattaaaaattgagggaatatgagagtctcagtttggctgagtgatgaagtcataaactgagctgagaaatggagtatttcctgccatatcaataaacaagggtgtcacagtcatcctagattccagcctttcagggcaaccaggaagaagaatacctgccatgcagtagctctcagactgcccccactccctacagtgagcgaggaactaaggatgtgaaaaatcaaatcacaggatgctggctggccccagatagctgagatgcatatgaaaggaacgatttcagtgagcccagactcttgcatctttacatacataaagccactaaattcctcaacttgagatatctggtttttcttaaataacaaaagtcttttgatgttctgcctacctgccccttcttgcaaacttctatgtaacctggctcccacccctccaccccacctcctcggaatagttctttcagggttacttgagatgttgcctcccaggcttgaagttctaaaagttttcaccaaataaaacataactctcatcttctaggttgctactattttgttgaagtggacagagtcaagtttgatggtgttcatatcccaccaagtgcactgggaaacccggaaggagagagaaaacctgaaacaatagcaacagatgtgcaaagagaaacagagatagaagatcaaaaagcacacttcttggcgtccttctcattttacagcccttggcctcactctgttcctaatgtccattttcatccctgtcctttaggtctgtgaaaacagcttctattaaaaagagagagagagagagagaactctcttttggataaccgaaatgcatacagcttgtgttaccagccatcaaaatagaactaaagacaacaaaaacaaaaagcagtatgagacatctgaaggagcaaaaccccaatttccatattccagcctttttccatacctatctaaccataaacatttatgtcaccttgaaattatccaaagcactcaaccccttttgtcaaagacacagaggcagagtgtttcatctttgaagttatactgcctttaccattagaaaaaaaatacatctgctaaattttttttcaacagagcaacataataaaagagtaagtgtctttgtagggaaaagtaatatagaaagataattaaatctcaggggcatttttttggtctaatgcagtttttctcaaaaagaaaaacaagcatcaaagctgcccccaaagacactttccaacctgccattgccacgaacatgaagttgagaaatgagaattctgtgcttggtttgttccttcttttcatgaaaaagaggcttaatattcacaggggacagagtaggaaaaaaaaaaaaaaaaccctctgctattatttccaggggttgaaatgcttctcaccaccaaaggtgttcgtctttacaaagatggttgctagggagttggatgatttgagggaatatttgaatatttgaatgtttacaaaactaaagagtggcatcactggcaaatgcacttattggcagaactgagccaattagttggtgctgctaaagtcactgcacacagttatttcacgaagggacaaac

SEQ ID NO: 49980 - DNA, 3148 bp, Bovine  19866880642577
atgtcaagaaggaagattaaaaaaaaaagaaggaagattaaggaaaatagcattctgagtaccgggtgaactagggcaaagtccccgagaaagcaaaagcttaactcgttccagggtcaaaaagcccagatggataggaaagaatgagaaaagagagagtagttgaaggccaaatcacaaaagaaaacacagcaccaatccacaaaccatgcaaaaggcatccactggagagcttcaagcagaatactctactatgtacagggtggactgtagagagataagagtaacagcaagaaaactggagagctggaatactgctgcagtattagaatggaaacccagtggtggattggaagaagatggtataggtggggatggaggaaaatgaattatctgattgagtgaacaaatgacatttatcagaacttgctgatgtactgaatgtgataaggaagacacagaaataccacccttcctccttccttttactctctggaacaagagaacgaacagtggttgagaagagtgagaatagagtgaagggaagacatgcagacctaagagttttagtttgcctgtacttaattttagtttgctgctgtgcttagtcactctgtggtatctgactctttgcaaccccatggactgtagcctgccaggctcctctatccatggagattctccaggcaagaataccagagtggattgccacgccctcctccaggggatcttcccaacccagggactgaagccacgtctccctcactgcaggcagattctttaccatctgagccagggaagcctaagaatactggagtggatagcctattccttctccaggggaacttcccaacccaggaatagaaccagggtctcctgcattgcaggcagattcttaaccaactgaggcaccagggaagcccttagttttagtttgcatatgttaaatctgagctgcctcttagacattcatgtgcagataccatgtacgcagttgaagctccagggtcaggccagaattagagacagagtttgggaatattatcttaggtattatatagtttttaagtcgagggtctggattaatctatccatggagactcacttgaaagacaaaataaagggacccaggaaaaaaaatagcaggactcaccaagatttagagatagaccctgaaagacagagaaagtaaaggaagaaagtgagaaagaatcagccatgaatactgaggaagggtgacaagctggatggaaaaactacgttgattatcaggaattacctgaaataaactgccaagcttagggaagctacaaaaggagtatttatacagatatctcatcattaaagcacttctgccttaagagagctatcagatacctaatctgagaacagaaatgagggtaaatcctggagtatgcttattagcctgcaatgtctacatctatctgtttaatattatggctccttaaccttaatataagttaacagagcacactgtgtgcagaagcattatcctaagtgctttttaatcagcagtcacttttttagtcctctcaactagcttacaagaaagtactagtaaatgaagaataaacacggatacagagctcactgtgaatccagccctgttcaagcacattatataaattaactcaagagataggaactgttcatattaccattctcattttatagatgaagaaactgaggcagggaaactttaagcagattgtccaagaacacacggctagtaagaggtggatccaggtttgaacccagcaatctaactccattctgtgcaatttaccattgaactacattgctcctgtttagctacaggcatttctcaagtgctattaacaattatactaagctaattttacaaatgaggggactgagccttgacagggttaggttacttcaccaagatcacttggataatgagtggtagatctgtgttttgaacttaagtctctcactcctaactactattaagcaagaaccataatcagcaagatacagggagagaaaccagaattacaagagaaatatgattctgtgattacacttctctaaattaatggaagaaagagaaacaaaatgaagatcaaggttttagctaaaagacaccatagccttgctcttgaaagcaaatgccagtttctctttatttcttctgtggacactcggggttgggtgtcatttgccatttttagcacctgataaccctgcttcgcttccaaggaaccatctccttagaatggaccactctgctttttagtgtcttccctttttgaacaattcaagttttattaaattttatttttattgagatagttgatttataatattatatttatttcaggtgtgctacatagtgattcaaaatgttcctacattatactccatgtaaagttattataaaacaatggctcaagagggaggggatatatgtgtacatatggctgattcagtgttgtacagaagaaacccaggctttccaggtagctcaggggtaaacaatctgtcagcaatgcagaagacgtgggagactcaggtttgatccctgggtggggaagatcccttggaggtgaagatggcaacccacgccagtagttttgcttggaaaactcccatggacagaggagcctggcaggctataggtccatggggtcgcaaagagtcagacccaccgccgggtgactgagcacgcatagcaggaactaacacaacattgcaaagcaattatattccaataaaaaaaagtaagtaatggctatattccctgagctgtacactgtatccctgtagcttatttgttttatatgtcacagtttctacctcctaatcttctaccctatcttgcccttttcccattccttctccatactggtaaccactagtttgctttctatatctgggagtctgtttttattttgttatattcatcatttgtttgttttttagattcaacatttaagtgaaaatatagagtatttgtctttctctgacatttcattaagcataatactttgtaggtccatccattgctgcaaaaggcaaaacgtcactcttttttaaagttagtagcattccattgcatatgtaccacatcttctttatccattcatctgttgaggacacttag

SEQ ID NO: 49981 - DNA, 1037 bp, Bovine  19866880715795
ctttgtttgaactggtttgtggtccgacttactttttctacttcaagtacaacactactctaattacttttgtttaaaaggaataggggcttccctggtgactcacatggtaatgaattcgcctgcaatgcaagagacctgggctctctctctgggttgggcagatcccctggagaagaacagggaaacccactccagtattcttgcctggagaatccccatggacagaggagcctggcaggttacggtccatgaggtcgcagagagttggacacaattgagccactaagcacacaaaagatggggaggggtgaaatcgtgcttcagatgataaataattgcctagtgttttagagatattactatcaaaaggaaaagtcctaattataagtgctattggttgctatttcacttgtattccactttttatggaatacaatccaatacaacaatactggaatgggttgcattcccttctccaggggatattcctgacccaggaatcgaacccatatctcctacattggcaggcagatgctttaccactgagccaccagggaagcccaattacaaatgaaacccctctatttagttgtcaatcactgttcagtttggaatcagacctattttgtatgcaggcaaattataaaactgtgtgtacttagaaaaaaataaaatttaatttctttataattcttttatagtttggattctggttgtccccaaagtattgttttcacttgtttatgctcttaagtttctgcaaaatagatgctgacaggaattagcatattttgagaaagatgactgtgatgttttcaactgtctaaatctcttgagttggggagattgaaagaactgaaagcgcgttttccttcagtcacatttccttcatctcgatgcctactgtttaaccgtctttgcagaggatacataagagctttcaacccagtttcagcagcgactccctaggaagtacttgggaagctatgaagtttgcaaattgacactcgccccacaatttcagaaaacagcct

SEQ ID NO: 49982 - DNA, 1406 bp, Bovine  19866880773926
tcctactgaaattgtacttacagcctgcttctgctgagtggaagatggaagagcaacacccagcttagacttacatcccactactttggctggctggggaaactgaccacctctagcttgaactgagctggaatgaaggattcgcaagttacttaggcactctgctcataaggtaggagaagctcagaccatgtctgcttctgtggtttggtggggtgagtggactgcaaacaagtcagtcgaccctcctgaaccatgaagaggagggtagcaggttttctgtgagtgcttccttgattaggatcagtattgccacaaaggtttcttgttgtcttaagccatgacttctccagtcgtttggctaaaaattacaggctttctcaattcttcttttagcctgttgaatgctcaggattgagggtctatacaatgctctgtctggaatatgtgggagcagataagaaaacagggaattctacaccgtcacttttcatgttcccaattttctaggcaacccactggctttccacctttcttatgcttgtttgttgtgttgtgtctggattttgtttagctttaaagaggaggatccagaaggaatgggttactccattttggctagaaccagaaaccccttcaaattatcattgaagacctattgcttacagcaaacttcaagcatatgttctgatgagctcaacatgtgttttaattgtgttatttgttttcctccatagttagagaggtagttgggtggaaaaaagttctatttcaagtggtgcctctagtggctgttattatacatgtttcatctacaatcttcctagttgtgattattttattagggaagagaaacaaaagatactgtagcatgtttcacatggtaaattcttttttttttttttaaacgggcatccctgatggctcagataagaaagaatgtgcctgcaaggagggagacctgggttcgatccctgggaagtgaaggagggaatggcaactcacttcagtatttttgcctggagaattccacggacagaggagaccaacaggctatagtccatgaggccgcaaagagtcagacatgactgaatgactaacatttaacattttttctcagttgcttgaaggtgccatgtactatatttcagccttgtttatttaaaaattagtctcactcaaaatccaaaatcattttctattcccagctgcagtgacctaaaaagtttgccttaagtatgactccatagacatatttatatttaatcaagcctccttactgacactcctggctacagctgctgattctgctgctgacaaggacaggaaggactttgagtaaaatgttgtgatgtctagttagttcagggcaggactttttccttcaaacatcacatagaggtcat

SEQ ID NO: 49983 - DNA, 1204 bp, Bovine  19866880785901
agaatgccatggagctggggatagagggatgacattaggccagattagagtgtcccaaacctcccactgttctgaccacagttcagcaggtttttttaagataaatgcactttagattgttgcaatctttttgttaatttccagagttctgaaaaaattgatttggacaattttgccagcattttgtttttgcttctatggagaaacagatttatagaggttcttgttccaccattccccaaacccttccctttagctataaaagctttctggtttctgaaaacaaacaaacaaagaaaaactgagctgaaaatttaaacctggtctggcaaacccacaagtaaatcagcttcttagattttatactttttatttatactaaattgttttaaggtctctcaaagtcttttcttttatagatgtttgattccaggtgaataattaaaatgactgtttgcaatcaactcccaacacttcatttactgctagcacccatgttataagtgccttaaaatctaacccatcagagaaccaattatggattcccattgaaggaggaaacagacagaacaggcttcatcttgagaactggactccatcttgggccggactgtggactttgagctatctgcccagtatctatggaaacgacataccaactggaaaaccaggcccccagaaggaagagccccaggctcgaacctagactcgcctttgcctaaaagaataccctaattatctgtgtaactgaatagaatcataaattctattatgcttgttggggtttgaccacaggcctattgataattgtccactgttaactacctaggtttaaggcatatgaatcacaggttaactttgattgtatctttcttttcttttgttcagactagttttagggaatcctaggggggtggaggtgggtttgggcacatacacttagggtataaaaggttttcacaaaaactggttggggtccttggctaagaggagactctgccttgggcccgccggtgtaataaactgcactccactatctgcattgtccttctgagtgagtttcctggaacacgtggctacaacaccatccttaagattctgttcttctggctctatttctaggatcaatatgagtatctatcagaaaaacagaggtaccataatgttatgggataaaatatttttaaaggcattcagttcagtt

SEQ ID NO: 49984 - DNA, 2436 bp, Bovine  19866880838322
tggacctttgttggcaaagtaatgcctctgttttttaatatgttgtttaggttggtcataacttttcttccaaggagcaagtatcttttaatttcccagctgcagtcactatctgcagagattttggagccccccaaaatagtctctcaccgattccatttttccccatttatttatcatgaagtgatgggaccagatgccatgatcttagttttctgaatgttgagctttaagccaacattttcattctcctcttccacagtcccttggacggcaaggagatccaaccagtccattctgaaggagatcagccctgggacttctttggaaggaatgatgctaaagctgaaactccagtactttggccacctcatgcgaagagttgactcattggaaaagattctgatgctggagggattggggacaggaggagcaggggacgacagaggatgagatggctggatggcatcactgactcgatggacgtgagtctgggggatctccaggagttggtgatggacaggaaggcctggcgtgctgcgattcatggggtcgcaaagagtcggacacgactgagggactgaactgaactgaactgaacttcgactttcattaaaaggctctttagttcttcttcactttctgccataaggatggtgtcatctacatatctgaagttatcaatatttctccctgcaatcttgattccagcttgtgatttatccagcccagcatttctcatgatgtactctgcatgtaagttaaataagcagggtgacaatatacagcatttatgtactcctttactgattttgaaccagtctgttgctccatgcctggttctaactattgattcttgacctgcatacagatttctcagcaacattatgaggaatataaaattatgcaatattatttcttgttcattagttaaaaagtaaagatattcatatatatatatatatatctgtgtgtgtgtatgtgtgtgtgtgtgtgtgtgtgtatttcataggatgagtaacatgagttcagtgatttagcccttatgttaccactttgtggtctttgaaaaaaagcatagctatgcagcaaataatgcctatgacagacaaggcctgcatactactcactcactaggaatgggttaagagttaagataaaaaaaaaaaaaaaaagaaagaaaaaggaattaagaaagacaccattgcaaaaccaggctttctgatgcagagttagaaaaagtcatcacagtcaagatttgcccacatgttataatgtattcataaatagcaccttaggcgacatagacattcatacatgtgctttcaaaaagtactttaactcctagaggagtggtcaggtgttccaggatctatgtcttaagggaacatgcctgcttttcagtgtgtgtgcatctgctatttcagttgtagggaattattgcctcttattctctctgctactgatgttcaacatgctttggctccgctctggggccttaggcctagtgctgtttgtggatcctattggctttgatgaaagagagagggggggaaagaatggttttaaataaaaaaatcggaagctccaatcactccaagtggcagcagtgtcattaagtatgacaaggaatgtatttttatattatatttaggaaatttgtgaatgctgatgaggcttttctgtttttttccctgggcaatgtcactgcaatgccgtgaatgctgcctgcacatatatatttctcctttttcctcttgcctgggttgtaggtttactatttatcctgatctgaatagttagagaatgtacctgtggtttttattggaggttaatgtcagtgactgcttggcccaaggtcatcttaaacagagtgaaattataagttgactgtggtaagataacacatttgcctacactcctgccgtgctctgtcctggtgtgtcatcatggggagctgttcaagtgaagtctcagtttcctcatctataaaacagagataacagtatttccttcactgagtttttgggaggaaaaaaaaaccatcaaatgaaagtgtttagcatagtacagggtatgtggtaaggtctaaaaaatgttgtcatggctgttatgaatcttcgtgtgcttagttgctcagtcatgtctgactctttgcaaaaaagttctgtatcagtcagtaagcatagagggcaaaaagagtgtggcaagcagatctcatttatctccaagattcctgcccctccccactatatgttccctgtatgaccctttccccttgaatgtgggtgggattcaggaatacaatgagtcactgtgcctgtgattatgttacattatacatccaaagggatatttcagatgtaactaaggtcgttaatcaactgacattgagttagtaaaaagtgagattatcctgtgtgggcctgacctaat

SEQ ID NO: 49985 - DNA, 1020 bp, Bovine  19866880853804
acacatctaattggtgctctacctaaacaaagatgtctattttgtatgctgagagttctagctacaatagattacaagggattaagatggtgattacctctgccttccatctgggaactgaggtcattaaatcttagtctctggaatgggcttcacaatttctccttatctgaaaggttactcatttctccctttgaacttgctgagcaatttacctcaataataccccttgattcagagctccataggttaatttacattatgtaaagatcactttcctttgatctaaacactgtcatagttttatatgatgggacaaggttaatcggattacaccattagttttttctaatattatcattatttcatatatttttatcccatctccttttattattcctcttttcagaatctcttaaatcacatgccacatgcagaatatagtttaagagtttttttaaaagctaaattgctgtgagtttagaatttggcatatactctattaataacagcttctccatgctataaagaagtctgccttaaatacgagcacacacacaatgaaacaagcttaaagtcacagcattacagctagaaacgatcttagaagatggttttctgtgggagtgggttcaaaaaatggttttgcatttggaaattagcatgttattgatgtctaggagagaacaaattttctgtggagtgatggaactgaaggcagattcctgtatactgcagagcagcagtggaagtaaaactagagctggatggtggactgtacttgcaaagcgtctaatagagaagatgtggcagcattcagaggaattagggttgacagacagaccttgaatgaattagaagacccatatgataactcttgaatgatgcttttgaactgtggtgctggagaagactcttgagagtcccttggacagcaaggaggtccagccagtccatcctaaaggaaatcagtcctgaatattcatcagaaggactgatgctgaagctgaaactccaata

SEQ ID NO: 49986 - DNA, 1690 bp, Bovine  19866880858866
catctagaacattatgtgttaccaagacttttcactttgtcttaatgctatgatgataataacactattaacaataaagtcactagcgctgatgtagcatcttactatttataaacactctgctatagttcaaatgtgttctcaaatcaaccccatgtagtaggatcactggttagtctcatattgctctcctatctcaccctttctatgttctgctttgtgtcctgggtaggatgcaggaggctgatccatgaagacctggactccacagtctctgatttatagttgatcttggctgaagagagacagtagctaagagggcacaaagagaggaggtcacatgatcgtggaaagaagtttgagctttatcaagaaagatttttttttttaattctaagggcgtcgtaacagatgggcatagtacttttctgtatgtcacaatgactgcctcaatataatcaacctccttcttcagcaaaacaggaaaataattataggaataaataagaaacattcttctgcctctgctctttggatattatgcattctcttctgggaatgaaagacatctaagcaaagtattttatgagggctgagatgataaaatctttattcctagttgctttgggtaagattttcccctacatccttgctggtacaatcgccatcactaccatcatcaaagccattgatgaatgttgtgctgtgtaaaaggatgttgtgaattgcgtttattgcaacatgagaatttgcaaatctgaagcctcaacctataggtggtattcgcagtagttatgcctgactctctggatatatagaacattgcatggcaactcaaacctcagcacacccaagctgccatctagccatcttagatacctatgtcatggtcagcagagtggacctgttcaggtcagccaaggtctacctggatcattgctagactttaagttaatatcctaatggaacccttgctgcacaatttgtagcaacccattgtgagagctggggaaaggggttacttccaaaagccttcttctctttcctgccaaccaaagcattgcagtataaattcattcctccaaactgcttactctctgtaattaactctgctctaggaatagctgttttataactgttgcaaatcaaaggactatgccactgaagtattcgcttgccaggagactgtgacatctcatccattaaaggaatgatgtttaagaacagcctcttctccttttctttttgaaagattgcttcactgaatggacattgccttgagttgtatcgagggaaatgggagttgaatcagcagcacttgtacaatgcctaactgctattactctgctcccaggagctttgaatttgcatggcttagcagactgctggctgtaacgatagaactcagagtgggttgacagcactggaatgtctaaggatgtactatgctcgtatcttcatttttcagaattcacctcttaagaggcagacagggcttttgaggatgaggctaatagtccctaattcccttgggtgttcattgtggaatgcttttacccatgctaaggtaatttgctattttaatatggatgtaatacacaatgctactaaaatttccactgtagtgaccccttcatgagtgtctattacctgttcaacagctcctggattctatagtttgaattaacct

SEQ ID NO: 49987 - DNA, 1145 bp, Bovine  19866880878932
tttatttcaaagccatcttatcagtttgtatatttccttcccttccatcaccaatctttggtcctgtactaagacctgtcgacttttccaaggacaccctgactcatctccatttctttatcttcctcttccttgacattatctcactctgctgctgctgctgctaagtcacttcagtcatgtccaactctgtgtgaccccacagacggcagcccactaggctcccctgtccctgggattctccaggcaagaacactggagtgggttgccatttccttctccaatgcatgaaagtgaaaagtgaaagggaagtcgcttctccattatctcactctagccatcatcttatcttgtcttctcatcacagtacctgctaggtatgtcagtgaggcatgggaaacaagccactcccaaatctatacatagtcaaattaaaacagttacattttagtcctttctgtttcaaatgcattacttaattaatgagttaatataattcaaaataagttaaatttttagacttttcaattgccaattgttttatattttcaagggaaattattttattaacaaaatgtatcacacaaatggctcagaagtgcattatgagtaattatatctcaagacaatttatactctggcttaaacagtctcttgctgcattaaagccccttaggaaatgatactattgtaatatcaattctatttcataaagctctagtggatgtcattgagattatagccaaaactcttcttgttatacagtaagtcatattaatgtgtgtataaagcatgttttgacaaggcagtataatattattattatttattaggtccaaggcacctctcagccagtaggaaattagctttaatatcacattatagctcctctagcttctgctttaatgggcttcagacaacagcctgtttccactccttcaagatggcttagagtcttaactgctcctgctgagctggtctctgtgaactgtgaagtttttaatctgatctctgctcagccccaagcatttaatttgtagtttaggaattagtagaggtctgctatgcagatcaacaagggtaaaaactgttgggctttattgatacacactgcaggaagttgagtaggggagagcaaactggtg

SEQ ID NO: 49988 - DNA, 2561 bp, Bovine  19866880950188
gtggccgagaagtgaggaaagataagatgccaaatcccaggaccttctggctctgctagtctgcaggtaaactagctggcataacggcagagttacaggacaagacggggcaggagcagaactggaaggagagaatgttataaacaagtaaaaggagattctagggcctgggttggatgaagcagtgtctgctacattgacattattatcattattaccttttattaggatggaactgcatctttcctttatgtgcctcatttcgatgaatactgggaaaacccatatattctccttgagtccaaggtagaaatcaagccaagactgggaaaaggatattagttcacaggaagatatatccattccaaatgatggtcgaaaatggaagccctaagctgaaagctttattaggcaacctgcggcatccatcgtaggcactgttcccagccaagggactagagtccagcctctgtgatttattggagatgagatgcaatgaaacaacacagaaaatggagactgggagagacagctcttttatcacagtaataaatatatgttcccagagccactgaaacctttttaaattctccaccccttatttaatacaattaaagcctgaattaattgtacaaggggtaaacaaagacatatactgctgtccagagactcaaaaggagatctagattaccttcctacattaatgctacctaacaaataaacctctgggctggacataggttagcactaggcatacattgaaaagaaattaatctgccccccaattttatggtcccagctagtttcctgtaataattctttttaaaaaatgtgtgctttttatgcttcacatttttctctgaacaggacatgttatctcctaattttatgagaataggccattgggtaaaaagtaaggagatggacacctgcagatttttcctaagtaatgactcagaagtcctactatgtcatgaagaaaacaaatctgaccctagcttaaagaagtaaaactccatgattttgagttttgtgctgtattcatggcattcttttgggtgtggagagccttgattaattacaattggttcttcagggtggaggaagattttttcaaagtggctcagtggtaaagaatctgcctgctcatgcaagagacactaattcaatccctgggtcaggaagagtccctgaagaaggaaatggcaacccacaaagtattcttgttctggaaatcccatggacagaggagacgggtgggctattgtccatggggtcataaaagagccagacatgacttagtgattaacactttctttcacttacctcattgtatggttttgggtcagccttgaaggcttggaaaagtctaaaaaaaaaaaaaaagtcagctgatataccaatgatctgaaaagtaaactagctagaaaaaattcatgttagttgtatgacatcattgggaaggtagttctagggaaaatcatgtgaaaaattacttggttggagtgtatcttagttttctcttgctatataaaaaaaattaccacagatatagaataacacacacattgattcttgcaaagttttgtgggtcatgaacctggtcatggcttagcagtgtcccaaagctgtaatcaaggtttgttttgggctatgttctcatctgaaggcttgactgaggaagtattcatctttacactcatccaggttgcggccagaacccacttcctgtggccagaggattcgggacctggcttcctgttggctatgggctggaggctgccatcgggttgtggaggccacctgcagttccttgaggctacccacaatgctttgtcacgtgggctgtccaacctggtcatgcacttcatcaagcctctgtgtagtgcatggtgatggaatcttattcagtttaacacagtcactggagtgatttttaacagagaccatccattaccttagtcatattctatggatagaaacaaatcacaaatcccacttctacaccaatggatgggattatacaaagatgtgtgtatatagagtctgcctccatcttttttatatttgactgatgacaacttttgagtctcaccccttcctctttcctttctgcctcatatctgggcaagccgataagaaagcctgcatactctcccacttgacgctggcaggaagttcaaatcatacaagcctctggccatgcgcaggaaccctcactccctgcttcaccccttaaactccgtaaaaacctcaagccatttcagaccttcttgggagccaccgtggcctcccttgaaagcctcattatgtgcataatgaatattttcatactctcttgggctgtgtgtagtgtcatcagtcttgacgtctgaatcaaatttcaggcagacgtccatttccactctgtgtgggggctgtaactgtgtagttatctctgggaggggccatgggggacaacctaagggcagaacaccaaagtatgattactgccaatgtcaggaatctgaagttttctaaattatgactccagctgtgtcgggaaatttttaaagagctta

SEQ ID NO: 49989 - DNA, 1816 bp, Bovine  19866880959713
agagtccttggactgcaaggagatccaatcagtccatcctaaatgaaatcagtcctgaacattcattggagggactgatgctgaagatgaaactccaatcctttggccacctgatgggaggaactgactcattagaaaagaccctgattctgggaaagtttgaaggtgggaggagaagggaacaacagaggatgagatggttggatggcatcaccgactcaatggacatgagtaaactccaggagtaggtgatggacagggagacctggtgtgctccagtccatggggtcacaaacagtcagacatgactgagtgactacactgaactgaaaagtaggttgactattgtctaaaaaggatatggatctctgaactctgcaagtcatttctttgtatcttgtagttttagttgtaaactagcaagccagaccattttaatttcctccttattgtccccatctgatcagtctttcctttggatcaaatctccctaacggtttctgagaattcaaagtcatatatcacattaatatcataccattccacattttcaaatatatttaacattaaacctcaaagctccccaaatctgatgcacaagtcataaaatgactcactcttcctggaacatatcctatattcccagaatactaaatcacagtggagggcaaaggccacaggccacatctccatcattcgtttttatattttcatgtaacatgtaaagcagtgcatgtagccagttcttactaaataaatgttgccctgttacttatcatcatcagagtctacagtgctaatatatttgctgttgtggttgctaagttgtgtctgactcttttcaaccccatggactgagcactcctctgtccttcactatttcccagagtttgctcaaattcatgtccattgagttggtgatgatatttaactttctcatcctcttccaccctcttctccttctgacttcaatctttgccagcatgagggtcctttccaataagttggtccttcacatccagtggccaaagaactggaacttttgatgccctggtggctcagatggtgaagaatccgcctgtagagtgagagactcaggttaaatccctgggtcacgaagctccctggagaagggaatggcaacccactgcaatattcttgcctggagaatcccatggacagaggagcctggtgggctgcagtccatggggtcgaaaagagtcagccatgactgagttacaacactttaattttcagccttctttatggtccaactctgtcatccatatgactaaatagctttgactatacagacctttgtcagcaaagtgatatctctgcttttcaatacactgtctaggtttcttaagctttcttttcaagaggcaagcatcttttaatttcatggctgcagtcactgtctgcagtaattttggagaccaagaaaataaaatccatcactgcttccatttttcccccttctgtttcccatgaagtgatgggaccagatgccatgaacttagtttttttttttttttttttaatgttgagtttcaagattttactctcaagtttcgctgcttttcactctcttctttcaccctcatcaagaggctctttagttcctattcatggtctgccattagagtggtatcatctgcctatctgaggttgttgattccagcttatgattcatccagtccaggattttgcatgatttactctgcatataaatttaaataagcacagtgaaaatttacagccttgatgtactcctttcccagttttgaaccaatcagtttttctatgtctgatt

SEQ ID NO: 49990 - DNA, 982 bp, Bovine  19866880972270
ctcctgcattgcaggcagattctttactatctgagccccagctaagcctagtatattgggaggttctatattctgtatctatccatatgtcctgtatgtcatctatagccatatgtatatgtatctatctgtatctatctacaaaacacaatgaaaaaagaaatgaagtaatccacacatcatttcagttatggctctcaattttgccagtttaatagttggacagaaataaaattaccttttgccacacacagtcttgatcattgaactgagtgtcttccattgcttaaagaatattagattttttcatcttaatttgagaggcagtgaggcagagtgaaataggactactttaggatcatctatacctggcttccacctctgcatcattcccctcactggccagccttgggagaggtacttttctgaacctcagattcttcatgtgcaaaatgaggatattttaaggttgctgtaaactttagaaggaagtcaggatgtttcagaaggaaacaaggaaattgataagagggttaaacggatcctggagagctgatgccttgagtctgatgtttaggtgaaaggctcaggtgttgctttctcttactccctctgaattggttttcctatttgttattgctggccgttccttcatctgtcctgcggcactaccgcattactcttcaccatggctttgcattttagaacatgctctcttttcttagatggttggagttaatttaagacaaaatagcttcaactgctcagcaaataacaggctgctgaagaagacaatatagttagaaaagaaaacgttaaaaggcaagaaaacagaccacttggaatcttcgtgaattgaagcttaggtagggagggcaactgtgaaaataaaccagataatagcagaatgcaaagatgctgtagttgccggtcagaatattttaagtatctgtttagaagcttatttaaatgggaagcaaga

SEQ ID NO: 49991 - DNA, 982 bp, Bovine  19866881000257
cccagccccataacctcatgctcctttgcacattctaaagtcttgttgttagaagccaggagttcctccacctccgttttcctgacttaagagagaggggaaatgagttgctctctaagctttcatcagtgcacatgtcactgctctgttcttctgttctgactcctgtgtcctttttaaacgtgcccattcccctcttgtctcctaatattcaaattgatgccgtagctcatgacctactctgaagctcaggtggtacttgcagaaaatcttttctttgcagtcatgcagaggaagctatgttcaggctccagaagaggcctatttgtgccagcttgtctcttagcttgcactgacacattgttcgtttaattttctcagtctactactccattagctttatcctatggtggggctggcccatttattcctgcttaaaatttaatcagacatttcactgctcgtcaacattttaacggggccatttagagcgctgaaactccacacatctctcctaattactgctagccgacagatgtcactttcactgttctgtcttccctgtctcctccagttgcacagacctgaaggagacactcattctttaaataaaccttaaagcagaaaacacaatcagagattaatggggagatgccaacccatgtttctgcctgattggaatctagtcatttagggaagttaaagactgcatcttgtacctcatcaggacttgaagcctactctcgatttttgttgttgttgttattgtacagagtgcaagggtcatgggaagtagaagggatgcagaatcaacaactagactccctgatctgccatgcttgtcatgcctttcttgggctactgtctgctcaggcttgttccttattcaactgtgaaattggaatcgcaagaggaatggttgcattttcattgccaggactcctctcatgatggagcacaaggaaagggggactgagtttgg

SEQ ID NO: 49992 - DNA, 3109 bp, Bovine  19866881080530
ttgttatcttatccccaagaaattttatttttctggacagtctcttctgaaatttgtgaacatcttagatgttccagtttcacccttattttacttatattctcagtataatcttgatgtcctttcttctgcattcaaatgcaaggacaaacaaacagaaagagatggtggttgattcccagggggagtcttgccctctgtactataatgacctttgaaatccttacttgtcattgaaggcaccattggctgcctggctaacattcagtcttgagttgcacccagctaagagcctttcctgatatgggactatcaccgttatcactacatttcctttcttctaaaaactcctgagtaggaatgttgctttttttcctttgaaatcttgacctctcagaggaatgcatgcctatctatgggactccatacaatggtaggcaattgtcatctgagtatcttaagtgtacctcagttttaattttgtaagaaagacagtgggtgatttctactcctaggaacccttcctttattagaattatcttccttgagatatctattcatctcaggaaataccatacaacccagagttagtgtttgttttaccttgtttctactgatattcttaattgctatggaaatgtccctatgactaatgtaacatcatcccatttaaatttcctcagggcaatgggaaatattttgcttcccaattaggttgatctcctatgacactcttgctcattatgggagtgaccaccagcaccaggagtcccacaggtcattctattttaatcaatttaaaagacagattttaagaaaatataacccttttcctatctgaatgactaatttgtaaaaacgtcaaaagaagtttgtaaaatggaatgattacaactgagtactaaatcaacattctaaaggacaaaggatgaaatatctgaaagtcaaattggagagggaagtgaaacacatattcaccatgaaaactagcccacaagtcttctctctttttaatcttgatggaatttttatcttagggacatcatttcttttcctgccgtagtatattgaacatgtccattcctccctttcccctacccactcccataggtttcaacaatttgaattcaaacggagataggctggtgtctccattcatttccacatgcaccctggactctatacaagaatttgactattgctttctctgcctgcttctaatgctgcatcttcagcatttcttctctcccctttgccaaaataagatttctgtttcatagtacatgattttactttggatttatagcatcatctttctcaaaagaatattaagaccatgtgggacactacagttatattctccattgcactgaggaaggagcctgaagacaaaaccaactgcatttaggaattttcaactttcccacttttatcagttcatgttatataaaagggaataaatggcatgttaattgtgctctcagatgatactaattcgggaatgttgcaaaaacaggagagagagaataatggcactggagggactaaagaggtttagctatgtgggtgggtggaaccaagagagcgcaaatcaccccagaaaaggttccaagtaatttaaacctaccctgtgttcatgtgcatgtggatttatgtgggtttctatatgcacctgttcggttacactatttaaggttaaacacgtataattttatggagaaaaagcaagctagcactggccataataacatagggtacctactgcttcctctctgcagtgatttggccatggtattagcttgtatcaaataaaaagttccattttcttatttataacatgaggggcttgcataaaattcatgagtcctccaggctttaaaagtacatgaataaacatttgagtcatagtttctatggcatctagattatagaacacggaacaatttggaaataaaatattgactaaattatttcctgatgttcttattcttcaggtgcccctttatgacttctttgcatcatcccatttttcatcagaaattaactttgctcaggctcgagccacactgatgaattctgccaaaaagcttacaaatattttgacctcatgataccgatgggatggggggctttcttatttggaggtaaaagagggctctgaagtcaatatccacaagttgatctaaagatgatctgtctaactgtagaaactgagctgcaccctggggaaatttgattattataaatgtaggaagtaagaaataccaagaggccaattacttgaaatggatgagctccaagtggttagaaataagcagagtttctaggacagtaagttcactgatacactgattcactgccccaggaggatgccacctacatacatctccctctgagtcactgcttgatgaggttaggacagattggaatagggatcaagagactagaagggagtgtggttggactgttgtgtttgaaagcaagggaatgaaaagatctgatataccagaaaattaaattgttttcaaaacatcactgagcagtatctgcaggtggaaccttgtctgttgaaaggtacttgggtattttggaaagaaatattttgggttttgacctttctcttattaactggtttgtaggaaaacctattcagaaggagctaccaacttaatctagtccaggggatgaccagtaattactggtatctcctagtggctgaaggaacattggcatctgttatatagagctggcagggatctttaggactgaagactatagatctctatactccaaaatcactgtggatggtgattgcagccatgaaattaaaagacatttactccttggaacgaaagttatgaccaacctagatagcatattcaaaagcagagacattactttgccaacaaaggtccatctagtcaaggcagtggtttttccattggtcacatatggatgtgagagttggactgtgaagaaagctgagtgctgaagaattgatgcttttgaactgtggtgttggagaagactcttgagagtcccttggactgcaaggaggtccaaccagtccatcctaaaggagatcagtccgggtgttcatggaaggact

SEQ ID NO: 49993 - DNA, 1080 bp, Bovine  19866881084485
gtttagatcgctgtaggctctaaagaatcaatgactgtatgtgcaatgactgctttcatctcagcttttgttcaatgattcttgtttgtgcttcaagttttgcaaactacttcgagatccctctgggctgaaaaaggcaagagtaatataagatatcactggcagtggtaataaccttttatttatcaaacaccttgcttccagggagctcagagtgccttatggatgttatctcatgaatcctcctgacatccctatgaggccgggaacaaatactgttccattctgagtggcaagagagaaaactgtaaggagggaaggtagaaaacacagaaatctttgaagaggaatgaaggtaactcctagtagggccatgatacgatgtattttgataggaaatggaaaatctctcttcccagaaatgtcatttctatcaatgttgacagctaatattgactgaatgcttactatatgccacgtatttcttttaagcacactgcttttattaacaaattgagtcttctcaacagtgcaataagattattatgatcattatactcattttacagatgaggaaagtgtgtacagaggacctaagtgacttgctcagaattaggaagtttgagtcaatagtcaaaataaaataatcaaatcaaatttagctataaatctcaaactcttacctgcttactacactgtggaattaatgctacgttaagacctgaagtaaatacagttagtggtacattccttggtctcatgaatgttttcacctgcaagtctttcaaaatacaggtagtctgagatggtgggattttcagtcaatattgacattattcctcctgaaacactcaagtagaaaaatgagtaggtatgattttgaaaaacactccacatcaagcgataggacttgcagaagattttcaaggcaggcaaggacagaagagggaactaaaatgggtttcatgcttaatatactccatgcacagtgctagcgaggcaccacatgtatgttctctcattttgtatttccaacacatcttctttaagtaggtagtagcatcctgattttgctcatga

SEQ ID NO: 49994 - DNA, 1590 bp, Bovine  19866881094672
cagcctttttaaacctgaagccttttctttcgtcatccataaggtccttcttcctcaagctgatcaagaaataaagaacagttgtgtccaactctttgtgaccccatggatggtagccccccccaccaggttcctcggtccatggaattgtccaggcaagaatactggagtggacagccattcccttctccaggggaaagaacacccagaagggctaaataggctgttttgctggctagacttctcttttgaataaattcaagatacataaggattgtgttggcatgcaggcatgctcatttaattgagtttgaggacagaagtgtttcactgctgctgggaatcattcatgaaggaagacaatggtcctttggtttgccccattgcactaaccttgatctattatcctctcctgttctcagccaatctcagagaacatgtatgatctgcagagtcaggttctcatagaaactatgtcaagactcccaatttcctgcctctgattttgtgcttggacaaattttactctgcatagatctatttcataaaattaagaaattaggtagcattttaagaaagtaagcccctacacattgagattcagtaaatagtaattgaaattatatttgaattctttagacgtcaatccaaagtgaagaaacaaactttagcacctgctctggctttagaaggcccttttttttttttctgttttcccttgtcttttttcgtacctcagtcacatctcctgagattccaaatgccagcataactataaacacaattcactaagtttctggcacaaaatgaatcaacagtggcagttctgcaccgctcagatcgaaggagacgtcattgtgaagtcatgtttggtttttctctctggagagattttccatcctttccaactttgtaatgacaaaactctggaatatggaacacaaaaagaattcatgtaatcaaagaaatccgatattctcctaagtgacatctttgcaaatattattgttatttgctcataaatgaagcaactgggaatcaaagaaaccccagactacatagctcttaagagatgaagctaaactatgaatctgaatgtacggagcactcaccatgatgatcatgcacgtaggtgttccatgttccactgtggttattccagagaaaattggagaattgaacccatcttaatagttacacaggagatccaataggcctttgttagaatccccaattaatagtgaaaaatttctagaaagtttttaatgcaaaatctttagatattctttttgtgcaccagaactgagaaaaaactcaaacctgtctgaatataaagtttagactctattcctaacatttgatgttctctgctttccatgttattttagagcagctctttagggattaaaataacagtcacattatgtcattacattaaattattgaaatacttttgctgctgctgctgctaagtcgcttcagtcgtgtctgactctgtgcgaccccatagacggcagcccaccaggctccgccgtccctgggattctccaggcaagaacactggagtgggttgccatttcctcttccaag

SEQ ID NO: 49995 - DNA, 1387 bp, Bovine  19866881110016
tgggttgccatttccttctccaatgcaggaaagtgaaaagtgaaagtgaagtcgctcaagtcgtgtctgaccctcagtgaccccatggactgcagcctaccaggctcctcccaatcatgggattttccaggcaggagtactggagtggggtgccatatgtctccaaacctcaatttccctacctgtcaaatggggatagccatacctatcctgaagcattgttttgaaagtcaaggaaacatgctaagcgaagcacagtgaaggtacttaagaagtcatagctctcatcattagcagcacttccaccttagaatgtaaagcctaacgtctgcttcctaagctcacttctaatcagacaactgttgttgtttgaccatattccattgacattgttgtgatctgaggtgaaggctaagtccgcaattattctatctcctatccgacttggcagcatgtcacatagagtgctataaaaactctgggctcctttcagagaccacaaaaaagagggttaagggtggaatcagaaaatcaatttagtttccgcctaggcagccttttgctataatgtttcttgaacaacataatggctctgtggagctgatgacagagggcagcagaagaaacagcccagtcgtgatgcaagtttgtctgctgcatcttgagctggcattgcaaggacaatagattctttagcactaggggtaatacttgcagaaaagctactgatgtggcaacctcaagtatgccctgcaaatctatgtgccaaggtctagttctgtacactgcccactgtgtgtgtgtgtgtgttaactcacttcagtcttgtcaactctttgtgaccctatggactgttgcccgcctttgtcatgggtattctccaagaatactgaagtgggttgccatgccctcctccagggatcttccccacccagggatcgaacctatgtctcctgcagctcctgcattgcagctgggttctttactgctgagccactggggaagcccatactgcccactatctatacttaattctgtaaagtctgtttgtcctcataaagtatcaggaaaaaaattaaaaagtagacagaagaacaaaatatttgtagccctagtaatcaaagacaactattgtcagcatttcagcaaattatttctagtttttactaattttgagcattgatccagctgttattatatgttccattacatattcaatcatgtaacaccctgaacaaggagttggcaaactacaacaacagctctgaatcaccgcctgttctcgtaactaagattctattataacacatccaaacagggcaagcctggcatgctgtactccatgcagtcacaaagagtcggacacgactgagtgactgaacaacaa

SEQ ID NO: 49996 - DNA, 1466 bp, Bovine  19866881114003
ttgagaaaatctatgaaagaacaagtgatgctatgagttttatgatcttcaaattaaggggccttaatgcttgccttaaatcagacctcactggttcacaaatcttgtccactttctacaacaatcatttttaacttttgtgctccccacagaactctgaccatccagctgctcaccccactctccttgcttaaaacaaagagaaatgtaagccattacacaggaatcctctgtcatctctctatcagccctggaagactactttcttccttccctgagttcctcacctctctcgttataactgaagaagtacatattatcctgtatctagctcacttatactttagtcttcttatctgatctcagaggaaatcaatgtgttgttctcctccattatctgtctcactccaatgctgaacttttctcaataacatgtgattccacttaagtttgctcatctgaaaatacagtgaaaacattaaaaattctcatttatacccagatattccatctccatctgtggatgattgctaattccctcctgagcttcagtacacatcatcttcaaccactctcctaacacacgatgatcagcttgaactgaacacatccaaagctctgaacactggctattcaacactctaagctctttttatatccaccctccccccccccaatgaatgataccactgttaatccttttcagaatgtcaagtgcctgggagtcatctttggccaaaccctctctttttccaccttcgttaacaaataaacaccacatctcctaaataccccttgaatacatccacttctatttccattaccaccagcaccctggaccaaagaccctcacatctttctggaccatcttaacactccctttcctctttcagtttttaaattcccacttaatcctgtttagtcaattatctggcctgcaatcagagtggtagttcctaagtacaaatctggtgatgtatcacagctgtgtaaaatccttcaatgaattatttttgctctttgctcttgggtgttgttcagtcactcagtctgtgtcccgactctttgcaacaccatggactgtagcacatcaggcttccctgtcctacatcacctcccagagcttgctcagacttatgcccatcgagtcattgatgtcatctaaccatctcatcctctatccttcccttctcctcctgttttctgtctttcccagcaatagggccttttacaatgagtcagttctttgcatcaggtggccaaagtattgaagcttcagcatcagtccttccaatgaacagccaggactgatttcctttaggattgactggtttgatctccttacagtccaagggactctcaagagtcttctccaacaccacagttcaaaagcatcaattcttcagcgctcagccttctttatggtccaactttcacatccatatatgactacggaaaaatcatag

SEQ ID NO: 49997 - DNA, 765 bp, Bovine  19866881168656
tcgggggaacagaagagaagcaggcgatgtaagagaagaatccttataaatatctattcttgcttcatctctctgcttatactcaccctaaatgctccctgatctgccctgtacttattacccctaaatgccattcacatggcaaggaatattaggttttcaccatcacctgcctccatggaagacataaatggttcatgtcactgtgttaaaaagagtgattaagtagaacaaatgttacagttatggaaagtgaggctcagagagatcaataataatgtttggcatttatgtgatgcttttagtcttccaggggcgtttctaccacctaactcctgtgacatatgtgataaggttttaggtaaatggggcagagattatcatctttattatgcagaggagactgagatttcaagcaagtcactgctctaaccacacattaagtatgtgagatcagacaaggtatcttacctctatgtatgtgtcagtttcaaatctgaaataggaacattagttgaacttataaggaatgaaattgggtcatttgtagagaggtggatggacctagagtcagttgtacagaatgaagttaagtcagaaagagaaaaacagagtattaacgcatatacatggaatctagaaaaatggtacagatggccttatttccaggtcaggaatagaggctcagacagaaaatagacgtgtggacacagcagggaaggggatagtgggacaaattggaagactgggattgacatatatgct

SEQ ID NO: 49998 - DNA, 1545 bp, Bovine  19866881288852
tagagaacccccatggacagaggagcctagcgggctacagtccatgaggtcgcaaagagtaagacacaactgattggctaagtacacaagactagcaagaggccatgtgactagcaggcaaaatgctgctttcaagaattcaatctgtgtttagatttttcatcaatatttgcttcagttttgtacaccctatacagttttgggagaaggaaatggccacacactccagtattcatacctgagaaatcctatggtcagaggagcctgaagggctacagtccccagttaaaaagcatcagacacaactgagcacgcacacacacatagtttttggtaaagataggcaaaagagagaatgagtaacctagtcccaatttcaaaaagaaaaatttgaatcatttcttctaaattccataagaaaagctacattgtgtgattctgctctggctgtgttgatcggggcaggggattaataaattttcaatagaataaatttatttcatagaataaattttcaatcgtgatgatgacaagtgtcaccaagaaaatgatgtgagtttttaggaagaatgatgtcagagtgtatttcctctagtgtcttacttagggatgcttttctttccccaagttactgtggtcagcaaaatcccactttcccataaatgaaaagacatttcgggaaaaaaaaaagagtgatgggggaaagaatgaggacaactgtccatcttagagaccatttagtgcaaatgcagatgcctctgagcaaagaatttttgcttcaagtgtagtttttttcctgtaattcttttccaaaattccacttcattcacttcaatcgcatgtgcattggactgttctatgtaaagcggcagtttactcaggaagtggttcttttttagcgtgtttaaatcccaagatgaaatgccacttcagaaagctgcaatcttcatggcactggagagtttcgggagtgcagaaacttcttttctgaactcattctcctgtttaggaaagtagtttaggtttcacaagtcccacccatctattgtgtttccttgaaaagcacaaaggataaaaataagctgcgtgatctcttgagaaaattgtgtttgtaacctatttcctcctgaaagtgatttcaaaagtaaatttgagccaactttgaaaggcaaagaaaaatccctctgttccttttcagtcaatattacttatgacttactacctcttatcttatgcttttcttttctttcttctccctgctctgtccacttggaaatcaaagacaagacagtcaaaagctattagggagagagacttgacaattccaaaagaatatcagttcagttcagttcagtcgctcagtcgtgtccgactctttgagaccccataaatcgcagcacgccaggcctccctgtccatcaccaactcccgaagttcattcagaatcacgtccatcgagtcagtgatgccatccagccatctcatcctctgtcctccccttctcctcttgcccccaatccctcccagcatcagagtcttttccaa

SEQ ID NO: 49999 - DNA, 822 bp, Bovine  19866881290008
ctccttattttatataaacagtgaataaccagtgcttcccttggaagaattgattactgcttcaccctaaggactctgttgagagaactgattcttggagctacctgaaggcatatggaaatagctacattaccgagaaactttttataataaagagctttatctgtaatataatgtacttcttctttctccaaagaagtcagtgcctgagattaaacatccgttgcggagtcagtggccaagagagactttattgagtccccactggccttgtactagaggaccaggacatgattgaaggtggtgatttccataaactgcttcaaggaaggttttaggacacagactggtaagagatattccaggattctttcttcttttcttttgtaatcatgattaaaacaaacaagaacagaccctgggcacagcttctgtaagtaaggaacactcaagcctgataataacttgaaatgtacacagtaccatccaataagagaaatgctaggggcaaatgggggaaatcacatctcgtgttgttttatgggaagtaggctcctctctccttccttccttttctctcatttccttgaaattaccaggctttgtaagttcctgattaactagcacttcataaactttctcattacccatgaacacatacatgacacaaattgagttcacttgctccttcttgctggattaatcatttcttattctctgtgccacagggtcaaattgtgtttttcctgtatttatcgtatgcattttgtgtttgttttcaccttttctgagacatttcttgcatagattctctctcaactt

SEQ ID NO: 50000 - DNA, 1061 bp, Bovine  19866881339223
ttctagcacttattcagtaaatgctgcgaggatatggttggagagaaaaggattctgcacgtatttgctgcaggcctccaatttccaagagctccctctgcaggaaggttcaggttcaggaagccagaatgccttgtggatctgggttactttgagcacaaactcttaatgcatctacagtcaacggccctggccttattgccttatttaacataatctgcctcttgcagagaaccttagaaagtaaatgccagaggctccaggatcaggaattaattataagaattgcaaaaccccggaaagtggttggcaggaggtgccccgtacaatggcaatttgtcggccactgttggaggaatgaagacagtaagcccgatggccacttcccttccctttggcttggagcacttggctttcatttatgaggccatcgggttcaattaagcttctgcatagcgagttgtcagtcaccatcaaggcacctcctggatacgtgtcagagcagcctccttcttgtcacttcaatctcgttctagaaacctgtgagcaggatttcaaggggttgagctggtgcatattgtgtaacactgtattttcctccctttctcttctgactctttttccagaggcttcagccatcacaggtcaggcttgcagagagccgaggggtgccaggcttatgagtcctctgggagtgcccatcttcgtgagctttgacaaggacatccttcggggagactgtagcagcagcttgatcagagtaagcagccccgggccatggcttttctgagggttcacattaacccagcaaagatggagaggtgggcactaatcccaaagaacaaaccaaagtactgaaaagtactgcctgggtggtaggttgagcgaagaggttggctccactctgttcgcctttgaaagcagctgcatttaatttttttctttatcagacacacctgacagctgacatctgtctatgtggcatgcatttgcaatttgccaaattacctctaacatcacccctttcccagccactcaagaaaatatatctgaatgcaaat

SEQ ID NO: 50001 - DNA, 1325 bp, Bovine  19866881351653
aaacagaattttccgtcaaattttttacacagatctgaatatactgaaaccatttaacaagaccttacttaaagctcagggaaagtagaagaacattaatatcaaagggtagcttcaaactgttgaactgagggctatttcctttttaatgaagcccactccattgaattgctaattccattggtgttatttaatactttgagtatgtttcacaatggtagatctggtttcagctttcttctcaaactcctcaaggaaatttacctttaaaacaatgtcataaggatgtttcttttatgaaaacagctgtcaggattaaatagataatccaaagaaatcaagtgtggtatatttaaagcagttactggtcaattactctgatataatccatatagaatccatacagttcaactttctatttttaccttccccatttcagggttatatgaacttgtaacaatttggatatatgaaggtagtgaagtatcacaactctaaaatcttagtggctaaacataagatttatctctcacttaattcatatgtcctttgaggtctcctcagaattctgttgtacattgttctcattatgagagccattctgatggaattgtcatcagccagaacagtgttaatgtccagaggaaaataaaagggaaaatatcctaaacttttcacccagaaaatatacatcttaattttggttacattgtattggctaaaacaagtcacaagccaccacgaatctgaggggtcttcaaagcaaaacttgcactggacaatataggctaggatgactttgttcaaggttattgtacaagggatgagagccagagctcaaagtgagcttaactctactgaaacaaaagacttgagaatttttaggagctggagttggggatcttaagccatctgtgtttgcttattggctttaaatcaaagaaaagtaaacttttgcttttcttcatgacaatatagttatacaacttgcagcaaggcacctgccagggttaggctcctacctttccacagtaactgggagattggggtattatcttcctctatgacaatatttcaaaggtatttttctcaggtccttgataaagacattcctgggttgtaaaactgcaagaagcttttaaaagtttatatctcaaaggagcagagagagaaaactaacaaatttcttacagtaaagctccctatgaaaagggagatcagggacgtagaagcaggaaggagcttgtctaaagtatagtcaagctgagtgaactgtcttggtcaggtaagagaacttcatttctactgtggctctgagagttgaa

SEQ ID NO: 50002 - DNA, 901 bp, Bovine  19866881412550
tacaagaattcagactccttgaggggaggaagcctgtgtatccctgtatctctgacatgacataacacagaagattgtagatactggccttccataaatactagaaaaatgaaaaaaatgtttaagtgtgttttttaaaaaatcagggtaaacctgaatggaaacagaaaacttttcttctcttgttaacgtagattggttagaacaaagttgtaaaagttatttagtaaaggattgaagctcaaattttggtgaataaatcgtttttcatagaaacccagttgtttcataatatatataaactcacttattaattgaagtaatatttttaaaagctattgataaaactaagaatagaataaaaattagaaagtgttagttccatggagagacagaaaattgctgttttttcggtattttattcagccagtgacatcatggaatttatttccccaatcttgcttaataggacatgagggaaaggcagggcggtaagagtagagaactgccaactgagaaggtgcttgtcccctagcaagctaagcaaagagaaccgaagagtttatttttatttgcttttgtggtagggaaattgaaatctagaagaggaaaaaaccatgagagaaagagaaggtagaacttttctcaattcccaaagaacaaaagacagaattatgaatgagtcccagaaagcctgctgagatgaaaagacaccattttgaccaaagaattcttcctttcaggcctcatagttcatcttaaaaacatgaaaacctgaattaagaacagtcaaaaattagtgtgatatgagcagaaagttgtaccgtgttcattggtttcattcaaacctagctctaaaatacgtagatagtttaagacactgatatctccaaagtctaca

SEQ ID NO: 50003 - DNA, 724 bp, Bovine  19866881426566
gcaccagggaagtccctgattttcaacttcaaataaaatcctccttcactctccctctctgtggttcctgagaaatatgcctgcttccatccctttcatggaagaaaccactttgttctaaacaaacaacagagagaagagtgagccagtattggaaagaggcagctgcctggctgagacagggtcgacctgtcagttaagctggagtggagcagagaggcgggaacagtatgtaccaggtgatgggatcatttcagacttgcttttgcaggggtgcccacttaagctgcatcttcaccctttagggtggggaaggtatgggtggaaggaaactgttctgcctttgatttctcctcagagcatggctgtggttgagaaaagttaattgttggaaaacagccttggctctgttcccacgtagttaggcccttctggtttcagcatcagacccagctgctttgcctaaggcttagggctcagagccataagacagcaagaagctgcttcagcgatttatttttatgtatttatttgtgttttggtgggagaagggttttggccataagtgaaacaagccacaaagggagaggagggagaggagagagataaactagaggaatttttcatctccattctcccctggaaagaggagtcttagattggctttgaattctccaaaaactaacatacagcgttgggaaaaaacgttttgtatggcccagag

SEQ ID NO: 50004 - DNA, 1333 bp, Bovine  19866881474547
catgatctgggatccttagttaaatcttgcatggttacctctgtggtgtgaccaactgaagtaaccatctggataaatacttcgtctaatttgttatatgggcaactttctgtataacaaaattatattaaaagaatttgtttagtagtgaatagaagctagttgcttctattgcgagtatgcttttggaaaaggaaatgacatgccactccagtattcttgcctggagaatccaatggacagaggagcctggcaggctatggtccatggggtcacacagagtcatttggacatgactgttgcgacttagcatgcacacactagtatgctcgcaaggaccgaaaaatagaggcatgaggttcaaacctcaccacttcaacttgaattcatacaactgaagaagattatctgggttcagtaatcctcagtgttttgagacctgtcctgtaatctctgacatatcagttatacactgagtctggttatgtattgaatctgtatgcatatacatatcagttatactttctctcaagggaagtggatacactaaccaaccaattccagttttctttttccttctgttggcatgtcatattctcccatatacaaacatcactgcttcttctgtggatattattcttggcagagaggtatctctggtcttccttaaggctttaactcattagtgaatctactcatccgtcttctattggctgattgtctagcaggtatcagaaaaacctatccaggcaaggctacaaacacatccagacgtgagagccaagactaacgcccagaagctctgctcttgaggatgtaggacttgcctgaattagagaaatgagtcctctgcaggatgggaaggatgatgaaattgtcaacagtgatttttctgacttagcataaatagtattgataaacagggggctttgaaaatgccttatatatctactccataatttcttcatgccataaatggtgggttcagtggaatttcatagccaaggaagaaaaggaaatcaaacataatagaacacattcaggtcagcacattgccttcaggacagctggactaatagggggtcaagcacatgtggagaatttgcaaatgagatgaccctggagaaatttgggcacaataacaccctgattagtgagtacagctgctcaggattcagaatcattctgtgtcagtctccatttcaaacttgtcatcaccttcctaacatttggtgtctcatccctgtgctcctcagtcctgccacacagtagcaaagggggcaaatctaacatttatacattctgaaataatcagcgcaaatcttaagaattt

SEQ ID NO: 50005 - DNA, 2029 bp, Bovine  19866880508406
cctttgtgccataacattggaaaagaaaacttgcctaagagatagttcagtgtgttattttttaaccctcttttaagctatgaattgttttcctgcattttcttagtaaccctggagaatcaagaacagataggcagatagctggtttaaaaaagaagcccacaaaccagatcctttattgaatactgtttctgtgtagggaaaggatagagaattctaatttgagagttttactaggtggtggattcattttgatatttggcaaaactaatacaattatgtaaagtttaaaaaaaaaaaaaaaagcttacagagaggctgcctgcaaaaaagcaatgccctttgaagcattcgtatggacatggagactgtatagcccttagggagatctacagacatccgctctgccgagtgctgggaagcggctttttcccatgcttgcagcatccctgtggggtaaagttctgttaattttgcataaatatttaccatatctcattttagctagcattgcttccttacactggtagtaataaggaaatctttgcttacccagcttgaaaagtttgttatagatatgacttgtctggagaatgttgttatctttgagggctgatgaagttaaaagtcagattggaaaaaataatggggtaaattacaaattcacaatccataaataatctacttattatagaaatatttgcccatgtttactgtcctatatttaaaagtgagaaggttattatcatacagtcagcatgattcacttcagctttgtcccatctaacaagtcagatcattgtcgctttcatatatcttgtcagtgtgatacttgagtaatttagtctcatttactacactttaacagttatttcctcatttagttgtaaaagcttcaatttattaagtaggttctttgtaggcattgtatttaatacatataacagcactataaggcagatgttattcctgttttacagatgagaaaaatcttagattcagagacatttgttgactagcctgttatttcccagcttatacatacttgggaccaggtttaaaatccaggtcttctgactcctggttcattgtgtttgctactgcacataattatgggtaactattttttctgtgaaggtagggtccaaacacaactacaaagtatggaattcaaatgagaatgttcagtcaaagaaggttatttatttagtttctttatcttttaacgtggacttccctggtgcaggggtaaagaatctgcctgccaatgcaggagacacaggagacttggatttgattcctgggttgggaagatcctctggagaaggaaatgggaacccattccagtattcttgcctagggaatcccatggacagaggagcctggtggtctacagtccatggggtcacaaagagttggacacgactgtagaacctaagcacacagcacattttgcatagtttgttagaactatttcttattgctaaaatagtaagaccctagtgtttaaagctggagaaggcaatggcaacccactccagtactcttgcctggaaaatcccatggatggaggagcctggtaggctgcagtccatggggtcgcaaagagtcggacacggctgagtgacttcactttcacttttcactttcctgcattggagaaggaaatggcaacccactccagtgttcttgcctggagaatcccagggacgggggagcctggtgggctaccatctatggggtcgcacagagttggacacaactgaagcgacttagcagcagcagcagtgtttaaagcacttacaaatgaacttgaacacaggtttagaaagtaaaacaatgacaatggcgctttagatgtttttatgtaaaagttctaaatcaaagggaaaaaattaagagctattataatataaaccttctgtttggcccacacaggttttccactaatagttagtggaaaaagagaattctttttcatgtgtatgactgtaggtgttttctatattcaacctttattttatgtgaa

SEQ ID NO: 50006 - DNA, 2061 bp, Bovine  19866880511410
ggatccaacctggcatctcttgtgtctcctgcattggtaggtggattctttacaacttaccattacctgggaagcagaagattaaaaaaagtaaatacatctaagaatagaaaagttctcaatggtacccaaaacgctgttgctagtagtttaagaggcaggtagtcttcataaaaggggacttgcttttcagtagattcctattttagcatttatatatatgctaattttttcagataaatgaagaggagaaaaagaactcttggtctcagtcccatttctcaactccattcgccttccgacttccaaagccttgccctgcttccctcccacccagctctcatccactccagcctccaagcctgtctgcaccacaaccactgcccctggggtggctactcttcactgtgtgcggaccaaggcctccccttcatgctcagctgcaagaaacacacaagggcctcaaatgcttgaaggagggaaattgccccaggtgggagccctgtgagcaagccaaggggcttggtttcctattaagtgcggggaaggagtggcagttaaacaccgagcttcaaagagtctagcattttcaaaacttgcttttggggaatatgcagcttttattggaggtgtcagacattaatgagagttctggatgttcccagcctgaagagccctctccctctcttctcttcccccaccccttctaacaactagatagcccctccttgatgaatcaagagaggctcagcctttaaggggtattcctgtcccatggctcagcccacttccccacccccccccatcacctctgtaataaggggtggaagctgagaggatgcaaggggtggggagtgggaacccaagggcagggcagggagcaagttcagacagaggcaaagcgagcccagcttgttcacctgctcctttggacaaggtgtcgtggctgatgattaggaattctggggcctgacctttgccagttgggatgaaccttccgcaaacaattgctcctatgggaagtgaccactctcttagatattttgagctccttaaacaaacggaagtgtgagagctctgttttgtccaaatatgtagttacaaatgagccttgcatgcatgctcactcacccaatcgtgtctgactctttgtgaccccaggaactgtagcctgccaggctcctctgtctatgggattttccaggcaagaatactggagtaggttgccatttcctcctccaagggatcttcccaacccagggattgaacccgggtcctacattgggaggcagatactttaccatttagccacctgggaagcccccacaaattagccttatttgaccacatttgtaatgccttcaaaggtagattgaagtgagcttgaaaggttaaggaacgtgtccaaaatacagggacatcttccaatatgtctagaacagaggacacactcacaaatatttgtggaataaatgtatgcattcgtgtatgcatgagtgaatgagtgagtgaatgatcctgttttctctttatctttacttacaacacttagacattagatgatattagacatttagattagatgttagaaattacttctgttggttaggcattggaatccctgaaaagacaataccctgagatactaaaggaaagcctccctgtcttacttatatttcaatgaatagtggatggatggatggacagataaatgagtaaatgaatggaacgatatatggtatcatcatccctacaaatacaatatgagggcttccctcaaaaaaataagagggcttcctcatagcttagttggtaaagaatccgcctgcaatgcaggagaccctggttcaattcctgggttgggaagattccctggagaagggataggctactcactccagtactcttgggcttccccggtggctcagctggtaaagaatctgcctgcaatgtggcagacccgggttcaaccccggggttgagaagatcccctggagaatggaaaggctacccactccagtattctggcctggagaatgccatggactgtatagtccatgg

SEQ ID NO: 50007 - DNA, 1693 bp, Bovine  19866880596569
cctgtctgctgtgcgggagaaccagattcaatccctgggccgggaagatcccctggagaagggaatggctatccactccagtattcttggctggagaattccatggacagaggagcctggtgggctacaatccatggggtcacaaagagttggacacaactgagtaccacacgtatagtcagtgatgaaaagagggtaaaaggcatcttgaatcggtggggaacaccagggttctggatagaatctccttagaccaggatggagtaatactcaacagagtcccagtgagaaaggtcaaggatctgtctataggaggaacacagcgggcaagacaacttccatctctgtctctcctccctggcatctggtgaacaccagatcagcagtcccagacacctgcgaagacccctgtcgagacggagacaggaggagctggccagccctccacgttcccacctctgagccacagtgctgcaggcccactgatttgcatgctttggcagcactggggtatgagcttgcctggggagcaattctctgggtaagggaggtggaagcacaggagtggagaactgttccagcaggatttttcactcttgcctgataaacacacagggagcgttctgcaaggaggctgaaacgctcccatttctgggctgcttctcttctcaccagctccactcccaggtaaacccagtaagacttcccctgtcactttatgactacgtggcaatgtattggcacttcctgggatagcaatgattaaaataaccagcacctttggagaccctcctgggcagtagccaccagagcaaaccaagagacttcccagtgaagtcattctaaccagtcaaaacagtttttcccaggaccccacagacaccaagcctaacttttttgttatttgagattcctccaaggaactgggcactgtggcctaatggccagagttctgtacagagaacacacggtaaactgagcccgagggttacttcaaaggctattttctgctggactttgggcaagttgcttgatctccatagctttcaatttccattacatactaaaaccaaaaattctgtctgtattcatgccactttcttcgtgggaacaaagaaacaccttggcatttctccgtttcaaaggaaactgaggctggcccctgaaggcacctgaagaacaggacacgggaggaccttgatgggctgggggaagaatgctggcttacgggatgggagatcagagctgcagttctccaccggctgaatggtctcagctgtggatagcaggtgcaaaggtgcagcgagggagacatgccctgggcagacatcactgatgacctgctgtattcacttccttctcctaaactcagtgcatagcgaccaccagcgatgatcagaagtggctctcctgaagaaacccacttgctaccccaggacaggaagatcttccagggtccctccagctctgactccctgtagattttcatgatttaaagcttcttctctagaatggcagagtaaacccaactggtgtcaccaagggcttccttgcgacatggcctgtgagtgtcccagtgactttctccacctgtgccattgtacaaagccttgctctccaggcccttctcacagatgtcaggggcatgggtccgggtgaccatggacagagggcgcccactcctccacctttg

SEQ ID NO: 50008 - DNA, 1472 bp, Bovine  19866880644104
tctcccgcattgcaggtggtttctttaccagctgagtccaagggaagcccaagaatactggagtggatagcttatcccttctccaggggatcttcccaacccaggaatcgaaccagggtctcctgcatggcaggcagattctttactaacaggggaagccctgttaagtgggcagctgacttttatttcactttgtgtatttatttatttagttaattagttagttagttagttattttttggccacatggtctggcttgcaggatctcagttccccgaccagggattgaacccagagcacgacggtgaaagcccggaatcctaacaggaggccatcggggagctccctgtgcatttttagcatttatagtgagtgctcccgaaatgttcgctggtacatttctagattccatttcttataccactgctgactcccgtctcagtctccttatgcttattataggtaggacgatccttagtggatgaaaccatttagtttccccagtatccccaaacctctcatcccagggacccaagggcctatcaaggtactaattagcaaagcctcaggacaggcccaggcggggagggagccttattgacgttaattggtactatcagatctttgcccagtcaggatggagcagcgcaggctgtgacagtgtctctgcccttgggggttcacaatctgtccaagactgcaccgcccccggtggctgtggtgggtggctgggtaggcagctcctcccctctctccccttcacagggcccagcatgtgagaagggcaggggtgaagcagggatagaactaccatctaccataccgtctcctacgaaagggtagggaccagggtctcagaccagccaacactccaagtgcaaccatgatgtctaccctgtgagagacgccagcctctgccaatggctcccagctaatttaatgaacccagggagcttgtttgaagtccagagtcccaggcaatgcccgctatggttgaggtcccggcacctgtatttttaattttctttctttttttttattggctgcaccttgagtccagaacttcccagaccagggatggaacctgtgccccttgctgtggaagcacagagttttaacccctgaaccaccagggaagtcccggggacctatattttcaacaagcatccaggggattctaataaggctggtctgcaggacctcattttagagaagactggtctgatgttcgtgtgtccaatattacttagtgcaaagtcaggtgcacagtactcaacaataataaatgctgattgatgaaaaaaatgaatgaatgagcaagtgggcagaatagagactgaatatctgtagggtctaaatcaaagatccaccttcctctaggaattcccttccttggggaaacttaagcccttcctccctggctcactctcttttgtggttgggaccagatttcttctgctgaaattgcaag

SEQ ID NO: 50009 - DNA, 1585 bp, Bovine  19866880652522
ttcctgaagagcctgagggtgacctgatttatgagaaccacaaacaaatggagagtttccaggatgctaggcactctgtccttttcctgcaccctcactttgcttctctctctgtagcccatggaataggatagtttcttttttaaatttgggctgtgcaggctctctgctgtggctcgggcctttctctatctgcagtgccagcttagttgctctgtagcatgtgaggtcttagctccccaacccggggtcaaactcatgtcccctgcattggaaggtggattcttaaccacttgggccaccagggacatccctttgagaaaaataaggtagaaatggaaattattttctagttggggcaactgagacaaagagtgaagtgattcgttccagttcacacagttggtggtagaagaaatggcaactcattctagttttcttgcctggaaaattccatggacagaggagcctggtgggctatagttcatggggtcagcatcaggcacgactggcaacagtgcacacacacgcacacacacacacacacagttggtaggaggcaggttcataactctgaccaggggccttcactctgccctgtaccagctcttctgcctcatctcaggatccacaacgcctgctgatgccaactggcatgtccctaagtgctgacagggtgggtgggcttctcccgtggcctcctgtgtataaggatacccgaatgagatcaactctaagtgtacgttaatacctcccctgaattgtggattgataaggacctgggcctggggggacgggaattgcctttaaatcaggttctgaagaacatcctagcctctcacccttggataaatttgtctctgcctggcagggcctggcaactgccggtggcccagctcccgcctcattaccaggaagcccagccctgccagtgtctgcttgtcactttctttgtcccagggagcccctggagacctttaggaacacgttccacctgttgggcctggctggcactctccctgcccgcagggcctgaaacaatgactttgctgttgggcttcatgatcatcacttgtggacagggaaccccagggacctgttcagctgggcgctcacttgcattttaatcacgtggccaaagagctctggagtaggaatagggaatcttggtttaaattccactaattaccgtgcatccttgtacttctgttttctgggccttagtttcctcatgtgctgaggatggaacctaatgtcccttccaatcccgaagtgccaggagtcagagagagtcaggaggtcattgggttacagagagggcagagggttaacggctgatttcagacactggtctccctagggtcccagctgtctgccagctgacagttcaagcacccaggaccctgagaacagtcccagagaccttggaccctgcctgtcccaggagcttgaaagcatggctggccttgggtctccatgggaacaaggggcagagggaagaacagggagatggtgcgtggtgggtaggggagggagctgtggacacagccagagttgagcggctggagtctggcccagccccagg

SEQ ID NO: 50010 - DNA, 2028 bp, Bovine  19866880669054
cccctagctcagaactccacatgcagggtggggaaagctcagagctggcgtggcctcagcctggcccagaatgagcagagaccctctgccatccctttttttcccccaatgattcgacattttttaatttatttaattttaaattcattttatttttgctgtgttgagactttgtttctgtgtgcagggtttctctagatgcggtcagcaggggctactctttgtagcagtgtacaagtttctcgttgtggtggcttctcttattggggagcacaggcttcactagttatggtatgtggccttaacagttgtggcttatgggtttagttgccccgcagcatgtgggatcttcccagatcagggatagaatctgtgtcccttgcactggtacacagattctcaaccactgggccatcaggcacgtcctgccttctttccacagatatcactgggaaagcccaaagccagtgaccacccagcacaaggcaactcaattaactaaggttttaatgagggctacattgacaacttctattgtccaagtctaataattctctttaactgagatcttttgccttcattaaagtaattagggcctgtgaggaaatgattagaaaaactctcaggatttccacccgtcatgtggaatcccacatgccatatgtttcatcactgggacgcaagcttggtcaattctttcaggtattgtcactccttaacaaagctaataagactctctttttttttttgcttcaaaagtcttaataagatagaaaatttgaggaaatcaatcagtaattagccattaaaactgatttatccagtactatgagagcacagaagtatttaataagatccttgtggaacttccctggcagtccagtggttaagacttcaatgcagggggcacagcttcaatccctggtagggaaactaagatcctatatgccgtgtggcacagcaaaaaaataaataaataaataaagatccttggtttctgggaactaagaactctggataagtagaaaaactggcataccacataacgaggcaacagctgaataggctcctacactagaactagagtaagaaatcatgtatgcatgcattcactgatacaccacgcacaccctactagcaggagagtctatacaagtggacaccctggcagttcatagtggcaacaggtgtcccatacagacagccatggggagagcatagggtgatcattgacattttaggaatcagtgaactaacatggaccagaacgggcgaatttaattcagatgatgattatatctaccactgtgggcaggattcccttagaaagaatggaatagccctcatactcaacaaaagagtccaaaatgcagtatatgggtgcaatctcaaaaatgacagaatgatctctgttcgtttccaaggcaaaccattcaatatcacagtaatccaagtctatgccccaaccactaatgccgaagaagcttaagctgaacagttctatgaagacctacaagaccttctggaactaacaccaaaaaagttatccttttcatcataggggactggaatgcaaaagtaggaagtcaacagtggtcacaggactggaaaaggtcagttttccttccaatcccaaagaaaggcaatgccaaagaatgttcaaactactgcacaattgcacgcatttcacatgctagcaaagtaatgctcaaaattctccaagctaggcttcaacagtacttgaaccgagaacttccagatgtacaagctggatttagaaaaggcagaggaaaaaaaaagaaagaaagaaaaggcagaggaatcagagatcaaattgccaacatctgctggatcatagaaaaagcaagagaattccagaaaaacatctacttctgcttcattgactacgctaaagtctttaactgtgtggatcacagcaaactgtggaaaattctgaaagagatgggaataccagaccaccttacctgccacctatgaaacctgtgtgcaggtcaagaagcacttcca

SEQ ID NO: 50011 - DNA, 2326 bp, Bovine  19866880686436
gggcctgagctttcctctggacagatgccccagctcttggaggagttctggtgtgtctggagaagccacgagagtgtgctggcaagaatctagagttggaattctacctttcagccgcttgccggctgtgtaacacgagaggaagctcatcacctccctgaactcagtttactcagccataaaatgggacaggtgctaatcttaactgcatctaatgataggaacctagcaggtggccaagctcacctaagtccccatgcatcctcatctcctcctgggacctggatgggtcccagctaattatcacgttttctaggtgaagattctgtctcttgcctgctctatcaggttccagattgctgtgaggctctttgagagaatgatgtgaaagttatttattgagtgacaggggctgtgggagcagccacctccctcatgtacagagctgggaagtgacttgtccaaaggcaacacagtaccctagtgatggaaggagcctggctgggggtaggatcctggccaggggtaggtctctggactcccactccatgctctctccagcacccatcatagactcatcctctgagctcccctactcttctgctccactcttcaggtcccggtaagaggtgccaaggtcaagagacgacctgcctataagcctaggaagctgggtgcccccagcagaagcagctctcgccttgctttccaggcaggtctccctatcaagctgcttacagaacagatcttggatttttctgcctctatgcattgtttgcagtatttttttccaggtggtatatccactcaccatccactcccataatccccatcataacatccagaatttattgagctttcagtgtgtgtcaggcagtgtgctaaccagcactttaaagtcacttgatcttgtttagtcctcataacaactacacattggactgttatatttccgttttacagatggggaaaatgaggtttagagggtttagcttgccaaagttacccagccagtaagtaacagggctcctatttgaaagctctacactctgttccctctgtacataattaagatgccacctcctttctgaagttagaagttacctgatctgttattaaattactgtaacacttcaatgttcctaatagcccttgtggcctgttctgtaggacttttcttattcttcctcctggctgttaactgattgtcttccccactgcaccaaataccatgtagggtacatgtcaggtgtcagaaagggctcagtgggggccacagtagccctgcaaggatagaaagtgtttaataagtacctcttcgggtccatacaaccactcaccccctgtcgcaccttccgctcctctccccacccttggcaagaaggcaggagactttcttcctatttcttctggcagaggaaagagaccagtagctttttggaggcctagtgaacccagggatgtcccctcccccatctgcctcaggacactgccaggctgttcccttctctttcctttccttttctttccctcctccacttcaggtttgccccaaatctgaggccattgcttatctacaactgcacttcacctaccatcatcctagaaaaatgcctgcacatagtttatatacccctgtgtgcttgcaatttccatatctctatttgcatactatttgcatagccatgtgcaccaggggtctgattctctgaccaccattatctggaacctctgtctcttttctatgtgcaaaattacatttctttctggggctttacttttccagaagccagaggagcatgtacctaatgactcttaagggacttccagctctagtagcctaggattctcgggtcctggggttaggagggggtggaactcctggggatggggccactggggaagagatggggccttatggggccttataggttcatagttggaaggacagctgtgggttccagaccacaggaggggagattgtgtgcaggaagggagattggatggaggatgggaggttgggggaaaggtggtagacaggacttcaccttcattcatttacccattcattcaataaatattgactgagcacttcctatatatcaaggaagttctccatgctgggcatatgccttcttacttcatccgcacacctttaggagaagcatacaatttttagatttcttttatggatgaggaaactgaagttcagggggattaatatagctaggagatgggagagttgaaatttagactaggtctgcctgactccaaagctggtgcttttaatcctgctgtccaacgtctgagcctgtctcctcttctc

SEQ ID NO: 50012 - DNA, 1263 bp, Bovine  19866880706028
ttggacacaactgaagtgacttagcacacacatgcgcacctgagttggtcacccacaccccacacttgggtcccagcaggcaggagcagccctttaccgcccttgtctatatagaaaacccccagggttctcaccttgctgcccaggctggctctgagatagcaggaactgggaaacagactgtaggtgtccgggaaccagcacgagctgctggagtgggtggagggaggccatgtcctatgcagggcgacacagacatcatagaatttacaagctgggagcgtgggctccatccacccgctgcctgtctgtcccaggggtatccaccgggagcttgccctatgcctctgtgtgtccttgtatgtggcacatagcggctaccccgttaatggtgctattgatacactgcctgtcctcagtcaggccgtgcctcgcagcctgttgttacttaaccttgccttgttatttaactttcgtgtgtgtcagaactgtctcccagctagactgataatgccccgaggacacagactgtgggtattacccatctctcagaggtttaccctagaaatgacacacagtacacatttttttttttttaatctcatgccctttgattatactaaaagccattttcgtctttggccgtttccagggtctaaaccattcctgggggaagaagcccgttgcttgctcttaataaaaacgctttgatgaaacagaaagtccatttccccttggggttcctcccattagcccccacaaagagaaataccagtcccaatatccagggacatgggagtcctctgtgatctggacccgtgggagtctatgatccccacaggaccgagcttaggtctgtgcacaaagaaaagacttggtaaatccttgctgaaaagaagtgaaagaataagtgcacattctatccttaaatatttccagggaagtggtggctcattcttccctgggggaatccatatcaaatcagggactcaccctgtggacatccagccttctcagacatttgtcattactatttcaggagcccctttattccttctagcttgacaaactcttgaggaggaagaatgggcttagtggggacagaagtgctctgtgaccataggtgtcatcgtggggctccactgaatatggctggcagaccccagccctatagctgtgagccctatcattttggcaagacaggctgctttttctcccagaggggtggagacctccctctttgcataagtagccaggcttcat

SEQ ID NO: 50013 - DNA, 3668 bp, Bovine  19866880725335
ggatagagaagtgagctggggagtcataagcacacaggtggtggttggcatcctgggtcaggagggtctcacctgtttaatttgtacagaagaagcaaagaagaaaattgaaatcccaaccctgggaaacaccagcatttgagggctgggcaaaggaagaggaccaaggggagaaaataagaaggtggagccagaaaaggcaagaaattgcaatgaagtgggtgaagcagctgtaaggagccctgaaggattgccgtgggaacaccgatgaaagacccccaaatcaggatgggatgcaggagggctgactccctaatttgtttggagaacaggttgggaattcataaaaagaacagcatagcagaaggaatagtctgtgagaggcattgaattctaaaacaacatgatgcatctggggaaccacaagctttttgttctggctggagctaagggtttaggcctaagacaggaggttgatgagagctggatcatggtgggccatggatgctaaattaccctcgaagctatgaggagccattgacaatttgaagttggagacaatatgatgttcattgaccattcatttcttaaatatttattgagcacacactatttggcccttgagatgtggcagtgcacaggatcgttattggtgatctctgcttagagtctagcaaggaaaacagacattaaacagaatgcaatttgtgatgaagcctccagagaaggcgtgtgggtatttgagggaccaaacctagtccaggtatcagggacttctctttggaatgatggtcaagttgatggcagaagaaagagtagactcgaatggggtaaaggtctgagttagaggtggggaaggggagcaggatggcggggcagagggagtgttgggaagaacattctctgcagatgaaacagtgtgggcaaaggccctgaggctggggtgggcagggagaggaagcacagaaggttggaatggaacacagggagggagactgtgtgaatgaggaggctggagcagtaggcgggctagatcctgtagggcactgtaggccacgtgaaggaaaccgaaccatgccatgagagatttggaatccttaaagatggggctttgtctagaatagttgggaggtagctatcacctcagttcaaaccgagctggggacaccaatgtggagaaaagaagtgggaggcatggaagagccataaaggagcatcatgcattctcatcgtgcattggatactgagcacctgccaagttctgggtgctgcagcagacactgaggatccagcaggggaccacacaagcatcacactcccctcatgaagtctccagcctagtcagggagaaagatgttaaataaatagtcacattaatacttgcagtcaatgctaaaggaaaacaaccctgaatattcattggaaggactgatgctgaagttccaataatttgaccaggtgatgcaaagagcagacttattggaaaagaccctgatgctgggaaaggttgaaggcaggaggagaatcgggtagctgaggatgagatggttggatggcatcactgactcaatggacatgaatctgagcaaactctaggagatagtgaaggacagaggagcctggcacgctgcagtccatgtggtcgcaaagagtcggactcaactgagcgactaaacaggaacaacaatacttgtggcgtcctgaaggaagagggtagagaaaatgctctaattcggtcttctccttgggtctcactggaacattgtccttgggactgggacatagtttcttctacttctggtgtgaaataatctccaagatatactgttaagcaaaaaaaaaaaaaagaagaagaagaagaagaaagaaagcaaaaaaggcaaaattattcagagcagtgtgggcagaatgctactatttataaaaaaacttaaagggagagccatatctctgcttgcacatgtacagcctgtctccagatagaagagaagaagctggttgcagtgactaaataattatttatttaaaaacaacaacaaatggcttggggtgtggcagcaaggggtgggtggaggaaaagagggagggagattattgatagcatctctcaccacgctgccccacacctgtctccacccttcgtgggcccccagcctactaaagaggctccttgtgaaagggtaggtcaatgaaagcagcagaaccattgctgattgattaggaaacgagtacatgctgaatcctgtcggcatgggatgttccaaactaggggagggcaggggtggccagtcgaagctccctgagcagaacctcccttacgaggtcctgggtggaggctgatccgagtgtcccaggacagcatgagaagatgaagggggaggaaaagtatgccgagttcagctccagtgaagagataaacagcagctcaagacatacaagagttgacagcttctgcaggaaggcagggaactaacatttaacaagccaggtactctttgccaggcattgagttagaagcttaatggacattatctcattaaacttaattaaaagaaaatatgagggaggtgttactgttgttttacggatgagaaaaccaaatctcagcagggttaagtaacgtgccccagctacacagacagtggtggagccaggcctcactcccagatctgttgggcccctgtgtctgtttaggatagtaatactgagggtagggattcctggactgtgtgggaaggttaagctacagtaccttaggtcccttcccagcccagagttgatgatgctgtgaggtctccagggcgagatgcaaagcttcagagacctcacacagttcgtctcctccagggacctctggagagtggatggtccactcatgcatcaagatgctaagcctgtgtcaggatggttagggctgagctcttctgcccaagcaagtgcaggggtcttaaaaataaaacacaagcatttccattattctttttttaatgtttatttattgggctgcattagatcttagttccagcatgcagggtcttcattgatcatgtgggatctttgaggcagtgtgagggctcagtaggcgcagcatgtgggcttagctgccccatggcatatcagttccccaaccagggatcaaaacctgcatcctctgcaatggaaggtggattcttaaccactggaccccccagggaagtccccacaggggtcttttaagaaggaagaagaagggactggaaataaagcagccatcccgcagtgtcggccacaacagcatcctggaggcatgctcctctcctcaccagagcatctgagcaaggcctctttggtctggcagtgcccaggcagccttgccaggggtcacactgcagagaggccctggcctggggtccgcagggagtggtaggagcagggcagagctggagctgggtggtgtacatggtccagagcctttcctgtgacacagagcacagggcattggtttgggattaggaaaccatccaggaagtggagccctaatctctgtggagtctacggcctagcaccctgggagaagctacagaagatggacacggaaatggaagagaatgtttacaagcttctctcacctttcaggtgtctccctctggatctctgggccccctctctgtccctccagtccacagcac

SEQ ID NO: 50014 - DNA, 1500 bp, Bovine  19866880741238
aacacacacacaaaaatcctcagcaaaataataggactgaatccaataatacggaaaaaggaaaataaattatgaccaactggggtttctcccaggaatgaaacaggaatatctgtttcaaaatgctaataacaccaattaatgtaatttaccatgatatgtagttccacataaattatattaatgtaatgtaaatttaataacaacatctgatgatctcagtcattcaacaaaattcaacatctattcatgataaaactcctatcaaactaaaaatagaaggaaacttcctcaattaaaaaaaaagtatctatggctaacatcatattaataataaatgactgaatgcattcttcctaagattgaggataaggccaggaaggccaggatgccctgtctcaccacagtgattcagcctcatactggaaatcctaaccagcgcagtaaaggtaataacaagaaataaaagataaacactgggaaacaagcaaataaaaactgtcagttatttacatagaaaaatcttaaaaagttaattttaaaaacctctttgaagtagttagtttactaaaagatcacatgagcttactaacaaggacaagaataaagccaatcacattcctatataccatcaataaacaaccagaatttgaaaattttttaaaaatttataagaacatcccccttctcccaagataaaatacgtaggtaaaaatcaatgacttcttatcagcttcaagagcaaggccatttctattggtcaaagctaaaataagcaattaacccaagcaagtaaacaattaatcttagttctaatgagcttcaaatctttatcaatataatttcaatctccagaaactgttcatttttgcaataaatcaaacatcttagaaaattaataatttggtttttagaaagaaaaagtcatcacctgttcatgttcactaccaaagtcatcgtcttctgctccaataatatgaggtgccacacgggtagagggactcccaacaagcgactgagtgtcctggaaacattcatagagaaggaacagaaaaattgcctggtggtcaatttcagagacagaataaagccaaactatcaaaaagacatggttcactaaactgactggatttcttttccttttctttaggtactttattttcaaagtggttctcaaattttccagtattgattgtttcttggtcagggggagggggagaaaacatttcccctagaaataataaacatcctctgtttatacacccttgtttatctggttctaatccctgtctgtaggcttcatttattgtttcatatatatctagaccttgttacagaaagaaattaagctggcttacacaaacagttacaatttttaacagtgaacgaaggccacaggacaaaggaaaaatggcactgttgacattttgggccagatgattcttcgttgtgggggctgtcctatgcactgtagggtccggagggcatactggccactgc

SEQ ID NO: 50015 - DNA, 3072 bp, Bovine  19866880777571
ctaagtagagaaagtaaaataccctaaatctcatctgttgtccaaaattctgacatttgaggtaacaaaatcactagcaaaacatggaagaataaagatatctatttaaaataactttaagtatcaacaataaaggtctactaatacaacattcaagagctctatcttatatatatatatatgtacgtgtatatatatatataataattcaaatatccatgttttccttctgttacttatcattagtaacaattcttgtaaatacactggtaagaaagtaaaacattatttcaatattaataacagtatgtcttattggaaaaacctgcttatcattgcaaatctatttcttttcactaataagtggaaataacaggaaaaaacaaagttaaacaacacaagcacacacacaagaaaaaccaaaatggaaaaatgacacacaattttaagattagactgaaaaaccactgtaaaaaaaaacgaagaaaaaagaataacaacttacagatatatctcatcatacagtgatatcttaaagctacaaccacatctctttattaaattcagagatggttcaccctcatttctgattaattttcaaccagggatggtttatcatttgtttgctacatttttgtcacataattgataatacttgtaacttacattagggcacgatatcagaaagaatcactttgtaaacaaggcttttataacatgagcaatggcttaattagctgatttgctaattatgctgtttgtatatatctgcttgtttttttgatggtgacatctcccatatccattctaaaaaaactatctaaaataaaactgagtcaaaacggtcttgagaatttctttacttataattttgggctatgcctggagaaaacagaagacccctgtattatggtaaaaccaaactggaacttgttctagaatatgaataaagataaaatatagagtatcattttgtagtagaacagcactgaaagaaaaaaaccattttgcactagatgagcaactgaggaaaagctaataaaatattaagaggaacagactgacttttagacacaaatcaacagaatatacaacttggctcagcaaagaataagggtggggggaaggaaagggtggtggacaactgtctaaaccatttacagtcacataaacataaaatgggaggagatcattatttagcctagtacagcaagtgtatacaagtaacaggacaacttaaaagaaaagtctgtgctaaagatcaagaaagacttcctgactataagatctatcagattgttgttcagtctcctgaggaagtgacgatagctttatcctctagagatacttaaaattagaatggataaggtactagaaagcatccggtaagagaaaaatccaaccctgacttagcttggaaagttacaagggaagcaggacagaaaaaatacacacggaaagacaataatttagagtgacatctggaggacttgaaagccagaaaatctaggtcatatcttgaatctatcctttccagttttataatcttaacttaaatgctatgagttgctctaagtgtaaatgatgatctgcctcacattgaattgaagacactgtaaatgttagagccacactgccataggatatcattacatatatcagggtattttcttcaaaaggaaacaacatttataattttgctgattttaaattttcagtccaaatgccattattttgaagattcttaactactgaaaggaaaaggaccgtgccttccaatgaagttttaaaacatcatcaacaccatgttttaatggatgaaacttaatgaagttaattatgctccctgtttctgaaaatgtggcatggtcaatccctaggagataagcaattaaatgataagtagcatttctggtaactttgttagacaaccatgatgtaaaagcacttctccaattaccgctggaaaatggttaaaatatcctgctgcttttacaacccgtatcagtaggcaggcaattcatactcaattcatgaaaccacccagtggttaagtggtattaccaagttaacatatttttattatgattcaaataaagcttctctcatcatctcactaaatacacgtgaacatctttataaatgtgccgttaatctagaagactataggctctgtacttttaaaaaaatttacttggactgtacatgttgactcatgtaaaactgtacaagtgaatgtactactgcatacctgtctgaatcagaatttaaaactgaaaaactagaagaaaagaacattagagtgaatacaaagctagctctgtgatcctggccctactttcaattcagtatttatctaatgactgattttacaaatgaatgctacaaataatttcaccttgcagatgactcaggcagccttgaaaacagtgcacatacagaatttttgttttgtattttaatcaaaagcattattatatggcactgttggcagaaaaagtattatgaatgaaaacgttaattactgggcaaatgcatataaagcctctggtttccagtctcactttaaaaaggtgcttctttaaaaaaaaaaaaaaaagaacaaaaagacttgcttcagttaaacagcttaaagataaacttacagtgctaaaaaaaaaaaagccaatatattaaaaaccttttatctataaatcaaaaccaacaaaatctacaagtcctagagaggacataggttcttttcaacaaagacctttatagcaaaatcgtacctgtattgtccctgaaaattcactgttctagaatacagcctgaaacaatttactcagtccactgaaaaaacattctcttatctctcaaaagaaattccaactaccacaggacccctaaactcttagggtgaggacaagcatccaggaggattagaaacaattaggattatttggggactaaggacagcaatcaatgcaaactggagaacagcaatcagatatttctatcacttttcaagtgctggttctaaaagctgaaaaatataatcttcaggtttcatagaaattacaaagcaagaca

SEQ ID NO: 50016 - DNA, 1214 bp, Bovine  19866880813815
ccgaccacatgggaaattctccagttagccctcccagtcatgagaatgaggccacaaccagtcaaaggcggtgggcaagagggaggccaccagagaagcctgaagaaccagccctttgtgctggactggggtccttgggggatgagtgcatttttggcgtttttagaatgatttttttttttttttaatgagcagcagaagggggaaggggagggagggagggagggagagacagagaggccaaaggcaggacttgggaaaagaagagagaggaggaggggtaagggctggagagggaggttttaaagaacgtggaaaaatataaaaggaggtagagaaacagagagagacagggcccagcagggcaattcttaggacagaggggagtcgccatgtccatgcctgaatggacagcttctaaagagaaagggtgctcatgtttggaggtggaggagtgggtgaaatgaaggtgccgagaaagaatttgacctccagtttacatgtgggaaaaacaggcttcaaaagggatgcaggatggacttttctggtggtccagtggctaagctccccatgcagggggccctggattgatacctggtcagagagctagatcccacacgctgcaactaagacccagcacagccaaataagtaaacctttttttttttaagttgggggaatgcagcagctggtggagacttctccccacaccaggcaccaggtattgtgttgaaaggctttgcaagcagcacctcatttaatcctcacgacaaccacacgaggcccgggatgtgtcatcatcccactcagcaccactttgcaggcgaggaactttgagaagtcgggcaccttactaacacctaacgtgacagcaatggcaccccactccagtactcttgcctggaaaatcccatgggtggaggagcctggtgggctgcagcccatgggatcgctaagtcagacatgactgagcgacttcactttcacttttcactttcatgcattggagaaagaaatggcaacccactccagtgttcttgcctggagaatcccagggacgggggagcctggtgggctgctgtctatggggtcgcacagagtcggacatgactgaagcgacttggcagcagcagcagcagcagcagcagcaacgtgacagcagtcagctgagccgcagcggggcttgcagctagctcagagctcatgggcacctc

SEQ ID NO: 50017 - DNA, 804 bp, Bovine  19866880830256
gaaaagaggttttcgtcatgacccacattgtttgtgcagtttagagtcagtgacccagtctcatcagttcaggtgggacccttcctgacgaaatctaagtccccggatgctggccaagggccaaccttgcagacagccctttccaggcctgctctattaactcttttctgcacaaaaaccatagagctagagcttcggatgagagatgaatgaggtgtgggcagatttaccgagtcctgttgtacgagttctgccctaccaggaaaactatgccagttctcagggctttcgtgcattaatctcctaggcatgagaggctgtgactgaattccgtagggatttaccatgtagattccactgggcttgagatgccagttcaggtttcagctctgctatacatactacaaaccagaaccaaagaccaaatgtcctggcctcagggtgatgaggctggttttttttttttttttttttttccatttcagatacattccctgttcatcttgttactactttttctctcaaaaaggtgccactctctctggacagtatattatgaaaaagccaatgtcaggaggaaaaaaatatttcttaatcaatagtctctcatcttacctaggcaaagcaagaacacaagtgtagtaaaagggcttaggaagtgagaattcttaggttctttgaactaatttggctactcacctgccagatcctttgggcaggtcacttgtttactctttacctctgtttgaaccctactgtcaataaacaaaatactccattgcatatttcatagagacattaggt

SEQ ID NO: 50018 - DNA, 1087 bp, Bovine  19866880906989
tcgcttgccaaagatcacgccagtcactagcaaagctctcattccaatctgagtctgcctggttccaaaacctgtatcctcagccactatttcagggctgggtggctcagtgctgagaactaggagtcctcccacctctttcctgttgctccagattggctgaattctctttggctgagaggtgtggagtagccgacacagggctgcccagcccaaagtccctgtccactgggaaaggaactctgagtcctgggtgaggggagggaaacagcagggcgcagggagcctggagggttggcccggggttcctggaagccctctcctcagtggaacctttctcactgtctgctttctagtctctgatcagctgactgctgggaggctgtcctgctaggacaggatcagggcattgggcacttggagctgtcagggagaaatatgggaatcatttcaacaggtaatcacaggatattgtgagcttgttcagtgcaaagaaagctcaaatggcacagataatcgatggacgttgcatctaagggatttcctgtggatggccacaaaggagtcttccctggggccctggtggtgggatgaagtgctgggctgggggagggctggcagggagtggtggctgtgatgtccgaggggccgatgaaaggttaaggggagttggggagagtgtgcctttgcctttgatcaggagtttagagactgcattttagccccatcttggtcacttacttacacgaaaacttggcaaagtcgttgtttttctggagcctcaatttcctcctctctgaagtagagggattacctggatttggtcagttcagacactctgattctgccatctctagaggctcctcagctggaacgtcaggacaaaaaacctttgtaataatcaacacgggcacggggtagagcttgtgcttgtcttcatgtgtatcttttattagtagtgttagcaacagacatgcaacagctaacattccttgaggatgcaggacatattaggctgtatggcaagtacactatttcttttatccctcatgtgctaagtgctaagttgcttcagtcgtgtccgact

SEQ ID NO: 50019 - DNA, 2270 bp, Bovine  19866880998321
acccctcctcccacctccctccccatcccatccctcagggtcaccatcatctttaatatagcaatttgatgagcagaaattctggaccctgttgtatatgagcttttaattccagagttcactttttcccctggacaccattgccaaatgtttcttttaaggagatggaatttcccagcaggcgtcttgtttgtgggtagagaagttaataatgccggtgctttcttactgaaccgagaggccaactgttgatatctttaagagcatgttaatattccatttgtggtcagagtgactcagtctcgaatcatggggcactttgccatttcaaagaggaaaagccttagtcctcttagacttcagttaatagcccatgtttagtaattctttcttggttaacccaaaaattgccagatgaacatggatagctgttaagatgataagaaagagcacgtgtatacctgtgatggattcattttgatatttggcaaaactaatacaattatgtcaagtttaaaaataaaataaaattaaaaaaaaaaaaagaaaatattttaagctgaatatgatgtagtgtcacagttatatgaatacttaagtgttatatgctcagcaatactttgtaagtagtatgcagtaataggaataattacttcaaaatagatcacccttcttaaaaatgatgaagaaaataatctgttgtaagtcagtgtttttttccaacgtgggtcataaaatcagtttagtgggttggggccagtatttttttttttaaaaaagaatagaataagaaataagagtgctttgcatgtaaaggaggtaagtgttactttttgtgacttttgttgtatacacacatgcacacattgtgtgcatttgtacacatgtatagctgtgtgtgtatgtgcacacgttggttaataatgtaaaatttctcatagtagaggttgtaaaaaaaaaaaaaaaaattgaaagccacttgtctaagccaccaccatttagggtatcttgatgcttaggcccagtgactcagttcctcgtgcaaggaagatttgaggatatttttattttgaaagatactaataggagtattatgattagataggctaattatcttgatgatagatttcaattttgcctcaagaaaagaattatagtagcttacatttattgagcatatgtattaataccatcagctataataggtgttatacattttttatcttagttaattctcagaacagcctgatgaagtagtactattgttattacttaaacaaaaggaaaaactgaggccaaagcgagttagctaacttgccaaacttactcagctagtaagtgattgcctctacctaatttcaaaataccagcactcaaaggctccaaggtctgaaaatgcattatattttgggagagcagtgaaaattttacaggtgtactaggattatattaatgctaaaatggctggagttgatcttacaaacaaagtcttgagttcaagttataacttgttctagcagtgctgcttctgggaatcctcacatttcttctgtttgattcagtgctgcatctcctctctgattgcatggcttatctctcccattagatgtttctagtggtagatgtttctaagtttagatatctctaaagcaacacaccatcatatttgactttatatctctgaagacaatgagattgtaggaactcagaacaagtgatggaaatgaaaaatttgaattttatcttatttacagaaatgttaaccataaaatctgtggcttagaaatatcactttatgaaatacagagtgaattggcaagtgtagaaacaggcagtccagtgaattcagactgttcgacatgtgtctggtgtctaattggtctttgaacaagagtgaatgagtagagtttgggctgtatcttgcatgcagaagagaggcacagccagaaacatgtccgtgtcgaaaatgaattgaagtaaatagacagggagatcagtaagaaaagacgactacttggcttaagaggaacttgacaaatgtgtgttaaatggctgacaaattgtcaccatctattgaatacctactttgtgacagtagttgtacctaatgctttacagttactctttttaactctcatagtgatcttaaaaaagcaaatgtcaccattttatagatgaggcaattgaggccaaataagtggatgctggggaaatccacatgtgaggcaatacagtgaagactactcactgaacacgtaacaaactcatgt

SEQ ID NO: 50020 - DNA, 1757 bp, Bovine  19866881018734
cccacaccttggagtttggggaggggagaggagttatgagctcatgatgtgaactggagtgcttgtgggagaaaaaaacatttcaaacgagctaccaacctaatcagtagagctctgtgtgtgagtgataggggtgcgaggataatcattcgaggcctgaagggttggtctcgcatgtcatcttggagtatgacaatgatgagaataactaacacctgcatacaggagtgactaagggagcttgggttctaagggagctgcagagacccaagtttatagctgagctcagccgctagttactagctgactgacctctggcaagttacttacaccctctgcttctccatctcttttgtgaggtatcatcataaatgactcctctgtcttttgtgcaaggtgacatgttctccacctgggactagaacctaggtcttatcaattcatggcctatgctttgtgtacactgcagtggagggaaaggggactgtgcatgtttaattagctggtatagggaagagctttggagatacaaagctcttgataagtggtaatcctcttaaatctgtgtagggctgatgtgtggatggaatatacaaggccaacagcattgggggaattgacgaggagggcagggcagcccagacagagagacagggaaagagagagaaaatgagtcaatgaatgttgagcgtgtgcacacaagtttgtatgtgtgtctgtggatgtacgtgcattgtttttgctcacctttggggtgcttcaaagtgatgggtagggattaaagtatcagatgggaccaacaggagacctccatgtctctgcatcccgggagttctgggattctctcctcggttggaaggtgaccctgggttctggggcagagaagcatggaagttctgaatgcacatctgtgtggcccaggggaggtgttgaagaagaacctggtgcagagtgagctctctgcatgctgccctgctcactcaatgtctcaagatgcttataacatttgaaaattggcctgatgattccttctggcaaagttgccagtcctgctgtagactggaactgggggatctgtgaactcagagacactctgttctgctttgactcagtggcggacaatctgttttcccctaggagctgggttttggtcttcagttatcagtcagtgcgctctctcctctgtttcctcctcctccccataaggaggctccgcccacatcctcactagcttccttcttttgccttcctcctttcctctgctggtggtgagggcagccagaagtcgacctgggttgaagatgtaagtgcctgtagttccttgcagggggtgggggtggggtgggatggggggatcccgggaaataatcatttgcttgagaagcgagacaacaaaggggaagaagataataaagcaggttgtaggttacactatgggcaaccaccacctggccccactagggacggtgggagagcatacagggcatcctagagcaaggtatcccgttggccgctgaccggagattgtgacacttagggcttgcgtgtgtacctcggctgcatgggttccggggaccagaaagttctcaggtgagctgcaggtgcctgaggctggaagccctcaagttggggagcatggatggaggtgagcagggccccacggctcctcctggccatcccgaaccaccctggagaccagacccgtactcagctgctgggtacgggcagctcctcgggccatacccgctcacatagag

SEQ ID NO: 50021 - DNA, 849 bp, Bovine  19866881019828
cgcacttgtaagggcgctgggcggtcgcggccggtggcagtacttgagcatgcaggggtaccaggccaggctcagaccatagcggcagatgcagggcttcccgcggtcccccacctgcccgcagcgaggcagcaacacctgctctgaagccttggggagagcctcgaacacggagccatccacacctgggagagaaggcgggggtcagggcgggggcgggggcctcccccacatggccccttcaggcatcctagtgctcccatgagctaagtgttaccatccttgttttacagatgagaaaactggcccagagaggttatcggcctggctgacgtcacacagtaaatagggattcaggactgtctgacttcaagtcctccacttgcccctgccagtgccacgcaggcatcacttcctccaggaagccctccctgaccagtcctagctgggtggagaactcccatatctcatcattgctccccatcatatttgaggtgatatagcagtgggccgcacccagctgaccttgctccagccagaaccggacgtcttcctggcgggtgtagatggcatccacggcctcggcacacacgttgcggagatgggggctcagcagcgccccctggctgaagttgacggcgatgtccatgtgcatctgctctgggccccgcacctcctcagcctgccgcactgcccgtgggtttttctgagtggaagagaagagttgttcctacccggcctcagtcagccccctgcccactctttccctgatcgctgattgtcagacaaacccaggctggctgccttcagatccttggggccacctgcagggtgacagtcagggggaac

SEQ ID NO: 50022 - DNA, 814 bp, Bovine  19866881153904
ctagtaattaaatgcttaatatgcacaaggcagtgcttcttatttaatgcttctcattttatgatttactcctcaaaacgaagtggtgagttcagtattagtattatcactgtcctacaaacgattcttagcgaggttaagcaacttgcccaagttcaaataccttttcattgtaaaaccaaaatatgaaccttgtgttttttctgaggagtcattgaacctagggtgttgagatcacatgtaattctcattgactgtactgtgacaatactttggccacctgatgcgaagagcctactcattagaaaagaccctgatgctgggaaagattgagggccggaggagaagggggcaacagaggatgagatggttagatagcatcaccgactcaatgggcatgagtttgagcagctctgggagatagtgaaggacatggaaacctgacgtgctgtaatccatggggttgccaagagttggacacgactgagtgactgaacaatgacagtactgtaacaatactggaatagtctgttttttgcactgatgtttattatcattttatgaggagctgagcctaggaattatcttaattgttaacctgttttgcagaattctttgtctggtaactttactcacttaagtgatttttctcttgcatttaaatattactaaaatcaggatgtatgttacaatggaatttttgagaattctaaatttagtagctaacattgtttgaatgttaataaaagcttgaccactctccaatgtaggtgaaatttccttaacttcctccccttcatttcggtcatccatt

SEQ ID NO: 50023 - DNA, 773 bp, Bovine  19866881286946
agataatttttttcttattataaaatgatatatgttctttgaagagagtttaaaatacagtgaggcaaatgtaagagagtgggaatcgcccataattctactatgtataataacattaataatcataactgatgtgctgaatgctgtgtattaaggactatactaagggctttgaggtactgttatcattaaccctttttttagagtgtgaggaaaacagactcagagaggttaagtaacttggcaaaggtcacacagccaggaattgatgagattttaatatgcacagagtgactccagggcccgggctcttaaattcctctttcttgtgtgaaatagcaacagcaatgaattggaaagggaggcgttgaagctgtttactggattttgcctacttgggactggagcaattgtgattatagtggtcaggtggggaccaccagtttcaggaatctttcgaaagcaacatctcgtggttctttaactcaggctttatgaagacagggaaggcgttactgaaagccagaggcgtgctccatcctgagctttccactcggttgaggctatgcgcacacgggagcagcagggacagtctccctccatcaagggtggaggctctgggtgagcccccctgggctctgcttcgtggtctgctgcccacttcatggcctgggtgccctccctttctctcctcagtgcccctgtagccagggctaagagtcttctgtcctggtgggtggtccaggtgtgaccctgcggcaggcagacctgtc

SEQ ID NO: 50024 - DNA, 1448 bp, Bovine  19866881360339
actccacacacagtttgcattcctgaacgtgtatgcctgtgtgcgtgtgtgttataagaagtcgtttaaaaaccaaagcacggtgttcatctattcagattggtcttatttggaaccatcttcttttcatgtaaatagattcccttttcttaacaaggccattagtgctatttacctagtaacacttgagtgtgtcaataatgttactttgtcaagaccgcatttaagtaattactgcattttctagtattaagtgtcttcactgcattcaaagaaaagtgcccatgcatctaaagagaaaggcccaaacacatgtggcgtgcttttacttccaacaataagtgttacatgtcttaaaagattgaaatttccttttagccttgggccaaggagacagactgagaaccgagaatttagagatggaaggtagctcattcaaccttctaatccaacgctggaataccttctatgcaaccctggcagatggccatccatctgcttgtatacttccaatgctggggagctcattatcgcctgaggcaactcataaattctttcttatttgagctaacatcagcccgtaacttctatccattggtcctggttatggagcaacataggaaagctcttaagtatttgaagacagctgccacagcttcctttagtcttttcaaattaaaataactagagtcttctaaattaagacttttttctgaaatgtggcagagcaagaatgaagtgattgttatatcatgcaatacccatcacagtactttggttgtaattgcagctagcaggtaggcatctcttctagtattttaaacttgggctaagcgtactctgcagtacagtttctgaatgtaacccatgccttgtttagctaggaacagtaagaaatctgtccctggtgaatagaaaacctgctatcttcttcctgttgctatttggaattccttgagagagcacaagctccgagaaattgctctgagataaaatttaaatgttttcctttagaagggaaaattaaatgcacccaaatataaactttttgaaagtagaaactctgttcaatttttctttctgtcccctatagtatgtaatatcctacctggcagaaagaagctgctggatgaattgctactctattgagctgaaaaaaagaaaactgctcaatcttatgttgaaatatgtatatatcagggatatgtatatatacacacacacacgtatatatatactatatgtgaaatacatatatattcatatatgtacagagagacacatatacatatgcacacacacacatcctttttttttttaaccttcaaatacctttataatatcctgaagtcattttataataattcataggaagacttaatgccactgttcagacaaaactgttctctggataaactataaatcccaaacacctgggggaatatgaa

SEQ ID NO: 50025 - DNA, 911 bp, Bovine  19866881531846
aacacaaatcccaaagttttccttccaccataatggaaataggaagaaaatctctgagaagcaaagaagaaggaaagatcattacttgggggcctttaggtgattttcacgtggaatgagctggtgacccaaggttctgtttctacggaattaaacacccttactattgcaatgaaaactaccaacatattagttcctaataagacttgtctccagggtcaacagagaaggcaagaattaagagaaccagcaaaacaattacccatgaaagtggcttctcagaggcaaaacatcgtgaaaggaaaaggaatgggaataaccagaaaaaatcaaaataagcattgttaataatgttaagtgtactctcggagaagttgaaaattaaatgcattaaaaaaaatacacaaacaaagaataaatagtttaaatatttaatagaatcttttaggtgaacattcacgtgatactgggaagcatcaacaggaacaggaaattctgtttctggagtagctgttagggtaagataatggaatttggcccttttaaaatcaacaaatgagtcttacaattgggtgaaactctcttattagggaattcaactactttttgcagaagcacttctcaaaatgttttctttgctccctaacttcagttatttgatcttttttttttttctttttaatgatgtaatggtttgaaggctgacaaaaaaaaaaaaaaattgaaacttgggacttgaatacaatgtcatagttacactaaaaaatatcatgcagtaaagaatatgcttttatcacttaaatattgcaaagaataactctaaagagtaaggaaactcacttaaaccacaaatgggtctacctcaattcaccaagcaacataggtaagtactgtaaaagactgacccaact

SEQ ID NO: 50026 - DNA, 2153 bp, Bovine  19866881563853
catcccgccctttgtaaggttgagaacttcctgcctggcttcattatttaaagcaaatttacactcttccccctcgagacttttggtttatttaggagtctctttttgattttgggagagttgagtagtctgcagtaagaatggactctggaggcagcagaactgggtttgaactctgtctctgcaactgacgagccatgtgcccccccaaacaacccacttacacactttaagatttactgtttgcaaataagaaacacagtcacacggaaggatcgtttgagtctgaaactgtgataataattacacaaaactgcctagcaccaaatatttacaggattcatttcccacctccctaaccattccctcttttcctctcttctttctggaaaagacgtctcacacagataaaatttatcaacaagttggaaacacataggcaaacacacctatggcttcctttggactggagagtaaaaggtctgctgctgctgctgctgctgctaagtcacttcagtcgtgtccaactctgtgtgaccccatagacgggagcccaccaggctcccctgtccctgggattctccaggcaagaacactggagtgggttgccatttccttctccaaagcgtgaaagtgaaaagtgaaaatgaagttgctcagtcgtgtctgactcttcgagaccccatggactgcagcctaccagactcctccgtccatgggattttccaggcaagagtactggagtggggtgccgttgccttctccaaaatgcgtctagtgactcaataaacatacctgtgtgctcacaagtcaactccaactctctcttttatacatgacaaatttcttaagtagattccatctggtgtgttttcttcctttcatggatgcataatctaggcctagagagatgagtgaaataactaaatataagatcatgcaggtctttagaggcacacatggagcccaaagtcaggtctcctggttaattctgagccttgtgcttgtttcctggatgtgttctttttttcccaacccctgctctgaaatgaatcacaaggttcttccatgataggcagcccagtgtatgcagaagaacccagtgtggtgacaaccagcattcacacatcagatagttcccaagaatagccactagcaaaaggttttcagagtttgattccatgctcagcctttcgagccccagccctccccaccccttcttctggccatttcacttatttggggggcaaaacagccatgtataggggtgaatcaacagttctctgtggcactccttcccagtcaaagaatcagagaggcactccacgcctcttgtcgaccaggtaggtggccaggataactagaagactctgattcaaaacaggtcagggttaggaattccctggctgtccagtgattaggactcagcattttcactgccaccgcccaggtttagtccctggtcagggaactaagatctgcaagtcaagtggagaggccaaaaaaaaaaaatcagggtctaaaaagagagctagcattaatccagctcttcactggaagcagatgctgctggtgtccccagagggctagaaagcagcacagtggttaaagtgcttcaagtcctgggcaccgaaaataatccatgaggatgtgacctcccagagagcacagccccttcctagagtttttaaacttgaatgcacggacctgtatgccagagggagaagaaaacttttatgggcttaaaatgatggggttttttcagacatgtgtcagtactagcagtgctatgtgctaagaactgaagccaaagcattaaataacaggactgataagcatattgcatttccagaggaggtacaagcaggaaaaacaagaaggcctctatggaaagcttcttttcaggaaggaacaactccaagtggccccaccctcctaagaaattgtatgtttattgaaggactccatgtctcctcacttcatcagtctttgtctagaagttcagtgctgcccaagagaagattccaaagtgcaacaggccaaggtacatctaggaacttctctggtggtactgtggataagaatccacctgccaatgcaggggacaggggttccatccctgatctgggaaagattccacatgccttggagca

SEQ ID NO: 50027 - DNA, 1138 bp, Bovine  19866881752730
tgtgtgtgtactgacttgtagacctgtgagctctttgataattatattctggatttgcattctcccaggatggtctttcttccaacctgttcccaagagattattttcagaggaagagattccatagcctatgttgtttataataaattctagtgaagtttttttaaaccttgaattttttaggaaaggtcaaagtgaaattgggatagtcatatttaactgacaatgacatgacattttgcatttatgtgttggtgttactaatgtatatttacttacttttctagatcaatgggcagtgcagctgttttcagagcattgaactgctaaaatctcgccctgctcacttggctgtcttcttacaccatgtagtttcccagtttgaccctgcaacattggtaatgtatttcatgatttagccagtttagagttcttaattgattcaaataccgtgaaacttttcagttttagcaagatgggtagatagacttctgccagttttctaaattagatatgaaagatgattaaaatgttactaatttatttttcaaaggcttggttatatggtaataactgcattgttcatggtgacctacttgtttcagacatttctactcaacgaggatctagcagattacatttttcttgatttcttccccatttctttctctactacagctctgttatctctattcagacctatataaacagaccaattccaaggagacccgtcgtgtcttccttgagttccatcagttcttcctggatcgatctgctgtaagttaccaagttaatatattacagtctttgcttcagtatactgaattactggcctcctacttctggtcttccctcccgtgtttttggacttgattgtgctttctgacgtctgtattatatctcaattattgactactcatgactgtttttttttttttatcatttctaagttaattataggtatataaattctcacaaaaggttttaagggatatatatgtatatatataggtttatatatatgcatatttaggataagggaatgaaaaagaatacaatatatatgtgtatatataaatatacatatatatttaagatccaaaggttagtacttgtataattggactctggttggcct

SEQ ID NO: 50028 - DNA, 1190 bp, Bovine  19866881791104
gtgtcagattctaagaaaaatcaaattttaatctcagtctttaagcgtttcgtgtctcatattccccagctgtcaacctttctgtcagatttagaagtgggatagactgaaaaagttaagttgtggtaagctgtgaacaagaaaatattatacgatgatcaaaaaaaggtctggatacatcaagagtcagaagttttttagtggagaatccttgataatccacattaaatatgtagatttctgctccttatcacttggggatacttactgggatactggaaaggattgtggctgtctgtctttttgcctggccttacataagctcagtatcccattctctattgtgttctctgtgttcttggcacagttcagtggacccggggaggaaaagttgaaacatgctgctgctaccttttgcagtaaccaaccctttgccctggaaatgatcaagtctcgccagaaaaaggattctcgattccagacttttgtgcaagtgagttgagtgagtcatgtaaccaaaaaaaaaaaaatgcagtttttttgggggtcaattacggaatgaactaggggaattctaagactaaaattttgcataagggttatatctatgtttacatttttaaagccatacattatctcttaaattactggaggatataaaggtgatactgtaatggtgaattataaagaatatatgatgggattaaaatatttgacttagaagatattgcttccacattgccttggagatattgcaggaaatggccatgcacactattgaaataatcctgtcaaaacctgagaagggccttatagccagcccagagaagagtcaaacagcagtcatgcttactgggctatatattggtatagataaccatcagcaaactagagcccgcgggccatatccggcctcttccctgtttttataaattaagttttattggaacacagtttattttgtattgctgtagacaaatcaccacaaatgttgcaacttgatgcagatgtatcatgtcacagttttgtagtttaagagtacaaatacagtttatctatgttctttcttcatgctttcatcaggctgaaatcaaggtatcacttgcagctgcagttctcatctgggactctcttaagctcactagttgtcagcagaattcacttaccttgtaaatgtataatcgagaacc

SEQ ID NO: 50029 - DNA, 1378 bp, Bovine  19866880291152
cctgggatttctttggaaggaatgatgctaaagcttaaactccagtactttggccacctcatgagaagaggtgactcattggaaaagactcttatgctgggagggattgggggcaggaggagaaggggacgacagaggatgagatggctggatggcatcactgactcaatggacgtgagtctgagtgaactccgggagttggtgatggacagggaggcctggcgtgctgcgattcatggggtcgcaaagagtcggacatgactgagcaactgaactgaactgaactgaagtcaatatgacttataagaagagaaggagagacacagataaagacacagagggaaaacaccatgtagcaatgaaagcagaaactgaagtgatgtgtttataagccaagggatgaaaaggattgccttcagagagagcatggccctgctgacacccaggtagcatccagaaccgtgagagaacgtccttttgcttggattgtggcgcactgtgatcgtatactacttttgtttaaggctacgctaactctgatattttgtttcagaacaaatgtggccccaggaaactaattacgccctcaatgcttatatgtcttagccagggccatggggtctatttctcagtgtcacagagcatcaacagaagtcgacagatactggggcaattctccatttctaagtagaaattggagctttttgttcttattcagtgtcattttcaactctcatccagtgatacaacaattcagagcacttcattcccaagtaaagatctccaaaggtaaagttcatccagtaggaagagaaagacaaaatatcttctctgtaaatttagaagtgtagggatatcttagatcagagtcaatcataatgctagaatatctggtgtttactatagtttttactttcaaatggaagtcagtgcactttttctggtgacagtacatgcccattttgtgtactagagccttcttttatagcaatattgacacacgatttaatgttcccatttctcctgattggtttggcacaaacaatgcatttatatgccaatgaataagacagatgtagttgactcccttctctctctaacatatacacacatacatataaaacagaaaatatatcattatttttcttatgaacagatgctgagaataatagattaatccatgagttcatgaattaatatcccaaggattatttccccaaggcagggaatacttttattagctaaagattgatgaaaattcgagattttctatggcattcgaattttgttaggtttttagctttacatgaattatttaaaccttaaagttataaacagtctctataaatcggagaggcaaccacagccaccctcagga

SEQ ID NO: 50030 - DNA, 1695 bp, Bovine  19866880411509
cattctcttactgtcatcctactgaggctttgagtgggaatggagatataatcatgtttgtttgttttatctgctatgtttagctagaagtccctatggtttgtttttggggagaattaagtaattgtgaaaccaattatattctttgtgctctgcatgacaatcagtttctattagttttcactaaacactagtgaaagcgttcagaagtttttgaattccctgtgaaggaaaaagaaaggaagtgaaggtggcaattaccaagagtgtatttgtgtgtgctcagtcatgtctggctctctgcggcccccatgcaccataacccaccatgctcctctgtccatgggatttcccaggcagaatactggagtgggttgccatttccttctccagggaatcttcccaacacagggattgaatctgaatctcttgcatctcctgcactggcagtcagattctttaccaccaagccaccttggaagccccaattacccagttcttgttcagttgttcagttacgtctgactctttgcaacaccatggactgtagcacaccaggcttccttgtccttcactagtagccatctcaaaatagtaatgtctaaacagtcttcttctttgcctggtccagaacaggtgctcaatatttatatgacttacgtgatgcttataaagtactccaagaatcaggtgggtccagctttaatcccaacatcttggagcacaggcccatgaatactgagttgttgctgaataaatactgaggaatccactatttgtttttctggagttgaagctagaaaagcaaggcccttctcattctaaatgtctgaaatgagaagtgaaaactactacaccctcatcaatttcaatgaaggcaaaatactgaattccctggaatgcatcaagtagaactttgatacatactagtgatactgtccatagtaaatcagataaatcatgtatagaaggtgtgaattttatcacctctagtgatggtatcctaatatgtcacgctctctcctccttccccaaagcatgctgtgtcattaattgttttacttctgtctggggactgaaagcttggccaacggctgttgatgtttcgacagtgcaggtgagtcagacagaaacatcacccacttagaggcagagtggtgccgatgatctctgtctcctcctcttagcactacggcccttttcacaagtatctgctgccccttctggatgcctgcagtttgttccctgtgaatatctgaagaggtgttgggagctcacggtgggttaccaggggcctttgggcatctagcagtttgctcagaccaaaagccaacacagctacttggcaggctccaagcgagcaccctggctgctctcagaagccttcttctaaccctgggctaattgtctccactgtgctgggcgctctttgtggacacccatgagctgcagctgcgtccaacagcaccatgacacagaatctcagctgtgctagcaggccagcttctgctctgaaatgctcctaattagctgttaatgcatgacatctccacaacgcatctcggtgcagagaacagcccattcatctcatgcatagaaggctgatgacaaaggtgagaaagaatgaattgttatgatacattttgttctgagtaaaaaaaaaaaagaatatatatatatgtgtatatatatatt

SEQ ID NO: 50031 - DNA, 1866 bp, Bovine  19866880457859
taactgtgctttcagcgcttttcctttgatacaaaagggaaaggtaccaactgactggggactcactttgagttgcctggattttccaaaggtttggatgagagggacagggcgggggaacccggggaggtgtgttcagatctgagcaaaggctgctccctatccaagccatattctctctcagatttctgtgacttttttttttttttaattttttgttttgtattggggtagagttgattaacaatgttgtgacagtttcaggtggacagcaaagggactcagccatacatattctgcccccaactctcctcccatccaggctgccacataacactgagcagaattccctgtactctacagtatgacttttattttccagataacacaaccacatttaagagccctgctctgccttcccttcacccccaaaaagctgcttatcagggtccttaagatcttattcatggcagtcttctgagcagcctcagtctcattctgagaagttttttatacaagttgtacgagttggaaaagtacaagaataatgggtacatttctgcgatgagtcaaacgcttcatccctatcagtctgtgtgaggtacaggatgtctgtgtttttaatgtttgtgtccttaatggacaagatttgatatgtgtgtttcctaatcctgagctattgaaatattgattttcatcctgacctggcctcctgggcacagagccagtctatctgcatctctgccctccacatttagcctgtcttcctgctggcctagactgggaacaccagggtgagattagatttgttggggggcagggggaggaatgtaaaaccagtgaaataactgtctggcctcatttctgtttgacagaacagggcagctattcttgacattcttggctaatgttatcatgtgtttaccctaagagccttttgccttttattttcctttttgattttttaaaatcttattttattgaagtagagttgattgacaataatgtcttaatttgctgcacagcaaagggactcagttatacacacacacacacacacacacacacacacacacacacactcatatgcttttccatattattttctattatggcttattgtggtgacttccctggtggctcagatgataaagcgtctgcctacaacgtgggagacctgggttcaatccctgggttgggaagatcccctggagaaggaaatggcaacccactccagtattcttgcctggaaaatcccatggacggaggaacctggtacgctacagtccatggcgtcgcaaagagtcagacacgactgagcgacatttactttactttactataggatattgaatatagttccttctaccatgttgtcctatctgatttgaatatatagaggctatcagtgaaaataaaagaaatctgagctaaagatccatttgaacatttcaatagggttgtctaaaatatgtaaaatattttacaaggaattccagagaaatgaaaaatctataccacatcaaaagtatcttctgacatggaaaatattagaaacttttccatttttgtgtgctctttgcatatcgatggtttggaaccaaactcaaaacctggtgctgggcagtgtctgaggggctatcagttcagttcagtcactcagtcgtgtctgactctttgcgaccccatgaactgtagcacgccaggcctccctgtccatcaccaactcccggagtccacccaaacccatgtccattgagtcagtgatgccatccaaccatctcatcctctggatccccttctcctcctgcccttaatctttccaagcatcagggtcttttcaaatgagtcagctcttcgtaacag

SEQ ID NO: 50032 - DNA, 1425 bp, Bovine  19866880490509
aggtggccaaagtactggagtttcagctttagcatcattcctttccaaagaaatcccagggctgatctccttcagaatggactggttggatctccttgcaatccaagggactctcaagagtcttctcccaacaccacagttcaaaagcatcaattcttcggcactcagccttcttcacagtccaactctcacatccatacatgaccacaggaagaaccatagccttgactagatggacctttgttggcaaagtaatgtctctgctttagatgttgtcaaagttaatttctgggtgttaaattcctattaatgctcagcagtttccctataggattgctgttgataaaatctttctgacgagggaaatgttaagattttacttctgtcgtcttcctcctgtgccttccccagcatctgagatttgtggtgtggatttattcctttgagttttcactgcagtgtgtctagcccagcgttttaacagttaatgtttgcctagtaacattggaaaggaggatttctcaccagaggtgatttctggcacgcagagtgtgtggcttctgagctttattatttttatggggtggagaagtttctccaggctatttctgtgaatgagagatcaaagtcagatggatctgacaagtttcctctgagagggaccacccagtggtttgatagttcttgttttgtttttttttaacctctcggtgactgatgttcccatgatccactgtcattttgtttggagtgaaagcgtatgaagaagcccctctttctgctcgtgatttttgccagaaaactactgggtgcttttattgtttttattattgtttcattcaaattcataaaaatttcccatgttcttttccctccagccacccctccagcttctcttagctactatttgtttgttttcccttcccctaaagtggagttcagtgaaacctatttgactccctgtctgggtgaggaagcagcagactttcctggattgggttctggcaacaactcggagactagcttcaccttctcttggggtgaagttggcctcctagattctgctgatgaatagttttatcagggaagtggtgtgttactttggccttcagttccttaccacgggtaaggcgttcaggagtctagatacatgaggaatggggtgatctaatttaggaatagctgaatgaggcaggtaatcagaagtgaaatcagaggcaccttatgaaaaaccagatagctcagcaagcaggattaagttggaggcacacacggtcaaacagttgatctaagaatcaactgtaactcaggaaaatttctgcggatctcactttccacgttgccttgtgcgaggtcgctcacttttaaaaagtccgtgtttcacacaaaactgtatctgttaaaagtattttctaatgttatttt

SEQ ID NO: 50033 - DNA, 1367 bp, Bovine  19866880532925
atagttcagaaactttattataccttcagtcacgctacatgtttgtcttctgtccggctctggctccatcctttcccttcagcctgctcactagatgcattgttttcttctcatgatagtgaggcaacgtttaaatgcaaggagagcactatcggggcttccctggtggctcagatggtaaaaaatccacctgcaatgtgggagacctcagttttatccctgggtggggaagatcccctgggagagggaatggttacccactctagtactcttgcctggagatgcccatggagaggggagcctggtgggctatagtccatggggctgcaaagagtcggccactactgagcgactcagtgcagcacagcgcctggtagggtgttgcatttctccttgttcagctgcacctaatcccttatgctcgaactcaccctttattgaatgggtggggggctatatttctctagtctgaaggcaccacgaatgatgattgcttcactttgccacttatgtctgggtgtttgtcatcatttctgatcatctgcttttgtttcgctcccagtgtaatcttgatatttaagagtagtttgtctgttatcaaatcattttatctcttgagctacccgacagtagaccctcttgttttcacagaagaaaagaaagaaaactgtgagagctttactatcttttatgtgattaatgcagtcttgattaagatcttagaactgcaaatatgtgacaaggcagccatggcctttttcttttctcttggtggtggtggtcaaaagtattaggtttgcagcatcacagtataaaaaatattgggagtattatttaacctttgttgcagagcatattggcataaaattatttggaaaatttgattttatatactggtgctgataataaatcatgtgtccttaagtaatttcttaacctagtcaaaataacatagttgggatgaaaatgcatgtctgttcatctgtaggctctacggctcaatactttctactagttgatctaatcactaaggttttgcagtgtttgtattattgatactcagattgataaaagagtaggagttttaagtagtaaaaagagttaagaatgatttttttgtctgccttttgaactctgaaatcttaaatgctatttttgcctttactaattttgaaaaaatcgctaatgagccccatgttttgtgatggcaggctgtttcatgcatactctttcctcttgagcccttgccagttgccctgtccttgtttttatccagtataccaatttgatttagacaatatggcctttaacttgaggggctcttgagtaaacgaaaaagatcaaaagttaaaaaaaaaaagaatttc

SEQ ID NO: 50034 - DNA, 1734 bp, Bovine  19866880544149
acaccgtttcttgtacctgtgggacactttgaagttattcttttttttcccccttggttctgtttaatgctaagccataactcttttgaataatgttgtttggtaaaatatgctaacgtgcaggctctaagtgtaggttagagttcaatacaaaatttgggggttttttcctgtgttatgtagagaaagggttttcagcctttagaagttgattgtaaatgcagtctattttgggaaaacacatagccgtgcaagtttcttgtttgtttattaatggagggctctattctagcacctagatgtgcttggagaattctccccaagtatcactgccttcttattccatttattctaataacaaatctagctctacttctttctccctctgcctcctttctcatttcagaaatggaagctaaaagagatgaaagtgaaagtgttagtcgctcagtcatgtctgactctttgtatccctatggactgcagcccaccaggctcctctgtccacagaatcctccaggcaaggatactggagtgggtagccatgcccttctacagggtatcttcctgacccagggatcaaatctgggtctcccgcattgcagacagattctctaccatctgagccacgagataaaagtaaataagcgcatgcctgtggcattggggaaaggtctttgagctaggagacagaagacacagggcaaatcattgaccttctccatctccggctgattaactttaagctgagaatgagtacattttgtgaggaacgcctacaaatgcatagtgcatgtgaatgtgttttaaaaaattggaactactattttaaaatacaggcactaatataacagtattctgtaaatttctgagtaaatcctagtaatggaacttgatctagttatatgccgctgctcattctccaccccctcgctgttcctagaccctgcctctcattctaccctatctttggcaatttcttgttctaatcatgctttggtcaagcacaggaaactgcaaaaaaaaaaaaaaaaagccaaatcttgtacaaaacttgttctttgtatcttaacaggaaattaattactgttgcacttctacctttaggaaattttaggaatttttccttgaaggatattgcttgctacaatccactggatgcagaaacagtctaagaaatgaatctggtaggaattagaacttttgaacactaccagtattgctgatatagtctagatggtgaagcttagcaatatattatacttgcaactgaaacctaaggtttgccatgcctttttgaaattttctgtttgcaaagcattttgccaaagggatttatgtctcttctattctcagaggccgtggagctggacaatgccggtcccagggtagatgcagccaatacggttccttttctcagacccttcatgtcacaaatgcttattccactggtaattcaaaaatgaatctagccagttttcatatactgtatcactcaacataccatcgtttctacagtaaaataatgttataaccatcaaaattatttcctaagtataaaagagctgaagtagttaaccttattatgttaaaaataatatgatgagaaaaccaataacgagtcaataaaatcatgcagagtttaggttcacagtttcaaagtgaattaaaagtcatcctgatttagtaggagaacacatttgtgaaaactagtacttcataacagacttatga

SEQ ID NO: 50035 - DNA, 2428 bp, Bovine  19866880559395
actggatttaaatggctagttcatcagggaatggtagcttgttatatccagatgcaccctgaagaaatgcctgctctgtctaaaaggactaaccactgtggtgatctgtctctggtgcctattttgtttgccactgttacaagtgttgagaagctttaacccttcagactcctcttttctagtgcagtgaagaccactcgccttatggtaacattctttattctcacggattgtacagtgtgcaactatgtttttagctttgttggttaaaatcatattcagtcttgtgatcctgagattatactccagttactttggatttgaatgtctccagatacccccggttacatatttgaatatatctggcttattttttaggttgataaatcctatcaagacttaaagtaactttattttcaacctttggcagctcctagcctaactctgcaagtcccgacaatagtcatatctgaagacagtggcactgttggtacaaactttgctctttggttgttccaaaacttaggaaggacattgtggttattgacacagatcacaactcagcccccttagttgttttgtcttaggttatttgctgagatattttttatgagtttcagagggctatataggcctgcatgtaaatacttaaaatagcatcctctcacttgagtatttggatggggacaatactcacgtgcagagtagtttagactgcttgctttgcatggaagcagctggttttgaccctctttccactactgttgtgaataagagtttttaggagtgttatcagtagacatttaggagtaaaaaaaatcagatgtagatttaagaatactttttcatgaaagagaattttgattgaaggcttagatattctatgactatttttatatggattaagtgtcaatttgcagaaaggatataaggaataagagaagtgaacatggagaatatgcaacatttcctccttttagaggaacatttcctgctacttttagagacctgtgcttttcttgatagatccatgaatttattattactcttctgttagactatgattttgttcatgagactcaggaaaataagaactgtgaagtattaaatagtgtttctactttgaagacattcaacataatataatctttgtctttctgtgttgttttaatcaagaaacttttgctccaatgtttattatacagtcaaaactcaagtttgatttatgttctgaaatgtaagactcaaggacccagaatatcctgggcgctcatcccagctccagcactaactccataaagtgtggaactctgggcctcgaccattgcgtcttcttaagtctcatttgtgaaataataatattatgtcatctttatcttctgttgtttttgttcagtcactaagtcttgtctgactctttgctacccccatggactgcagcacaccaggcttccctgtccttcgctatctcccagagtttgctcaaactcatgtccattgagtcagtgatgccatccaaccgtctcatcctctctcactcccttcttctcctgccctcaggttttcccagcattggagtctttcccaatgagtcagctctttgcatcagggtcatctctttggtctcctgtattgataggaggattttttacctctcaccacctgggaagccccttattttctatgatgctatgaattttaagattctgtacgaattatgtcttttgatgcttggtagaaaagaagaaaagatttctttgtcttctgtattattcagattaatgccttagacaaggatatatctctatttcaatttagaaataggcttcagaaatatgaacgatgatattgaattaacgtttcaatttccattttaattgacattccaaggctatctaaaatttatagtattttagaatttcttaaagtattattcttgtcagcattcgtattttgaaggataagtctttaaaaaatatgtctgtgctaggtacatttctaaataaaagaaatttcaggctttatttcaggcttattaacctgaacaaagttcactaaacaaaaagaacaggatataagaaaggaatatttagaacaagaacactctttgagaaattgcattaaaacttttggtcacagagtgtagcatcaatattccatagctggggtatgatttttggcttatagttctggtctgccctagcattttaaagccaaattcaacaaaaagcatgaaataatattttaaataaattatttaagcatctctattttgaacttttcctcctaattttctggtgttctgcttacgccctaaaatcagccttggactgttatttcttgacctggtctagtgttgataatgtcagcagaacactttccctgggttattgtatattggctgtactgttttcgaaagtacataatg

SEQ ID NO: 50036 - DNA, 2495 bp, Bovine  19866880612542
aagcccctgaagagaataagcaaagttataagtattgttttagggtgacaggatcatgaattttctttctattcactttcttcaaacgtattatttctccaattataaagaaactaaataaatctaaagaatttaaaaggtaataaaatgagacaaggagacaatacaaagcatgctatgttaaacagggaaaattttttactgccacgtccttgagttacaccatctctgaaaatcatctcccgtatcaccagcactggcatcctctcttacaacatcttgagaatctccccaagatcctcacatacactgaactcttcacaacacacagtagagttctggggaatgttcctataatgcacacagggagcaggcttctgccatactatagaaattctactattctgggaatgtaattccttaagataaactcaaaaatgaattccaagcttttaccatgctttgtctctaaaacagcattctaactagttttctattttcctaacacagcaggatcatgtttatggagaaagttagtttgacatgaaaagataactctggagtccatattcagttcattccttaaaccaagagaaatcaaaatgtaaacagacaagtggtaaaaacaaactaaagttcccaaacattcaggttctgtttgtttaacaggagaatgtttgttcaaagattattaaatttgccagtggggtaaggacttcacagtggaaaacaagttcattacactgagaatacagtataagaacctatcaacagtacatgaaaaaagaaaaaaaaaatccaatgagtccaatccagatggcgattttatatatagtcttttctatgaacatgtaatatttttatatattttttaaactatgaaacctctttaaaagaagatcatcaatggtggaaaggatgaagcaccaacatttggtcaacaaataccatccaaatgctacctctgggcatgtgtgaacagtgatggccacaaagatggtaggtcgtcgtctcccgacttgagagagcttactgcccaacagggaaaggagcacaccaacagtaaaagtacaacgggaaaacttctttcattcagtcaccaaacactttctgaaagactgtctactatatctctggcaccgtgggaaaggctggagaaacacggtcagagttttagaaaaagatagaaaagctgttggcatggagctagtaattcaaaaagagaggtgggctatattcaaaacatcatacaagttaactgcaaacttacaactctgtgaaatgctgagagagtaaatgaaagataactaaataataaggaaacggaaaccaagagacaggactgtcgagggtgcacagagcagtcagcatagactgagacagcgtaatggtgaagccaagattcgggggacaactatgacggaagtgggacattccaaaagacgcatctatttactatgatacacgagagacactcctgaaggcagacatagaccaggttataattaacgaagttaaattccataccatggtttttattgtgtgtgtgtgtgtgtgtgtgtgtgtgtgtgtgtgttttaatgagagaacctagaacatgtttccatgctaggttcaaatgttacaaagacataacaaaattttcacagcaatagggaaagtgtgtgaaggacatccagaactgtaaccaagcttgtaaataacctggaaacagaaaataaggggctatgacaagttttaacagtgtgggactatattcccatcaggcgcaagcttaccccgatgatgctcagccctttgaggtaatcctgacgaggctgggcttgaggaacacagccagcaagcactattttcttattctcctcttgagcttttctaaaagatagaagagaaagtagtgttaattcttttcctcacaagtgtaccctgggaaaccgatgttagtggacataagttccctagaactcaacaagcccatctagcacaaaacaggattttcttacagctgcttcaagaaagtacattataatatgacttctgaactaggcgtctatttatcacaccataaaggacaccatggcagttcaatctggtaaggtcattcattaccgcctcattctaaaagaaaaaaattttacttacatagaattctcaaggatataaatcattcttgaaagccacattttccagacagacattagccattcaaataagttatatttattttaaatattaatgaaaatgttcctaaaacatactatatgatttctgagtctttttgtctagtataaaagtaaaatatacgtttaaaaagttgaacaggaaagaaatagaaggtataatatccccctctcttcggagaattcacacagctcctcacttctgttcctcagagatgtctacaagttatggattatttatgcttatgtctagacaatccctctcaatgcaggtatgatgtgtaaatagacttgtgttcactataaatacacaaa

SEQ ID NO: 50037 - DNA, 764 bp, Bovine  19866880652230
tgtcgtatttgtttgtatgccttgtgcgtgtgtcgagtttcttcagaagcaacaaaccacattagcctgagcaaatttcacagtccctcgtcactgtttgtttttgccttgtgaatcatttggcttataaaacaggctaatcctttaattgaatatgccttcagaaacattctgtgcaccctacaaacttgggtggctcttgctaactctgctttatttattttaaataatactaggtgatcccaaagtatttcctttcaatttttggaagactgttattgcaagcggtaatgtttgaagtcaggatcctttataacaacagtagcaaggaaacacagataccttttcctaaagtccaactgatggaaaataggatgcgatctgtcctatttttagtaaacaggttttccaacacagatgcttagttcctacagcgaccagcttctttgaatgcagcaatacaatgcattctattcttaattgaataaagaaaacaaattggcatagttactgcaggagaagtgggtacctcatgatgaataatttgtgagtccaactttaactacacttgacatttttccttaggtcgctgacagactgattagtgagttaactgctgatggtacctattctgtggagggactctttcagttctggggcttatgctgttcaatcaactaggtatcctctgtgatgagactaaagcctcagtcttgatcaaagggctttggaggaagcattggttgaactgattggctgtgaat

SEQ ID NO: 50038 - DNA, 990 bp, Bovine  19866880760936
tgacacttaattcacactttagttcactggctcctccccagccatcttccaagataaggctgaaactgtattgctatctgacaagcagctacacagaaaatagtaaaaaattaaagagttatcattggacttcccataggaatctgtggtgagttaaactgatgtggaaaaacaaaacaaaacaaggaatgcacctagagaaacacagaattggacaactacaggctaggatttggtgtgcgcatgttcagtcggttcagtctcatccaactcttttgtgaccccaaggactgtagcccatggatagtcctctatccatgggattatcctggcaagaatactggagtggtttgccagttcctcctccgggggatcttcccaacccagggataggacccgtgtctcctctgtctcttgcattggcagcatattctttgccactgagccacctgggaagcccaggactttgcttcctggtatttcccaatcctattccctaccacttttgcttggatgcccttaggttgacactgcagtttcaaatccttatctaagaccagtaatcatggtgtcatacaattcacttcacgtctgccttcctccttagtggagcaggcaaacaacagcatctctcccggaactgggacagacaaccctttcaaaataactgcatgaatcatgcctacttcatatcctgatcaaatctaggttcacttccaacagtcgactaacataaccagaaaatacatgcagactagctccatcatgatctctcctgttaactgtttcaatctcagagaaattaaaatccatgtcagtgaaaaaaaagacaattttaaaacacaccccttaaatctgtagctttgtaagcttcatctacttggaacttatagaagacctcagaaatatgtaaaaatagaaagtctaatgagtattttaagattcaatgtctgttaactatttctttctctcaagatgtaagctctttca

SEQ ID NO: 50039 - DNA, 955 bp, Bovine  19866880782861
tgccaagcccctcccccgggcttcccattggcttggaacccgatgcaataataatctccgcgtgcaatgagaagctccaaatctgacctcattccaatttacagagcaaactttttaaaagggctagaagtacagctgagatttctgctgcctcttttttccttttgctgtgcgtgcctgcgtgtgtgtgtgtggtgtgtgaagaggatgttaatgcatgaaattattaaggggagagacggaaatgtattctaaccattatgttagataacaaggggcttagaagagggggaagggtgaaatactgtaaatggaagctttctgcttaaaagccaagtgattatttttattagttcttttcagtattggaatagagaatcagcctttagtgcaaaatctgttcctcggctccttcataaagccaaggatgtaaaagagggagggaaagctatgaaaataaatcaatagatattgaaaaccattaagaaagtggtacctagacacctgtcatcactattattttaacaattccaggtacagcacagatgttgatgtattgtgttaatcccttcagagctattttggtgctgtttgttggaaggcagaaaagaggattttggggggcaataatttcttgctctcttaaccaaacaggggttaactatagttattgaatgatttaaactcccctttgaatcctggatgggcttccctagtggcgcagtgtggtaaagaatttgcctgagaatgtaggagacaagggagactgggttccatccctgggccaggaagatccccttggaggaggaaatggcaatccactccagtattcttgcctggaaaaatcccatggacagaggaacctcatggggttacaatccacagggttgcaaagagctagacacggctgagcacacagcacagcacacacagtcgtaaatcctgggtagcccaa

SEQ ID NO: 50040 - DNA, 902 bp, Bovine  19866880784456
catttgtcttcacttattttaatgcatacactgaaaatgttaactctttgcagttttgcattaaagacaaaatccgtgcctgtgttctaggagatcctatttccggagtcaccttcaacactcttaaagtcatataggtcaaggtaaaataagaccagagttgtatttcacgcattccttcggtaatgacactgtatcagccactaagtcatttccctgcatctacactgattcctggggctcagtggtagagatctgccttcagtgcaggagctttaggggactcgggttccatccctgggtcgggaggatcccctggaggagggcatggcaactgactctagtattcttacctggagaagcccatggacagaggggcctggcgagctacaatccatggagtcgcagagagttggacacgactgagacaacttagcacatccacattcaaacttcttctcagccatccaaagataaattatcattaatagcattagaaagtgaactagggagcataaaaagagaacatttcccatccttatatcccaaatgaaaaggagtcgatattgtgaacagattctaatttacactttgtctataacttaattataataggaaattcacttctaaactgcagagttaacattttcagtatttgcattaaaataagtgaagacaaaatgtctgtcctaattagctttcatagaaatggtaaaaggactttagtgcccaattaccattactgcttcacctcagtgtcattctcagttcaatgtcagagtcaacaatcagactttacattatgaagatgataatatatgttaatactaaatgtcaaaacactaagagttgtaattatacacacatttattttcaactgatattatcaatggcttgggtta

SEQ ID NO: 50041 - DNA, 1142 bp, Bovine  19866880789841
tagcagccttgggaatctgttgcagtgttaattcctctaaattgtttcagcttctcccagttaattccccttccccttccagactcacatgttctctaaaagagtgggtgggggacttccctggtgggctagggattaagactccaccttccagtgcagggggtgagagtttgattcctggtcagggagctaagattcccacatacctcctggccaaagcataaaacagaagcagtattgtaacatattcaataaaaacttaagaaatggtccacatcaaaaaaaatccttaaaaaaaaaagtgggaagatattaaaggcagtgttcaaatgtagattcaaatacatattactaataaaactggcttaaagaatttctcaataccacaagcattttacaaatgcaaccttagcctcaaatatatagggagtaaaaaaaaaaacacaagatattttctgttctttcatgcccatctgcaaattaggactgccaactgctttcccctctttactacgattaacgattaacgattaacagagaccttaacaactgtggcgggctaaaacactagacctgacgagagaattgaaacttaccatgtctacccaacgtcagagtctggagaccaccgtggttctctaacatgtacacactcatcatagcgtcaggggaggccctcctgcgtttcccgccccttgattcccgcagggctcagtcccttgggaggaagcacttttgtctctctctctgcaccatctctgattcaagctggtccatctggaagtaatactacccgagcgtttatacccggagcctggctctccacaagtgactgcatgtttcctgcaaccaactattggcagctgttacacaggccttttctgctttttagatacctataattacaccaattatgccaatcattgatgtttataaaggatttaaaattttacacactctgaagagtctatcggaaagcaccatctgaggcagagggacaccccacagaggggcccatttgaccatttggattgctgctgtgtgtcccttaaattgagcatcagagtaagtgaggcttcttatgagcctatatgtctgaggcaagttaatcctgtcactggaataaaattctgtttggttaa

SEQ ID NO: 50042 - DNA, 5063 bp, Bovine  19866880849276
cttcttttaggacagttttatattttttccctctaaaatgtaatttttattcaatgttataaatatttctattcctttgcataattgtttcccctaggttcttctgagaatggacaggtgaggttttccaaggggttggcctttgttggttacctggggtatgtgacatatcggagcatcctgagaggtgatcacaggagctaagtagaaaggttgcagtagaactgaaatttctcatcatctgattcctttgtcccaggaatactgatgtggccagtctgaggctagccatggacttttatagatgtagctgaaacaggtcttaatatcattcccagaagggacatgggtttggtgtggaaatcttataaaaactctttcagaagataaacttggaaaataagatgataaaatcacatgatttggtagttgtagagaaaagacctgcttcgtaattttttcctttgaaaaactgatcagatcaaaacgaaccaaaggtataactgggtaatgtgaaaacagtgaacaaaaggtgtggctgctcgggcctgtgctgctgagtggggcttcaggaaggagggaatgaaatcaggatgtgggagatacatcgcctagctgtgctccatacaggctcctaaccactgagaaattccagagcagactgggtgttactgggttactgccaactctcattggcaggtctgcatgtttcttcatcagaaagaaaatgagttttacccacatgctttcgcttataaactgacatcagggtctggggagtagagtgaaagaaagactcagagggattgactctcttctctgctagatggttgtctattttcaagtgcaagaaggaggctacaggagatgaaacaacagtctcatggaaactgatcagatccacaaacacctgtaggggtgagtagctgatggagaaggaggactgagacatcggtttagggaagttgctcagactggggcaagaatgccctggatgcttctctatgatttttcttgtctcctcttttctattttactttttaaaccaattagtgttaaaaattccagagccttcttcaccaggtgctaagtagaatttattagcaccttttatttttcattttttaaatggtgaccttctgtggatggcaagtgacacaggtttcccatttgtaataaatgttttcttttaaaatagataaacttaagtttccaaagtgattgattgaaagcaaactatttagtaagcaactctgctgatggtacttggctgtgacaaaagtcctgaggtttgggaaacgtcataactgaacaaagcctttatgtttggtcataaaagctaatatttaatcagcatgtattatggataggccactgtgtagagcacttttcacatccgatccttcacaagttgctcagtagtgtccgactcattgcaaccccatggactgcagcacaccaggcttccctgtccttcactatctcccagaccttgctcaaattcatgttcattgagttggtgatgccatacaaccatttcatcctctgtcaccccctttacctactataaatctttccctgcatcagggtcttttccaatgatttggctctttgcatcaggcggccaaagtatcagagcttaagcttcagcaacagtccttccaataaatactcagggttgattttctttaggattgactggtttgatctccttgctgtccaagggactctcaagggtcttctccagcactgtaattcaaaagttgggaaagtaacgtctctgctttttattacactgtctaggtttgccatagctttccttccaaggagcaagcgtcttttaatttcaaggctgcagtcaccgtccacagtgattctggaacccaagaaaataaaatctgtcactgtttccacttttcccccttctatttgccatgaagtgatgggaccaggtgccatgatcttagttttttgaatgttgagttttcagccagctttttcactttcctctttcactgtcatcaagaggctctttagtttctcttcactttctgccatcagaatggtattatctgcatatctgaggtcgttggtatttcctccggcaatcttgattccagcttgtgattcatccagcccagcatttctcagggcatactctgcatttccccttcatggatcacagccttgctgtggtgagggggcttgcctaactcaatgaagctatgagccatgccgggccaggctatccaagatggacaggtcatagtggagagttctgacaaaacatggtccactggaggagggaatggcacaccactgtagtattcttgctatgggaaccccatcaacagtatgaaaaggcaaagagattggtgttaggagccccatttgacagaaaaggaagttgaaccttgaagttaaattttgttgtgaaagataacacaataagaggagaagccaggactagaactcaggtctaatgcccaaatctctgagtcttctgttaaaacgcgctactcctgcttttcccttgcagggttggggcagaagagagcaatgaagacctttcagagaactctggcaaaggccgtgtgcttctgtgtcctttcccaggtcagggctcagaagttgcccatgttctcattcggtttatacaatagccagggcccctttctttcttcttcttcttctttatttttggctgcatcacacagcatgtgggattttagctccccaaccagagatcgaacccacggccccagcagcagaagcccggagtcttaactgccagaccgccagggaagttccccatttccattcattttcttcctagtctgaacacttcttcccctcccaagccctctttctgctccatcattatgaaaacacctgtcttctgcaatctagtgctataacaagtcatgctggaaggaggcagtgcccgctgacctcagagtgaattacaacatatcaaagagtccgagttttaaagttgtcagacctttgtttccatgaggaagaactctctttttttgcactcataccccagcaagagattagcagcctgaaatcactttgacagtgtcagttgctctactgcagaccacagggaattttaattccagcctgtgaaattgtaattgcatctcaaggagaagtgagggatcctgggtaatggccacagccgagctcaatgtcagagttgccagttgctgccacatcagatattacttgctgttattcaaaaatcactccagctttccatatgggaagttggactggggagcgaaagtaaattaacagaaactgtcagctgttcagaacagcacggacagcagtgtgacagaggggactcacctcccatcaaaaaagataactttttctcttttttggggggttaatataaagagtttcacaaacaaatttcattacttaaggtatgcagctaaatgatatcattattaagcaaaaaattatctggtctttggcatgatagattaaagctgccaatttctattcacttcttccaggaaggagttgggagtggggagggggggcagtgcatgggcaaagtggcccaaaagagtaattaaaataatgaagatagcaagtccatgtcaggttgatgtttgcaatggattaaaattacctgctatcaaagttaaactgtctgagaaattgcttcctgcctatgtttggaataaagggaatttagaactaccacatctgattacaaaacactgagagatagagaaaattatcagcaaaggaaaagacttgtcacctgccaccttctgaagacaggggaggttctgacgagtactaagtggttccaaaattaattttttttttctacagatggtcagaaagaaaagagaaggggctaaataaaattgcttagttaaatagctacaatctgtggcttttttgttctagatggtagaaacaattcatgtataggctttacttttcctcatttgatcatttttagagtaaactttagggatgacatttcactcgtccaattacaggaaacgtgcccttagaaggtctgtcagcagggataccttctggtaaaggtccgactgccctagtcgcctctctactgacccttgacttcaggctcccccaaactctactccgacctctctgcctggctaaatcccctcattgtttagaaacctgttttatactctgcttgccccctgatcttatgacatctgccctttcattgtacttagtatttttttaattttaattttttggccatgcagcatgtgggatcttaattccccaatcagggatcaaatctgtgtcccctgcattggaagtataggtcttcaccactggactgccagggaagccccttaacattctttagaaagcctttgaggacctccctagtccatgttagatgtccctcccatgctctgatgattccctattttctaccttgagtggctggattgcaattgctgcccagcttcccaaaggtaggatggtatctgtcctgttcactttttgcaattccagtgccaagcacagtgcttggcacctagcaccaaacaactgccaagttgtctttctccttcacaaagtcttcagcctgcatccagaagggattctgtttctcccagtgccctcaggttaatgtgagcacctcctgtatccatggtctcagtgtatctgtgggtgccctgcccaccctctagcttgagagcagtaaactggttgagaacaggctgtagtaccagattgcctgggctgtaatcttggctctgccatttacctgctaatgaccttgggcaagtcacgtctctgggtctcagtttcctcatctagaataattgcttggagtgactatgaggattaaataacctaatgtattcaaagtgcttgcctgagtctatgtaaatgatggctatgatgatgctgctgttctttactattactgctacatgcatcagaagtatgtctaagcttccatttgcttggattcttgtgccaatccaaccaatccttaagcatcatttctaaaaccaaaaatggcagggaggaaa

SEQ ID NO: 50043 - DNA, 1338 bp, Bovine  19866880878537
agcaaaggtgaacttcagaagcatgttgaatctactctctgtatgcaaaagctgagactcaaattgaaattacaacgattaaatcaatttttccaattcaacaaagctatttttttgatttcaaataaatgtcttcacagcctatttcaaaagaatcccataatatgagcaaaactatactgtttattttgaatatatatggatatataatctacttacagtgaatctacagaaatgaaaaatgcacctgtatagtatcataattttggactatctaacattaatacatcagctgtacctacagtcgcccatctgtatccaggggtatggaatccacgggagccgaaagtactaagccactttatgtaagggacttgagccaatgtgaatatggaaagcagactgaaaaagaaaacccatggattctgacatctactggggctcgggaaccaattccccagggataccaagaaacaactgtacaaggaattttaacttgtttctatagtctccacttcataaaaaatgaaaaggaattcttagccaactctttacatgatagttggaagttggacacaattcatatgttcaacaatgaggaataactaaggaaagaagtgaatgttaactttctaaaatgttatataacctctaaaaatggacaacactgaatcatggaaatgtgtattcaaaagaatgatgtgagagaaatggatacaaactgatagatattcagcagtaaattcagcgaacaataatagttgaaaattaactgacattatattttttttctataaagttcttccatgtccataacataaaccaatgaaaagcaagcagatgaatgagcaagctgtcaggcaagtttgggatgaagctttctctctcttgatattaagttccttggcagctagaaagagtagcaagggttcacaaaatcagtttactatttatttcaaagagaatgattacagcacatatatattcaaagaattcccttaaagctttcatttccaaggcccagagaaaacaatagtttgaattcttttcattcatctccatttcactgctcatttaacagacccaaatctctgtctccaaatgcaataaggaagaagtcagaggggtggcctgtaagttctggagggagaggggagacaagaacactcatcctcctttgcatttctttaaaacttgattgaatttataacaaatataaacaagcaaaaccaagtcaagacaaaaaactagagcagacaagtaagtctttggggggaaaaaaaaaaactgaaagcatacagaaaagcaactagataagagcatgcttaatcagaaaaa

SEQ ID NO: 50044 - DNA, 6147 bp, Bovine  19866880894352
gaacagttgttacgtgttaaagggatttaaaaaatttttaaagtgacagtgaaacctcttcttgtattggtaatatttatatgtatgaattggtctataaattctcaaattgtgtgaaagcaaattttataggaattaggattaagcccagtttcctttcctttgccaagctgctcaggtaaagagtacccaaagggatggggtgtgggaatggaaaaacctccgtgcggaggtaatatttattcttgctcagcaagtgtttgggttatgttgtaaaagctagtactgaatgtatggatagcgaatcagttatctggctctattctgaactgttactggttattttatttacttgtttattttaaatgttagtggctcaagtcgtgtctcactctttacaactccatggactgtagcccgccaggcccctccatgcatgggattctccaggcaagactactggagtgggttgccatttccttctccatgggattttcccaacccagggattgaacacgagtctctcacattgcagacaaactttaccatctgagccactagggaagcccttgtgggtaatgcatgacttatagctgttgattttgtcctttcctagtattttttctgcttggcaaaagaaaccggtgctgtccttccccatcctgtgtgtaacttgtcagggagaggagcagtctttgtgagggtgtagacatgctaacaaaaaatgttgtgtacatataacttgactcaaaagcaaagtcccgtggaaataagtttcaaattctggagtttttatgattatcatcttgaagcaacattttacggttataaaaataactatcaggcataaaattaatttgcattgacttagtaatctgtatacaaaccataaacaggccattcgttagcacagtcacttaataaacagtgttaatgccacaatgttaatagctagaatttttgcgattcatttagcaaacatttaagtacttgctgtctgtgtgcctggttgtggttaaatgtgattatttctccctgctagtttgtaagttctgttgagtccagtggcctcatctgacttgctttccagctcaacagtgatgagtatgaccccctgggtacacagtcaatgcatcaactgaatgaatcatagattctattaatagctgagggttttttaaaattttattttattggagtatggttgatttacaatgttgtattaatttctgctgtacagccaagtgattcagttgtgtatatatacattgtttttcatactcttttccattatgatttatcacaagacattgaatatacttccctgcgctatacagttacgacattgttgtttagccactctgtatatcacagtgtgcatctgctaatctcaaactcccactctatcccgcccccagcccccttggcaaccacaagtctgttctctagatttgggagtctgctttgtagataagttcgtgtcatattttagattccacatataagtgatatggtatttgtcgttctctttctcatttacttcacttagtatgataatttctaggctcatccatgttgctgcaaatggcatcatttcattcgtttttatggctgagcagtattccattgtgtatatgcaccacatcttctttatccatttatctgtcaatggacatttaggcttcttccttgtcttggcttttgtaaataatgctgctatgcacataggggtttagtaactaaattttaaagcttagagaggatattttaggtacagaggaagagagtgaaggcagaaagacttgaggaagctctgaggaatgaccaaggaatgctgcagtggctttggttcagagatagtacccaaattacccagggggcaagtgattggattaatgtgacacaggggagcaggcgtcacagggaaaatgaaggacaaaggaatatgcagaagccaaggttaccaggttgagtgttgtgttcatgaatcaagagcctgggggaaaagatgacctgggttagttgtttgaggctcaatttcaaaggatcagtgaaaattaaaccaaaatgatgtgggattatgggggtggcagcatttgttgggcagatcccacatgcaagtcactttctttagtaaaacattgtatacagaagtgatgaccaggacatggcttctgccccaaggaggcagtgacacacagggagggtggtgaagagatctgtggaagcccatggtttaaaagtttctttctgtttttctagggaggcgcggggatccagaacgaatttgaactgggattttcaaatggatataatatgtggaggtggtagggaaagcattccaggcaaacgacatagcgttagcaagatatggactcaggaaaaggcagggtctaccaggaacagtacattgtctttggtgttagtggggaaagtgggacgaagccctgatgtgatacttgaaacttgattctctgagtgatgggagcccttgcaggttctgaaagaggagagtgacagatgatcatgtcttagaaaattcactccagcctcaggacagacttgggttaagcaatggttctcaaccttggtttcacgttagcctcacctgcaaagatttaaaattccaaattccaagctgaaccccagatcaattaaatcagttgtgtgtgcttagtcgctcagtcatttgcaacccaattgactgcagctcgccagcctcctctgtccatgggactttccaggcaagaatcctggggtgggttgccaatccctcctccaggggatcttcccaactcagggacccaacccaggtctccggcattgcaggcagaccctttactgtctgagtcaccagagtctctaacagtggcacccagacgtcagtattctataaatcccccagtgattctagtgtgcaatgaggactgcacaccagtgactttgaacagggcttggcagactcttcctgtcaaaggccagatagtatttttggctttacgggccacaggctttctgttggagccatcccaggccgccttggtccacaaaagcagccacacacaatatgtgaatgaacgagtgtggctgtgtgctaataaaactttatggaagtctgaatttcatataatgttcacaggtcaccagtattcttgttctctggattttttttttttaatagccgttcacaaatataaaagcacagtgcagactgtacaaaactagcagccagtcattatttggcccgcagagtctattttgccagttctcgattttagagggtgaaaattggcctcaggtaggccaggaaagaaaacatttctacagcagttcagataagaggtaaggttaactctcttttgtggttcattgcaagggcagagtgaagataagtgatactgagtcgatatttatagcgactcacgttctcatgcactactttcgagcacccagaggttactgtacaaaggagcctggaaggaggaaccattgttcgtggtgtgtagagcttagttcccctttgactttgttctctttgcggggatttgttttacgttgaaaggctgtttcttttcccgctgcttgtgatggcttttcattcagcagcacccatcaccaccaaacagccaagtctccttcctttcttacgtgccagccatgactttgttttcaaagaatgacctttccttgcacacaaatgttctctttagaaagtaaggtgagcctgatataaggagatagggctacttatattttattttatcagataccactgaatttatgcagagtcccctctgcgttttcttccagcatttgttgcctcgttaaggacttgccagggcaaatggtgcccctgctcgtccaccacccccaccgtgagacccagaggctgatcactgctccttctttccactgttttaggaaacatgcaactggtgaaagtttcccactgatacccactgtgctttaaaatcagtggtgcatttccatgatggcctggttattttatttgagcaccattacactgagtgaacagattcacttatctgttttctgacttccactcttagaagtctgctatttcagtgttctctgagaaatgtctatcctgacccctttcctgactgtgaagactggtgaaactaaagaacacactgtctctccttggatttgctcttacaggagggagagaaggagatttaagactacagcgagcagcgttcatggtcatttccattttcttgcaaatcttactagaaaataagaggtcaaaaaaatctataaagttagagcagttttctttttttttttttaatttttcctaccatcctcacagtagagttatttctcagagaacacagaagtagtgaacataccatataaaggaaaaacagatgatattctgaagaatctgtttgttttcctgaatgttttggggtgtttttgatcaccaaacatacttcacatcactaatttttttccccaccaatttctaaatgtgggggtccattgtttaaattccaaagacttgtttttccttctctgcagtgaccttgaatgattatcatcattttagggacaccagccaaaaacatacaacgtaaaagtgaagttgtgattgaacactgataatgtcaagtgcttttaattaagcttctgacgttttatacgtcgataacaaaataaaggttcaggtttattaaattagctttcaacttgttttttcaaaagctcttaccacatagggaactaaatatataacagcagcctgttctctgcagtcaaagcctcaatgtgccccagaggaattcctgcatggaatccatttttaaggaaaggaaaaggtcaggaaataaggcaaagccacagacataatatggggattaagaatgggaatgtctggtaggaatcacaacccaggatggcagcagctgaaagacagtggggaactgaaatagaggaacagaggttaccagttggaggagaccttagagatcgtctgggatagtggctctcagctttggctgcccactggaaaactcaagagcatttaattcacacacttgcatgggtcgcaccacgccaatgaaatcagcatctccggggatgaagattgaagcgcagatttacttgaaagggtccgcagtgattctgacctgcaagcagggtggaacctaacccgactccttcatttcacactgaggtccagagcagatgccccgcccagtggtcagagaggtgttgtcagtctaggttcctcatctcagtgtagggcacccctctcccctcagctgtctgtgccaacaatcatggtgtcttcctctgccctcccccgtcttgtattcctgtctcacccaagtgccccctgtcctgcctctgggctgttgctcacatttatctcgcctcctctccttgcccctcgcttcctgtgggacggtgtcactttttggagccactgcacccgcctctctcagtcttcagcctctagccttgctcccatgctccatatgtaacgccgtgacaaaactctgagacacatctgatggtttttcacaattcctacaccacaggctcgaatcatttagccgtttctttggttcaacaaagcatgtccttttttctctgtctctgcgtgcctgtgctcgacctactttcttatggtttataaacggcacgatctatctatagactcaattcttttctttctgcttttatcaaaaactgaccctcccccccagtaggcgagacgattttccctcttcaaccaaacgttgtcctatttcagctgagtttaatgggccgcgctttgcctacagcctaactagaggaacctgccgatgcagtaagtataatagagggtcccacggtcaacatcagacctgcctcagccccaggccacatccctgggagtcacggccttcactgacctctgaaggtgtccgggccacttcctttctcttcctgacttcaatgtctgtaactactctgtgcttagtccttgttctcacggtggttctcccagttcctagtccttcaccaacaacccttcggattctcagtccttggttgttaccttgcaactcttggctctggctttctccacccttttgtctcaggacaggttctcggctctcctgggagcacctg

SEQ ID NO: 50045 - DNA, 1267 bp, Bovine  19866880916416
gttgtgtgggtcccatcagtatttcaattaagagagtgcctcagtaagagtccagctcctgtcttcgcagttcagcgtgtttgatccttaatctttgctttggcactcctacactgaggagcttctggggacctagcaaccctctgctcctccagcacctgctacttaactctgcttatctatagtgattcccatcagtgcctccagctttctggtcttgatctcctgtatctcaaattctcttaatacacctgttcagttaagaattcacatgctttgttctcaacacatggatgagaattcttaaccaaaaagacacctgggataactatctcaggccgtgaccttagacaacagatgcttctgggttttttgtttctctcttttgggaggtttccatcagtatgatttctgcagtcttacctggagccatttgagatacaagggaagggttttgttgccacagaaccttcatggtccactactttccactccgaactccacagaaaaactctaaatttctgattattggcccatagaagtgttaacacatgccttgtccacaggacaagggaaaactaggctacaatttggtctcaactccatgctttgggcctgaggaaggagactcgactgtagcacagtctcttgcccgggaatcaatggagaatagtcaatgccatgtcttatttggttccatatccgataataaaattggaagttaaacagaaaataaaccaggagatggagcttgtagagtctgagtccccttgagagaaagtaaaggagcttttgaaattcagctttaaatgcattatatgaagaggcattcccaatgggctgagttttgtgtcattgaaaaggtctgctctagctgttgcccttgaccatttctcacctttgctgtttttatgtcttttttggtttctggttttccagtaggtttgcttcttacacatttctttcacatgtaagatctctaaccctattcaggcaggataagattctcaagcctccaattaagatccatcttctctttttccccttttaacacaacatcctccaagatttttgaggttagagaggttgaaagttccaaagcagtctgacaaaaagcacaagttggttggatcccagtctgaaaaaaattaatcttatcaaactggtttgccttgggcagtcagaattataccaactacgagaacattcactaactaaaaatgtcgtatttcaggtggagactatttttaatgccttggacacacaa

SEQ ID NO: 50046 - DNA, 1426 bp, Bovine  19866880953115
acttactttagatcctgcaacttgcaagtaaaaataaactggtcattaattcactctaattttatttactgagtaagggagatgaaccctttaatttttttttaagtccactgtgtatctataggacttcactggtggctcagatggtaaaacaatccacctgcaataggggagacctaggttcaatccctgagttgggaagaccctctcagggagggtgtcatatcacatcttcttttttagattaattaatttattttaattggaggataattacaatattgtgatggtttctgccatacatcgacatgtgttcccctgtcctgaactcccctcccaccttcctgcctaccccatctctctgggttgtcccagggtactgactttgggtgccatgcttcatgcatcgaacttgcactggtcatctattttacatatggtaatacacatttcaatgctattctctgaaaccatcccacccttgcctaggagatggatcttgtctcccatgtttaaggtctacttaacataaaccacaaggccactggacttttaacaaaataatttgtgtaaacagttaggtcttttaattcataaacaatttcatttctgaagatgcagctatcaataggacattcttgcttgttccgttcacacattcatgtgtgaatctgaggactaagcagttgttttacttagcatcagaacacatgattgagaggagaactctgcatgttatcattttttaaacatgtatgacaatatacagttttcattggggagtgacggtaaattcaacacagctcaaatggggaaggactcaaagtttatatctaaggccccaaggtcctgggaaccctaattacaatctcctcatatatcatggtgaaaaattctctcattgagaggtaactctttaaaattacacgagaaaataaaagtaaataattcaaacattctgctttcttaaatcccagtattatgttaaaaagacaacagagaaaccagtaaagtgacagggaatgaaagtaaatttacaaggtatttactaaaaattattaaaacacaaatctcttgaaaacccgagttgcatctcatgctttgttctatatagtttccttccatatccctatatatcccatcacatctttcaagaaatcatcttattcatttaaataaaaacatcaaaggactatagttaattgtccaactagattaataaatttgaatagaataattttagtcagtgtctgctcatgaacagctgttttaaattagtatattaagtaattcagacacttttctttgcaaaggttgcatgatttaataaagtcccatatgccgccacacgtgccaacacttccagcttatcttcaatccagctgctgttatgatagtagctgccaactttcaaccaactgaagag

SEQ ID NO: 50047 - DNA, 722 bp, Bovine  19866880959093
gatatactctttggtaaaatgacaggtactgttaactaccgaagatactttccaaaagtaaattaattctcttctgcaaatcttagaaagccactgccaccaaatgtctggtgtcaaaaaatcaagcctgtgtatgagacacagtactcaactgtgacggaagagcggctgaaactaagcaatatcccttgcacactttagaaatatagcttttccacgctatattttcattgcaggttccaagtcgcatatggaatttcatcgagcataatcaattcaggatagccaccgattcaacatttactgagcacctactaaacccaaatatggactgtcacccaggcccgacccgacccaacaccctcctggctcagtcttccagtgatctgaaacccagatggaagcagagtggaaacacgtgttgccaaggactaagagcctgcctctgagcagatgctcggcaagagtcttcattaagtactacaggtttcctccaaaggtcatcaacgttatcctttgcttatttgatctcaaaagcagacggatttgccctcaatcaaaacagaatatgggcaccttaggaccctgacagagagcaaaccctactcaaaccagatgcctggtgcaaagaattgggtttctagtggtaaacgggcaggctatttgttcctctgaatcagtggtctccatattttagaaaatcactctcctgaatgaattaa

SEQ ID NO: 50048 - DNA, 861 bp, Bovine  19866881063146
aagacttgcttctgaacatggtgggaagcttaggagggtggcggtgatgtgggaaggaactaaggagttagggctgtggttaggaccagaagaaggtagagttaaaacaagagcagagcatgaaatttgctaggtgctgcttgttttcaaagaatgctgtttattctgtgagatgtctgtcatgttccacatgatctacttttttctgcacgggaaaggcataagataaaaagatattttagtgctactgatagcctctaaactcagaactcagagaactaagtttctgtgattatcaatgttataatgtaatgaatggatacacttctagactgtttgtacaagtttacttaaaaagtcaaatataactcgtgtcagtgggttttcttatataaactgttgtgaaagtggttcaagataatgatacggtgtttgattaagtgaggtaatcacttaagatgtgtttgtcattttaatactacaaagctagtggtagtcagcgcaggttcctttaatgcactgttccccttgattgagagaaaatttaaaaacagtattaaaggtgattaagtatttttttttaatggctttgaaggcttttgataatcacaactagctcttgttaacgtaacacctaagctaacgttgggtttgtttccagaataaatataatcctgtagaaggcacattaacaattaacattgagaaaacatccaattcaagtgacatttatatatgtaaagactttcagtgaaagattacctactcttgtcaagcatttcactttatttaaatgttttcccctctttcatcactgtctcctagcaaagcaaaacaaagataaatagttcagaaacttta

SEQ ID NO: 50049 - DNA, 985 bp, Bovine  19866881096446
tttgccatatggaggaatgggggggaaaaaaaaagttccagagatacagaataaactagaggagagaggaaaaaaaatgttaacagaaggccgaagccatttcactactgtaataattattcttgtaatgttttaatcaaaggaagcagccggtctctctcccctcatctaaattcaagccaccacactttgtaggtgttaatctccacgccttccaggctgttaggagggagcggaaactggcagcccctgctctgcagaagcctgtagcataacagtacctggcactgcccttaattatctcaattatgttaatatgtgttgtttgtcaacagctagaaagaactgagactgttacgcagttgtggagactgggttttagaagtaggcttgagtaacttggaggtttcccttgagttataatttttaagggattttatatttatgagagtgaaagaagaatctaaaaactcattccataatctcatctggtgtctgttttccgaaagtcatttgtcctatgtcgttacagtaagtttttattcttcttcttcactggtgatcaaaaaatatgtaaatgtgtaaagcatataaatgagtaaagacaaacgggatacccacagattgtaaggggatgtgagagatttatttctcaagagctaaattaactaattaattactatataaaatcagtagtacgtacttttcaaatacaacaggaaaacatttaagactattcgtgtaagagaaaacaatgctatcagtattcaaaaccctaacactagcagctctttttccgagcagcatggcgaagcttatatgcgagttctggtccattttatagtttcctggcataaacaacgcctggaacccagcccagtccacccatgtggagaccgcagaagtgaatcggatcaatggcaatggagtcattactaagtcaccaaacacacgcagggtgtgagcccgtatcaacaacagaaat

SEQ ID NO: 50050 - DNA, 1689 bp, Bovine  19866881115520
gaaacgtgcccaacgtgtcacagctagtagaggagaaaaggcactttctaagctaggttcacctaaccttcttattacttgctctttctcctatttgctatgccgcccagatgttttgccaaatttcgattacagaaatgggaaaaaaattatgttcactaaaggatgggcatttaaaaagctttgggtgtggttgctgggttgaaatgttacataatggtttcctccaaactcacacacccgctgataatgttggttactatggctgagctactgactttggagaaattgttttcttttgcatgacaaaattgagatagcaataaagtatctacgcagatcttccggggttaagggcatcaagcatcatttgaaataaaaacatggccctagtaacacatttgaaagtgaattgtgaggagaacagggcacacgtgtatgttaacacggagctgttctaggaatgtttataaacaatagatgtggaatgaagagccgaagagctgtgatattaagactttccactcttagggacaatagggacaccttggcctatatattatttgattctgacaagcatcttcccatcttgtctaacctttctattaaccatacaagaagctttcctttcagtattttgtttttctgccatctgaaaaaaatgagctttaacagccatcatgctgtcatcgtgccctgtgaataggttcttttaatgaagaattctagtgaaattattgtttaggaaaagaaaaccaatttacatttttatgtgttttatcttttaaaaaagcctacatcataaaaatgaagacactttcaatagataaatatctcgtatatttagaagacttcagtctatttaccatttcaagactttttcatgcttaaactaccttttgaaaatagtttgaaaataggtaacagattgaaaaagaaggtaagttaagagtagttcctttctttaatattacaaatccacctttggcagtgaaggtcaagtgcaggttataaataattgaaataactcataactaatacacaggttgatcaactactatcgaaaacagctagctttttttttttaatagaaagaatgggtatcttcaatgtgaaactaaataattacagcaaactgggttaactctgacatgtagaattctacagagccaatcaatgttcgttccctattgtaaatgagccttgatgaccttttgttcacattaatgctgacaaactctgcatgatacatgactgtcccactctctagctcctcccaatagagttttcggcttttattccagtcagtgcacttactccacgtctatggatgtggcgcagggcacacattagtcgggggtgggggtgagggcgtggaaatggcagacaccggtctatactgtcaataaccttggagaccttggggaagatacaagggcaaataatctactgtggtagagaaaagacagctaggaagcaatccctcagtattatctttatgatttgagatagcgtcaaaagacgtaatacatgagagtatttcctccatcaaggaaaaagcactgggaagttacctgcacaggtaggtgttgcttctttggttacaatttaagctggatgtagaaacccaaagaggtacactgggaccattaccttcttggtgaatgaacacaagggccatgacaattt

SEQ ID NO: 50051 - DNA, 1672 bp, Bovine  19866881143329
cttcccacccttctacaaaagtgctgtgtgtttgttttaaaaaatttcaaaaaattcagaaaggccaccaaaggagaaaatggaaaccaccccaggattctgtcacttagagataactactattaacgttgtggtatgtgttaccagttttttttttttttctaagcaaatgtatagtaattattattttaataaagttgatatcaaagatattatttccattttttacacatcagtaaacatcccccccaccattaaatattcctttacaacatgatttttcagtgaccttatggccttatcctgtgaatgtagagtatctattaactcattacctattattggatatttagggttttttttttaacattttattattacaaacagttctataatgaacattctcatagatttatgtttactcagattcacgactgtttcttttaacatattcctctacatacttggaaggccttgatacgtactggcaggctgtccttctcacagattttatgaatttaattccttgccagactaagtactaaggcatgggaaatgggtcttttgaacacagtgaataatcaccaacttgcgaagtgacgtataagtgaattcactaattcattcaacacatactcgttagccttctaaatgccctaggtactggggataaagcaagcagacacagtccttgttcctagagctttcattgtatcaagacagaaaatgaaggaagcaataagatgtaaaaagtgaaaaaatgggaggtcatgagaacagagaagaaagaccagatcggaaaagtgtctggaggtaaagggggaagtactgggattggcccgatgtcctgaatgaggtcggatttcttcatgttcttctcaagtcaggtccctcatcctttctgccgtcacaatttcccctgttctcccatgttttctatttctaatttgtgctgagctaaaacagaatatcttgtttcaaaagttccctcctagctataaaagaaatcactattaaatagtgtatctttttaaagttgtgcgcctacaacaccctgccacccctacctacacaatgattaaaaggcagaataattctggagaaaaattaggtaaaacaaacagctatttaggggaaaaggttttctagaagattacttagatataaattatagtttttcatggctaagtttctagatatattggaatcaatatggtaaaacagtttttacgaacttaaatggctaccaaaattggtcagtagtaaatggcctgaaggtttaaaaggaagcaatcaaaacacacagtaattacattctcaaaataacatcacccatccctgtagtttaatattttacacaggacagcatttagtaactgctgaagttaataacttctaccaaagtaagctgcttttccattttatgcagacaagagcccaatgattaaagctataaaagttatgtataatgagtcctagtcacaccattactttagaaacaaagcattacttctgaagagcaaatatatgcggattggaaaatatatcaagactttgatacgattttcatcttataaaatatataagaaaaaagaaaataaatacaagatgacatatggagccaaataatatatagataatatatatgatatctattttcaagatatagatc

SEQ ID NO: 50052 - DNA, 1500 bp, Bovine  19866881187164
aggagcctggcgggctacagttcatggggtacaaagagtagacgcaacttaccaactaaacaaccaccaccacctcaaatgtagtctctactggggcctaaacagggcatgttcagcctgggccttgtaaggctctcccctgttccctgaggacccggtgcccagcgtgagatgagtccacacggaacacccatgctggagccttactcccactcctgcttccctgcttctaacacaggcggtcagcctcccttgctcatcccttaccagggtggcccatactggcctgaagagccttcccaagccacaatccacagaaaaaaagttcacttctcatttgatgagagaagaacaaaaaagtaggaaaacccgcctgatattaagaaaatacgatccagggatgacccaaagaatccctctgcccctaggagcgtctctaacccagaggggcctatggcacctcctccttggcccttcccagggccaatggcccctgaaggaggcactgtctgctttagtcatttttgaactgcttcaccgcctggggaagtgcaaccccaaacactgaactagaagtctggctgctggtgcagcaaagcacgctgccttagaagggcagggactggggagccccttcagctgggcctcgaagaaaactctccacgtgaagctagtgtgatcctcactctggtctccaaagttgttcacacaatgtgagctgaatccaaggaactcttttccttttgccctcagcacttttcattatgatggaagttcttttttttttaaaaaggcaatacaaaaaaaataaaactctgaaactaaaaaagccaaccaacagacaaacaaccaaaagcctgttagagcgctgagacagggagaggaagtccccgcccttccaggccgatgtcgccggtgcagacatccttcctgtcccctggacagaacttttccctccacggtgccaggctgtgggaggctggggcagtcagaactgcctgtttcaaactccccaatgccaaaggctgctcccatcaaagacgaatgaggactaaaacagacttactcctttggatagaatgttttgtagatccacaaagataagccccacgttagcttggctggcttgatgctataaaatagccttcctgccacaagatgctatcaatacgaatctctgctactttaagtctcttttgcttaaattgatttactttcagaactctttctcattttggagaaatcctgagagtgtgggagtgtctcttacctgctcgtagaatcgattgtgcgcaacataaaacttggaatcaaaagattcttccgtgactaacacttgttgtctctgaccaatctgtggaaagaggggagaaaaaaaaataggagccatcaggcagatgtctgagaatccaaaataaacaccaacccaaagagttatggaccagcaagtcatgtctttttaaattgtttttttaagatttttttttaatgtggaccatt

SEQ ID NO: 50053 - DNA, 1231 bp, Bovine  19866881336556
ttctgtttggaaggcgcatggccatgcctactccttgattttggatttctggcctctgaaaccataaaaggataaattttatattttaagctacccagtttacttttttaaggttgccctacgacactaatacaaatatgtgcacagaaaactgatctcaattgtgttaaattaacatgcaattaattacacacatagcaacatatgaaatgttaccaaactgttaaaaaaggttatctctgagtggtagactagctgatttttatcttgttagctgtgcttcttccaaattttgtgaatcatttttcaataaacatgtttacatctttaaatcagaataaaagccaataaaggataactccataaaaaaaagtgtacaaacactaacctaatcaggaagcaaggcataaaggggaaaacatgcagaatcagaaaggccaagaaagaaataatcatcaaaacaggcaaattttaaaagtaagaaactactttgcataaacttatgtaaatgatttgaaaactttaggtaaaacgaattaacttctagtaaaatacaaattaggaaaactgatcccagaaaagatatgaagacaaaacacccaatatcagagcagacaatctaaagcattccttccaccactgagtcttgagagggtagatgattcaaatgctacataaactactccgaaacccagaaaaacaaggaaactatcccatacttttcttcttaaatgaacatgacaataattcagaaattcgacaattaaaccaaaactgccaccattcccaagaatatgggagcaaaaacgctaaaaaaaacactggcaaaaagactttagcatctgaccaagaagaagcaatagaaaatcatatttattatgtggttttgaatatataaaagagcaaaatagagaacaactgaataaaggaagaaaagagaatgcaatcatatactgctataaagttcttcagttcagtttagtcactcagtcgtgtccgactctttgcgatcccatgaactgcagcacgccaggcctccctgtccaacaccaactcccggagttcatccaaactcaagtccagagagtcagtgatgccatccagccatctcatcctctgtcgtcccctcctcctcctgcccccaatccctcccagcatcagggtcttttccaatgagtcaactcttcgcatgaggtagccaatgtattggagtttcagcttagcatcagtc

SEQ ID NO: 50054 - DNA, 1328 bp, Bovine  19866881345468
tgactccttggactgtagccctccaggactcctctgtcctgggattctccagacaagaatcctggagtgggttgccatgaccccctccaggggatattcctgacccagggatcaaacctgcattcctatatctcctgcattggcaggcaggttctttagcactagaaacatccttgcactttactgcaattattaaacacttgccacaggcttgagatctaaaatgaatatgccaagaaccattaagccatacagcaggaaggcaggtgcacagaaccctattatcctgaggctctgaggcaaggaaaaggccagcaaacgcctcatgaaagtaagctctaaactgcattcagggcaggcagtggaatgaaacatgattacttgactccagtcaaaatcccaaagaatttagtaccttattcagatgtcctaatgtgtttcttctgtgatgccaagttaaagctatcagctattaaaaatgaggctgcaaggagagctgcctatttgatatcattccagacccacctcctacagagtaatgctattctgctttccacagctgtttctccttacctgaggtgaggcaggtgcaggacaaaagaagccaaggactctgcacctgctccctcaaatgcagcttaggtaaagcaggtagcctgaccttttccagcccatcaccaggagcagatgttcggtggagaccaggaggttctcatgcacttgactttgccgcatttgaattcatttaatttaaccaatctgatcagactctactgacagatgctgaggggaactgctttctaaaggcttggttaatcttgaaagatcttgtcagaaaatactggaacaaaatcttagcagttcaaggtagaagtggatagttactataaggtaaatgaaaactcctgataaagaatccattttaaagtaagaactgcttcattaattctggaggttgatgcagataaaggagtataagcatatatttcattttaactatttataatgaaaaactgcaaacgcacatacaagtagatagcatagtataatgaaccttcatatacttaccaatcagcttcaacgaatagaacccatagagacccaagcctcccattcctacatgccctcccttccgaccccacccagagatttttgtggcaaattgcagatacatcacttcactacagatatttcatcaccacatttaaaaaggtttaaaatattttttaactcatcagtattcaattttattaagtgtccatcttttaaaagtttgtttgaataaggacccacgcgcactccacaccccacaattttcttttaaaatc

SEQ ID NO: 50055 - DNA, 1026 bp, Bovine  19866881578339
ctcccagttgaacttggagcccaaaagaaacccagaggaaggtttacccttttagtgtaacttctgttatctccagttcgagcgtttggcctcacattgctggaagatgatttttttaaacttgccttatttaaagtgatttcatcacgctacagacccacctgctagtgcaggagatttaagagatgcgggtttggttcctgggtctgtaagatcccctggatgagggcatggcaacccattccagtattcttgcctggagaatccccgtggacccaggagctgggtggactatagtccacagggtacctgagtcagacatgattgagcaatgcactaacataaaggaaaaaatataggctcttctgagaggtagttttcatgctacctcatgtgaaattaattttgtggacttgtatagaaaagtgatgtgaaaattaactattgtacagtttggctgtttttaggttcacctcacagatctctgtagatacctccactgtatcgtatgccccattgaattccagctctctgtgtacttgcttgtctcctctaccagccagtaagctaccagatgattttggatgaataaataaacgtctgggaatggaaggcgagtaaaatcaaacaacgaataatgagttagagtgatcctttaaaaggcaccaagcactgaacagaaaggcacagtttagctcaggtgcagtcttattaagatgccagtataaaaacacacagaaatgtttgcatcttattcccccaaatttagttagggtccttttggtagtacatagtaacaagagtgggggatgaaggtttcattttccgcccatcagtattggacttgtccgttcagttcacagtggacccaccttcactcacacccttgccatctctcctgggtcctcctgtgacagcctcctgagtttgatctccctggcccctctttacagataatcttcgcaaactatgggggcctgaatgtgtcattcctcctttcaaaaccactcagtgtctcctcctcat

SEQ ID NO: 50056 - DNA, 1121 bp, Bovine  19866880621082
attgatgcttttgaactgtggtgttggagaagactcttgagagtcccttggactgcaaggagatccaaccagtccattctgaaggagatcagccctgggatttctttggaaggactgatgctgaagctgacactccagtactttggccacctcatgcgaagagttgactcattggaaaagactctgatgctgggagggattagaggcaggaggagaaggggacgacagaggatgagatggctggatggcatcactgacttgatggacataggtctgagtgaactccgggagttggtgatggacagggaggcctggcgtgctgcgattcatggggtcgcaaagagtcggacacgactgagcgactgaactgaactgaactgaatgaattttaaacaatacattgtgtcaaaatgaattgcaattgacatattttaactattaatcatttttaagttctttgattagatattttaaatcatttgctgttagaatctgaatctttagtaacagtttctaatttgtaaacttgccaggcgtctagatccaaagagaaagcccagacagacatcttgcccatacaatagtccaaaaatgcagtagctgtggtgatctgcggtctgtttgtgtgagcttctttgcataataaggttttatgatgggtactaattgggtttattgacactgctgatctgttcttaagcttcttactgtttgcaatttttgcagggctaataccaggctagattcttaattcccacccctttgagtaccaacttaaaattttggaacttaccattcttgtatagtctcagggtgttatttcttcaattgctgtatacctgcctcataaactgcatttttcttcatgataaagaaacacagattgaaactttaaggagactatctttcaatagcaaaagggtataatgaaataaattttggtactttaaaatacactcagtaaatcaaagtaaatgagaaatcactccaagagcagtcctgcaatttggtcatgttttagtgcgtagataaaattcttcagaaattggctacaagcactggcttataattaatgtagccaagcagtaagaaatatgctgtcttcactaagttaatgtgtc

SEQ ID NO: 50057 - DNA, 1131 bp, Bovine  19866880748272
caaaatgagtttttgggagactagcagagaaattgcaatttgggacaagaaaactatggggaattgtagacaagtccagagaccaggaaaagagtcttgtttttataaagcgagaggacactgcagagggttgtggtagttcttgggttgcaggcagtaggcagcttgttgctggcttggagcaatcactcttcttgctgatatctgttagctactatgaaggccaggactttggccgctcccccttcagggcttctttatttaaataaggtttcctttattcattgtcagacaagactgagcgactaagcacagaattacaagaatactttcaaagcaccaagcagcttctattgggagactgaaaaataacttacatacattacagaagagcagttcttgtcttgcattccatgcatgtgagaaagaagtctgaagcccagaaatgcatgtagttggaagaccaagaattcgatgggcatgacattttctagccagataaaaatacacatgcatatgtctgtatgactcattccacacaactcaaaattgctagagagtgggtgtagctacgaatattactgcacaatgtagttttcaaaggaaaaaaaaaaaaaaaaaaaatttggcagcttccaatctccccgagtaactttagattaattgaaattttaattaataaaatgcccaacctaaaatatattaaagacatgtcaagtgctatagaacaaatgagggagaatgaataatagaaaaccaaagtggtaactgttctataaatgcacattctttggtctgtctgtctgactacattttaactaagttaggccatgtctcagccagtaaattaaaatagacaattgattcattttttgccactatttcaatttcactgtatttcatatttaaatggaaagatctagattgtccaaataatgttttcaatttcaaacatctctttgtaaattgtgcttgattattagttgtaaataagctaggtttaatagacaaaaaaaaaaaaaagaatagcaatgggcttgacagctattgttttccctttgtgttttcgtaagagtttccttatgccaggtactttgggaagtgacttaacatgcattatctcttttaaac

SEQ ID NO: 50058 - DNA, 2245 bp, Bovine  19866881018804
taaaactaatttaaggaacaatttagcaatgggaggcttaaagaataaaattaactttacttactatagaatttccaatgtgtaatagtttagcctttcagctataaagttaatattctgagaatatttcaaaagacatttaataaagatacaagaacagtaacaaccctaaaatggttttaaaagacatctattcaatataggcaagagtgacaaaaataaaatacaacattatgaagctatcaataatgtactttaaaagtcattcattttagaatatataatttaatttgtattaatgacaattttgagcccatacctgacatataaaatacatccttggaaataactcaacttttccaggacaaatgtaaaggaaaaatgcattcatgtacaatggtttaaaactacaatacccacagccagtaatcttgtcacataaaaactaaaatgaaatttctttatctctttccaagggctcataaataaaatattttgtagatcaagtgtcacatcaatggcatatcttatcctgtagatggcctgttatcagctccatgaaatgttcattcctacacaattaagggacatgtaagatgtttccccggagaaggcagtggcaacccactccagtactcttgcctggaaaatcccatggatggaggagcctggtgtgctgcagtctatggggtcgctaagagtcggacacgactgagcgacttcactttcacttttcactttcatccactggagaaggaaatggcaacccactccagcgttcttgcctggagaatcccagggacaggggagcctggtgggctgccgtccatggggtcgcaaagagtcggacacaactgagcgacttcactttcaccacatcttttgagcttcccaggtggcgctagtagtggtaaagaacacccctgccgatgcaggaaacataatgagacacgagttcaatccctaatttggaaagatcccctggaagagggcatggcaacccattcttgcctagagaatcccatcgacagaagaacctggtgggctgcagttcgtagggtcgcaaagagttagacccaattgagatgacgtagcatgcatgcaagcaccacatcttttaaagctaaaaaccacaaaccagctttcttctgtattaagaaaacaaagacttgaagtgtctctgtttggcgagcactatctggccttaataattgggtgttgtataagtgttgggctggctggcagtggcttctgcccacttaagtgaagtgactactcaggattagagctattggttgtctttgctgtgtacatgagataccaactagggattattgtatctgttgttattttagcagaagtcaagtctgtaccactgtcagctggccatgtcaagggtttgtgacccccattttacaggtgttgggaactgagacatttgctcaaggtaatactattagtcaagggggcaagggttctgatgcaggttgtcagactgcagaggccaccttcataaccagaattccatagggccctatcctcaaagggtaggatatgctctcatagtcccttccagccaccagcctaaacccaaggaacagaaagaagaggagctaggacaggaaatggggtacagccagagtgctactcaagtttcccttgaggatgcatagatagggcatcctagaagattcaaaggaacctgtgtagtgagatccaaagaatacccagatctggagatggagttagagggttgataaaaaaggatctcctgcttctaatgggctgatataggtctttatttttgaataatgtgtaaaaatgacataagaaatctggtattagcaaaaagtatcacaaggatgcttttcattagtgctcagtaattgacagaatgaaaggaagagatacagacgcttgccttggcaaggtaaaaggaacacaaattagtcatcaccatgaaatgtttgccatttgtgtcttgctaatataatcacactgaggaatacatgccaggaaatcatggtttctgaagtacagcttaggagatgctaagaaagtcttccactggatatttctcttgggactggctctgccctaccttctcctttcaaactttaaatagaaagtaactattctgtttgaaaaaatgatattttccctgaagatgccatgagtgctcacccagaagactgcaatcatataagaattctcttacagatgacagaaaattaagaagctcata

SEQ ID NO: 50059 - DNA, 999 bp, Bovine  19866881115862
ctcccgcattgcaggcagacactttacccattctgagccaccagggaatcccaagattacatatgaagaagtataaaacaaaacaaggaaatacagtgtttctgagaaactacgagtagacaaattaactatagtctacattcttgtgacttttctttggaaattcacactcccataaatatgttgcatctcctgggtgtagatgtagttaaacattaacggaataacaacttaaggcatttctattaggcttcaaatcataattacatatgatttcttcaaaccttaaaaaagataacttttaaatgattgaaagtgttatacaatagacaatttttaagacttgttaacacaactactgtggaagatagaattctaagatagtccccacaattcctgctgcctgttttataagtcctttgtaatccttgggactatgaaggcaacaatcccatcattaagttttgttatatggcattttgctttaataaagggaagctatctgtgagggcctgacataatcaagcaattcagttgctcagtcatttctgactctgcaaacccatggactacagcacatcaggcttccctatctttcactatctcctggagcttgttcaaattcatgtccagtgagtcagtgatgctatttaacaatctcatccttgaatgtaatcatgtgagccctttaatctggttccagaggtcagagatggtcagagacggataagttggaataatttaaaatacaaatggaatttaatgtgaaggagattcttcactgctggaaagggccatgcagcaaggaatgttgacagcctctaggagatgaggcatggcagccagcaggaaatggggacctttattttacagctgcaaggaactgaatttggtcaaaagtttgaatgagtgtggaagctgatccttccccagagtatctggaagggaataccctaaacagagaatctaactgtgccaagctagatttactaaatagat

SEQ ID NO: 50060 - DNA, 4606 bp, Bovine  19866881244156
gctgcccagtttcctatgtccatggaatactccagggcaagaatactgaagtgggttcagtatatttcagtatactgaaatactgaagctattcccttctccaggggatcttccccaacccctgcctgcaatggggaatgaacctgagtctacctcattgcaggcagattctttaccatctaagccacctgctgctgctgctgctgctgctaagttgcttcagtcgcgtccgactctgtgcgaccccatagacggcaggcccaccaggctccgccgtctctgggattctcctggcaagaacactggagtgggttgccatttccttctccccatatttattgtactttaaactaaagttaataagttttaaaaactccttaatgaaatctatatctttaaaatatgatgtatccaatgaattgtctaatttctgcttatatataccttctatatagctagatttactcttgaattatgctctttccctactgaattctcagaaaatctaagttctttttttttcagagatgacttgaaattttaggaatttgatttcaattgagtctatctatgcaattcaaaaatagataaaatattttcagtgcactcataaatccaagagaagtaaaatcagtgctagtcactgattttccttttcaagtacttctagatcctggtaacatatttagaggatagtgctatgtgaattaacacttctccaaattattttaagtccctctggtccagttatcctttctctatctatatctttttttttttttttggtgtatgttattcggtgtatatttaaacagtcagaaaacacaagtaccagtgaatccaataaaatcaagatgtaactcacatggagaaagaggatgaattttttttaaagaaatctttcttaagataataaaaataatacttgaaagaagagagaaacagggattagactgcatttccttttaaagtaagatctacttgatttgtaaaaataatctaattgtaacttcttttcattctcatttttataaagaataaaatttgtacacacttccctttctgatccgcatgtttaaacagaactgctcagaataccactggctttgaaaacaaatcagatgtcttgatggtatatacaatgaatgtacatagaaaagcatctgtcatatttttatctaatttttatcatattttattttctcttattcacaatgtgaaaattgttaatagtgaagtcgagttaatggaacacagtgagaaaagcaaagttgttcatattaatttttaagaattttgaagtatggtcatgctcagatagacttgaaagaatagcagaattaaaactgcccccatgataatgagcaggccagagcttaaaacatggaaatacccatgatacattttaatgaaatgatttattcttcattggtacttcatttttcatttatctttaaatgaatgtttactttaagaatatcctcaatatgcaatgttataaaaatgaaagcatgagcactttgtaagtgattatatacatggccaaagtttaatttggctctccattcaaaaaaaagcagtgtcggtggatatttgggcaatatcacttaattcatggttacttttccccaagatttataagcaaagtgaaaaaattcagatgtaggctgttgatacaaaatgaaatatactagactgaaaaaaaaccctatatattctcaaaacctaagtaataccatgccagagcataatcatgtattcactaaccatgtggtgtcaagtgcccaagggatagcttcctccacataccataagatggtcaggaccataaaacgctttgtcctgatggttgctgttgacaatggaaacaatttttaaaagctaccctcaagatcactctggtgattttccaaatgattaggttatggtgaatgaatagggagttcttataaataactgatatgccaaactagttacaggaatataataattaaagcctgagtttaactcgcctcttaacaaaacagacatttggaaactattaaccaacaggctctaaactatagtaagattatttttgttcctgtctctcagaattgagagttccatacactcattttcattagaggtatctctaacagaatttcacctttaatataatttctgtgcctgctcacattttctaaaaaagagaatgtcattacaatttgtaacaaactcataaacctgaccaagttgaaatttaggaactggaaaagacgatatacaacacagtcctgaaactgtgtttccagaatattactggtctgacaaatgttaatagcatgtacttaagacaatatccttaaattgaatttcaaatcaatttgctggataatattctttagccacatgagtaaatacaagccctgttcctcaatgtttgttgttgttaatttaaggaatataacacttttgtaaaaggttaagaaaaagtcataatttcaaggttggtagatctaaacatttcaatattaatttctttgttcttcataaatgctatgaaacaagaataaaatggttaaatgtaatatttttcatttattttcaccttgtatttaagtgtctttgatagtttccatcctagtttgcaagccaccaaacctaaatatttcatcaggaaatgaactagattaaaagtaagctaaaaactggctttttcttctttaaaaaataaaaattgtaaaactaatttgtttggaggagtaaagcttcttagaaatcaacccaatgaaatcatggttcactgttttcaactagttctattccaaacaaagcataaaaataaaaagcaaaaaaaaaaaaaaaaatcaaattaacaatattttctaggcaaaaacagattacatagtattaggcattagattaggctaccattacaaatgattgattaaacttaaataaaatttgtaataaattattccattttaaaaatatgaatcacagaactcataaattcaaactcctaataggatatatgtaaaaataaagaaaattaaagtacaaatatacaatactattttaataggctgaattttgcaataatctgttttatataaagtacattaaactgaaagccactactttatttacctatgaaagccataaaataggtaaaataactattcacatttaaaccattggtttctctgcattttaaattcaaacttcatgcagtattgaaggacagtagattatatgggatttagtcagacttctttttcattttttctagtaagtagaatttataagtaaagatagccaacccaataaaccagattgaacagggcaaaagctgttgggaaaaatattcgagaatacgaatcaattttggcaatgcgtatgtgtatcctcccttccctccaagatcctgttctgcagtcttcaaagcaacagaagaagctggcacaatctttgccctccaaacactggtagccataatcatcttctccttgtggcagagaaaggctattcattggaatcagagtagatccaggatggagtccagaggacatctgagtaagataataaatgagtgttgagaaaaaaaatagcctaaaaaagatcaatttgtcccctcaaggcaaactctaagagtgatatgcagtaaaaaaaaaaaaatcatatttttcaaaaatcaaacaaatattcaatcctaacatcttttttagactataatttactttgtagcatataccaatattattttatggtccaaagattttgagggaaaaatacactaaaaaatgaaatatatttttatacctttaaaaagatgatctactaaattattattgaccatgaatctaattctaaaatgaggataaactatattttctatgatattttacagtaaaatatttataatactataaacatctgttggtttgctgtggttatattctatactgtattttagtcataatgaatacaaataataaagattcacaagttggtattgattttcttatcacttaatacctgtatagcatatgttccaatgttaatcagagtgaaggtggttaaaatacaagattgttagtacctgattttggtaaagcagaaaattttaagaaggtgtaaatgaataaaaaatatttgaggtctggagttgtggataagcacaaagcattgtgtttgtgagaaagaacgtgcaggagttaaaaactcagcttggaaacaactgatattcaaaattttgctcattctaccaaaatttgtctcattccagtcttccccatagctggggaagaattatattaatgaatgctttaattaaatggcaaataaattatgaatgaaaattgccatctttagtaacccttattctttaggacatccacgtatttcaggggttattttagatgtgaatctcacaatatagtataatcagtggttttattttataaacactgaatacaatgctgagattatcacaattgttttatcctgattttcaattctaatgagaatgtttataaaaaatttttcatcctaaattctgaaataaatctcaaaactataaaattaaacactgtatagaaagattagaaaatcaagcacaaaa

SEQ ID NO: 50061 - DNA, 1135 bp, Bovine  19866881331325
gactctcacagctctggatttttaaaaaaggaaaagttaaaatatgtatttaatgaatattctttgaaactgtaaaacctcatgtatgacttgaaatgtatgcagtgaaaataaatgtattgcaaatagtggaatgaatcttgagaaatcagtattttgacatatggaaatcagagttctgttgtacaatattctatttcagacatttaacaaataattatagaacttctccaaggtattcaacttgcttgactgttgaagggcttattctgacatcttattcagagatgctatattattcatgatatgtgtagaattccttttctttgccctgcgggattgtaaggaatcatgcatcacgattaaagagaaattaaacagttaaatccttaaatgcatgtgacaagatgtaagactacttctacattatccagactatttggctggttgccagtgatattcaatcagatgaagacttctggtaagatgcattgcctctaaattagaaggtccatattatagctcatgatgaaaatgcaaatgtcagttggaatgatccaaagtcttctacgttgctgacattacttttcctttatgattccagtaaaattaatagctcttcatccactcagttcggcattgaagactcttcttttatcttcaaaatgcctggaagcctgttatagactgaggaaattgtttttcttctcatcacctctgacccacctatctctctttttaggccaaattgcacccatcaaaatattttgcttaaacacaagtgctctgtgctcagtcgcttagtcatgttggactctttgcaaccccatggactgtagcccagcaaggttcctccctccatgggatttcccaggtaagaatattggagtgggttgctattttcctcctcctgggtatcttcctaatcctggggtcgaacctgtgtctcctgcattggcaggtggattctttaccactgagttacctgggaagcccttaaacacaagaacatttaacttaaaagtaaattgcactttccattagtcctgcaaacagattacatttagcagttttaaattgccatttttcttttttgcttcctttctccattgcattgctttttcataatccttta

SEQ ID NO: 50062 - DNA, 1731 bp, Bovine  19866881414802
tactgtggtatgtagtttttacaatggattgaattttcctgggtaatggaacagaggtatagagatccccagaaaggttatattcaagcattgttagatctagcctttccttaaccagaacttccaattcatttctgataacatttgagattagatataaaccatgcaagatttcttggaagtcatctctcaaatataatagattttgactgatggatggttcttgcaaaagatcggtcttaaagtcgtaatgacactactaaattcttctgataacattaggctaacaagtcatgcctaagtgaagaatcaaatcacagcctttaagaaatctaggaacacagtagttcagccagatagataaagagtttaacaagtccagaaatccattctgaagagattttggacattagaagaacaggagaagaacccagttcaaggctttcctttctcttttcctgtgagccacattaaattatttctcaaagtaggaaatgaataactaaaataaatagcccaaggatttctaagcaatgatttaagcagttataatccctacatgtcttttgatttttttcttaaaccaccactagatgggactcttgcatccttggtctggattcttagctgctttatctacacatggggacttaaagaactcaaaaacaacagggaagctataaggctctttatttgtcaggttccaaatgagatatttgcatgtatcatttaaggttcaagttgtatcatagttcccattttagagataaagccactgaggctgagagagagaaagtgatagggaaagggagaaagaagggaggataatttaacatttgatggatgattttatatactgggcatttataatgcactttatcctctcaatgatccccccagtcctgaaaaataacattttcattttatggatggagaagttgctgaatcttagccaattcacatagctgctatggctgaagcaaaatcctaatctgtgcctgattctagtgcacactgtctctgtgcatagcatagtcacttctcgagcagtagaaacactttaatgcttgatatagctttaaaaagtgtaaagctgtaaggagctgaagtagtaaaacacaagggttagattcattatcctgaaaactgcataatatggacatacagttggctttgaaagagaagaccatttacggattaggcagtacaatttagtgaagagtgtgcacttttgaggcagtctgcctgggtttgtatcctacttcaaccacttgttaacagtgtgatctttagaaagatatcagctttacttagcctcagtttcctgaactgtaaatgagaatgataatgatatcaaactcacaggactgttatgagaattgaacaaattaatatataaaaagtccttttaataatgtttggcatacagtagttgttctgaagtgatattttttaatcctatctgaactaatgtaagaatacacaatttatgcatcaattaaaggtccgtctagtcaaggctatgatttttgcagtggtcatgtatggatgtgagagtggactgtgaagaaagctgagcgccgaattgatgcttttaaactgtggtgttggagaagactcttgagagtcccctggactgcaaggagatccaaccagtccattctgaaggagatcagccctgggatttcttggaaggactgatgctagagctaaactccagttcttggccac

SEQ ID NO: 50063 - DNA, 978 bp, Bovine  19866881543963
gagaatccctaaggacagaggtgcttggctggctgcagtccataggatcacaaagaatcagacacgaatgagtgactaagcacatccagttatcagtatagtctaattctgtcacactctatgtaaataagaatatatccctatctctatatttaaaatttaaaaccaatttgtgataaagccatgatgatatttgaactctgttccaaaaaattttttggatattgtagttagctaggtgtatgggaaaagaatctgttgacacagagcttgtgagttaattcagtgtaaataatagattgtacaatctgattcaaattataaaataattgattgtaaaactaatctaattctgaatacagtattgcagtaaataatgttttgctatcttaagtatggaaaaataatagagctttctctttcagttattttatattctatttaagctgcttcagaatctttttggatagatgaaatgtattatttccttttaaaaatatcatggtttgtattagagtgctcgacagaaaccagattataacccagaggatccacgtttttaaagaactaatggtattttaattttaaagatgaaaagggggggaagggcctttgttttgatcgaaagaggctgtgagggcaaagaagtgtacaagagcatgagcacactagtttataggtgaaaagccctttatttttataaaaggccagttattatctctgtgcctcagtttccaaaacaggaagtaagggaactcttgttgataacctgcagcgccccttccttctagaatctctccatcattctgtgactcgtttcaagtcaaatagagtagaaaataaggtttttggaacagacatctgaagccaattttttcttcattgtagagaaatagagagacagagtatgggcctgaatacaagctagcagaataaggctgctaggcctcaaaagtgggccagcgagaacaagggctg

SEQ ID NO: 50064 - DNA, 1233 bp, Bovine  19866880388352
gtagaaagggagttttgtgcacttgggagcaaagcatagtacaaatcctttctgcatttctgcaaccagaaaccatgcaaatgtttttgcaaatccacttgtggtcttgctggtagtttttgagcatagccctctttgtgaggcagtgatgttgacctctgttttctattcactgtcctgccccaaagtgagcaccctgttttctctgtaaccgggtgggcatactcgtctctacctaaaacagagaggcgccagcctagctttgcctgaattcttgcacagagtgattttggttactcctgctttgggatcacttatgtgtcagctccagcccccttaaaccctcagtcccatccctgcgacaaggaagaactttgcagggctgggagcggctgccacctggcttcagaagctctggagcaggttcccccaggggatccctagctggggccgttttggcagttcatgtctatcttgcctattttgtcagtgaggatttctgtgaggttatttttaacctgagtgtccttactatgctgagagatacctttgtcacacaaggaaaccatgcctcatctatctactccccaaagaattttgaacgagaagcctgaagacttactgaaggtgtggggctctggccttgaaattggctataggagtcctttgaaggcagaggcacagtgtcgcagggtggctccagccctttggcctctcacaacacctgttatctttgtagccatcagtcctgtgaaagtgaagtgaaagtgttagccgctcagtcgtgtctgactcttagcagccccgtggactgtgtctgactcttagcagccccatggattttacagccccaggaagcctgccaggtttttctatctgtggacttctccaggcaagaatactggaattggttaccatttccttctccaggggatcttcccaatccagggatcaaacctgggccttctgaattgcaagcaggttctttataccatctgaaccaccagagaagtcagggagtcaatcctatccatgcctaaaatgcccctgttgagagtggtgatctctgttccttcatccatcttgccagggggacctaaaaggcagtttcaggtgctacttctgaaatcttgttatcagagaacagctgccttgacacactttcacacagtggggaatacatttcgtttgacttccagggcctccatggaagcttctctgggtttataaacc

SEQ ID NO: 50065 - DNA, 1798 bp, Bovine  19866880555524
cattttaagataaggtttctttagaaataaaaactatacttaccacaatccattcagctatgttttcatagagctctggactgaaaattgcttttttaagcctcgctagaggaccatcagcatctactaatctgcaccgcatgaaaacatcacagtagcctctaaaatcattgcatggggatccaggttgcagggtgatagttcgaccaaggaagtacttgttccactgcacagaccctgtactggcacaagttgatggctccactgtaaaagaagtgcccaatataagctgaagatcagattctctattgggctagctgggaaaaagggagaaactgcctaaaatcatcattgtgacatgctacataggctttcattagttagactggataatacccttacttaaatatcacaacataaacaaccagcaactcttttgacttagagcctacaatggcttaaaatccttctaacagtgcatatattaattattgcaaaaacattggcaggtttcgtctagttcatcatgttaaaaacactgtagggaccacaaaactggaaacacaatgctatactacatttaaatatttctcaagagaatcagttcagctggaaattatctgtcccaactgtataccaaagtttaacacttaacatttaggagaaaataaggtttttcaaacagattttatactcgtgcattttcaaagccttactcttcttcatacagcagacatggcataattccttatcatctttgccatcagaactggcacaggtacactcctccaagccatgtttctcacagatagaacctgcacattgctgaaagaaaaataaaagaccaattatttaatccctatacagtcaaacctcttgttcccagtaacagacagatgcctccaatgctaaaataattaagtaaaaatacaagaggtggtgggagcacagattagaatcagaaatggaccatataaacacatcttaaaaagagcaagtgcaaataagatagtaaatcttaaaaaaatggtaacaaaaatctagacaaaacacaaacagaggtgattagatgaacatccactttatgttggttattatggctcctttataagaaaagaaaaatcaaaagctcctcatgtagaggaaagtgattgtttagccaagaaagctttaaaggcctcaaaggcagaggaaataatcaagagtccttttatttagggtactaaaatattaatttataaaacttaaaagcagtacaaagttacatgcctagttacataactatttttctctagagtatcaaacacacgcagtagaaagttgaaagacaagtcaataacaaatcgaatgccaccaggcacttatgccacataatgcagtcacagctttgtggggaaatagatacggatgctgaaactgggactgagatgaattactttaactgtgaggttttaagtattctgaaaaagatttcataaaattaaatgaaaaacaaatcaaatgcttaccccattaatgcacacttgcgtatgtctattacagtctgtgaagttcggtttaggatcagaggctgggcagagagctgtgatgccattacatattccttcttttgcacagtctgaatcatcccgacacttttcagtttttgacttgaatgcacaatgtgctgtacaacagggaccttgacttggactaaaagaagtactgagttgagtaaagaaaatcccactaggacatttccgatacaatagatacagtcttaatttttaaataataaatattatcttttaaatgttaa

SEQ ID NO: 50066 - DNA, 1246 bp, Bovine  19866880573357
ctgtgtcccccactggtacctcattaagcttccccaaagaggggaagccctgcaaagggaggcggagcaacttcagcaccaggcctgctccgccaccccaccccatgttgccccagtgagaaaaggagagaaagaatacaactatcccctccccagtgcaaatcccacttccttggtgaatctagctcctaaagggaaaaaggaagaatgtcaaaaaattagatgatgaaattgaggctttagaataaagtgagacaaaggaaaaaaaaaaaaaaagacttaataatagaactgaccaaatgttaggaaatctcaagatgctattaagggatgaaaaagtatgactttacatggtcaaaggcatggatgggagcaatataaaactgtttcacatttgtattcctctaaattcagactgaacaataaatctgtaacataaagccttagtttttattgtaggtggtccctttgaacttggtgaattgaatcaaacacgtgtatagagcattgattctcaaactttagcacacatcaggatcacccgagggcttgataaaatagacagttggctccacaccagttcctgacttagtaggtctggggtgagattgagaatttgcatttctagcaaggtcctgggtgatgttaatgttactactctggggactataatctgagaaatcactgtggtatggattagagcatcacttaagtgtatatttaacacagccttgaaaataggctcctgaacttctgaagaagccaatacaaatgttaattttatttatttcacccatttactttccctggaggaagcaaggcttgaaagttgcattagggctccattgtatgaaagaatgaattgaaaacccatcgctctacaaacagctgagtctgtgaggtcatccaggatattccccatgttcacacagcagctctgccatggagatggctgctacagcacaactttgagcaggggctcgatgtgcatagtcaagggtgtgtgaggaacagagaagttgttctgcttgcccctgaggaagcaggagtcatctttgcctcccccagcatccttgtgattcacagccagtcctctgtggtcaggctgacatctccccatcagaggacgcaccctctcatgtgaatgctgctcagtcaggtttgagtagagctgcggatgtgcatgctaactgcttcagtcgtgtctgactctttgcaaccccatggactgcagccctccaggctc

SEQ ID NO: 50067 - DNA, 1065 bp, Bovine  19866880601199
attgtgcggtagtttgagcattctttggcattgcctttctttggggttggaatgaaaactgaccttttccagtcctgtggccactgctgagttttccaaatttgctggcatattgagtgcagcactttcacagaaagtagtaaatgttaaattacatgttttctattttataggtattataaaatctgggaaaagaataccaacgaggctaataaatgcaaaatatgtgtttcatttcaaaaaagggatcgtgatttgcccacttgttagtttaaaataaaagagaactgtcattcattaaataagcatttaatgagcgtaaattataagccaagctcttgtctttcctagatataagggtgttaagtgaaacttaagagacaaagagaagacatccaaaagttaaaaaaaaaaaaaaaagcttagaggctaacaaagtactaaatcaagtctgagaaaataatcctataaaagaaacagacagatgatgttcaatacatctacttatatggccaaaagaaaacaaagtagaaaaatggagtcaaaatgacaaaatgagaggccaaaatttaccagtctaatttattatattctaattaggatagttttttatttaataatctaaataaacaaaaaggacctctaggataataattaaaaaaacaggcttcatccaaaaaactgtgagggggaaagagcaagacagggaaagagcaagacagggaaagagcaagacaaacaattaagtatcttcagacataagataatctgaactgatttttaagatctctagaaaaagtcaatcacagaatcctctcagtgcatttccagtgttaacaacgctcactcacagcaaactcactctagacttcctgtgggtcataagaccatgtggggcccacagttccttgtcatgatactaattatgccatcctgcatgagcagaaagcttcccttctatccttcagaagatgccattgtccagactctgactaaatgttcttttatccttcaaccgcatgcaccactcctcacaccaatctgccaagcagaagggaacggcta

SEQ ID NO: 50068 - DNA, 2126 bp, Bovine  19866880634843
aaatgttggtgctgggagaactccggtagctttttttcacactccacacatcctttaccaaagaaccatgtctcaagttcagcacagtctcacaactttattgtttctgagcctacttttcagttgtctctgacaactcacagaactcattcatcaatctcatgtgaagcttttgctctaggaccacttttgtgttggacaactagttgatgcctggtatctttgcacgcagcagacactggacagtttgggcagtgcacagttggctcacagaacttaggttattatctccagaggcaagcgagatcttagaaaggattttataataattcagttatgttggagaccaaaaggaatgctttcaagaaattctaaattaaggcccagaccaattatccttgtcttatcctggtggcttttggatatgactaaacttaggtgtgcttctgagtagacacaggtgaatattcaagctgctaaggcatctgaagtacatatttctgtcttattcttctttaaaatttatttttatttgtttttaactggatggtaattgctttgcaacgtactgttggtttctgctgtacaacaggtgaatcagccataagcatacatatatcccctccttgcacctcccctcccacctcccactccatcccacccctgtaggttgttgcagagcgcagggctgggcccccgtgtcatacggcagcttcccgctggctgtctcttttacgcacagtgatgtgtatatttcatggctactctcagtttgtcctgtcctctctgttcccccgccatgtccacaagtctgttctctacgtctgtgtgtctgttcctgccctgcagataagttcatcggtaccatttttctagatcccatatttatgcattcatatgctatgtttgtttttctgacttatttcactctgtataacaggctttaggtttgtccacctcagttcatctgactcaaatttgttccctttatggctgagtatattccattgtatatcagtaccacagcttatttatccattcatctgtcagtggacatctaggctattttcatgtcctgttcattgtattaataaatagagctgcagtgaacattggggtatacatgtcgttttgaattgtggtttcctcagggtatatgcccagtagtgggattgccggatcacacagtagtcttatttctagtttttaaaggaatctccatattgttctccatagtgcctatgtcaatttacattcccaccaacagcacaagagggattccttttctccacatcctctccagtatttattgtttgtagatttttcatgatggccattctgactggtgtgagatggtgccccattgtggttttgatttgtagttctctaataatgagagatgttgagagcatcttttcatgtgtttgttggtcatctgtctgtcttctttggagaaatgtctccaaagaaggtcttctgccacttttctgagtgtgttgtttgtttttctgatatggagctgcaggagctgcttgtatattttggagattaactctttgtcatttgatttgtttgcaattattttttctcattctgagggttgtcttttcatcttggttatttcctttgctgtgcaaaacgcttgtaagttaaattaggtcccatttgtatatttttatttccattagtcttggaagtgggtcagagaggatcgtgctggtgatttatgtcagagtgtactgcctatgtcttcctgtaagatttttacattttctggtcttacatttaggtctttaatctattttgtgtttatctttgtgtatggtgttgctgctcagtcacttcagtcgtgtccgactctgtgcgaccccatagacggcagcccaccaggtttccccgtccctgggattctccaggcaggaacactggagtgggttgccatttccttctccagtgtatggtgttaggaagtgttctaatttccttcttttacgtgtatctgtccagttttcccagcaccatgtgttgaaggggctatctttgcttcattgtatattcttggctcctttctcaacaataaggtgcccgtaggtgcgagggtttatctctacactttctatcctttt

SEQ ID NO: 50069 - DNA, 792 bp, Bovine  19866880663559
cacgtctatcatcttcctgtttctaggtagatgaaaactctggaattgttttaattacttcaacgacagcaattccaaactccaaaaggcacttgtgtaaaaagctgctcaaaacaactctcccaagtcatttggaattaatgaaataaagtcccagcatcctagcacagggctacgaagacctctgtgtcaggaaggagagtgtacagatggggaagaggggaagaggcgcagatttttggtgtatggggtggagtgaaactcccatttcagctgctggattcatgtctgggcatgtccatttgcctggctggcctttaggcgggacagtgattattcgactggattattaaaggagtccaacacaagaaaccttgagtgatttaatgtgtgcagactattaggagtttcatgatcattaagaaataaagccagcagggcaaaacatcaaggtcaattatcagcatgagtctggaaatgagaagagactgtttggacattaggacttcaaccatcaaattcaagagctcctccctttggtgacccggagtcagaaaatcaggaaattctcttcacccaagccagagcttcagctcattccccttgcctcagcccaggttcctaggtctgaaaacaaagcttttacacccttgttttttttttccctaaaatatcagacttatttttggacttcacctccgtcttcttcacatgctcaagctgcaattccttacagatgttttgacgtaggagcctatgttgaaagaagcttaactagtccctggtttggct

SEQ ID NO: 50070 - DNA, 2520 bp, Bovine  19866880795782
tgaggaaaggaagggcaattctgacagataaaactcaccagggagcttaacaattactccatgaaaactgagtaagaattctcttggaaatagaagcttccttctaaaacagaaggataaaaaagaaattgcttttctccaaaattctcacttatttattttaaaatggaacagaatccacatcacagatggttccctaagtgctttactgccagacataatctatggttgagataagatacaaaatctacataaatcaaagctactgagcaaacattcacttctctgtaaacgtggctttttgtcaaagggaatatattcatattcatccttgccagccttccagttcaccccctcgggagacactcagacagaaaaatgtctaactaggcattcaaggcattcagctgatattttcattactttcggtaagcaggccagttaggagcaacatgtaggctaaggtcagtcattctggcatgtcattatgttacaagaacatgccaaacacacacacacaaggccaagaggggtagggtaagcagtcagctccctctggccgacagacaggaaagaagtttctctctaaggtgccagatcaaagttccccctccagggtccacacatctacaaagcaaaacaagatgacaagacctgggatctagtctcctgggttcttcagttggggaaagaaggccttttgtccagtgcccaaagcaaagaaacttctccaagaccaaaagctgacatttccactttccttaggaaggcaacttgagttgagaactggattcaaaaattatcttatttatatccccaaggctcaaaaagaacttgagtcaaagggtaaattgaagccggacagttcaccactagagaaaagtaaaaaaagctcaaaaaggcagcctcctgataatgtgtgaaaaacccctatttccttggggacacagaacttaaatcaggaatgtcaacaacatcaatcaggtggcactctctattacaggaaagaaactcacaaatcggctggagttgttgttccggaccgtcttggcattcccgaaggcctccagcagcgggttggactgcaggatgatgtccttgacgtgctgttacagcagaaagaccaaagttaggaagacgcaaacacctacccggcagtgaaaggctagacttgcccgaggacctggttcctgaatatggtgagggtgagaggactcaaatccaagtccctgggatttccggaggatttactctttcctctcaacagacctggccctgttggtatggtcatgtcttccagctcccctggcttgatgcaggattccctgcagccagggtgccaccacaaatcaggatctatgaatgttcccagactgggtttccagattggatggtgcagctttatgctatgctccctggtatatcggggaacataagaagaaggggtatcttcttgtcttctgaccagattcttaatcatcacgactcctgctctactcaacttctgtcctcacctactgcatgcccctcttcactgcaaatgagagttaccttgagggaaatgaaatagtttctcctcccctaacaacattacagacaaacagacctgtgcttcccaaattttcatgtgtctgaatcacctagaaatcacatcaaaatgcaaatactgactcagtaggtctgaggtggggcccaagagtccatgtttctagccctggtgttcctggtgttgctggttttgtctgtatagagccccatttgagcaacaaggatccacactggattgggtggaacaattcctggcctattggaggggaacaatttggttttcacataccccaattcagtgtcaggctgaaaagtacaaaacagcccatgggcaagacagctcaacagatacgagttgatgttggagaaggttttgaaccagtgagtcattccttgtacttctaattattcacatgctatggttaaacatgttccagaaataacaagcctttggcttgtgctctttagctactgactaatttcaagccaagagttctgtatcattgtcctcataggaaaacaggaagagaaagatcaacattaaatgtctgcagtcgggccactaggtcgtcgtccatagcaaatcggacgagatgaaggcactaaccactgattgattctgcaacagccaaagtgcttctctggcaccccctgaacattctgaagatcaacgagaactggaattccatccactgggcacatgtcattagcaatgggcacagagagcaaattttgggtggttcctccatggaatccatttcagagtttagaaagatatttctaagcagcctattttcctttaaaaactcatggatttatatgaaatttgcttttgttcgtaaaataattttgactttgtgggttttcgttaatcttctgtatttgttgtttgctggccaaacatccctacaccatttaccaacgcttcactttcttgtagggacagaaaaaaagaaaagctcttctttgtct

SEQ ID NO: 50071 - DNA, 1379 bp, Bovine  19866880853079
cataatgtgggataagtagtcaaatactagagatgtaagacaaaaaatatattccaaagcctaattctaatacttaaatctatgtctcattcaactacttactggacaccttgaaacatgaagtaagttactttacctatgcacactgaactagcattttacaggaagcagccaaatcccagttttaactgtctcaaatagcttggtatgtgtatgcttacaatgatgattcttaaatttgaggaacattcccagattcccttgagaatctattagaagtcatagatccttgcttcagaaacacacacacacacacacacaaaacaatttttaagtgttgataacactgtaaatcacagcactgttgattcaatgggattggtatgagaacattttcgattcaatgggattggcatgagaaaattttcctactgttaataaagactgatcactaacattaaggaatagtctttgaaagtacgagaaagttcaatgaccatatccattcattcatctgcctcttttgctagctctaatggtgactggttgatgcaaatgtgcctctaatctagcctataaatcttaaaaacaaaaatgtttaagttctaatttctgctagtcttatacatgtaacaattttcaagcattacaaaatactgtgaaggaaagactaatacaccactatcaaattccaatatacccaaaccaacaatgaaacgtctgaatatgtaatttgttgacttgagcaaaataaaaacataattgctctaaattcttttttactttcaaggatgcaaaaccagatctctaagaaatttttttaacagaacatttaattttcccccacagtattcaaagtaaacattttatcattattactcttggtataccaaactgaattccaggaatgtaagaaagcccaactgggaaatattacatagaaaaaggctgaattaacaaacacattatatttcttacttatttcttataagtatacattgacatttacttatctgatagcagtactgctggttttgagtaaattttttttccttcaatgggaatgcagaatggcagtgttgtctttggaataaattaagaagacagtaacaactaacagaggaataacttctacacatatgtttttcaagggcaatgaatagttaagaatatacttatggaaaagtatgcctcaaatacattttaaaaaatttctcaggatttattgttttgtttcctaataaaatataatgcaccgacactgtgtttcctcctttaaccaacagagtgatatgaagaataaacttggcctaaaactcaacttgtttgagctaacagagaactgtgtagcacatcttatatctgattacttgagcaat

SEQ ID NO: 50072 - DNA, 1659 bp, Bovine  19866880870098
ttactgaggcttagaatgtaaatcatgtaactacttacagcagcaatagtcttcaaaaatgactaaaccaaacttttaaatataaagcatataaaaaggactatcaaggatagttttccaaactatagaaatacaggaaaatatgtgttgcctcataataaagttcaataaatattctttctgaatcctagaaacactataagatgttataggttatttggttcttataagttagaaaaatctgattgtttctacataaattcctccaaattcttatctatcatcaaacagatttttaataatgcttttctactagactcagagattatctctgtctaacatcccttcagaaatgtgcttttttttgatttaataagtatacttaattttctacaaaataaacatgatttaaattttaaggttcaaggtaattatagaaaaaggtagacactgaactatctctttttgtacatccctatatttacaagggctagcatccactgtggtttcctctttatactcacttgtcacactgaataaatagtaactgtggtccaagtaacctatattaaagattttaaaactcctcaaaattttacaacactacaaagttattaagatctgattttgatgagtattagtgttacataattttgctactggaaaagaaatacaaatctatattttttttcctatctaaattaaatccaagttccattatcagtttctcaaggtatatctaaaatgtacattcctaaacaaaggtaaagctgttcaagggctgaactagtccaatatacaactgagggttatttattcttattatttttgtcttttttttttctttttaaatctatattaaacccctggtttctcatggatcagatcataatttaacattgtaaaaattaatttcagaaactattgtgctaatatttagatttgaggaaggaatcagacaaaatcaattatctctattcattgttagaacagaagatgaaatagcttactaactgatatgagttatgaatgtcactatgacacaaaatttgctgttatttacttatttggctacaagtgcattatttttcatgaataacaacacagcatttccaacttgtaacatgaaactccagctcataaagagtgtactctgtgatttttaaaagtctgattgtaattaagtaacaacctttcccctgataaacatgaacaaaatccattggtaaatcaggcacagacggtatttatcggtttttcttcctttcctcctatggttgtttttgaagacatacagatggctccaacagaacccacacttgttataaaatgacacaactatttttctccttttccttttctttatctttttctcgtggttcctttcgtttacgttcactgtttccagattgtctgccacttgatggagaagcttgcactggctggctttgctttaaggaaaataaacaggaagaaattatcacaatttttctaagatgcttaagcagagttacctaaaaagaaaaaccatgagagtgaaaggaatcattaatggaaaaatgactgctgctgctaagtcgcttcagtcatgtctaactctgtgcaaccccatagacggcagcccaccaggctcccctgtcccgggattctccacacaag

SEQ ID NO: 50073 - DNA, 1723 bp, Bovine  19866880895974
atataagtcctctttcagatatatgactttcaaatattttctcttattcgctatcttgtactatttttttttttcaaagaacaggacttttaagctgtgaggaccagtctatcattcctttcacgattaatgctttttgcattgtgtctaaaaatagttgcctccccaaggatgtaaagatttttatctgatgttttcttttgaaggtactatagttttaattcttaagcttctgatcccttttaagttaatttttgtatatgttgtgaaataatagtcaacattcattttattacatgaatgacagcattgaatgaccttggcacattgtggaaaacccactgaacatatatgttttgaactattactgaactctctgggtgttccattgagctatgtgtctatccttaaaagactgccaccattgtcttgattattgtaaccttatcataataaggtcctttacagcaaattaatccatagattcaacccagtttcaactaaaatcccatgctttttggatacaaattggaacactgattctcaaatgtatatggaaatgtaaaggaccttgaatagcaaaacagtttttcaaagggaacaaatctgggtactcaattccaaggcttattatagtaattttttaaggagttaggcaaggatttcactgtggtgtcgatctcctcagcttctttctcttcatgaaattcaccatgataatcattacaggtatgttattaagaatgctgcttactctcacacagggttcctttaatattatctcttaataataatatttgtttctagtttcaacataaggaagattcctgattcttctgacctatattaccttgttgatacttgtgaatcttgtagctgattgcatttccctattgcctttggctgaaaggaatctaaagctagatttgtggctcttgtctagaatttgtccaatattctatggtatgtatttctgtatcacaactatctctgggtaaattttcctatcatttatttttcattggttctctacagtctaattctatttaggtttctaccctgatattccatgtgttcatgtaaactcttgcaaatactattagagaataggactgggaatgtttaaacatgtaagtaaatgtaataaaatatggttcatttaaagtggcacttagggcttccctggtggctcagtgataatgaatctgcctgccagtgcaggagacacaggttcaatcgctaacctgggaggatcccacatgtcacggaacaactaatccctgggctaaaactattgagcactctgccctggagcccacgtgccacaactactgagtccatgtgctgcagctactgaagcctgtgtgccctagagcctgtgctccacaatgggacagccacagtgagaagcctgggcacccaaactggagagtagctctgctcacactattcagagaaagtccatgcagcaacgaagacccaggacagccaaaaataaaataaataattattttaaaaatataaataaaatggcacttatggcaaagaattagtgtgtatttcacattgagaattcagtttcaaacttttagattgcatcactatctcattgttaagttttgttgcataaaccaaaggtgaagcagtggaaaatatttttaacgtgaatcatcttgtctttgtgtactgcttaacacttaatattgaccacggtcaagtaatt

SEQ ID NO: 50074 - DNA, 1593 bp, Bovine  19866880911781
ctttgttgttaaggtttcaatagtgatgtccctgaggcctgttctatcaggcaatgaaggactctaaaggtccacaaccaccttccactttcaacacagcaggatttgctgtgttgaaaagtagaaaatttctgttacaagtctctttaaaaggagtcattatattgcagagactataaaaatggttcccaaactttagcatgcatcatcacctactgactcagcgggtccaggtgggacctgatcatatttgcatttttatccagttcccaggtgatgctgatgctgctggtcaggggactacacttttgacatccattagtctagatcaggcttagcaaacatttcctatcaaagaccagacaaatattttaggctttgtgatgccatgcagtctctaagtgcaaaagctgccataagcaatatgtaactgaatcagtgtggccatgttctgataaatcattatttatggacactgaaatatgaatttcatgtaattttcaaacgaatattattctcatttttttcaactacttaaaaatgtgaaaccattcttactttgtgagccatataaaaataggccgtgggctgaatttggctcatgagccatagtttgccaacctctgctctacatgaatgattggttctcaattccagctactcatcaaaattgagtgctgggagctttgaaatgacccaaacacttaggctctgttccaagagattctgatgtaactggtctacgttgttagatgattctcatgtacaacatgaataaaagtcaggtaagtgtggaaaacgaagttaaaaagatttcttactgcaggatgtctcacaatattatcacaaatctccaagatgggaaccataatatgcaatattttccaggttcatttgacaaccaaccgcataatggtttcgtaaaacacatggaaacactgctctaaatctttcataaagaataccatatacttaatactcaggttcataaaattacagaaaaataagaaattaattcaaaaatgagaaacacatttgatgtttgtcaaaaataataatgaaaagataaacttctgacaaatctgaacaaattaaaaagaaaaaagccaccaacaggcaattatcttaaagtgtgggggaaacacaccaataaaactaaaaaaatcaaggtcaaagatggttttctatgtcagattgaacacaaaaggtgcagaaaatgtgaattatggaagaaaacaaaaaagaattaccaatgcacctatttaaagaaaaaaagacagtgatacagggtcttaacagatttcctggtgaattttctccaacttttcatgaactaggtaactctctgataaatctaaaggatgtttatcattatctcctggccagacacacagtagacactcagcctactttattcaaacgttactatcaagaacaacttttccccagaaaagaaaatgtctttttaacataatttctttggtgctggtagcaggcggtaactcataccctaaactattaaactgttatggttcttcccactctaccttcaagagggaaaatgtcaccacaggataccaggaaaggagacaa

SEQ ID NO: 50075 - DNA, 1860 bp, Bovine  19866880919149
agtgggcagcttcccccacctgccagggttcactcccccagcaaccttatgaggtgagtgcgcatgtaaaatcatcccccattttaaagatgaagaaactgaggcttacaaaagtcatcacaattattaaggatcaaatgaaataatatatgcaaaatcacttagcagagtgtccaacaagtaggaaataaatggtacctacactgccttctttagggggaagaattaggggaggagacatttagggagtttgaaatcaacatgtacacactgctgtatttgaaatggataaccaaccagtgcctactgtattactgcccaggaaactctgctcaatgttatgtggcaggctggatgggagaggagtttgatggagaatggaaacatatatatgtatggctgagtcccttccttgtgcgcctgaaactactacaatatttttaactggctatactccaatgtaaaaaaatatttttaaataataataaaaaataaaatgccttctttaaacagcagaacagagaataggagccaattagccttgctctcagtcacaagaaactggagagttgaaaaaaggcctcttgactcccctggaggacaaacaccaggcttcggactggccacacataatgagaaaactgctgaggagcaaagtaaaagggccatcgagaaagggcttggcagggtccaaagtgccccagcacaccggtgagggcagtgtgagctctgatggaggggtggcagaaataagtcactctgcaggcagctcagacagcagtggcagccccacggccctctgtccttcttagacggcccctcaccccaggctcagctggtccacatttcagctgtcacactccccatctgggtaatggagtgttatgaagcatgttggaggccatcaattagcgcttaactccatgtctgttgggtcgtatttccaaggatgctccactcaaattcatggcagaggtaaatcttgctccttttcattcaatgacttggagttaaaatgccgcccaacagtttctcccaaagaaattgagatttatgggtcactgtcaatatcaacacatgttgaccattatttgagagcctcctaggtcctcgggactgattgctattcactttgaaagatgactgtggctttataatccactcaggttgctgcattcgtttcttcccttggagacttttttattccacttcatgatgttttgcttggtggcataagccccattccccacaccctcaaccctatggatactctaatgtattcgaggctctgggacagacacaagaggggcccactcatcttcagtccagaggccggtgtaacaacagggagaaggcaccttagtaaaaaagtgctcctattttatgaactgaagccactagacacaatctgaggttaccgatgagctgcttgaggggcaataggtggggtcccctcattaacacttctggcctttggtgtgtctgggaagggtgtggatactgatacaggactgagtcacttagatcagtgatattgacattggttctcaaacatgagccaacatcagaaatgccaggaaggtttgttaacagagatttctgggccccactccagacttcttgcttcagaaggtcaagggtagggcccaggactttgcatttctaatgagattcagttcagttcagttgctcactcgaatccaactctttgagaccccatagactgcaacacgccaggcttccctgtccatcaccaactcccggaccttactcaaacttatgtccatcaagttgggggatgtcatccaaccaactcatcctctgtcatcaccttctcctcctgccttcaatctttcccag

SEQ ID NO: 50076 - DNA, 1781 bp, Bovine  19866880970871
ttcttgtttgtgcagaaaatttactccaaagtaacgtctcaacatcagcactcctgacgctgtgggtgtccagatcctttgttgcggggggtaccctgtgccctgcagggggttaaacatccctcgcctttaccccacagatgccagtgccacctcctctacctggtgatgagcatcaaaaatgtctctggtgctcaggccctaatccagttttaaatgtatttaaatgtcttctagctttaaatgtattccttctacaaactatgcttcctccagtcaccattcataccttgccttaaaggcatggtcctagttagtgagatcttgaaacatgtctggaataaccctttattaaatatgttcatcaaaagcatttagagaatgcatttaggaaacaaatagagcaaacacccccttgcccctttaaggactaactaaagtgaagcctatgttcatttgcttctgaaagaaacttaagacttcttctaagaggggccggactgaactcaacacagtggggctggctgttaggtctggccgggcctgttaacacctgtgggagggcggaggaaaagggagggtacttcctggggcctgagttctggagagaaaaagcacacccagttttgagcagtattctgaagaggccagagcctcactgtcctcgctgaggtcctgtgacaacagatgctacggggtgctgatgagcaagtcagatcatgagggggtggccgagggtaggggggtactggctgctagctgtccccagcaggggtagtgttccttgagtgcttcctgggactccctgtgtagaagggagcaaacgccaaggtaactcaggctccactcttctcacatcaacccccatgcccaccttcccacccccacaaggcacttttatggaagaggaaagacatcgtatagatcgttagcatgacatcatttccttcctagtcttggaaatccccatcacctgcttgagaaagcaggctggctggataagcaggtttttaattaagtaacctatatattagagatgtgtcagcatttggttaataagagccattagcctagataccagaagtcatctgacttcccagcaacaaggaatggggagtgggggtgcatttagaacaccctgggcgggaggaagcctgcagtctggcacctccagggagtggggctgggaggggatgtgcgcttatgcacacacgtgcacacacacacactcaccattcatagatggagagctggcctcttttttgtccatggggagaaacccagcaccattaatgcaggtggttggggtgtctggagcccaagagtactgggacttgggtgcattctctgggcagggggccctcttagcatagaggcaaagctgggtgactctctgaaaagaagggccagcctgcctgcagccttcccaggagtctccctccttgctcctctgcccacctgcccccagctttggctgaggtcacccagctcctccccttcatgccactcctgcccgttgctttctttcaaggctccctgaacatcagctcagtgtgttatcagtttacctcactcttcactgatccttctaacagcttcctcctgcccttggcttacgaagtccctgccaggtgcggccccacttgctccaagcctctcatcccgctgcaggccacactggcatcttcctacctctctccatgcagtccgggccctggctgggtttaggacccctgtccacatactcctagtctacatcctatttgctggtgacaaatata

SEQ ID NO: 50077 - DNA, 778 bp, Bovine  19866881032380
tttggaaccactttagggaagtaagccccattacccccagaggattccagtacaaatggacagattttctgaatgccatactctttcataatcagatttcttgaaagaaaaaaaaaaaaatctgattcaagccagagttccaaggaagtacaggctaagaagaaagtttggaaggggaaaaaaaaaaaaaaacaaacacttttcagcaagaaaacacagcctctatttgctttctttgctggaatccacaaaaggagaagctgtagtctgaaactacaggatagccagcaagatcaggcagagtagacaaagaaaacagaaaacaccagacttgtgaaaacggtcttccttccatacctcatctcatcatcttacatgacaacagaatggtgaagactagaaagcaaaaacaaagagccaaaaagaacaggtgaaacaggaatgcaaaagaggatgggaagatggcaacctctaaaaggtataacttaacctcagcagctctagatctcaaagcttttttgaagacctgctatagagttggccaaaagtttgttcagatttttccatatgatgtaacagaaaacctctaacaacctttttggcctgcccagtataaaataaattcatttgagacaaacttaggaatgtctgctgagttcaaaacaatattctacagggaaatagagtcaatatcctgtgataaaccataatggaaaagaatataaaaaaaatatatgtataactgagtcactttgctgtacagcagtattacacaaca

SEQ ID NO: 50078 - DNA, 1318 bp, Bovine  19866881034887
gaaaacttgaaagtgacacaggacgtcataaacattttgggcagagaaatcaataagcaaccaacatgacaaatggctcacaggaacattcgagactcctcttggcatggattacttttcacttgggaagatgtgttcatcgacatcacattttctgaagaacatcttaggagggaagtcaaatagggaaactgaataatgcagccacatctgttcattgcacatgcaaaatgctggctggttcgctgattatactcacctctcctccaaagaatctgtatttatgagcccactcaggaaagataacactggcatcttgcctttcaggcaaaagcctgtttgtgctttacttgtaagaaagcacaaggaaagaaatgggccgtcaataacactgcagctgggctctttgaggtgccccaagtcagagagagggaaacaagcattccattcaacactaaaatgcatgggctgccctccagagcaaagctgcctgtcctcagcattcaccttgataatgttgccacaaacactgaaattttggtggtcgttacacatctctggggtggcaaagcaagaagtcagactgcccagggcaaggccaggtctcccacagagcctggatgagagggaggtcagatggatggtaaataaattggcaagaagaagcctgaggggacttccctggcggtccagtggttaagactgaaccttccaatgcagggggtttgggtttgatccctggttggggcgttaagatctcacatgcctcgccaccaaaaaaacaaaacataaaactgaattagtattgtaacaaattcaataaagactttaaaaatggtccacattgaaaatatatgttaaaaaagagggatactaaagtcaatccacagagtcaccaccaacctgcttaccttatctcatactacaaactttttgaattccaatgatctctgtgatgaatggcccccagcaaacctcattccttccactggggctcaggataggctgccctccaaaatgccacaatggcatattggttattttggattaaagttacttaggaaatggccagtgcaagagggacacccttttgtacctccctaaaagcagggaataaatctctcctgtgaaggtgccctttctgatctgaaggtaggacggacactcttatcaccaaagaactgggtctgagaagcctgtataaacaaagcttgtcacttctttaatttactaccccaagaccaaactctgcttatattctttattaatggaccacccaaaacctaagtttcttcgtcctgtcaattcctcacaaatg

SEQ ID NO: 50079 - DNA, 932 bp, Bovine  19866881093941
cctcgttttccctatttgtaaagagaagataatacttaactcttaggtttgtggttaacagcaaaataatgtagcacttaatccagtgtctaacatgtgctgagtattcaacaaaggttattagcacctttccacttttcccttttcccagttaaatgttgtaagcactggaaaatgtgactagggtgtttctattagttaaatctcattaaatgagaaaaatattctccttcttttatgtttaacagtaccatgttataactgttcctttgatttaggtgtactaggaagcatgatgtcttttaagttatgatgaaactttaaatatagaggtctctattaacataggtataacatttctatttctagctcaaatattgataactccaagcttaaaagttgaaacctaccatcttatggttagcttttcactgaagttctctcatttcacagaatacacatttcacaccgagtcctcaggttctttttccctccttttaaaatctgtttgttatagtatgtgtaataaaatcttggataactactatagtttgcctaaaaggtgtcactttctttaactttcccaaactttaacataaattgtcttcaatttgagtcttcaggcagtataatgctacatgttatttattgtttatttacttacaataatggatacattaattatatctattctgaatgatagaggcaattatgcaggtaccatataacattaaaaatttatataccagtagccttttttcctggagaaggcaatggcaccccactccagtactcttgcctggaaaatcccatggacggaggagcctggtgggctgtagtccatagggtcgctaagagtcggacacaactgagcgacctcactttcacttttcactttcatacatggaggaggaaatggcaacccactccag

SEQ ID NO: 50080 - DNA, 1353 bp, Bovine  19866881101154
aatgtctgtctggttctttggcccactttttgattgggtcatttatttttctggtattgatctgcatgagctgcttgtgtattttggagattaattcttgtcagttgtttcatttgctcttatttcctcccattatgaaggctgccttttcaccttgcttatagtttcctttgttgtgcaaaagcttttaagtttaattaggtcccatttgtttatttttatttccgttactctgggaggtgggtcacagaggatcttgctgtgatttatgtcagagagtgttctgcctgtgttttcctctaagagttttatagtttctggtcttgaatttagttcttcagcccattttgagtttagttttgtgtgtggtattagaaagtgttctagtttcattcttttacaggtggttgaccagttttcccaggatcacttgttaaagagattgtcttttttccattatatatttttgcctccttttgtcaaaaataagatgtccataggtgtgtggatttatctctgctctttctgttttgttccattgacctatatttctgtcttttgccagtaccatactgtcttgatgactgtagctttgtagtatagtctgaagtcaggcaggttgattcctccagttccattcttctttctcaagattgaagcagtgatttttaaaatatatttatttatttatttggctgcgttgagtcttagttgcagccagcaggatcttttatcttcattgcaggatctctggttacagcatgtggcatctggttccctgaccagggattgaacccgggctccctgcattgggagcactgagtgttagccactggaccaccagggaagtccttagaagcaatgatttttagtattagggcatttatatttataggttcctggaacctgggagagtctagcatgtaacaaggataaggaatagagtaactgattaggaattgtagtagacaagtaggcagcttggaactagggaatcaggaaaatctgtaacaaagggaagatgagataagatgatgagtaggtcagaagcccgggtctgttcagatacagttgaggagatgggtgattatttaagtgcatcagtaagatttagtgatagagttgcattctgttcctacttcttgaattttttgactggttgttaaagtataagaacaaatctcagttgagtaggttgagactgcatgtgggaacaggcaattttgtggtgtctgactgagctaagtagtgcaagggtaggagattggcatgggctcctgtggagtaaattgtgccaatttcaatcactagctgtggaaatcaagggtatacatacatatatatatatatata

SEQ ID NO: 50081 - DNA, 817 bp, Bovine  19866881116142
cctgggtctcccacactgtgggcagactctttaccatctgagccccagggaagccccttaaacatagtaggtacttcataataaaaatggaaaagatgaataaattggataaagtggaaaatttatagtaaatgtgcctgtatttaaatatctttttttgtcgttgtttttctcatttttttctcttcccctttctattttcagaatatgagtgatgctatggcagtgttgcacaaactacagacaggcttggatgtaaatgtaaaattcactggtgttcgtgtgtttgaatatacaccagaatgcatagtatttgatcttcttgatattcctttgtatcatggatggttagtggaccctcaggtaagtacaaaatcttaaattatatgaacacaaatatagtaaaaatttattaatttggcaaaggaatctaggtttacattttctgatatttatatttttgtgtttttacatggaattagccacattgtgaggttaagagcacagtcccctagactgctaaatctgctcaagacttctgactataatttcatggagttagaggccagctacagagctgagtgcacatcctcagcaacacctgttattgtctatgtttttgattatagccatcctagtaggtgtaaattgtctctcacttgtggatttgtttgcatttctctaatgattaatgttgttgattatctttccatgtgcttattagccatttgtatatctttagagaaatatctgcaagtctcttggccatttttaattgggctgtctgtctttttgttacgggttctaagagtttttt

SEQ ID NO: 50082 - DNA, 869 bp, Bovine  19866881123416
cccacggctgcgtaattgccaacttcccttgaagctgatgtttcccaggtggagaatccccgccactatctgtagtaccagcgcctgctcctccgcaaagatcccaatcacgttcatggcgtgctggaagaggggagagaaatgacccagacaagtcagtcactagctatggaagcacatcagaaagaaaccaaagcttggatggggttgtgcagttacacatggcttagtccgtgatggcagctggaagtcaccataagacattttcactggccaatgccctctcacacattcaagtctcaacacggtgctggaaaggcagttcagtcttaaaatttcttttttgtggtttggtcattcagtcatgcccaactcttctgtgactccatggactgtaacccaccaggctcctcagtccctgggattctctaggcaggaatactggagtgggttgccatttccttctccaggggattttcccgacccagggattgaacccacgtcttctgcactgcaggcagattctttatcactgagccaaaggggagcccagtaaataacctgccgaatgtgaacatgtaatcgtctagaaatacatgcgagaaggctctggaggaaagatattcagatgcagaggcagctgcctagtcaacaagtctgttcttatctcttaattttctccttgttgccaccgtctccctctaagggcaccagtctgctttccagccactccaaactctcacaaacatttctcttcattgggagggctgagaataaattgtacttgcaaaaggatcttgaaaaattccaggaaaaccaaataaaagaatcattataagagctttgtttctgagatccattaaattaaa

SEQ ID NO: 50083 - DNA, 1365 bp, Bovine  19866881241160
agattctacctataattaagtcactcaggttgcttttttaggcccaaaaggtagaacaggtgtggtcaaccaacagatgttagtacttagaactgctgttaccagagccaaaacatcatccaaaatctctttaatcacatttcctactaaaccctttcaattttttttttgtatcagcagctagtttcttcttcttaagggaacacttcactttcttaattttaatttgtcagaagcagaagagataagcatcaaaaatttaaaagacaaagcaagtaatgtacttgagcaaaggggagagggtacagtggagcagttactttgaatttcactttaactttttctagcccattttttttagcacatgtgtcacttaccattttatattacccattttgttttttaaagtatgcaccacccaggtttacatcacaattatacacagaaacaacacagcaaaagttaaaatagcacaaaatacctcactttatttactccatgtgatcaccaatacgaatttaacattttttgacattttaagtactcactatcaaccaatttacttaattagcaaaaaaaattactgataattttttttgctgacatttcaattttccagaaactaaaaacctaatctgctcctgagaaacaggaggttcctccctgtatggttttgcagctgagaagtctgtttatttcttatgagtggagatgactgggaggctccagaagaggaggtagaggaaaaaactgggagaattccccaatttctcatgaatgaggctgacactgcagtttcaatacctttgtttgaaatggaatcctaaacattaaatccacttatatttaactaaaaacactgaaaaacattccagaataaaaaatagtatccaattatccacatccctggtcccctcaattggttgcaatcatttacaacatgagaaaatcctaaatacttaatttaaaaaaaaatcacagaccattaaattacgccactcttgcaggggcaaaaagaattacttatttggtacataaattttatcattagattttttttctccggaaggaactgcaattttaaaaaattaagaagaactcatcaaattccacatacctggtcatggtagctggtactagaagtactattcgctccacaaggtggttgtacttgtggaggtctttccacaggacaagtaggatcactaaaggaaggagaaactgggacagctgggtggggagtatgatgatggggggggatgatgctgaaaatggtggccatgctgctgaaagcaacttgtgtgtggatgtcctaatgcatggtgattctgcgatgaccctccacagggcgagtgctggggacag

SEQ ID NO: 50084 - DNA, 1024 bp, Bovine  19866881279261
tctctccatgtctgtagaatgataaagaacttttgagtgtgatcaggagactcgtgtacaaactagagcagtgctgggtgagaagcaacagctcccttcctttgggctgggagccacccattcacctgaggccttgttaaaggcaacagactcttaggaactttcctggatctcaccagcttctctcctcacgttccttttccctggcaagtcttccctcatgtgggcttcagagaggaaagcactttggttttaagtatgtatttgtttagctgtgctggctcttaatttggcgtgcagggtcttgtgtcatgcaggacctggttccctgagcaggggttggacctgcgccccctgcattggtagcttggggtcttagccactggaccaccagggaagtcccagcaccctggttttatacaaatggcatcaggacagtggccaccactttctattacatctctccctgctcccaccactcctgcatatgtagctctatcccgccagttctcatgatcatagttcgcttgattggcttggtctaaagaggtggttctcccactttaacgtgctccagaatcacctggagaacttactggcccacttctggcatttctgattcagtaggactgggatggggcccaagaatttacatttctaacaagttttgagttgatggtgatgctgttgatccagggaccacattttgaaaaccacttttatcaaatcattttgatcaaaacttctatgtaaaggtgaattgaggggtgctattgcagcaacaggattcttactccataatccagacctacactactcagatggatgaaacgaaaataatcaaacaagccttcttgggcccagtttgagttcccagagtaggcaggggattaaaaccagtcagcaaaatgcaccaaatcccttagctctgtctgctagcttcctacttgcttttgggttttggcaagcaaaaccatctttccaggctgctttgcaagttacagacttgcaccccagccagctg

SEQ ID NO: 50085 - DNA, 1149 bp, Bovine  19866881280351
tgtgtttacggacctgtttttgctctcagagagcaaaataggtcacagagtgattcagttgcagggtggaagggaaccccttttctagtgtttccaggataaggcctttgacatcaacttggctgtacttttcgagatgccaacctagagcctcacagccctggggctggatgaggctgggtgaccacatgtgggtgcaaaactcatcttgagaatcatccacagatgatgccccaagttcttgaaccctggtgtgactgatggagatggaggtcacaaggctcactcacaggaggtggcactcttacccggcagcaccctggtctgggaccttgaggaaatccaagctctccagcgcctgtgatgctcggtccgagccgatggactgctgctgtggcaaaggcgggcgtgccatggacgtgtacaggctcttctgatttgacctctggtttccagcagcatagggatatggcacaaactggtttttaatgactccattctgatgcaatcctagaaagaggaaaacagaagaaaacaaagctgaaaatttctgatcctgtgctaaaaggctcttcaaacttttcccctctattagccaagagtaagttacttagctttgccaggcctcagtttcctcatctaagggcataactgctaacatcatatattgtgaagaacagacccaagacatcgtaaactgcctggcaatgtgtggaacacagcagactctcacgtgtgcttgttgaacttgacattagaactaccagatgttcagggtttcaaagccgacagtcaaagaaaggtaagcttctgactagttggaaggcacatttttgggtctaagaaaaatgacgaggttatgattcaaaagggctggcaggcagctgtttaaacacctggacatcccttttcaagggagtcagtcctaggtgcactctgtgagagccagtcaggggagacggagagaggagtccacacaggcaggggaaatgtggccactggttggattaatctgaacagagcaagctctcctagtcaaatgactgctcctagtcaagatcacattatctggtgagtggatggattacggtgctgcgctccacaccgcacaccttgcctgaaaggggagctgttgctctgatcacacta

SEQ ID NO: 50086 - DNA, 1830 bp, Bovine  19866881303433
tgtgggctcccttttgtttgttttccggggtcaggattaatgaacgctcttgtgcttctgctgcaaaggaaagagggaaggaaaaagatgtagagatgggcaggcctggggaagtgatgagccagagaatgaaatatatgaattaggattacagattctatttttatgtcacaactgaaatggctacagagctgggcctgaatagggatgagggtgtcacattaataagtgaaataaaaaaagatttgctttttatgttccagtcatagccacggtttcagtgatttggaaagaatggttcccattgcccaatttatattttttaccagttactgaattttttactctttagagttttgtgacgtatgtggaaggaggaagatgcctaaagctgtaagtcctacattccattaaactaacattgtatataacgttccaatattaatagtcctatgctttttctgagctgtactctaaagagcagcacatcattaaaaaaatcaaacaatgtcacctatttaagctgcccaataaataatttatataagaaaatgcaaatatatggccaacttcaattgcccatacatcataaaagccccaaacactgcagtaatttatgtggcatgtaacttaccgctccttggtacatttcaatttccttttccccaaaatatggcatctgtttgaaagggttgactgagattaatacggatcctatatatgtctgaatttaaatccagttaaggtctatcattaatcttcacagctacacatttttcaaattaagcaaccagatgttatcaagaatttataacgattgtcccaatgaaaagctcatgggtttgttttctaaaagattacaaataaagacaaaagcagttaccaagtagttcaggttttgttcttcaggaagagtagtgaacttaattaccaaggtgttataaaaataaatcattactttaagtgaattgaaacacattctctcaagactggtgatacgcatggctagggaaaaaacaaaacaaaaacaaatgatcaaggactaaaaagagcaaatattttttttttccttggttctcttaggtatactgagaacatattcatttacttgtttaataaacagagggatataagatgaactgaacagtcctgctctttagaagccatggagaacagagttgtatccataagtagaattcagagcagaaaattacaaacacatatagatcaggttttggagaaggaaatggcaacccactccagtattcttgcctggaaacttccaaggacagaggagtcttgagggactacagtccatggaggtctccaagaattggacacaagtgagcatagatcaggtttagggaagaaggtgttatttatgtatgggaaattctggaaggcccctcagaagaaaacgtgttacttatgtccccaaaatgaagtgctattataacattcaaaatgtttctatttatcatataacaataaactagttcaaattggatgtctacaacttgccaggcactgttacatacgctggggatatacagcagtggacaacagagagaacagatgtaaaataccattaaaaaatgcaaacatcaacaaaaaacaaaacatacacaatactcaaaattgtttcttttaatcaatgacttctacatgtttagaaagtttgcagttaagaatgtaaagccgggactttcctggtggtccagtggttaagactctgcctcacaatgcaggggatgcaggtttgatctctgaaagcagtgagatttccttccccaaagggacatttatatattaggacctgagtgtcaaaca

SEQ ID NO: 50087 - DNA, 1162 bp, Bovine  19866881331044
gaaacagttgtttaacacagaataattgtgaaatcattttagaattagaataaaccataataagatattaattcaaactgtttattttttgtaggtcagtatggaaatcctttaaataaatacattagacattatgaaggattatcatatgatgtggattcattacaccaaaaaccaccagcgtgccaaaagagcagtatcacatgaggaccagtttttacggctagattttcatgctcatggaaggtaagtaaatttattgctgattatgtctgaagttccattgtattcaatgtatgttaagagaggaaatttatacctttcattttccttctctaatggaaaggtccccatttgtaaattcaacctacactggaatttggtgtgtacattagaaacggttttcttttaaaacagattggccttttatattgttaaggaaacaatcacatttaaatgtttttaagttcatgaatcagatcctcagttgtattattagaggatatgtctttaaaaaagagtctgtgtttgtgatttccaactattttttatgtgttttatggcctatatgtctattccgtggtgccaacagtgaaggtagctggttgtaggccattgaatgtcatttaatttctcattaactcaattttatcagctctaaaatgacaacttgtagacagatgacctactgtactgcttaattctcagtatcgttaaggaataaagagcaagggagccaagggagagaggtaaaaatcacaattatttagtgctgttgtgttccacgtacaaggacatagatgctttatatgtattttcttatttactctctcaacatccaaacaatgtaaatcgttttatatccaaggaaacttaagactcagagaaaatagcttctttaaagttatgtaggacgggggaggtctgtgctgtgattcacagggttgcaaagagtcggacatgactgagcgactgaactgaactgaactgaactgaaagttatgtagcacagggacttccctggtccagcaactacaatcccgtgtgctgtatagtgtggccaaaaaacaagttaatagcacagatttgacccagacctggctgactcaaaaccctgtatttttttctttgactgctcagtcgtgtcccactctgtgcgatc

SEQ ID NO: 50088 - DNA, 1490 bp, Bovine  19866881345013
tctgaagaaaatgaataagacaaagttagcactgtatgcaacacttattttatttcaaattcacaaacactttaaagcctcattttaaaaaagagaaaggaaaactttgaagattaagaaaagtagaataaactaagaatctggaaattaggagatctaattgcaacagtggctcagtcactaactagcaatgtggccttaggcaagtcacttcccattcgggtgcttcagtttctcaatttgtgcagtgagggaatttgacctaatgctcccttctaaagtcccttccagaagtgacagtactctgtttaggccatgccacactgagctttattgaacaatgactgtactatttatagtacataactacaaagtaagtcagtgcttcatcaaccagaaaaaaattaaaccttttctgttagaaaatttcaaacatacagagaagtagtaaaaaagtaagtacaatgaactcctatgaaccaatcacttagctttaacaactatcaatgatatgctgtaaacaactgcatctaacctattcatctgctcttacaaattcatctaccaggatgaatctaacagataaagagtttttttcttttttaaatctaaccataataccattatcacttctaaaaaaactaacagatactaactaatagtatctaatagccaatctattttcaatttgcttcaactacccctttacatcagttcatttgaaccaagtttcacatacgctttccccaacccctctcctcatagttgctttttatgcatcttaagttcttttaatagataacagattccctcctctcttgtttttacactactagttgttaaagaaattgggtcattgtgtcctatggaattttctacattctatttggctgactgtatcctagtcaactagtaatttttttaatgtacattagttttgattgtcagctagaccaaaattccttaagggaagaaccatgtattatttatatcttttgtatttccacagagtctaacattaatgagtcaaatcttggttcattaaggttagactgtctggtctaagcatagtgagtaatttcagaaagactttccgggtctttttttatagttctttgattttgttagtgaagtttaaaattggaacaagaatgctactcttaataagaacataaaaatcacagaacttcagcatctgcagagaaatgaaaagaatcaaatgtcttcgttttagagacaagaaaactaacttttagagagtttgggacttgctggaaaccatatgccccagtatgggcaaaacacaagactaaatcaaggtctcctagacctaaagtctggtgctctttctgctacaccaaatcagtgtgggaaacagttgtagcacagacttcaaactgaaagctgagtaagtggaagagaacatacctcaagcacaggaacccaaaacaaggttactatagagacctagcttaattcagaaatttcat

SEQ ID NO: 50089 - DNA, 714 bp, Bovine  19866881346451
tctctctaattaaacatatattagtccaagaaattcaaacacaaaaaatgtcttttgaactcacagcaccctcaatttttcatacttaatttcatcattattttacacaatacaaagtttttcctccaattagttctatcatggtaacacaaaggccactgtagagagatgagaaatctgactgacttaagcttgttttgaattgaggttgtcatcgattcaaggggattttgaaggaagaaacggggtttttgaagatctgactctatggtgctaacaaaaggctttccccatgcagtaaggccaccaagcggaagcagtctttgttatgcaggatgtgattaatattacctcatcatttaattttagaacttgaaaataaagttgcttgcatcagttctcagttcatggcacatggtttgaaacctgagcatatctacttttttttttttttttaattaagaagaaatacaggattactaaaagtttagaaaataatgaactgaaagaagtctcccaggatatcttttcctttaccaacctctgctaatctttttgtggttctagttctagccttttttgtttttttagtgtggtttttttctttacagttttttacatataatttgaatctgatttgcttcacgtaccgttgctttgtgtgcttgattccccctcgcccctcatgtttacagtcttgctgtcagttgtaat

SEQ ID NO: 50090 - DNA, 691 bp, Bovine  19866881346588
caagcactggcctcacccatatgcaaccgcctttctctagggtgtggaaagaggggtatttccatttccaaacctcaaaagccatttgctctcagataaacaaacatctccctctgcctctgccagctccgcccagctggaaagtcctagtgctaaattagtagcatttcaatcacatctgtgacaagttggcgacaggctggggtatgatgagtggagcaatcagctgttgttacaggaacgaggcatgtggacagaataataacagaatgctatagtaataatcatcattgtaatggtccccatttacataacatttttaattgccaggataaccaaatgcgcaagagcacccgtttgctgtcaaacagaccggacacagaaggcctgtgctgtggcccggagctgctttcttgacctttctgagcctcagttttccatctttaagaggataatgatctctgtttcgtaaggctgtttggaggtttgaatgaaataatgtctataaagcatttatacaacattacaagtatcctagttgtagaaatgttggtattataagtagtatttttattatttcaactagtctgaagtgttgtttcattttgcccttaacctcacacaggagagaaagttttaacacaatttggctgaaagtaaaatagagacccagaaaagttaaatgtctctc

SEQ ID NO: 50091 - DNA, 719 bp, Bovine  19866881367645
ggccctgagcacctttccgagagttccgaaaacctaacccggaaataaaactggtctcatgcaacttggcacgaattttccactcagtcagcctgcactgccagccctccccacctgtcctttgccctgctacacacctgctcacaacacaggcagtggcttcacgcctcctgcacaggctggccagcttcaccggccgctttatttcagcatctccacccttagcatgggctctccttgggaagtgacaccagccttcatctgctccagggacggttctcagcctcctgaaaatcacccctggttttgaacctccaatcatcccacgggttcagtcactcagcaaggaggtgtcagtgctctgcactagaggtagagaggaccctatccttagggtgctcccagcctagtggggtgggtggattcctaaatggtgctttgcacattcctgcaggaagagctaagatgagctgagccagggaatcctccagccacctgtctcaccctaaatccagtgttaactctgcaccatcccaaatctctccctgggggagcagggattgttctaagtagtggaaagagtgcctgactgctctgtcaatattgggacattttaatgtcttggagattagtgagtaaagctgataatgaaacctaagggtctgcatttaaattttgctccaaactggtacatcccttttatatatgggtttctatta

SEQ ID NO: 50092 - DNA, 2445 bp, Bovine  19866881389977
cggtcttaccctacaacagtcctctcacccctgactttgtgctttgggggaagaaagtcacctctcattcaactccttccacagaggtaaagagcaagtcacttaaccattttttttctctctcttattgttagcaaagagattaagatagtgaggtttgtttgcatcccagctctgggattttagtttgtaaaaggtactcagaaattggtagttgttattagctgcatgaggtacatattataattcccatttgttcctaaagaactgagtctcagagaggaacagttattgtctgagccgacataggtggaagcagtgaaatcaagatttgactttaggtccagctgatgcagaggtcattggattctgtctgcgtattgttcttctcactgcctgtctctctgggaatccctcttagcctccctgaagcctgctgcaacattgacccacagaaccaacctgaaccgttgtctttcttagacttctagacccttcaatactagactctcactattcagagtgtgatccatgggccagcagcatcagcagcacctgggagcttgttagaaatgtagactctcaggctccatctctacctactgaagcagagcctacattttaacatgattcccagatgattcatgtgcacattaaagtttgagaaaccctgggatgaagcagatcattagtaaaattaacgcatcttattttcctaattaggtcctggagtttcttaatgcccaaagccacaactctgcctttttttggcattcttcccaatggcattgggtactccaaagacctataggaagcactgagttaaaaacttaaaaaactataggccccagatcccttccttccttttcatgatgtacctcttatagccctgaggaaagctgtgatgtgcatatatattcatttccagctctacaacactgctaggttaaagaaagtcagatcaatgggaccatgactaatggaggcggagctgttagaaactgcagaggcaacgaatgggcaatgggtcagacgaactaagtcagacctgggctcagacaagtattagcaatgtccccaaggtgtgtaactcctgtgagcctcaggctcctaaaatactacctgtttcaaagggtcactgggaagcttctgtgaggtgaatgctctggagcccctagttcaagcccatggtgcagcaaggctctggaacactgctctcattcctcccttctttccttctgcagagctgtgtgggtaagcaccaggggagaaggcagccctgtgttttatactatcattcgggtcgaggcacctagaactgtcatggcgagcggcctctaaaactgaggatttactctctagctgagagaatccggggagggttgatgcccagaagctgagctgctctaaagggccaacaagtcatgcaagaatagctaagcgctgaagaggagagaagcagtttaattttctcaaattgatcatgtggagaaatctgtcggctgactgcagagtatgcttttagtaattgccaggattttgtatcccagggagataaaatctcgcagtgcggttgtgtgagggactcagggggcataaatctgccacgggcggctgctagtagcgacaccccaggggtaagggaggagagcagttcagaggtgaggggcgtgctgctcttcagctccactggccacactccagagagaaagcgggctgctcaacagagggcagtaggaaaggagagacacatttcctgaatagagtggggaggagacagaagagggtctgcggaactgcagaaccacagaaaagcacggcagccctgggaaaatataccgagcatccctttgctctgctgagaggactgagggagccgctggacatcctttcttgccttaactccctgccctcaaacccacccctgccctcaacccccaccgtgggccaagggagatattcagtcacacagaaccatacctcctgagggtaacccgctggtccacaccagaatttcctagggctcttattaccaaatgtgtggtcctccatagaccacagccagtcagaagctcttcaggtgggtctgggaattctgcatgtatcataagcttcccagcaatcccttggcattctaagatttgaaaggtgccacttcagggtgagattttgagattgtgatctgctaaaagcatttctctgggtaaacaacaaagaagaaatgtcacttctaggtccttgctgttcaaaatgtggtccttggcccagcacgtggtgaaatctgaagagcactgggccagggagtggttctcagactctggaggcaggtagctgttaactgggggctggggggcacagaggaaagaggctagatgggaatcagagacctgggtgtaaatcttggtccttccacctgggctttgggaactcaggaggtcattgcac

SEQ ID NO: 50093 - DNA, 905 bp, Bovine  19866881425500
ggaaagtgacttactgttagtaagacaattccaatctgacacaaccaaacgttgcatcaactttcccatcaaaagcacattctctatcttttgaatgatccaagcaattctctattactcaaattggaaaaagtatcacatccttaatttcctatatccagttagtagtcaattcatcatttaggctgtgtggcactatcctcttaaaagaaaaggggtaaagaattccccatccaaaagagttaatctcatcaattcctgttgctacactcattacattctgacttctagtttaatctcaaatgaaaagatctctttcattatgtcattcctttatccaataatttataatagcttcctattatcaactatatataaagtctaaacaagcctagtgatgggtcctctgaaatctgacaattaccttcatacactgaaagaaagttaagtcactcagtcatgcccgactctttgtgaccaaggactctagcccaccaggctcctctgtccatggaattctccaggcaagaatactggagtgggttgccatttccttctccaggggatcttcccaacccagggatggaacccagatctcccgcatagcaggcagactctttactgactgagccaccagggaaaactttcatactctaattactatttttctctacaactgcatttctcaaactttttggtcccaagaccctcttcagtcctaaaaaatcactgaggatcctaaaaagctctagtttaaatggattctatcaacatttactatactaaaaataaaaattgggaaaaattttaaacacaagaatgcagaccacacattccattaaccgtcagggccaagggatgtcatcacacatcatacagcttgggaaaactctattaacactgaa

SEQ ID NO: 50094 - DNA, 1042 bp, Bovine  19866881472166
aaatagccacttacctgtgaagctcttagtgggattaaaaaaaaaagtgaatgagtgtatttgcctaatttagagtgatgttataaatagaaagtagcatttttagacttcctaaaatttgcctttccctctcgcagatagacctcagtagattcaccattgccaaatcaattctgaacctgaggttctgacaccagcaaagtattgtaaattatctcaactttcagtaatttgtttccttgtttttttgttttttttaggtgtccaccgatttagagaataatgacacgggagttaattctaaacctaaaagtcatgtgactatcaggcgggcagttttagaagaaattggaaatcgggttacaaccctagccatacaagtagctaaggtaacaactgtgagggctgcacctctgcacactaggttgaccctgtagagcactcagtggcaacacaggctgtcttgccctctttacatttctttttcatttcagaaagcccagaacactaaagtacctgttccacccaccaaaacaacaaatgtcagcaagcacccgaaacctactgcttctgtgaaaccagtgcagatggatgtgttggctccaaaggtaggaaattctgaatttacaagcatacttaacagagtagccagtttggggctatggtgtaagggcacctttatcgtcactgtcacttttgaagaacattgatagcaggagctctgctttaagacaacagtgtagaaaatgaacatctttgtagtaatggtaccttaacataatgttatgaccttgagtaacaaagttaaataccttaatacctaaataaatttcatgatctcagaggaaaatttgatagattttattaaaaataattcactataggaatgaacttgcctgtgaagggggtggaagcttggaattctgagatcttcactcatggaagaacagagcatactacaactgagtatgcttgtgtatgtgcgtatacacagtcactgctgcaaatcgtgaactctgactggaatcaacagtttttcttg

SEQ ID NO: 50095 - DNA, 1134 bp, Bovine  19866881491092
tgtcgagagtcaaagcgggaagttaagtccagagggcaatgatcacctataacacatcctaaagtgccaagctctctgtcctctggcacctactctgtgtgtgtttgtggtcaaaccaggtacatataagtacacgtgaaactagagagagaaccacagccctgatgtcagttgcttctaattaacacaggggccaaggaattagatgttctgttgtttatctagtaatcctctgaagttccagcaagccccatctcctgatgcttaaatgccagttccaaaatagggagatttactctcaaaaccaacagatgtttgggctgtcatcattatgcttgttttttaaagtcatttgcgatttcactgtgaagtcctatctgtatgatttattagaaatcacttatataagattatttggaaaatcatactagtcatgaggtatctatctgtctcaatgatttgtctttttacagcaatgcaatctggcattctgtaggagcatttggtcaactttccatctcatcaaactaaaaatgttctagaaatctcccacactttttaaggtggccttaatcagataccttagtttcatgaaaggtaagactaatgttttccatcttaaatacaatgcattctctcattagttatggggttagcctcttagctctctggacctcagtttctcacatataaaattaatcaataaactacatccttgccatggctcctaagttctaaggatctagttattttaagtactgtgttagctatcttgaccaaactctcatcacaggagacaaataggctgcaaagaccaaaattcttctttggtttatactgtcagggagaaagaaattttcctatccttttaggttcttctggctagtctaagaattgaattgacaggagaaacattaacagaagaaaatcacatgaaagtttaataatgtgaacatgatagagacccaagaaaacagagtaactcaccaaaatagctaaagtcctcactttaaaaactgtctttaatcaaagacaaaaatgtatgttgggtttagtggtttgggacttcaaaggacaagaaggcaattcacttgaaaatggaaaagcaaatgtctggtaaatacatgtttgccg

SEQ ID NO: 50096 - DNA, 1324 bp, Bovine  19866881555645
actggggcacctcccttaccagctattacctcccagggactgggcccccaaatgctccctctggttggtggctcagcctgtgccgtgcccgtccactgggccccagactggttcccgtgatccggtcttgtcttgtttttacaaagcaactccaggctggggtctgtgaataccactttctccctgcttctctcctttcctttgttaattccaatatatacgcttgtcacaggcttgaaatcaagttgaaaaaggagaactggggtccctggagtgcagggggctcccgggcaagtgcagttccaccaaggctttggcgacctggccatcctcaagcccagcaacaaagtgctgcaggtcagcatcggacccgggctgcccagaaactcccgtaagtgtgcacgggccccacgggtggggccgctgctgggctgctgggctccctgcctggcccctgctcaccctctctccaagctaaactcttttcccactaaatgctcataacactgcacagatctgtgggccaaagaactagtgccttgactgcttcctgtggttggggttttcttctgattgaaatgtttcagactaaaccaacatcagggcaaatgggcaggttaaacttttctgaatcatttagtagttacgtgtagtattgctggcgttacagtattaattatgtttaaaacagatctgtttgttggctttacgttcccagccctttccagtccagtcttgtcaacagtacagacttcgtcctttgtgttaaagcagctgaccacacttaccaactccttacaagggctcactcttacagtgcgtcacgtttaatctctccctactcactttaaagtgtttcattaggagacacacacgcacgaactcacactctgtagtttgactccttttactggcctaggcttctttttcttagatgccaccgttacagaatacagtccacatgtatgatcagtgaagagtatgccaagtataaaatgggcctttatggcttctgtctccagtggtatgcactgtataactcactaatacagcacagaaaagtagccactcagaaaatggtgtacgtctgagtatcagtgagtacttgcagaagacagcacatttaggtgggatttttgaagagacttttacataaaaggactctttacagagatgtgggccggatgaaggaaacagggttggggctcgggcagagaagaccaagatgctactattaccctaaggatgtaggtagaggagattccagaaatctaaaaaagaacatgtctcagaatcactttgctgtacatcggaaactaacaca

SEQ ID NO: 50097 - DNA, 1612 bp, Bovine  19866881600865
ccctcggtgtgagtcattttagaattctgctgtctgaatataaaaagcaagtcttcatagtcaacaaattttcaacaacacttaatataacacaccatgccaaaaatgatgtgggaaagaaataaacaatgcaggatggtgacatttttcagctaaaattaacaagaaggcacatgcatgtatacacatgtcttattgtttagtccaccagggaagcccatacatatgtctatatgtgattaaactggttagttaaaaatatattaggttaataggagcaaaccttatatggtgggattccaagggattttagtgttctcctttctagttaactgcattttgtaaatcatgttaaatgaacatttattgctttaaagtggtttttaaactttactttttaaaagatatgtaaaggacacgatccctgttcttaaggaatttctagtgttttaggggtaaatgaccatacagggaaaagcgagcctgtctgggttaatggactgctgctgataaccatttttttttttctaacccagctgatcaaaaaccatgtctacataaataatgagcccatgttctaagaacattccaataaataatgagttcaactacattcattggaaattagccttttatgggcttgtcaataaaccaatcctccctttaaacgtttctatggtaaaatgcatctgaatgtccaaaaagcaactttataattgagttttggaacataattcagaaatatgagagaacttatacacttgccttaatgtatgataataataactaacactaacaatgtattcactgcatttgttatttcatttcaccctaaacagcctcatgtagaagtttttatcatcacttccattttacaggttaggaaatcaaggaacacagatcacaaaacttgtataagatcaccaagctcatgcagattaaggctcaaagccaggctgtccagattcatcccaactctttctggtccatcatcagccagtttccatgagtcttgcacacaaaagttattaaaaccctttaatgataagcctagataaagtgagcatatttcagcttttttgccaaacaaaatgaaaacttagaactgcacacaactgcttccatacaattaaaggaagctctgcacaggtatctaggagtcagcaaatgttccctgtaaaggatcagagaatacttagttcaggctttgtggatcacagggtctgttgcaaatactcaagtctgccactgtagcataaaagcagaggcggacaataagtaaaacaaccagcagagctgcattccaataaaatcctgtggcgggtggggttttgtctggaagcagtgggcttccacacctgaccaagatgctattataatgtgcttaatgaatccaaatatatctattaatacttaaaagcaggggtttagggatttaactacccagataattggtaaaatttcctatggtaagcaagaaacagcatcatattggttagaaacatccaagtaccttggaataatgtttattagcataaatacctggtaagttgagctccttcctcatcagtgatggaaatgatgcaaaactactgctgcatatttatgggtg

SEQ ID NO: 50098 - DNA, 1369 bp, Bovine  19866881616305
atgtggctttttccttgattaggctatgggaagggcaaagatggtgctaaagtttttcttttttaaatttatttttaattagaggacatttgctttataatgttgtgttgatttctaccatacaacaacttgaatcagccacaggtgtacatatatcccctccctcttggcttccctcgtggctcagatgataaagaatctgcctgcagtgcaggagactgggttcatccctcagctgggaagatcccctggagaagagaatggcaaccgactccagtattcttgcctggagaatctcatggacagaggagccttgtgggctacagtccatggcgtcacaaaaagcggacgcgactgagtgactaacacacctccctcttgaaccgccctctctccctccccccattccatccttcaggttgtcagggagcactgggttgagttccctgtgatacatagcaacttcccactagctgtctgttttacatatggtaattatatgtttcagcgctatggggctaaagattttcctggtgtttttagtttaaagttttttcctgcatcaaaatcatgatgcagccaaggacttccccggagatctagtggttacgactcggtgcttccactgcagggagcacaggttcaatccctggtcaggcaactcagatcccaaatgccacactgtgtggggaaaacaaaaagatgaagctggtattctctatttcagtccatggctctgtacctttgatgtgctctagccaggcacgtggtgtctaaaacctgtgctcttcctaaagaatgtcctgatctgcagaattctatcggtaatgctccctaattacaaagcagagactgacaagtccagacttaaaaggtttaaaaaagattgcctcacgcaaaaaatgtgcccttttgcctgtttttctgcattcttatgttcactaaaagaaataagagaagcgaagatcaattactgaaaatgtctgacattcttgagttgtgctttatgtttcagtcttagcttgccagatgccattttgggtaggactggaaagcattcagaacggaaatttgattcaaatgtgtgttgacttcattataaacttcatagagagctatggtagctgcttaagttccttcaggattcaggagttctgtttggtgcgactatgtaaagttattttagtataattatcgtaggtcataggtcatagacaagcaggggtctgtgaaaatctgtatagtagtaccagcaagtttatgctcttggtggctcttggtggtgatgctgttggtggccttggagggtgcggtgttctggatggccattaaaagtggagtctttgcaaccattgtaaaatacattttt

SEQ ID NO: 50099 - DNA, 855 bp, Bovine  19866881759921
gtgatggtggtaggacttctctctctagtccagtcactcacagggtctctcttcagccctgcttccatgttcctacagacaggaggaatttccccagctggatacaaaacctatattctccagtcatcatcttaacattttccttctcaatcatcccccttgaatcctgcagaggccacatccctaaatggcaggtgtaggaggaatgtgacgtaggactcctcagaagccagggaggatatggctcactgcttatatgcctcacatctcccttgggctggttccctccagcccaagagagtcactctgctcatcagcactgggcttgggggttacagagcctacagcccctctgcccacataagcaactaaacgacagatcattttttaactagctctgcagaaccccacctgcaaccctgagctcagcattccaggccacatcctgtgggtgctgacgagaagctgagtgcactaagaatgtctacacagggcctaaactaatctgaaaaccatcctgactctgctgtgctggggtttgctttcttttttccatttgcccccagactagccaagatcaacattataaatcgctaattctgaactgaagggcactgccaacatttcaggaaaaaacaaggaggggaaaatgatatatacataggcttcttcctgaagttaagacatgaagacataaaacacatctgaagacaactgaaactgctcctgcctggggaagaggccagatggcctgacttgagcagtgggaaaacaggccgaggctgcccttgatgttagctgcccttgacctccacctgtgcctctgccatacctgctttcctcccagtctttggg

SEQ ID NO: 50100 - DNA, 2108 bp, Bovine  19866880636997
ccagctggagtgcaggtatctctccaacttgttaggagagggcttcatgcaaggcacccacttatactggggcactggaaatttgctggtgatatcgtgattactcagaaatcatacttgagagtgatcttatggttacggcacagttactagaaaagatgacattttatgccttcatgtttcatgttctgttgttcagtagataaggcctgtccaactctttgcaatcccatggactgcagcatgccaggctcctctgtcctccactaattcccaagtttgttcagattcatgtccgttgagtcggtgatcctatctaaatcttatcctctgctgcccccttctccttttgccttcagtctttcccagcatgagggtcttttccagtgagtcaactcttggcatcattatatttgagcaacaatgttatttactaaagctgtggctgttgaggaggtgacaccaaaatcatccttttgagatattgtgacaaaatttgcctacttgaatgacactgtagacactcttcctatttacagactttagtctctcaataagcattcaccaatagataacttgttttgtttgcaatatcaaggatgctagcctgtctttgccctttctgcccaagttatggtcaagacagaagtggccttctcagtacctgacaaggatgggggcagattggggtatgcaagctcatggcagtgggtgggtgacccagccctgggcccacctccacatagctgtgctcaaagcccccagccacctaaagctcccctgtgtgtctttgtggccgcctcccattcacgttgtatatcagcctgctgttgttccctttttgcagccaaatctttcccaaaggcctctccccccaggcccagcccctgcacctcatcctcttctgcaggcttcgactacgcccacgatgcagaggccgcgcacatggctgccactgccatcctgaacctctccacgcgctgctgggagatgcctgagaacctcagcacgaagccacaggacctgcccagcaaggtgggcaaggcccctgctgggagctccttctgaggcagagaaggcgggtggggtttgcagtcaggactatatgcagcctgcacaaagcaggctcagcaaacccagcatctataaggggagtaccactctttccttttctccctcctgaccactgaccctgctggccaaagacattggatgggtccacctccctgagcaccacgcgctgtgcctaagggcgccaagtggctgtacacacctgttcccgcatctaccgggatgcgggcttccactagttttcacgtgttcctgtgcccagacaggtggccatgtgcaggggctggttttatgggctggaggccttgaggcagtgggtagagtgagtccactcagtcagcttcaggatactttcttctcagaggctcttctcttctttttggccctgttccctttggagggaaaataaggcacatgtgggaagggatggtgtctaatctagatgtcacctttgcaatgcaggccgcggacattgaggtggatgagaacggaaccctggacttgagcatgcacaagcaccgcaggcgggagaacactttccccagcgggagcagcagcagcagcagccctggcgtgaagtcacctgacgcctgccagcgccagagcagtaccagcgcccccagcagctccctgacctcacccccgtctagccacgcctcccgccaggatgagtgggaccggcctctggactacaccaagcccagccgaccacgagaggaggagcctgaggaggtgggtgctgtccaggtgggaggtccagagctgttggatggttggaggagaagggggttgagcaggtgcttggcggtcagcttgccttacccaagggttggcataaacacgctggaatctccaggcagaggctctgtgggtcctacccctttccacacagggttctgcctgctccgggcagctaagtccaccttcctggaggtgttttcaccattggctcagtttgtggccttgtcccctccaagagggaggtggtcttctcacctctggagaattattggtcaacaacagtgtggctctccaag

SEQ ID NO: 50101 - DNA, 810 bp, Bovine  19866880641006
acgccagggcgcccgcagcatacttgggcctctcccatgacggcgccgagggctcttcctagatcggggctgcgctcggctggggcgggaggctggaggggaacggaaagtgggtctcagtatcacgacccccttttcctcccctcccgtgtcaagctcaggggttgcctcggtgttgcctcggtgccctttggcattaggcagccgtctgtgcactgtcagccgcagcggtccccaagctccgcgcgctcccgcagcaccctgaggcctcgacacgttcaaattgcgcgcgcagccgcagagcttccgaggtcggaggtcccgggacaggcccaagaatccgcatctctaacaagctgggagaggggtttcgggagcgccgagggtcgggaaccaccctgagcgacccccaacgccggctccttgttatcgggctcaggaggtggtgcggcacgccagcagctggcggaggctccggcggaagctgtcgtccaggaaggcgtagaggaaagggttgaggcagctgttggcgtagctcaggctggtgatgaagtaggacacggcgatgaccagcggcgtctgcgggaggtcggtggtgagcgccaccacggtgctcaggtggtagggcgtccagcagaggaggcacacggccaggatggccaccaccaggacggtcacccgcttcttggcgcggtccagggccttggcgtggctgtcgaggcgtatggcgcgcagccggcacagcagcgaggtgtagaggacgcagatggtggacactgggatggcgaagccgagcaccagcgtgtacag

SEQ ID NO: 50102 - DNA, 1362 bp, Bovine  19866880706037
gggctcaggggcaactgggcaattcgaagtgcctggcaggccattttaggacaaagggggtcaccagcgagcaccacatcttacctgaggtcggctcctgtgggctccaggggagctgagtgagagaaggagaaacagggaacttgtgtgcaagtagaattgaaaaaggcacattgtcctacagcacaagtgggctgaagcgtggaggcaattccccttagacctgaatcccatgttccccggccccctggaatatcctctggggtctagtgaatccacggtcccccaagccggtgcccctgccagatcctccctgggggctcctggatttacagactcagacagaggccccacacaagacaggctctgtgggccatccaggcaggacagggtctctttcctaattgcatgtagaagtcagtgtctggttagaaaccccccagcagataaagccagacaaagaacagaaggtggcccaagaaactggtccctcagggatgggccactgggcaaaaacttctggagtctgactggcagacacaggaagctcagggcgcccagcccctccttgaaggccacccatatacaggagcagcatgtaccccgtggtgttggggaggtgaggcttgccaaggggtcagggcttgatccctgcagagcaagaagggcctccgccccctctccccaccccactgccagttcaaccaatgacatccccaccccctccagcacgaagactaatatcctgggagcagagagactggtgatgcaaggctggcggcctttcctttccaaacagagcaggtctaatgcagctttgtttccccctctggagagctaggtctgctcctcatttccatccccacaggtacctctggccctaaagcctccctggtagccctcttaggcagcccaaggctgaggagccctggagccaccaggtacctgaagccccaggtgcccagagcaggggaggtgcatcccagggccgaggcactgctccaggactctattctcctgaggacagctgctgggagtggcatttatagcttcaggacccgggactcttggccagagtcagctgggaggggagggcagcactcacctcggagggccttggatcttgtacgagctctcttttcatcattttctaaactcatctgcaagtaaaaacaaccgtgctgttaacaggacccagcagaaccactgctgtgtctgcagcgtggcctacgccatcgtctggctccagcgtcgctggtgcctgtgaatctgacccaggagacaaggaacggctcacagggcaggaacgagctgagaaccaggagcagcaggtgaggcacggtgcttctgggaaggagaccc

SEQ ID NO: 50103 - DNA, 1248 bp, Bovine  19866880706119
gtgctcggcagaatgaatggcacagctgtcagctcgtcgacgtgagctcccagtgtgagagcagcccgcacgcatcctgcagccctctccattttgtgctctttgaataatttatctgcaggaaatccaaattgccaaggcccgctttaacccagcagaatgcttgccaatttccttgggaaaactgacaaaaaaagaggtgtagattgcatttcggctgagagtggctgggcaatcagagctcggcacctttgtgccgctgcatcggaagccactgcgccgggctcgcgcagacgacatttgaaggctcataaatgtaatgaagtccctttgacacctgctcctctcttcactttaaatgtgagccattggtccatggggaacctccgctttaaaaatagaaattatagtaattgtcttccgtgctgtcgggaggctgtaaatgcatggctctcagctctactgcctgcaattgacggctgcaagaattaccccaagttgagattttttgtccttaacaaatcacatgtatgctcgtgctgcgtgggggcaggggggctcactttgcaagttccaacttatgaactgggggtccatgggaaaggtccctctcttccttcctgggtgggaccttagatgctggacctgtgctggtttctggggacaaagcccctctctgctgctcctttctgggcatctggctttgctctgatggccatgcagtggcaggagggtggggggtggcttcctccccttcctggccacagggcacacctgctgggtaaaagtccctcctacctcctgcccagacccaggctgaggattctctgtgatgacctttgctcctgggggcatccctcccctcccagggttctgcctccactccctgaaggacagtgtgggcagcattcccatggaagtgggtctggggcagagaatggggggcgggagctctgattggctcgggtaggtggttgggtgacaccagggtctggattatgtcgggcaccagcccccctcgggggctccactcactctttcctgggggaattggcatctctgggagggtgacctgcaggttgggtctagatgacccctcagcctgcactcctaccccagcctggctctcacccctgactccttcccacccccagagccagtgccgtggcacatggctgatcaaactcagatgagctgtgagtccaggagatgtgcaggatctctaaaagttagcactaaacaaaaatc

SEQ ID NO: 50104 - DNA, 1501 bp, Bovine  19866880755477
agagatgatacaaaccatttcgatacgctccctacgcggaggatggcagaggcctgagtgtttatcatcatctctgaatattttcatgctcagagtatgggggatgggacaaggaagcagcatgctgaaggaagttgacccccagatggtggagggagtgagcagtcagtgggggctgggcagagggaggactttgggggttccaagcagagttaggaagaaagaaagctgagtccagggcaaaggcatctggaggaagtggagagggccaggtgggttgtgctgagtggatcacatccaggtggaaagggcacttgggaacctggagcccaggcgggatgtcacgtgcccagcactgggagcagaggccacaggggccctgggagggatcagtggcttttgtccaggctttggaggtctggtactgctcagaacaggactgggcacagagagatgggtttgagagggctggagagctgaagaacgattgcgttccgaggctgagagggcccttaattatgcattgtacacaagacgtttcaccaagtaaacagagttttaaaggctggctcagtcatggagagctgtttcctgtggctcaacaagtttataataaacacagttaaacttttatttatggcacagctgctaattgcaccataaacattttttcatcaagcaattgctgtttactcacttgccaatcagctccctctccagctccctctctccgtgttcccaatatccctactttccgaatctgctgtttgaaatgtctgtctccaggcccaccggcccctggaccatgcctcccctgccccccaacccccgccatcctggtgggcagccttgcccctgccccagcccactctgtcctgccatccctgctctgagagtttctcatatccgtcgggaccaggcccagtgcaggaggcctacagaacggccatgctgacctgttctgacatttcccctctcctggttccctaacctcagagccccaggcagacctcacctcttctctgtccccgcccttatcacagtcccccagcgtgtcgggggtctccccatccacctctctacaagaccgggaatgacatagctgacacctgggtccccagggcttgccatttccttaagcagtgaccctagtgctcagctcctgcctccatcccccctccatccccccgggagacctgctcacacctctgtcccaccctgaccacctcctgtgtcctgggcaagctgaggacccttctctaggctggaccctcaggggctcaggtccccccttcctgtggcccctccataggctggccccagggtgagcctgtgtggtgctgaagcagagtggaactgagctgtagaccctctgggtggcccaggcctccccggcaacatgcagacatgctgacccctgcccccaccagatagacccaggcctcagtgtctgaacgctctgagtgaccttttgggtggggtttctagagtcctctccagg

SEQ ID NO: 50105 - DNA, 1922 bp, Bovine  19866880857711
ccatccctcagaggccagtgtgagctgagacccaggcaggccctcccctgcccgccactacaggttgcctgcgggatgtgcaggaagaactgccatggggaagaagcactaggagacttgaagtaacagcacatatccccttgcagacagcatcagccagaggaggggaaaaggagagctggtttctgagcccttggctgggagccccagaggagcatctttagggtcgtgggcagtcaaagtggaattctggtggtggaataacttgttaatacaattccccagacaggagggagctggagcacctggaggggatatgggggtgtttctgagaatcagcctcagggcacaggggctccactttttgaagggagtggcctagcccttccctgtcctctgcttaaagttgcttaagatgcccctggaagggctgctgcccagttaaggacaggcatgaaagcactgctgcaagcattcagtcactgttactggagctctggaagagctcagatttttaaatgtacaagagatggtgtggagacaccagcctccacagcccaggggccggggcaggagcgagaccagcagaaaagaaaggccatggggtctgtaccattccagtgaggggctcagagagaaggaaagcagaggaggcgtctagagtcaagcagtgacttcactctggaaagggtggaattaagaaggaccaatggagaggccccgaggtgccaggcactgtaagaatttgagcatgaccggaaaagaggagcctgttgccaagaagaccctggaaccacgataaggccagctctgaagggccttgggaaagcgaggccaccagagcacgagcaggctctcctcctccactctggactggccaatgcagctgagaagttgctggcgagctctcagctaccctcaagggaagatgaggcctaaacttaatggctgcgccttacagggccttcctgggacaaaagcccctctggtcctcatttctcatgtgtaggaaaaaggctgtaagccccctcaaccttccaggttccaaagagcaagtcagtcagttaagaggacaacagagtcacaacagggcttctagttcctctggaagagacagagggaacaatccgacacatatctgagtcactctgcagaaactaagacacttgcccagtggtgacgacatgccgaccacaaccctgtggaccccagactgttggaatcgtaaggttgagattcttgaaacatcacctaccacctcaccgtcagccaatcagaagaaggtccacaaactattatgcatctcgaaccctcttccctcacactgtctgtaaagacctcaccagaaagccagtgggaagttgaatgttctgagcaccagccacccattctccttccatggcttttgtaataaactttcctctgctccaaactccaaacccagttttggtttgttcggcctcactatgtgtcgggtagacaaacctgggtccaataacacccctccgggtctatggctcatgtcactcacctgaggatccgatccgaattggagctattcttggaaggctctcccggctgtggctgttgcttctcatgagatttggctaatttttcggcagcagcaatgggacacccagacaaactagagacaggataggaggacagctgagcccttccccaggccccgcccatctaagccaggagccagacaccagcaggtgcccagggaaggctgtcgttcctatagagggggctttcccccagctctgtcctcagccctcaaagcacctgctgctcactcagtttctgtttttggaaattctaagccaagacacacagagacaatgcatcctaaagttcttcaaggctctagacaaaggtctctctctggaggatctgggggatgggcctgcctctca

SEQ ID NO: 50106 - DNA, 1466 bp, Bovine  19866880931322
agggagaagacccaccacacagcacccaggccaggcggacccaagcgggggacgaacctgcggtgggaggcatagttcccagtgatgtggccactgccgtcacagccaggggtggggcagctggacaaaagaaacagagcgtcagatcagagagcgaggcaccctgccagacccgcccccggggctgagtccactcagggagggcggcggcacctgctccctgcccgtctcggagcagacccttcgcctctgcctctctgactgcaaatttctcccgtagcactcagctcaagaaggaaaagggacccaaagtaaagctcaacttaaagtcgagatgctctgaagccctcacactgtgcatgcacacgtgtccacgcttgtggacagggggtggggggtgccttcctgatgtggcggggccttccccgaggacaaggccccagccagagccagctacagggcaggaggaagctggtggggttgggggcatgaagaggaatcccagggacaaactctgagcagaggtgagggctggatcacctgcagggcaggtgtcaggcttctcactgtcccctaggggaggtggtgttagccagcagctatcccccctccagtggcgtctggttaaactagctctggctgccagggctgagggcaccgactctgaggcagagctcgccgaggactggcactcagtgggggctcaggaggcgtccaccccccctcagcccttgtctgctctgtgggcccaatgaaggctcatcctcgctctttatcaccctgaaggagcgggttagaggccagcatggtacaggggtgaggggaacctcccttgctgtctggcccaggaaggtcctagtagaggcagctcagcctctgcccaccaaggtggccagggcaggagaatagtcagcgcagggctgtgcaggggccggcccggtcatcacaggctcccactagggtgttctcctttccagactatagaggtcccctggggggtcctgtcgttcaaggaggggacttacgtgagcagctccttctttatgtccttggagagaaacttcagcttaaagttggccagggtgacctccccggggtacttccgctcctcaaaattctcctccgacacttcctggtcatctgcttcagaagaagcaaaagaatgggctgctggctctgactgcaaaagaccagcaggggagatgttttaaccagctggcgggggccgggcgcccagcccggggctgagggagaggggcctttcagaacagggtccacagaggcattttctggagtctcctgtcttatgcatgcaggagtaagacatactcccaagatgcaggaagcagcacccagaggggcctgggggtgctccttcacctcagctgctgtgccttgagctgacccaggaacaaggagacaccggatgccacccaaggcggctgctctgacacccttgatagcct

SEQ ID NO: 50107 - DNA, 1407 bp, Bovine  19866880956825
tatgtgttagtccctcagtcgtgtctgtctctttgcaaccccatgaggtatagcctgccaagctcctcagtccatgggattttccaggtaagaatactggagtgggttggcatttccttcttcctgacccagggatcaaactgggtctcctgcattgcaggcaaactctttaccatctaagccaccagagaagccctcgtccaccctgagaagagtgaatttcttatcatatcgggccctctggaagggggcctgatatacagttggaagagtcctctctgcaactcctgtcttgacctcagtgttccatggataaaataaataattctgactacttgattccaaagatcctaattgtaagagtctttaggatgttataatttgtactaaaaatgtgtttacttacttcattaaaccattgttttctgtgtccctcttaatctaagaccctggccctgggaatgcagtagagtcagtttctgcccacaatgcatttttcagttggtttaatgcagtgtgatgaggacctggatagtggaggagggtctaggaacagagactataacactccaatgagcggggtgagacgggggcaaggaagacttcctagtgtgtgaatcctcttgttatatactgccatgatattttagctttttcttctgttcttctgccttccctcagagtgcctaggataaggttctgagttgtaagtaatcagttagtgctactgactaaagtatccatgttcctttatgcctcttgtttcacagccagtgccccagcctcctgagccccgccccatggaggcaaataaaaatctgaatccagagctccatccgagaagttctggactcttggatctgacacttctttctcaaagatcatgaaattcttgctccttactgtctttctgatcctgttccagatgttgccaggtaaccagaaccaggaaagaaggaaaagagcgctagggtggggaactgcccatgaaaaggataatatctttctgtccattcagacagggttttcagaggcttctgaaatctgcttgaccttatcagaatttacctttcccaggacaagcctgaggttccatattaagaatatgtgtttggccagaatccccagagccatggaaaagggttgggtggtaccacatagtccttcggtactcaggtgtaaccttcacaggcaaaactgactttgatactttgcaccaatcaatgtcccaagggcccgactgagcagctgtctggtttcagctgtctttacattctctgccagatcatgggtcctggagcgtatcttagacattaagttctattatcccttcatgtgaaagcctgggatgataataatggagcagtcatgtggaagtgagcacaggtcctttctgctcctttccaa

SEQ ID NO: 50108 - DNA, 749 bp, Bovine  19866880971866
aatactgtagggattaagaccgaaaccaaacagacctgggtctgaatctgactctgacatttattacatgaggggcagtatggtcattcatctgttttagatgcctgaaatctgcattgacttatatttgagtaatttcctaccatatgagacaaggtgagaaaatacctctctctctctgcagctgggaagatcacagttttgtttcgtagtcccgctagggtaagggcatgtgatctctagcgccagtgttctctttgcttaagatcctagttccactcagaagatcaattcaccagttattgggttatggttttgtggttagcgagtccaagggaggcagttcgtcagagggacatgctgtacagacaaaaacagtttacttctacaacattctctttgaagcgaaactaatagaagaatcaggtgaaattttgattttttgacataatgaagactttcaaggaaataaaaatggaacacaaaaagaaccctctagaactcaaagcaatatgatcgatttaaaattgtattaaagtaagtcaagaatggtcacaagaactgaattggtgatctgtatgatgaaatagaagaaatatttcacagtgcaaaacaaaatacgctgaaatgaacattgttagctgggggatgcttcctgcactttcctcacgctttcatgaaaagacttctgctacacactccaaaaggggaaaagtacctctccaaataatgagctcaagaattagaag

SEQ ID NO: 50109 - DNA, 980 bp, Bovine  19866880974161
gctgttgataatcctgttacagcagtcgaacccacaccctaactcactcacaggacccaggctttccccaattccctgtggctttcatttttttcaaaagccatggaacctccttttcaaatcatagctagggaagtaatcacactaaaaacagacatgataaaaatagcttcaggagccgactgtttactgtttactgagccaggcgctgtgctgaatgctttccactcatcacttactcacagtcctaacaacatgcttataagggaggtactacattatgatgctcattttacagatgaaaaaccaaaacaaaaccaaaaaagcccaacaaaaccccccaaagctcagagaggtaacagtgtgcacccagcggcagagtggggatgtcatcccagagcccaccttgcccatcacttgctgtaccggggagtcccagtatcggagagacaaaggggaggggagggagcgggaagaaatccaaggtatggccaaggcagggggtggcggcagcactgaccttccttgttctccccagagccctgtgtgaacagcagctggtactgtcggtttgggaagttggctggaaaaaacttattcatgagagggctgaaaggaaagataaagcaggttggcaaacagagcccctgtgggggtcccacaaccccagacatttgtttacaagctgttatctcccaacaacctcacaggtgccctgagaggtaggtgttattgtgcccattgtagagatgtgaaaacaggccctcagagggcaagtgactgcccagggttacatgggaaatcagtatcttgagctgatttgagacctgaacctagcctcttagttattacccaagaaacacaaaagaggcagactttcacataaaacagtttttaggacagcaatggattccaaagtctggtttatccacaatctgtatgagagtcccgtcaagaatgcatattctggcttaagcctg

SEQ ID NO: 50110 - DNA, 2136 bp, Bovine  19866881013878
acatgtttgtaagaagggatagaggctcagcagaaccagatttcaagaagggatgcagaaaatttttggtataagtagagtgattaaaaacaagtttcattatttggaagagagtgttggtcttgggtttagcatgtacttgaaatacaatatatttagactttctactttctacaatatctgtagagggaaaattgttgtggaattctaggtttaaagcccagattcccatttctctggtttatacatatattaatgaaagaaacatgaatttaaagtcagaagggtttgtcccttgttccccatcactgctcagaagctgtgggatcttggacaagttctgcatgtatatgttcaactcagacaactctgaagtctagacttatgtattaaattacatatttattttgttctcttagatttctcaatcatttcagactcaaaacgtcctaagctgaattctgaatctgtttgcctggcttttcttttgtctttcatcttcagtaattggcatctacaatcccttctgttgttcagttcagaaacttgagagtcacttttgatcccccacaattcatctcaagtcaccatgtacaaaccattaaaatgtgtgtgaagtaattttctgtccctggctaatgggcatgtttctccttccttcctgaaaaacatttctaataaatggcaaatacatattttgactttttgagtctggtcattcttgtgcaaccatttggcatagttttaagaccctaaggaaagtggaggaggagtacagaatgtggactgaattcccacatggtccttccttgcttttagatcctcctccgtatctcccttctggatccagagattccatggttccacacctgagctcagagagcatttgtatttcaggtaggaattgagtttgaccatttttttttacctgtctgttaacccttattgcctatacctgagaaaaatcatgtctactgttttccaggattgactccactctgtgtggtccttactcaaatgatcaagcagaaagttccatcactgttttagcttattttaaaccactgtgatatcacttagtataattcagaattggtgattagattactacctctaatcactgtaaggcaagtgcagagaaaaagagagggagctgggcagtcaagcaagaaaaggaaatttattagtgggaaaagagagggtgactggctcttaagagaatcagcgttttccctttctgacagtccttcttataccccaccaatgaaaaattatctgaagggacggtcacgtagctggaggtctggaatctggtggtcttgcagctttgaaagataggcgccagtgagataacaggatgccatttgggcaatttggtcagtttcacagatcactgtgatttattctttgtttgcaagatcgacataatgagccatattatcaatgagaccccatgtgggccctatcaatcatcaattttcctgctttattctaggggaaagatgttccaaaatatgtaagacaaaaatgtggaaactttccattttggccagaaagtagtcacgatattatgggaagaagagacttacaaaaggaaataaaaatttgaaactctctcctttacagatatgtctatgagagattgaaaaatataatttatgaattctaaagggaaaaaaaaaaccttttcagatacacattgctcaaactcccctcaccaaaaaaccccccatttgtattgttgacttaaaaataagtccatcaccaaagtttctatattcctccagattttctacaaagatttcagaaactatgaagttgcttcaatataagattaagccctcaaagcattcttactataatttcttagtgtttataagaatacacgctagaaataataggaaatagatgttattccacttagattaaatacatcagagacttttcaccagattcactctgttttagggaaactgactcttttgctattcaaagcataatagatcaaaagacagaactctttacaaagtatgtctaggattaccaattattaggaattgactgtattttaaacaagactgaatctaaaagaaggcattgagtggatgcaacaagcctgtatgttaacatgtaaag

SEQ ID NO: 50111 - DNA, 1604 bp, Bovine  19866881073687
ctgctgctcccaacaagggtgatgtagctccttgctatcctggttccttgcacatacccccaagcccacaggacactggccttgagtgcctcgcagtcctggggagctgactcgcagggagatgggtgcggtgggccgagccctgatgagcggttcccagagtctggttggtggatagatggaagttgtggaaggagcaggactcctgggctcttgcttctgtccccggggtgtgagctgctagaggccaggcatcatcctcccagccccccgcccctgaggtctcatggcagctcctgggtcatccgccctcatggtttcacctcccttgcagcaggcttcaggctctggagtggggtctttgccaccacaccgcgcctacctccatcgggatcctgtgacttaggtcaaggctgcatgttgtggagttgttctgtctgtgggtgccgcctcagtgagccagcccagggcagccttggccaggcctcacagcctcgtgaaggccactgagaatcccatgtttatgctttgcccgtgggccagacttcgggtgctggttccaggagcacctcgagggccctgttccccagccccctaaaaacctggtggcagcttgcctgcagtggggagactgatcgtggacaaaggaatcctgccttgatctcatacacacagagctttaattaaacacactcatgaaactgtaatgagccattcatttatttaaatggggtgagttatttcattaattttttgcgaactgcaagcagccgtcctaagatgaactgttttggagacaatcttctactccccggggggatggtctggggtgggccctgagattctgaccctgtccccatgccacacggggccgcccccaggtgactgctcctgcttgtctcctcccagctgtcccacccctggatgcacaggctcggggcatatccgtggcaagtactccaggcaccgaaggtgaggagctggcgggccctcaacgggttcctgggaaagaggtttggctgtggagggtggagctcctctcctgctctgcgaccctctagaactgtagggatctagaactgtccccctctgctctggactgatgagctccggtggcctcttgtgcaaccctgagcctttctgggtgtctccccagtggggctgctctgaggccagaggaggccttgtgggcaaacccagaacagagccagcacatggtggggtgaccgttttcactgctgtcctcctgggggtcccagggtcccactggacctcaggggcctctgattgtggtacccagttcagggggtggatgagggtgggaagggtctggaggtgggaaaggaaggtctgagtgctcctgggggcggtgggcacggggcagagtagcctgggccggcccccatccccagccatcccagagcgggtgactctggcgtggacagggccccccgaggttaggggtccccaggcaagcaggaagtgaaatttaaaacacaatctggtgctttttaatgtggacacttactgtaaaatttcgaacacatcgatatgccagtctcgcttttggattttggtggagggaggtgatgagaggcaaagag

SEQ ID NO: 50112 - DNA, 1287 bp, Bovine  19866881116190
cagccctgaagggacccatcttcatttcctctgtcctgtccctgatccccattatcctgggacccccagcccttctcaggtcactgtgcctcttgggaatagaggaacccagggccccaaacttagaatttgggagtttccattttgggcaggatttcagtttggctgcaggtcatggtggacatggatgcttgtctgtggggctggtagggtctgagaattgggagagtccactgtttctttataactgggacttgtggaactcagaattgcttcccttatgacaggaaaatgaagcacacacctctcgtccatgagaaactagcaaacttctcagccactattcaaggaattccccctcctatatatctttgtgcgggttatgccctgtacagctctagggggcctcattcacttcacagcctggttgaatgacgccccttagggttgagcagggcaggagttgtacaaaggttcttggcagccctatgtcccagatgacagggatttgactccttcaaccacagcccagcccagcccacagggtccctacctcccagctgttcgtggaggtccctttcttgcttccctgcaaagagactggccagactggtcttcccgacaccaggatctccgagcaggaccacgcgatagagggcctcccaagagctttcagagtcgctggattcagaggaccagccgttgggggcaggtgaaggttgccgggtaggggcgttgagggagactgactggcccagtcggggatgctgggtctgtgtagaaggtgctgtgcccagaaggccaggctggtggccccgggcggacaggggcagtggagtgctggctcggcgacgcaggggggtctttgcttcttgctgagtatttagggtcatccttgggaaggggagtttccttccttccttccttctgcaagaagtgggagtgggtggtgagccaggtgaggtgctctgagccccttctgtagtgtcctgatgaactgctgctcaggcttcctccagaggcctttcttgatcagatgggaggaggcagcacttcagatcctctagatgggggctttctggcttcaggcccagagtgaacttgggtcaggctaggaggggtgagtacgcatgaacacacacatgcatacacacccagaggtcacttcctatgctttgaggacgatccactccccccagacacacaggcagaagggcagcagggagacaggatgtccacacaagcatgcacacagagctaccccttgcattcagaacgggagaccca

SEQ ID NO: 50113 - DNA, 1256 bp, Bovine  19866881223743
ggatggctgggctaggctatggcagagggtgctgggttgaatagcacagggtccttgtgtcctgtcttcatgcttctcatctccatcctgcaccccaggcccatgtgcttcgtgaagcagcttgaggtccctccatatggaagctaccggcccagcgtggccccccaccacacccagggccaacctggccaaggagctggagaagttctccaaggtcacctttgactacgcaagttttgatgctcaggtttttggtaagcgcatgcttgccccaaagattcagaccagcgaaacctcaccgaaagcctttaaatgtaagttggggaaactgctctgggaggtgtagggtctgaggggcagaggaggaggaacccttccccaggagcatgtagggactctccatctggggccccagctgtcccagtctaccgtggtgactttctcagagtctgggtctcacccacgttgtggccttcacattcagcatcaaactggatgtgtctcctcactacacgttgaaacaaaaacaagtgtgttatggtgtgcatgtccaaagagttaagcccaacatcgctgacatggtttaccctgtgggtgtgccctcccccggctgtcctttcccaggcagtttattccagctcaagggtggaggtctagggagagccactgtgctgagcctggatacccaaaagatgctcagacagggaccatcttgctggatacagtgtgccatttgtaatattagcaacaaaatttctgggtgcttgcactaacaaaattcattcctacaaacctttgagaacaagctctcctgtctttctaaaaaactattcctatacttgggtttcactgggcctttgttgctatgcaggctttctctagttgtggcgagcgggggctactctgttgcagtgcacgggcttctcacttggtggcttttgttgcggagcacaggctctaggtgtgcgggtttccgtagttgcagcttagagcatgtgctcagtagctgtggcacaccagcttagctgctcctcagcatggggaatctttgatcccccaggctagggatcaaacccatatctcctgcattggcactagactctcaaccactggaccaccaagggaagtcccctgtcttcttttggtcgcttattacactaatttgtgagttgcaagccaattagcttgcgtaatacctacaaaatggaaaactgccccgatgtacataaaggttggaaccggcagctcatgatgga

SEQ ID NO: 50114 - DNA, 759 bp, Bovine  19866881568855
ccaggtcacacagccgtctggctccagagtccacatttgtaaccattattcaaactgtattttatacatagggacctttttaatgttaggatttagtgaagaaatttccaaaaaaataggccatgagaaagttaagactttgggtcaatatcccttccaagggtttttggtcatagcatgggggatgaggggcagctccttcgtttattcattcaacaaacatggggcattgggagtacagggacaacgtggccatgccctcaaggaactgtcagtcaactgggaaaaggggatgaaaactcaagcaaatatatacagtaagtaggagttgcagtaagtgtcctgaaataagtgatcagggtgctgtgatgcaattaggacaggtgtgggaagggaggagagaggaggaccacttagatgggcctgttacagcgctatttccagatatatgacccagaaactcagaagaactgaggttgagtgggaggtggagggggaaagcttgcctgcctgtctctggattaaaagacatcccaaggaatcctcccatgatcccctgggcctacccataagtgttattcagcccatcacgtcctgccaaggtagagaattttacaatgatacagagctggtatcaaaatttctatgaggcaaagaacccacattccgaagggggcatgcagtgcaatggttaacagtttggtgtgaacccagctcagactccctgggtccaaatactagctctgccatttcccagat

SEQ ID NO: 50115 - DNA, 933 bp, Bovine  19866881694484
actggctctgcctgcctcagtcgtagctgggagaatagagtgaaggtttgtaagctttaggataccctggtgattggaggctactaatggtcaagctgtttgtaattccatacagtcttccagtccacctgtctctcaggagatgctggggagaggtatttagatgctacagtagatctaaagctctcttctattaccctctgctccagccactccagaccttccaccaactcctgaactgccgtgtgcagctacttcgctagtttcctttgcttcgaatgtcttctggctgaaattcaacctctacatgaaggttcgagtccacctccagcacaaagctgccctgcccagccccaggcgcgctcaatcttctccctaaacccggcagcactacttgtattacaatctcagatctagttattcctcgctcatccacacacccaaactccgtggtgatagggctctgacccactcatctttgcagcattcctctgtcctggacaacagtggaggttcaggaaattctgttgtttggaagatgttttctaaagagattagtaatccatgtgtagaaggtgctatggagaattactcaagtctggggagcccctcacatcaagtgcctagctcattccatgctgcccttcacctcctttgtcctgatctatttcagaatttctccctgcaccaagtgtttgtgtgtatggcatgacagggaggctgaaagccacctgaactctgcttagaacaggcagaacaataaggcaaacggggccatctaagccctgcctgaccaatcccctctgcatctgacctagagggaaccagcagcaagttctccgatcttgggaaagaaaggtggcaggccccagtcactgctcaagttgggtaatgtttcgagaacctgggttagagcagtttcaaaagcggcag

SEQ ID NO: 50116 - DNA, 1463 bp, Bovine  19866880467622
cccttcccctatttatttgatttatgtatctattacttagaaaaatctccagcttataattacatcagtagtttttgtgtgcttttcacattacttttaaagcttttttcttgattcagatgccatatttcaaggagtttgatcatttttataacaggcaggatttttctcctatttcactgatttattaaaaaattcaccatggtggtctgtgtttatattgccttaaactaattcctctttatttgaattccaaaagtgtgtttacagtacatagttaagagtttatcttttaactttttaatttatgaggtataatattagttaggtgtaagtaacttttcatatggttagaagtttttaaatcatctgtgagatgttttaaaattaaaggagtaaaaaaaaataaaaaaaattaaaggagtaaaagtaatcatgggtaaaaaaaaaaaattccaaagctcagaatttaaaactttaaaatattaataaagttaagtgtcttcttttttcacaataacatgcattagtaagatgaataaaatatcttccccccaaaatgtttctttttaaacaggtgaccaagtgaaatgggctggacgctatagcctactgtacaacctggtgaaaatgtcatgggaacttcggggagataaagagcaggatggacttaggaacaaaatatggcaaatgttacagaaaacaaaggatcgtgagaaagatgggcgaatctgcaatgcagtaaatattgctcaagtaagataatacgctgggtaatcaataggaaattttatcaccaggaagcatttgtcctttatctctgaatatccataatcagtgtgtatcagtgattcacaattgagaacacaatttacaaaatttaatactgacctaattttagttaaagaagagagttggcagtcttctgattaagcagcttcaagaaaggagttaattttgggaaagagtaattgttctgctttggacttgtgacttcaagacacaactctaactaggctgcctgtacattctaatttgtcgaggttagcctgggtctatgcctaattttccagctttcttattagtagtggattaattcattcttaaaaagtgtctcaatttggataataaattatttagttatcttaatttataagtttacctttccagcatcagacaatataagtcacaaatttggactcactacatctaatgtctttttctttaaagttaaaaatatgttttacaaattcttggtttttccattctgtttgaatatatatgtaaaatcattttgaaactagctatccattcttcataaaatacgaatatgattttccagtgatttttttaatgcatgtgatacctatgatatttcaaaactccatcaaatttccccccccccttcatgtcttattttgaaacaggttaatttgttatcctaaagtatactgtttttctgt

SEQ ID NO: 50117 - DNA, 2900 bp, Bovine  19866880930122
ctcctgccccccagtccctcccagcatcagagtcttttccaatgagtcttgtttaaattagggtcacctggtcaagccaagaatttgagtgtggaaagaaggatatgatgtagcgacccttgaataaactggggacaatcactctaacagtgctccgcaagttccaaagcaagtgaccaaccgttgaagcccagtgaggacagcctagtcctcctcaaacggtttcttaagatctccagtttcataaaatcaccctttagtccctaagaccttaccttggtaacccacacatgcctttcaaatttaatgcctaatattgcccagtccaaactttcttcctcaactagagaaagtaagccaatgaccttctcttaaaaggtcctaatttatttttggctcataccatttccttatcttaaagatgtcctttgacccttcccctttcgatcatttcatgtaactcatcatttacgtttccagctcatatactacttaaacaataatgtgttcctcattaatacacgaaaaaagagaccaaacatctatgtgagcttccgtttatgccatgaacttttacggagccagtcacgcatagaatagtccttttgtactactccttatcttctaaagaataggtattctggatgaaacataaaatttactgtgtaaaggttatttattggacatccttgcttcttccatagaatttagtatgataaagttaatttagtaagtactcatatttgcttcatattttttactgttcttagtgagaacttttatataatttctcactttacatactcatatatctcaatattaaataagagaatcaaactaaattaagtgatatttaaccaactagatattttctaatttatcatttatatcattacttatattgtttaataattcaaatctgtctagctgtctctagttaacctatatatgaaacgggtctatagtaaattattccttttgttagactacctaatacaaattaagcttgttttatattaaatatgtattacacataaattgatataactgcttttacaaatctttaatttagatttttctgtagggaaagcgtgccctcctcacatactgactatttaaaatgaatgaaagcatcccttggaagtctcactaagcaccgaaaactaattagcacatctagcggttaagcttttgtttattcctttattctcagaactgactgcttgagtaataaggtcttcacttggatctagcatctaaaaaatatttgccatgtctgattaagtgacttacgaatttcaaatgtaattatccatagaaatttagtaaaattttgaagaaagaagctatcttacaccaagtgattggccttgaaaacaggcttataaatagaattctaattctagaaatgacaaatttgagttagctcattcatgtagttacaatataatccacttgagatatgaaatggcatatgaaaataggtacaaaaccagataagaacataagtaattgaaagaatcatggaagcaggaaaaaaagaaaataataagaccgaataagatgcattgatcatcctctatttctcttagaaaatggctaaaaatttgactatttttttaagcttcagtaagtatcttatacaaaataaaatcaataataaggttcagaaagcacgtggaggatttatttcctataacccagtaaagagaacactgggtgaacagtggtcatcactgtcataggcacgatgatcttctctgtttctctttttcctgtgttcctcactccaaaaccaaggaaaagctaaagcaacctgcataaaagcaagtccatgaaatccaaaacaatgtagcttaaaagggcagcaatttgattggctttttcctcggaaaaaaaaaaagaatattagaaatccagagaaaagaatggactacatgttttcatattgtcctccataaagatcattactccaaatcagatgtataattcaaaaacaaagagtttaaggttttgttttccactaaggatctggcaccccactccagtactcttgcctggaaaatcccatggactgaggagcctggtaggctgtagtccatggggttgcgaagagtcgtacacgactgagcaacttcactttcaccagttattttactccccttggtatgcctgttggcaagtattcatccagaagtttagcatttcattttaactcttatgtgtgttacatgttgctgtaagaccatatgttaagacatgacacttaggcagtcatcaactttcataattatacctgggtggggggaaatagccagatttatgttagtttggtgactgaactctacctgtgatgaattttgttcttgaaggccttcttttttctttctagcattgctgtatatgatttaggtggtggaacttttgatatttccatactggaaattcagaaaggagtatttgaggtgaaatccaccaatggagacactttcttaggtggtgaagactttgatcaggccttgctgcgtcacattgtgaaggagttcaaaagagaggttagttaccagtgtggttaatgtgtagacattgaaatagagagaatttctttggactgcggtttgctttgtttatgattttttctcccgttaatagactgttgcatagtccactgaaattgcatttcagtttcatgggcgctctgaactgttctggttattgtaacttcaaattgtgaacagacaacaatgaaaaggatacagtacctggtgtataatagtactgtggtattttatataggaaacctgaatgtctttggattggggtatccaggtttttggagagaagtgctagaaccaatcctcacagatactgatggacaactatataggttccctccacta

SEQ ID NO: 50118 - DNA, 4829 bp, Bovine  19866880489407
atttgcctatggtattggcctacacagtttgacccctagatgtcagatactgttttgggacctggaggacacatttcttgaaatgaaaaaattgccatcatcttttcctcagaaaccttgatgagaagttgttgttcagttgctcagtcatgtcccactctttgtgactccatggactgcagcatgccaggcttccctgtccctttaccatctcctggagcttgctcaaactcattttcatgaaaactcatgctcaaactcctgcaaaatgactctcaatagctcttcccaccagtccactaatgattggactactaatacacacacagagtccatactgattgagatacagaaggaactgtgaggttaatctacagatgaaaccccatgtttggctttttaaaactttccctttgctgtaatatctacagataataacttctttttatgaggaggaattttattggatcaaactgtagtcttagtatcaatatgaaactgatccaagcagggattgtcttaaatggactctgagaaagaaatagtagtaaattcattttaagagaacagttttactttctttacaagaacagtgttggaggcttagaaattagcactgatctcgcgcttaaagcaaagtaagtgagacttaatgaaataaaataacactttgagtaagatgtagatcctgttgaaaatttcacattacctataaatagaatcattaggtttaaaatgtagatcttcacactgtgtcttcaggatgctaaaacagccggtagattcagccagcacattattcaaattagattttcagtgttggagaaataacatatctaactttatgactttgaagacacactttatttgtgtatatctatctatctatctatctacatatatatgggcttcccaggtggcgctagtggtcaagaacccacctgccaaagcaagagacataagagacacaggttcaatacctgaattgggaagatcctctggaggagggcatggccacccactatgcctagagaatcccatggacagaggagcctggtatgggctacagtccatagggtcacaaagagtcagacatgactgaaacgacttatcaagcaagcatacatacatgcgtgtgtgtgtgtgtgtgtgtgtgtgtatttggtgtctttcactagaatgggctcccctggtggctcagacagtgaggaatccacctacaatgcaggagacctaggttcgatccctggatccagaagatcccctggagaagggcatgacaaaccactccagtattctttcctagagaattctgtgcacagtggaacctggcaggctacagtccatggggtcacaaagagtcagacactactgagcgactaatgctttcactagaatgtaagttccataaggtcaaagatttcatctgtcttgtttatccagcacttagtttgttgcctagcaatagaaagttcttgatatcatgtaagaggttatcaataaatatttttaatgaattaatgtatataatcttatctatcattgcactgatgtttgaggcttttaaggaataagttgtatttacttttgtgatgtgcaaaagaataagattgcattgacttttgcttttttggtcacaatgagcaaagattcagtttacctcaaataattggagtttcggtgaggctgtttttcagcaataaaggaaaagggcttctgtgtttaatttaaggatggtgagaagtagatctcatggaaactgaagtgggactgaaagaggcagctgtgtgggacacaccatgagaagtcatgaatctccagagcttagccacaaatgtgactttgcttcccttcagcaattgaaaggcctgctgtttaaatctgattgctttttactaccacagtgtttaatctttggtttattaagtctttatactgtctcatatcttctgccttctgctttactcttggtagcctgaataaatcctagtgttataggtagcccaggctaggtacagcatcacattctaagaaacatagtccagtaaccaacactcacgtaaaataatttaaaattttacttcaaaaaaattttaaggttttagctcacttttcacaaggttatttcttaaaacctctttcttctcttccactcaggtgttttctgtcacaatttgtcatgtcccacaagactcttctcaacttgcaagtctcaggtgtcttttcaggccatctgtactgcagacacaatgttgccatattgtattaatgcaaagccctcccactgactcttgccctcccccttggtaatcctggacctctagactcctcaactcctttgtgctacactccccatccttccccaagagaagctcccttgactacgttccagttatcttgagtatattccagttaccatgagtatgttccacttttactgtggacatccttgctctttaggtcctttcctttatccagccaacctggtcagtcttttctctttttttctttcttcttcttctgctgctgctgctaagtcacttcagtcgtgtccaattctgtgtgaccccatagacggcagcccaccaggcttccccgtccctgggattctccaagcaagaacactggagtggattgccatttccttctccaatgcatgaaagtgaaaagtgaaagggaagtcgctcagtcatgtccgactcttcgtgaccccatggactgtagcccatcagggctcctccatccatgggatttgccaggcaagagtactggagtggggtgccatcgccttctctgctgttctcctattcctgttttttttttccttctctctctccacctgttccctttcctctgtccctttccttctcccatttcctctctctctcctttaaatctcagtcttattcatgcaaataccctatcctaatatctaccccccccaacttatcccacacaatttggttaataaaatggcccctagagggaaatatctagcaaatattttccttagttaagaagtgaagtgttgaggagagaacaaagctaggaaaactcatcctattctatttattcatccttcagatcagatcagatcaggtcgctcagtcgtgtccgactctttgcgaccccatgaatcgccggttttctatttcctcaaaatcctgtggtctccacccttgcttatgtctcttctgtgtatcctctagcttcatttgacactgtatctttatttaatttattaggtcttagcccaaagcgaagctttgatttggggcataatatgctttgactttggccttgactttgactttgggcccaatatccagtcagcaaagggctgtgggagaaggggcaaggtcatgagacccacacagagcatctccttcagcagacttggagagaaaaggcagtgccgttgtgtggcaagattgacacatgaagcaggatgtagtttgggctccttccttgggaaattcctggaggctgcagaatacactaggcttgtgtggacttcaaagaggttaattgactaattgtttcctttaaatttatctatgaaattctcaagtctttggaagaactgttctctctgtgataatttgcagagttatttcaataattatgatgggaatttcatgtcagataagtataaaccttagtgagttatctaaattggatttgttttttatccttgacagacttcactttaaatagtctttattgtagtaaacattccagagaaagactttctctttagttaaagcacctctatatatagtccccattttttctctccttggaaaaaggtatatagcaaaagcaaaacaaaacaaaaaggctttaatcaaggaaaggaactgggggaaaactacacctgcatttttctgttattgtcaaaaactcttgacttatagatgttagtgacacatgggaagctgactctatgagactgggatttgattatcttccattaaaaacttaaaggaaatctaacagaaaaaaaaaaaagttaagttagaggaatatgagccacaatagtatagtgagctgtttgggttccatgtgacttttatatatcttttcaagatggtttcagttctaggtagtagcaatgtagagaattgatgacaactgaagttcctgatgtcaatgaaaaatgctgcttcactggtaactggaagatatcttattctgggaagaatactactggttccctttaatttggaatcctgtggagggaggaagggctgctgtttgcctgaaacagttcctccagcacaagtcattaggtcaagtggtcataggacccgcttatggcccagttaccttggtaacacaaatatttgaaatggtaataatgctgcctaggatcaaaagagaacgtcttcagtaaactgtgtacttttcgtgaatgcttcatacatgatgatcccatagtcttacaaaaactattgtattagaaactctagtatttcaggtcagtaatgccaatgtgaggcttttgtagatgtaattttgtttctcaaacttgccacttttaaaatgtagacattaaatatagatgtctgcaaaaaaataataaaaattgtgtgcttttcttgctatttgggcttaaataatgcttttcttgcttgttgagcttaaagctcaacattcagaaaactaagatcatggcatctgatcccatcacttcatggcaaatagatgggaaacagtggaaatagtgtcagactttattttggggggctccaaaaccactgcagattgtgactgcaggaaattaaaagactgttactccttggaagaaaagttatgaccaaacttga

SEQ ID NO: 50119 - DNA, 1832 bp, Bovine  19866880492439
aaaaccttggcacttactctaacatttgtatcatgtggttaatgctttggtacactgtctgcagaggaaatatgctcatattgatttattgaaaacaaaattgaacatgcagagcaaaattataaattttattgtgaatgtggaacaatggcagaatatgccaccccaaaatatgtcacttcagcataacgattattttgaacaaaagatacttgaaaaacagcagatacaaaaaatcattctgatctcccccctttcttcctgcaaacaggagataaaattagcttgtgaaagatgccctccctatactaggaagaaagaagcatgtttatgatcaaggatgggaaattaagaagcggaatccatatgaacagacttcattaaaataattcttatcttcctttagcctcttcataagttacagttacttttccacaattgtctttctctgatcagtttagtacaaaagtatttagattttgccacttcttcaggtcttcatttcccaagagggctcccatgtcacagaaaatttgtgagcttgtctcctattaagctgttttttcttacagagcccagacaaaaattttcctcctctacactgttcttggaaataagcatttcagcaggaacattatatattttataattgtgtctatatcaaaaaagcaaagtagaaaattagagcaggttatattcatatgaatataaccacattttggtgtcaactataattttcctttaatttatcaaaatgtattgctcagatctgtacataataccaagttatgacattctctaggaagattcggagaaggcaatggcaccccactccagtactcttgcctggaaaatcccatggatgggggagcctggtaggctgtagtacatggggtcactaagagtcggacacgactgagcgacttccctttcacttttcactttcatgcatttggagaaggaaatggcaacccactccagtgttcttgcctggagaatcccagggacgggggagcctggtgggctgccgtctatggggtcgcacagagtcggacacaactgaagcaacttagcagctaggaggattggaagactaaattttaagtcatgtccaataattataatattttccttagtatcgcattgctatttaatattgactgtgtggatttaggtaaaaatatcatcaaataaaacaatatgatcttaaaattattctctaaaatctatattggtaaagttgaatttcattgggacaaatatttgaaaggacttttttcttaaggaacagccattggcaaaaaagactttattcaaattattttaaattattgcaaaggaggtgagaaagtgatacttctaataactatatctgaagtattgaatactttagacaccatattcttgagagctatataaaatttttatgataagagaaatagtttacctttctatttgattgctcattaagtaatatttatttaaactctatcggtttaaatgtggattttttacacctgtgttggagtttcaagacgtgactacagttcttgattttaatccaccagcagttttgaagtttgcggcagcacatatgaaggttcagagccaagtggagacctcccagtgaggcagcttccaagctgaatccacaatggattcatctatagatggtgaggaaataatgggataaattatggaggcatttcttctgcatgaaattttggggagattttgaatttgctaacagctttaccaaaagtcacaaactaacatatgataatttgatgttttgtcttgtgatcacatgtcccaattcttttgtttagctg

SEQ ID NO: 50120 - DNA, 2334 bp, Bovine  19866880800650
ccagcaaatctggaatattcgcagtggccatggaactggaaaagctcagtgttcattccagtcccaaagaagggcagtgtcaaaaacagtgagaactaccatacaactgtgctcagtttgcatgttagtaaggttatgctgaaaatccttcaagctaggcttcagcagtatatgaaccaagaacttccatatgtacaagctggatttagaaaaagcagaggaaccagagatcaaactgccaacattcgttggatcatagagaaagcaaggggattccagaaaagcatctacttctgcttctatgctaaagcctttgactgtgtggactacaacaaactgcacaaaattattaaagagatgggaataccaggccaccttacctgtctcctagaaacctgtatgcaactggacatgggacaatggactggttcaaaacttggaaaggagtatgatgcatattgtcatcctgctattttaacttatatgcagagtacatcatgtggaatgcttggctggatgaatcataagctttaatcaaaatttttgggagaaatatcaacaaaatcagatatgcagatgataccactctaatggcagaaagtgaagaggaactaaagagtctcttgaggagggtgaaagaggagagtgaaagagttcgctttaaaaccaacattcaaaaacctacgatcatggcatccagttccataacttcatgtcaaatagatggggaaagaatggaaacagtgacagattttattttcttgggctctaaaatcactgctgatggtgaccgcagccttgaaattaaaagatgcttgctccttggaagaaggtctctataacaaagctagatagcatattaaaaatcagagacatcactttcacaacaaaggtctgtaagtcagagctatggtttttctagtaatcatatatggatgtgaaagttggaccacaaagaaggctgagaactaaagaattgatgcctttcactttgtggtgctgggagaagactcttgagagtcccttggacagcaaggagatcaaaccagtcaatcctaaatgaaaccaaccctgaatactcattggaaggactgatgttgcagttccaatactttgtccacctgatgcaaagacatgactcattggaaaagaccctgatgctggcaaagactgagggcaaaaagaagaagaagcttgcacaggttagatagcatcacagactgaatgggcatgaatctgagcaaactcagggagatagtgaaggacagggaagtctggtgtgctgcagtccatgggcctgcaaagagctggacatgacagcaactgaacaacaaacaaatgcttcttttacccaaataatttttaatgttctttttccttttggtaaagttttacctacttctaagataaactccaaaacttctcttaacttgtaaggaaaactggcagtattctattgtttattgaaggaaatcataaattctttaatattgaaagaaatcataaattctttaatattcctctcagagagaaatgtcaactttctgggatctgagattactttaagcactttatctttatatagacagaatgtccccaggcttcctaaaacagagtttacaaatgaggccacattaacagatctgaatttccttggttcattagtctccccctgctccctggagaaggcaatggcaccccactccagtactcttgcctggaaaatcctatggacagaggaacctggtaggctgcggtccatggggtcgctaagagtcagataggactgagcgacttcactttcacttttcaccttcatgcattggagaaggaaatggcaacccactccagtgttcttgcctggagaatcccagggatgggggagcctggtgggctgccgtctatggggtcacacagagttggacatgactgaagtgacttagcagtctgctgcctagcctccatcccatcccagaggccacctctgcaaactcctggtctttctccagggtgggactcagttgtgctcctccaccatggcctcctctcagagtggaagggaggagagcgcccctcccacactcaagcctatgttactttgttttgttttgttttatttttcagtccccaaagcagcacttagttatcctcaatctgataaagttgcctcgaagtctgtcagtttctgctatctgtctacaagccctatcttgtcctatgggttgaagaatagaaataaccacttttctccatttctcagtctctcgagcccggggaatctgcaccaatcttgcctgcatgcatagcatcaagttatgtggatcagtaatgggg

SEQ ID NO: 50121 - DNA, 2415 bp, Bovine  19866880921237
ttagaccacaaacttacatatgactgttaaaatattaactcaaccttcaacaggcatgagaagttgaagttgtttacaactagccaggaaaaggattattgagtgtctttcagcatattaagacctacgaagaaaaacaaaaacagatttctggattgggttctgggtttttgctcaaagtagtagcaggaaactttttcatctgacaatgtatgatgcgatttaaaaattttttaaactaccctcttgataaaagaaggaagcaggaaggaaggtagagagtggaggaagagaaaagcatacttatcttccaagacagtttcaagaattaagaataatgtacataaagtacacagtacagtgttcacatgtgctagacacactattgagagtatctgccatgatgacgatcatgtaaaattgcacgttccagggaatagtatctgcagacctatctacatttggttagcaagtcacctactttaccactcatgtacattcgattacttgatttcactgacatctctgagatagttgggaaatttcatactcctagccttgcaatcctagactctgccattgtcacaggcttttccactcactgtttcctgggccactccttggactttatgcccttctcacatgtatatgtgacacttctggtctctgtcactaacagtagttggatctgaggtcatgttttggttatgttgctgcccagctcctcccaaacttagtggtttgaaaccacctttttattatctctcatagttttgtgggttgacttgattcagatgggtggttcttatactccaagtaatgctggctaggattgcagttacatgagagcttggatggtctggtatattcaagattgcttacccatatgactgacagctgatgatggccatccactgggagctcaggtgggctgtcggctggagcacctgcccgtggcctctccatgcccaggttcctcgggcttctcacagcatggcagctgagttcctacagggagaatcccagcaatgagtgtttcaagacaaaaaaatcagaaacttccagtcctctcaaaaacttgactcacctgtgttgtgttattggtcaaagcagtcacaggccagctcgtactcaagggggtgaaggagtcagctccactctcgatttgggaatggtatacagggcagggaagaagctgatgagtgaccatgttacaacagggtaaacattacattcctttaaatttgccttcagtgagcctgtcctttaaaaggaccctcacaggctcaaggttcatgtcccggaagtaattgtggaaaaggtggtgagacatcattggcctaaacatcagaacctgttctgatttgttttgggtccagttgtgtcaatatataaacttgatactatgtaatctcttctgaaagaaaattgttatccagtctgtttgttcagttgctcagtcgtgtccactcttttcgaccccttggactgtagcacaccaggcttccctgtactttaccatctcccagagtttgctcaaactcatgtccattcagtcagtgatgccatccaactgtctcgtcccctatcatccccttctcctcctgcctttaatctttcccagcatcagggctcttccactgagttggctcttcgcatcaggtggccaaaggactggagcttcagcttcagcatcagtccttccaatgaatattcagggttgatttcctttaggatgggctggtgtgatctccttgttgtccaaggtgtcacctatttgggtgagaacaaaggcaagaggagtctcctttagtgtgcctgtccatttgggggcagtaaaggaactgattccaagtggttgccatgtctcaacacacagacagaagaaatgccaaatgccaccccaactgccaggttaagagattggcctgtgacgatggtttaagaggagacagggttagcagggcaccgctagcccagagactgcctctgtgtgactgagaaacaggggttcgttcttctgggtatgtgcagccccacacaggggtgcccagcttggcaggaggaggacgggtcctcaccccagccctcccagggcctgccaggtgccctgacacagccacccacgcagcttctgtcactgagctgctctgcaaggtacccgctctatcacctcaaaagaatgaagcaagcttcctgtctcatctgagggtggcacgctgtgacttgggttaacatgatccgttcctcttccccagccactgcagcttggtacacacaaggagttccagttcagcgtaggggaatttggaagataaaaatcagttcagttattagtttagtctcacatctctcagcttgtcatggttgaaatcttcaatcagtggttcccagttgccacttccttttctaatc

SEQ ID NO: 50122 - DNA, 1200 bp, Bovine  19866881094313
acatgaatatacattctccatctgtgcaaaagctgagtttgggtattggaaggcctacacatcctattgaagagacatttttcttatagcagtttcttgtttacagttgaaaatctaaaacagaaaaataatctctgatcataagttctgatttccaccttctgtgaccctcacttaaagccaattggtctcatgtgatcttcagatcttaactccaaatccatagcatcatggggttcacacacttgggaatagacaggaacttttgtagaaacagttcctaaaatggatatttcaaggaaaagtcatttactttgctaaagtttgggagaggccataagtgttttatcccataggactcagaaggttataaacaaatgtaagactttaccttcagcactttgaaactcacaaaataattttgaagcttgtattggaaataattttgtacacaaaagaataaaatgctaagatctgtttatagaagtttaatttaagccaatgcattattctgtggcattaatcctaacaacctcactacaaactgcattcatttaacccctggagattcagttcctttacctaaaaatgagattgaaccagatgatgcctgaaaatcccattcaggtcaaagatactataatttgatatcaccctaaatagtaaacaatacatttccattttgattggttttatgctttttcaattctcttgtatagttgaggaaaaaaattacaaaattttaaccctcctactgttgtgcaatgtgtctactctgagttgattttactcatggaattatattaactctttcagcttttaaaccaaagtatcagacagaagagttgaactcccagcacagttaaaacgctttattctggaatgcataatctactgccaaggagtaactaggccttgggaaaaattatcatgtccttcattgttctgtaaaaatatttaactgtaaaggatcactttgaaggatattttctctattttacaaagatgctaatttgagaaagtcaagagtaaacaaggaaaataatactttttccttgaatttaaaaattacaaatgtcaaacatatgacttacacaaagtttaagaataataaaactacattaaagaaagaaaaaaatggatgggtaactcctatacaaggctggatttccaaatataatgcatttttagagatttagg

SEQ ID NO: 50123 - DNA, 1536 bp, Bovine  19866881351225
acacatagctagagcatgtgttttgtaatcctaaatagtaatgggttgtattcttaccaatggttatggagtgccctaaggagaaagcattggttgtacctgtattttcatgggtggctgtactcttgtgaccacatcaaaattcttagaaagtggttggaaatacagggaaaacagagagaagctctgctgtttccacctgttcctgagctaatcccttttattcttatggcgggtgtttatttcatcctattattaccaacttgagatcctcaatttaagtctctggtattgttttttatgtttttcattaatttgtactggatttattgttagtggatcaggatgctaaaatctttgtttctcatctcatctatgttgtatgtatttcccgaaacgcatcaaacactagagtacacagcattggcttaaaagtgagacataatgcagtgtcatgcattgatttatggattactgactttcttatgcactctgatttaaatcattatacttgggtattttaaaattgcccattgtaactaactccacagcattaatggaaaaacttttgaccatcacatatagctttttttttttttttttttgagaaaaaggcacaggagttttcatttctaaatgtttgtgaagacagatttgtgaagcatctttgtattgctggatgattatagcagcatttataaagttgaatgtaattaagcaaagtgggttcttacactggaaatcaaaagacttggattactactttggcattaattcaggttaatgcaacctgtctggacctgtttttcaattaagtactagggattctagaagcttgaaagtggaatggggcaaatctttagcccctatcattggagaatgatgcctagggaagagtacctggtggaccttccctcctgaggatttaggtgggcattgcaaagatttttttgaacttcctgttttcctagttcatggtgaacatttcactttaacttcaaatgctgaaagagcatactacattgcttacatatatttcagagttagtgtgagggtgaagtgtattataaaaagtgctttgaaaaaatttatcattccatgaatatgtaaggaattaattctatgaagaagtgtttaaagataatgtatgttcatctggaacaagatttatagaataagtgttcttataaattgaataagcatcaccaaaattgaagttcaagggaaaaaaaaagcttgtaggccaactatagatagtagtacaaggagaattaacttgtacttcacaggataggataataatggcaaaagtcccctgatgaattacaaaaaaagagttaaagggaatgtaatctaacagttgaaatcagttcacaggtttttactttataaagctattgaggatctcctttgttggcaaagctttttactatgagaatacaaaaatgaataaagccccatgtgtggctctatgtgtcactttcatgcactggagaaggaaatggcaacccactccagtgttcttgcctggagaat

SEQ ID NO: 50124 - DNA, 1111 bp, Bovine  19866881392729
atggcaacattgaagtcaagttgtgtgaacaacctgaagagaagaaacatctcaaacgacaccttaccctctttaattctgaactttctgagaattctggtttaggcagtgggcattaattataactgtcttcataattcatgctattcatagctgaatctgaaaattattttgaacaaaagttaaagacttgctttttatctaaaagccttctccatgtgcagtcagtgtaatatggctttctatttattgctaagttggatgagatcatttaacacttgtattttttttctgaagtttaacagttgaacactataatgtaatttttagtgcaccattgaaggttggtgatagtctcttgcaaatgaagtgtgtccaataatcataaagccaaagacagtgaagacacagcagagtgacagcttaggttttgagccagatgcttgggtttcagtttcttacccatcaccatggttgtaatgactgaccagccactcaatgtcttcaagtctcctttccttcttgtgtaaactggagtggttcctccaactccaggaagtttctgctgctgctgctgctgctaagtcgcttcagtcatgtccgactctgtgcgaccccatggatggcagcctaccaggctctgccgtccctgggattctccaggcaagagtactggagtagggtgccattgccttctctgaggaagttgctaccaaaacaaaatgagatagcagtgggaatgcactttgcgttctgaagcacccaagttctgaagcattattgtggttcttcatgtcttggtacggccccaccctgtatctgttctcttttcctttctgagacttgacctcaaccctattcaacctttcacatgtccctgttttgtagctagtttctttcatcaaaagaagaatattcctgggatcctcattcataagttgactatcgtatattttggagaaggaaaaggcaagccactccagtattcttgtctggaaaatcccatgggcagagaagcctggtggactccagctcatgaggtcacaaagaattggacacaactgaatgactaagcacataatacatttaggccaatctagctatatcaaat

SEQ ID NO: 50125 - DNA, 877 bp, Bovine  19866881403091
tttctgctggcaggcaaatgcagaaagtgaccctggaacattttattttaagcattaaagtcttaccaatataagttcaaggaagagctgaaaaaagcagagaaaactatcttaaagcaaattattttattccacttgaaaaacctccagtgaaaaaattgagatcacacaaatttgcagtaatgtgcttgcagggaggaaaatgattacaagtaagaggggtggaaaaacatttcaacactgattaccaatcccagcccccagtctacctcaagtcgttgcacatgccacatgggagctcccacgatgatggccaccagccagaccagccctgtaaaacgttaagattattagaatgcaactcagcaaagcaaaatccacctgcgcttaattctctaaccataaagactccttatgttcaagggaccgcatcatattttccctggcgcagggcagtggtctcctcacattttccactctaccctccaaatcgtcactggagcataaagaacagacttttggacacattgggagaaggagagggagggatgattttcgagaatagcgctgaaacatatcggtaaaataggtagccagtgggagtttgatatatgcatgacacagggaacccaacctggagggaaggagtggggagggaggttgaaagaggggttcaggagggaggggacgcgtgtatgcctatagccgaagcatgctgatgtacagcaaaaaccatcacaatataaattatcctccaattaaaagtaattaagcaactaatttaaagaataaaaaagctgttgctggataaagcgcaaattccttaaaagggtccccggaggttctctacaatgtcgcttgcctctctgtgtcctgt

SEQ ID NO: 50126 - DNA, 939 bp, Bovine  19866881824875
gcttcccagttggctcagaggttaaagcatctgcctgcaatgtcagagacctgggtttgatccctgggttgggaagatcctctggagaaggaaatggtaacccactccagtattcttgcctggagaatcccatgggtggaggagcctggtgggctatagtccacggggtcgcaaagagttggacacgactgagcgacttcactttagttatacttagagggagagctaaaatatgttgttcaggaatatctgtatatcattagtaatcatctatatagcctgtctgaggaagaagtgtgctattttgttcctattttaatcatcttgaagacagtaaatattatgttgttaggatagatttctgcaataaaatctcatgaagcattctactttctcagctcagattttaacttgagcacacactcctcaaattctacagtaattgttattactatagttgatactcagtgcttgcgaaatcttgaaggtaacagtgctgtgacttgaaagctgttgcatcaattaatttgagagagcagaggaaccaaagtaatgaagcattaaaagggctatattttcagagtagttgtatgctctacacgacaatacaaagaataccatctccagtgagtttaattaagccaaatgggcataactacaaattgctacccatatttttgaggaggagggaatgtgcattcttgctgtcactgatgaatattttgcattgatcttattgcttgactcctgactgtccaccaggcatagacctactgtttcttgttcacgtctggcctctgttctctccagggggtgatcatccttttggtggagttcacacaccatatccttagcctttgcctttggctccccaggatctgggtttttggctctatagcatccacatcacttttcatgtctctgcaagatagcactgta

SEQ ID NO: 50127 - DNA, 1251 bp, Bovine  19866880556374
atctcctttagaagggactgcttggatctctttgcagtccaaaggactcttaagagtcttctcccaacaacacagttcaaaagcatcaattcttcggtgctcagctttcttcacagtccaactctcacatccaaacatgaccactggaaaaaccatagccttgactagacggacctttgttggcaaaggaatgtctctgcttttgaatatgctatctaggttggtcataagtttccttccaaagagtaagtgtcttttaatttcatggctgcagtcaccatctgcagtgattttcttattaattacctaatttatatatattgtagtgtgtgtatgccagtgtcagtctcccaatttatccctcccccagttatccccttggtaactgtaagtttgttttctacatctctgactctacctctgttttgtaaataggatcatttgtaccatttttttaattccacatataagcaatatcatatgatatttgtctttttctgtctgacttgcttcactcagtatgacagtctccaggtcatccatgttgctgaaaatggcattattttgttcttttttatgattgagttgtattccattgtatatttgtaccacatcttctttgtccattcatctgtttatagacatttagattgtttccctgtcttagctattgttaatagtgctgctatgaacattgagggtcatgtatctttttgaattatgattttctttggataaatggccaggagtgtaattattgggcatatatccagcatagtatgaaaggtagcagaggaccttggacaagtaaaaggacaagaaagatcctctgtaatggcatagaatgaaagagatagttaaaaaacaaatcagttgtacttttgtgtgagaagaaattcaaggttgtagcttaggactgcagtttcctaaggaagtttttattcatttatttttacttttatttgcatttattttttgcggcatttattcccgggccataagtttttgtttcttcagtttcttctgggatctttttcttctgtgcaacttcctcttctggtttaggaacaatctgttctttttcagtaaggatcctctcaatgtggcagggagagctcatataagggttgatctgaccatgagctctgttaagtcctgcaccacatcctgggggctttgttcacatctaagcccttaagttcaacatcagtctctgcatttttgagcctgtgtagtaaaaattcaggactg

SEQ ID NO: 50128 - DNA, 1223 bp, Bovine  19866880584540
ccaagttcagtccaaaacttaagaagtagcgtggaactttccaaactcagtaaacgaagtgaccacatctcccccagtaagtgcagcgttctccatcatcctcgtagacacggcctggcacccgtgccgcttcagcaagagccttcgagaagacatgacacctggttagtatcttaccaggcacctccccagcccaagcccagcacaccctggcctccaatgaagaaagggctactcaaccttcccccaaccccaagtcagccaacacaacttgagatcattgtttttgtccacattgggggttgggaggcagctccaggtcccacctgcagctcacatgccatccagaccccaaggggcacatgtgatcccttgacctaaagatgcagacttgggggcactgcaggaccaggctggggctagtcccagcttgtaatcatctctcctgattgaccacactagaggaggaaacaccccacccttctgtgcctagaccctcactttgacaacctggggcctgagtctcaccgtccttgagagccccccaagtgattcattaagattacggggcccagtctggccatgatgctaaagggtcacagagcccccctcacttacctttggctgcctcgttacaccctgccggtcccagctctgtgggaagtcgggttacggcgggttgcaccgttgcccctgccccctcgaaatccaccccggaaactacggcctcggaggaacctccctgacactccgaaggtctccgtgttgagcttcctctcctcagcccacgtcgtccgcctggaactgaaccacaaacaaagaacgtgaaactgactgcagcaggcagctcctcacacagcctggggaggaaggaggacagatggtgactcatcactggagccatggggggcggcggcaatccagtcaggaccttggagccggagcctctgcactgcaaggattcccaggcctatttcctactggacgggtctctcacacctgcaacctcttaaagccagcacaagactgctgtgtgctcagggtgaagggcaacaagagcctcttcctttcctttctgctgtacccccagcgcccactactccactggagtaacgaagggacctgagtgtccacaccatgctcatcctacagactccatttactgtctagcatgttcctgggcagcacctaggcatcagcagttgggtactaaaaacaaagca

SEQ ID NO: 50129 - DNA, 2507 bp, Bovine  19866880590862
tttcctggatagaaattagaaggtataagtgaaaaactcttacaaagcagactgttatcatagcctttggtctaactaagatgctgtgtatcatacaagaaatgtgtatttcttctctaaaatgtctttcgggaaaatgcagttactctcatcgcctgatgatgggagtataagccaaaacatgtgctcccaaggcacagatcaaattcacagctcactcagcccagcaactctttgagaaatgtaactgataaatgcaaaaagacaatctacaagacattcactgtgatgtttcttatcgtaaagaaaaaccgatacctaagtgcacaataaaaggaacagaatcatgacacagctactaaaaaagatgctgaaaaacactcagcaaagaagcatgaaaaagttttaaatcacaaacagagcacaatccccctggtttaaacattcatccgcatgtaggaaaatcgctggaaataaacttgaggaggacgccgccactgctgtggcaggctacaactgctgtgcaggccccgtcatccctggatgcagctggtctgggcttcatcacacagacattcccacagcccgaaagcctgatacaggatgctgggcccttcctgcggccctgcagaggccactgccctcagaccccgtcatgtacggggccatggagactccaagggctccccacgtgcacgctggggcagcatgacctcaacacacagccccgtggctcccgagaggtggctctcaccgtggcagctgtcgaggtggtggtggcccctgggaccgtccgctgaggtgtcgccgtctgaacagctgtcgctgtcccaagtgaggttgtctgagcagtgccacccaaaacaagttgaggctacgagaatccaaagcatgaggtaaacagatggccttcgtgagactccctgcaacggggcaggccccacaggacccgcgaccttgagggaccgtttcagccccatggctgaccgtgtccccgagagctgccatcctgagcaccaaggaagcaggccttcacacctgcagcaaaaactgacagaagcaaagccgcggccagaaggaacctggccgtcaggagccaatccagagtgtcccagtgaggccaggacaagtagcttttcacaacaacccagatcacatttcagaagttaaaaggaaaaaatatgaaaacagagaaactgaaaagctcatcccctggctcgtgcagggaggctggtgataagagagccagtatgtcccagggcagcactgggactcactggggtcctgggctcccctccgctgccaaaacacccttctctgctctcccaaagcgagtcacatccagaaatggtttttgaccaggcaggggccccatgtagtcggtgctgagagggaggggtgactttgttcaacaaatacatttaaacaaacgaacaactagacaccaaacaacaactgggctcgtcaaactctcgcgagttctaatcccatgtgagcaatcgtgcaaatgtccactgcttctctatcgtaaattagcactcttccaatgtaaaagtctagacttctccaatttctcaaactttcgtatgactttggaaggcagggggcagtataaccctgagcatgacttgcatgcggctgctctcagcaaagcaggtcccggtgcctgcctgctccaggaggtgctccgatagcgctgctcatgggggggcaaagggacaggggggccctgggcagacagctatctgcaacctcaggctgtaaacactggtttcccaggagaaacgtcagtcagaagagatggtgggctttctttatcattgatgttttctttcacttgtaacattaagcacttattacttttgtaacaagaaagtagcaaataaaaaacttcagaaagaaaagggaaggaaccaaccagtaggcatagcagagctgcttctggacaatcagaaacaaccaagggcacatccagttcttggaggttttcatttccatcaaaatgctcccctcacacgtgctcccactagccccataaaaacaccttccacctggattaatactgagatggcagacagaacctgttctgataaacctggtgcaaaagctcacaatgaacttcactaccttctcagaaaaggctcttctctctacaactgaagctcaagacactccaaccaagctgaacttggtcagacgactcccaaccccaggaagcaccactgccgagcagctcctgtagcgggaagagactaccgagtctacttgggaccaactgctcctccagctgctctgaaagcagtgtcacggctgcgggcaccaagagacagatgaggacaaggtcagggcaagcaggaagaccaaggcgagtgaggaggccaagctggatcagggccagaagcccccacgccgcgctgccggcacccaccagggagggcactgtgagagctacacactaacacacacacagcgaggacacgccctcctcggtgcagcacacaggcacg

SEQ ID NO: 50130 - DNA, 1748 bp, Bovine  19866880785949
tttctgttgtgtttgcaacagaaggtagactgtcctgtgttcacgtgtgctgggctgctcctccgaacatagttactctatagttaggattcattctgtctcagaagtctgtgcacctccacctagtcttcagctgtctgctgcaacagtgcccacaggaacgtgggaggggagatggcctgacctccccctctggcctcctcctgtggctaagcccctcccgtgagctgggaattctgccaagactggcttccgaggcttctcttctgccctcaggcctggggatgcctcggggtggggaaagattcctgcagtgccggctccaagggcagcctgggaaccctgggctcttacaatgagccttcactgggggagcacaggctgtcacttctctgtagtcagctctcattgcttcatccttttttattttattgcgccttaagcaaaaatgaccatgttctagcattttgtggaagatgccagactgagatggttcttgtccaggagggcccagagtgaaacacattctcagaccatgaattcaccagcatctcaggactgtcgagcccccacggggttagagcttatgtggtttgggggaagcgttttctaaggcacttgagaggtgttcatggtggtaggggtttccctcctcggggtgccctaactaggggagcctgctggctttgttgctgcctagactcagtgcaggggatggtacaagtcagggctgtgctgcgtttggtagaatttctcaaggcagttgccttcctctcctgcctcattcgccagctgggagacaagtatcggggtgtggggtgtgaggcttgctccttttctccatttttaaatcctcttcttctcaactcaggagccagctttccatctgtctcagtcagcaagagccccatggtggagcaggccgtccagactggatctcttgataacttaaactccaagaagctgttacctggcaagggcactgtgggcatgcagctcaatgggcgcccggccccacccggcaccaaggccaccgccggtacttaactgctctctcccctggtctttattcatgttctcataggcacagtgcttcctgggggggtctctatttttttaactagatcccccggcccctcacctcacaagccctatagattttgcagggcagcctcttgccacatgtaccctgggggtgccgcctatatcccttgctgggctttgcttctgcgggtactggccttaaactctttccttttgcgccttagatatagctcagccagcagctgtgcaaactcaagggcaggtgaatgacgagaacagaagacctcagaggaggcgctcaggtaacagctattgccatttagagttctggggagctgtgctctgctcactgctcctgcctgcttctcgtgggtgacagtttcagggggctgggttcagcggtggcttccatgtattctgtccctcttggtctgctgtttgacactgagcaatgttgggttagtggcttaccagccaaggccactctttcttctcacagggaacagacgaacaaggaaccgctccagagggcaaagccgtccaactaacatcaaggaaaacacaatcaagtttgaaggtgactttgattttgagagtgcaaatgcccagttcaacagagaagagctggacaaggaatttaagaagaaactgaattttaaaggtctgaaaatttgccctccccccaggagtgtccatagagtggg

SEQ ID NO: 50131 - DNA, 1168 bp, Bovine  19866880904012
ttgcccaggtttcaaacacaaacttacttccagaagggccttgataaccagcttaatagtcagatcatctgtttcaatggcttcgtcagtataattcttctccaggaattcacgcactgacttggcaccccgggcctatggcgttggcctgaaacagggatgtgcgttacatggcacagaatgcaacgattcagagccagccagtgccaccctgctcctgcgtgctgtggagaggcagctgggctgggggaggccttgccccatggcttctttttgcaaagggctatttggagttggtgctcatgcccactaagaatgggattctaaggaaagacacacgggcatcttatatacgccacgtgtccttagagctcactgtcctttgctcccaaacatcaacactgaacaacttcctggcttccacatcacaagtgtcatgagcacacaacgtgtgtatgcacacatccctctacaggatgaagccagctcaaggtcccaacagcctccaaaactgcttccaaaggcaaagcagccccaagcccctttcttgccagggactcaccttccaggcatggtatgtgcccgaggggtcagtctgatagagtcggggggtgccatcaaagtcaaaacccacaatgagggcagagatgccaaatggccggcgcccgttgctctgcgtgtagcgctagcggagaaagagacacagtgacactgcagcctccacatggaggctgcccaaaacccactgcgaataaaacacaccatgttccaaacacagattacaacaaaaggatgaaaataaattaagcccatgttcaggttacttgtaattcaagtgaaaaatgaaacgagcccatggtttttcagcattcctccttcctgtgctacattttcattcttagatcagaactgcatcacggaacatggctggggttccttggagttactttgacagcagacacaatctggctacagaccaggttcacaagtgactaagatttcaccaagggcaggagtggcttttagccccctcacaactgtctggtgactggtcattcagaacaagacaaaaactacatcgtgtccctccagaaatgtgaatgtggactactccaggccactaaataagaacaccacaatgccactgaaaaggatacacaatagtaaa

SEQ ID NO: 50132 - DNA, 1934 bp, Bovine  19866881211649
gtaacaacagagactgatgcaaactacagaaaatgcctccccaactccccggccttgaggcccaggaagaaagaggctgccatccaggggcagtgcagccagtgagagacaagtttacacccccagtacaaacatgagaggagagtcatgacctcaggtctgtgcataagagcacgcagactgcggcctctggtaggtttgtcccatcactgggcagagaagactccaatgatgaagggacccctaaagctagctagaaacatggaggggaggacaaaaagggacaacctctccattgtatggacatacaatactatacacagcaccaaatatgtcacaccatcaaagcgccatctggcaccagcgtgcacgcttgctgtcctaccccgcatgaaatgtgcgtgcttcacaagcagacgctgcgtgaggcgaggggcagcctacaggtcacagcccctcagagctgtcactggcctgtccatcctgggcggacatgccgcctcaggattcctcatagacgcgggtccttcactgctggtaatttccgtactggccctgcaagagagcaagacacagatcataccccaacaggcctgagtaggagggtccacacctgaggatgagacagatcccaccccagcccacgcccaggatgagaggtggatgagcatggttggccagcgaccaaatgcctcagcctgtgtcctgaggcaggtgggtagctgatgttctggaagccaccatccaggctgagatgactgacttaggtcagtgggtggaagaggttggctcacgtggtcacacagcagctgaccgcactgggcctgggctaggtaccccgtcacatccccccctgaccctgccgtaagcaggtttgggacgggctccccaggcacactccccttggcaccgcttcccacgcgctcactggaacattccaaaagccaaaaagctttgctcccctaataactctgccctgggcttgtgtacctcctgttgaaaactcattctctacgtacaactggctcattctttatctctctttaaggagcaaggtgagaagtatttaaaaaatgagatacaggaccttacctattcaggtaccaagagaaaaacacccctaatccacacagtgccttaaggttttattagccatgtaaattgtcattagtgcctcggacctaccatatggtcactgatagatagtcacctctcgcccgggactgtcctccaaggagactccagagtgcccaggacccatctcctcccgcccaccaccctgctcctgccccagacagatccaactgtgccatgcaagatgcaagctctacaatctgcctaggtgccgtaacctgcaggcacgcaacagacatgagggaaacaggcatgagggagacatccaaggtgtgaaagacgagactctaggcgagtttaggacataaagagccagctgtgtctgactgaagtggaaatttttaaaaaccttacaggctcagagaattcatgttctggaggaacctagggagccagcctgtcccattttattattcctcacggccataggggaaacctttgtcacatgtgatgtacaaagtgaagcgtgggtctggaaacgggcagaaggcttgcctgctcgtagccataaggccgctgctgctgggtggacgggcccgtctgagatgctcggtagcttccgtactgctggccttgtccctgctggtagcctggagtactgtgagggggcaccctgggcgggtcctagaacacagcaggatcgtgaagatcaccccccaacaccctctcccacaggtcctcccaagcccctggagacgtgcattcctgctaattcagtcgtgtctgaaccccacggaatgtagcccgccaggctcctctgtttatggaattctccaggcaagaatattgggagtgggttg

SEQ ID NO: 50133 - DNA, 977 bp, Bovine  19866880209990
aaaagacgcttactctttggaaggaaagttatgaccaacctagatagcgtattcaaaagcagagacattaccttgccaacaaaggttcgtctagtcaaggctatgttttttccagtggtcatgtatggatgtgagagttggactgtgaagaaggctgagcgccgaagaattgatgcttttgaactgtggtgttggagaagactcttgagagtccctcggactgcaaggagatccaaccagtccattctaaaggagatcagccctgggtgttctttggaaggaatgatgctaaaggtgaaactccagtactttggccacctcatgcgaagagttgactcattggaaaagactctgatgctgggagggattgggggcaagaggagaaggggacgacagaggatgagatggctggatggcatcactgactcgatggatgtgagtctcagtgaactccgggagttggtgatggacagggaggcctggcatgctgcgattcatggggtcgcaaagagtcggacaggaccgagcgactgatcttgtctgatctgatctgataatcaacacagtttgactctttgggaaattttgacatcagtttaaatagatgcaagacatctctgaaatatgagttgctgggctccaactttagctatgaaataaattttaagccagaaacgtccttgccaaacaaatcatttaataaactcctggatatgaataaacatgtatgttggtattttcaatacatgtaggtgtattggctgcctagcactaccataacaaagtaccacaatttagtagaaacaacagaaaattgaaagagggctaaaatgagcaaagaatagaatcattcctcttggatagatccccgggagccgaatggctgtgtcatatgataaagtcatgtttaactgtttaagaaaccaccaaacaatttcaccaaagtaagtgtgcagttttaaattcctgccagcagt

SEQ ID NO: 50134 - DNA, 939 bp, Bovine  19866880502599
tttcgttttctccttttctctttcctattgttccctccccaatctgttttccatttcaggtttaaatgtcctctgccttgacattaccatgtaattcattatttgcattggggtccaaactgcatcagatttttgtatttcacttttacattgcctgactcattttggctactcattagatgtttgttcatataacacttaactcagtgtttattatacagcagttacaaatataaatgacaactcaggatttgcaaaatgatgtttaccagcagttgcaaataactggatgttatctatgtgtaaaattggcaactaggacccaaaagcagaggctcaaaggtatcaaatactttcacattctacagagaattaaaaaaatactggggctagaggcattttccaggacttattaggaggtggctgaaccaactctgctaccctgaataatcaccccagcctcaggaaactccctggctgtcccagttaatacaaggaaataactagaaaaaagagaagaaggaatggagagagaatcattaggtttgaaattaatagcttgccagggaggtctttctgctagccatctgagaagctgcccacaccagctgtgataccaggtacaagcttggagcgtctagatgcatcaagctgaggtagagtcttatgtcccaccccagagaactgtgcagtagggtcttcataggtcaccccaggtattcacacaccattcctttgagagaacacccagtggccacctgccacacagaggttgttaatggtcagcagtagtcaaaggtctgatgggaaaccccaccagacctctgcaaagcaaaccccaattaactataaagaagtatgccttcccccaagtcactccttctttagcattagggaatttagagtcagaaaagagagaggtaccagtcccttggggga

SEQ ID NO: 50135 - DNA, 3173 bp, Bovine  19866880533300
cttttgaactgtggtgttggagaagcctcttgagagtcccttggactgcaaggagatccaaccagcccatcctaaaggaaatcagtcctgaatattcattggaaggactgatgctgaagctgaaactccaatactttgatcatctgatgcaaagaactgactcatctgaaaagatcctgatgctgggaaagattgaaggtgggaggagaaggggacgacagaggatgagatggttggatggcatcaacgactcaatggacgtgagtttgagtaaactctgggagttggtgttggacagggaggcctagtgtgctgcggtccatggtgtcgcaaagagtcagacacgaatgagcaactgaacggaactgaactgaaagctattggatatatctgagataacattaaaaatagtaaagagagaatcaactgagcttgattgaaggcaggattggaaaaaaaaaaagtcccatcagtttctgcaaactgctcagaaatctggttactcctatgagacaagttctcccgaccaaccttaaggaggcaagtggggaggggagggaaacagtcagtggaaagatgagaggtggggcaggctgtggggcagggccacagagcaagtgtgaagagaacctgggaatgagtacattgatgtgtacggggcagcattcattcagtcactcactcgttaaacatttagcccatgcctattctgatgaatgttgtagaagagcaggaaacaaaacaagttatagtctctccctcatagaaattataaccctatttaaaaaatatgcgagcagatgaccaataaattatgaaggctctgcacacctgaagaaaggaagctattagtgctgaaagaagttacaaaattaacttgacacgtatttaatgatatgcagaatggttactgtgctgcacaattatttccttcaaagcaattctcccatctgttccctcacttctgttcttcctgccactgctctgtgtaggtccttattggtgcttataaaaccaatgcaatagtcttccacttggcctcccacctttttgatccagcttatactatgatgctacatcagtctccaggcttcttaagtcaacccttgcacaaaatcctatagaagctccttcttgataaaagcccaaatgtccttttccagcattctaggacaactgagaccaagtacagagttatcttttcaacctcatctcatactactctgctgtatgtaaactcacacatataattaaacacatcagtttgtctaaacagtatgctaaattgctagccattccatgaacatgaactgtgtgcaagacacattcatgtctttgcaaatatcattttccgtgttttccatggaatttccatgcatgcatttccatgcattccatgcagaatgatttctgcctttatttctgcagtgtttctctaggactggcttcttgagctctaagatacaaatttccaactgtttgtaaaatatctcatatagatgtcctatagtatcaccaacacaagcaaaatgtgtttcctttggctcacaagtgccctccctctgccttccccaactaagtcaatggggagcatcacaccatatgcagttccatgtgtgacagtccacggggttgcaaagagtcagacacgactgggtgactgaaccacaactgcacaccatcgcccaagtagaggcttaggagtcatctttctcttttccattttacctcatatctaattaggccaacaagtcttctgcatttgatttacaaagtgtctttcaattcaattctcttcttccaaaatgaactttggaatgtgacagcagtatctactgccgtattgtaaggatcataagacacaaggtatgcatgctgcctagcgcagttttgaatatatgtcttcaacaacttagtttccttccctccttagtgccctaaattaggcccatgcttattttgaaactgtatatgttgagtcttttggctgctaatcttttcaacttccaatcaaaattcttctttcctcttgcactgcttccttttcttttctaccttgttttagaaagagtttatgtctgctaacctctttataccctcctttccacagttgacaggtccctcaagttgattgaatcatttctaattctctgctttcttcctggatgagaattatacctctgtgccccttgccaaggaatctgcattgaatcctgctatagctggacttactaccccatcccattgatgttggctgtgtactttcttggccagtggaacaggcagaagtatcagtgtggcggtctctagatgaggcctctgcactcttgtgatccaattatcctattgtattcctatactctattataagagaaacaagtgctgagtagttacacaactgctagccctacgagaaagatgaagacttgtggagcagacctaaatctaggctgcagcttggagtccacccgagctctctggagcgtgggtgagtccacctgaagttagctgaatcatgaggaagaaaaaatatacatatattttgttgctataaaccactgatattttgacatagaggggaacatggactaataaagtcactgcttatttcaaaactcttggtgtttgtattagtctgggttctccagagagacaggatcaataggctgtgtatatacacacgcatgcgtctgaaatctggcaagtgtcaaatctgcagggcaggctagagactcagggaagaatttgcagctcaaacttgaaggcagcctggagaagaattcctttgacttctttgggggacctcagtgtttttctctgattggataaagttcatccacattaaagggtaatctgctttactcaaagtctactgatttaaatgctaatttcacctaaaaaataccttcagagtgacacctagactggtgtttgaccaaatatctgggtactgtggcctaaccaagtcaacatataaaatattccaaactctttaatttatgaattcactggcaaatgactgagagagacttggaaagctaagttaacatgagcatcctgtccaagctgtgtgactctcatctagtaaacatcagtgtactgtattttcactaatcttaaactaagtaactctttattttatgagtacgattgttggggcataatctactgta

SEQ ID NO: 50136 - DNA, 1188 bp, Bovine  19866880571612
tggcatcaccgactcgatgcacatgagtttaggtggactccgggagttgatgatggacagggaggcctggcttgctgcaattcatggggtcgcaaagagtcggacacgactgagtgactgaactgaactgaactgtgcacctgatcttcacaagctctaaatctatgttgtgttgttcagcgtctgcctgacagagctcagtccaatagtagaataaacacatcggcctcaccctggcgtttgatggcagcaacccccttcctacctctctgtattctccccatggtcttgtccttttcctgcagcctccagaccccagcagggggccacggggaattgcagattagcacactgtgctcttcctgttttgtgtgcagctcctctttgcattttccctattcaggtaggcaacactcatcaatcagccctgcagctccaccactgagaattctttataaggagcaagctttctttagtcatagccacttgtataagaagagagatgttttctcccatgagttgtttgatatgcagtacagtcattcttcttgttctgaaaagctccccctgaataagttggtataattccaggatgctcagaactataatatctttaattttgtctttccaaaaacaaattttatgtttgtgaaagggactggcgtggataagtagcaagcagtggagactaaaagcttatctgtatggaactgttgctacagaaaagagctgcataatcttccctgtcctgcacctactaaatcttccaaagggttgggaaaacaatatttcatctgtttttggctttctggtaataccaaacagcatatcaaatggaacaaatcttatagcttctttagataagcatcttccaaattagtggttattgaatttttttcatgggtgaagttaatatgtattcctggaaaccagaaggatttccatggtccaatacatttaaaaatcttagagtaaataaaaatagatttccttcctgcaggaaccttcaattcctgaaggaatctttactaatgctaatatgttgctttgatcttctcagatgcggaagtggtagacagtcttgactttggaacaagcacttatatcttaagaagctagagttcagtgaaagagtttttgaaatgaagttttagattcataccctttaacctaaataatagttaaagg

SEQ ID NO: 50137 - DNA, 2551 bp, Bovine  19866880624960
tctcgtataaggacgcaggcttccggatggagtgtggattgtctaatgtgcagctttccttcaaactcaaagtgacacactttgcagtgattgttttcacttttattttcagtaaccttacttaaatatgatccaggttcacaagttcctcttagaagtcttattagaaaatcttgccttatgttttagaaaataataataagtaaaactaactttaaaaatatacatgtcagtctggttccaaaaatcgtctcaaattctttttattttaatgaaaatgtagttgactcatatcaaattcacaatcctctgtgaaatttccctttaactcctccagttctactgtctttctacttcacaattaaatgagatctcagatgtcttcgcccaaagcagcctgggtaaattcccacggtgcagactccaggcagaattcccagaagagcagatgacagctgttccttccccatcacactggaaaagtggcacaaggacaggttgctcatagaacaccggacaaatatccatccacccttgagagggttccaaacccaaaggcatggcgtgagcatcatcagaaaaattgccttttccttttaagagaaaagaaacgtggcctaatctaagacaaatgcaaattccaaagaactttgaaatgaaccattgcaacaaaagaaatttgggaaatttcaatcataattatatgaatacactgaaaagaaattaaaattaaaagattgaacaagagtatatcaatagttttctgagatggtaggaataataaacatcaagttttttctaagtgtttgttggttgcttaccatatgctacttcagtgtgaaaaacttgtcatcgataggaagcttgtaatttctaatatttagttttattttcatgaagtaataattattatttcagttaattcaaacaatgcagaaatgtatggaatacaaagttaaaggatctccttgccattttcttactcccttttacctaaccaattccagtccccagagaaagaggtaacttctgttaaaaatagtttggtacacattcttctggtaattttaaatcgctcttggcatatggttatatgtggaacatttctggtatattgatggctgtattttggggtgaaattttatcatgattttaatatgattcttctgaaaaataatataaatatattatgtatattattcctagtccttatatttacacacaattattttaccaaggaatatgctattattgtattcatttctccaatgtacatttgtgatttaagaaaaattcattaacttaaaaaagctgcacataattaatatatacaacttgatgagtttgaaaatgagtcttcacccatgaaactatcaccaccaataggtttatctgtgccataaacctattaatgacttctgaaagtgatatacttagtattgatcgtatacattattgcacatgatattgcttttattattatattattaataatacattattatttattatatattatatcattatttgttattttgtgaaaagaacatgtcatatgaggtctactgtcttagcaaatttttaaatacacagtacagtagtcactataggcattatgctatacaatagatctttcagatttattaattttgtataactgaaactttgtacctttcataaatacccctgcccaagccctgggaaatcactctgcttctatgagtttaactagattcatcatgtaagtgacatcttgtagtatcttttcttgtgtgtatatcttttttcacttagcataatgtcttccagattcacttgtgttgttgtaagtggcagaatttccttcttttttcttggctatataatgttctgttgtgggcttcccaggtggctcagaagtaaagaacccacctgccaaagcaggagacatgagttcatgatcccagttcatgaactgaggagggaagaaaactaagtaggcagagtttatagtgggtctaatgagaaaaagagccaggaactctcagaccctaatatttcttatcctgtcacctatattagattgaaaattttaattctgtacattaaaaataaatatttttatcttatcatggtcagagacattgaaagatttcacatatcctcttattcagattcagagtttctttgtgattttggcgataaatgataaatatttatttccttttatctttaattttttaaagctttatacatcattccattctataggattgaaaaatatcaggttctattgtctaatttttatcttttaaaacttctccatgcattaatttttaaatagcagtcataatactgaatctttctgaatgaaaatattatcttgtatttgtaaaagatgaagtctttaaaatttgctacacagcagaaacatgaccataaattccttttggtaaaatttttacacttctgtgtatttcaggctccttccagagatggaatcttagtcttttaaagtagctcctgaacttgagcacatatccgcattatacgtatatgtcagtcactgagt

SEQ ID NO: 50138 - DNA, 1012 bp, Bovine  19866880650461
tcccttgtccatgggattctccaggcaagaatactggagtgggttgttgtgccctcctccaggggatcttcctgacccagggatcaaacctgcttctcttacacctcctgcattggtaggcagggtctttaccactagcaccacctgagaagccccagcataagggaagggcagtgtttattccgcctgcacctgacgtgtgcacacatgtgcgtgcacacacagatctgtgaaagaggcatgattatcatcttcgtttcacacacgcagaagcagaagctgggaaagaaggatgcctttcctgagatccagccttaactgttagagctaggaatcaaacttgggtcaaccttgcatcaaagccagggggaagtgactaatgttaacgcttgtaaggctcatatatatgactgtggtagattattcatagctatattgggtatgcatcataaaaatataaattagtcactaaaccatgatgtatcaggcttcacatatgttcccaactgctgagataagcaccttgcagagcatcgttcactgaagcattatgtaatttatgcttgcaaccttcatctgaggcagaggacacttcatggttcagaggagaaagtcaaggcccagagaagagcagatgctcccccggagtcagagcgatagtctcagggcatcactccaccccggatctgtgtgtctgtgtctgattaaccatgcttttgagaaacacagtccatcagccagtttgtcttgaaggggcaaagttgacacttccccagttaaggattccaaacaacagactaatttggaagggatgccaggttcatatgacaatgccagttgtaaaaagaagacagcaaaggcatgttgcagttcaaaaatatttgaagaccatatttaaaaaaaatcactggccaggagccagttttgaattctgaatccctctttcccaaacttttcccactagttttgtatttatgtaagtgggcccagcttttaaaccctagcaattcta

SEQ ID NO: 50139 - DNA, 1124 bp, Bovine  19866880659400
gtattgaccaacttgcttttaatagttaacaaaaagcagaaaattaaaagtaattttatttaatttcagccaagaattaatgtaccaaaaatgtccagatctacattttcatcacatttatcatcatatttcctattgcagtagagaaaactacatcaaaacagataagtagtttgtggaaagatgagaattcactgtaattgtcagtgaattcacagctctgtccccagtgctccaaagcctgtttataactgtctcttttcataagatccgttcatttactcgttcattcattccgcaagtatttattaaggacttacagttttccaggtctttaagtatatgagacatgaagaaaaagtaaatatataagacatgaaataatagaagaggtcttatgtaaaatacactgctaagtcaaagctcaaagcattctagatacttggagtcaaaaggactcaaataggccattattgcatccagagttactgccaaacttagccacattcattctctgtgggagactctattctttctttatgcacagagctcagagaagaaactgcaggtgccatttaatcacatagattttctatgcttttaatttctatagaaccattgaattcattaccaaatagtcatctagtgtctcctgtgtctctcacctatgaatagaggaaatgaaatgagtataatgaaattcaaaaactgtgccacaaacaagagcagtgcaccagctagaattcctttctgcaaaaaatttaaaagtactaagcagacattaactcacaggcaagtatgaggacattagatcatcacatcaagtgaagcatactttgattactgtaacctagtttggaaaaaaagtgatttgtctgaattctgagatatagtgacacagaaatttttctcaacggataagctcattttaaatatcttttaactaactgtttcccttaggaaagcctattggattggcattactttttagtatagtatcataaaaaaatttgaacatagctactaatataatgcttatttttcttctagtagtttttaaaaacaagtttatgttcatatcataaattaatttatttttagtaatttttgtgcaacatatgcca

SEQ ID NO: 50140 - DNA, 1320 bp, Bovine  19866880690165
cttttacttgcagaattcctcccatagttctctgtacccatcatgggggataatgagtacaatgatagttcagttctctggtctaaataataaactattccaagataaattcacttaaaataacacattgaaaatcctccatctttagctcaggaagaatgctgcagtcaccttcgctttctgagatggcataaaaaccttgaaacagagcatccataagtgagttggggctgtactgctctcacatctggtaggtatttggatatctatctagctcaaacagctatagctattttgtactttgtatgtactggactttctcatttcaaaaggctcaaagaactttataaataaaatggtcattccctctcccaatatattcctgaataatagactggttatccacttgtaaatagaaagcacgaggcatggtggagaaggtctatggaagaaaatgcaggccatcagggtatggatattatattcatgaaggacctgccttacttctttgtaaaacatttaaatataaaggtgccaagctgggaaatgtcctaacctgggagtcctatcctgacctattcaggactgacttctaatctgcactcttgtttggctcagtccaatctaacaaatattaactgagcattactatgtccaggtgctccatgcttaaaaaatgaaaatgaatataacaaagatcctgatcttgagtgagagagacaaactagtcaataggcagtcttatcaggtgtaatgggagcacagaagactaaattagcatgctagcccagaaaaaggatgtcataaaaggcttctccaaggaataaatcttaaggaatgaacatttgtgtgaagaaaggcagcagtcaaggtacagaaagaaaaaggtgtttttaacacagaatgactagactcttaagaattccattagtacttcctgggaagggagactgtattttttggctagttagtgagagtcatgaaactcatctctggtgcatcaaacgcagactaaaataaatgatgcacttccggagcctggcaacagaacaccctgtgttattgtccatgttcctctcccctctcccttctccccttaagatagttctcaaagaactccaagatgggagagccacatgacagaatgagcctggatccccaaggttctgctcggaggagagctgcctaagccgtcactgacttagtgtgaataagaaacaaatctaatagtgtgaagccactcttaacaatactgttaatagtgttaacagtggctgagttcattatctgattatataggctaagaaataacaagataga

SEQ ID NO: 50141 - DNA, 1767 bp, Bovine  19866880701039
ttctgctctaagagatgtcttgtataatcggctaaatttaaagtcgttgttgacaacctgctacttgccaagcgaatgctcaccttgagctgaaacctgtctccttgttaccatctctctatctgcactctttctgacaattatagtgattcttctgtttttcaagtacttgtgaaatgtgtttttcctatcttttctcctttaatctttccccatattacatgagtttgatactcagcactttccttatccatgtgcagagaaagtagttcctgtggtctttgtatctcctcaaacgtcagcccccgcaccaagctgagtgtgccaggtgtggtttgctgcagtgctggttaagctgctttgctttcccgtatgtgcttaagaaagagctgtatttaggaggtaagttcaagaggtatcttgtcaaaattgtctagaaaagcctctagatcactttatttctgatttaaaaaaaaaaaaacctacatcattgatattattaagaaatgactatgcccatacgtggatccctgatcattgctaaggtttttcataagtcagaggccaagtatccttcagcccttttgatgaataaaatcttgtcctcctttgcaagaacttccctcagagcttagttggtaaagaatcacctgcaatgcaggagaccccggttgggttcctggattgggaagatcccctagagaagggataggctaaccactccagtattcttgggcttcccttgtggcttagctgataaagaatctgcccacaatgcaggagacctgggtttgatccctgggttgggaagattgcctggagaagggaaaggctacccactcctgtattctggcctggagaattccgtcaactgtgtaatccatggggtggcaaagagtcagacacaactgagtgactttcactttcatcttcactcctttacaaaggatggttaatatcatacagttagcctgtcttttacaaattcctaaaccagattattcccaattctaattagcacagaggaagggaggactgtcatagtctctagtttaaatatcattcttgtattaaatcagccagtgtcacattatgtctttagctgatacattacactctgactcacactttcagctgtaactcctgtttcttttttcatggtattgctaatctatatgcccacatcctgaatttttaaaactcatttctttactaaactataggacttcatatttaatcaccaataaactttgacttgttagactgagcccacccctcatgatcttcaacttttataggaacacagtgcaaacagaaagtgaaagtatattactattgtttatttttcttggggaagcgtaatattaacttacttggtgctctcagtatacatattttaaaagaagcactatttggtccacgcattgcacaactaactataacaggtacagtaaaactgactaagtaagtctaaccattaacgctggtcattcaggaactgtgaagttaggcagtatagggccttagagacgtgtttagaattttgggacaaaccagtagtccctcagacctcagaaaagggctagcaaagaccaaggcagagaacacagtcttaggcatgctaccattataaaaattcaagctcagaaataagtctggggattcaggaaccaggcatttgaataaagatagaggcaaaatatcaagaaaaaagcaaaagctgctaactaaactggagccaaattctgctaggctgggtacaatgga

SEQ ID NO: 50142 - DNA, 864 bp, Bovine  19866880764604
aaaattggactccaatggaaaaaatacatctttttatgactcaatatcttaaagatagtaattctttcactctcatttaaatttaatgtgagtttaagtattaaatttaatgcagtagtatggaatggtttccttcccacatcttttggatcttgacaaatgatcctaaagtgcatttagaaaaataaatctctgacaatagttaggtattaatttgaaaagagaaaaataatggagggggtggagatcaacatttatcagatatttaagtaaattataaatggttctggtataataattgaaaggcaataaaacagaagagagaacttaaaagaacaaagattcaatgcttgtgcaaatttattgtattatggtatttcaaatcagtagtaaaacaatggattatataataattgccaaaaagataactggccagtcatttgaaagaattaataaaactgtattaatactccattccttaaataaaataaattgcagctaaatatttaaataataagtaaatatacttgcaaaataatcttaaaataagaatgttctttgatcagaagccataaccagacacatattcagaggtgtagagaaaaaggttgataaatttgagtacctacaaacatgaaactttcataaagccactaaaatacaaaatcaaaattaagaaacgtaacagaattgggaaaattctttgatatgtgtgacaaagatctaatatctttattatataaagagaagtacagattgggattaaagagatcatcaacctaaggagaaaagtcagcaaaggataggtgcaattcatgataaatagctagaaatttcttctataagaagctggttgatctcatt

SEQ ID NO: 50143 - DNA, 1014 bp, Bovine  19866880770932
aattgggtattattaaaaataggcacatcctgcctatgttaaagcagattttaaataggccattgaatctcttgtttctttctacttggtgttatatttcctattgtcttcactggatagcaaacttcttgggagaaatgatcatgccttgagcaccttttgcacctctatttatcatctgtctgctatgttttgaataaaacaaaccttgaaagaataaagcaattaagtaaaaatgtcaagtatagattataaaaacactctgtctacagatcactaaatatgtttgtaggaaaggatttaaaagtctgaactgaaaattctaatatttaagatgtttgattttttttttttccctaattgaaggaaagataaagatggaatttccggtacacggtaacaccaaaatgttcttaggttcttttttcagttttgagaattctcatgatttgattttcatccagcactgtcagttgagacatctgataatctaaaagcattcagagaattaggatcccatatggttcaaaaatatttcctatccggcagggaaaaagagaacatactgtgaaaataatactagtatatccttcaacttatgtgtacaaggagcacaaataaatataaatcattatccatgattataatgatcatcagaattgattacaatgaacaaaataagaatatacagttgccataaccactctgtattataaaaaacctgaggtatatttcaaagcaaagatagccatggagttatggcttgtccttcagaagcaacaataattggaaatgagcactgaatgaggagtcctgacttatcactattgaattgtgtaaacctggaaaatcatttaacttccttgggacttaatattctcaactaaacaatgataaagttgggccagatgttcccttctaacacagcatctgttctgaaggttctagcaggaagtaaatctattcatatattgtctgaagaataactgtccttgtttagggggaaataatttt

SEQ ID NO: 50144 - DNA, 2121 bp, Bovine  19866880813326
ccttatctctcttctatccaatactttgttgttgagctgttttataaatttatatgttacacctaggtgtgacttccttggtagctcagtcagtaaagaatctgcctgcaatgcaggagacctgggtttgatccctggtcagaaagatcctctggggaaggaaatggcaacccactccagtactcttgcctgacaaatcccatggacaggggagcctggtagtctatagtccataaggtcacaagagttggacatgacttagtgactaaatcaccaccaccacataccatgatggtctttgtactctcgaggcttggactaccacgtatatgtcaaagatccctagtaatatatcattaaccacagccttctcttgagttccatatttatacttccaggtttaccctggacatgttttcaggcattcagacttcagcatttctaaaacctcattcaaactgtcctgctcttcctcagttaattctaactcagtatacagttgtgtgaactgtgaactgtatacagttgtgtgaattagaaattttgcagtattctatattttctcttttcctgtgtgtaatcattttgctaatttactaatttatggttctaaatactattttttttggcagaagtctgcttttcattctttccttgtgattcctatgtgatagtgatcttttggtcagaatctagtttttgttcccatttgttattgcttatctttgtttcatgtaaactatgtgcttagaagactattttgttttttctttaatttggcttagaacacacacacatacaaacacacacacacaacttatgttatgtgtacatgtgtacaaatgtgttctcttattttttaaattaacttgattttatagggtaatattttttgttaccctcacatttgtcctttcttgtgaattacagtatgctttcatattagccagtggttttcttatctggcatgctatatgcaggccagaaacagtgctgttcctaaatctgattcctggaatatttcacagaggtataaaagtattcatatgatagtattcatgatagtatttattattataatagtaaccggtatttttttaaattagtgtcctttatggaacttacatttaagagggaggagagagaaaataaaataaaaatttgaaaatagtatgatagaagataaatgctatggagaaaaagagagaaggaattaaggtagaataagggatttaagcttctgtaagctgggatgctcacagaaggtcacactgataagataatatttgagcaaagacctgaaggacatggaacaatcagccaaaaaattcctcagggatgagtattccaggcagaagagaaagcaagagcaaaagtatctatcttgagtgagagcgaatttcccagggtattaaagtaataagatattaaaatgggagtttcttttaaagatccaagataatagacgccatactccaaagtgaggttcaaggccacatgattttgaagttataaagaagttagtgtgaaataggttagacaatatttatagaatttatacccctaaacacatataaagtatcaaagaagtccaggacattgacagagaaatgttagagataccataatatgtgaataccgtctccaatttgattgatggaagtagtccctaagttttgcatgaagtcgaggggaggatagctgtcttagaccacccagagaacctaatatctgcccttacagttgaagggatgtggagagttggcatctgtctgatgtctacctgggatctcagctgtggtactctatcaaatttccccattgctgcacactcttttttcaccttcagcctcatatctccaaagttgagcatacttgtggaatctcgctgattctctttacttgcctctcagataaattacttcttaacaagtaaagagtcttacttggggccaaatccttccttcagtgaagtcctgttggcactattccttgcaaacattcttcaattttgtaatatgatatgccattcttttgtggtttccaataccagtttttgaagtttcactgatcattttgattgaaattttaggaagtggagaagagaactgcccatgtgta

SEQ ID NO: 50145 - DNA, 571 bp, Bovine  19866880838323
acatgaaaatattttgaaaaacataaagccattctataaaaaacaaggtgatattaaaaaaaaaaaaacaagaagaaaatgtttagattcctgttaaggaattctagaaaagtgcaaaatataatggcatctggatgctgtattaagaccatatgactggcaaaggcatcttttcaaccatggttcagagaacttgttgtttttctgtctttacctgtcaattttcctaaaatatgaaaatctggatttgagatattggaaaagaatgaattttgccttccaaagtcagagagtttacaactgttttgttttcaatctcttgtcaaagaaccttggttctgagtaaatcagtattcataccactcaaagagccttggttctgggtaaatctatattgataccacgccaagagctttggttctgagtaaacctatattcacaccactggtgtctgcaaaattccctcagggcctgggtaatgtgctcactgggtggggagcaagtggccactgggtgagatgtgctatgttcttgtgctggacaaagcctttgcacaccatcaagggcctgt

SEQ ID NO: 50146 - DNA, 2103 bp, Bovine  19866880865040
ttaattagttcaagtagtcatcctattgcaggcttagtgagttaatggttgccttgaccatcacataatggcagcgcaatgaacagaaagtaaatgaatggatgaaactccttgtgtgccagaccctgacccccatgccgcagagcacggtggggtagcaccagagacagacacaccaaagacagaggtccaatccacagtttcctacctatgtgcctggggaagttatcttctctggatctttagtttcttcctctatgaaacagagataatgttgcctactttgcatgattgttttggggattcaaaatgtgtgtaaatgataaaattgctatttatttatccatttgtctcccttttaaatagggaaagcagaggcatagagacgtaaggtggcatgactaaggtcactcagttgggaagtttcagagtcagcatcaaagtctagatagttgtcttcatgtttctaaccaacacactaagtcacgcacagatgctcccatctacaatgagcatgaccatgaccaggaatatgttagtcccccacactggtgaaacactttgattcttactaagatcactgaaccctcacagcaatcctataagaaagagagccagccctgggcggtactattttttttttaatcttttggtcactccatgcaatatgtgggatcttagttccctgaccaggactcgaaccctgcactggcagcacagagtcctaaactctggactgccagggaagtcctctgtgtggtactgttatccccactttaaggtgaggaatgtaaagcccagagatggtaacttactggccaaatgctaactcgatgaattagcatcggaacatgaagtcacatgcagatttgaaccataaacataaatataagaaagagagtcagccctgggtccagggtagattcccacatcactattacgtatccaggtggtcttttttgcaatgcttttaaatcattctcacagcaaagttgaaacctggctagatattgtcagacagatgagaaactgaaagtgaagacatgagttcatgaatagatttgaactctttattgccggggtaccggtcaattatctcttactgagtggtgctatcagtccaggataaaacaaattagatttttaagaaggtgcaaaattaccaccataaaatcagataagcctggtgcagttgggaataaattctatcatagaaatacatcctgcctgatatcaaaggcagccaagagatcatgccaagagtctcttggatgaaaactgacattttctgctgtggagacagaagtggaagcactgactggagaattatattatgaagagttctaaaatatttatcatcattctaggtcatttattcatttacccttttaatgctcatttcttttgtgccaccaagtcaagcataaattaagcaaagaataaaaattcattttgtttttatacactaatataaagcaggaagcttctttgttccttggtttaaaaaataatagcatttctcagaaatattagaacactaaaatgttctttcagaaatatgacttttatcagtaacgaggatgctgaatttattcaagtaggttatgaatttttacttttgagggggcagcttcctttgacttaagcgattcaggagggggaaatgatttaaaaaaaaaaaaaactcaatgagaattgacattgcttcactgtattaattaccccattatgcttctttctagactcaactcaggcacctctttctccaggtggccatttttgactctccactcaaatgaagatgtcctttctctgttttccaggagcactctgcacaaacctccattcatccctgcccgcagcacagtgtatggaacctctctgcccacacatctgcgccctcagaagatgagcaggacaaggaccatgtcttacattcacctggtgtgcttagcccctggctggtagccagagctcagaaagtgtttactgagcagcaccgaatttcaaaaacaacctgactataggagtgtttgctccctttgctcacataaaattcatttcaaattgtagcaaggataccaaatacaaaattttctaatg

SEQ ID NO: 50147 - DNA, 1170 bp, Bovine  19866880876709
tcttgcctggagaatcccaggggatgggggagcctggtgggctgctgtctatggggtcgcacagagttggacacgactgaagcgacttagcagcagcagcagcagagtcccctattagaaaaaagacaaagaggaaagaagctgaattgtattccttttttcctgtgtgccagatgctatgcaacttactcttgtgaacattcaattctccaaataagtcagtggtattatacccattttatagataaagaaagggtaacttgttaaagtcagctccttcaaatgtagattgatttcttcctgaagttcatattcctttcaataaaatatgttattataaagaacaatggaagccagccctttggttcttcctctttagttcaattcatatgcatatgtactatagagagccaacggaggtgtttaagtgtaaaaccaaccacttgctcttagcaaaacctaacttggtatggaagactttagctcaaaccccaaagccctcctaaagcacaaaccacatggtcatatattaaaatgaatcatagacctgaatatctcctgcctcccaaaagtgaatgcatatgctaataatgatttgggtttcacttattttcagaggaagaatttccttgcctccggtaatattcttttttccatgaactgttaaattgtacataaaatcctctctgtgaaatgctgtgcaacaggcataatttatttttgatttttatttctctttgcagcactatttttaatagagccaactgggggaaggtgggtagtagaatacgttagcttacaagcacactattttgtctaaatcaagagagaacttatttttattattattttatataacacttcactgagtaactcgtttttttcccccagatagattaaatctaagaaatccctcaataatagaataaccatgtagcaatatgaattaagtgagcattaaactagcctgagttcactaatctctatcaagagatagtatttaatcaaccaagcaattgtgtccttagcaaaatagaccctaaaatttatttaacatcttttattctaaatagtcattaaaaactaaaatagcctacagtaagtagtagattttgatcactagaagtagggctgagattctccggttttgaaagtacaagtaagtattca

SEQ ID NO: 50148 - DNA, 801 bp, Bovine  19866880988092
tctatatcaactatcctcacttttcacctgcaaattcattccttaatgatctacaatttggctttcccttctttgaactttaccaaaactattctctcaaaagacaccaatagtttccaaattacccaagtaaatagtattcactcagttatcatcctaatcaagcccctctgcagttttaaatgacactgtcaactacaaacttcagctccattcctccagacctaactgttcctcattctaggttcccaattacggttactgttactactatccattcattcattcaacctagaattgaaggttaacttagtctcttccttctccccttccacatcatactcttaccatctccagtattccaacccctattattacttagttcagctctcataatttatcagctggattattcaaaaagtcttattaatttctggaatcaagtcttgtaatgcattaaatccaccttccatgccttccatactcctaaaaataatctttcagcaatacaaattttatgaagtaatacaaactctccctcccacatcttgccccccaccaggtttaaaaaccttcagtgggcattaagtgggtatccattgcctagaagatacggacaaaatgcattattagggaatacgaggtagtttcatgactccttctacagcagtatttcctgatcacctccctataccatatcctttgcaacttacatttcactcggcaaaactccttctagttttcaagcacaaatcatgctgtttaatgccttagtgtctttggtggtactgtcctctctgt

SEQ ID NO: 50149 - DNA, 1033 bp, Bovine  19866881020018
atttgtccccataggttggtagagggtataatgatgatcaatttgtggagtagctgtgtttaagttttatttgctatacatgagaatattggcttgagaaactcagactttatttaggtataatgttaaatatgtgagagcttagggaacaccaatattctcactaatgaacatcccaggttatttaaaacttctgtggaaaacctatctgtttatatttgttctgaaacatattaatccaatttgaaatactagtacaaatagtataacaacagaaattaaatctttggtaattggggctctcttattgtctcagaccattcattgtgggcacaaattctcacatacagaattgaaaacatagataagtctgtatcagagatggaatttagtgtgtattagactaagaccaaaaacctataaatttccttttttgggggaataaatatgtaataatattaaaataggtagcaaaattttaaattaaggttttagttgggaggtctgggtctggcttatttataatctttcaaatgtgtgtagatgttctatggatatgtggatatatgcctaaggcagtcaactatatttatatgtatgctaaatttctattctaaacatccttgtttaaaaaaagatgtatccacatttattctgtttaggaaagaagatatgcactggatatgttttccccatgctcctattataattaattccttttttaaaatagccaggaactgagagggtataggtaaatgaaatctacagacctttaatcttattttagttataaataccagtatcttcccctactaaatatttataaggtctaataacatgcaggaaatttgaaaataatttgagttaatttacagtattttctcatttcttttccattctttgccaaaggtattcctgggcaatatagtatgctagtcagctttaactgaaacttgactttccccaagggacaccagtgcccttgcagtcctctctaatgaagatatctcatcatccatgcatttcactcatg

SEQ ID NO: 50150 - DNA, 1499 bp, Bovine  19866881036742
tgttttgaaatgcaaaacatctgactcatggtagagatgaagagctgtgtatgacccatgagagaaacttatcttattgttcacacacagggcagagaaaattcaaaaccgataaggcatcaggcatctcgaagcaaaactactttaatgagggtgagtcatggtgccacccagggaaatgaatcaggtgcccacatgccaaatcttcttcataattacagtgtttttttcccttttaaattaaaactaaagtcaggtaacaactaatgtccctgtagaacaaatttagccaaatggaaatgtacaacagcctatgaagtaaaatgaaaatatgaaagggatacagcttctccagcaaggaaagaagaaagaattatcattaccttaagtgtaatgtcatgcctgcaggccccgaaggacttttaaaggcttttattgtgtcctctactccagttgattttgacatcttcccaccatgtaatgactccagtagctttctctcaacattaaagtcttagatattgtacccaagactcctactgtttcctgctcaagccaggagagtgaagagtatccttgtcacctcccatacccttctcttctaacttctataaccaatcacaaacgctttaatgtctagatcttaagcatctcactttttttcacctccacagatacaagccctaatctaagccgccactgactcactcatgcccattttgaattattgtgtcacccagtttctaagagtagctatagcacagctagaatgaacatggagagatgcaaatcagctatcactctactgtttaaaacttcaggattgttttcccactaggacctcagcaagcatatacaagcatttgtaagaaatttgggaaaaaatgtagtaaccctcctctttctgggatgaacacagaacaagtcagttttcagaccctatttccctactggccagactttttatgtagtgtagaaactgcaataccttttgtccctcgaataaaatccagattctttaagatggcttgtatggccccttactacctaatctctgccaaactctacagagtcacccctggccattctttcactcaggctctgtgatcctgcattctgggtcagtttcagtcccttgaacagtaaccatgttgtcatttacatctttgccaaacctcccactgtttggaaaaatgttctctcttctctgtccagataactcctgcttactccctaggtcttaacaaaaatattacttccccacacagcacttcccagacctcctagattagaataagttttcttgccacacattccagagaacctaatgtcccagtgcatgacactcatttatttattgaagttgttggtatgaagtcagcttctctgatggactcagctgaataaaggaagtattatttgttcttcactgtattatctgtgcacagtaacatgtctgatacgagtagaagttcaagaaatgtttatcaaaattaaag

SEQ ID NO: 50151 - DNA, 704 bp, Bovine  19866881071356
tgttgacagtgtcttagcccatagtgaatgacctatgagtgccgagttcctcagtgaaattgtcagggacaggtgtgttgtatattattgggggaaaagaaactgacactcaccagtaaataaaacatacttcctctttatgaaaagttatttccagaaagcactgcatatatgaaaattttctttgagctggcacctttgagtccctgctaaagacattacctaccctgggtaactaattatctctagttctgttagtagtttcaaactatcacctcttactggataaaattgatggaaaaaatctaaaaagagtaaagtggaaaagtgttcctttccaaatgggagaaataacaaaaacaaaagcttttaagtacactgcagcataggatgcttttctgcaagggagaagaaacgtttgaggagaactaaaattagaatgaagaaggtggtgtggaccttttgtgctgctcagggattgccagagaggcaaacgaaacccttccttttaattagctcacactgactggaaatagaactcctgaaactgagttaatcttactccagcagccactggacacaagcagctgaggaaatctctggactccagctagcatgaaggccaaacgtgggctgctgagagtggtctttgagctccaagctgaggttcaggatgggctgatatgaggaaggattaagggtta

SEQ ID NO: 50152 - DNA, 2001 bp, Bovine  19866881144346
ctcacattcaagaaaatggccttcccttttcacatttccagctgttttcccactcccacgtgttttatttagacatcagattcactgatttcattaggtggtgcatgctatgcctcctgcattggcagggggattctttaccactagtaccacctgggatttcattagatggtagggaggtcaaagtcacatttccagttctcagtttcttcaaaacaaagcacgtgagttataggataggtgcagcttattcacacttcatatacttcaaccactgccagaatcaattttcatatgatctgaggctgtggagctttatggcttatgttatattattctgaatttcatctgaaaatatttccaagtgcttcagtttcacaacatagaatatttataatctaggtcaaacatcatgcttggtctgacttgccaaacagagaattccaaatgaccattttctcctctaaaaatatatatgtatgttttttaaaagataggaaaaagcatttctgtctcaattttccccatgtagtgatttgccttctggcctggatggctctattctttctaattcaagatgcaataggcttagagaaagattagaaacattcatgctgtaatattaacacttacaaaatctcactgttcttatctgagcttttcatttttgttaagatgcttaaccagaatggaagctgcccacacaattcttgtatgaaaattatacttgctcaataatattcatatctccacctacttttgagtgaaacagaacaagcactaagttatgcctgtacacatttgcataagaatataccatacacaaattcaggtttgcatgcctaatttcagacataccatcctagaaatgcacattataaaaaacataaactttccacgggccagaacgttttcctctccaggtgttgaattttgttttccctaaaagggaaagataacgatagccttaatttatatagtaccttttcccattctcctttccctataagatataggagtagctatttcatgggcacttgaaaaggcacaaatcctttcttccttaacgtatagatcctagtcagggtatcccagaagactggctctttaggcaaattctagaataaagtgaaatttgtcagtatagtttctctttgatgattgtctttccctctcttaaagttaacccagttctttgccagccccatagcttagagatctctacacagacatctgtcaggctattccctctattccttgttccatagtataaaatgtttcaactcacaaaaacgggcttgcactatcctgtctagtcttcatagtggtctcacagtttagtaagctaatagggcagatattgttcgtgatcactagttttcattttcaacagttctaattcccttttttttttcctttttactatttacctctcatagttttatatcttcctattttgattaacaatttattgatttttctatataaaatttatctcttcaagcttttaaacatacctattagaatggttcaagaaattaattgatctgaaatgataaactgatcgttgattttgttggctgtacttattagttttaaatttcatgtattttcttaattttggattttaggtattcatccttctgacccttgctttgcccttgaccctggcttttacctttggatcccactttcagttttgcacaaaatacttttagcccctctgccatacagaaactgagctactggatcagaatctaacagcccccagccctcaaacctgtgtactatctggggttctgttgcatttctggtccactgaaattttatctggtttttgaactggacttctctttcagatttttagccaaaaaaaaaaaaaaaaaaaaatctcattgctatgtattgtgaacttatgggaccatcttgatcagaagtttgtggtatccaatgtaacagctacaaataactaaaaagacattagctgccccaaatagaaga

SEQ ID NO: 50153 - DNA, 773 bp, Bovine  19866881216294
agaggttctgtcctttctcacctgagaagaacaaaacagcagggttttcctgcagctctgcgggaccccagcctctgtgacctctgctgctaacagcctctccacaggcaacagacaggagacaccaactatgcaaatcagagtcctgatgttcattatcagctacaaaacccaaatggccctgaatctgagccaagcaaggcatttctgtgtgctgtgcctggttaggtggggatgctgattagtcagattacggtaataaacttttaattcccttatgaggcatataaaaattatttgttagcctcctttttctaaaggagggattgaataatgtatgttggtatataagttcagtattaggagaaggaggggtagggggcattcttatatataaatgatatttgttactcttcatgtcagtttggttgacagataaaaaacatgctgttttttcacatcaactatggcccattgagaactaaccagaatagaaataaattggtacattatctattgaggaacaaatgctaaagatgtaactggtaaaattcaacaaatattagagaattatcttttcatgatcatcttgatagaaagttaattgtagatgatacaaaaggaatagatatttatctatttatatttatgtaatttatttaaataatctatttaaaatcgatattttatctatttatctgctaacattctgcatcacctacacatgcatgcgctgcatcagatttattttaaacatgaaaatgcattcatat

SEQ ID NO: 50154 - DNA, 1909 bp, Bovine  19866881282625
tatccatgggtttgtgactttcattccaagtttaggggtgagggaagtctagaagaggctacactctctgactcctgaccagtaaatgtcaggctagaactgtattttcattttaggactagagatatcaaatgattccaggttcttctccagtctgcaaaacatacttcgattctttttgaggttgagtattcccaaaagggacctaggaaggagaaggaatagagactgtgcacagggtgtcttctttccagaatcatattcctcagctctccaacagaaattatgttctgtcttatgtgatttttttctgaattaggtatatcatagaataactaatggagcatgccaaatatttccctctattaaactgtttctatttttgacaagttaaggttgttttagagggtaatgtttaaatgaactttttctttggtgtacctatttaaaaacagagaatttattcagagtaacataagctgctaagtatttgactgggtcattggaattttccagacaagaatactggagtgggttaccatttccttccccaggggatccttcctgactcatggatcaacctgggtctcccacactgctggcagactctttaccatctgagccaccagggaatcccttttgatccctagtaggagttaactacaattcagcagtattctcagcagcagagtattttacttcaaagtcctagcagtttcagtagagaatctgatataagatactttatggaaagtttttataagttatttcccactggtgcagttttaaatacagtaatcacatttacccccacagtctccactaaattatgtatcaatgaggctatattacttgttactttgttgagtatccttaagggtaaaaaacatttctgaggggcaactgatactgtttttaagacccaactcaatgccagttttatgataggaatggctctcctgaccacacttctttctagctgggtctagagacaaaatgggactggagataataggccatgaaacaagtaggtgaggaaaggttttggagcaaggtatctttagaaaggaactaaagattcacttttataagctcttctaaatattttgaaaacatttaaaagaatgtcttaaaattattttttaatgaatgtgtgctaagttgctttagttgtgtccgactctttgtaagcctatggactgtagcctgccaggctttctctgtccatgggattctccagggaagaatactgcagtaggttgccatgtgctcctcaggggatcttcccgactcagggattgaacccccatctcatgtctcctgcattggcaggcaggttctttaccacaaatgccacttgggaagtccctatttttaaatatgtgtcattaacctaaacacatgcgatattgagtttgcttagattcattcggcatatctgttaataagagtaaagacatacatataaattcttttggtgtattctactgttcttacaacacattctcctacctacactttcctcttaaaattgtgtctttttataattctacatttatggaacaatagtcttaagcccctttggtacttcttgccaacagtaagtattacattttcttgtttcttttccagattttaccttcagagtagctgtatggcactttgaaatggaggtatatttagtaatcatgttattttaacatttctagcagcaaaaggcctaaaaagaaatgagaaccaagattatatcttatataagctcaagttagaaaagatcattatctgaattgttcaaattaatgcaatttgtgttatttatcttaattaatataatgaaattaagtcctaaattattttaaaagtggaaattgtgaagatattaaaatttgaagttgcttaaattcttaga

SEQ ID NO: 50155 - DNA, 847 bp, Bovine  19866881298993
ggaggaaaaaaataatctctttccactctttgtggattttgttcataatatttggtctttaattaggtggatttatttgctttcattcatatatgccagaattatgtgaagtgtatgcttatgccaaattcattttcctcccatcattaatattggtaaatttggaccattattagatagaatttatggattgaattagtagtcacttgtcacagtcttttaaactaaaagtcaaaaggatattttatactgtcatggacaaaaggtatctgtctagcattgcacttttgtggtagaatggctgtaattagtctaccagctatgggataatcagtattatggtacagtttcctttatagcaaagaaatatcacaaaagataatgttgggattcaggtttgtcttaaaagattttgtttataggacggtgacataagaaaattctcagagaatatttgttcacaagttattttttgatgacagaagaaagaatgcattctatagaatcagaaaacacacagacaaaaacgagttattacctttctgttgggagaactcaaggtaaccctgtctttacaagtcagcatactaggaagctagtttatatagaaaaatagtttaacatggaaaattacactttaataatacctactaattaaatgcctttattcagtaaaatagagttctcactgcctgaaagctataaaagcctcctggaatgattgattactctgaatttctgtagccttgagtaaaccacaggcaaggcatacattttattgattctgggactgaaggtctgagctatttacaagacaatttaacaataatttatttaactctttgca

SEQ ID NO: 50156 - DNA, 1375 bp, Bovine  19866881320227
tccctcttctgacctgtcttttgtgttctttcccgaaagcctctttgttgttgttgttgttcaactaaaaattcagatatttctgggaactgtggcaaaaccatatcttcccatatcttgaacttgcacagttgatttccttcagcaccttagtgtaggacactgcatttatccatgttaaattgcatcttttttggtgtcaacatggcctgtcagcctgttgagggaattttgaattttgcattggcctattaccatattcaatatcctttaccacctgtgtcattgaaaattctgatacacattcctcttaggtctacttggatgccattaataacagtattgaatagagcagaacccaggggcagaggtctatggcattctatctgtggtcccctacaggctgaaacagaattttcaagcctcttagatataaatttacaaccagctgggaatccacttaatttttctctcctagaacccaccatcttatagataatgaaagacttcatcaagagctttgttgaaatcaaaaggcactatatctatggcattctcctggtctgtcaacctcatactaataaccctgtcaaaagaggaaattaatgtagtgcagcaagaacttatttttaatgagaacactgaagtttgaagagaggctgatggcgcaggtgtcgttttggagaaaagatgcctggccagttgctgagtgagccatttccagtggtgacgtgacgttgatgcgtgaccaagttccagaggctgggctcagcccttctggttaaaaaaactggactaaatcacacactgaatgaatttctatttattgagaatcattctgtgctgggcactgggcttaggtgcttttcatatatctcgtttaatgccaacactaaggtaagtactattttttttttaactcccattattgtggatgagttaggtgaagctgagcgaggctaaataattgacccaaagtcatatatagtaagtgccagaatcgcggctcacactcagtcaccctgacactgagccctgctctcagtcactgtgttctcctgatagaatcttgtgtgcttttgtggtgttgatttagttgacgtgagaacagcatagcagcaaaatttgcagtctgttaatgtattgtgggaaggcttccctaactgtgatcaaaggctccccacccccaatctttcacacttcctttcctggtatctgggaaccgaaaaaaaaaaaaaaaaaaacctgattctgtgattgcttcctgatgcacatggtattggaggaagaggaattttgagggatatcttgcttagatcaatacgaagcctgacgaaatagtctcttgagtgcatgctaagtcatgttagtcatg

SEQ ID NO: 50157 - DNA, 817 bp, Bovine  19866881330824
atgtataacgttttcctcttaaatttatatcaaaacaaaataacatcaaagatgcagttttagaatgcttaaaatactggggaaaggatggagaaggttctgtaaataactcccgctagcacatagaagttatattattttaacgacagtttggcaaatcctctagagctttttatggaaactgttgcaagctcaaatgttcaaaacatttacttccttgttatatttttaattattccccaataattttctgtactcgacagctgaattggtccaagagtgactaggactgggaattctttagagaccagcaagtgtctctgtgccatggccatcaccaacaatcccaggtgaaaagcaatgatttgttaaggcacttcttgctcacagaaagcaagaggatgaaactctccccattactttaaaatataatttattttcactggggaatccagacataggctcatgaaattaaaaaatgcaagtgtgacacaccaaattaaatagataattcataaaccgtcttagatgtgtccagagctcactcttgatttagtataatacgtaaggtggggtttgaatgagcatctcaagaataagccagctcctgaaagacagtagtctgtgggggaagtcttctgaataggctaaggtagtatgagtgaacactgaaatggagacaaaacatcagttagcaagaatgacaagatgcattcattctctctaatttgtcccctccttctttcattcattcactcatacatctaaaacatttatttgggagcaattatgtatttggcattatgttttaggataa

SEQ ID NO: 50158 - DNA, 1540 bp, Bovine  19866881344456
aaaatagtaattttggagttaagcagcagaataattgaactgaaaaatcactgagggaagacttaacagaataaataataaggaaacttgcatataagtcaattgagattaataagtttgagaaacagaaggaaaagaagaatgaagaaaaataaacagaatgtcagagactggtggaaggctgtcaaggatgcaacatagagaggcttccctggtagctcagtggtgaagaatccacctgcaatgcaggagatgtgggtttgatccctgggtcgggaagattccctggagaagaaatgacaatgcactccagtattcttgcctgggaaatcccatagacagaggagcctggcaagctccttgtccatggatacaagagtcagacatgacttagcaactaaatcaccatcatttccacatatgtacaatgagaatctaagaagagacaaaaaagtgaaaggggcataaaggaataatgactagaaacttcccagttttgatgaaaaaaattaatctgcagttctaagaagttcaataaaagcaagtaggacaaagttaaagagatccacacctcgacagaccatagtcacactgcccaaagacaagacagaaagagaaccttaaaaataataagagataggtgactcatcaggttccagtgaccctcaagaagattagcagcttatcaaaaagctagtatctagaatgcaattgaagagataataaaaatgctgaaagaagactaagattatcaacaaaaatttttatattcagcaaaactatcctttgaaaaacaaaggataaattaagacatcatcagaattcatcattgggagacctgtccagcaataaagagtaaagggtgatctttgggatgaaactaaagcacgctagactgtaactcaaatccacatgaagaaataaagagcaccagcaaaggtaactatatttataaaaataaaagacagtttaaatatattaaattttttttcttgtaactattttcttcttcagtcttatttaaaagacagttgcatagaacaataattacacaaatgtgttgatgggtttataattatgaagtctagcatgacaataacaacacaaaggaggagaggaggaatggagctatattagtgcaaagttttatatgtaactgaacataaattagtattaatccaaactagattgttttcagttaagatgttaattgtaatccctagggcaaacactaaaatcataagtttaaaaatatagtaaaagcacacaagagaattaaaatggtatactagaaaatatgtatttaacataaaagaaggcagtgatcaaggaatcagatcagatcagatcagtcgctcagtcatgtctgactctttgagaccccatgaatcgcagcacaccaggcctccctgtccatcaccaactcccggagtccacccaaactcaggtgcatcgagtcagtgatgccatccagccatctcatcctctgtcgtccccttctcctcctgcccccaatccctcccagcatcagagtcttttc

SEQ ID NO: 50159 - DNA, 769 bp, Bovine  19866881374203
gtcccttggactgcaggagatcaaccgtaaatccaaaaggaaatcaatcctgaatattcattggaaggactgatgctgaagctgaagctgcaatactttggccacttgatgtgaagagccaagtcattggaaaagaccctgatgctgggcaagatcaaaggcaggaagagaaggggatgacagaggatgaaatggttgggtggtatcacctactcaatggacatgagtttgagcaagctccaggagatggtgaaggacagggaagcctggcatgctgcagtccatggggtcgaataattggatacgactgagagactgaacagcaacaatattacttttagaatttttaagcaaaggaaaaaaataccctaaaatgccattaaaaatcaagaatggtacaaaccttcttaaacagaagctgcctttgtccttcagaattataatgccaagtctacaaaacttaaagctggaaatacatcagtaaacaaagtccaggaaggctgtctgagatgtaaataggattaaaaggtgatgaagtgagagagattgagaacattttgactttttattaaagctctggtaacttagactcaatcttaacatgttttaaattgtctaatcatgtgtgtatttgctagagagagctgtcccttaatcctttataccatatttgtaattttttaaaatggtagtgatacaaaaatacttctcattatgccaagatttatggaatgcctataatctcaaatactgagttgggtgctcaggg

SEQ ID NO: 50160 - DNA, 917 bp, Bovine  19866881573379
atacagggactgtaactgaggacacaaactcaagacctagatgggaggggtgagttaggatgccgaggcctatgaggacaagtcgtgtgcctggccgtgcttaactcagaggctacaaagcttgagtgtctcggttgtaactggcaatgtcattcgttggtatggaagatgtattttctcagaaaatcagttaagtatggatgtcagtttcctttctgtggtcacttgttaacaaatttattaactagatgatctagtacaaaacaggtctcatctgaccataggaaaaatgtttttatcacaccaactggtttaatttaaatatgaaatcaacttgcattaaacaaaattatataattcaaccagaaaagaaggattctctgcaagaagcattttactcatgccttagtgactaaagatttatatggaataaataatattgctctagtactaggctcattaaataaagattaacagaagtccagtccttgcttgacaaatttgctaagactcatgtttattcagtcagtattgaatctatttatttcccttaatgcatagagcaaagggccttacataatcgtagtggtgactcagttacataaatgaatgaatcattaaatgagtgaatgaatgaatgaatattatccttaaaagcaagtggctataatggcagaaaaatcccttatgaaatagtcacatgccatcaaagataatgttttcttatctgcctttcatttaattttaaccttcacaggggaatttttccatttttctggttactaggcaacctgttattttgaatcacttagtataggatttgctcgctatggatgctcaataaatccattttgattaatgagccatttacagcaacaccagtgagaactgtttccaatcctgttgcaggagaatag

SEQ ID NO: 50161 - DNA, 971 bp, Bovine  19866881580348
ccctctcttcccgaatatgcctatctcttttctcatgtcggggccttgcacctcctgctccttctgcttggaattcccttccagcggctctcgtcatgtctgactgctccttctaatccttcatgtctcagtttacatgccacttcctcagagaagctctctttaccagtctttttaacttaggtctttcttgtgtttttttttttttctgtagcactctattaatgacctttagagtagtgttgactaactgggggaccttgggcaaattgttagggtctctctgtctttggttcttcatttgcaaataagggtaataactttacccaacctcaggagttgttgtgagtaatcaacaaggcaaagcacttactagtgtttgacatacataaaactttgctagctaataattacttgcattatttttattaggttatttttctgttttccccaatagattataaactctgaaagtagagggatcttgcctgtcctattcacagtatatcccaggacctggcccagtgcctggcacatagtcagagctcataaaatattaattaaatatatgttgaataaacaaatgagtggagtgcctacctcagtggtggctttgactctagattaaactgccagtttgtttccagtattaaatggcctcctttctaagctgccaaattcagcaaataaaaatacacgatcccagttaaattggaatttctatattttatctggcaaccctacttccttcactaccaccttcacccttaataagcaacactttctatctctcctcctccctctccctgcctttctcctcctctttgcttctctcctttaaagtttatttggctatgtctgaatatagctcccagtgtcaggaaaccctaccatccttaaatctggagatgtctggtctttgagggactaatgagtcacctttattatatgtctccaattcccagagggct

SEQ ID NO: 50162 - DNA, 953 bp, Bovine  19866881597656
actgatgttattttggctggagattcggaaaggtctcatggaagaggtggagttctgtcaggagttctctgatgggttagtaaaacttagaaagaaatgagtgtgaaaaacatttccagagttggaagtaggaggagtaaaaggtattgataaaaagatgggaaagaggcacatttagaaagagttagtttgaatagaatagaatattcatggaggtaatgctaagaaatggaggacatacatacaacaaatttgggctctagaatcaaacaaatctaatctgaaatcctgccgcagtcaccctcagtttcatcatctgtgaaaaggtgcctttctcatggtgtttttgtaaggataaataaaatgtgtgtgtgtgtatgtgtgtatttttgcctggcacatagtaagtgttaaagtaattgttgctattactatcatatacatgccagataataataactataagtagataggtggcttgaggtattattgtggaaagtcttgaattaccaagtaattaagtaactaagcaactatcaagtaagcatttaataattattagtgtaacaattcatgaaatataattttcaattgttggcgttaagtcagaaatttgcaaagcttttctgtaaaggtccagattgtaaacattttaagctctgaaggctaggtcatctcttttgcaactattcagctctgccattatagcacaaaagcagtcatagacactatgtaagcaaatggctgtggctgcattacaagaaaactttattaaccaaaacaggaatggtccagatttagttaataggccatagtttgtaggtcctgtcataagtatttcccatggaagtgttctccctctgatggagacacctagaattatatatcatacatctacttttccattttcacattatatatgaacattcttctcactatgcaattaaaaacta

SEQ ID NO: 50163 - DNA, 1146 bp, Bovine  19866881728357
accccatggactgcagcccaccaggctcctctgtccatgggattttccaggcaaaagtactggagtggggtgccattgccttctccgatacaaggcattaatggtcagcaaatatttattgagcatctatcatatacatttagaattatgcgtaatctctggaaatgtttaaaaaatgagtaagatgtaatccttgcgctcagaaagtttgtagtttaccagaaaaggaaaacagattatctgcattataaatttaacaattaatcagatttacttttgatatatattacctttataaaccatacttcattatcaaaagaaagaaacaaatgaaaaaataaactcattttcaaaaaagcttccaatatatatccaaggattggtaaagatttagtacaagctcctattttttttctttaatgacacttacagtatagtagagtaagtattcaaggtcagagtaattgctttcagaccataccagaccctcgcacatcagagtcaattatgttcactctactctattgaaagcaggaaattgggagtaatttatttctaacaacaaagggtggcaaagttgaaagcatccagaggaaagcaatcaggatggtatatgatttaaaaaccatgtcacagaagaaatgatgaaaagaactgcagtgttctatcccagagaagtcgtatagcagcgtaatagctatctcaatatatttgaaaggctatccctcacaagcttcccacagagtgggaaagggtataacaggctgtggtagatttattctaaagttctttgaggcagaataaagaaaaatgtttatcagtcaaggagggcaaatttagatcaacacaaaaaacaattttctgtgaattaataatattgcttatcttctaaaatagatgtgcactgataaaataattagctaaaagatagcactagaaagcaacacaatgaactcctcataagtggaaatgcttagttactgataaaattatgtataaaagacactgtacaatgactataccaggtgactgtaagctccacgagagctagaatttttctcattcacattctatccccagaatctaatataactcctgccacataatgggtcttcagtaaatactaattgatcagctgaacagtct

SEQ ID NO: 50164 - DNA, 661 bp, Bovine  19866882083820
taatagttttgtgcttggaagcatgaatgcataccctcagtaattttaaatgatacaggatttatttttagccatatgcccccacctgaaaggtttatgctgttaaacattgatattccttgaaaagttatgcccaaggcatattgcttcttttttccaagctaggaattgaaatgtttgtgaaacttactgaaaatttaccagatctgaaatcagagttcatatctcttattcagtaactaataaaaatagatttatttgatcaaccatccaatatttatttgcattgcattattatggctactctgatgacattggactatacaagatacactcctgtggctccaattgtgtctcaagatgttgttactgggtacttatggggtgacatggagaaggatatggcaacccactccagtgttcttgcctggagaatcccatggacggagaagcctggtaggctgcagtccatggcatcacacagagtcagacacgactgaagcgacttagcagcagcagcagcatggggtgacaggaatcacattaataagactcagggctcaccttcagagtccattcacagtctatctgtggaaacaaattcatgaaagaaactccaggcgtattaacacaatatggtaaggtctgtagaaggtattaa

SEQ ID NO: 50165 - DNA, 1607 bp, Bovine  19866880425933
actgaaagcaatgataggactgaaggaaagtttataataaaagtcaccagggatatcacttcataaacctagaaaacaacattagaaattgaaatgggaataatgaaaacggcatttgaaaggaatgtaaatgggaggcaaggaaagaattgttgagacacatgaaaggaagtcattacttctgttgagttcctataaatactgaaaagtgttctccgttaaaggggctggtgccacagcgaacgggatgggatctttcccctctgcacacgggctcaggctgtggttgggcgactctccgtgttcctatgccaggtgcggccggcctcctgctcgaccaagagtgcggcctgagaggctcccacacatcaccggacctcagcagctgtgcggtctgactgacagctgtgtctggtggaagaagtggggacagggcactggggggacacagtccatatggactgtctcggccaagtgcaaagcctgtggccttccctgcacggagaagatagtcctgcaaagcgttaaccatctgcggatggttcggtatctgcatcgaggtgcgttccaccgtgattcgtgtgtgcgagttcattagtatctggacattttgcagactgtaaaaattcaaatggccttgacagttgctctccttctttgcgtgcctttggtgtctgaatttgggtgccagtgtgagtccgtgtgtcgcacagtgaaagtgtgaacgacgacaaatggtttgggaggaatctcctgtgcctttatgatcgtcacgtgcctctaaacaggacagaagaatacagcagccaaggtagcgcacgtttagtcctcccaatgtagtcggtattccgcagctcgagccctgagcaggactcgatttcatcaagtctcaggagcaaggtggcagaagtctgtctactcaggggccactgagcttataaaaacagtcgttcaaaggaaccaaaaggatgctcagcattgtagaatactggaagcacacaagctttggagcgagacagattccacactcagctacttgtccactgtatctccttgagcaagttatttaatctctgtacctcggtttctttatcagtacaatagtgtcagtcgtgtccgactctgtgcgaccccatggactgcagcccacaaggctcctctgtccatgggcttctccaggcaagaacactggagtgggttgccatgcccttctccaggggatcttcccagctcagggatcgaactcaggtctgccacattgcagggggattctttaccacctgagccaccaggaagtcctggtgatgcctacatttaagacagagatacctacaaggagatcccaccagcccatcctaaaggagatcagtcctgggtgttcattggagggactgatgcagaagctgaaactccaatactttggccacctgatgcggagagctgactcatttgataagaccctgatgctgggaaagattgagggcaagaggaaaaggggatgacagaggatgagatggttggatggcatcaccaactcaatggacatgggtttgtgtggactcgggagttggtgaggacagggaggcctggcgtgctgcggttcaggg

SEQ ID NO: 50166 - DNA, 2075 bp, Bovine  19866880515588
tgggcttccccctgttgctcagctggtaaaaatctgcctgcaatgtgggagacctgggtttgacccctgggttgggaaggtcccctggagaaggaatggctacccactccagtattctggcctggagaattccatggaaggtatagtccatggggtcacaaagagtcagcatgactgagcgcctcccactctcactttctctaagctttgtgtctttcctctcaaatgccacagcccctcacaggatgcagagcacagactggccctgccagggtagactagctccacgcaggctacctctgggcctccattctttcatcatgaaatgaacagccttgccggatcagctctccaaaggattgggtatctaaagctccttaccatgatgagtctgacccatattggttctgtagcagtatttttttttttttttctttagcaagatgtctcaagctctgaactactcacttatgaaaaattagaaacaaatccattgtaatctgggtattacttgcaatgagcaagggtcttagcacattaacattgattcagaatcaacttgtagcacaaattcgttctggcactcctactgaccttttttttttcttttaaacaattcataaacttcccaaagatctgattcattttggatttttaaaatactattttagtaaaatttctccttaatgaagtggttatacattacacataattcagtgcattatctctttcagctccagtaagaaaacaccaggaaagtaatttcgtttcctcttctgtatataatgagtcttttcatgtttcttctagttaattccttaaaaaattaaaacgaatgacagcctgaaccattttctccacattcatctgtgatgttgtgtggttaatagtccagtctcatatttgcgtgggaccagctgtcaaagatggcaccgtggggaatgcactataattttaagacccgttgcagagtcacatatgtccataaatctgcatcactagaatgcttatgggaagacagtcatcaccagatttgaaaataaatcctttattgctttcattttgaacttcactctttacttgactcaaattatctttatcagataaaggatgaggggccctcataatgagtgaacaagtttttagaagccatctcatttgcacaacttcttaacattcttgccagaccccattttgaacacagccagtgcaattatctccattcccttggagagatatcttcttgacctagtcaaatccacatcttgggtgagtttttcaatacacagaactttgagggaaaatattgggcatgttctacaaacctctctgagcctccaggacttcatctgtgggcagaaaatactttcatgtgggaaaattagacaagatacaggaagaaaggtggtcagtttattatcccttcagcgtgagttccttctccaagcgtggccgtggtatcgctgtttaaaatcggtcaccggcagcctcctctcactcgctggcttccgccccacggccctcctcagaggctgcttcccctcgctgtgccaccacagcggtccaccgtctccagttctccacaggccctcagggaggctgaagacacccccgggctggagttccaggcgccttgtgctggcctcaggacagccgctcctgtcagccttccgcccggcgccgagtgctctgtggccgttcgccgtgggctggttcccgcattcccctcacggtctctgccatccctcaccagccttccctctctcagcagacggcctttcctcccacgacgctaaaacctagagactccaggcagcgctcccgtctcagctgctgctgcgcgctcacccaccggcactccgcgtcggggacctgcagtcttgcgctcctcactgacttctcctcagcacagaaacgtggccacgcccttccagctccggaagaactgtctgtcgcgctttctccttagttgccttcaccccccagtcctgctaatatttctcgttcgctgccagtgtttctgaaagcgtacccggccttattgccctcttttccatccagtctgggtggctctc

SEQ ID NO: 50167 - DNA, 1104 bp, Bovine  19866880537301
cataactcctaaaatgtccatttccctcttaggaagccaacagaggtaaactttattggtgatactagaatgtatgcacaatataaaaaagtaaacactgtgctcaatgttttgaaaacagaaaactacgtatagggaaattttttctgtcttttagaaaagcacctttagaaaagcatgcttgaactaacagatacgtggtgagataaatgagtatctcaaacaggtagtaattcaagtgttttgagttcgttataccaaaaacacttattctgggacactgagtcaaagaacaaactactacgagagctataattacagcaaagcattgaaaataatcaacagtgactccagcttgaaaaatacctaaataacggttgtcgtaaatagcttttctctacaaactgtatcttccaactacttgcttgccttcttcttggttgaacacttttaaatacaacataaaaatacataaagaggaaagtacagtttctgtgcacaataattcaaaacaaatgtttctctgaaacaacactttttgttcagagtttgcccattacaaaataaggatgtttctgaaatctctgaattcttgtgtgatacagaaatttagaagacaagccattaaatttccctaaaactgagcttttcaaagactgaactgcaagtgcaagggaaaccttaggcagtttccattctgaagagcctactttctgcattttttttaagtttcccagttttcccaggccagttctacaataagctctacagtaagaatcatgcagcagccttttaaaaataccaattcttgaatcccatgaccagagactctgatttaataggtttggaatggggtctcacttcagtattttaaagctctccaagtaactctaatgtgtaagttctgctataacaaaacatttgtgtctctaaatcactgtgacatgcaaaatcacacagtaaaaaccaaagaccttatgggaaacccagtgttaaaggtacaatgctcaaaagcgtcttcagggatattaattgactataacttttttaagattaaagaaaacaaagatacaacaataaaaactttacatgatcttgcttgca

SEQ ID NO: 50168 - DNA, 1138 bp, Bovine  19866880557404
acattactttggttgcaatgtatttcagatttatgtttccaaagggctcagttatctgacgagaacaggagcatattaaatctctgcataatacatttctgaaatggcttgtatctaagacaccaagcagttattaaatcttgcttttaacccaccagtcctctaaatcttctctccacagcttgattcccagtagagaaaaaagtaactcaaacaaaaatcttcctgtttactgtaataagctatttacttatctgtgcacaaggttgagaaattatggaatagggattcatgtatttgcccagagagtatcttgcatagacattttgtttaaattttcatttatattttcaattcataaaaggattatatactttgacccacttataaggagagaaaatagagcactatgttcccacttgctatttactgaggttgacaagtcactctaagccctctgaacctcatttagtttatttgtaaatggagataacaatactgcctggtagagcaaatgatatgatgttaattaaagtgctttgacaactataaatattatgtaaatataaaatactgtgtattgttatactactttaataagaatgaaaactagttggttatttccccatcatgccttttgtaaaataaggacaggacagaaagacactattttgaataatctaattgttatgagaagtctcaaataaaaaatttcttaattaaaatattatagatcagagctaaaatttagaagccatttaacccagcaactttagttttagatataaggaaagaaagacccatgaaggtaaatactaaaaacatacacacttacgttggggtggaaagtcacagtggtggaaaggggagaattaaacacaaacgttacgtttcccaatttgctgtcatgtcacacttgactgaagaaatctagggttagggttagagggcagggcagggcaagttccaaggctgtgttaaagttctgccagattataggagtcattttaattggtcactttattttattggccaattataaaatagtaacaataaaaattataacatgatgatgagaatacacaggagtagttataatgggttaagcaactcactccaatattcttgccaggaaaat

SEQ ID NO: 50169 - DNA, 876 bp, Bovine  19866880559045
cgtctgaggagaagcagtgcgcggtttaacctctgtgccggggttatggtttctttatctacagatttcagtttctttattggctggtgagcccagtttgaccctcttagtttcaatttctgtcagcaaagggaaataatatttttctcggatggtattaagtaatcagtaatgatgcctggtgaagcttttcactgtgatgtgtaactgtatagttcagtactacttttaccatcagttcttgtgttttaattcagttatctggaacacagtagtattttaggattttagtgcctgtcatttctatgtaagaatggggttccatcttaagtttgttagttaccgcatatgtttatatgctcttttgcagtttaaatttaattgcctgcctcccgtaagttgctcagttaatgaccctgtattttaggctgtcattcttccagattcgctacattaagaaaagtaaattctggccttcagataagaatggaaaatgtccaaaaggaacattcaatgattttgtagcttcatatattttttcttttatatttgaagagaatttaatagacataatttctgttttaatgttacaaaattcgtagttatggtgttctaaatactagtgtcttagagtcattgggtaagtaccatttataagaatcatttcttatatttgtaagttttatgttaccttgatttaaggagtcataaaaatgttagaggatgtagaatctattggtgtcatcctgtctaatctgtcattttatatataacaatgtctctgaagaccgagataattagtgactcatgtagctagctagtgacttgtacaactgtaattttctgtagactttaaaataaagtctcgcttccttc

SEQ ID NO: 50170 - DNA, 1058 bp, Bovine  19866880632646
ttcagatgaaaaatgaattggaagatattaatgtctacagaaagttatacaaccttttttcaattaatagtatactaataggaacagaagtttataagtaggggatttgagtagacatgaattaaaagtaagaattgtttccctttgaaagacaaaagtataccatacacgaaagtattttatgaaacctgcagatataataatgaaatatttgctaaggtgacaaatagaagtctttcccaaataaccattgggagcaaagaacttttgaattatttagcattaatttgtagagtatttaaacaggtattcaattactaaaagctattcaagcggagtccatagtggcagacttctttgcatacttgtcaatgaggatttttattctaaagcaaccctgataactttaatgacaaagctgatcaaattctgagtaatccttggactctaaaaatacgccgtggctgtgaccttgagtggaacaaatgtgctaagcaggccgagcaggtaatgaagcagacggactgaaaagctgtgtcgaagagaaaagtagagaacaattacttctcagtatgaacagcagaaaaactacagactctgacaatcattttatgtcctgtattgtggcattctgttaattattcctcctaaagatcatagttgggcttgtggcttcaaaataaaagctcatgttgtcaatatgttcagaaatttatctgctttaggtgttcagtaaattgtaaattgtgaatctaaattgtagttagttttcttcttaaagtctgtgttttttgccttaaaaaacaatccattatcctggatggttatttccatccacttgaccatggatgggtaaagcttatgttttcactgttttgggtaactaacttcttaagttggacctgtattacttggctcttgcttgggaataggttgtattactgtattagtgagttgtcctgtaattggttaaggtagaagtcattactaaaaaaaaataaaagtgaaaatatagctttaaaatttatctcttctccaccctaggaagaactcctttt

SEQ ID NO: 50171 - DNA, 690 bp, Bovine  19866880704350
tatatacatatgtgtatatgcatgtgatagaagcaagaaatactacaatttttttttaatgacttgaagaatattcactgttcttagcatctggctcttttgactgtaactgctaattgacctagagtctcatttcaaaagagaatctttctgttttcagactgcctacttttgaagtgtctacttttgaagactctgaaagtacctatttctaattcatcaaatcataatttaagatatcttcaaacttacattttaatgaatcacttttaagtagtacatattaacattattttaaagaactcacttggcttcttgtaagaattttattttcagttcctgaggaagatcttctttacacgttttaacagcaacagcagttttatcctttaatacgcccttaaatacttcaccaaaatttccctgaaaatacaaacatatttatcatttggtgtgtaagacagtcacataagtctttgcaaaattccaggcaagcatgtaatgatgagttttgagttagagtactctgttggctttattcaatttcaagtatagataaagacttggcatgctgctctttccaattctccaactttaaatatactattcaacactccagccattcgggagactgaggcttgaggggaatgggaaaggaaagggaaaaaactgtagtaggtaaaaggaaag

SEQ ID NO: 50172 - DNA, 1101 bp, Bovine  19866880833821
cccctttagcctccctgcccctcccattccccgctctaggtcatcacagaatgccaggctgggctccaggtgttatgcagcagcttcctgctagctctgttttaaacatgatggtgtctatatgacagtgctactttctcctggcctttctactaatgtctgttgacgagtttccttttgttctccacgtgtaggtcctccacaaagtgggacatgtagcctggtacccgcacagtggggttcataaggtctagagctgggctgatgactgcctaattatgcagggaatctagcaactcttgaagaacagtggaaagtaaggtcaagtctaagtaggcctcttctttctattctttctggagctgatattttatgtggcagattcaatgattgcatggatgtcatcagggttagacagagactagaaatacgtgtcttaattgatcatcaaacgtttctggatgtggtgtcagaaaggacacttgtgtgtccacaagttctttctctatgtctgtgcctccatctcctctctgtacgtagctttgtcagtactgtttttctagataccatatatgtatgcattaatatatgacattcatttttctctttctgacttacttcactctgtataacagtctctaggttcatccaccttactacaactgactcagatttgttccttttcatggctgtagctcagcgtcctttgggttccaaaactagtagatgatggaacagtctcctgacagcaaaaattaataattaaaatgattaaaatttgtgcacaaaacttattgaaaaaatatgcatttttaaaatgttactacaaagaaaagtaaataattctaaatacatttctataactgcattttatgtaattcctaaagaataatgcatataaatataaggctttttacactatagatccagaatcatatttttatcactgtactgggcaaagcatatttgtagttcagacgagggtagatatttatataagtatcatatcacttatgattacatgtaacagaatccttggctagttatttctgtatgtttgataaaacatcctatgatctatttagtaaaattctcccccaa

SEQ ID NO: 50173 - DNA, 1425 bp, Bovine  19866880871938
gaatcgagaagcagaggaagcgtagtgtcataatactgattctgatgaagctgtgcccccttcagtgccaaaacatactgattatgcaacatatggagtttcattgtggctttgtcgtaacgttccttagccttttcagtttctttccctgaaaaaaaaaaaaagttgaataaagttaagagataatttaaaagttctatcttcactatatgcaaactgagttaccactaattcatgttatctcacacattttatgaataatcaaaaggctactgaacacatgtttatttgtcagtactttgtacaaaggatgctctgaagccagtgtaccctgcaggagctgtttgatgaataaaggtcaatatacaattttttttgaaaaactgtacagatatacgctccttctcatcttcaaggagcttacaccaaatggaatgacagtgcacgtgaaacagcattgccaagagaacaagaaagtttgtaaaaatgttaaatttgaaggtctacttttgagatgtaagtcaagaccagggaagtcagaggagactgtggagaaaacagaccttaaaagataaggcaagtctggaaaggtaaaagaaagacaggagagacaataatagttccttcacctcactctctttctccatttcttccttcgtttcattcaataaatatcattagctgctcatccccaggaactgtgctagacattgggaattcagcatttggcaaaacagagtctttgacaatagcccatggtctggtgatttggaatattgagtgaaaacatggggagaataagcaatgttacataggcaagcaaatcaatagctcaaagatagcaagttttgaggaaacgaaggaaataagctgcatagctcagatagttttaggttgtgaatgacttgaagatcaagcagagaaatttagacttgatacagaacaagtctagaagatgacaaagtaataagaaatttctatgattcccttactaaaatcattcagaaaatatttacaggttgacaatataaatgaatgatgatacaaacaaataaaaattttaagcagatcttcaatttttgaagcaaacggaaaaaatatttcttgtcaattatctagacttcataaaaagtttttgccctctatccaaggagagctcaccaaatgaatccttcccccaaaataaatcttatgttgagaattcttgatgcaagaggtttttctctgcttccactctgtttagactcagcacccatttgggtattccctatagacaggagtctgaaaagcatctcctgttggagacagcaatcctactgctgggcatacacaccgaggaaaccagaactgaaagagacacgtgtaccccaatgttcatcgcagcactgtttataatagccaggacaggaagcaacctagatgtcc

SEQ ID NO: 50174 - DNA, 2999 bp, Bovine  19866880921647
tgttttgtattgtgaaaacagcaaaaacatcatcaatctcagataaacttctactgttcttaataagaaaaaatcaataaatatctttttcttatttctaccttaagaataacaccctaccttcctgctgtatcccaggaataaaaacaattgcagtctttgttttcagatttaaaggcaagagaagagctttttcctctgactctacaggtggtttctgaaagtgttctccaggtgacctgaggtgaccgacaagtttattttgcatttacacacaagtttaataggacctgcatattaacaagagtaataacttgttatagcaaccaaaaataatttttgtattcacttattacctgtatacaactctttcaactttctcatctgtttacgctttggcttaccatagatgtaactgatcgtgcgtcttcttcataattgactactggaggtggctctttcccatcattttcttgcactttttgctccagcaattctttctgtgctgtaaactttgcctcggtgcatctcagctgctggactgactgtttcagctcttcaagtgtctgtttttggcttagcagaagtacaatactaaaagagaacacatttaatataaattatttcaactactctaagaaataaagactgtgaaggaaatcatatcctgtatatgtgtagattatgttcctttcttcattttcctctttataagagtctttcagaactataagaattaggaaactaaacggattttgagtcatcacagtagttgttaaacattagcatttacaaaattaaaggaagtttttggaagcaaaaaccaaattcaaaatgctttcaaattattacgatccatggcactcattttattttacagtaaactgtccacctcacaaagtacagatatgtcggtccagaaatgcagagcctaaatgaattaacatgactgaagcagaatcttaatttattttaaatctcaaacggaatatagctaaaatcagatctctgcctagagaataaatcaaatcaaggtgacagctggaagcaagctgtgtgcctattgtgaggatcgtgtgcttagagctagggcaagttttctgacaaggactaccgaatacgtgtaagccctcaaatcttccaatatacaccagtagaaagatagtagacctcttcattcctcctttagagttttacccttcaaggctgtccctaataggaatttcaaattaatttgcccatcttaaagccacaagaaaacaggtagcagcggtgagaaacatcttgaagatgctgtcatatttagtatattagtatctgaaagaactgtgccacgcactgttgaaagcaagttaataatagattacagacagtttggaaaaagacagtctctttagcaaatgcttctgggaaagctggacagtgcatgtaaatcgatgaagttacaacacgctcaccacacacaaaataaacttaaaatggcctaaagacttaaatgtaaaaccacatgcttaaaaatcatagaagcgatcataggcaacgtggtcctactgcataacatagagaactatattcagtactctgacaaaccaccatggtttgtcagaagagagcatttttttaaagtatattcgtgtataactaaagcactttgctgtataggagaagttaatacaacactgtaaatcaattatacatcaatttaaaaaaattgatcaaatacatgagaagataagccacagactaggagaaaagatatacaaatgacatatctgataaaggactgttatccaacatatacgaagatctcttaaatatcagtaataagaaaataagcaaacttctttaaaaatgagccaaagaccttaacagataccttacagatatacagatgacaaataagcatgtgagaaagtgcttcacattctatactatcaggaaaatggaagctgaaacaacaatgagacagtattagacgtttacgaggaaggccaaaccccagaacactgccaccgccacctgttggcgaggctgtggcctggaattactgacgggcacgaacaatgggcagccactctggaagacaggctggcagttccctgcaaactaagcatacttttaccatgggatccagcaatcctattccttggtatttacccaaaggagttgaaaacttacgctcacataaaagcccacacatggatatttacagcagctttattcataactgtcaaaactgggaagcaaccaatatgtcagtcatcagaagaaaggataactgtacaagagaatacgtttcagaactcaaaacaagccactagaccactgaagacatggaggactcttaaaagtacatcattaatcgagagaagccagtctgaagggctgcataacgcacgattccaaccacgtgacactctgtaccaggcaaaactatataaagagacagtaaaaggaccatggccaccaacagctggggctgggggatgcactaatgtgtggagcacagaatatcttagtaaaaaatgccctatatgatgccataatgatgggcataggtcattatacactaattcaaacccacagaatgcacaccaccaagagtgaagcccaatgcagactacggacttagaatgatactgatgggtcattccagattcgtcagttgtaacaaatctgatgctctggtgggcagtgctgataatgtgggagactatgtattgtgggagaagtatatcggaaatctctgtaacttcccctcagttttgctgtgaaatttaaactcctcaaaaaaagtcttaaattttaaaaatgatgtatctgtacagatttaatagaatggctcggataaaaagtaatgacaagatcaaatgctggtgaagatgaggcgagattatcactaatacattgctagtgggaatggcatgtgcatgcatgctaagccgattcagtcgcatctgactgctttgtgaccctagggactgtagcctgccagactc

SEQ ID NO: 50175 - DNA, 876 bp, Bovine  19866881005592
tatttccaattggaaaggctgctgggccagaaaaagtgacctttggctgagtgaccacttgttacttggtcagcttcaaggctgcctgccattaggaagaaccaccaagtaataaactattacagtgggcacttatctagcccctacaggacactttctggggaggacaggaaagcaattgattttctctattcgatagtcctcatctcatactttggtcatctaactgcctagtatcacttctgttcaattctcagggtaccttatgtaacaaggggggtaggggagggttttttttggacagatttaaaaagcctagagcttttgtatggcataaactaatacctagagccgtagacaggtgaggcacagagaaaaggaaccccggaagaggtcttcttgtcctaaaagatctcatttgaaccaagctataaaaggaatatctaagtgctctccccatccactgaaccatttttattctgatgaattaagaatcatttccaattctggaaatttctttggaaaaatgtgtttttttttttttttttaaaagcaaattcacttaatctctccaaatcttggtttttatatctgaaaaacaggaagttatttttgcttctgcaattgtctaattttaggaagtagatatgcacacacacccacagctggaagtttcaacatactatagccacaggtgaaatgcttgatagcaagttgttcagaatggtccaaacagacccaactgtagggtttactgacctaaagacttcaaggcaaacttttcaataatggaacatattatgtcgtctctaaccatttatagctcctatgcctggaataacaatgtttaggcagtacccagcacatctaaaatca

SEQ ID NO: 50176 - DNA, 1742 bp, Bovine  19866881103200
aaaaatatttgaataaaaggtcaaaagaaccaggttctctcaaagttaaaggtcttgctcacaaccaaagtttcaacttttgaaaaatttgacaattaaagagaaaacatacacagctataatgggctggatgtgagcccccgccaaaggtatatccacccagaacctataaatgggacccttcttggaaaaggagtttataattaaggagtttataatcaaggatctcaaaacgaaatcgacctggattgtccgtgcgggtcctgaatccaaagataagcttccatacaagaagacaaacaggagaggaaaacacacagaagaaaaggtggtgtgaagaaaggggacataggctggcatgacgtgcccacaggtcaagaaatgccagggtttgccagcagctacctgcccgaagcttggagggaggctttctcactcagaaggaaccaactctgggggcaccttgatttttaacttctggcctctagaactacgagagaataaatctatgttgtttttaagccaccaggtttgtggtcatttgtgacagcagtcctaggaaactgatgcacagctgacaaagagtcgctgaatatttaccttgtaacatgatcatcagctgccctaagcgtcaaaaacaaaacaaacaaaaaaaaaaccaagcttacgtgagttctattaatcaggaaaactggtccaaaaattgcattattctcataaattgtatacagtgagattaaaatgtacatacatgcatttttattgttcactcttaccactccaggttttagacacttatctcaggccaaaacaacaccgtgccctcaaatgcactatcagaagtatagctgcagtctcaaagacagtttttcccaacaggaaccctgattactccagaaactatacagcaatacgcacagctcagcagcagcaaggtcacaggacctttttattcatttacagtgcagcaactggaacagtagctaactttttatttgctttgctagcatctattttcacactaattagcacacgtggttttcacatttttggatacagtattgtttccaattataaggcgccagcaaagaaaagaggaatttcaaaggcaatcaaccactaatcaaaaacataagttgatataagtttatacatatagagcatgtagtaaaaagattaacactggaagtaagtataaaattactgggccatagtctttattctatcagatctttttcatggtttatatagaaatggtattagaaggacttttccaagctagctatttttctacttcaaacttttcacttcacgtagttgagaaaaatggagatcagcagtgagatgactcaactcatgacacaagtatgatgacaaagccaactcccttttctactgtaacccctggcttagattacatccacaaagtcaaccaatgctgggcattggtcactcattcagaaatttagtgtgaggtgaggagaaaatgctctaatgacattaaagtagaaatgttacatagaaacaatgactgcattcaaatttagaacacttagtgtaaaagctgttgttcatttacacccccaaaagatgcactattttgaataccatatctcaaaaatgtaataaaaacataaaaataccagtaaaaattttaaataattataagactaaagaatgctgctaataagaacatacactcaagcacacatacacacacacacacacacagaggcactggg

SEQ ID NO: 50177 - DNA, 920 bp, Bovine  19866881144901
atctgatactgtcaatgattttgactcatttcacaagccaacctagtgtttgcgttgtctacttgcttagccaagtctaagttgagagatcagagccctaaaagaggcacaaaaaagtgcttgtctggccttggatatgaatatataagtaaagctatatccctcataatatgaaatattccgtgaaatgatcatagagaaatggagtagatgccctggacttttaacatggccagttattcttttcctctcaaacccccaactctggctgtggagccgattatcccagcattttatagccttagttatgaaaataactacactgaaagctataaaagattaagtggctacgtatgattgttttatgaggtagaaatttgaagttaatctagttgactgttaacttgatctaaagtactgatatttgaaatatgcaagttattatctcaatttatggtaaatattattatgcacttgatttaaagaatcatatcactcttttaaaagaaaatcacaaaacagggttatgagaggaggtaattttcaatcatgagtggggaacaattttcttatgctagttttatctgttacgtatcttctcttggaaagttatttgtcgtcttataaatggaatctctttcctgatttaatttgtgtaggaagttaatgtctttgaccatataatgtgctataaaacatctaatttccatcttgccagacttcatttttagcctacataaagaatgctattttggtctcagtataatttctgtttatagtacctcacgcctctctgcatttgtttccctcttactcatgagaatatacgtgtacatcatatgtcagagtagaggacgtggcgaccagggtaatttctctcttattcccagaggcacatgaaactagacagcctgagttag

SEQ ID NO: 50178 - DNA, 1349 bp, Bovine  19866881406336
ataaagaaagaatggaaaggaaaaacggagggagaaagaggagaaggaaaaaataggagcaagagtggaagaaattaactgagatttattacagttctaatctagcaattacatttcctattatacttttagacaaccaacatttatatttgacaaatgatgcaagaaaatacagttctctgcacacagattttattttcaataagcttttgatctctcaagtcagttgtcacccttatgggaaaaaaagctttttagaattttcttcctctcctacaaatgaacttgcgctgtaaaccaagttaactgctagaaaatcctcttgaataccctgatgatctttagttcaagtaaagaagggaaaatgtgcatgtggctaggtgggtagggtgtgtgactagtagaattgaactgattagccacaagtgatggatgagaacagaatggaaggaatagggaaggagtgagaccttttgagtatatcttttaatataagtcttacctttgaatcaaatcagtgttttatatatttaaaccagtataattataacaacaaggaggggaaaaacctaaaatgggatataaacagaaacaagtgaacctaaaatttttcatatcaaatttgcaacatgaacacaaaaatgcatcaattcaaggaccatctgaacacggtctattgtacgtacacaattatgtgctcagaactgcaaaggaatctggggttttacttagctggtttattattggtagtagtataagtatggcggctcagatggtaaagaagctgtctgcaatgcacgagacccaacgtgacccctgggtcaggaagatcccctggagaaggactctaaaatgattttatttttattatagaataaataaatacatcaatgtttggaacccgagttctcactgtgggagtgaaaacaccataaaaaatggaggtggtgttgaaatggaatagacaatgtgcatatgaactgatgattaagaaaaagaagctcatattttttctctttgtcacgaaatggtctagacataatgacgcatgtggcaatgagcacgttcagtgctcggctttctcattgctgctccccaggaaaagcaaccaaatgtccatggagaaacgatgtgaccccaggcctcaggcaacgaaaacacaaagcaagcctggacgatgttatgctagaagaagattgctcaaggacaaatgacaagccaagaaaaggtcacaagggccagcttgagggcatcgtaccagccaaattgggaatttgggacaacttgagcatcagaaagaataactgtgaaagacaagacattgaattgtaacaatagagtgagcttcg

SEQ ID NO: 50179 - DNA, 1617 bp, Bovine  19866881546080
actgcacggaggcctcactgggccagcagcccagggggcacaggggcctctcctgtcttgtgttcccagcatatgagttctccgtggcactggagaggacctatttcatgagtattaaaaagaaaagagaacttctccatattttgaaagtataaattaaacttcctttctccattttcgcacaagccatgttgatgatatcctgtttcatcatgagtatctaaagtatttattagaaataagaaaaattcacagaagtttcaggtcataacataattgcggataaagataacatttttttcctctgcattggacttgatagaagcttcactaagccggaaagccatcagaggtcctgcagattgactgcaaatatcagccatactccagtcatcacaaaggacaggaaagttttacctcctgtatcagttagggcaagctcggttatgctgcagtaacaaatagcatgagactcttaggaacttaaagcagctgaatgtatttctcatgcagtccatcacggatcagaaaaggagctctgctcacagtcgtcacccagaaacagagcctctggttctaccgtcgcaggggcagggaacttgcgaagtcgtggactggctcttcaagttgttcctagacgtaaccgtcttcacttctcacgtgtactgactacatcaagtcacagggcagtgcgtgagctccacgtggtgggcgtgtataaccctcctgctgggaggaacactgtgtattcgtgcacagtagcacagcaagcgcactggcggttctgcctgctgtgccagtggagtgtaggtgcctgaaaagtttgcttggtttattgtggttttaaaagccaccagcttaggcgtctagacacacatcaagtggacgaggccttggacttcatggaatgctcgctccagtatggctactagagcatggattccaaggttattttggtcctaatttgttagcaccagtgaaatttccatgaaaagtatctcttcgaccatggatttcacatagtagctttaggccgagggaataaaagcagtaacaagcatctctgacaggagactgaaaatagaaggagggcacaagaggctactctaggaacctgtttcctttctgttagggacttaatgggctttctcactaggaacagctttttacctgcgtttttgaaaacgttaaatgcgttgtcagtgaaccgcagtagagcatttgaaaattcagttccacttctttgtttgctcgacttgtaataatctgaccccaactcccttctcagtcgttttaattatttagattatatgcatggcaagtgtgggtatcttgtttaatggtgagtcactgagcaggtgtgggaattagacaaacaaggaggcttcagtccgggacgttttcataaaagaggtagatctttagggactacaaagtggtttggagtttttaaattacaagaactatacttaagggaaataaaaaaaatggcatggcttcgtgaagcatttattaaataagtgctatagtacagactgtgcaaggtgtccggggatccaaagaagagtgagaaatgatcttcccatgaaaggcattcaaagcctttccgagcatacg

SEQ ID NO: 50180 - DNA, 1898 bp, Bovine  19866881627482
tatgtataaagatgttcatcacagtactgagacataacctaaattttcatggtgggagatggattaattaaattatggtctatttatacagtgggatactatgcagtctactactacataatatcctattaaaggggcttcccttggagttcagctgctaaagaatctgcctgcaatgcaggagacctgggtttgattcctgtcttgggaggatcctctggagaaggaaatagcaacccacttcagtattcttgcctggaaagtcccatggatagaggaacctggcaggctaccgtctattgggttgcaagagtcagacatgacttagtgattaaaccaccataactttcatttttttttgctgagattgtttcatttgtttcaagagaatttgtaattattcttgaagcatttttataacagctgctttaaaattcttgtcagatattttcaacatctgactcacctcaatgtcagcgttgtttgattgtcttctctcattcaagttatgcttttcctgtatcttgaaggtatgatgagtgatttccagctatattttggacattttggataacatgttaggagactcttgatcatacccaaatattttattttagtagcagtcactttatttaaacttagagtgtaggttctggccaacttttgtgagctatagttgcaatgacaatttgttttcagagctctttcaatactgatatgggatactttattttggtattatttgggctcttgctttattattgggcttccctggtggctaagtggtaaagaattcaccttcaatgcagaagacacaggttcaatccctgggtcgggaagatcccttggaggagggcatggcagcccactccagtattcttgcctggaaaagttcatggacagaggagtctgcagtccatgttctcccaaagagtcagacaagactgagcacctaacactttaactttcactttattattgtaagtgcctcctgggctgcttagtcagtgtggagcaggtgatgaatccctagccaggcaatatttggggggaaaagtaatgtcaggaaggaagtctaataatactagatattttaaaatgtcacaacaattaaatataataattaaaatactggtgcaacactagagagattatggaaaagcactgaagcattcagaaatagatccaataaacctgtcaaggtagcatttcaatctagtagaattgggactccaccagtgaccaccacttggaaagagtccactttttaaaaagtagccaattaccccaacacagtttattgagtagtctatcttttcccttactgatctgaaatgccaattttttcatataccaaatcaatttcattattttttgagttttttattctattcaaacaatttattctaggaataagatcacactattttaatcactttagctttataatttgttgtattatctgggaaagtaaataacttctcaaacactgccattattacatatatatatatatatatatatatatatatatttatacctatatcaactaataggatatttctcagtcatgtctgattctttgtggcctcatagaccatagcccaccctctctgtcctcggattttccagcaagaatacaggagtgggttgccagttccatctccaggggatcttcctgacccagggctcaaacctgcatctcttgtgtctccagtgtcatctgcgaaacttatttattttatttggctgtgtcaggtttcagttgcagcacttgggatttcccttgcatcatgtgggacgtttccttgtggtatacagactctcgagctgtggtgtgggctcaatagttggcagtgtgtgggctgcagagcatgtgggttccagcagttgtggca

SEQ ID NO: 50181 - DNA, 1321 bp, Bovine  19866880454607
attggatgatctgaatgggatgggaagaaaggatatgagtattggtaacatgtctccacctacttaaacgcttgacgatgaagggatgatacactatcaccgtggaaaaacagccctccaccttcggtctgggaggtggaaggagcaagactgaggaagacagagaagtactctactttgggtgtcgctgtcttcttggctattctgaaactaaatctggctctcctttaatcactatataaattcactgatattcttgccttctccaggataaaatctggccactcaacaaaacaagaattctcaaccactggttcaaaacaaactttattttctatagtaaaatgtttttatttctaaaagtaaacttctctatataagtgtccttaagagctagtgtctcttctactcagtttaagaaggtggggagcacagtaatctctgtgggaaaagccaccatgtatactcagtggcactgctatgtactcactagatcctgacagaagtaaagtttaagagttctcacctctgggggtactaagtgatgagacgcttgtgcggcaaacagaaggatcttcgttacttctaacagtgtaagagatcagaaaggcacggtcagtcagtttacagccccgtctcaggaccacagcaaacatggcgagcacacacaccggccttagcgctcctgctgagtactctgcctggaacaccccaactctcggacgtctgcatggctcactgccttgcttcctgctcagctgctgcctcatcaaaatgtctttcctgaccacataatccaaacagaacccacgctggcactttctattccccttacctgcttccttttttctcagaatacttatcttcacctggacatattatatacaacactctgtggatctccttctaggatgtaagctccatgaaggtaagagcaatactttatgttcactgatgtctaatgcagtgctcactaggaatcactaaataaataaaaaaatataaacatacacatatacatactctctccctttaaagaagcagtatatataaagaatctgcctgcaatgcaggggacctggggtttgattcctgggtcaggaagagtcccctgaagaaggaaagtggcaatctactccagtatttccttgcctggagaaccccatggacagatggctacagtccatggggtcgcaagagtcggacatgacttagcaactaaaccatacatatataaagaacgaggcctttggcaaacgaagggagggatcttggtctttcttctttctatacctcataggactgaagtgaggataaacaa

SEQ ID NO: 50182 - DNA, 1485 bp, Bovine  19866880479887
taacaccctacccccactccagtcatgaccatcaaaagtgtctcaaaacatttccaatcgtccctataaggagagcagcaaaattgcttccagctaagaaccactaatcaagtgatttagtgtgatcctccttgggagtttaaagtggatggcaggccttgggtgtctttgttgtaatagtagagaataggcgtccttgaaagaatatcagaggaaatgaacactgaaaaccagactgactcactaaagtgacttgctctctctggtaagggtccatctcactggacgagttcaggcatacttggaagctattcagctctcatatgaacattgacatcacagacgactgcatctgtgaccttgcccggagcattgacttcaaccaaggatggccacattgacatcaatgaattcctggaggccttccgccttgtggagcaatcctgctcagggggtgatgtctcagattgcccacaagtcacaaacagtagtaacagggactgcagcagcccaggtgcacactaaggccagctttgtccccatcatccaaggtgcctcagaagcaatgccgagctcgttgctggaatgtctttcttattctccataaattcatggaactttatgctgagaatttgcctaccaatatgcaacagaatcacctgtgtattcaagcgaattctaccaaagaacttttaccaatctttctcaaacttttccaaaagactgaagagggaaccctcctaaagatcattctatgaaaccaccatcaccctgataccaaaatcagacagatatcaccaaaaaagaaaattacaggccaatatctttgataaatatagatatttgtatttataatgcaaaaaatttcaacaaaatattgtcaaactgaatgcaacaacacacaaaaatgatcatacaccatgaccaagtaggattcatcccaagttcacaaggatggttcaacataagcaaaatcaatgggaaacaccacatcaacaaaagaaaagacaaaacccacatgatcatctcaaaagatgcaggaaaagcatttcacaattcagtatccactcatgataaaaattgggttggggaacatatttcaacataataaaagccatttatgacaaacccacagccaatgtaatactcaacagtgaaaagctgaacaccttcccgctaaaacctggaataagacaagggtacccactcaccacttctattgaacatcatattggaagtccgagcaacagcaatcagacaataaaaagaaataaatggtattcaaatttatttatttataaatttatttatttattggaaggggagaggtaaaattgtcattatatgcagacaacatgatactatatagagaaaaccctaaagattccacacaaatactagaactgataaatgaatctggcgaggtagcaggatacaagattaacatacagaaatcagttgcattttatactaacagtgaaatat

SEQ ID NO: 50183 - DNA, 909 bp, Bovine  19866880549303
atgatgctaatgcaggtttgtctttctcttcagactctgagtgaatcagaaaactttgaagcagctgtttacaaactggccaagactccgcttattgctgatgtttattacattgttggcggcacatccccccaaggagggagtggtcatcacaaggaacagaggtggccctgcagacatatggcctctagatcctttaaatggagcgtgagtagaattaaaggctctggtcattttgtatcaataatctttttttttaaattgatgagcctagagatactgtttatttttatatgtgcttttttttctttagctgtgtcccagttgacctcaggtaagacaagatgatgtgctttgttgcaggtggttccgagttgagacaaattatgaccactggaagccagtgcctaaagcagatgacagaaggtaggctctgcacactgcctggtttgcagtgttttcttgtggtcaggagaacatgcccctcctactccaggaaatggaaaggactacagatgctgtcccctcccagaagatgtacctgggcccccggccagtgcctcagccaggatgggagagtgtagtatgtggtagacagcatgacaggaagctggttgggagttgggaggacaaggttgattctggcctcgggggcaggaaccctagatttcaccactagctctgctgatgactcactgggtggcctcttgagcctctgttgacctatcttccccacccccccttttttattttttattttaaaacttttttttttgtattggagtatagctgattaacaatgttgtgatagcttcaggtgaacagcaaagggactcagctgaatgtacacatgtatccattctctcccaagctcactcctatccaggctgccacaaacataagcagagt

SEQ ID NO: 50184 - DNA, 819 bp, Bovine  19866880885633
actgcaggtggtacttctgtagcaaccgctctgtcacattaggcccaaaataacagccgcctcctcgaacggtgttggccctgcagccctcctgagccatggggtcactccacagtatatccaccacctggagagaaaaaaaggtatgtttcgcgaaaggagagacttgtattttaaagtttcaattctaagtggatgttgaggtcccgatccataactcagtgtaacccaaactgaccacctttcttggaggtttctagcctcagaatcacctgcgattcctcctctttctcaccaccctccatccagtcagccaacaagttctgctaattttaactcttaagtaattctgtattctctccttttcttttctttattcaatgaactataagaagctgccatttttgtagatcaaaaatggttggaaaaaacgagttcaagtaatcctatgaactacatgagatcaccagcagcagcatctcccacctagattgcagtctccctgccacagtcttgccctggtgaaatagtccatttgactgccaaagtcatctgttttggcaagcactgtgccttcctcctcagtatctattctcctccctcttccttgctaacagaactcttagactggggtatttggcctggcactgtgctggctaaatacgagcttttccattcccccttgcagcttggggtggccatgggaatgcagttctgaagattctggaacaggttttagttgcctgcaaacacggaggacggaagcttctgatatgatacttttggccttgagctgcagcagtcatctgatacatatgt

SEQ ID NO: 50185 - DNA, 1757 bp, Bovine  19866880904485
aggcgcctggcgggctacagtcctggggttgcaaagagtcagacacgactgaatgactattgttttctgagaggttggattatcatccaatttttacagacaaggagatggaggcttggagtgggtgacttggccaaagttgcacagctggtatgtgccagaactgctcctctgtcagagtccagaaacaagttcctatctacatatgctgtggccctcttcgaacttaacccctcaacatttcaaacaggattcctctggctttgtcctggtctacttttctacctcagtcccttcactccctccacacaaactcaagccatattaattaaggttccctgagcacagtgagctctcttatgattctagtcttttttttacatgctgtccttaccctcccagtgaactacttatccttcaagatccaaatcaaatcacctgatatgaaaagtcttccttaacaccttcttgtccccactcctttggcaaagttaattactcttttctctattatcttcaagattcttgtacatacctttattttatattttccatgttgtactataattaattgtcagagaatctgctacagcaggaagggactttatctcattaccttttttttgttgttgttttttggctatgctatgagatagttccctgaccagggattgaacctgggccctggcagtgaaagtgttgagtcctaaccactgggccaccagggaattccctatcctcgcgatctaccattcaatatgtatgtactatattggataagaaagacaagctccctacccacatggaacacacattctagtggaagagacagacaagtgataccataagcaggaatacaattccacattgtaggggaaaaaaatggtagcacaataacatgaatgaaaaatgtaaccttaaaggcactccataattctttgacttccaaagttaatttctaaaagaaagaaaaatttgtttctttttcacccacctgtttctcccactctttaatcagttcttttacttctggtaaatctgggtttaggcaggcttcattcccattcttcattgtagcactaccaaagaaacagcaacaagttttttttttttttttacttttaatgattcaaatgctttctcttatccacagaattcaattccccaattaaaatatatttgtagcatctgggacttcggtctttttcctgccttttcatttttttaagtgactggggggacttagatacatttctaggatagcacataaccctaaatttaaaaaatccaacagatgtatgcaatgggagaacttatatctaaagataatattggttctgttatgctggaaaaagctatttatgtttaaatgaaaacataaaatagaaaagttgtgaatatatctactttcctcccaaacaaggaaaatgagcatgaattttactaaattttctagtaaaacaacttaaaacataataaaatgttttcctaagacaagattaatggactggttgaatttttaaaattccatcagactccccaggaataatttaacgacttttttctttaatttctgactaatctaagaataaaaggagtcattctatacatcatccttgatttaggcttcaaaaaaatttaaaatatgcatatctttaacctagcctggaattctaggctccctgtatctcagatggtaaagaattctcctgcaatgcggcagcccaggtcaggaaaatccctagttctccagtatt

SEQ ID NO: 50186 - DNA, 1705 bp, Bovine  19866881139420
ctgttttaactctgcaatttgttcgaatctcctgctgttgctgaagactgttcatttgtgccaggtgatagttgggaagatttctacaaagagcagagagataaactgtgaaataaattcagtttaaatagtgaggaaaaaaacaaaacaaaactgtacacacataagctatgcctggtacacgcacaccaaaaaattccacactgacatttaaaattttatgcccaaaataacatttcaacatagcacatcttgtcaacaaaatttccatagctaatcaactcataccaagtcatttattcaatctaagcacttaactgagctaatataaagaaaagagcataaaagcaggtatttactgagtgatttccatgtattaaaagagtttgatatggagtacctcatttaaatctcacagcaatggaacagataccaccaccaccattttatagctcaggacacaagtttaaagaggttaactaaattgctcaaattcagttagccaggatgcactgatgctttagacagtctgactccagagctcacgttctaaaaccttaaaatgataactttagcttaagggatccagaaatagaaacaagcaggataatgagaattatttttgacctcgattttataacattcacttaccaaattttcaatcaaagagtctttttcagccagttgactttgtaaaagttcccgattactttttaattcttctatctcttctcgcagcctactaatttcttctggctgaacgccattcatctgagccccatcagtgtaaggaccttgatgctgactgtcttttcctattaggcataaaatttgagaagtcaacatgaaacttttcattttttgagctgacaattcaagtgtaaaaaaatacataatttcctgaataattactttggaggcacttttgtatgcacatttcatctttgcaaaacagtgcactgacaaaataacaaactgatgttttcagggtttctgggaggaaaaacagcacagtcttaagactaaactggctcagtgatctaaaattaagaattatagtagcttcaattccaattctatcacttaatataagagaaaataaaatctttttagaaatcttcacaaaagaatagctttctacacagcctaaaagaactgacgaattattgtcataaatagaggaagtaaaagttattttcttctgaaaattttggtcaccttcatataaataaactatgtttctaagcagctagcattccaatcataagcagtatagaatgaagactatttacaagcatttgagcccttagcatgtgccagacaccaaactagaattttatatatattacttcatttaaatctcagctccactttgcagattaaaaaaaaaaaaaaggaaaggctagaccagtcattcaaaactggctatacattagaatcacctggggagcttgtaataatcactgatgcctggacccagtccctaactaatttaattagaaacttcagtgggcgtctcagtatcagtattaaaaaaaaactcaagggatctcaatgtgtaggtagctaaggttgagaatcaatggatagcagagattggacttcaaattctgacttacacttctgtcacagcgattaaggttaaagaaagagtgagcccacaagaaatctcctcttggggacactacaataggaaggccagcta

SEQ ID NO: 50187 - DNA, 1023 bp, Bovine  19866881526326
cgcagctgaagcctggatgtaacagtggagtgtccatacatgtgccacctgtgggcaaggcagaacgaggctgaaggccaaagccagctctccctcctgccacggaggaactcagagggatctgagaattttaaatttaaacagcctcccacagtgttttcagaataggaaagaacactttgtgtggttgcttgaattataacttttaattattctgatatacgtagatctctatttgtattcttgtccatgatcccaagtgttagggggaaggcttgggattgttttttcctctttggatattagagaaaatgatgtgtatattaaaattcctctctttattttcagctatacaatctatactaccgtaatgagtgctgccaacccagacaagtacatgactaggatcaggaatctgagttaaaagcagaagagagagttcacctattctatgaaggtttgctaaagttgttattttgtgtgttttccccaaggggtggggctaggggcaggtagatgtgtgttggtatttctcctggaagacagtggcatcctcaacattaatacatacataatattttctgacaggtatctggtgtatggttgtcatttgtgtcaggttattgttacaattgggctttcctggtgactcagctggtaaagaatctgcctgtaatgcaggagacttgggttcgatcgctgggtcgggaagatcccctggagaagggaatggcaagccactccagtattcttgcttggaaaatcccatggacagaggagcctggtgggctacggtctgtggggttgcaaagagttggacatgactgaggtgacagcatgtactcattgtcacaattaggtatttatttttaattgtttgattgaaagctaatcatctgatgcccagtgacctttgccctttattaaaacctgctttcagggcaaagtgttacctcttcacttacggcagaggggcaaatatctgtaagacttctgtgtgtcccaagtaacagggaggcaagc

SEQ ID NO: 50188 - DNA, 960 bp, Bovine  19866880926902
tgtacttcttcctctcctacctgtcctttgttgacatctgttttgtctacaccactgtcccaaggatgctagtgaatattcagacagagagaaaagacatctcctacacaggctgcttcactcaggtgtatttctttatggtttttgctggaacagacaatttcctcctgactgtgatggcctatgactggtttgtgaccatctgccaccccctgcactacatgatcatcaggaacccccgcttctatcgtctcctggttctcatgtgtttatcattttattcagctccctctttcatgtgctactgatgatgcagctgactttctgtattggaactgaaattccacatttcttctgtgaactgactcagactctcaaggcagtatgctcagacaccctctcaataacatctctttgtatgtggccactgccctgctgtttatgtttcctctgattgggatcctctcttcttactctcagattgtctcttcattaataaagatggcctccactgaaggcaagtacaaagcatttccccactgtggttctcactgcactgtggtctccttgtgctatgggacaggcctggggctttaccttacttctgctgtgacccagtcttcccagagaagctccattgcctcagtgaggtacactgtgatcaccctgatgcagaaccccttcatctatagcctgaggaacaaggatgtgaaggcagccctggcaaggctcctgagtctaggcaccccttgtctgtgatgagtcactgacctcagaactaagtggatattgtgaaccccaaagacaaatgttgtagatttaaatctcctggttccttttctcccttaaaagacatgttcatttcttctattcctaaaacacctgtgacttcacttttttgggattgtcttttaagggtttttttttttttttttttttatgtaggccattttttaaagt

SEQ ID NO: 50189 - DNA, 814 bp, Bovine  19866881104481
ggagattgtgagatggctgagctgaggtacacatccagggctattacataaaataagcaaacaactgccaggtgagaaccacaggtggcaaaggctttgtacatcccacctgatgaggggactctcagaatggagacaagaattttatagtaagagaaaatgattcctgagatagagagaaaaccagtcaaggcaccgatagtatagctgactatgttattggtgaaagtatcagaacaagcaaggtcgagcagttgagaagggtcacagaagaaactagaaatttctacatccttgaaacaggtaacttgtaacacaatcacattgtgcacctgggagtccaaaagactaacacaaaaggacagcaaaactaaggagcaacagaggcgcgggttcatgatgaccgtgtagtgcagtgggtgacagatggccacaaacctgtcataggccatcacggtaagaagcatacaatccatacatgcaaaaaggataaaaatagacatctgagtcaggcagcctccgtaggagatgattctgctgtgagattggatgtccacaatcattttgggaactgtggtggagatgaaactgatgtcaaccaaggataggttggagaggaagaagtacatgggggtgtggaggtgggggtcagaggtgatggctaatatgatgagcaggttccccaacacggtgaccaggtacatggacaggaagaggacacagagcaaaggctgcagttctgcatcatctgagaggcccaggaggaagaattctgagacacttgttagatttccagttctgtgtatcttggaca

SEQ ID NO: 50190 - DNA, 1124 bp, Bovine  19866881147218
aattcagttcagctgtcccagctacaactgtctcacctgctgtatcagggatagtgacctcacaggttaccaattctgtggcacagaccagtacaacttttacaactgtgactgattctatgtacaaatcagagacaacagcatcaggggtcacccatactgagaaagatgcaagttcagcaattccaactatgactattctccctgggaagccagatacaacagtctcactggttacccatcttgaagagaccagcaaaagtattcccaggacaacccccaatgtttcccagagtgaatttgacaccacaccttcaatagccactagtcctggggcagaaggcagttcagctgtcccagctatgactatctcacctggtgtaccagagatgatgacctcactgattaccagttctgttgcagaggctagtacaactattccaactctgactgattccacacacaaaccagagacaacagcctcagggatcatccactctgggactgaaacaagtccagctgttccaactatgactgtttcacctgggaagccaaatacaacagtctcagtggccacccatcctgaagagacaagtccaactttacccaggacaacccccagcgtttcccatactgaaacagacaccacattctcaacagccaccagtccttggacagaatctagttcaccagtcccagctacaactgtctcacctagtgtatccaagttggggacctctctggttactagttctcggaaagaaattagtaccactcttccaacactgacttcttctccaggtcaagtggaaaccacagcctcatgggtgactcattctgagccaaaagccagtccagctagtccaactccacctgtttccactagtgtaccacatatagtgaacccacaagccaccagttctgagacaaaaactagtatggttattccagctctgacactttctccctttgagccaaagaccacagcctcattggtcactcatcctgagatgcaggccagttcagctacttcagttgtcttctctactatgccaaggttggtgacctcacttttcacaagttctgggacagagacaagtacagcttttacaattccaacgatt

SEQ ID NO: 50191 - DNA, 1293 bp, Bovine  19866881211944
cttcctgatgccctggcctcatgggacactgatggagatgagcctgtgatgtttcaggacccagtaaccttcgaggaagtgtcagtggacttctcccaggaggagtgggcccagctggcccccgctcaaaaaattctgtaccaagacgtgatgctggagaactacaggaacctgacttctgtgggtgagtgtggttggccacctctcttcgttagtagattttgtttttcagagctatcagtggtagcttacacgtctgggagtttacatgtctgaagtaaggtcctggagcaacaccccccaacatgtacacaatgggcaggatgtcattcatatttttttttttttttaagcagatttattatttttaaaaattatttatttattttatttttttggctgcactgggtctttgttgctacgtgtgggttttctctagtttcagcgagtgggggctactcttcattgcagttcacaggcttctcattgtggtggcgtctcttgttgcagagcacaggctctagggtgcaaggattcagtagttgtagcgcacaggcttagttgcccctcagcatgtagaatcttcctggagcagggatcaaacccatgtcccatgtgttggcaggtggcttcttatccactgtaccaccagggaagtgccattcataggtttttgctgcaaacctttctcaagcacctgctgtgttgcaggaactattcttgctcttgggaggagcatgtggtccatccttaagaagtgatattgtagggactttgctggcagtccagtgattagggctcaacacttctcctctggaaggggaaaaggtttgatccttggttggggaactaagctcctgcaagctttgcagcatagccaaaaaaaaaaaaaaaaaaaaattgactgtgtagaatgggggtgagcactctttttgttaagcggccagggagtaaatattttcagctcagtggaccctgggtctctgttgcaactgctgaatgctgtcactatggtgccgaagccaccgcagatagcatataaacaaatagtcagggctgtgttccaatacaacttgacttacagaagcaggtggctagtgcctgggctgcagtcaccagcccctagtctcctgtcttccttttgagagtgaagatttattcattatatcaacctgattttcttcatgatcggaagctttcatgccccttctgtgtgtctctgagcttgggtctgaggatccctgatccctggagggcatgatgtgagacagagttttgggtcttgggttatta

SEQ ID NO: 50192 - DNA, 1744 bp, Bovine  19866880430360
atgaatttattctctgtctccctttccattctgttataccactggcagtgatgtcaacataacagactctgattcccttcattaaggtacctttcctaataacagggagacaccccactgtgtcttccaagtcctattcccgacactgcaggagattcagccattgctcttgggatccgatccccacattcttgcctctgcaggtttcatccaaatacaggggaagagaagaggcttcccaggtgtctcagtggtaaagaatcctcctgccaatgtaggagatgcagaagactcaggttcaatccctgggtagggaagatcccccagaaaaggaaaatggcaacccgctccagtattctggcctgggaaatctcatgtacagaagaacctggtgggctccagtccatggggtcacagagttggacacaactgagcaacacataagaaaggcagggggaacgagaaggcccagacagcagtggcaatcaacgaaacttcaacatggatgctttctgacactccttctttaccccaaattcagtactgttttgacctttcccacatcattagtttcagttgcttgttacgccttccttgttcacaggttagtaaaagcccaactggaaggagcagtaaatcaaatccgagcatatgggaaacagcacatacccctgtaattcacacaacatacgaggcaataaggaacaggagaaactaaaactgctgtgatgcacatctattcttatgacagctataatgaaaatggaaaatagttttagcatagcattccagttaagtctcaagatggttgtgttgtggtttgcctgggctcatctgcccacagaaaacaatggagacctgaaatttctttaggaaataattacaaagattcacaactcccaaatgtccatgaaacatgcatcagaattttaagacaatttaaagggacagttctcatacgtgaattcccatcaccgtaagcaatggaaaccaggactacatcctacttctctagccaaaagccatagaaaaatatttcccaaaagaaaaccaatcttgtgcatcctgtttattctttagaatgatggggtcttgaagctagaaaagatcttacaaagcagctgctcaaacaccttgattttattcacaaggaaactgagatacaggaaggttaagaagggtttcccaaggtgacagtgctggttggtagcaaactcaggtcttggccccaggttctctaatccccactcagttctatctgctacaccctttggcctcttcattctagttctatttaccatgctgctgctggtgctgctaagtcgcttcagtcgtgtccaactctgtgcaaccccatagacagcagcccatcaggctccaccatccctgggattctccaggcaagaacactggagtgggtggccatttccttctccaatacatgaaagtgaaaagtgaaagtgaagtcgctcagtcgtgtccgactctttgtgaccccatggactgcagcccaccaggctcctccgtccatgggattttccaggcaagaatactggagtggggtgccattgccttctctatttaccatagttacagtgttaaaccttttaaagcttcttttcgttttagaatgaagcaatcagttaatactttccatctcttttcatgggggaatgactggcacaacaaagacctggtgaaaattgctcaagattacttgagaagtttacagaaaagacagaaa

SEQ ID NO: 50193 - DNA, 4746 bp, Bovine  19866880471196
aaatggaagtgatataacaacacctacaccattggactattatgagtccaataatagtgtattaatagtgtgttaacacacatcaagcacaaagatgctacaggattatatagtagttgctgtatagatgtgtaaactcatcttattatagtatgattgttttattttgtaaaacaagctccccaaaacactttttaataataatgtgtgtattcgagggccaaggctggacaggagaacagtagactccactttaggtgcaaaatttaaggggtgccaaaaagtctagtgatcaagataaataatatttcaatgtaatgttttagaaatcaaagtaatgccaaaaaaatccaagaacagaatatcaaaatgttaaacaaagtcaagatgaatatcattgatatttttttgcctcaggcttcagtatagagtctgttcatatcacagtaaactatctggaaggttacacaccaaacttttatttctagagtgggaaattatatcgaatttcactttgcttttcatttctgtatatttttaacttcttaccatgagaatatatataataaaataaatgagccttttaaaagtttcatttcttaatgaaaactagagagaaaatcacggggtgatgcaaaagtagatccaggcaatcgactgattaaaagacaatgaggccgcataccccacagagaacccactggcaaaccattcccctgcactgcagagctcatttgttaaaactacaaaagagaaagaaagaagaaatcggggatataagaaataagagtaaaattcatgtaagcctgctgggcttcaagcttaagcttgggcccaggctggggctcaagctgccttccgtaaaaggaaggggttggggaaagacccccagcagtaccagtggagggtctaaccagcatctcccttgggttgagtgaggatctccccttgtcttgtgtccaaggaaagggcaggccttgtccggctgtcctgctccatctcaccatgccccaaagcctggaagctggtaacagaaagtgggctgtgattaataataggctatgtctaaatccctaaagcagatcaatagaatgtagatacgagttgatagtaacctctttttttcttttcagtctatttgtagtaaagagaaggtataacattttcctaaaataggtaaacttcaagaaaactttacgaagcaaaacaataccagaaaagtggggaagggaccatgggttatgaaacttcatagaagtttttttttttttttttttctaagaccattgatagatcacaacacactgaaaacaatgaaagttcaccataaaccactaatctttccacatacaggccgcccattatcctttgggtttttttttttttttagaatattttttaaatttcaatagtatttatgaagcttttcattgaaaaaaatataaagcccaaagttacagtgacgtgtaatgctactatctgggtatcccttgtcagcatttgaataagaaaataagaagcaatgctcaaaaaagaggggatgtatgtatgtgtataactgagtcactttgctgtacagcagaaactaatacaacatggtaaagcaactatactccaataaaatatttttaataaataaacaaaataaacataacccactgaagctctgccaaggtagtaagaaaatagaaatgaaagttttaccaaagtatttcttataattttatttttgtcaattccattagttttcttacagagcaactttgcttctgcatgattaaatattaaatacagaaaagtataaaagtaaattaggagtttaccttcaaccacacttcagattcatccaatttttcaccacaaaagaaagtataagaattctttggagagctttacagacagattttcaatgcatatatcagctcttctacatcttaaattgcacattaaagattatactaatcacaaagcaacacatctttctttctcacccaggttatggtatgaattgtgctccctccaaattcctatgttgaagccccaactccgaatacctcagaatgtgactgtatttggagatgaggcctttaaagaagtaattaaaacaacactgcaaagtaatttcccaccaattaaaaaataataaaaaaagaagtaattaaggtaaaatgaggaccttagaatggaccctaatccaatctgactggtgtccaaagagaaaacgaagacccacaaagagacaccagggttcacgtgcacagaggaacagctgtgtgacgaggcagcaggagggtgactgtctgcaagccaaggagagaggcctcagaggaaaccaaccctgccagcaccctgaccttggacttgcagttcccacaactatgaggaaacacatttctgttgtttaagtcacctagtctggggtattttgttatggtgggcctaacaaactagggtaacatatcagtaaatgtttgtgatatttctgtatcagtgctcacagattcacatttcataaaatcatcacagcttctttaaactctgccctattgattggcactgacattgactttgggtttttgactaattcaaataatgttgcagtgaatattcctgcactggtattttggcagaattttataaggaagtgaatttccagaagtggaattgttggctcaacgtataaaagcacacatacttaatttcaacagatattatccaattgcccttcaaaagtttccacttccaccagaggtgtgtaaaaatgacattttccccacattctcaatatccctagctttttcattgttatcaatccaatagctaaaaattggtgtactgttctggtttctacctgtggacaagtctgaacatcttagagggctgtcaagagtacaggctcagggggttgaattctggagctgtcttttcctagctgtgtgacactgaccaagttgcctaacttctctatgtatcaagcttctcttctgtcaaatgaagcagtggtggaaactaccttgtcacagccttcctataagaacttcatgagtaaagagacatcaagggcttagaacaatgtttggaagtatagtcatctccaaattaatgtgagctattattatttctacttaaaaaaattatacgtgttttctatttgtattactcttaatgtgccctgtgttatggactgaacatttacatccctccaaaactcatatgttgaagcactaacctccagtgtggctgaatttgagacgaggcctctgagaaggtaataaaggttaaatgaggtcataagggtggggccctgatctgataattagtgtccttataagaagagacaccagaaagagctctctttccatcatcatacatagatgggaagagatcatctgagcacactgttagatggtggccacctacaagccaagggaagaggcctcagaattaaaccttaccttgccagcaccttgatcctggacttggcagtctcctgaaatacaagaaataaatttccattttttaaaataccaagcctgatattttgttacggcagcccgagcagactgatactccctgtttacatcttttactcatatttctgtccaattagttttttgcttattgatttgtacgagtttctctcatctatactaccttaatttgatttgtaaggacagacgtgttgaccaaaagaccgtgattgggtgatatctactagggtcttcccaccaggaaaagattgaaaacgtgaatcaggcagcatttgaggtaaaatttgcatgctaaacagtgtagatttaaggtggcatgtgaaatggtgttcttgacaccagcacaagtgtggcattccataatctcctccaaagactaagtaccagggcaccttcacttgactttgatttttttaaaacacatctccctctcttaaagaaaaatacagagggtatcagttacttcttaccattgttcatttccacattaaaaatcttgggactgaaatgcactttttcaaatttaaatccaaaattgtaacttaatgcagagcaattacaagtaacagatgctggaaggttagcactttttgcttccacaagaaagatacacattgcatccaaattttgggatatgatatccaaactaacttaggatctggcagtgagagatcgctaaatgtaagctcaagcatataagcattagagctggaaagtatggggcaattgggaaaccagacacataaaaactgcactgtatttgacagacagccccctccacttgattggcacatcagaccccaaaggtaaggggatagaatgtcccagtagaagcataaacctcagaatggaagtgcggtggattcaaaacccagacctaccatctaactagctatgtgatcttgaccagggtaatttaacctctaggattcagtttcccctgctataaaagaagaatgatgttgcctactttactgagttgtaaagattctataagttaatgactagaaaacactcagtcccttgcctgataaatgctaaaagtcctgcaaatgactaaatgtctctacgactctctcagtacctgaacccttttattttctgagtttttgtgatctgtccaacccaattccgtattcaccaattgactgttaagtgattatggagttctaagtgcccaataccacccatacaaggaataaaagagtaagaccctcgagaaacttccagcctcattaaggaagccaaatgggta

SEQ ID NO: 50194 - DNA, 1214 bp, Bovine  19866880570512
tctttataggatttatgtgccgaatcagttgcaggcttttttccaaaggcagaatccaaaatctgaggctgccttttagtccaggtcaatcaaacaatgtggtattgtatatatgctcagtggagtttttctttctgctttttaaaagaaaataatggatagtataaagtttacagtcagggcctcatttattacaaattttcttcaggaataatataagtccataattatgacatgcgttcctcccctgccccctcttaaaatattaatttggtgaggaggttagaaatctatcataaccaatgacaggcatcagggcacaaaaatagcaaggctcgagtgtaatattttattgccatgttttgaaacaactggttaggcagatgccactgttatcttccagttacttctcatttttcccgagttttaaatgcaagctgtgacaaattaaattcctatatgcttttctaaaaaaaaaaagacaatttcagaaaacactgcaaaaaaaaaaaaagttgaaataggaagaaagggatattggcagcaagcaagatgagaaatctactttcaaggtctccgatgagttgcttcaatggccccaaggcatgtagatacgccttccccacgctggccatgcagtctccatccagaaaagactttgcaccctacaattggcagttgctaaaaatgcactctgccggctaattttataaaggtactgaagaagaaatcccatcaccaaacgctgaatttttctcattctctggtgtaacacttaaatatgacctattatatcaactctcaaaagatataatgggtcatatttcggagctattagctcaaacagaattgtgcatgatttcaactgaccgtggagagagtacacaaggtggttattttttcccccaacatcaatatgcttttcatcatcaactatggggtcactgttcagtaattatatttttgctagaaaaatatatttgaatcacattaaaagaaaaaaaaaatctgactccttgaccctaattagggggagttggggatgaaggtagaaaacagattatcacaattcttttgcttcctgctgctgggattaaaaacagaattcagtcacccagccttcactcaggttcaggacgttaggtggcacaggcttgtttctctgaagtgttaataccactgcctctgctgccatcgggagtcaggtaaacaag

SEQ ID NO: 50195 - DNA, 1485 bp, Bovine  19866880587190
ttcaccaagtatgtagtttataaaataaatatatacatgttgaagttgtgtgctcaaaatctattttatgtttggagtgagggattaaagaattttggagtacaatgcttgtattattgacgagcacatgtctgaagcacgccccccagtggcggggggaatggtcacagcctcctagcctcagcttcagggcaatacttccactacttccggacaggaagtaagggaacagcctgtgcccagtggaaaaccccaaaggggtaaagcgacgccaagggcaattatgccaagtggaatctgtccaggaggctaatacccctcttcttgtagaaataccctgggactcagagaggaggagggagggagaagaacttggaaacctatcaggaaatacaggaaatttaattttaaaattagagaaagttttcatttaatgggattaaggagagcattgggtaagtactgtttaaaaatgtaaaaacgtgcacagcgtggctgcctgccaacaacctacagtaagtattctcccctcccccttatctaaaatggctctttgtctttttttcccctctgaaatattaaactgtttggctagtttatccattttagaacatgctttcaaatgaaaaagatataaaatgataatgtgattttttcttcttcttctttagactatagctttagttccaagtactgaggtctggttagggtttgaaataaaacgttcccttcctcagttaaccagggtgtttactaaggaaaaaagaaattctgaggaccaaaaaccagatagggatgtagctagttttttgtttttaatctctaatgctagagtacttactgcctatgaagcgccttgataaagcagatgtgtgcagtgcatccttcagaggatcgtggagagggatagagttttcaaagagtatattgtatttcgttgcacggtgctcttcttcctcttgggaaatgtttgattatcatgcaggcagtggaggcgggagagacagagattatacagggcgcttcaggtagcatttctcctccaggacctctgtgcgtttaagtaaaagcaattgaagagatagaaataacttctctcatgcttgtctttatatttggcagatggtgttacacaagtcagagtttgaacctttttaaggcttattttttttcctccgagtctgtttctcaggctctctcagccgtgaggactgggtgaggggcagcctagctctgcgtcccagaggaccatagaaggggccgctctgcctagagcatggttgccgattaggaagacacggagaaacattggttatgtcctggagggttgggtaaaaatcaagtgtagaatttagtctctttctctcagcttataggtaatgatcaacagactccttatctctaccttcaaaatatctccagaagccaaccattttcaaccttccaccattacactgctgtctggatttattttattttattttt

SEQ ID NO: 50196 - DNA, 1631 bp, Bovine  19866880697246
ctggaagggcgctagtggtaaagaacccgactgccatgcaggagatgtaagagacatgggtttgattcctgggtcaggaaaattccctggaggatatggcaacccactccagtattcttacctggagaatcccctggacagaggagcctagcaggctatatagaccatggagtcacaaagagttggacatgactgaagcgacttagcatgcaaaactgagactaatgaggacttccctggaggtccagtggttaagactctgcgcttcttgtcaattcatcccaccttctccttcccctactttttccacaaatctattctctacatctgcatctccattccttctctacaaataggttcatcggtatcatttttctagattccatatatatgcattaatatacaagatttttttctttctgacttacttagctctgtatggcagactctaggttcatccacattactacaaacgacccaattccattcctttttatggctgagtaatatttcattgcacacagatagctagtgggaagctgctgtgtaggacagggggctcagttcagtgctctgtgatgacctagaggagtgggatggggcgtgggaggaaaactcaagagggaggggatatgcttggtttggtccagcccctcagtcctgttcgactcttgcgacaccatggactataacccaccaggctcttctgcctatgggatttcccaggcaagaatactggagtgagttgccatttctttctccaggggatctttcccactcagggatagaacccgggtctcctgtattgcaggcagattctttaacagctgagccaccaggaaagagggaggatatatctgtatacatatagttgatccccattgttgtacagtagaaactaacgcaatatcgtatagcaattatagtctaattaaaaaaaaaaaaagatttcatgtttccattgctgggagcacacattctaccccagattggggaactaagatcccacatgctgcgaagcatggacaaaaataattgagaagaatgcctaccacatacacatttggagtgaaatctaaaagagataacaaatgtcaagaccctcactgtctttctggtaatccataaacatccctccagccagtcgccatcctgaagttcaacctggacacacaaacagatgtgatcacatgcacccagcacatcttctccaagtccttgtcgcattccccacccactgtgagccttttctcctgttcctgtcctcatcctgttacaaccagtgtttagaccatcctgtcttcccttatacatctagacgttctctccttttcccccttccctctctccagcaccccgccatctcctgtacccacacctagacactcatcttccttctgaaaccttccctccctcctccagtaacaactgccttattcaagagcctcaacctccttccctgcatctgtaatcatcactgaaatgctgagcacagctggattttcaaagccaatggttaattacagggagctgagggtaacccaatgggcggtttcaagtatttagagtgtaaaataatgaaggtactagtgagcagacagctgaaaatcatcgtacaaccccctgaacag

SEQ ID NO: 50197 - DNA, 1720 bp, Bovine  19866880732397
ttgtgaagacattgggacatttagagcctcaggcctgcaggagatcaccccctgaagaggtagtgtagaccaagaggagatcaagagttgaggctgtaagagagctgggtgtgctaacgtatggagttcagacaggcatgctgagaacatgccaggcaacgtgataatgcttggcaggcatcattttattcaaccacttaagtctccatttgtcctataataagaccaaccgtcacctctctgctttgcttctcaaatctgaccataattggataatctagtccgtgctgcccatgcgtttcttaactgttggctgtatcaaataaaggatggcccttttatgactgtgagttttcacacaagagggctgcttcctggaacttactatgagaaaaaagaaacaagattggcagctgggggagagaggaaagcatttgactaagaggaagcctcctcacctcatctgatagaaatgcttggcaacgaacccatgaagaaaggaaagccaagagtgttactgctgctggaaatattaggagcaggctgcctcattctaaatttttgtctaatttagtcactgatcttacaccagtatagagagaatgggtcacaacagtagagtgtgacagatcaaaaagaagggttttttggtcttcctttccttatcttagctccacgttctacttccaaattaagatggtgcctatggatataaatatataacatcgcccaagctaattgcatagatcagaaatcacggagcagatcgtcttgaggcctaaggggatgcagattagaagtgaagttgacagtgtgtccttgaaggagacctgcatagtgatgactccagcaagtgaaatacaggtgaaatcccttgagaacagccagaactgtcaagtgctgacatcagtgagaggttagagaatggacattgacactcagattctgcctctgttaagaatgtacctacatgtgggtgggacttcccaggtagcactaaacctgctaccaaggtaaagactcctttaccttggtaaagaactcgcttgccaaggcaggggacataagagactcaggtttgatccctgggttgggacgattccctgggggagggtgtggcaaccccctccagtattcttgcctggaaaatcccatggacagaggaacctggttgggtacggtccatagagtcgcaaagagttggacagactgaagtgacttagcacgcacagacacgctacctgtaggtggagagctggtggtaagaaatactggagttcccctctcccacctgttcttttcttatatatttatatttgtgtacatttaaccattttaataggaagatatatgtggtctatagtttacatcatggattagctgaattctgtatagttttcattttcctttttcccaataaattctggactcataagtagaaggcccatgctctagccttttctctcttgctaactgatgaccctggataagtcatttagccttactgaggtttctgcttctggaatagtggctaacctttacatcaagcctcattaatcccccactttttccctgtggaccacaggcaggcagcctgtaggctgggtgaactgcaacagcatcactcacctgtctagggcttgacaggctgtcagcaggatctcctggatattccccagtgtgatcctccatgatatgacctctgataatctcctcagta

SEQ ID NO: 50198 - DNA, 1176 bp, Bovine  19866880752417
ctcctcctaaatgctctttaagcttgatgctagtgattgttctctgtggcgggaggaagctatcagcaggtaggtgtaggtaaactatgaatatgcagctgctgaatgaaaaacaaggtgtgttttcttaaagcagccagcttggaacagaagctcaagtattcatcagatttttagttatcccagatagaagctttacaaaagaatatacaggctttgtgcttcctcagtataagacaagtgaggataaacccggaagcacagtgtgcccagtgctcttgtccatgcaccaggacgggtggggctgtggttgaagaaccaccttcccattgcttgaactcatcacagagaccattagaaagtctttacagaggaaggagatggaaactggatggtaaacggagtgctaagtaatacagccaggttgtaaggctcatttggcactaaagagtgtactgtttgactgcaaacatacattcataatagtcctttaatttgtctcttttagaaggtcatatttttcttgattgctttcacaaacacacttggcacacctgtatttaaagcactgagctaagaacctttttcaacatgcaaggttacaatttgatgtattaagtatatagttatataataattttaaatttactatgtgaaagcttttgcttatataatttatgtctttaccttttcccaagcttcctttattgatcatacaaaacaagtacagcccttctctgctttcccattaccagtgagctggtctgcaatgtctgtctgtccaaagcagcatttataatagccaagaaactgttcctagttcaccatagcaactaagatcaggacaaatatttattttattatagtttttatcttctgtattttatgtgaaataggaaaaggcctttgctttccatgtgaagctgtttaaaagggtaaattgctattcctttggggagaaaaaaagaagcaaccctgaagctgtgcttatattaatggactgctacattgacccgaattgataatactaatttaaaacactgaaataaatgtaaccttcatgcctctcagattttaatttctaacattagtagcacgatgatgttaatcatcatttgccatacaaattttttctaagaaactgcctcagaaatcattcgaagagctccataaaca

SEQ ID NO: 50199 - DNA, 1246 bp, Bovine  19866880758669
ttctttacccccgagcaacaggggaagcccattgggaatcatacaaccccccatatatccatttttttttttttttttcctcttctggggaaacaagggcataaaaaggcagagaaattgctagttatcgaacagaaatagtgttagatccagtgtttccttctcagaggcagtgttagctctgtatctttccaagtcttgctggcttgacagaatgctgctaagaaatgaacagtctgtatgcaggcaacgctctagctataatcttgcatttagtaggaaaataagaaattgcttttgcgtgatttggtagcctctgccatagtatcgtattactgaaaaacatggtatagtttccttttcatagccccaaattgtcttgtttaacaatttaaggaggaatttaaaccaggtcttaactcaaagttaaaacaaatattaacctagttatgatttaaagccaaataatctgtcctaatgcatttcccttgtggggaggtacagggcaatttaaagagatcttacaaaaataataaattctacctaagggaaacggaaatctacgattcttttaaaaagtgatttccatttccaaggagctgagtgatggagcctccctttggcagattccattagcgacgggacctgacatggtagaagcaacccaacagaatatgtatatttcttgttttgatgtaatctgagattttttttttttgtctttgaacaataagcgaatcaagtcatgactgaatggatatattgctctggtattttaatgtattacaatttatggcagtgtttacttcaacccttggcttgctgacactaaaattatcttaaagaggaattataaaattagattagatatacttcaacaagtttatctctaacaataaatatatacaaattctgaaatgaaataccctgcaattttcagccagtgcttaaagtaattacacattctgtggtgataacacattcctttcttttattgtgccacaagctggtgagatacctctacagtgcatgttaatgctaattagcagataaagtgtaaatgtgagggagcctcgaattctgttgctttgccagtttgctcctgattggaaattgcggcccgagtctcctctcattccagctcggtccattcaggcatcgcctgagctgtctttctgcagtgtgttttaatccatcagatctgttcgccattgaatgccctcgatgtttggttttcaattcagca

SEQ ID NO: 50200 - DNA, 2871 bp, Bovine  19866880819210
ttccagaagggctccagtgaggaatgagaatattcctcagaggatggaaggattttatctgaatgtcaactcctgggagtaggggaggaactcagtgagctgtgagagttagggagaataggctgggaagctcatgagtttggggaaacataaacagacatgtctgggtagattggaggatatgattagggagacatggaaagacagattagaacagtaagttgaacttggacacttgatccagacccagaagccagaccaagaagtttgggttttgtctcacattctacttattcagtaaaattgggcaccttgtctttagttcttatgaaaaatgttttaactcaaagtacattttcctaataaacccagatacaatcatgaaaaaacatctgtttttcccttcatattgttcaggagcaaatcccagtttgattttctattcagaagcttgttcagtcctaatgtaaaaaatacataatggcactcaagtgctacataaaatgatttcaaaggaattttcatttaaaaaatgtttaaggaagccccttataagccccaaagacaccaaaggtaagtgaattcttagccttttcttccactttccttccaagataaaagcttttctaaaagagtaagttggagtgtgaggcttattttaatctaacgggtagagatagtgaaggacagggaagcctggcgtgctgcagtctatggtgtcgccaagagttggacatgactgagcgactgaacaacagaagtcatttagagttagtgaaacttctgaacttttcagtatttttaaagttaccttaataatttctagaataatacattaaatcatagattgtcaaagtgtttgccaggtggacaccttaatgaacaggtagtcactggtaatgcgtcttaatgattagatgtaaatgtattctgttacaatgacttaaagaatgattggaaaggttctttctccctttaaatgcaatcagacatacaattagtcagtaacaggcacaaaactgaatgagatggactccccgttctccaagagatcatagtctaatgtaagcaaatgacaatatgcttcaagaggctacaacgggaagtaaaaccagagtcttatcaacagaatacctaagaaaccatttccttggttcttacatatggttactttgtgtaataaatttcacttgagaacagtagaaggtcctgttactattcaatttaagatttaatttcactctcattgattccaaattggcagattccaaacacattaaaatctcaatgcgtgcaatatattacacccatcttcttccaaaatcttcccaaaagaaagtatcttttgctccaaatctacctctttgccctttccttacttgaaaccctgatgctgaaacctttggaggaaaataagcatctgcttacgtgtcactaagctgagagcatcttggtgatgaggactggagatttagttgttgttttttttttttactccctaggccttaagacatactaataaaaagtgagaaagaaaatgaccgagtgaatgaataaatgagtgaatgagtacatgagtaaaaggatattttaagaaaaaagagctttgtccagagaacagtcattctattgaagaaatttcatctaagaacatactgtaatcataacataatcactgaatgctcaccatctgctacattttgttctgagcgctttgtatttgttcatttaatcctcattgtacaagggattgtctttatttattaaataagaaaaatggactcaggttacataatgtagggagctggaacatgtttaaaagttcttcacttgggtacatggtctcataggggctttcgggaatctgcacctaaattcacctgataatttatatacatatatatgtatgtgtgtgtgtgtgtactttaggcaagatgggtcatatttgattcagatacccaaagtggacatgccctctcctccaaagttaaaatactttatatttttcagtctcaacttagatattaatctttaaggaatgaaggagtcacactaaattgactataaatctagtagtaatattttaaaataagggttttccacgctccaactcaatttcctccaggttctctcttaaaaataaatgaacacgcaaaaagacctttagagcaactaattccaccaaacttcctaaatgtccatcagacatttccataaaagagacagaattaatagtaaaaccaggaaagctcaacagtgaccacatgcttgccatctcacagcattttctagggtctcctttatcttgggggtggtactagatacactccccacctgcctggaaattggactcctcctcccccttctaactctactcctgtctctcattcttcctgtctcctttgttggcttctccttgactgatgggcaatccccaaatctcattcctcaaggctctgctgttccttcttctcacactttgtcaaagttctcattctgtctcatcacttcagcatgaacctctaaccaggcgactccccagtctttgtaattcatgaccttcccagagggctagttgcacttttaattgcacctcggacatttccaatgcatgtcttgttgtcctctcaaattcagcgcatctgaaagttaactcagcatcttctccatcagctccatcagactgactctattaactgttctctagttccatcagtgataccaccatgattaagagggtctgtgtttaaaatcaatccaccacttggtgtgactttttctctcattaccctgtagccaagatctacctttcacaatatttgcttcctctgccccttcaattccttctgcacacatcttaacctagaactt

SEQ ID NO: 50201 - DNA, 1097 bp, Bovine  19866880823863
gagctaacttgtttggaaatgtgtcagtctgtgaaaaaatccattaaactatacctgtaaggtacaagcacttttctgtgtgtatattttacttcaatgaaaagaataacacttgtcatgacaagggaggaaggatagggtcttatgagcacaaggagccctcaactgctgtaacttggggtagtgtggaaagctgaggctttagactcaggtctacaatcccatctctttcactgattctctgctcttctgcagattacttgagctttttggttaggggcttcctcctctagaaaatgggagtaataatacttgctgcccaactggatgtgttgcatatgtgaaataacatatgtgaaaacaagtggaacataacaagggctgaggaaatatggcttcttctctcactttgttcttaagtctttctttcaacagagcaaatacacaacattaaaaaaaaaaggaaagaaataaccccctcagaagctgcacttttttttcatctttcatgccatgtttaaaaatgttcgccaagaactttatgaaaagttgctccacatcctataaaactgattttaaaaaatctttgtttctttataaacagtgcctatttttttgtaaaactgccagtttcattgtgaaggttctttaacaaaggggagccacttgagatcatgaaagcatcaggtgtcacttccacgagtcataacttcttcaggaaaaattccaggagcctggtggaaatagagccactctgcacttcttcctacgaggcaaacacggcctagagcatttcacttctatccttgtgatcggaaagaatgtctagagaccaaaccaaactcacacgtcactgggcatatctagtcttccttgcactgcagcagggcacgagaaacaaagatgaaataaacataggtagaaatggtttcccatgaaacacaagaacatggcatagttgaaattgggatggaaatctggagcctgagagaccatttaaagagtttggggctcttagaattactgtgcttggtcaaggtcactcagacccacacacagtctggtttacagtcctcttcccaggggtttttaagtca

SEQ ID NO: 50202 - DNA, 1269 bp, Bovine  19866880852909
aacagaagaaattactttctatttctcagagatccttgaagccaaaatcggtgaactctcaatctcctttctctctgacataaaatttattttttatgttcatccattttctgctcacttctcttccttgtttcagagtttcatcacctttcagagtcaagtccatccatccttctctggattccatgagttacagtcttccggcggggcactggacaacaggcgattttctgctacttgccagccccactcccaccccttgcctcatgtcttaatctctcctcctcccttagctctttctggtcaagcttacatcaggctcaaaactctccttccctgaaaatatttttcttgaccctgcttttctttcatgtgacttccccatctctctctccctgtgattgctaaaattctgaaagagcagcctgttcttatggattctttgcattgatcatttggactgctcttgttttcatgggagatagcaggagctttgaaatcagactgccagggttcagtcccagtgaaagactgtcctcatcactactctgctgttgactggggaaaactgatcgttcctttaatactgccttttcaagcaccaatttatactgtttcacagtttataggagcttgacttggagagatacttcgtttgcttttattttcaaatttgagctcctgtctgataagaagacttgtctttcctataaaattgagcttgtattaatgtactgttaaggagaatgacttacagtttttaaatttagattttaattggggatgaggaaaagaacaaccatcatgcaaagtgaaaaacgtatctatgcataatggttggttaccattcacagctcttcagccttttctattaaaaatctctgtataaacagaatgggatggtcactctatctgccaggaagcaatttttctgatgttaaggtaagaataaggcagtcgtacttcaccagttaccctgcagttcttccactcatttctttcctatatgtggcttaacatcactgacttgacagatgaaagtggtctaatgtatcagggaaatggttgtacagtaagaaatgtgctctgagtaaggggagagacacgaaagagcaaagggctaagaataattactggtattagttttttgggcaaataaagcactgtgatgttaaaaatgaaagcacttgtaacaaaagactgtttgaagataccaaaaaaaaaaaacaaaaaaggaagaggactttctcttcttgctgcctctagctg

SEQ ID NO: 50203 - DNA, 1388 bp, Bovine  19866880949407
gcaagtagcagcaaccaaatcccaagtctttatcggcaggtgatttcgtgctgtgacgatatatgaaaggtgatgagcagatagacggtgactgggacgtgaagtcctgctgtcttatacagttgatcaaggaggttgtttaagatgagcagacatttcaacagaatagaagaaaggcagggagatgtttggggaaagttctccagtaaacaaaaaaatggcatgcaattggtgtgttggcagtggggtttcagggaaaataagaactttggctaaactcataaagctaataggaagcctaaatatacttggctggctccactatggtgtattctctcttattgaatgtctccagagtatcattatctgaaaagacccatgtctctgtatgcttgatataggcatatagagacaggcaagacctgtggttaatgtcatggcaaggctactacattatatcccaggctggaacttttgtttgaaatgaccagctgaggttgttcttttggatgtatgtctgactcagtcacttcaaatgaaagtcacggttatataactcctgatgctcttcagagagagaagaggaacagacagagtttccttgtgtcagctgttgtccatggtgacataattttgaaactgccattgatggagtgcttgttatggtctgtctcctagctaagtaaatgacccagattttcctcctttaaaactcattttttgtttttggtggtgatcagagtatgttaataccagtatgtgagccccacagggacagcaattttctctcttgtcacccttgaattttcctggagcagtacttggtaacggtagatgaacagcaaacatttgttcaatgaaagaatggaataatttctgtaagtcatacagctagcaaataacaaatcttggggttgaatgcagtttgtgtgattgcaaagctttaactactatgctgcgctgtgagttaacctgaatggaatgtggggaagagatgaaaataggaggttggacataagaagggcctgtgtggaagaagcaaccccgctgaagctgttaataaagaaagcagaattagcaggtctcctctccacatggctgaatgtgtcttaggctttttggggctaaacagaaaactatagcaatgccaattcactgccctctaaaggagcacattggcaggactctcatggaataattagtcagcagtacaataaatgaagtgtgatggcatctcatttcattctgtctactccagagcttgccctctttggaatcacagacatgaaacttgaaaattacagatttccatgttggaaactgaaattatatcagtatgacaatggccctcatgctagttttaattgggtttcagttaatccaaatgg

SEQ ID NO: 50204 - DNA, 933 bp, Bovine  19866881056742
gtgttacagagcatgttgaaacaaaatagaaagaatccaagtgttaacaacattacatttcaagccagtaaggactagttcaaaaaatgaaaacctgcaagatattaaaactgcggggaaatcaattttgccttaggaaaacaagaccacatcagtgtatcctgaacgacagatgaagatggttagtaagaagagttatccaatatgcatgcatgctcagtcactcagtcatgtccaacttttttgtgaccccgtggactgtagtctgccaggcttcgctgtccatggaattctccaggtaagaatactggagtgggttgccatttccttctctggggtatcttcccgatccagggatcaaacctgtcacttgcattggcaggcaggttctttaccactgaggcaaccagggaagcctaatgccagcattataaataggctctatgttatattttaaaattcttcactggagtagaaacatttctacttaaatagaaaagttaaaagccgaagatgttcttccaggagttaattattaagcacctctcagtagatatttatgattcttggatgatggaatcaaattttgtctttctaataactactagagattatgaaatccagtagaaataatttattatattaattaagagatactgtagagacaggtttaatagtaataggaatcagacagtattattaaggttggggtggatatataaaataatgcttttcatgactaaaatttatcttgattcactttcttaaaataactcttaatgtatttcatttctctgatacttttattacaattctctatgaatatcatttagcctaggtagggtatttcatcaactaagtgtaaattgtattatgtcaagacaggaaataataaagttatgtgtgagtgttaacatatctgagactaaaaga

SEQ ID NO: 50205 - DNA, 1290 bp, Bovine  19866881093421
taaattttggggggaatgcaggtattcagctgcaaacaatgtttctttaagcaccaaaaagcagaggaaggagatagtaatacagaccctgaatataaagaaactatttttctggacatgtggcgagatgtttaatagtttggagttatgtttctacttttactaaattttaaaggaaagaacaccaagttatatctttattaaagttctaatgtcttttagagaagaattttgaaaatatcatcaagaaaaaggaagaaaaaattatctctagaaaacttggcacccaaagagattaactgctaagactttggtgaatatctttctagaattttcctgttcaaacatacacatgtgcacatacacacacacacatactaggcattctgtctttcactatggattcatgttgcatttgcattttagaaatctgctctttccctctaccaatatatcttgaatatttttccatgtcattaaatgttcttttataacatgtgtttccatttttttttaatgaaaaaaaagtggtttctgctgcaggatttcatggtcaacttgtttaaatttatggcaagaacatttttaattgaaagtgtatcagaatgacatgcccagtcctggagaggaagcagagcagtggggagggaaagagtgtaacccgaggacctggaaacacgcagaggaccaacaagcaaatcaatactctgagatgtgcaaaagtcactgtgccccagtttccagcaaaattcatcccgtctcttgaagacattatttgcaacatgcctggaactcaataaactttgtgttcactgatgggatatgaagttgatttaataaccaaggacctggcaattgactcagcggacataaaaaaagctgatcctgtagtataacaaatgtgtgaatctgttggattatatgggaaagtagcaatcagctgctgtttaaatacttgtagggattacttgtcatctcttaaaatcagtttcataaaatcaccttgtaaatttattttctgaacagcccctgtgtgtttgatgcaagaacgttgattcggtgatggaccagtaagtgacttggtaggaatgtcagtgacaagagagcagacaagttgaggctaaggctatcttttggtttagaaagtgtgaataaagacattaaaatgtaggcaaaagagaaaaccagaggtgaaggaagaactgggagtctggttagtataatttaggaaagatgacacccagtgggatctccagtcatgtgtctagaatatcttatccatttggcagg

SEQ ID NO: 50206 - DNA, 1359 bp, Bovine  19866881149274
tatttccctgttcaaatttgagtacacttctttgttcctgatttcttttacttgggcaatatataggtaaaatttaacccaaatgttcacttaaactttatgagggaactattctagtaaaacagaccgataacatcacgctgctgatgttgctgctgctggtcctctctaggaacctctggattttcaaattctttgaggaattcatccaaattatcagcctctcctcctttcctcctttttcgaagatcttctggtactagtggtgtaagacagcgtgtaaagagctataaaaaatttaaaaatcaattatataatctctattacaaatcacaagaaatgaaaccctaccactaacattacaatgttttaatagttggtgtatatatatataaaattgagcacgatttctacttaatgttacaccatattcacattccattctataatttgaagtcctgtaagattttcattgcagcaattttagataatttgaggatgaaatttttttatccattgtttaacttggggatttagttttaaatttattgacctgcagtttattttcacattcatacacttaaaactcaatctaactgaaatcatacccaatagctttacatagtacccttttcacttaatgatatagtaattttatattatttctagtatgtttaatgactgaatattccactgagtggaaatatatatgcttgtgcatatatatgccacgcttgaaagattttttaatattttaaggttctttagaaaaatttaactgtaaatataattatttaacatcttcatagagttttttcccccatattttaaattatctcaggaaaaattactgaaaatgaaactactaagtcaaaaaaaaaaaaaaacttaagaaccttcttccaaatgactatgattgtgcaccgaaaaaacagcagttttaacaaagcttgctgctttaaagactttgtttttaaacaatcggttctaagaatatttcaactctagaaaacggcttgtaaattaaaagaaattctcataaagccagaaatctgtattgtgggaaaagcagaatcaagccatgttttagccagaaagcatcatctaaagaatggagacttgaaccacggtacacagtaaggcaacagaactaataatttatcataggaagctgaggaagaactattattaaaaacaccagtggctttttagaatagtgaaaattcattccacatcttttagaaatgtaggtgtcacttataatcttccagatcaggtttatgttcagtatactggggtttaagggagaaaaaagatgccatatggctggctgaacaatacctgatcaaaaatgattta

SEQ ID NO: 50207 - DNA, 951 bp, Bovine  19866881277259
tttttactgggagatatgtgaattagtattgttctaatgtaattggttttgtttatttttgtctctccaacccagattttaaacttttaagcgtagaaaacaaaatttcttttataaccttgtctcttttccctatcccagtcatcagtaaatgcttttaaaattttgcaccctacagaaataggtgctaaataaatgttcaataaataacttgatagatttgtatattcagaaagcaagaaaataaccttagaggcatagtctagttccaagtaggttgagtcttagaaaccaaaggaaatccaaaaaagagcatatatattaataggtatatgtatagctgattcactttgctgtatagtagagactaacatgacattgaaaggcaactatactccaacaaaaatttaaaaaaatgaaaaacagttttgaactgttgaaggatattgatcgccaagcatggttcctctggtattccccattcccagaagaggtgtaggtgtcagaagaagcatgcttagcagcatgaatggaggtgatgggacctatattagtgagtccatagaatagatgttctcccaaaactctttcccctaagtgtctcatgcttttacttctgacatttcaattatgcatttttcaatcatgccttgcatcctctgttgacttttcattaccatcttttctactgtcatgttcttatattagtttacatctgtggaaggttgtcttttttgtagtgtgccttggtgagaaagtgttttcttccaatcccatctcaggggtctccctatggttttggctttcccctggaattatgaaaagtgcactctgagaatgaagttgtgtattttagaatgcatacaccacacatcttccattccttgttaaagccacccatgccatccctccttaaaatgagctcttcccattttcagtaacttctgggta

SEQ ID NO: 50208 - DNA, 874 bp, Bovine  19866881606815
caccaaagggcagccctggtcctgagatggagctgatgaaatagctgttgatgccgtccattctctgtgccagggaaaggtctcttcacatctgtgggagtctgaatggcagaaaggagaaggaaattaagaaaactgtgcccgtgccttcctaatttatggttagttattaaaaaaaaaaaaaggcatggagaggaggctccatggtgccaaggtcatagaataaattggtgaccgggataggaagagcctcagacgactatttactcagggagctctttcaacctgagctggggggctctgaatccaaggagctgctcagcataagcacagggcagctttcttgtcagcctcagccctttcagggaaccagaactgcagtcatattgaatcatgaactagattagccacattagaggtttagctacaatatatttcaaacttaaaacacaggctgtggcagtggtatcaaaacctgtaatttctgatgcaaatgaacagcatgaaaaatggcccctggctactagggtagacagaggaatatgtgagtgaaataacatggcagttatgtcaaaattggaagaataactatattccagaatagtaaattattatcacgacttgactggtagagtaacccagaaggtaagagaatgtgtgtgtgtgtgtgtgtgtgtgtgtgtgtgtgtgtgtgttggtacctggataaaattacattgtcagttttgtttagtccctctttaaaacctgaacattcatttttgaaaatacgtgtggaacataaggtgacatttgggaaaaaagcataattttcaaagaacactgatcccattagttcttatattacagatgccgagaatttaacttttatagt

SEQ ID NO: 50209 - DNA, 2255 bp, Bovine  19866880506580
attaaattgttttctatccaagatatcattataaacaaaacaaagcagactttcctagtgattcagtggtaaagaatctacctgccaatgcaggagatgccggttcagtccctgagagaaggaaatggcaactcactccagtattcttgcctggaaaaccttcaccagagaagcctggtgggctacagttcatagggtcccagagttggaccctactgagcaattgagcattcatgcaaaaccctttcacatttcagattgcttctatctcttctgtctttctctctctttcatttttaagggcccatgtgatttttaataccttggtttcatcaggataatccagcataatcgccctatcagcataaactacatacattaaagtctttaattctgtttataaagttttctttctgtataacagcatattcacacatcctggaggttagaacatgaacatttttggtttgccattattttgcctttcataccaatgcttattataatattcttttcaatccttttctgtaatatgctgtgggaaagggacgtgtgcagtaatatctaccatatttaataagaggcctatagtgaagttcaaactaaatatgtaaacaatataaagtggtatttaagtaaaattcatcatcctaatgcttcaacttagcagccaatttttttgaacatgaggtatttgttgaattaaaaaagattcattgaatggataaaatctgcatctatgatttgaattttgacttctctaattttatcctttcaaactgtctttaataaatctatgtttcaaccatgatactcctttagtccctggaaattccaaatctctcaattattaggcaatgctatttatgatatctgtaacacacttatttcacttccttggcttttcaaatcctactcctttccctctgccatcctattcttgctagtcagaaattcccatttatctttacaattattaaacttcacttttggttacaccaaacccctacattaaatcaggtccccttgctgtagacttcatatttattgaatacataaatgagttatttattttctatattctcatacttcattctaaatatatattttaatcctatctttttcactcttaattctagactctatgaaggaaggaacattgtctgtcttattcactactgtatgcttaacacttatcacaaggcctagccaacaatggatgtttaataaatatttataaaatgaatcagtcaatgaatagaattaatggataaggaaactcagcattttcctgggatcagtattcaacttagtggccttaaatacctggtgtgattctccaacattttctgatattctgtatcagtttttcgtatgaggtacctagttcacattttctgccttactgaatttctcaaatattccctctggacgagaaatcctgtgcttcccgcctgatccattcagcctgtctcatctcaacttcttgcttgacaaatagaagatacctgtcaaaactgtcttgcacagcaagagttctggttctagacctttctaattagtaatgctgaattgtcccacacttcactcagtcctcacaggataatcttaaaaataacaacaagctaaagcaaaatttacacattgccatccagtgatagatatctttattagagttcttatttttaaccttttccctttaggcatttcaactcctttacactacatcctattatatcctgtggttgcaattgcccactgaataaataaagaaaatcacaggattgtccttaatataaacacaatgaatatgtgttggagacagatgtaatctctagccgtgcagctgaaacttacactgctcaacatggggtgaaaagatgccagaaagatccagtttcagggaatgactgacaaaatcacaaataatcattgcagggtaatcatagctcaggagctgctccacacaattgttggcatgactgcctgtgaagacgtgattacaggatagaaaagtccatgcagctggactcacgatagagtggaattctttgcagaaaattggtgaaccactgcaagctcttaggttgaaggtaaatgataacaggaagaatagattttccttttagactctcatataagcgaactatgtttctattgttgatggagttagatagtttgataaaagttcagatttctggtttccatgtgtctttttgctcaaatacatctggtgtgaaaataggtgtccccta

SEQ ID NO: 50210 - DNA, 887 bp, Bovine  19866880561463
atagtcatgctggctaaggaacagagggcaattacaagcttcctggtgtttatatggatggcagccatctatatttctctgcgaagggtctatggaataaaagtgtgcattgcagaggcagttaagtgagccagatatagcaaactaaggcagataacgatatggcctcaggcctaacatggctcaagtcattcctccctgacaagagtaacggctcttttgcccttaaggccctcaggcccacggagctccgggctgtcatccttctctccacagaacacgtgaggtcattaagagaaatgctgacgccactctcggggccctgatcttccctgacaccaggttgcagctgacacagagatgacattcctttggtgtcaaatccaggcagagtgttgtcctacctgtcccaatatctgttggaaatcagctcttggaaataatttaattggttctacctcaattcagataagactgaaaggcaaggataaagttgccacacaagggcaaccctggattccaaatgaccctggaagatccctggatacaatgagcccggtacacctgtgggaactctacctggctagttaaatcctgaagtaatgtgtgtatgagacaacagatttatgtggattgcgtatgtatgcttgcattcctggatgcaaagggttcctggatccagttccaaaatgtgtgtgtgtgaaggcatccccatgccagcaaggaatttcttggagaccagcagagtgtccagaaatttggctcaattctgacattatctacccagagaaagaatctaccccgattccacagctaaagggctccatcccacaatacttccctccatttctaacaccagatgcaagcccaggtttttacctgtgttt

SEQ ID NO: 50211 - DNA, 2596 bp, Bovine  19866880619806
gcctccctgtcctctaactcccggagttactcaactcttgtccctgagccgtgatgccatccaaccatctcatcctctgtcaaccccttctcctcctaccttcaatctttcccaacatcagggtcttttccaatgagtcagttcttcacagcaagtggtcaaaatattggagtttcagcatcagtttttccaatggatatttaggactgatttcctttaggatggactggttggatctccttgttgtacaagggactctcaagagtcttctccaataccacagttcaaaagtatcaattccttggtgctcagctttctttatagctcaactttcacatccacccatgactactggaaaagccatagccttgactagactgaactttgttggcaaagtaatgtctctggtttttaatatgctgtctaggttggtcatagcttttcttccaaggagcaagtgtcttttaatttcattcctgcagtcactatctgcagtgattttggagccccccagaaaaattaagtctctcactgtttccactctttctccatctatttgccatgaagtgatgggaccagaaaactaagaccggatcttagttttctgaatgctgagttttaagccaactttttcactctcctctttcactttcatcaagaagctctttagttcttcttcgctttcagccataagggtggttatgcatatctgcatctgcatatctgaggttattcatatttctcccaacaatcttgattgtaacttgtgcttcatccagccaacatttcgtatgatgtattctgcataacttaaataactagggtgacaatatacagccttgatgtgctcctttcctgatttggaatcagatttggaaccagaaacatttggactggttcaaaatgactatatcactttccatccctaccaacagtaaatgagagtcccatttggttcaaatccttgccaactctccagactgtctgttcttttaatttttataattctaaagtatacatgctggtataacattgtgattttcatttttattttcctggtaagtaattatgttgtacatattttggtgtgcttaatggccattcattttttttcatctgtggagtatctaatcaaactatttgcccatctttattagtttttttgtcttttttaattgaattgtcggagttctttatatatcatggatacaaatcttttgttagatataaatagcagtggtcaaatgtgattttaatttagcaaattttaaatatagcaacactggtcatagaattctagaactataaaataaatgtctcaataaacattggctttaaggaacctctgaactctcagcttcaggacaaaagtccccattttttgtatcagtattttcctcttatactctctgtttaatttttctacaaaactatgtgtttggttaaaatcttttgccctaatgaatttgaccttgatatactgggataatgagattttcattcaaattttagtgtaatctatagaaaactgtgtgcaagagtttgtttgtttgtaggggttgctaaactgtaaagagcctgatagtaaaaatttgggcatggaggatcaaaggtctcttaaaattactcaactctgcctctacatggcagagagtgtattgccatagacaatacatgaatgaatgcatgtcctcatgttctaaagaaaacattttttataaaataagtggtagtctggatttggcttcttgactcatgttatagtataaatgtgctcacatacacacacacacacacacaaatatgccaaaaataataaaataaataagaaagttagtttattaatagttttatgaattatatccctaacagttatctccataccactgcaaaattggccagactctagcactgttgaggtaaattttcaggttcaacctcagtgtcattcagttaaatttatagagaaaacatttctactgcaaggtcacaaaatgcggtcttatctctgatcagctatcacataaatctatgccagtcatcacaagggaaactggtggatcaattcaaacttaccactcccttcagaaaagtaattctaaatgcatgtgaggctgaagaagcagaagtaacaccatctaaagaaacactcagaagctgtaaaactattacatcagactaatgtgtatattatttagggtgagcctgtgtgcttataagcaaattactctaaaatgctcactcttttaggacccagatattagcgactaagtatttagcaggtggctcagtggtaaagactctgcctgccaatgcaggaaacgcaggagacgtgggtctgatccctaagtcagaaagatcccccagagtaggaaaatggaaacccgctccagtattcttgcctggaaaatttcatagttagaggagcctagtgggctgcagtctgtggagtcacaaagaattggacatgactgaacaactgagcacacagtaagagactaaataacaataacaattcttcttttgttctacccttatgcaccatagtacctagagtgctcagtaatcactatggaatatacatcctctattttca

SEQ ID NO: 50212 - DNA, 1634 bp, Bovine  19866880645533
ctaaatccaagggtcagtgttacctgccaagggaatatcgcagaaaatggactgcacatagaatgtgaggcaagaggccctgaagggatgaagtgtggagagagaccaaattagccaagatggagtgttcaggctctcttgccccgcgttttgtaaataatgactccataatggctgaggtcattaatagcactcagcatgcacatcacgaggtgctctcttggacatgggctacttttgttatatgagttccacctaaaaagcgggggtattgctgctgtatcatggctgtttatttgggtaagccatgagaggagagaatggagcatgtctactgttacagttgcagcatcagccaggagagaatactgttatggctgctgtatcagccaggagagaggttgtgttgtagtaggttatgctaggggtgctgcatcagccaggagccaacaaaagcatcctcagttcctacggctcctcgagcctccttccagcctcttagctcatgccttgcctaccctgggttcagggaatagtgcacacagtcagctgtagcaagacagtcggtgtcatgaaaaggatcagcaagacaggtgtcaagagtcgagatgcagacctggccccaacgtgtgatttaagcggtgaaaggcggtgactgctgagctcaggtgtctctgggctgtgatgctgcctctcctggactgaaatggaggcagaacgaagtgtgcatctacattactgtcacttggtattgatttactgatggcttctaaaaatgtcgcatttgaactgtcagtgaatttgccgactgttggcacgagtgatgaaagcaagtgtgaaccataattgattaggcctcatttgcttatccatattatgctaattagatctgcaatctttccctttgtaccatcacccagtgacagagtaaatcagggtgattgggatgcagataggattagaggcaagatggaacagggccctccttatcagagagaatgtgcatttctttaatacacttccctatagaaacagtgccatatatgactccttttcttggcattttttctgtgagatgacttaattgaaatgaattttagctttctaggcctcgaacttgaaatatttttgtataagcccaccctctgtttagtaataacaaggtatagaatagggtcagaaagaggaattctttaggatcacattataggcaccctgggataactcctgatagaccagcagaacctacatttattctccttgacctcccagttgcccataaaaagtgaagatgttctcctatttctgaagacgttagctggattccgcactgtattgtactggagtctaaaattttacatgaaatttttagtgccatacttatgtatcttcaccaaagcacacagacctaaggagacagctaaagggtatccattaatcaccaaacatatgttgaacactcactaagtaccaaatgacagagtatcttctttttaattgacatgcaacattgtgcaagttaaaggtgtacaacatattgatttgatgcacttatatattgcaattcattgctataggtagtggtagctaacacctctatctcatcatataatcatcatttcttctagtattgg

SEQ ID NO: 50213 - DNA, 1065 bp, Bovine  19866880662232
cgccaggcctccctatccatcaccaactcctggagttcactcagactcacgtccatggagtcagtggtgccatccagccatctcatcctctgtcgtccccttctcctcctgcccccaatccctcccagcatcagagtcttttccaatgagtcaactcttcgcatgaggtggccaaagtactagagtttcagctttagcatcattttttccaaagaaatcctagggctgatctccttcagaacggactggttggatctccttgcagtccaagggactctcaagagtcttctccaacaccacagttcaaaggcattaattcttcggcactcagccttcttcacagtccaactctcacatccatacatgaccacaggaaaaaccatagccttgactagatggacctttgttggcaaagtaatgtccctgcttttcaatatgctattaggttggacagtgctatatgtcagttatatcccagcacagctggaaagacaaaaatagagataaaagaatttgtacatcctgaaaaagagagaccatattgaagacatttaccttagcaacttctgatagagagacagaactgattttaatttactactgatttttatcaaacttttaagttttagtttaagagacaggatcacaattcttttccccagttactaacactttgattgtctcaaattcccaaaaggaagtccaaaatatcatgctgtagaatttcttatgacttagaatctatactgcttttttgcaaaggagccagtatcaccccaaaatgcctctcttcactcttggagtcataaaaattatgcttttcagtatacttttggacaagatctagtaccaaatagtgaatgctctaactccttttgagggcttgctgggtctttgtgaataagatgtcattggtgatccattcattcaccagaagaatgttgttctgatgttttcacagaacatctgtttcacagatgagtttctgaacaacagttccagcctgcgtaatacttatgagctcatactttcttacaatttgggtgaaatcctcattcttccaca

SEQ ID NO: 50214 - DNA, 1948 bp, Bovine  19866880688334
atgcttgtaatgtctatctttatctagtcaaggtcaccaggtaaaggacccttctcttctctattgatacttttgttagcatcccagtgccctttccccagatgttgtttttgtcagtgatgtctgattctctgtgaccccatggactgctgcactccaggctttcctgtccttctctatcttccagagtgtgctcaaactcatatccattgagttgatgatgccattcaaccatctcatcctctgttgtccccttctccccctgccctcagtcttttcaatgagttagctcttagcatcaggtatccaaattattcaacttccaatgagttagctcttagcatcaggtatccaaactattcaacttcagcatcagtccttccaatgaatagtctaggttgatttcctttgggattgacagattgaatctccttactgtccacaggctactcagataatatgacttaaatttctatcccttcttgctcagcaactcactttattctaatttttacacataattatctcagtcattgcttattattttataagcttttgtttctcaacaccagttgcattttagtactgaggcagcacattggttgtcttgatcagcatgagaaatactgtggtcttctgtctggctagttttctcaattcccccaaatagaaactggagagcatcttagttttatcattacatcattatcatctcttcagaatcagttacttctgccaatagataatttttacctattatccatggatgcttgttagcttacatttcagaggctgatttctgccactctgtcctctatttctgaaacgaaactacagttcctgtgcctgtcattattaggcatgccttctagaaatagctgccaactcagtctaaatttgcatagtgtccgggccttggcagtagaaggaggatagctctacaaagccaccttcctaggtttctacatgccagaggaaagatggtccctggggaatggccctataatagattcttgagaaggatacagcttcagctgctggcaccatgaggaatatcctagtttgctttgcaaagtctgcccaatcttggctcaccacgctattcagatagccttcctaggaaagctggctgtgcttcttatgttcgtttattctaaacacagtgtcttctcctcatccctcgatgcttattgtgtggtttaattactaccctttgcctagtggttgccagcgtgatatgctgtgagactaacgcatacaatgcgatgtgtgcttggagggactgacaagcccagcttctaaaccagagtctcaaagggaaagaccaacaaaacccgtcgtcgagaaagtgatcatttctgtgccatgcaattatatcctttaaaaaatatacctctggtgcactaccctgccaacagtttactgacgaccaggaaacaaaaccagcagttgatgtgagaatggctatggaaaccctgtaatcatcttaaaaatagatttatacagggaacctgattgttaggaatgtagttttacactctgtctcaaaagaaaaaaaaatttcttcacactttggccattttaatttctacaacaacactgtggatatttggggttggaggagaggtgggaggagataagggagagaggagggaccaaatctcaaaaatgcgtgagttttttatttttttttttatgtcatatgcttaccctcaacttaccacccgcagacacccccatacacaccacacccctgtcattatgggaacatctccctactgatcacacccaccaagaagccataaaaataaacgttgttatcacaaataaccacttctctagttctactttacctcatccacatcctccacatgcacactcttcagtacttcctttcccaccatgaggcataaaatgcacatgtagatcacagtcttgctcttcagga

SEQ ID NO: 50215 - DNA, 1037 bp, Bovine  19866880774591
atggtttgagatacctgtctactttatggtcaggcagaaattatctgctaggtgccagcattcatagagacctccctttgtttcatctaagagatcaattctatgatctttatttccttgagcagaaatgtcaagagtggctaatgctgacattgaagtccatcaaacacagtcactgaatcacttcctgctttcttggtcatgctatagtttaagctgaaattttgactacctacatcagctgacaagtcttaatatttgactattgtaaagacaaggggaaaactttctgctttcaatcatttatttattaaaaactcttaagcaccaggcaaagtgctaggtgctggggtcatgactggaaatgaaaagcatggttcatactactacagaactaaaaatctaggaaagaggacagaattaaaaacaaaaacaaagttttggacacttgatgttgaagaagaaggggggaaggacttcctgggaaaaaaacatttcaagttgagatggaggatgagacgatgtagttagatggaaaagaggaaagaaaagaggagtgatttattgacatgagaagaaccttaaataaagaaagagttatagatttgctccctagaagaatatcagtcatactccatatgttattaagtttctggatcaaaatagctacttaaagagttataagttactatttttaatgtaatatgtatataaaatataaaatatgaaaatacccagaccctttaaccttagctggaattagtttgatctgcctgattttttttacagagtttatagggtgacaatgacataccataagctcttactatttatttcttgtttttattacctatgccactcactgtgtgcttaatacatgttacatacaaactcagtggagacttaaggatgacattctgctcacctatgtggaacatatatacacacacacatatgtgtttgtgttaaattactaaaaatgtcttaagctatgtcagctagaattaaagttagtgtgcaaaaattagagcatctaa

SEQ ID NO: 50216 - DNA, 1609 bp, Bovine  19866880828982
ttggctgtacagcctcttattggcaattctagagttcagtaacaatattcactctgcctcatacttcctctgctctggtatgcatagatagttttactcacactttccaagttataccttttgtttgtcctctagatcatcactagcaaccaaagccttttattttgggttaaaaatgaaaccttttgctatttcaggacaaaatagttctattgctgttaagtgtgtgtgtaattttatgaaaactacttctggtatacttagctttctctcttattttagataaaaccaaaataatcctcacaagttaactttgttacttgtcttttttttttccctatctgctaacatatataagttttcactcaataaatattcaagcaatgccagactctgttctaattgttatggaagcaatactgaataaaacacctgccctcaaggaacttttattacaataaaattatattttatggaaaaaattctgagatcacatttaaatttaaaaggctaaaacatatgaaatatatatctatatctatgtttatgtttgtatatacatatatatgtatacctatagccatctataggggaggagaggggtgtttgtgtgtgtatgtgagtgtgtgtgttgcctataaagtttgagaaattaactctaggtcagctgaagaatgtgctttctgttaaaaatatatgaaaacaaagaagaggagaaatacaagaaggaaagcatattgagtactttttatataactcttcctcttcacaaagtagtgaaagatattactaagtctaccagaggggtttttttcattcaaactccacctaggctttgagtcttgaaatagaggaagagagagagagaatcagaaaatatctgtggtgaagactgggtagtagaagagggaacttgtactatataaaacatttcctaattggaaaaatccatttgctttctcctcgcctagttttgaaactttcatgtttagatattcttgaaataagacatggagaaaagaaatggctggtccccaagagcaactgtacatctgagttctgctttaggaggaggtagaggtcatgcaggacagaatggttagtttggaccaagtctactaagatctctgtcagaaatcatgctggagttctaggctacagaggctatgaagttctctaatagaattcacagggtccctggatgtaaatgggttaactattatatcttcatttttattaacttctaactagagtttagcacttccttctattatgaatgtaggaaagaaatcacattaggattagcagaatttatggacatcatcaatagaaatcacatatatccttataccacatcacagttgttgcaagtgtctacaaatcacgtttgtgctcatcagtactttgagattatggtggctattagacccacactagaccttgttattgaatatgtcaataaaaacatatatgatcttataggatatttttcccttaattgaataactgtctcaataaaacagggtttcttttgaaatttacctattttgcttttgtatttaaaagctttattctaagggaggaatttacaggcttcctcagactttca

SEQ ID NO: 50217 - DNA, 1904 bp, Bovine  19866880890387
gtaatatgagataaatcaactcgcattttattttgtctcaggatattgtgatttttttggtgtagggaagttctcctgttcttttattacttccccaagttggtcactgatggctcagtttcttttcagagaaaagaacaaaattcaataaacattgtctgactcagacattgttttaggcactcaacattcataattccattatatatttgtaacaacactgtgagttagatactattactcctgttttatgagcttgccttgtgttgttcagtctctcagtcatgtctgactctttgtgaccccatggactgcagcacaacaggctgtcctttactatctctctgagtttgctcaaattcatgtccattgaatcgatgatgccatccaaccatttcatcctctgtcacctgcttttcctcctgccctcaatctttcccagcatcagggtcttttccaatgagtcagttctttgcatcaggtggccaaagtattggagcttcagcttcaatatcagtccttccaatgaacattcaggactgatttcctttaggatggactagttggatctccttgctgtccttcttgtgttgctgttttccaaatgactttttatacattccattgttgcatctctctgatccagctaggaaaatctctttatttttatggatgcatatgattagattgggcccaccaggataattcaggataatcttcccatttaaaggtcattatgctcaatcatgtctgcagtgttcatggaaggaagtatattcactggttctgggtatttggggataaacatctttgagaggaggtgcatttttctgtctaccacagagtgggtctggggttactggcaaactttgcctacttcttagctttgtctcctgggcttcccaagtagtgcagtagtaaagaatccatctgccagcgcagaagatgcaagagacaggagttcgatccctgggtcagaaagatcccctggagaaagaaatggctacctgctccagtattctttcctgggaaattccttggacagaggagcctggcgggctacagtccatggaattgcaaagaatcggacctgcctgaagtactgagcacacacacacaaaggtctcctgatcttggggaataattgctaattttccacattgttctctagatcagatctgaaggtcaggatgaagatgaagcccaggaaagctctgagctactagtagacagatcctgacctaccaccaaagtgtttttggcctaccagccttctcaatgtcccttttaaagcaatttgtagtctgttatcctgtatcattaacctaattagtgtaattgcacccaattacgtaatcagtgtaaatacatgaagaatcacataattagatgaagtaattaggtaattaatagatgatgtgggaaaaatccacagaaaacattttgaaatggacatggcgcctgtatgaggcaggcgaattgctaacttcaacatctcagccaactcccttggttggggaagagagatccacaaattaatgagaatctaaagcatgaaattgttgttctaaaaaatgataccttgtatcaggtccctccacctccaattttatagctctatttccaggttctctctctgtgttgctcctgaagagagaaatttccctcaccaagctgagtaggatgaaaaaatctagctcaacggaaaccagatttgacactgagtctatagataggatgagactgttattaaggccatgtcctgtgtgaccaaaataacccactgcggcagacactgctttggtctgctgagtttgacagtcttctcagctgattctcactgaggcagagtcagcctgaacatgagcacgtgttgcttaagcagacccagcaactcgtgggag

SEQ ID NO: 50218 - DNA, 1974 bp, Bovine  19866880937178
tgctctacagtaagtctttcttggttatccattttaaacatagcactgtgtacatgtttatcccaaactccctaactatcccttcccctcattcttccccctggtaattatatacgtttttgttttgttttgtttgcttatgttttcctcacttaaatgctgctccatgaggagagcatctttgtgtcattccttgttctgttcaaacatgtagagtagtgccctgcatatcgtgagcactcaaaaaccagtctggttgagtgatgagtatatgaaagaatgttgaataaactatgctcccactggagctctgcattcagacctgctattcttgcccccttgatacctcctgccctcccacctgtgccccacagtgtgcatatgggctgtacaaatgcccggactgaatcaacactaggtctggacttggttgcaggaaccccaggcagcagagttcagcaagtacagctgagctctacagaaatgtagttcagtaacttggctttcagtgggtgtatacccctgtcagatacctgcacactaatggccatttcagaaagtagacaggttggcaaagcaaaaggaattgagccctgcaaaaaactcatctccaagattaaatctttgaagatcctcagatagccattatttccctggctcccttccaactgagagagtcagcaaaatgatcagtgtcttatctctcaggtaaaggaagatactcagagcccatttcttcttgagtgcacaaaataaaaaattctactgagtggttacttcctgtgtttgacagtttcaagatagacagtacttttctggaatggagggggagttggcaacagcaagttttcacatgctaagatagctcatcagattctcctggcatgattgttaagtgggtttaagtgctgcattcttttttataatttacagaattgtggattaaatatacattatatttcatttataagggtagcccgagggttcagataattcagagcaaatgtgagctaatagtaaaaaaaaaaaaaaaagaagaagaagaagaaatttcttcacaattttaccttttaactgattcaacttgacaaattaaattgtttacacacacatgcatatgcacacatacacagaggaattaattttatgaaacagtctttcttatagtcaaggctggatttctaaatgttttattagtcctttccctcttattttttctacatagattataagttccttgaaagcaagatttgaatttaatattttccttgtttttaatcagggaatttgacacaatgttgcaaatgcaatgctctctcaacaaacacttgattaaataattagagctagaagttaatttgcagtttcaatatataaaagccttcaataaactctaaattctatctatttggagattattaaaccccaagtaattaacactgatccacagtacagattcaaattgaattaggccattttgaaagaaccaagctgcagccatgtacaatttcaactttatctaaactgaagattgatcctcctctatatcatttaatttacccctttagggtgctaatgaattccagtacttccttttagacctagacaagcagagccattgtcctaagctctatgtttcaaaggatccaacatctgcagctatggagtgctttccttgaaatgttccaagtcctcttccaatgtctgggacaggctagggccaccagtatcatcctcacaaggtgccccaagtggtgccccacttggaagacaagtggtccctggacctattttctcttatgtgcaggtaccctatgatgctttatcccctgtatggagttaaccagatgtctcaaagagctccaggactcatatctatggaattttattagccccatgtctaagaacttgttccaggataacggtccaccaagtgaattactgttccggcagatgagatatttcttttatagt

SEQ ID NO: 50219 - DNA, 2398 bp, Bovine  19866880988320
agtactacactgggaaaatgtgtttaggcagatgcagatgttctcacatgaaatgtttctttgaaaagttgggggaggtgtttaactaatggaaagttcaggtcatcacttaggcttgatgcttagaagtaataaagctcttgtccataaaggtgtctctgtgtgtacatgttgttggtctggttggaatttggccatagactgctagaaatgagatctctatttttgagacactaagaatcacaagcttaacctctattctggttcaattagtcagttactacgatttgcatgcctgatctacagccatctagtacctgtgattgttttctggacataaccatggttttcctcctgtgtgccatctcctgggaagttactaccacatagaacattctcttattctcttatttggttgttaacctccttgctcattgaaatccatctcaaatgataccataataacctttcctcattctacagccagatagaatttctctttacatgaaatgcaatcaggttcattagaacattataaggttctacatggcaaaatatctttcctcttatacttgtatttcctataagaaagtcactcaagacttttccatataaggtagtaacattaatgacctcaattttcttcccaacaaacatccgtatcctttgcatataactcaatggtacacttttgctgtgggcagagtacacattctccacaccttagtttaggcacatgctctgatgtggccggtgggttgcatgtcattagatgtgatggagcagacttggaaagtgcttgtgtgactggcctccttgttcctgctctttggacatcaccatgagaaggccagtcttaggataaggatgagagtgaaagaaagctgtgtagtgcagagttgctccaggcaagatgctccagttaaagctgcagaggccctaggctatataaagagatataagaaaacatagccaagatcagccgagctgcaaagacatgaaaaataggtgtttatttttcactgagtttttgtagttattcattgcacagcaattttgtaacaacagccaatggatataatattaattaacatctttaaataaattgaattattttctagactctgctgctgctgctgctaagttgcttcagtcctgttcgactctgtgcaaccccagagacggcagccctctaggctcccccgtccctgggattctccaggcaagaacactggagtaggttgccatttccttctccaatgcatgaaaatgaaaagtgaaagtgaagttgctcagtcgtgtctgactcctagcgaccccatggacttgtccatgggatttgccaggcaagagtcctggagtggttgccattgccttctccattctagaattgaatgttttaggacgaatttgtatgcactttttaaaagtatttattgaattcagtacaatattgcttctgtttcatgttttgacctgttggcagtgagacatgtgggatcccagttccccaaccagggatcaaacccacacaccttgcactggaaggcaagtccaatcactggagcaccaggaaagtccctcttacacacttaaaatggggaagagagacctacagaagacattacagatttattcgtgcatataacaatgacactgagttaaggggatgttgtaggtctgctactgctaagtcgcttcagtcatgtcggactctgtgcgaccccatagacggcagcccaccaggctcccctgtccctgggagtctccaggcaagaatactggagtgggttgccatttccttctccaatgcatgagagtgaaaaaatagtgaaatcgctcagtcgtgtccgactcctagcgaccccatggactgcagcccaccaggcccctctgtccatgggattttccaggcaagagtactggaatggggtgccattgccttctccgatgttaatttcagtcaggaggacctgtgggcaatgtgcagagatgggagtgggatgacacttgcttattgtatttagaacaggtaaaggaatatatccccaagcagtgggaaggtggacggtggtatggaaagagacttttgaggagggtgccagagcctccatcatcactcatttctggctgattttcaattgttcagtgtccttcctgtaacatgaaacacagagatcacccctgtacgtgagggctctgtgttaactgtaaagcactgaagaaatagaagagggtattggtgatgatgacagagctgatgatggtgacaactaggttctttccaacgccggctttctcagatttcatttcactgcactgaatttaaactttacaattctcatgctgcctttttatgagtcatattcagggggaatttttacataatatcataggg

SEQ ID NO: 50220 - DNA, 667 bp, Bovine  19866880998475
tgacccactgagccatttgcttcttggggttaaggcctgtgtcctacttatcttctcagtatataacaaattgcttgacccacaataggtgctcagtaagtaatcaatagtaaatcagtgagtaaatgactgaacaaaagagaatttctcactagaaatctaactgtaatctttttactcctcccagtcctcagacaccaggactctgtgcccctctaccctggactctaagattctcttctcatttccagggtgactctgcaaccctcaagcacacctggctctgttaccacatctgtctcagccagaagacacccttgtttctcctctctggcagactggccctttgggcagcattcctgcacttattcctggtgtcagagctcagacactggtgaaatcacttatccgctgcttcattagctatggctgctacctggatgctgcacatagcattaccccacacttattgatcttgcatttcaggaccaggcagaatgatttcactttcaactgactaattgtgtagggaaagggctttaaaacaagaaaggaaaaatccattaaattctctaagacaaaactgaggtcaccctgctaagtacaacacccatacagatgtgctattaaaacagatgttcatgcagacaagcctaaactgttaaca

SEQ ID NO: 50221 - DNA, 1315 bp, Bovine  19866881034501
cttggaattcgtatttacttccaactctttggggatataaatgatgtagatatcctcattaggcacaatgaagaacccaacattgccagatacctaaaggcttcccaaggtatacaacattttaagctgaaagtggtggggagtgagaggatactaaaaagagggataaaaaagtaggtatggtggctagaactgaagaggtgtgagcgcttggtatcacatgctacacagaagctgaatagcttgaggactgaaagaaggccatttgaagaaaaaaactggaaagcagtgtcactctttgagagaactattctggtaaaggtgtaggagccaaagtgaaaatataggcacttctttattgctgtccccaagttcacatctgatacaatttaggcatggtaaaaagcaagcacaagcgtctaaaatggctttattaagtatgcttccgtattttttccttttttcccctagaactgcatccttatgacgtaaacctggctttctttttctatatccatccattcactgtactatttattagttcacttgtatatccaagcctctagtaagtctccagcataagcctctcccctggctttacatgcctggccaaaatgaagctgtaaacacacacagtgtgacaatcctcttcctgtcccctgtgcctctgtaatatctactgtgatcatctcagaacaaaattatcccttcactgttcaagttctttttacatgctctcttatgttcattttctttccatctgcatatttatctcctgaaatagagttaagacttatacacttgagagatggactgtgtctgatgcagtgtctccacaccaagctgttctgccttaattttaaacattccattttttccccttttctacagggcaaagtctaaagctttgagcataccctacaactccattatgttataactagttgcaacataattggagttttatgcttcaaagctttgcacatgcacagatggaaagcaaactcctggaattcccttagtaatcatgatttaggcttagttgctcaatacagaaatattaaatattaattgtgtgccagaccccacacacaaaggaactatctttaaggagcttgcatcatgctgcttgtattagttctctattgctgttttaaaaaattagcacaagctgagtggctttaaaacaacacaattattatcttagagttctggagattagaagtctgaaatggttttcaccaggctcaaaaccaaggtgttggcggggctgtattccttctggaaactcttagggaaacatctgtttccttgc

SEQ ID NO: 50222 - DNA, 1428 bp, Bovine  19866881073685
tcccctcatattcctcagtatttcttagcttcctttgttgcatcctttgttctatccatcctataaatgtggctggtgcccagggtcctgtcctcgaccagcttttcctcttactttatacttaatcattttcattgcttcaactagcatctgtataataatgtctcttatatctaaatttttagcccatccatatgtgtcttatttctagattagtacaactaactaacctcctgggaattataattggatttcctacaagtatcttaaaataaataggactcaaccctatcttacatgctcttcatctttatgatcccttttcactggatcataccagtcattcaaaaccaaccctgtgactcatcctggaaactttcttctcttttactctatacatccagtcccaagtctaacaaattctactcgttattctttcatcaaattatttttccctcctcactgccactccctaagttcaggctctcattatttcttgactgaaacacagctgaattccttacctccagtcctgtgttaatcttggttagagtaattgttctaaaaacaccaaccttatcattctgatttattgctaaaaacttctcaagggttagttatttttaaggcaaattcccacctttttaatgtataatgcaagggtttccctgaaacagcctctgctttcttctctaattttatttcttggtatgcttcattcttgcacagtgtttaaaattctttcaatttgcattaacttgtcatgctgtttcatgaataagcatttttgctcctgctgtcgtgtttgctgagagttacttttctctaactctatttcatctcttcagcctagtaagaaattatgccattttttagactgtaatttcaatgacttctcattttagagtagtatctgaccctctaccaggcagaaatgatcacaggactgtttctgtctttcctgctctacttctttatatacagacttcaattacatcataaaatagtttacattactcatgtatgacagactagctctatcagtatggtgggtagaataatggctccccaaagttatccatgtgccaagccctagaatctgtgagtgtgtaacattacaggctactggagagttaaagttgatattcaattgattttaaaataaggaacattttctgggttatccaagtgggtccaatgcagccacaggggtccttaaaagtagtggaaaagaagacagaaaagatggagtcagaaaagatatgatggtggaagcaaagttggaataatgctatatatggtttaaacgcttgattgctggcttcacgaatggaaggaggccataagccaaagaacacaggcagcctctagaatctgggaaaggcaaggaaacagattttccctaagaatttccagaaggaatacagc

SEQ ID NO: 50223 - DNA, 1378 bp, Bovine  19866881149501
tctttgaggggttgtgttttattcccctttgtgtcactctatacctgacacagttattatatacctggcattcagtatacacttgtttactgaataaattcatatatgcagaaacaaatggctcaagtaaccattaataatgttaagagatttgaggggaaaaactatatatttttatttaatattgtggctagaaagtgacacaaacaactagctctttaataaatgagtctaaattattatgataaaacatgcaggaaatgtgtccatgagagcttgataactctgaaaaagccacagctgaagccattatccttatgttgttcatctcttgaacgattttaatttctgtgaggctgaactcttttttttttttcccttcatttcctaagaacaattgactctgcttgcctggcctgaggaaggctcctgggtatcattgctctggcaggtggttttcatttgcctgtccagagatgctggcacaactgcaaacacagctcccatctcactcccagccatatccccaatgctgcctgcaactgatacaatggcttgttacatcctagaatatatggttgcaacagtaatgtagccctatcttccttcagcatgtctttgaaaaagcatttattggattatttacttagcaatttatttttaacttaaattaaatgaactatttgaaaaatgtttcttctgaaataataatggttgtccacttaacctctgacaaaggagctgaattggaatgggacctcattgttaagccctggcagctgctgcctaggtttagtttcctaagcaacctggaaacttaattatacccaaacaacaaggacaagtatttagaggaagaagatttagtgaaatcaccatcatcaagcgcctaaaagctgagaccactgagagaaagagaagtacaaatgagaaaatgctattcgatgatcaagtaaattaaccgcaaatcttttaaaacagtaattaaaaaaaaaaaacttagtattttaaatctctattaaatgatcctcagtgtttcagtggaatatcacattacaactattcatgcagtcagctaaaattgcattgcctgggatagtgcctgcaccaaagagctgtggcatgttaggtactgcttaaggggatggtttttgaaccaacccttgaaaaatgtatagaatttggatacacagaaggttgatatatgatctcaactaatctgtttatgcaatcattgaatttgaattcccagtgtcttgccatcactgtttactgtcatatttcctgatggcccctgcatcattccacttccctgcatcccctcaaacacaggttttgggcaggggtaaggggcactggggtaaagaacccaccgcca

SEQ ID NO: 50224 - DNA, 1303 bp, Bovine  19866881178151
ttaggtatgtcagaagaaaagattaggtaaggtaaagatatagcaatgggaactatccagaatggactacagagagaaaagggaatgtttaaaaaatgaaaaacatgaccagagcatcagtgagaagtagcacaacttcagacagcccaatatacatgtaattagactctccaaaggaaaaggaagaaaagttgaaatagaaaggaatatttgaagaaatcatggccataatttttccaggtttgataaaaactataaacccacagataaaaagctcagcaatcccaagcacgagaaacatgaataaaactaaactaggctacatcataatcaaattattcaaaaccattggaaaagaaaattcttatgtcttgataaattaacccctttattattaagaaatggccttctttatccctggtaatattctttgctctgaagtctactttgtctgatagtaatatacccaccgtagttatctgttattagtgttatcctagttgaaacctttagtttcaacctatttgtgtctttttgttttaaggtgtgttttttcttggtggcatgtactgttgggtcttgattttttaaatataacttggttatttataatcactaatcttttctatatataatttctgccttttatttggattatttaaacaataataatataattatcatatcactttatatcagattatctaatgggatatggtttgatttaaatctgtcatcatacttatttcctgttccatttagtctttgttctcattttcttctttttttgtcttcttttcaattaattaaatttttttataattccatcttatctcctttttttaattcattcaccataactgttagttgcttttgggtctataatatccatgtttaacttaccacaggccacatgataagtaatattattccacttagtgtatagtatacatatcttactatagtatacttttatttctcttctccaacctttttgctacagctgtcatacatttcactgtacatatgctatgaaccacacattacattgatattatttttgtttaagcagtaaattatcttttaaaaagatttaaataacaagaaaaaaaggtatatgctacccatgtagttgccactgcagggcttttcattcctttgtgtaaatccatatttccatctggtatcatttctgtctgaaggacttaactttaatactccttatagtgcagctatgctggtgataaattctttcagcttttataaaatcattacttagtctgctaaatagtcattatttagt

SEQ ID NO: 50225 - DNA, 944 bp, Bovine  19866881183953
gagattgggcaggtttagccaatctagtgataggtgttaacccttggaatgtgattttaatagccaatagggatttataattaatgtgcaataacccaataatgcacatgtctttaaatttaataggcccagttaaggtaagatcattaagcacccaattgaatgtgaaacacatatatttgaggtttaacgactatgcagcagatgcaggatggattgtgggattgttaaaggacactaagaaagttgttaatattgcgagggtgtttaattaatgctttaagcaatctatcctttgaaatctgcccaaaatgctatgcgaaatctgctcgaggagcaggagcataattgatagcactaccgtttaaacccagccacatcgaaggaaaacccaacagaaacagctctctaattagcgtgagaaatgacaacaacacaacaaaaactactgagtgtctccaatgacaggtgcagcaaataacaaggctgatgaaggactttgcaattaaagattccactatgaagattaatagagtattaaattaatgtaaggcgggatatcagagatgagtttctgccttacaagccccctccttttttatgtttctttccttcattcgtttctatgcctatgattcttccctatcatccctcagtattcaaatgactgcttttagtttctgtattctttctgtgtctgcccatgacctttcttcctttgggcctcttctctcgtatctcctctgttttacctggaaggtcaaaataaagtggttccagctcactgtcagtgccctatctcttgggcccaccattgcactgggttctctcatgctacaagagtagtttgaactacaaattagactcgaagctgcaggattacatatgtttgaaactttcgaaatgccctccttgttcagtttctctttttattggaatattta

SEQ ID NO: 50226 - DNA, 1152 bp, Bovine  19866881214618
tctaaatctgtgagcctatttctgttttgtaaatatattcatttgtatcattttgtttttagattttgtatataagggctattatatgatatttgttcttctctatctgacttgcttcacttagtatgataatatccaggtccatcccatctaatgaagaaataagacaggtataaaaataactcaattttggatagtgtttcactggtgtttttaaaaaatgatgctcacagtgtgaggataacgcgttagcagcagaggcagccagtcctggcatatctgggtaagacaccaagtggcctttatcattggaaccaggataaatacatacttatacatttttatgggttttctagtttatttctaaagcaaataggtaaatttagagtgaatcagttaatttcaaaatataattcattataaaaatttcccacctttttcccacttagaaagatcacagatgaggtgcatcttagaactgggctgggatggagctgagaggaagcctgtcgcttcatttgagggttagctgcacgggactcaccacaatttgaatattttcttctttcttgtgcacagtctgatgtccttgaggttgtctgtgttctttatggcctggagctatcgggcccattttaatttgactgttcacattgtcctctgaaattatgaataaggaaagcatttagagccataggtctagttctgggggggaaaaaaaagctggctctattttctgaggttccttggctggttatttttcaaaccagaagacttcctttccatgatgtgaaactctaaattgccagaatggttaaaaataacatatttttaaagattgctatacttgagagatccttagacagttgcagcttctttataggattatgaagaagctgcacatgtggaaaacaatagaatctctgtctctctttctctctgcattctgtggtctgtgaatctgggagtaggtcttggatgctgttgccagacaagagagggtactatttgtacctgtagttggcaggtaaaggtggtgacactcagtgaggctgatgctattttttctttggttgtgacgtcactctgttgccttgacagctgctgtggaaggtgaaacctgtggaacatgtaaagcttagaaacctctca

SEQ ID NO: 50227 - DNA, 774 bp, Bovine  19866881358051
cctttgaaatatgaagatgacttttttcccacaaggctaaagaggttttacttagaggtggtataaatttatcggttttatttttggccactggagggctctcatatttttccactaatgaaatagagaccttgagcatgactaaaaactagaagtcagagatgaaagttgaaagtaagtgttcctgtggtttgtgaccaaatttaaatgcagacaaatttgagtgcatattagtctaatgctatagagcagtgatttggctgcatgggacaaatgtttgtatcactaacatgacttagatctccaactttggggaaaagtggactgtctccttcatttcctttattttagtgattgtttattgtctttttccctttctggctaataatctcctagcactctgttctttcaatggaggtcctatcaagtaatgctgacccttggttcttttttttaacttttcccccttttctattattcctaaaccctgtctaccactccaaagtctctcctcatcaatgaccgtccctaacaattatgcttcatggattctttaatgaactccctaccccttgccacacacacaaccatttgtgctgacctcaatgcttctccaggagatagtgaagaataggagagccaggcatgcagcagtccatggggtcacaaagagtcagacacgccttagtgacagaacaactacaacaatgcttccagatctatttaggtcaaccacatagtgctacgtacttgtgctaaacatcaggttttcca

SEQ ID NO: 50228 - DNA, 1185 bp, Bovine  19866881367754
aaatgaggaaatgcaattcaaccttaactttatctcagcagctcaagaaactggttttatttcttggaatttcccattaagaggttgtttgattgtacttcctctgacctcttgagtagctggaactgggttggagtgttgtttgactatgatcattatgtccatagacgaaatagaaggaaatataccttggagctctttgaaaataaattttaaagggcagagcaatggtttttcatctgaagccaacatcataaaatgagcttgagaatgaaaaattggctgaagagtctggctcaggctttcttagaggcaaaaatgaagcagaattctagtttttccaaaacatctcccaaaaatattccatgggcatccttgttggtttcaaagatagaagacaatcatagactgctacagccataagggaagttagtatttaattcaacttttgcaagtaacagatgttgaaattaagtcctggaattttgaagtgatttgtttaagatcactcaacaatgccattgtaggatctatagcagaaccacatttgtagattcgtctcccattctttcccttcctcagttttgtttggttttgttttgaactctaccacatgatcttcagaaaatgggctatgtctgacatatatagattttacatgcttgttccatatgcaataagatttattggacattatatgtagaataacaccctcaacatcatggagggttcaaaggtgaattagacactcagtattcatgaagcatacactctcctctctaatagggtagcatgaaagcttcagaaataacctattgtgtagaaacaatgaaagaaaaggcttcttggggacccagagattgagtgtgctttagcaggctataatagaatctgactgtgcattgccagctattattttggtaaccatccttacaggcatccagggaatctcctttccacatggtaagcaggatgcacatttgttcaccaatcatacattttccatttcttagaactgtcatcccatatttctccaggaatctctggcttcactcatccaaaccccaaattaaatccctcatgatcattattgctaactggaagaagatttcctcatagtaactggaaaaagctgtaggtgcattcagtaaggatttgagctgtagggttagttaacacttaggt

SEQ ID NO: 50229 - DNA, 1342 bp, Bovine  19866881391342
ttatgtaaaaataaagcacgacaaagaagagctaacattcattatgagcaagttaaagaactcatgcacagaggaacttggattcctttcttcaaagatataaatctgtagctatgagaaacctttcctaaattcctaatagaattttatgtagatatatggttggactgtttttttgttgttgttgctgttgtggtttttccatccctctggcttatctatgtcatacactttctcttatccatgctaatggaggggatcagtagtgcagataattgaaaggttgtgtgccaacaaactgcttggtggttgctgccaaaaactccccagtgttgcatagtaaatgaaaagtcaagcaatggcagggttctcatcacatagcagcccagtataataataatagctcttattattgaaccctctttatgtgccagattaagtgctttatatacaattatctcatttcattctaatctacaaccctatgaaattagtatattttctcttttatgaatcagaaaattgaatctcagagggtcaagtaacttccaatggttgctctaatcattttagtggtaaagccatatttgaaaccaagttgcttattaaagcaaagcctatgcattcagcctttttgctatcccacttccaaatgccatagtgcaccaacctatgcttgagagaattaacttgcaaaggtgggatgctggaagtggatttagagcgttggtcctactttaaactccataaagggatattttcaggtaagagctttcctggtggctcaggtgtaaagaaggcacctgcagtgcaggagacaagggttcaatccttgggctgagaagatcccctggagaagggaatggcagcccactccagtattcttgtctgaaaagtcccatggacagagaagcctggggggctacagtccatggggtcccaaacagtcagacacaactcagcatgtacacatggtacttattattcatagatacatgttattcataggttttctagttttgagttatttctaaaactttaattaatctctggatgagggaaaggtttgagatgccacatgcaaagaatgcattttaatccttacctgaggttctctgtagaatttggcttagtaacagctcccttcctgaattcctttcttatttcagcttctagaccccagttcatcctggtttacaattagttccgatttctttcattgtcgtctcttccttaacccataccttgtattttggtgttacccatggtgctgccatttgctctcttcttggctcgttcaacaggtcttaatgtaacttcaaacaggatccaaattccaata

SEQ ID NO: 50230 - DNA, 1776 bp, Bovine  19866880677404
tgctgtgtaagaagtgaaagttgctcagtcgtatctgactcttctgcgatcccgtggactatatatagcctgccaggctcgtctgtccatgggattctccaggcaaggaatactggagggggtagcctctcccttctccaggggatcttcccaacccagggattgaacccaggtctcccacattgctgaacacaaaattactttatgttttcatgcctgagcagcatggatagtcagtttgggtgtggttttgtttttgcctatatgccttgtggggctttgagatcatcacggatcagctgcagcccagctcccatgctcttgtcactccaggacccagctgacggggcagcttcttctggggccactgtggcttaatggcagagagacaggaggtgcaggaaaagcaccttggtgctcagggcttgtgttcccaagtgatgctttccacttcccccaccttggccagagcaagcccctgtccccgacatccctgtccagtagggcaggaatgtataacatatgtccatacagggtcatcacagggaggtgaaggcaccatttgttttggaaacagaaatatcacagtagggttaacacgaagaaggatcagatttgacagaaaagaagcaagatacctaagacttactaatttatgacatatcaacagtagtggaaatagaggaattaagaatcaatttcaagcgcatggcctgagcagccaagtagtggtgatgccgatcaccgggaggagctgggttaagggaagacagagggtcagtgctggacagagttaagtctgaagaggtgtgggtccggtcttactgtcatggagctcaggagagacggtggctggagaggcccagcctcaacggatctctccagccaactcagtctgcctgaaagggagtagtcgactgaaggagatcatgataagagtgtctaaagggagagagctgaggatcagctcaggaagggggacacacacggggttctaaccacattatgaagctgtctgagctgggtgggcacaagggtatttgaaatagtacactttattcctttctgtgtatccagaatatttcatggcgtgtttcttttagagaattaataagcaaccagagagattgttttaatcacttcataaatcacatgctaataataagtgctttattaggtagagcctacattttctctgctttaccttggtgaaatgcttaccttggtcgtattacccctactgttgtgtacattttaagtactcggccaagtcatcctttgtacatatggtgttatctcaactcctctgctaactttcaccccagtgtctgaaactctcatgttgtctccgcccctgcaggtgttcacgactctgtcggtgaccaagcgctccgggggaaacatcctccagaccggttgctgaggttaagccccaatgtagatgctgctgcctagactccaaaccactgatgtgtttcttgcccaagtccaaggcgaagtgctgcgaaaggctctcgggtttggcacctgcgtgtcccgtgcttacactcctcgaggcccccttggatctcacaggcgggaggtgattcgtggaaggcaggcagcattgcattggggttaccgtgatggactgaaaactggctcttggcagagcatcagagcgatgcgtccatgaagtcaccagccccaagcccctcgtggtgggtggtgatggaaccgtcaaagcagttttctcctcggcctctcctttgtgggttttcttacgctcaccgtcaa

SEQ ID NO: 50231 - DNA, 780 bp, Bovine  19866881550653
tgatatttttttcttctgtattcccttatctcatccccatttataggtgggaaaatgaggtttagagatgttaaatagcctcccaagatcacagaggtaataactaacagacctagttactgcagttcagaatcctcctttgttcttaaccactgtgttctacttttcccattccacggtttcttaataattttcttattcctttgattttcaaaatagctagaatgtctaagcttttggctcctctgagctttgttgttgttgttttggtaatacattagaacatcaccctcagccagactcccgattttgggtttctttgggagaaaggggattttgttggacttattaattaacagtggtaatggatagtgcttttaactgaatgaatttgcaggactggaaaaatacctgtcacagaggaagagcaaaccaacgtgccttacatctatgccatcggtgatatattggaagggaagctggagctcacccccgtggccatccaggcaggaaggctgctggctcagaggctgtatggtggctccactgttaaggtgagtgctggggctgtcaacactgagatgctattcgcagtggtcctcctggtgctctgggtaagctgctggtgaagttttccaggtcttgaataatttagttattttgatgatggcattcccatatgtgctttagtaactattctaggcaagacattgttatgacctctctacctttgtgatttattatggacattgtcactctcagaatcaaacgaggagtaaa

SEQ ID NO: 50232 - DNA, 1128 bp, Bovine  19866881126895
cccaacatagagaagttggaggagtctgaattgggcatctcccaggccctcttggaactggagatgaactcggacctcaaggcccagctgcgggagccgaacataacagacgccgaggaaactgaagttggtggtggctggaaagctatcatcatctttgttcccattcggcagttgaaatctttcctaaaaatccatgggcagctgctgcacaagttggagaagttcagagggaaacacatcatcttcatcgctcagaggagaattctgcctaatccaactcaaaaaagttgtacgaaaaataagcaaaagcatcccaggagcctcactctgactgccatgcatgacaccatcctggagaacttggttttcccaaatgagattgtgggtaagagaatccccatgaagctggacggcagctgactcataatggtccatttggataaagcacagcagaacaacgtggaacacaaggctgaaacattttctcgtctctacaagaagctcatgggcaaggatgttaattttgaattcccagagtttcagttgcaaacaaaaatgattaaataaaatattattcacaataaaaagcccaagatttaattgattaaagaaccgtttgtgttctgtcacattatcatcttgcaaaccatttgggaaatgcagatataaacgggcatcattgcagaagacaaagctgagagtgcagagtcaaatgggagactgtttgcatccatggtggtctttttactaataaagggtctaagccaggaaaatgtcttctgtaaagagccaggtagtcaagactgtaggctttgggaattccttggcagtccagtggtaaggatttggtgctttcactgccataggccctgattcagtctcggatcagggaactaagatcccacaagaaagtaagtaaataagaatactgtaggctttatttttgttgcaattactcagctctgccattctactgtgcaagcagccatagacaatacataagggagtgagtaggctgtgtttctgttcaactttatttatggacattgaaatttaaatttcatatgactttcctacatcaagaaatcttattcttcttatgcttttcctaagcatttaaaaaat

SEQ ID NO: 50233 - DNA, 810 bp, Bovine  19866881257717
tgttccctcatttgaccactcctctaagtttagatgtgcagaagggcttagatatatccagagtaagccacatgcaacatgttacttgatcaattttctaaaataaggtttcaggacaatgacagtaaaataagggaagaaaacatggaggaatgaagtcctaattactatacatgcatattttttttttgacagtagggggaaaccttttacagataagttacaaacaaagaaaaggcaaataaacaattttgtacaaggaatttaacacattctgtacaatgtcttcactttgctgtcatcatatgtacaaactcttcatagtttacttgaccatcaccatcaatatctgcttccctgatcatttcatcaacctcttcatctgttaacttctctccaaggtttgtcatcacatggcggagctctgctgcactaatatagccattaccatccttatcaaacacacgaaatgcttctctaatttcttcttcactgtctgtatctttcatttttcttgccatcattgtcagaaattccgggaagtcaattgtgccattaccatcagcatctacttcattaatcatgtcctgtaactctgcttctgtgggattctgcccaagagacctcattacagttcccaattcctttgttgttatagttccatcaccatccttgtcaaatagtgaaaaagcttcttggaattctgcaatctgctcttcagtcagttggtcagccatgctgcaagcgctacaggtctccgggacgcaatcacacaaccactcagctcgctcgctccacttggactcatag

SEQ ID NO: 50234 - DNA, 2957 bp, Bovine  19866880580691
cctggtgggctgccgtctatggggtccacagagtcggacacaaccgaagcgacttagcagcagcaatagatggtgactggttatgagtagacaagggaagaagagtcagataatttcattccccatcccaggttactgagagtgttggtgccattatcagagataagttaaacatacttagtttgtcatgacagtgagacatgcagcatgcatgtctttagttggagttggaaaattttaaatgtaattgttgggcaagcccgcaagatggcggcggctggagcgggccgtctggaggcgggcggcgtcggccctgttgctccgggccccgcgcctgcccgcccgggagctctcagctcccgctcggctctgtcacaaaaaggttgttgatcattatgaaaatccccgaaacgtggggtcccttgacaagacatctaaaaatgttgggactgggttggtgggggctccagcgtgtggtgatgtcatgaaattacagattcaagtggatgaaaaggggaagatcgtggacgccaggtttaaaacatttggctgtggttctgccaacgcctccagctcgttagccaccgaatgggtaaaggggaagacggtggaggaagccttgaccatcaaaaacacagacatcgccaaggagctgtgcctcccgcctgtgaaactgcactgctccatgctggctgaagacgccatcaaggccgccctggctgattacaaactgaaacaagaacccaaaacaggagaggcctagaagaaatgagcgcctggtgatggatgcctcaaagggcccacaggctgccagcgcccccacccacgcagtcacatgggtgttcagaagccctcgcactacaataaaagcgctctgagatcacacaacctttgctgctcacgttgcgaatctaactcaagcaaaatacacagcctagttgttctgaaccctggggtttcctgcagctcactttcatcgccttaacctcgtgtgtgtctatacctcgcgtgtgtctatttcgatttatgtgtatgaccccaaaactgaaattagtagcgaagtctcaggtttgggtagtcgtgaagtgcacaatatctaattctacctgaatcttttgggggaagattaccaatagaaagccttggtaagattatttggtaggaccaaataaagtacacgtattgtacataaaacagattttgcatctatataataaagcaatgttgtaagacggaaaaaaaaaatgtaattgttgaaatgtttgctaggattggctttaagttgtgcaagcagcattttccggcggtattacttatgtaatatactgtgtacagccatgtacttcctagctgaattcctcattattaaaatttgggataactttcatttatactgatagtatcaaagctggatgttgtcattaaggaaataatactgttaatcactgcttttgaatggaagaaccatgatacttatttttatttaaacacttacatagtaatagccagacactattataatcactttacaaatgttaaataatttaaacttaatcattctcataaaaaaaagaaaagttgaggttagaaaaggtagtaagttaaatgtcaaataaaacagtggttcaaacttgtaacattgaatccctttcattatgatactgatatgtgatcaatttgtttttaagtgaaaagaaatacaatcttaaacataattcttgatgaccaccttgataatacaaaacgtatttttacccagttgaaattaaaaagaaaacaccatttacctctaccactgaaattaactataaaagttgctgcacaactaaacatgccacaagatagtataacagctaaaaaatcaaaacatttgcagacagcaccaccagaagaaaatacaagcacaggtatatgcaatgtaatatttccatgtaactcatctttcctaagattggatcttttaagaaaaagaaaaaaaaatcatgagattctgccataatgggcactattgatattagaacttctgaccgtatttttgagcttactgatgttggagcaaaactagagtaattcatttttcaaaatgagaattaaaaaagcacgtggtaataagtcgaaaaaacctacagtaaaaagtaggaattccaaatcattattagtattaatatctatcttttctaattcagcctactgaagcaggatgctaaagatgaggactaatttgttgcttaatccatagtcctgtctgactctttgtgaccccacagacacaggctcctctgtccaaggatttctcaggcaagtgggttgccatttcttcctctaggggatcttcctgacccaggattgaacccatgtctcctgcttggcaggattctttaccactgagtcatccaggaagcctgaagacttcagttcagttcagatgctgagtcatgtccgattctttgcgaccccatggactgcagcacgccagcatgctgctgatgccatgatgccatctaaccatcttatcctctgtcacccccttctccttccgccttcaatctttcccagcatcaggtggccaaagtattggagtttcagcttcagcatcagtccttccaatgaacattcaggactgatttcctttatgaatgagtggcttgatctccttgcagtccaagggtctctcaagagtcttctccaacaccacagttcaaaagcatcaattcttcagtgctcagctttttttatagtccaactctccaaatatgactactggaaaaaccatagctttggctacacagacctttgttagcaaagtaatgtttctgcttttcaatatgctgtctaggttggtcataatttttcttccaaggagcaagggtcttttaatttcatggttgcagtcaccatctgcagtgattttggaggccccccaaaataaaatctctcctgtttccattgtttcccca

SEQ ID NO: 50235 - DNA, 2278 bp, Bovine  19866880753989
tgttgaaggtttatcataaagttgaaaatgctcacatgtgactatcacttctcaatataatagcttctattctgaggatccattgtaatggaataatctaacaatttaatttaaactcttttggcatatgaaaattactgtggttaaatcttcctcctcactgtttgtgaagcttatgtaaaacacagcaatatgatttctaagtaaaagaaaaaattttttctctacgtctaacttaccacagacagagtcaaggattctacttcctataccaataatttgtgactgtaggaggcaaatggaaattgcttgagttaatctgaaaaatgggaactaaaatggaaatttgggtatatttaaacaacagggcttcttttttttcactttctaaggttgcatttgttcttcagcataatttttttttaccataaactctattaattatgtttcaatagtgaaaggataatgcagaaataaaaatgatgtgcataatccttatatggaacagacaatgtcaaaaataattggtatgttcattgcagcactgtttacaatagccaagacatagaagcaatctgaatgtccattgacagatgaatggataaagaagatgtggtacatatatacagtggaacagtactcagccagaagaagaaacagaattgggtcatttgcagtgatgtggatggacgagagtttgttatacagagtgaagtcagaaagaaaaacaaatatctatatacagaatctagaaagatggtccagatgcgcctgttcctgaggatagcaatagagacacagatgcagggaaagggtgcgtgaacccagcaggggaaggagagggtgggacgaattgagagagcagcacagccatatgttcacaccatctgtagaacagggagtgagtggggctcagctcggtgctccgtgatgacccagagggtgagactgggggcaggtgggaaggagggcaaggggaggggatacaggtacacagataactgatccacgttattttaacagcagacaacactgtaaagcaatgatactccaataaaaaataaaataaattataaaaaataactggctgctgtataggaaagattacaaagattaaaagagatttaggattgatacaaagcagaaaagaagcaaccaatttgaccgaccattcttacctgccatcccagatcccggaaactcacatagagttcatgctttttacaggcttgtttttgttcactggtgttataatctgaaggcgaaaatcagattgtcaacaaatggcagtctatcgggtatattaatatttcttttgtgaggtcacttataaagtcaaaaggaatctgtatttgaagttgtagaacatgagtttgaatctcaaagcgaaagccgcttactaactatgtgaacttcaagcaagtcacttgtgctgagtttctgcttctgtaaaatgcagaccttgaggggtccggacgaggatcagggttgggtcctttgtgttatgacaacagtagcctgatacctgccattcagtgagtgctcattcattaactaactcaaaccgcagttgtgcttactatacttaagcatataaaatattcaaacactatgttttgtattctttcacaaggcaggcactgggaaagtaccaactgggatgttccagagtacatgttatcttaatatgtatcttaaactcaggatccccaaagtggagctgctgattgccccccacccccaagaccaatttcacctgcagatgactgcgagcaacttcccaggcaaaacaaacactgtagcctctcacctccacaaccaatctgtcatgaaatccttactcattttaccttcatttgaaactcagccaccctcaccagctccatgactggctctggtccacgctgctatcctctctttcctgaatcactgccacatgctcgctgctattcctcctgctctgcactgtccccatcccatcaacgcagccaagtggaccaagcgtcacgctccagcataaagtctcacagtggttcctgcatcatcaaggctcccaaggttctacgtgatccagccccatcaccctctggcccatttgctctccttcactctactccaaacagcctctgtgctgttttgcacacaggtctgctttctctcaccttagttcctttactctcaacaaccacacccttccctgcaatgctcttcccctgaatatctacttagccaatgctcagagcttcctcagctcttaagcatcatctgtcaacagagc

SEQ ID NO: 50236 - DNA, 1555 bp, Bovine  19866881002112
cttttttagttaggactttaaagcagggccaatataatcagagtaagactgaaaaggtgtaatagcagaatgcctttccaactctaagacatgaattccagtggctcgaaataacaagacatcatcactgtccattactgttccaaaaaaacaagtgattatgtgaatctgtgttatgtgaatctcatcttctgtatcatgtgatacctctaagctgttctgtccaaattccaattccagctttttctaaattctgctgtgatctatagttcattctattaagtcttttccataatccctctataccatgttatacacacacacaccttccctactccttccctcactcaaatccaaaaaccttcacttaatcacctcttaatcatttgcctgaaaagtaagccctccagcctcttattgtttccttccagatgctgctggggaatgactccccacagacctcaccgaacattccatcatggtcaattggctgggcagactgtaagtccagtcctccaaagcttttacgctctttctttccaagaaaactcagagctaacaccattgtttcctcacaaaaacagctaacatctgcagactggaacatcaaaacaaagggaaaaaaaatgtgcagggttctgctgatgttggatgcaaactttctcagccattttaggcaataaatcaatgttcttcttttcaatttctattgaaaaataaaccatactggctgattttcagtttctcctcagaggaatagttaacaaacaggttacatgcaatgactaattagtccttctgccttccagctaagcaaactcagcttgtatttggaaatggaatctctaacaaaattcatcacattgctcaaagaatattcaattttattctgcatttaaatagtttgtttcagctttattactttaatctatagatacattggtatagctcaacaaactgcttattccaaactaataatgtacaatgtttattaaagttattaactccaggactttcctggtggtccagttgttaagacttcgtcttccaatgcataagacatgggttcaatccctggttggggagctaagatttcacatgcctcatggccaaaacaccaaaacacaacagaagcaatattgtaacaaattcaattaagtctttaaaaatggtccacatcaaaaaaaaaaaaaatcttaaaaaaataaaattaaaaaaaaatcttaaaaaagaattattaacatcccaaactttgcattgacaaatttgaatataattaccatattatcttataaaaatcacttttaaaactttgatctttagttgttctacaatctcggttaatgtatgttccagtttagaaataagaaaatattgcccctctagtaaagatggagccaaatccctcttattccagctgtttcctgtatggatcataatggcgtttagtcatttctttattttagacaactcctttaaatcggtgtttctcagactttaatgtgcctacaaaccccagtagagcttgttaacagtttctcgggcccatctccag

SEQ ID NO: 50237 - DNA, 1070 bp, Bovine  19866881025251
ataaaagctgagggcaatttggaattctctttgcccaggttttagggctggttttaaaaggcatatgcaggacccatgaagaaacagatgaagtgattcagaggttcactcacgaatgtttgatatcacttagtttccattcccgtgtgaaaagattttaatatttaatataattctgctgaatgtatactctagaaaatactgaaaggaaaacttgagttaaaggaaatagaacagaagcttgcataaacactcatctctggagagctggatctcttaaatctatttggtcttgaaagcatgtatacatatagacctctcgatggaaatgccataatgataacttgttagatagaatgtcaatcatttgattttttttaaagtgttatttaggggcaggagtattatttcagcttacctgcactaaatttgcaactagcttattgcatagggcaaatttaagaatatatttaaatttaagaatacatcagagatatattaactgttaatagaatattattaacaggagtttagaaatttatatgatgatgataatgatgatgatactaccaaccactgttttttaaaaaattttattttatcggagtataggtgattacagtgttgtgtacagcaaagtgactcagttatacatatatgtatacattcttgtgggcttcccttgtggctcagctggtaaagaatctgccttcaatgaggtagacctgggttcgatccctgggttgggaagatcccctggagaagggaaaggctgccctctccagtattctggcctggagaattccatggactgtatcgtccatggggtcacaaagagttggacatgactgagcaactttcactcactcatacattctgtttcgtattcttttcctttagagtttgtcccaggagagtgaatatagttccccatgctatatagcaggcccttgtttgtccactctgtatttaaaagtttaagcctgctcaccccagactcctactccatccctccactacccgccttggcaaccacaaatctgttctgtttttgtgagtctgtttctgtt

SEQ ID NO: 50238 - DNA, 1537 bp, Bovine  19866881276557
tatatcaagtaaccagggtattgtatccaatgacaacaggctctgagtgggagaggagagaaggcatgttaaccaccagtcccatctagtcttcactctgaccagaactgatgctgtcaggagccagctccttggagccaaggcgtgaggtccaccctgaatacttggtagaaatcacaggaaccagactgtttgagagcagtaataaaatgatcagggtgggtgcaggagaagcagcctaatataagagctataaacgtacctgagaattttgtcactgaacactaattctcaaggagttaagacatgagcacacagttcagacattaactgttaagacatttttagctcaagattgttttaatccccaactcacctatcagattatcacatatttatggaagtctgaccttcttaggaagtgaaaaatcaacctcttctgaatgtaaaagcaatagaagtatagcttttgattttttttttcacttttgtggttataaaataattctgttattcactagaaactcagaacggaaaaattgagctatttcaaatttttttaaataacagtggtgttttgggggggaagaattaatttcaatcaagttaaacatacagatgtttagtgaactaagtgatcacaattaaattttatatttaagtaaattggaatattaagcatacattattttgcttctcttttaaattctatggtgttttgtgacattttaggtgattcattaaatgtaaatgtatgtaatgtgcattggctgattattccaatgatgctatggctttcctttatgaaattctacccctcagtacattttgcctagttaggtattacaattcatctttatagtagaaaaaaggtaggattttgattaatcaggctatcttttagatatgtaacagcctaaggtaattgttaaacattcacctagtaaggcttagaaagaattgtctcattcactaaatttcactcacatggaactcattaacaaagttataatagatcaatgacagaaatgctagctaatgatcccagtgaaaattttaatgtgactagcagtcactccacaatcttaaatattgtaccctgggagaattccaaatatcagttagaagagattaatgttacagagggtttccttggctactgaagcccattggagattgtcccccaccttttataaacagtgaggcttactgtgttttataaccatgaaattaaagtcggcagagttaataaccgacctcagtcccacaccatctgctatatttatagataaacattgtctgtgacttgtttatcttaactcctcccctagaggaattatattatattatgaactatattgtaaaatccctgtacatttgacgggaaatcaagattaatttcagccttacagtaagaacaaatttaaatagtattctccccaaatgagctacagagatgggatcatttctgtcttttttttttccttccaaaaatcttacatagcagggctgagagctgatgcagaccaaacctcta

SEQ ID NO: 50239 - DNA, 1306 bp, Bovine  19866881327702
aagatttggaaaaagtaataactaggcacaggaataagttcttttaaaaagatgcctgatgaagcctcatttcatacctcacttaataactgtgtacaaaaataagaataaaactcagcttataagaaattaaagactatatcttcaggtaaatataaagtgtgtgaaataggcaacaggtccattatgtgagcagattaatcctgcaagggatctgagtaaggaatgcagcaaagttcaatttggattttgtaggaaaacaggggaaaagattgagagccatttcactggaagaacgatgcatatgtgtttataaaatgcagcgtgaatcgtcagtgtgattacacttcccttacatatgcagacagggtaacgttctcattgacccctcccaggattcccgtgtcttaagggagaagcactgctccccggccctgctgagctctgccattccgatgtgtggtcccacggggctggtgcccttacagcctccctctctgagctgcatccacttacctcagtttgaccatcagcaggagaaggatcccgcaggtggccgtcacgcacacgacaccatagatgacttcgcctagaagtaaaagatgtttttaaagtactggatttttagagagaacgaacactaaagatattttagagggtggatttttattatatgtgctgctgaagcaagcaccagaggatggatttttaactgaccattgaaggagggatgaaatccactgagagttatctcctttgcatgttttcctttttgcaatgcaatgcctttcaccttagacagggtcggataatctgaaagaaaacaatgaaaatgaggtgaaagtatatcaaagtcatgcattatttttatcccgtgggttgtaatttgctttataagacaacaatttatttcaataacattattttaatataatattggtatgatagatttgggtaaaagggagaacacttttattcaattttaacagcctttttcacctttaatcaaataactgcataattgaagttgctttaaaaatattactagaataatggttacattttataatacaattcattttaccttatacatagactagggaaaaaatacaataatttaaggctgaacattgggatactgaaaaacattccttcattacaagagtgattgttcgagtgcacatttccccaagacccactgtatttatgaatttttagaagtaccctcaggagagtccctgaaccagtcactctgctcaactctctacctagacacttcaatatctggttttgctcattcccctat

SEQ ID NO: 50240 - DNA, 2705 bp, Bovine  19866880155809
atgtgagtaatcaagtgtctagtgttgcaatagttgttttatttttttaaggtaaagaaggaaaaacatgtgacgtaactgctcagatggtgctggtgtgttgctggagaagcatgaaggaagttgctttactcttaggctcgctgtgccagcttctacccatgcggtctgtgccagagtcccccgatggactgctgacggtggagcaggtagggtaggcgttgattccgcttggtataatctctggtcaaagcatatatcccaaacttttatttataacccaacttaaacaaatttttttggaaacatttttcttgaataaaatcttaacagatgtcagctgaagaaggttcactaatgtgtagaaactggaccttgcaatacatttccaaactttggcatttttagaaatgtttttatttttctaagttatatacataattttagctcttacctcacttttaacttcagtattatcgtttgaatttttgtttctccattgaatacacacaaacttcaaatttaaatgaagtcgtctctttaggaaaactccacaaacctcttaaattttggaaagaaaaaaatatatacatatataggttaattatggatctcatggttctctctgcattgatgataaagttatatagttactttggtttttttggctgacttttattttaagaccacaaagttagttcaccatctgggactgttcaagggacttgagtgcagtgtttacaagaaattagcttaccacaagcatttcatttggaaatattttagatttattagatttctgtttttaattgattccctcttcctttccatatggtttcaacaaatccatttcccaccattttccagcaaagatatataacatgtactttcatttttaacctttttcaaataaagataatttttcccgtagggtgttacgacatctaagaacaaaacaaatattgtagtatgctaatgctgattatttctataataaccatgtgaccagtaccatggaaataatgctaatatttttattctcacactcgctgtggctaatgtgctcgcatctggttaacagctgggcatgtgatgttgcaaggctctgagatggagagcggtgaaggggagcaggacgctgccggcttcatcatgttccgtattctcttccaaatcaaacaggcgttagtgtcccagcgttccttgcagtccttgctggtgactggctagagtgccaatgccaacatctttgctgaggaatccagctatgattaatgattacttcactgatgttcaccatctcactaagaagtaaacatgggctagagagccccttgacttctcagcttttcaaggacaagttaaaacatctagttttggggtttgttggcctgtgttttaaaaaaagaaaattaagggaaacattgttttacttttactgtaactgagaaagacctgaaagcttcctgtgaaaatcattttgacttgacaccttttgtaggacatccaagtcttatgaagtcatgtgggatatccaggttaaaactgggaattcagttcagctcagttcagttcagtcgctcagtcgtgtccgactctttgtgaccccatgaatcgcagcatgccaggcctccctgtccatcaccaactcccggagttaactcagactcaacgtccatcgagtcagtgatgccatccagccatcacatcctctgtcgtccccttctcctcctgcccccaatccctcccagcatcagagtcttttccaatgagtcaactctgcgcatgaggtggccaaaatactggagtttcagctttagcatcattccttccaaagaaatcccagggctgatctccttcagaatggactggttggatctccttgcagtccaaggaacttcaagagtcttctccaacaccacagttcaaaagcatcaattcttcggtgctcagctttcttcacagtccaactctctcatccatacatgactactgggaaaacaaaagccttgactcgatggtcctttgtggacaacataatgtctctgtttttgaatatgctatctaggttggtcataactttccttccaaggagtaagaatcttttaatttcatggctgcaatcaccatctgcagtgattttcgagccgccccaaaaataaagtctgacactgtttcccctgtttccccatctatttcccatgaagtgatgggatcagatgccatgatcttcgttttctgaatgttgagttttaagccaactttttcactctcctctttcactttcatcaagaggctttttagttcctctttactttctgccataagggtggtgtcatctgcatatctgaggtgattgatatttctcccggcaatcttgattccaacttgtgtttcttccagtccagtgtttctcatgatgtactctgcatataagttaaataagcagagtggcaatagacagctagacgtactctttttcctatttggaaccagtctgttgttccatgtccagatgtaactactgcttcctgacctacatataggtttctcaagaggcaggtcaggtggtcaggtgttcccatctctttcagaattttccacagtttattgggatccacacagtcaaaggctttgtcataatcaataaagcagaaataaatgcttttctggaactctcttgccttttccatgatccagcagat

SEQ ID NO: 50241 - DNA, 750 bp, Bovine  19866880388169
caaataactgtaattccactctcaataaaggaaataaattttttctcctcctactcttacttaacagggcttttaaaagtccttcccatccaggcaggacctgtggtccagctgggacggcagggctggaatctgcatagagccggggcagcagacagggctgcgagtggggctgtgctgacttcctcttcacggtcctcacagccagcctcgccaggccagcagctgacccctattctcacttggtttttggcctgggtcagcttagttttcttccagtagttggtaaaccgtctttgcatcaggagagagatagtaaactggactgaggagagagggatggcggggaaaggggaaggaagggactcgaaggattaatgagctgatttccattaaggctttgacatcttggaatgaaaagcggactgtaagagcagaagcccagtcctctactccggccatgctgccagctggccattcatcaccaaaaattccccaacaaatccacggctgttgcttaatcacctcatataaatctctattaatcttgcaaagtcaaaacactaatatatgacaaaagtctttatgtaccctcgattttgtggtcaaaatgttaaaaaatggaactgatcatccaatggttccaatcaactttttttttaaacctccttttggggaataaataaatgacctccttactaatgttttagtatctactagactgaataaactcaagctaaatgatcaaat

SEQ ID NO: 50242 - DNA, 1181 bp, Bovine  19866880404863
atttgtgtttataaaaccaaaactcaagtattactgcaaatcagaatacacagttattaaaccaaaatactcctatttcccttaggtcaacatgaacctagagatgattaggtttactcccttctattctctaccaactctttacctcagaaacatttcaggtgattaatttaagcctaatgattcaataaagaccattgctaaaggcacttatagaaatgataaaaatacaaggatatccttcctcttcttactaaagttttcctaaaataccttacaccctggacttcccggtggccccatggttaagactccatgcttccattgcaaggggcacaggtttgatccctgattagggaacaaaaaccccaaatgccatgaggtatggccaaaaatatatatttttcaagtactttaaaaaaataccttacagactgaaaactccagtgctagattttttttttccccctttcaaaaaaagagctcaaggttgatttattacaccaaagtgaagggacttttttcactctggattttaagcccaaatgtaaactcaactggatcacagaacaagcagttcacagaagtgccacgaagagctctggtagtccgattccatgacccttcttcccacactctccccaaatctgggctctttcgaaaaataattttcagggcaaagtttaccactttcctacactttctgaagagaaattttacctttttaagaagagaacaaatctgttgtcgcactcctggagactgactgttaagattgtatgtgataaagaactggatccactgcatttcttctgtggaaacgatttctgtgcttcgattactttcacaaagcaagcctaatgtatcaatccgtacctaaaatacaccaaagaataagatgttcatttttcagtgatgtgtcagttgctcaatatgtccaactgtatgcgaccctacgcactctagcctgccaggctcctctgcccatggactttttcaggtgagaatagtggagtgggtagctatttccttctccagggtatcttcccaacccagggatcaaacccgggcctcctgcattgcaggcagattttttaccatctgagccaaaaacaaaagcaaagcctaaaccacttaacatgtttaattatctacacagatatcaagggcagaaaagaaag

SEQ ID NO: 50243 - DNA, 2148 bp, Bovine  19866880407921
ccccagtccatggaaaaatggtcttccacgaaactggtccctggtacaaaaaaggatggagaccactcgctgccctaggtcatactgctctgaagtgctaaggctagtatttatttgaaccaagcaatatggctccagaacctgtgctctttgccactcccttaactacgctggcactgaatactacaattcactctttgcccctctgtttacaatgctccatctgtggggtgtgacgagctagttctcaacatgccaaaattaacttgccattaaataacaaacaattggacttactttgctttcttgagagatctctcctctgagcttcttgggcattgctctagcagtgttctcttcttctagtctgaaatgagtagaaaaggaggaaaaacttgttaagcccaagtgattgtgacaggttgctgaataaaactggctcaactgaatttctgagattcttgagaaactgagaatttcttacaaaagaaattgtccttataatagggaatcgagggtcattgcacagttataagtgtcttagcaaaggaaaaatgtgtcttgaggctaagaagcataaaatcttcatgagattatgtatgggctgctacttaggcatactttttaaataattagaacgtgtattttccatctgactttacctaagtttttactgttaaaacttaacataattttgaaaatcttcagggttgttgaaagagtaagaaaaaaaaatattaacaagcatttatataaagaagttgaagtttacaatatactttcatacacagaaccttactagatcatcctccttttactctcttagaaaatagtatcataatgatatcaatatatgttgaaatttttaaaaattgccaatgttttcttatgtggtaatcctacacttgaaaaggagccttaaaaggcaagtttcaatcagtgaagtgttcaaattactgaatattataaaatgaaagtttcagtactccaaatggtacatagtaaatttagggaactgctttctaatgggtaggcgacagtagcctctggttaccgtattagttgacatgccacaccgtgaagcctctgagtcggattgaaatccccctttattcatcagttttgtatttttcacgtgcgaagtaccacttcctttcttcaccaaccaaaggttagtcgccaaacctgctgaagggcacactgagagtgggatgtgtgagacgtgctcggtgacttgtgttctgttttgttttgcatcagggaaaattcctggtttgggatatttatgtcctggccaccagtccccaagagacggccacatttctcccaagtttcaatgaaactctcagtcccagaggtaaacttcagctcagcctcagtctgaataatcgcaaaatcaaaattaggcccacgtgaatgagattttctgtttggcctatacagtgtccagagcattagcaacatgcctatttgtatgaagggtgatgctgttgtcaataagcctgctcctttttgataattgcagtcatacaggaaaaagccatctgttttgatagaaactatggaaatatatctaggtagctaaggaaaagctggattcttactaaaggatgtgtcacacctacgagaaaataatttacaaagcagtgtgtagaaaatattttcaaacactaaacaagtgagtctcttaagctatccttttgcgtgatgggtgagtggtgctttgtttgtttttcgcttgactgattattcattttttttttccccagaagaatctcttttcttgtgaagtcagagtttaaggctcagcttcttttcagcttgaataaaatgaaaagtaaaattcttctgttactaagggtaacctacataagtcttgtgaagagaaacttaaatgtaattcttgctttctagctgagcttcagtgccatataattaataaattcagtcacttcttacccccgccttttttttttctgcatgatttaagacatcagaatttaattcatagccagaatgaaaaccggacttaggaaaaacttgaaaagactagagagggatttgcattctgttgcatggttgaacacgtccctaaagtagcagctttaaagtggccgggtcctgctagaattccccgtagaacactgg

SEQ ID NO: 50244 - DNA, 2408 bp, Bovine  19866880409896
ctctgtcgtccccttctcctcttgcccccaatctctcccagcatcagagtcttttccaatgagttaattcctcacgtgaggtggccaaagtactggagtttcagctttagcatcattccttccaaagaaatcccaggggtgatctccttcagaatggactggttggatctccttgcagtccaagggactctcaagagtcttctccaacaccacagttcaaaagcatcaattcttcggtgctcagccttcttcacagtccaactctcacatccatacatgaccacaggaaaaaccatagccttgactagatggacctttgttggcaaagtaatgtctctgcttttgaatatgctatctaggttggtcataactttccttccaaggagtaagcgtcttttaatttcaaatatagtagtatttaaattgtaaaacattttaatcacgttttcccttaaggagcctttatttcctgagtcttaattgttgtctcaaaaattataaccaaagtgctcagcaggcatttttaatgctgaattgaagatttgagaggaccaagccccaaatgccaactaattggaagccatcttctcctacgtgatagggaacattttaggatcaaaactgtatgtttttctctttaagcagaaaagtccgaattaaggaatagagtatgaaggtaaagaggagttacagtaggcttaaaatgagcacaaggcgaatgaacgacatgccgtgttttgattatctttctctgattggagcagtgttttcccctccctctcctctggaccttgacccttaccagtctatttataattttcttgttttaatcaagctgcagtagtcacatcagtggcaccagatacattcaccctcacatctcttgactttccccttgtgtcttattttcctcactcaccttgagcgttgagagtcctgacttctcgtcttgcccctcctccacacagcaacaagggctcgctgcttcaccatttattcttgtctttccctttcttctgtaagtgctcttcatctcctggttgtccagccactgcacgtatttgctgagggcctcctttgtgtcgttgcccaaacccaagccccctactttcatcagctcttctttacaagagaaaatggaatagcccatcaggcatggactctctccatggagacacccacgttacccaccaccatagttccttctcttgttttatagccaggctcttggaaaaggtggtctgtgtttacagtctccatttcctccccctcttattcattccttcaatcactgcagcccagatgcttcttccacaacttcactgaagcttcactgacaaaggttgaaataggagtgccctcttcattacaaaagccactggatgcttttcagtctttagctttctggatctttctctggtatttgacactcttgtgcactggcttttcaagacgctcttcctctgtggccttctttggcctttgtttcttccttgtctttcagggctccttcctcacgctgcctcccaaatgctggtgcacctctttatcttgttctccactcttttctttattcactttacctgtatggtacttctccggctggcaactcacatatgttgatgagtcagtcctagatctagaatgcatatgaaatcatagactcaactttctgttggacagctccttctctatgtccatagatattgaaaagtcagcagtttcccccagggagttcctctgcacactgaggtttgaacagccatctcttagggcctagcacagtgtctacacattccctctggctagctggagtcagaagacttctttgaaagggaacaaaactcaggatattatggagtatccttccagtattactgactgtgttcatatgaactcagtaacaaaggaaagttggtttaaaaaatcattgacttttgatatcccaccagtaagtttgaaatggtctgcttttttccttaaactgatgatcatcagtttgaggtagcaagtggcagctgttggtaactttctttggaaatgaaaaagttaaggcccaaaggagtgagcagaatgtgttcacagtcaaaaactgattcattaaggagtcagggatttacctatttatttctttactcagctgtaagcatgtgtctggcatggtaaaggggagcatcagaaagataagagttttggcaaaatgggatgtcctttgtgctgtgttgcctctttgtccctatcatctttgctctaattttttccatataattagtgataagtgataataattagcagatgtttactgtgagctaaacactgaatgcataccaactcatttaattatcatgacagcactctgaggtccctaacattattattcccatcctacatcctacagagagggtaag

SEQ ID NO: 50245 - DNA, 3643 bp, Bovine  19866880472533
ccccttccactcagcacgaggctccccccaaaccctgcccaatgcggccttcctgggccaccgagtgccttctgtcccaaatcaactcatgccctctcacaggaagactgtttttgggaatgcccagaaatgcccagctttcacatttctgcaggttcactcaggactgttttggctctgtaggttaggggtggctggattctgcctcaaccctggaacccccaaggcctgggacagagctggctgcgctggggaaaatgtagagaaagtgtcgggttcccctcacccctgagaacgacagccgacgggggccttccctgctgcggggaactcagcctgtttgtagctgcgcagaggtgcagggactgggctttggctgaggaagaagggaaaggcccagaatgagagcactgtcctccgccaaggacacaggactgttgacgtgggcgagatgggcgcagcctctggatcaagtccacggtgaggaggaaatggttttcactgaaaaacaaagttgaaaaacagtttactgaagggaagagaaagaggaaagcggaggggaaaaaaaaaaaaaaaacccacatacctaaaactgtctgatcatcaaaatcacctagttggttaaaaatacagattccaaaatgtgttccaagtcaataaaatattattcttggtagctctgggtttctttttccttgtggtttaaaaatgtagatcccttgtcaattatatctcagaaaagctggggaaaaaattaagctacatgtaaagtcagctgaagaaggaaaatcagttgcacagcaagaaaactttttcagaggggatttttcagtgcatgtggagattgaggaaagtgaattaaattgtcacatttctaagctggacattaatatctgaacttggaagatttaataatataatcagcttttcttttttttaattaaggagaatctgctattggaaatacaatgtaaatctttagaaaatgcagatttcaactcatgtagcttggaagacccctgggtgggtaggtacaatgagtgagcggaagcagtgtcttatggaatcaacagtgtgggtcatgtttctaattttcccgttaggctttgggaaggagggagaggagatgcaacaggatcaggaagaaaaatcctaaaagccacttctctccaaccaggctgggtcttccgctgaatgactctgtcccatccctccttcctttttcacttgttttccagtgaattgtctccacctaccttctcccttccctcttcttcctccaccttaagcccctgctacctgaacaatgggaagctggataaagcctttcaattccacagtgtgtttgtgtcccagttcctggaatctgccctcatataggtctgtgcatgcgtgattaaatgaaggatcttgagatgggaagattatcatgggttattctgatcggtctaatgtaatcacaagggtcctttaagagagaggcagatcaaagagtagaaggtgaggagatgacagaagcagagattagagtgatgccctttgaagatggaggaagggactacaaaccgaggaatacaggtggccactagaggctgaagaaggcgaggagatgggttcttccctggagcctcagggaagaaccagccctctgacaacttgatgttagtctgtgagactgatttggggctttggacttctagaaatgtaagaggatgaagctttactgtttcagccattcagtttgcagtgatttgttacgtagcaatcagaaagtcctacgctgaggcttccctctggtggtccagtggctaagactaagtgctcctgaggcatagaggccctaggttcaacctggtcagggaactagaccccacatgctgcaactaaaaaagaccccctacgctgtaataagacccaggacagctaaataaataagtacttttttcaagaaacagaaagacgtgcacctcctgacctcttccccgtccaccccaccacccagtccccacctgggaccgaactcttgccaacacttgggcccttcttagcactgctgtccctggccctcttagcgatgtttgatattttccactttgctctttcttaaatcttgcatcagcccactcccctggtcgtccttctgcctctcgggtcctcttcctcagcccttcctagtgctcttctatcccacctccaacatggctgtgtgtcccagggttctcttctcaacctgcctttctgctcactttctactttctcggagtgtcacattccagtgatgatcccaaaatcaaggccatgtgctccacaccccagtagccagctggtaatagtggtcttcctgctccctcctcagcaaaccactatctctatccgaaagcattttccaccttccctacctgttgaaatctggctcaccagtttattcaaggtccagtttataattgaataaactggctcaccagtttattcaaatgtcacttcctccaggatgtcttctctgtctgccatgtcacatgcttatcttaagtaagtttttttttttatctttatttttttttagagtagttttagggttcacagcaaaattaaacagaaagttcctgaggagcacttacttttcataggctattgtgtgaccagcttttattgacattgtcttattcatttcactcaacaaatctgtgtagtagagaggcattttatttttctttctttctttaattccttccttcctctgtcccgtctttcctttcatccaggtttactgacatataattgacaagtaagaatttcatatatttaaaggtgtacagtgtgattttttgtgtttgttttaaattagttaattaatttatctggctgcattgagtcttagttgcagcatgggggctctttcatttaggccctagcgcttctctctagttgcactgcgcaggctctaaagcccatggacttcagtcagtatgcaggcttagctcccctgagtgtgtgggatcttagttctctgaccagggatccaacctgtgtctcctgcattggaagatggattctcaaccactggactactggggaagccccacgatgttctgctctacatgtccattgtgaaatgattaccacaaccaaggcactcaacacatattacttcacgtagtaccttttttttcctttgtgaaaacaattaagagctactcctttagcaaatttcaagtttataatataatataatgctaactatggcagtggtggtttagtccctaagccatgtctcattcttttgcgaccccatggagtgtagccccctaggctcctctgtcagtaggatttcccaggcaggaatactgggttgagttgccatttccttctccaggggatattaactctagtctagtactatacattagatctccagaacttattcatactgtgtgtctgaaactttgaaccctttgatcaacatctccccatttctcccacctcccagcccctggtaacctccattctactctctgcttccgtgagttggactttttaaacttgcacatatgagtgagatcatgcggtatttgtctttctgggtctgcttgatttcacttagcataatgccctccaggttgacccaagttgtcccaaatgacag

SEQ ID NO: 50246 - DNA, 779 bp, Bovine  19866880478593
atgactgtcaagtcgtatttctattaagctgattctgaataaattcagaagcttcactggcagtgaacattcagggaggaaggaaaacgtgtgtgccgtctcagtgagaattacagaaacaaaactctaaaatggtacaattcaaggtaatgagatttcctctttaatctagaaaaatctcgttctctttaatgaacaaagtgagagttgacgtggccagtaaacctggtattctaagtcaggagtttctaaccactctgagaactttgcattgcagggtgtgaaggtcttcaaatcaccaccaaatcaacacagctgatgaaggggagttttctacaacatgagttttcttgttcaactatgttgcgttcctatgtttcacgtcaccaaaaggaaatgagccatccaaactgtatctcaaagtggcagaaaggtcagtctccaatgtgacatagcagatactcagtctagtgtatatttaaaatcagatttttaaaattttataaatttataatttaaatttaaaattagattatttcagaagcacttgtttctaatgctaccaataggaaaacagagaaaaagaagaaagcactatttcaaacccttttgattattaaaaacagcattaatctagttcattcattcaacaaacatttgttgagggtttacagtcaaatgctatggggagtatataaaataactggtgacgtgttcacatggctacttaaagtacaatatacaatatatagcttaaattataaatcacgattcaaaga

SEQ ID NO: 50247 - DNA, 1018 bp, Bovine  19866880495791
cacacacagccctttgtgatcagtgagtcaccgttgatagcctggctttaggttttacatcctgagaccatgggaaatgaggcacttcaccacaaagtttcaatgtggaaccaggactctcacatctccccttatggcaagttgattttaagaccctttaattactcccgataggatatcagtgtggccagtaagccatttacctctataaaactcctgtatttgatgatagttgggtactatagagagaggatttgggcgttttgttataatctttgtctatggtatgatgtcttccaagcttaacctaatgtttttccaagtctctaattatatttttcattcatttatttaataacaattataataatggccctcattagattagtttttgtatttgagaggacctaagaagctaccttggagaaggcaatggcaccccactccagtactcttgcctggagaatcccatggacggaggagcctggtgggctacaatccatgaggtcgctaagagtcggacacgactgagcgacttcactttcacttttcactttcatgcactggagaaggaaatggcaacccactccagtgttcttgcctgaagaatcccagggatgggggagcctggtgggctgccatctatggggccgcacagagtcggacacgactgaagcgacttagcagcagcagcagcagcaagaagctacccagtcctgttctcactttgtagatgtgaaaattgaggcgctcaaggtcacatggctagtgctggaaataaggttaatggttatttttagctcacagttagctcaactaagacatttaaaaaatttagctgatcatttataaatggagtttctattagcaacaataatactagtttggattcaaatattttgaaattaagctaagagccccagtgttttgatatggtctggaggtgtcattcatgcatttttcacagttgtttatagaacattcaatctaggtctttaggcagagtaggtaaatgtgt

SEQ ID NO: 50248 - DNA, 1817 bp, Bovine  19866880568809
aacttgcctggaaaatcccatggacggaggagcctgataggctgcagtccatggggtcgctaagagtcagacacgactgagcgacttcactttcactttttgctttcatgcattggagaaggaaatggcaacccactccagtgttcttgcctggagaatcccagggacgggggagcctggtgggctgctgtctatggggtcacacagagtcggccacgactgaagcgacttagcatagaaccaaaacaatgtacctgaagtaaagctatgagacttccaaggccaggtcagaaagcaccatgcagtttcttcctggttctcttggaaacctctctctagaggaagccagctgccatagaagaatttcagctaccctacgactgccatgctgaaaggccacatgcactccaaatgaggccctatcttctagttatcccaccaaggtgccataatgtgaataagtctgtcttggatcctcctgaccagttcatctgtcagctgaataccaccaactgaattcagtaaataccccaaggagaagaatcactcaggtatgtactgccctaattcttgatgcataaaatcataaaataagagatgtccacggcttcccttctaagcattcaaaatgtcatgtgtagagttgttactacatggggctaaacattaatcgagatgtcacttctttccctccattcctagagccatcatcaaagcttgtatcacctctgctctagattattaatagctgatgccaggctctcctcactactatctgtcattacaatctatctaacctaacacttgcaactgaaaaactactttgaggtaccaacaccataaccaacatcagtctcataatgttttacacttgtagaaaactttataatgcaaaaggatcttcataaatatctattttacttgatccatataagaaagaccagagagatctgtcaatagagcaaatattctcttccttactttataaagagaccagaggctgaggagattcaattttatacaatctcactgccagcagaactaagacctcgtgtcatagatcattgctagttctctattctacttgcctcctgagatctgtttcagattaagaaaatgttcagtgcctctttccatcccaactatagcgactctgctttctaggcatccataataaggctttttctattcaactggatgttattgcctagtaactctaccactactgcaacaatcaggctggctcacttactcacctaacaatctgtcaggctgattatagcctctcagtatttacttacaaagtctcctcctttctcctcctatctacttaaaccttactcatgtgttagcacaaattctgcctcctccattaagccctactagcccatccctgttgctttctctctgctattcctacagaatttgcaaatttcgcccaaattttgacaattttattggatcatcttgttcaagtgtcttggtctcactttccaggctcgtattcagctaatacatatccatacagacagcaatgctgggtgctcacagccactgtctgttctgaccagtcagtgcccatgacataccatttgttaaatattttgaatttcatccctgcttatttctccaactaaaccataagctctttgagagcaagaagcttgtctcataaagaagtatttcagcctccaaaccaagcataggactaaacacacagctagtgttcaatacatacatttgctaattgatttgaagggagtgaagtggattgtgctgtgagaaaaaaatattcttaagtcatctctacactggaa

SEQ ID NO: 50249 - DNA, 934 bp, Bovine  19866880577710
tggctgggaacctaagtatttagggggatctacaggctgtcactcctaaaaatacagccccccagcctgggagtcagccaggtgtggctgccacacagcctcccagcctggctgatgtgcagttctggacctgcacagacatcacagcagctgcctgtgcagatcccaggagcccacggacacccccaagacgcacgcaccaagtctgcacatacagaccttgctgaggcctgttcctgtttgtatacaggtccctcgtccacatacaacctcaatgcactcacacttcccgacacacaccgacagacaaacccgaggccttccccactagaacaccagcctctccagggtagcgccctgttgaatttgcccactgctctttcttcaatgtctgtaacagtacctgacatacaccaggtgctcaggaaacgtttgcgctgtattttttattctttattctttggctgcaccacatggcacgcgggatcttagttctctgaccagggattgaacctgtgcctcctgcaatggaagcctagacgctttatcactggaccgccagggaagtccctaaaatatgtatttttattaattcattcatttggctgtgctaggtcttaattgtggcatgtgacctcttagttgcggcatgtggggtctagtttcctgaccagggattgaatggaatccattggaagcccacagtcctagccactggaccaccagggaagtcgtctgttttataaatgaacatgtgtgcacacctccactcatacacacacacattctataactagttaccctcatcctcactccatccttgcccctgtgttcaggtgctacgagccctggagagggcaacaccaggaggcttgtctttttctggcctgcccaatcctgcacagccagagtccaagccagggtgagggcttgg

SEQ ID NO: 50250 - DNA, 1167 bp, Bovine  19866880601592
ttaaaggcttttgtaaaatacagatatcatttaatatgactgactctctctagaacctgtatctatgccaaacatttcttcaaaatccacaaaaattgtagacctgcccaaagtaagttttcttaatatcaggttttttaggtgtattctccacattttttggctcagaggttaaagcatctgcctgcaatgcaggagatctgggttcaatgcctgggttgggaagatcccctggagatggaaatggcaacccactccagtattcttgcctggaaaatctcatggacagaggagcctggtggggctacagtccacgggattgcaaagagtcggacatgactgagcgacttcactttccatatttttaggtgcattctctgccattaagcagtgtaatgaatttagataaaataagtctatccgtactataaattattcaaaatcaaaaagtaactataaaagagaaacctcatttaagccaagtatttcactttattcctataacgaagtgatctctcttttacagataagctttaaaaaaaatagattatcttgtctgcaatcacaaagaaaattcagaagaggattaggactaaaatatgtgtcttagtcctcggtgaatattcttttcactatgaggcttcccggtggtgctagtggtgaaaaaaaaaaaacctacctgccaattgcaagagatgttagagatgcaggttccacccctgggtcgggaagatcccatggaggagggcatggcaacccactccagtattcttgcctggagaatcccaggaacagaggagcctggcaggctacagtccatagggttgtaaacagtcagacatgactgaagtgacttagcatgtatgagtggaaagcagtagtttgagatttttttttaagtcctattgtagagataaaattcccactaaacatcctgaactatttggagcggtcttatgtgtgtgcaaccttcccttacctcgcttcagggctctggggctgcctggcccactccgactgcgagagtctgactccgaggtccgggagctggatcttgaactgtcttcttcttctgacccagaggactcatccaggaacgggctgctgcttatctgggtcgccttctaaagagaaacaaaatagcctccctgtgtgtccatctctaaa

SEQ ID NO: 50251 - DNA, 2730 bp, Bovine  19866880623757
agaattttagtatatcccaaatattacatgggacatacttatagtaaaaatgatttgctcttagtctgaagttcagatttaaccaggcatgttgtatttccatttgttggctgacaactctatttcagggccaggaggcagggggctggtggagaagtaggggtggtggggggtcatattccacccaaggacagctgcctcaggtccacccaagccagcttgtacctgttgagtagttcctggggccagcctcacgctgggagtagtgggagtgacatgctctgggtcccacggctctgcctagacccacatgctcgtttcagtgggcctgcatgtgggagcgggttactgcacggggtctggaaaccagactgatcagtgggagctctcctgcagatgtggccgctgttttccaaaagtcaagagataccattgtgatgaataaaatgcacatttgtttaaaggcaagcattacataacagcttttggctcttagagctttctctcaagaaaataccaaaatgtacttactagggtagaggaacacttttggagttttcatactggaaaaaaaatctaaggactattaggactgagaactctaggacatgacttttcatggaccatggacacagtggacctctgctgaagcctatggactttttcttggtgttttcaaacatatacaatcaaatccataggtcacaaaaggaaccagtggtgcaaaaatacagagatcaaaccatgaaggaaacagctttatgaaagagtaacaggcttctttactgacactttggtggtggtcatttaaaagtagagatgggtagatatttcaaaagatgggcaataatttcaatgtgatctcaaaatatctgatttctactggtgacaacgtcacagtttctgcaaatactactgtagattgttccctgcatttcagttctctgctaaatttcagtttgaggcttgtgtaaatacatattgttttctcatctgaagtcatggatccctgaattctacccacaaaccttttgcggtagcgcccaataggcattgggacctggacattctggagacaaggcccgaggggagggctttaggcaatgctgataacccagtgagaaggaggccctggtttattttaaatttaagtggtagaagaactcacacaatacaaacacaaatgtaggacttccctggtggtccagtggttaagcatccaactttcaatgcaggggacatccatccctggtcaaggaactaaaatcccacatgctgcagagcaactaaaagagaaacccatcttgcaaccacaggaaaaaaaaaattattccataaaaaaaaaaataaaacaaacataaatgaagacatgaacgtacctgggcaacttgataagcatattgtcacaggaattaggacttgagataaggatgttcagagttcataaataatgccctcttgcaggatgtcaactctcaccccagtgtgactgcctgttaaagcctcaggctgagctaatcaagaatatctgcattccaaatattcaacattggaattaatcttgagctggctgtggatcgaggccttttatgtatgaattttaattttttccaggcttattgagatataattgacacataacattgtgtaagtttaaggtgagcaacagtgatttgataaacgcatacactgtgaaataataatcataatcataataagattagccaacatctatgaatggacagggaggcctggcgtgctgcgattcatggggtcgcaaagagtcggacatgaccgagtgactgatctgatctgatctgatgaataacctcacataactataatttttttcttgtgataaaaactttggagatctactctctttgcaactttcaaatatacaacacagtcatgtgaatttagtcaccctgctgtatatcacatcccaagaatggattaatcttataactggaagttttactttttgaccgccttcactcattgtccccatcctccacctctgcctctggtggcaaaaaaccccaccaatttgttctctgtttctatgagatatgtttttttagattctacaacaagtgtgatcgttgtagtctacaactccttctgacttctttcattaggtcctggttctggaaggattatgggtacatttggaatgagggggagtgaggcagggagggtggggtaggtccagtctgggttttcccctggtggggtgggaatacacggtagataagatgcaggggggtaggaaaccacaaggaagtttctggaattctgtgccttttgcctcctttcttaatttcccttcccctcttctgagccctcctcccacccagaagcaggatccaattttctctctcttttttttttaaatacaactcagaacaatttaatctctggggatttttctgtggagggaaactagaggctagttgtttctgcagttgtaagagaaatacatacatacatacatatatgtgtgtgtgtgtgtgtgcgtatgaaaagaaatgcaaaaaagcaaaatggctgtctggggaggccttactaatagctgtgaaaagaagagaagtgaaaagcaaaggagaaaaggaaagatataaacatctgaatgcagagttccaaagaatagcaagaagagataagaaagccttcttcagcaatcaatgcaaagaaatagaggaaaacaacagaacgggaaagactagg

SEQ ID NO: 50252 - DNA, 1479 bp, Bovine  19866880649692
tacgagcctctggtttttaaaatgattaaggaacaaatcccacatgttctttcctttttttctgtcctataatttgagtctttcttccacagttcccccaaattcagagctcatcatatttcttgtttgcaaggtatacgacagagataactctgaggtttaatgtatttatgtaaacatttttcaaagatgtcaagatttataattcaagaaaatgttctgtgaaagaatttgttttctgattacaaaatgatttcctgcttttgaaaaaaataacaactttctatttacttagctggctctgaaagtcccatggagatgactattcctttcaagccctaatatcgcttttccaggtgcaggactttgactgatttcaaaggtagctttatgcagagaaggaatctatatgctacaggagggaataagacagagagccctccccatcttaacccctcctgctttccccacaaagaacaacagagtgaaacagaactattgcaacacagatgagacacccgaatagacatgacaaaaagattttcacatgcctttgacttcctttttgcaaccagggtataagccaatctcggtaaagacaggaatctgtttgacaaacacaaacacaataccgagcacccaacacccatatatgtgttgttttttccaacaagccattcatttccctaacactcaggaacaagagcaatagccacaagcaccccagcgttagagggttttgactttcccacagtgtttcacatattttgcagcagaagaagtgactttgagaatagcaaaggcagcccagagacagagtaaaagactatatgttgttgctggacagactggcagaacgcaagccagaccctttagaggtgagtatggggaatgaggctgggaggcccatttgtaccgctggtagaagagccaaagaaacaatgtcaatctgactgcttctaagtttggccaagagtggctcttcagtaaagaaaactggatgtcccctgacaatccgaaccttccttctaactcagctgcatcccctatgcatctctgaaaagcctgttctgcatgactcattactacagattcccttcaaagaaacagcggagtcgcacagaactgtgtgggcctcagggtaccatctttataaccaagataatgacccctacccctcttcctcacagggatacagtgaggaccaagggagatgagtgcttaggagtttgtactgaagaaaccaccaacgatccataatgcacataacagaggccagagcatctggtctgggatgcttgggagttgcaccatcttttcaggagatctgcaaaattaaactattttcaaaatgacactgagacattactttcctctttcattctcattctctcccaagtgtacagtggagtttgccagaggctacaaggtgtgtgatgatgtcaccccctctaatgactaatggaatgtgtgctcatg

SEQ ID NO: 50253 - DNA, 1372 bp, Bovine  19866880673794
tccgaactataaatgccaagtaacgaagaaaccacaaaatgcggtcactagcagcctggtactgggcagtctttcgtgcagtggccgtaggtccattttcaaagggaaaaagggcaggtggcttcccaggagtgtcaagatttctctttctagtaactagtcctgggtatgctctcctattattccacacaccctggagacgggggacagcaacgcagacaagaaagtccccataaaagcctttgatttggaagctactggaaaagggatccctctctgaggcctgggggttctgcaggaggggcagactcctgggaagctgaatcaacagaagctctaaagcacctcttcctgagacagggagtggctttcctgactcaggcttgagtgtgctgtgggggcgggaaggggcgtggctggagggctcaggcgtgctccttctatacacgtgacatcgtgcggttgtctctgtacctcagtttcctcacgtctaaaatgaagggtcaggcttccctgatggctcagtggtaaagaaacctgcctgccaatgcaggtgacataggttcgattcctgatctgggaagatcccccatcctgtggagcaactaagtttgtgtgccaagagtacaacaaagcttgtgtgctcagagtactgagccagtgctccagagcctgggaacaactcctgagcccgagcgctgcagctactgaagcccgtgcaccctagagtctgtgctctgcaacaagagaagctgctgcaatgagaagccctcatactggaactagagatagactccactcgccacaactagagaaaagactgcacagccaaaaataaacaaataaaaattttaaaaaaataataaaaaattactataaaatgaaggaccactagtacctcttattaatgcacacaaaatgcttggcacagtgtttggcatggagttaagtgctcaatacaggttgaccataattattatgacccctacaagggagatgatactgcaaataatgtttcctgaaaatgagaatacaatgggaatcctgtatacatttcaggggtaggaaaacagccttgtaagatcacttacatgatgtgggcaagatggacaaaacctcctccttgcacctaaaatattttttggaaactgttatgatgtcatttctttatttctttgggattaactgatccttttcaagattcatattttaatatgtgacacatacagataattacaaaaaaataccaggttatataaaaattagtaaaatgcagactaggaaaggaaaagcccacacataaacccaccaagagaacttaaacttgagagtcagtgaaaataggtaagatatttgtttaaacacttggtaa

SEQ ID NO: 50254 - DNA, 972 bp, Bovine  19866880697457
ttgttataatgtgtggatattgtgttcctgtgacagatctcttcttggaacaaacccctttaagaggtcagtcttataatatgaacagagagtggtagaggtttccgcctgtgtgtgaagtacgaagacatcactgtggtgcattcattcctcacttccaggaagtgcacatgctacctttttttcaattagaaagaatattattcctctcttttcaaagacccttaagactgtaggcaaccagtgttaagtgtttcttttgaatccttccacaaaatatccatgcatgaaataatcctaatactaatagtagcttttataagtggttatttcacatgttttctcattgaatcctttctcaagccctacaagatagatcctattgtcatccatatactgggccatagaaaagttaggtaagtgacttgccagtggccatagggatagtaaaagcagaactaagacctgagctgagcccaggcaccctgcctcctgaacacctgtcttatgagagacagagactatgtgtgcatgcattttgttttttgtcactgatgaaagcatactccacacattgttttgccccttgcttttttattttacttaacattataccttaaagattgctccatatcagcatgttcagatattgctaattgataggaaaatatttccacagtgttgaaattaagaggccatcacctttatgaatccaaagaataaaaactaagtcctcgcaatactaaatcagacccgacctgaaagacctttctttaatattcaggaagataaaatctaggaataggttttaaaaaaaaaagaaaatgaaaataagtgaaatgaagtctgtcttttagtgtcccagtattttttccttccctttgttattcctcccccaaattcccagagtcatgatttttttatgacagtgggtaccagttggaaagggtgatttgacacacagatcaccaa

SEQ ID NO: 50255 - DNA, 2535 bp, Bovine  19866880729798
gaggcctggcgtgctgcggttatggggtcgcaaagagtcggacacgactgagcgactgaactaaactgaactgagagtctctgcccacactgaatctggtctgggactgcaactctccttaaccatagaatatagccaaaggggtactgcttcagtgttggcctaagctttagtgaggtgtaggggctcccatttttgcacttttgagagccctgtgctgtcaatgtaagaagtcttgtgctctgctggagaattccacatgaagagggagaaaccctgagactagttggagacagagggaactttagcaatcctagagtcccagctgagcccagcctttcaaggtcctggccagggtgacagacacaagaatctggcatcttgattcagacagtcaagtgcccagatgactgccatcccaggtgccatctgacttgtagcaccatgagagaccctagcgagattgatagaagaactgtccaggtaacttataaaatcttgaaagatgataaatatttgttgttcattttaagccactatgtcttagagtggtttgctatattgcagtagacaaccaaaaaaggaagcacccaggatagcgcctggcatacagtaggtactcaatgaatattgctgactaaatgaatgaacctcttccattcttttcctagggcctggtgctctgagatgcctcccagccccctgctcacccctctgcacctgccttatcttattgcccagggactactggggctaaagtgaaaagggggcttctgctgggctcttgagtgcacaaaagcctgaaatgacagtttcctttgtgagaaaaatcccagcctctggatgtctaaggcaatgtcttcccactttttggtaaaacaggcaggtttactatatttattttttttttaagtatttatttattgtctgtttgtttagctgcatcctgtgtgtcctgcaggatcttcttatgccacatggactctagttgtggcacaaggacatagttgctcctgcagcatgtggggtcttagtacccagaccagggattgaactcgtgtcccctgcattggcaggcagatcctttacgtgggaagcccagaaggtggattgttaaccaccgaaccaccagggaagtccctcgtctatatttctgaagaggaaagacgtgagaatcagcttctggagtccatctaccctgggtttgagtccatgctcctctatgtcttgactacgtgacagtgaactgctgatttaaccaactttcttatctgccaaatgggctccagataaagcttcagtgcagaaactcaacatgctatcctctgtacagcacctgcagcacagcagataccacagagctgtgagtgtgtctaaacaagggtaaatctcagagacaatgcagagcaaaatatgcccatggccagagcacacaccatttgtgattccactgaaacaaagtccccaaaaggggaaaattaattgatggtaagagaaagaaacttctgagagtggttaccactaagggggggttattgactatgaagggctccagggaaacttctagggtatttgaaatgttctatattttgatccattgagccatgccatttaagacagtttgatgcctatatgttacatcttaataaaggagttgagaaagtgtcagtgtatcatcccttcactcaggcatgatctttaggagtttcctaacttccaggccttttgcccccacggggctgtctaaccttgcctgctcacccccaagtccaccctgagagcagccttgggtgacgctatcctagcgcttggcgtaagttggctgtcactgccaggcttgacctggggccgattccaggatgagaactcagttggaacatgggctgactttctgctcttgggacgggctctggggcttttcaagatctgagtggggcatcctgcttcaggatcgctggggaggcagcggtgggatcctcgatgcccttgggagtttgtgagtgggaagggggtctttactacctgccagcaaagacctgggggctctaaggggctgctgcggagtgtttggaataaatgagcagcaggatcacgtccttggcgtggcaggcccagttcctggaaggagagccgggaggggtgggcgctgagggcgtccggactgggcagaaataaagagcttcttctgctcacaagcctgctatttgaggacctggagccatgacgtccctcaaagtttccattctctgtgctgcagctgttggttacgtgtttcattcaaaatgctttgcaggaagcagcaggctccacattccagggcttttagtcattttttctctcagagctttggggccaggattagaacgttcttcaaaccacactgtcctcggcaggactcccaagaggaagtgggtgggcccctggaggatgagaacatgggccccaattcagagatggaatgaaaaaagattaaggccagcacaagtaaactcctagagagaggcttagccggtggcccacgtagggtgagggcgg

SEQ ID NO: 50256 - DNA, 1539 bp, Bovine  19866880749944
ggtgagagaaaaatagcttcgcagttccagacatccgtcctaccccatactatccagggagaaagagttccttttgcagaaactcccttaaagactagtgattagtgctctctcattggacaaaattaggtcacgtgcttgtttctgaaccaatcaacttgctgcttgacttcagccgatcacgatctaccactggagctgctactgagttaaattgtgtgacttggacaatttactgagccttgttctcctcatgtataatacaggatgttaataatacctagtgttttgagacagtataaacaaaatcaaaatttagcacagtgcctgacattctctgcatttgatcaatgatagccaccaatagctattagcactaattctaaaaactagggctccattctcaaacctggagtatgaaagctggactggggctttcagtttgaaactaatatcggtctggggcctgttcctgagaagagggagtggtaccaacattaaacttgacccccagccctaggaggtaaactgaggcagtatgcccatggttcagctgaaagcacaggggtccagagagatccatgctccccctaaccctcagcaatcccaagaataaagagacagaggtgattctgcccaaacatgactttcctctcattctgtgacctcccccggggatcattcgggcccctggggcagggctgtccattaaatggccacattcgatgcaagaggagcagaaaggctgcagagcgccactctggctcagctcatggtgggcgatggggtcatatgccctgacaggcctttacccagggagaaaaatctttctaatagcccagaagaatgccctaatctgacatctcgtttagcagattattgggcccggctttgatctctactgggcataatgagtgcgcctctggggccaatcagcagtcattaattagcacagcggcctgcagctgggcctgcccaggaatggggtcctcagcctgcgaattgggagttgagggtgatgtttgtgagcaagtcaggcccagactgaagctacgggatagatcagggtcaccgggatcagcccccgaggtctctctgggaaagtgctctaatctgggccttcccatgacacatgtggcacaccagggaccaggcatggctcccatttggcaggacatcacccgacagtgtgagcagagaaccaactgggcacacggctcacggggtgtgacatcgcaacacagcgcaccacagtgtgcaaggcacgtagcagaaaccacccggctcttcatctagccctctcgtggaagggcagactctgcctctatgactgattgactcttgaccaccatttctgtctcttcttgggtccctagcaaccacctatttgggcttttgggaccctgggagatgaggtcaaaagatagtttttgagtcctatggtttcatcatctctaagagcagtggtactcagccttgcagtcctgtattagggttggggttgcaacaaagctggaccaggaacacagatgaggaggg

SEQ ID NO: 50257 - DNA, 1584 bp, Bovine  19866880810167
tatatgactcagtaactccaatgttaagtatatactcaagagaactgaatacagaagtccacatcaaaacttgtacacaaatgttaatagcaacattactcaaacagtcagaaagtagaaacaaaccaagtatccatcatcagatgaaaggataaacaaaatgtggtatatccacacagtggaatcttcctcagccacagaaggaataaagcactaatacatgttacaacaatggatgaactttgaaaacattaccttaagtgccaagtgaaagaagccagacacaaaaaatgacatattgtatgattctattcatataataggcaaatctcaagacacagtatgttagcttagtggtcgtcaagggctatgaaaagagggcaaaggtgatcaactagtaatgggttgggagcttctttgtggagtgatgaaaatattctagaattacacagtgctgttgattgcacaaccttgtgaatacaccaaaaacccactgcactgtacacttaaaaagtaacttttatggtttctgaattacacctcaattatagagagtatatatttacaaatgaataaacaaaaagtaacagtttaagtggatgtatattaataatctattgtttgtggttatccctgccaagaattccaccattaactcaatctagagttaattgttaatctcaagtagcagacatatatttcaccaagagtactgtgctatgaaaatgacacatcaaataaattctgttaaacacatctattcgtttctttagttatgtaattacatactttcacagtgaagtagcaaaatgttaggaatattattggtatttaatatctgcattccttattaatagggtcattattttaaaaatccaaaactatagattggttggctaatggcctatggttggctaacggttgcctaatggtcctgagatctagacacctgatttcctcatttcatcctgtaatttcagttaatataaagtaactgctatgttaatgcaccagctttctaaagattctaattttgaacaacggtcaccatcttttcccattactactgattttacagagtctaacaatatacatagctttgagagccatagaaagaaagaaaaaagaaagtgaagtcactcagtcgtgtccagctctttgcaaccccatggactgtagcccaccaggctcctctatccatggaattttctaggcaagagtactgaagtggattgcatttccttcgccaggggatcttcccaacccaggggatcgaacccgggtctcccgcattgcgggcagacactttacattctgagccaccagggaaatccccttgagagcctatgactacctgctaaataaataacatttttagatttcgaatttaaaattaatctatcttcacagcagcggacaggaaaaagtctttgttttccaaatacccccaatgacttttggaaacatttactgacacaaaacgaactgtttacagttgtggaatgaatgctcttttctctgaatctttgacttcctgtttctcttacaaatccctagagggaaagaaaaagaaaataaagaatt

SEQ ID NO: 50258 - DNA, 1387 bp, Bovine  19866880830989
ttggcctttgaagggtaggccttcctgaggtggacactttaatcgcccccaattaaaccattgccggaagcttttaacagccccatacggcctttcaaggactgcccttttgttagacggccaagctgtcatgtaaaaggagagcaggctgggggcctctgaccactcaccccaggccccaaggccagccagccccaaactcaggccagcttctgaagagtctgctgctttgcgaatcaaaggctgaggaacctgctttgatctggggggaaacccagcccttccttggctccccagattcagttccctcactgagggtgtgggtccttccatgaaggcttcacccacacagtttccaagtctggggccagccaggctgatccctggggttctgggagtctgcccctcacttcaagaaacaggtccactgagatggtgaaaacattccctgctcctactgcccgccttgggcaaggacacccccgccccaccttctccggctactctagggtcttctagcccttgtgacagagtgtagtcctcaaatgagtgtcctctgggaccctgtcagaaatgcagacttccaggccccacgcctttcagacctactggatcagaatctgcttttaaacagctcccacaggtgaagttggagaaatactgctgtagtatttcatcctctctctgcatttcctctcctactgcccccacctctgcccccaaaggcaagattaagtgtagaaacgatactagccatgataagttatggacaatatagccctctgctttgcagactctacaacatatactttctggaaagtcaacaacaaagcccttcctgtcaatagcagtttctggaggaccccagatggcaggcttccgtttggtcatttagttaacatcaaaactctccatcctgacttccacacttgatccttcatttcattctcagaactgcccgaggaagagaagacaagcacccccattaaacagcagagaaaactgaagctcaggaaagttcgtgaataggctagaggtggtggtgaagttgagggggcgggtaacctagaaaaccctcctggggtctccctgctcttaggtccagcagggctcccatccacagctatgacgtgtgtgccagagctgcagcccacttcccacttcactccccaaaagtgtcctgggggtgggcagggccccctgtgtgggaggaagccaagcctctttctgttacacaaaagccccctacaggcaaggaaaagccagaatttcccaattcctacctcctccccttcctcctcacaaaagctgcagttcatccagaatctatgacacgcatgccagtcttcaggcttagcgctttctctttcaccatcccacttagtcc

SEQ ID NO: 50259 - DNA, 2258 bp, Bovine  19866880862063
ttctcccccaaattgctctaaaatttcatgcaataccaatcaaaaaacatcttgtctattaccttactatttattctttcatatgaacttactgtcatgtgaaaaaatatttttaattaaaatttttatttgcaatgtattaaacctatggttgttttatttggccacaccatggagcttgtgggaccttagttccccaaccagggatcaaacctggggtcctggcagtgagtgccgagtcctaatccatgaaatgccagggaattccctaagcccatgtttaaatttggagaaaactgacatctctataatatgcaatatccttagggaaaacccaagagaatcaatggaagacatattacaaaggattttcacaaatgatattattacaaacgagagtgaggtgactgagcatggtgtaatatataacttaggagtacaggccctgaaactctggatttgccactttctagcagtgagaccttgggcaagttaacttctctgagctttggggtttcatatagtacaaaacagtactcactttctaggactgtaatgaagatttaatgaataaatatatttaagtgcataaaatggtgcttgacaaaaaggaagtataatgtaagtgatgactaacagtataattacaaagtgaatatttatagaaaccaatcaccttcaagagtaaaaacaagtcaaaagataaagcatgagaaaaggattcatgacgacagtagtaagaaatataagagaaatatgtgatctacatgaaaaaagctttaatacacaatgccactgaggaatggaggagaaacgaatggaaaggcatacggtgtcttgaggaggtcaacagcataaaaaggatgttatgcacggtgaataatttaacgcattaagttaatgcaattccaataaaagtatcaatagaatggaggatgggaaaaccaaacaattgatttcaagttcacagggtactgaaaaagaaaagtaatgaaggggaattagtctaccaaattgcagaacatattacaaagttcttgtgagcaaccggtgtataaacagacaaaccactcaatgtagcagactagaaacctagaaaataagagcatctgaatactgagatttagtgtatgatagaacgataacatttctgtcaggagtgataaaatgtacttttcagtaaatgaattcgggaccaaaacaatcatgcaatagctgtccattaatttattttttaattcctattgataaggctcaatactcttaatagtattttaaaatttataataaaaataataaatgaaagttatcacttactaaaaaattatactatgatagccactatattgggaagttgtacatacaacatctttactccttatatcaacctttcaaattatgtgttatgaatagtttatggatgtctaagcttcattttagaatttaagtgatttgccccaagtcaaataccctcaaagtggaaaaagagtacatcaagcctagatcccaaacctctttccatataccatcctccacccataaaataacacaggtttcaaagaaactctaagcacgaagcaattaaaaccatgggatatgattcaatttcttatactataatggaaaagaatagaaaaaagaattagatctatatgtataaatgtataattgaatcactttgctgtatagcagaaattaatataacattgtaaatcaactgtacttcaataaaaaagagaaaaaaacagtgcaagattataaattgtgcatatcaagtaggaatgaagtgactacaataaaacacagtatcttctctttatgctttttttgttttaaaatggtaatgctggggtcttatttccactctgtcaggagagcctggcatttcagccactgaataatagtcaaggtgaatccaccttataccaaattctttccaataaagaagagagttaaagtgaagctacagtgagcttcaacacaacgtgacactaaggaaaactttgtaactgttttcattttctacatacaaggtcccaatgtgggaaaccgaaaatctgtatgccagaagaataaaacacgggttattttgacttccctctgctgggcaataagcctcttgaacttctatttttggaaatggaggtatccctttaatcctgttacagaactgctgatggtggtaagacggcagaggaaaatcggcaccgggcctgtaccagcaccgtttccaagagcaggaataaaacggagcacag

SEQ ID NO: 50260 - DNA, 1440 bp, Bovine  19866880885061
cttccctccctaacccggtacccggtagtcgactacagaccacgctgtgagctaccgagacaccgtagagctagaccagcttccgggactcatcctgactgctgcgactcttctcagacgctcacgagcacgaggtttggcttccaggcgtcttctttgccagagccgcggtagtgcgcgactctccaccgctcggccactttactagggcagccaggggatgcacatcaattcccgttctatagttacgcgagaatttggcggtcttgaaactgatttccgaaagcttaggtctccatggagatagcactttaaccattccggccccccccccccccccacggcttgtcattccctagactccacgtggttgggaaattgtccacagaatgtttgtgggagtcagccagaaaggtgtaggtttcactggagcagcaatcataagggaagcagccagtggggagcaggaggagtataatttactgagcatcttctggccacttaaggagtgccttaaggtgggcacgagattttccactattgggaggacaaacgtttgggcatccactaagcacgcataagcaccaaacctctttgtgcagtcttaagggttccaagataaagttctgcggcagatttgctcacgattcatcacagaatcgtctccccatttgcttatctctatcccttctaaggtttgtatgttggtgacttacatgggaagtgatccgtagtgcttattccccttgatttaatcatgtcactttgcaaatttttaccttgtcgatgcctttctagcagtgtcgatttttattaccattttctattaagtgggttttcctatttcactgctgtattaatttcttaactttgcagagggaccataggttcctcagtgtcaggactatcttgtcacttggatatagaatttacttaagatgacaagtagtccacttttctgctgttaaaagtacacatactttttagtacatcactgataaaagtttgttaattcattagtttattcatcaaaattttttaaggacctgatatatgccaggtactgttttgggaattgatgattaaaacagtgaataaaacagattaaacttgctgccttcattgaatatattactaggggagacatatatgcaaataaacaagttcttgtaagttcaggtagtagtaagtgctataaagaaaataaagcaatagaaatgacttatatgtgagtagaagtggtggaattttaaatagagtgtccatggaaggcttcttagaggaggtaatgtttgggaagagacctgaatggtgaggagttggccttgcaaagatttggtggaataagcctaacagtagacatatcaggacatacaaagtcccctagatggtgaagagaagattgatttgaagtgaactgcaatggaaggaagggccagg

SEQ ID NO: 50261 - DNA, 976 bp, Bovine  19866880910436
ttacttcataggttgttataataactaaataaatcatatctgtacagtgcttagtacataataaatcaatatttggtatttttattttaataccagtacttggtatttttatgggtgggtaccaaaaataaattttaatccagagaaaaaaatagcgaaaaatacagaaaatatcatgaaaaagtgttattcctattttggtgttgaatatatttactgggaagccatgagtaacttggcaggtttatcctctttccactgtataaaacacatatgaatcattccatctctgagatctgtcaaaggatttaagacaaataaaattacagaagaccccaaaaaaaggaagaagaagaaaaagaaaccacatctaaaacagcaattctgaaataatattcctctcaatctttattcactgacaaagaaaaaagaaaatttggcaactaaattaatgaccaaaaactatttacaatcttacttacagagaaaattacacttttaaaatttacaaaatggacactcacaaagaaatttcttatgacaagcctactgaagaacaaaacaaatactggcattaagaatttaaaggtcaattaactggaacccaaataagcataactttttataacttcttataaagaaagtccataaagaaaccaagagagtacaacagccaagggaaccaagaaaattttgagtaggaggctgtggtcaacagcgggccaactgctgaagggctgaggtactgggacacttggaagtgtccagtgaggctgggcagcaaggttataattagtgatattgctaaaatcattacatgggggacaatcatagtacaacctgggaaatgatttttacagagagaggagcaaaaggtaaagcatgagtcactgactctgagttaggataagctttcccaacttggagataatcaaactgggatttttttttccaagttataatttttattttaata

SEQ ID NO: 50262 - DNA, 1200 bp, Bovine  19866880913729
cgcctacacccctcctgatcgctaccctttatactcaggtccccctcctgggatggggagccacaagagtccatgggagaaaacttattgaattaaacagaggacgtcccagttgaatttgaattttaggtaaacagtgaacatctttccagtgtacatatgtcccaaatattgcacggggcaccttacacaaaaaagctatttgtggtttatttgaaagtcaaatttaactgagtgtcctgtatttttatttgctaaatttggcaatcctatactggaggtcaaactattctttggaccagaactcaaagacctggccaatatgtacactgagggtcgggggaaaaaaaatcaagtgtaaggtcactttttgaaatgaggagtgaggcagcacagagatttgccaggcaggatggtagccagcaattcaaaatgtcaattctcaagtcgtctccttcttgaacgatttcctgctgggaccatgtcagtggccccctctccctgccaagagtcagagaggctaaaaactgtgcacagaggcacgctgggactgtgggtaacctgggctgtgtgcggcttccgtgagattctgaaatttctgaggtggagagtgagcttgcggaacactgagggacaagtagagccaaaataaaactcagtatataatctagggtgctaaaaaacattaacctcaatcttcatcactatcattttccgagggacatgactgagcccaggccaccgtgctcagggggaggggtaatgaagctgacctcaaccggaagctccaggttctctgagtgcttggtgaagaggacacagcaggtgaaacagaaatagtggcctcttccgtgatccactgcttcgtgggtccactttgctccaaactgctcgatgctgcactgcaattcaggcagcatgtgctctgttccaccatggcccctgtttgctctgatggaacacccgccagttcttgcagtcatgctccttgccaggtcccgggaggctccagagactgtaattcataatatatggccgtctagagcttccctggtggctcagttggtaaagaatccatcttcaatgcaggagaccctggttcaatccctgggttggtaagatcccctggagaagggtatagcaacccactccagtacccttgcctagagaatcccaggacagaagagccgggggttacag

SEQ ID NO: 50263 - DNA, 1931 bp, Bovine  19866880917736
catttggaagtgtttccatcgtaaggtgatgttattcctgaaaactatgtaaatatgtcaactattaaaaattctatctacacagttaaagaaataagcttggacaattttccaaacaaagagtgtaagaaaattttgaatcagtttgctaaaaatgtaaaaacaaagctttccaagtattttgcaaatataataaccaggaaaagtggaaatttactagctaaatgtcaaagtaaattgcacaatggatggatgggagtgaaatacaaataccatggtttaatgggtccagaatgatacataccttttattagagaactatctcttatatcatagctgaaggatatcagctatggccattatgaataccaagactaaaaatgtataaacattcacttagcaaatgattcagcaatcctacttctacgtatttcctcaagagaaatgaaaaacatgtgcacacaaataccagaatgccaatgtttatttgctttattcacaaattttctttgttcacaatttattcacaacagttttattcacaattgccccaactggaaacaacctacatgtccatcaactgttaaatggataagcaaattgcggtacgtccacacaatggaatactccttagcaataaaaggaacaaatgactcatatacacagcatggatgaaactcaaaagcaatatgctaagtgaaagaagccagacacaaaagatcacatactctgattccaattacatgacatgctgggggaaaaggcaaaaatacagggaaagaaatcagactagtgattcctaggggttggaagaggggagtgactgaaaaagtacataaaagaaccttcaggtgatgaaaatattatacatcttgactgtgatggtagttacaagcttctatatacatgtcaaaactcatcaaaacatacacttgaaaagtgaattttaccatacataaatcatattttgataaacccaatgttgaaaaaaagtgtttagcataggtgctcagtcacttcagtcgtgtccgacccttggcttagcatataatgctacataaacattgaatagaacaaatattttaaagcatatatagaaatatacaaccaaagggaattgcctgagtctccatggttaggactcagcattttcactgctggggcccaggttcagttcctggttggggaactaagatcccacaagtcatgtggccaaaaataaattaaataaaaaataaaatgaggagcttaaaaaaaaagaagtattacaaccaaaatattatcagggataatctctaagtggtaaattattgtgatctttactttttaattttgttttctgtttataaaagtaagcagaagtttgaaaaactgactctaacattcagatggaagtgccaggacctagaatcatccaaacaattttcgaaaaatgaagctggaaaacactacctgatttcaaaacttattataaggttacggtaaatcaagacagtttgatattactggcataaagatagacatcaatggaacagaatcaagagaccagaaataaacctttatacttaaaaaaaaaacccagctttattgaggtaaaattgatctataagtattatcctctacttacgtggacaagtgattttcaacaaaggtacaaaggcaatgcaatgcaaaaaagacggtgttttcaaaaaattctgctgatgcccatgagcaaaaaagtaaccctctatctacactttgcaccagacacaaaatataactcaaaatggccatagacttaagtgtaaaatttaaaacagtaaaacatctagaataaaacctttacgaccatggagtaggcaaaaatttcttagctatagcaccaaaagcatgacccatagaagagtaaattgagccgtggactttatccaaatttatccaaacagaca

SEQ ID NO: 50264 - DNA, 2747 bp, Bovine  19866880953821
ttgggcagggcaggaaggaggcccattaacacttcggccggaccgcgcttcctccggcacctcggccagggcggacacaggcgcgtttgtcccgctttcactgtggcgctgtgttcgcagcagcccctgccccccagccccaggtgggcggtgttgcccgggcacaaacgtcctttatggatgggcagtgctggaggaaggcaacacctcccgcggacagggaccaccccccagaattccgaattgaccctggagcctcctcccctggcaaggctggcactgcagggagcctggtcagtgggggcggaggggcccggctctgccagggtttgaggggcaatcagggggtgcgtcctaggagaggagagggcggccacagcccattccttccaggtcccgtcttgggggacagtcctctcaccctgactgctgccacctcctgcggctgaggtgggggactttaatctccttgaggggttctttgggagggccatgccttggtgagacctgagaagagggaaagcaggcagactccaactattccacatccccctctcccccaaatcccttgaggagtgtttgtttttttgtttgtttggttttttttaactagatttcacacctccccagttccccctcccgtgacacggcgcagcatgcgggatcttagttccccgacgagggatcaaaccttcgtcccccttaatcgctggactgccatggaagccctgaagagtggggtcttaagcattcagggacaacctgaccatcccctccatggagcgcagtccttgagagcctgggactgaattctcggagggccttccccgagcagaccaccccgccccacccccgcgcgctcttcctgcaaccagctggcgacagaaatcacacatctcccagacaaactctcttcaggccccactgaacttccgtcccccattcacacagatcttcaagcccctctccccctcccaggccttttgaccgtttaatccattgacaggtgcaggcctaagccggctgcctggcagcgccccctagagttggcccatggacctgcccccaaagggaaggtctgactaaaccatctctccggagtccagcaggaggtggggaagggagcaggttgctgagctttgttccctgtgcacgtgacttcaggcttagccaggtgcgggtagcccctatcagtaggattccttggcttccttttatatatggaaagactgaggagaagaggcccagcgttctggggtttgcagtctggctgggagcagggtcaggcgggggcctcacagtgggggagagacccacatgctggtggaggggcacccttcctgtggtgcctgaacagagagctgcctggtggtggtggtggtgccctgtgttctctctgctggactctgcagagtgggtgacccctggggatagagagaacaaggccctgccttcctttccctgtctcctgaaaacccctgtgaatgtgacactgctctgaccatggccaccagcgctgacttggtttatctctgaccctctctccaggctgagggaggtatgaatgggggcagcatcactggccttggtcacaaacccactatttcacatcctgcagagtcagaggctgggctggcggcccagacacagacacccccaatgcctgcacaaacacagacagaaaggatttctccgcccggcacccacctcctccacgactcagatatccgtgcagacgcttctcaggcactcacagcacgcctctagggtgcgtgtgtacatgctcagtcacctagtcgcgtcactctttgccaccccacagactgtagcttgccaaactcctctgttcatgggatttcccaggcaagaatactggagtgggttgccattcctccttcaggggatcgtcgcaacccagggatcgaactccccgtctcctacgttgtaggcggattctttactggtgagtcgcttgggaatagacacacaacacatactcctgtgcctctcccagcagcaatgagcgcacagcacccacccccaccccaaccctgcacccatagaaactttgtttggaccacaacctcacagacccacgtatgtgctacagctcccgtcacagacgtcccctcctgatctcagtcatacaagtgaactcacacagagacccagcacgtcagagactctagaacacttgtgggcacacacacagacgcatccacgcagatgcacgtagacacacagatgcatccacgcagatgcacgtatgcttcagctctctgagccgcgctcctcccctcccccggtgctggatggaggtatttatgctgataaccacttatttacagttcatggattctgaaaggcggttgcatgtgtgtggttgagtttgtgggtgcatgtgcgtgagtgtgagaaagagagaggctctgtaaggtgtcgggcaagcagagtggagaggaagagaaggaaggaaaagctctgtgactcacttccagctgaacaatgccacatctcagcctccgcggctgggggagggcatgtgtgtcaacacagccagggcccggctgtgagatggtcagggaggtggggaccccatccaaagagacttgcccttcccctctctgctcccggggggtgtgaacgcagcatcccacagcgcccaacacctgtcttgtctgcagcacagtacatgagaaaggcaaagacaacggcagtgatgcctcagcatgtgccttgtgctcagt

SEQ ID NO: 50265 - DNA, 1184 bp, Bovine  19866880981990
ctgtgaagaaagctgagcaccgaagaattgatgcttttgaactgtggtgttggggaagactcttgaggagtctcttggactgcaaggagatccaacaagtccatcctaaaggagatcagtcctgggtgttcattggaaggactgatgctgaagctgaaactccagtactttggccacctcattcgaagagttgactcattggaaaagactctgatgctgggagggatttggggcaggaggagaaggggacaacagaggatgagatggctgcgtggcatcaccaattcgatggacatgagtttgagtgaactccgggagttggtgatggacagggagccctggcgtgctcactgaactgaactgaactgaatgtattaaccagttattgtctctcagccccaaattcactttctatactctgcgttaaaatacaggggcgtgggattctgcaaactccattaatgctttaccagctggttttattaggaagtaaattttattagaaggaagttgatgtctccttgtcacctcaaagatggaaagtctttggggagacattcactggctagctctgctatgagatttaagtttggcttatatagctgctacatttccttcttctgactgagagccagtgagctctccctgctccctttcctccctccctcctcctgtggagatgatattctccacatggtcttcttttccctctttgccaggagccacagagaatgcctcctttcaaatcactctgtgttagacactccctctgccctcttcccccattccccaacatcctgtggcatctccctaattcttccaagtatggatctcaagccttggacaggagtagaaatatgtgggctcttatgagtccaggacactgtggacagtagctgaacttggcatttcttgcagcccaggtgtcatggaggaattaatacttactacctacagaagaggaaacagaaatatcagccactcctataacttaatttaaaaaatgatcaaaacctccaaaacaaaaaaggacaaaaacaaaacaaaaacaacaaaatgatgggtgaaagatgtgaacaaacatttcataaagattcacaatatccaataagcatttcaaaaatgctctataccatttagtcgtcaggggatatacaaattaaatctacaatgaaatactatta

SEQ ID NO: 50266 - DNA, 955 bp, Bovine  19866881052117
tttgcaatacgacagcccacagcctacaacctgtggtagaaccatagatgttaatgatgtttatgaaaagagcagagtcacctgtagaactaatataaacaaagaaacaaaaagtcatttgaaatcagggcagtataaaaacatcatttggaatcggaagcaactccttcccccgttcctgccgtgggatgtctcagccagagctagagagaacatcagcatgtgcaaagtgtggatgtagacatgtgtatggaatggtcttgtgtgtttgtctcctctcagatgtggtcactcacctgtctaccgttcccgtgaaatggcagcacgtgccttggtcccgtttgttatgatggacgaaatccctaataccatccaaactctgttggccaaactccccgactgcactgaccagtgtttccggcaaaaccatattcatgggacacttctccaagtaagtaaagtcagtctttatgacttctgtcaaataactgcaagatgaactttggtgctgttagcagctgacgatttgatacacagacttttcactttatgcgtagaagtgttttctaatgctgaaagaacaggtatttcctaggggtgcttttttcatcataaacatgaatgcagtgtcacagtgtgactcagtcagaacatcttttgcattaaaacctaggttttctatggcctgcttttccatctggctttcctctctgaagaagttgtgtcttttccatcaagtatgcctgaagaacattctgggccactccctgttcacagtgaagttgtgagcattccttgatacacatcaggcagctttgtaccttaaatgtcaaacccttctttcctattttctctgtgctacaaggcagacttctcttttgaataaataagcaaaatgacttactgcttttaacttaacatttcttctaggcaagactcaaggacaataatgatt

SEQ ID NO: 50267 - DNA, 1665 bp, Bovine  19866881129454
ccctgaaacgctctgcaaagtgctctcatggcagatgcaggagacactaaaggccatcgccgggctgctcctgcctcccggactctctgcttccacctgagcagctcgctcacttctgtcttacagattcataccccaggatttcacatccgagctcatttgaacaagcgcttccatatgaggcaaaaaaaaaaaaaacccagcctggacactgtttaaatttcaatcactagatttgtgtgactctgcgtgaggcagagttctaggtggaagcagcaggggaggcttgtgaaggtacaaacttcaaccgcctgtttaggaggagaggatgaaaggcaccttcgaaaaacaacacacccagaggtgtagaagatggccaaaattcagcaagttgaggttattccataacctttaaaaaaaaattctattgaagtatagttaatttataatgtattaatttctgccgtacagcaaagtgattcagttatacgtacatatattcttgacattttcttttccttgtggtttattacaggatactctgctatatagtaggaccttgatatttatccatcctgtgtatgacagtttgcatagcctttctttttttgtagaaccctttgtctctgatacacggtctctgctgggtctcatttgatacagtggcgtcagacttgaaaactctaggataagaggatggagggtctgacctgaggggtgctgcagagatggctgaatctagaagcctgaggtggaaccctgcatgctcaccttgcagagggggtgctcactgtgagccggaggagatgcagggggcgggctgtggtgctctagcctgctctggccttctgaagcaccctcctcaggctcctcaccttctctggctcaggatctccctctatccctcctcttccagcttcagccagggaatgccacctgattcagaagccctccttcctttccttgtttctgtttatgagattcaaaacaagtttctgatacccaacagtcgctttggttgatgcaggaaaagaaagaagccagttaacaaggaggtccagacctcaaaccactgtcagtgtttaggttcgagaatgatgacttcgtggtaggaactttgtttttgtttttttagatataattgagataaaaggcagaaactttcttatgaagagagagttataaaagaataaaggacttttgggaaagagagacagatacagaaatggagagagaagccagcacacgtttcctcatggacatgagccatgggtggttcttttccttggagtgctagccccaaggagttctcatccctcccttccaccatgtcccccgccacaaaacaatcatagaatgcctgtgcattctgccaaatagaaatgtttagggatgacaccctaaatcccaccttctctgcaatgccccccaccttccaagatctcccctttttctgaactcctgcagcagtttggttatgaacagcctttgatttcctactcttttatcatttgctctttcatacactttagttctatcttcccaactagcccatgagtttagagactgtcttctattaggtacacagtaggtactcagttggtgtcgatagctgatcttccaccacaataggccacctaccagtcggtagggagtcatcagtca

SEQ ID NO: 50268 - DNA, 1205 bp, Bovine  19866881176317
ttacctttaattaagaataaaagtaccccagaaggctgaaatgagatctgaggaacaccccacatgggtcagctcatcaccataagaaagatctggcagtgcccaggtgaaactgctccagagtgtgactgtaacactgttctgttcaagcaaagatttagaaaacaggtttcctggacagaactgggcctgacatctccacgactgagctgacaagccaaaaaataaacctggtgtacgaaggtacccagtggttctgaaaatagctcactgtctttacaaactgctaatgatcaagtcctgggcctagacaagcaccaagcaaggaaaggacaaacatgtgctcagcactaggctaagtgctctgaaggatactagcatacagaagatacaattctaagtctcagagacttaaaatcaagcatgaaaaacaaggcagaaatcaaaacaaagcatggctgaaggactggcatggtaagagccaatggaatggtataaccttgctctggaggccaaagcagagaggagaccctacaaaaggctactcagggaaggccagcttcacagctggaaggcaagcagcaggtggacccatttggaaatgcagagcaagggcaaaagaggtcctaaactaatctaggtgacacctggccttgcaggacagctaggggttccctttcccaaggcatgaagagcctctagtagaggaagcatgtggaggagatgaggttgcacaagacaccatggaggcagagatgtgtaagccctgcctggggacaaggcagaagtttagagctcctctggtagaaagcaggttggaccatggaaggccctgaatggcatgctaatgaatttcaacatgatttctcaaatactggaacgctacttgcagttttggtcacgtgaggaaaacactgtttaggtctgttataaacatttttaggcaagtctatactgcccatatgaaagaattaaaagaagggatttttctcagcaatgtttcaaaaatttaaaaaccagtaatattttcatagatttttaaataaaatcctatcactgtgattaagttttagaccactcaatcacatatacttgagtatatgcagcagccacttgatcattttacacagaacttctgtgtaaaaaactgacttcttaaaggcaaacccagtcctaaccacaccttactcaatcccccctccaaa

SEQ ID NO: 50269 - DNA, 858 bp, Bovine  19866881184420
gaaaacaactgcttataatctacaatcttaggtccgtcttacatcttctccctaagccttggtttcctcatctaaaaaatggtataatgttccttttttttttttctgaattaagaattaagtgaggcaatcatgaagtgtttagcccagactttcctggtagtccagtagttgggagtctgcctgccaatgcaggggacattggttcagtccctggtctgggaagattccacatgctgtggggcagctcagcctgtgctccatgactactgagctagagcctgtgctccacaaaaagagaagccatggcaacgagaagcccacgaaccccacccagagattagccctcacttgcccctgctagacaaaacccacagagcaataaagatccagcacagccaaaaattaactaattttaaaacataaaatgtttagctcagtgcctggtatacagaaagatcaaaataagtggtcctggcatacgttgttatcgtcaggtattttatatgcattatcttatttacttggaataattcacttaatggactcattagtgagaagagtgaggttttaaaattaagacattgtttctttacaattttaacaagctatgtagttttaatgtctctaagtaaaagcaataaataaaagggctgcattctaacatgtgattccaattttagggaaaagaatgagaaactaatttttctaaaactttgtcttaaaattatcaactaaaagagactactttttttagaatctgaagctttaaaaaatggcatgtatgtttcttaattaaatctatacttaagtgaaggcagatagtaagtgcggaagatcatggcacacttcagttta

SEQ ID NO: 50270 - DNA, 1530 bp, Bovine  19866881226802
cataattgcaatcaatctttagcttgcagaaatgacattagcccaaaaacctatttggcttgatatagaaacattcatttcaatacaaaatttctatctttaatatcctcctttactatttatagacatggtaatattaaaatttgaatatggccaacatctgcctctataataggtacctctatttcagcagcttaactagaaattactaaaacaaaaaaattcattttcttaccagttttagcatcagcagaagtctgaagaatctttaccatatagcttaagctctcagggttgcagttcagtaattttggcaagtaataatcaatcacataagatttctgatccagatttccttcacacagtacacaaagaagaggagaaacccaagtctcgtgccacttgtcaatccaagtgctgtcgacagcctgggatttcaaacgactcttatgatttttaaacatggtttccaagaggtcacttgcgtaaggcaccagagactggtcccccatcacctctaagatttgcgatggaatggttttagctaatgccaaaatatggtcaattcctatcaagtctactaaacaaccaaggcatgtgtactttcctttactatgccattccaatcgcagaagactctcggtcagttcaaaaatgaaacgatcagcagacaaatctgaacctgactcttctacagtgagctggtgcatttggagaatatttctgaatatgattttggtttggtgtctcaaagcatccagtggatgttcccagtgggtatagacatagtccaaaagcctcctaaccacatctgcattcccattcaggttgtcctttaggcttggggaacttgagtcaaggacttgtatagctgaattagtccaagatgccaaaatcctagacagaaacatttccagggttgactccttgatcctgaagaaaaatgaggcaggttagtataaactgacaaataaaaggagtctaattctataatcatttagaccttaaaaatataaagaatgaccataaaattgaattatcattatatttacaacaaaaatacaacacagccaaaacaaatctcaaatctttccattttgtaaaagttaatccaaaaaagcacccaaggaaacgtggttcattattttaactgtggtgatgtttcacaggtgtttaaaaatgtactcaggggccagggagggggaatattagagtgaatcagctttctctgggcataaatgaaattattctaaagttgattatggtgggagttgtacaaccctataaatatactgaagaaaaataactgaaattgcacaatttaagtaggtgaattgtatggaatgtaaattacacctcaatatagctgttcaatgactttaaaatgtacataacttacattaaaacacacacacacacacacaaaatacaatccaatgaagtcagagacctcattacagttctggcttgggtgcttgtaggtaatatgctgttaggtaagcatttactttgctaagcttcattttaccc

SEQ ID NO: 50271 - DNA, 1745 bp, Bovine  19866881231966
ccctccttcctcctccctccctgtaccctccctctgggtcgtcccagtgcaccagccccaagcatccagtatcgtgcatcgaacgtggacgggcgacttgtttcatagatgatattatacatgtttcaataattaaagaagaacaaattaagtggtcatacactcttggaagccatattaatactttatgtaggtaaaaaaatcctttaaatctgccatttctatagtagattagaaggatttgaggaaaactagaatgtcttaatgagttttttctgtttttaaaaatatttttagaatgtcttaatgtttaaaatctaaatctttgtgtctttgacttgtgatccttgaatttctatttttaagtccaccccacagttgcaaaagatgttaccttctttctggaactttgaatactcattttttttaaagttctgataataattctcagtgattttagactcagtaacagatggatcttattcttagtgaatagcttctatctcagcttttttagtaagatcccagagttgttaatattaattttttccttcttgatctcagggaatggttacattaaataagagaaccaacaatttgttacatttatctaaccacttttttttaaaattcacatttatctaaccactttttttttaaatccaccgtatcttgcccttctcctcatggctggccgactggtaatttaatttctatttggccattgttgtcattgcctgtgcctacagctgaggctttacagtagcccctgatgttttagcctgcagtaaacctcgacaatatttgatggtggagagggaggttaagatggcttctgttgatatgtagctttctcactggatctcatttgggcaaatcgtttttcaggcttaaaatttctccatgcttcaaggctgtgttccctttttaaaatgtgcatgtacatgcccacaaccttcctgcccatctgtcactgtttaatttaattgaaataataaacatgaaccttgaaataataaacagtacttgactgaagaatgaatggagtggagaattggagaatttagcttatgaaataataggagcttggaaaaatctctaaattaggaaaaataaccctacagaaaaagtctgaggaaatgaaggtaacatttctcaattaacaatcataatataactaatcagaacttgacaaaaaatagctctctgttactgtccttaggtggatggataaaccattggaaagccactgtgtagtcaggggacctgatttattggcacaaaatagtctaatgaccaattagttgggtatacagcatgtgtaatttgatttcagtctgggttttatgcttatcttagaatccttacccactaccagtgagatagctttgtggatagaaattggactaatctgtttatggaagaataatttgcttcagtgatcttctcaagacaacacaaagacctaaaaagcagccatggactggcctgttcatttctgttacttttggtagagactcaagctatgaaagtgttagtcactcagtcgtgtccgactcttgtgacttgggctatagcacttagcatagaaaaaccaaaccaaatccagactctcttgtctctttcctgtcagccttttaattttatttcttttaatttctactatttcttgactgataaacaggaaaagcagaatgatctgatttccttccacatccccatccttaaccaccacctccctcagg

SEQ ID NO: 50272 - DNA, 1099 bp, Bovine  19866881252083
tgttctctggcaagtctgtcggtgagagtactcggcggggctgggaagaacacgggtccgtgcccaccacagcggaagagacttccactctctgagagtgggagtcaggcccgaagctggggtggaggctgggggtgctgctggcctcagtcgtcctaagcagcccaggggtaagtggagatgggggccatctctggtcacccctggcagagaagggaccccaactcatgaaactggctcaggtttcaaaaggcaagattgcacacatgggtgcacacgagaccctcgcatcctgacagggcctctcggggggacgtggcggcccctgagctcaggaacgaaagcgcacaagaggagagttgaggccacgagcaggagaacgaggaatacagggcactgggctcgccctgacgaagagggaagatgagacccacaccagcaccatatggcctgagccccagactgtgggttcatcattgcccgtggggccgtcaccttgtgccccgggagctttcatgagcagcagcaggggaggcgaaatgatgcaaaaatgactgtcatttcctctagaggagccggttgttgtccctctgaggcttagtcactgggaggccatggaaacaatcccatcaccctagcaactaggtggaggcagggtgccccgcggcggtggtcacctgctctgatttaagaccggagcattagtctgcatctgcttcggcacatcagtgggggcggctgccagtgacgcactcagtgagacgcaggtgaacgtcaggagcccaggcttcctgggacagcgactgatgggaaggacatttggtacgtgttaactggggttctgctgggtcagtccaccgaacctggggtgggtgtgtggggctcctgtcttgatcacacatgttagtcttgaaggaataaatgggaaaatacagaactaattcctgctcagctactctgcttcaacagccattggcccttgccctctgcccaggcaatgccagggtctgcttgggagttaccctcacaattcctaacttgttgtttccttccctggaacctactgagaatataaatggacatccagatggccctggga

SEQ ID NO: 50273 - DNA, 1351 bp, Bovine  19866881348897
gaggagtctggagagaggcccaccaatccagccttcctttcatcctacgcctgccttggtcttgccttggccccagggagctcagaaaggattcccgctgggctgagccatcttttcacactgtgtgctgttttttttttttcttttttttgctgagtggcacctacttctgactcactgtgcatcctccctaaaaggacagagtctaacacgagcaagatagtgaattatccccgtggagaaagccttcacattttacctgttacgtttcctttgggtccattatccaatctttgtaacatttcaagcataaaaggatatttgaaaatctatgaatgtgtttttctttctcgcctttataaatacatgaccttcatcttccttggcccgaggcatcctctctgcctgaggagagatgaacatggagttttgacacagaaagcacgaaagaaaaatgctgtaatgtttggcctctgatctgcaaaatatgattatgtggtaagtcaaaagtcttctaagccatgctacgctcttgagagcatattttctggatgccttcgtttctcttcttgggtgtgatcaccgcattttatgtaagggatgcccgggcaagaggaggaagtcccatctgctttgctcaatagaggggccctggtgatgaccctgcctgtctcccaggctgctctgaacctacctgcctctgtctccaacaccaaggctccgggtaaggcagaggagcctgggaagccagcttcacaggccagcctcagttcccacaggcctagctaccaagctgtgagcctgcaggtcactcagggtcacggccactcaacaatgagatgccacaggaagggagggggcaccactgggtcagtgggaggccctgtgggaggcagccaggggcaccacaggggctctggccagacaagcaagaccagaccatgagttacaaactcagcagggacaagctaccttgcctggaaaccaaaggacaccacaccccaggatcccaacacgtggctgctgccagctgtcacataagctgccccatctgtccacacacctccaccttgtatcggtgggagaaacttaggaagtgttcagtttgaaaacaacactttctctaagcaaaatgaaaatcacttaacagaacaggctaaattctcaggtcccaggacgtttaaatcaagtgggacatttcattgtttttctcatgcttatcagataggagttgggggaaaggccagattagttatacaataaataaagaaatgactttttactctgcacagacaaattaaagtgtgagtgaaattttcaatcctactacacacacacacaaataaaggac

SEQ ID NO: 50274 - DNA, 1050 bp, Bovine  19866881374487
atatttgctttgttttacctgtttaggatttcagtgagtttccaaagccgtgtaagccagttcaaatgctcctctgtgcctggactgtaaaaggtgttgtttaaagtaatctcctatttcttttaccttcaaaacaaaatcaaaaaataaatattcaacttaagtttacactgacaggtgtatttatgtccgtaaccacttagaactcaggtctagatgtctgtttagcacctactatgcaacagttaatattttaagcattttgacaccatcacaattgattctcacaatgaagccatgaaagaagcactattattatctccactttacgatggggaaaaaggaggcccagaaagaccaagtaacttattcaaggtcacacagcaagtcgatggtaaaaacagtgcataaacctaggcaatttggctccagagctgaccaaggtttaacagctacgctagacctgcctccctatgccagcttcacagaccttgctgttttctctgttagctcatagcattcaataccaacagcaaatcacaaaaagtgacaaccttcactcacccaggtctaggtgaaataattacctattttttctctcttcaaaaaaattttttttctattatgactaaaatatacataaattttaccattttaaccattcttgggtctacagttcagtagacccagggcattcagtatattcactttgctgcacaaccaccatctatctacagaatttttcatcttcccaaactaaaactccaacctactaaacaatattttccaaaaattacctttttatacacacacacacacacacacacacacacacacacacgttaatggccatgcaagatttagggcaaagggcaccctgaaaactgacaggcttcactctgagtcagaagcatggagctttccagtatgcgacccaatcacttttctacatgctgcctttctccatgcaagtttaaacaattaacaaaatgacaatatattttaaagaagacataactgacagttagttgctgatgaggttctgcacag

SEQ ID NO: 50275 - DNA, 759 bp, Bovine  19866881375912
cgtgtgaccgcggcgccatcacactcctcacatagaaagagagataaaaactgtggggaaagtgaaaaggcagttaagttgtggcatcagagcacaggaaacacatgactctcagaatgtgatcccggagaaagccggaagccggcagccctgttttgaacggaaggcccaggggctctgagaagccctctcagaggtccagagcctgctgagctataaacagtggtcgcatccaagtgtttgtaaatatcaggggcggggggtgttgtgggaggggtgctacggaacagtgggtaaaggaccctgagaccgagctcaagaggctcctcagcggctgctggggatccctccgcccgccagtgagcgagcagtgcaagcccaacactccgctctggagcgcaggaccagactgctttgggccggggtccctcctggggacaggcgattcctgtcacttgctgacaccagcatgtgggcacctccgaaacgaaatggaacctgtgaaagctgtcctcctagtaggtgtcccagtgacgccctcaggactccgcgccccacctcttcctttctgcacgctgacctcctttagaagggctctttagaacggggatgggagtgtctagacgacaggaaagctttccagatcagtgagcaatatgctgacaaacagggcccgggctcagccccaggaaactgatgactcaggaggacgtgccttctctccacagacgtgttcatcaggactggccagggccctcc

SEQ ID NO: 50276 - DNA, 554 bp, Bovine  19866881401271
attgaaactttgctttcagaatttataagctcaaacagtcactcagatcaacacttggctagtttccccaaagcactcttgaggcataaagtttcattcctgagaaatatgagtcattgtggacagctaggcctgagtcagccaggtcataccttctccgagggccttgcctggggcctccaaaagcctttcctattccaaaggacatttccaaacctgcccccttagggtcctcactgttcctgttttatctgactctcaggtctcccttccttgcaatacccacaaaaaaaggaataactcattcagtaccggatttgaagcagttgtttgtgccagcctgtagattgcgtcctaggtaatctgaattctttttggccttcttaggactgcaggatacgcttgctctctggaaatgtgtcctcaccctcctgcaaagtgaggagcaagttgtccgagatgcagccacggaaactgtgatgaccgccatgtcacaggaaaacactcaccagtcaacaggtactttgtgcttatctctcttcgatgcctcagag

SEQ ID NO: 50277 - DNA, 1307 bp, Bovine  19866881486587
tcagagtatcttctatactctatcacaatctttaagaattaaaactactcagttgtgacttacacataccacctgtgaagcttatgaaaatgcaccacttgctgatatcactgggacttctttcccttatagtaagcctgattcagtttatcttttttctttttaaattcttcttattatttattttttgttgaagtatagttgatttacagtgttgttagtttcaggtgtacagccaagtgattcaggttttttaaaaatgtttatttggctgcactgggtcttagctgcagcatgtggtatctagttctagattgaacctgaactcctttcacttgggagtgcagagtcttagccactggaccaccagggatagcccatcagtttatatatatatgtatggacatgtatattctttttcagactcttttcctatataggttattacaaaatattgagtacagtcccagtactactacagtatgtctttgttggttatctgttttatgtataggaatgtatatatgttaattgctcactcatttccaactctttgcgacctcatggactgtagcctgccaggctcctttgtccatggaattctctaggcaaaaatactggcgtgggttctttctccagatgactttcccaacccagggatcgaacctgggtctctagcatggcaggcagtttctttactgtctgagccaccagctcaaattcctaatttattcctccccccatcattggatctttttgatcagcaaagcaatatgacatttgaggtcttactattatcttagatttaatttactgttcttaaaatatgctgaccagtaatttctaacatacagtccaatgaagaaaattctactgattaacactcatgtagtacatattgcaaatagtatcaaaattttggtattttgatcagtttttacatatgccctgaaagaacctttaatgtgctaaattctatgtaattaatatctattgaagtactttaagtgttcttaaataattccaaaagggaaacacgaatttttctattttttatgtcttttctcacatttcagatgcagcagcttgagagacaagttattgatgctgagcgtcaagcagaaaaagcttttcaacaggtagtgtatagttttggttaaaaaattttttttgcctctaccaatttaagcattgttttgcccaaaataatcttgaaaatagttttcagctgtcctcttcactttgtcgtttttactgtttatgagctagctccatagagaaaatgtagaatctaacttgttttgccc

SEQ ID NO: 50278 - DNA, 1140 bp, Bovine  19866881521379
ttaacaaatatccaagcaaacagcacacatcctaggtccttggcgtttcacgcgtaattgtctacatctcctctgcttacttgtagatgagaaagataaagaaggtggtttgagttattttggtgccaaacaaaattctagaaagaaacactcagcaaaaaaaaaaaaaaagttctaaataaataaaaagaaaaaggagggagaaagggaagggcgtgcgtggagaggaaacaggagggtgccagcgggggagggcaggaatcttgtttgatacctgtcggggtttttatttgcaccaggagcgcggagactgaggacgctaagaaaacccgcccaccctacgtagcagggaggggccaagatgggatgcgggacaggagtcggaggagtttcgaatttcttaaactctccagtctagattcaggtgtcagctctgttcctttccggctcggccaaccacccaccttcccctcccggccctcttccaacacgcgcagtcttcccaagaattctgagtctggaagaaagagaggaaagcaggggtccaattggccttccccgcctccgcacccacacaggcaagcaaagcgtctccgcccgctcgcgaggatccaggttagcggctctcaccccaggctggaatcatcagcgccttaggtttgtccgccctctccacctcacctcagattcccggtcccagtgcccggttctgcatctgtgaaactccttgtaaactgtggtgtgacttgagtatgccccaagacacgaaaggagctcaggcgctctgcctgccacctgcgagcgtaggtgaggggcgggcccccaaacccggcctggcgggtccctgtctagcatcacggtctcccagcactgcgccccccgcctctcctctgtcctgtctccaaccagtcactgacagagccgagcaaatggcacccaacacatctgcgggctctggcctgatctctgtcctagtgaccggacaggggactagcatcaatcggggcctacggtggccgctgtgcaaccccggcattcccagtctacagatgaggaaactgaggcctcaatccagtgtcagcaacccagtgatcaggcgcttgggtttccaaacccgccttctcctccttacaggatagt

SEQ ID NO: 50279 - DNA, 680 bp, Bovine  19866881631983
tttttaaatctctttaattaggaaccactggaaaaatctggctacttattaaaaatgagtggtaaagtcaagacttggaagcggagatggtttgttcttaaaggtggtgaattactttactacaaatctccggtgagtggaaattgcttgttatttagaactgaattcctcaatctataaatcagacacctggctgattttcttccatgtaatgcaattaatgagacaaatcatttcttattatgactattacagataatcactttgcattggttttcttcccttcatacagagtgatgtaatcagaaaaccacaaggccatattgaacttagtgcatcctgtagcattttaagaggggataacaagcaaacagttcaggtatttttttttcttttttatatcatgtaaaactcagttgtcaattatgtaagctaatagaatgaagactgggttttcagtatttttttattccatttggtgatcagtttgatgcccctaaaatttgtgaaaccctgggacttcttagttaaaactatgttataacctaagtttatattaagtaagtctccactgtatttcctttgcccttgatcccttacactgtttgttccccactcctaaccctcccagccattctcagttctcaagctgtcaagctattttagcagaaggttatttg

SEQ ID NO: 50280 - DNA, 2046 bp, Bovine  19866881648629
aaccctataagcttttagaatccatattctgccagaatatgccttgatagtagacctcagctccataggtgtttgttttttaacaaagttatatatgtctggaaaaaaaaaaaccttgcattccaaagtttcatactggttactggtttcattgccaccacttagtggatgtttaatttagaaccattttgtctgctctttctggaagccttgggcagagcttagttcataattgatggggaataactgctgaatttttagctgttttgagttgattcgcaccactgcaccacaactcaatatgaaaaaaaactatttaacttatttattatcttgtgaaaagtatacattgaaaattttgttcatactgtatttatcaagtatgatgaaaagcaatagatatatattcttttattatgttaagttatgattgccattattaatcggcaaaatgtggagtgtatgttcttttcacagtaatatatgccttttgtaacttcacatggttattttattgtaaatgagtaaaaaaatcttaatttaagagattgtatgtaatatttatttcattaatttctttccttgtttacgtaaattttgaaagattgcatgatttctttacagaaatctatcttgatgctgtggaagtagtttgaggaatatcttacgagtttttcttagaatgtataatggttgtagcccatccaactttaaaagaaaaaatgaccacattgcaatcaggctcacatgtggtatgcttttctcattccaactttataaattagcaaaagatgtttttgtttgcttgttccaccagttctactgtgacatactctgcatataaagacatgtagcaataatggggcgagggtgatctcacagtgcctttggaagggccagaacttgccttaaattttcctcaaccaaataagtattttgtctattagtgcttgagagaatctgaatgtaggatgggttcaactgcacaaaaggagaagatttttaccactttttttttatatagatataaagtgaagaggccacctcttagtgctaaaatggtatgtagtacatgaatatgccttgtttaattacagaaaattccaaaacttgtactattttttttcccccgtgtggaaaggcaggaatgcttttctggacagcagctgaatgagcagtagctttagttcgtttgtacgtaggtacagtcggagcactatgtatgtgtgtattgtggactactttgacagaagtaggtattttgaatgtaacaaggttaagtcaacttgagttgtaatatatttggggaatcagttcactacaaattgtgactgtaaacattgtactgtaaatgttttgtagttttcccccaataaaacttttgggaaaaaaaaaaggtattaatgtgtaagatagcttccttttttaaaatggggatatctatagagctttctagcttcccaccactgtcaggcattgcccaggtcttagagagttgggcggtagggtttagagggctgcagagcctgagttttgaagagcttgtctccctatatgttttaatagcaagttcttttagctgaaagtaatttagactgtcaagggcattagtttagctagctgttccctttgctaataagatgcatccccgagttggctgactggtagcaggtcctggttgggaggcctgaggggtgtggcccgcctgtgagtcaccaagcgatcacgtgtctgcagtggcagctgaaggtctgattttttttttttttttccagtgggacgcccgtgaaactgaactgcttgggtgaggatggtcttgccagcccctggctgaattgggggcgggaagttaaagcccagcctttctgggccagagaaccagggtttggcctggaccttggaaagcctggttgtgctgaggacggaaagagaaggaagattaaacaagttaaacttatatctgggtagtgtttgtttatgtggacagcttcctctgggagtgagcacacacgttatttagcaaaaggattagtgtctgtgcttaga

SEQ ID NO: 50281 - DNA, 805 bp, Bovine  19866881902700
cctgtgatacttaaggtgttaatctcagcaaattgaatttaaagaattatgaaaggtatattgttctagtatgtttaattcagtgaagagattagtattttatctttacaaaatattgctctacatagcatggaagttacctgagctaaaagagctgccatttctaatgccaggtccctgttcagaggaaaaagtccatttactatttggtcatttgtctgatacattaacagcaacttttctctatcagtctctcctcgaacttgcattgagaaatataatctgtaaaaaaagaggaaaattttcattaagtgatatacttacaaaagaagaaggtaaagagaaatccagaggactgatacggggttgttctaacaatattctctcaatgatacaaacctagatcattacgatctgttgatgacctctattcctattctttataacatttaccagcaaactgagaaaaactgctctgaggctgagcttgaggggtgcttctgtgctatttttatgccctgaaataccttagctgctactgaggaaggacctgatgccagtgggctgtataaacccaattttaagaacactcatgatctttcctacacaccatggacataacagggaataggaaatgaaggtttcaattaaaaatcaatgtcagatgagatcaggcacgttcagggtggtatggcaaaaccaatacaatattgtaaagaaaataaataaataaaactgaaaaaaaaatcagtatcaaatggtcaaatgggggcagctctccaggaatctaaaagagagtccatct

SEQ ID NO: 50282 - DNA, 4305 bp, Bovine  19866880414337
ttgattgggcctgaggtgtgcagatactgtatccattcttttgtgacccagtggaccaccaggctcctctttcattaggatttttcaggcaaaaatactggagtggtttgccatttccttctccaggggatcttcccaacacagggatcaaaaccctcatctcttaagggttgtattatatatactatttatattataataaaatataaacatatctatataaagaggtttgttgttagaatttgacttatgtgataaacattgtgtgtatgtgtgtgtgtgcatgtgtatgtgtgtgtgtgtgtgtgcacacgctctgctgcttcagttgtgtccaattctttgcagccccatggattgtagcccactaggcttttctgtccatgggatttcccaggcaagaatactggagcaggttgccatttcctactccaggagatcttcccgacccatgaatcaaatccacatctcttgcctctcctgcactggcagctgggattctttaccactagtgccacctgggaagcaatatatatatctggatatatatgtgtgtgtactattgttgtttgccagggcatcttcccaacccagagattgaacccgcgtctcctgtattggaagcagattctttaccactgagccactggggaagccccgtgtatatatatctagagatacagaatcagttatatatagctttcatatatattatatgcattataaatatcatatgaatctatatcatgtatatgtgaatattatatataatatgtttttatctacatgtctaccaacccatctatcctgatggttctgtctctttggcgaacccaggcagatccatgtcctcagggctgtgcagctcgactgatggggttcaggtggatgcagggaggccaggcagggggcagtgctagagtccagcccagccatgatggtggcagcagggagatggagagaagtgggcaattctaagaactatttggaaattgaaattgataagacttgctacggtttggaaatgggtgggagcaagggagagggagatgctgagaaggatttctaggttgtggctctgcttctaaacagatacaggtgctctgcatgagaacactggaaacattctaggctgtgtggggccgagtatgggcaggcagggagctagcatgagagcacattattagaggaaagcttggaggcaggccacaaagccagagtcatccgtgtagggatggtaacagacagcatggctgtgagtccccacggagacaatggcagtcctgcaaaaccacactgacccatttggcagagaagaacgagcctgtgaaggagacagagaaggaacaggccggaaggaaggtgggcaaccaccaggaagagtcccctggtgccaaggaagcaagcatcagatggcgcctcgagcaggaagtggccagctccatcaaatgataacgaaagggcacacaagcgggaactgaaacctgccctgaagattaaatcaccagggaagtgaaacctgtgcaggtctcagctctgagatcaactccctgcatgtctagctggcatctctgaagcaagttctcgggaagtttcttcaggaaactgaaggcccgggagagctctccagctcccatcagccccttggccacccctgtcctgacaaaaggaggtgacacttgactacatctttcccttctcctcccccaccccaagcccttaggttgcctttcaaacagccagaattcctttaaagagtaatctaggtatgcttcagctgacattcaaaagtgcattgtaattcaaatggaaatgcagaaattcattcccttggacagtcttgggaaattataatagagataaaacatcttttaaaggtggcgacaggcatttatctgtggggacatctctatgcgatagactctcctgatgcaaactcaagagcggtccaaccttcacacggagtatgtcctttcggcagggtcaccgagtctctaaatttgggaaagacattaattgcatccatcttcgcttctccactttgtccctccatttgtctttgtggattttggtttccccgtgtctgtccctcttcatttttctgtctcctcctatctccctcagtctttgtcactctctctcacacacagaatggacaattcctttacatgcatacatcctttaccttccatagttactttctcccatgcaaaagaagcaactgtgaattcaggaaacctaccagattggttatttctgcatgcattgccatcccttcagaacagggaataacagggcataacaaaagggcagggttacggagtcttttgatgtcttcctagtagagctttaaggctccctccctcaccagctctacccctggagcccctctcaatctacccctgtccttggtcctaagtcagctgacaagagaggggagtaaattagtagccgcatctccccgtgcccccatagacacacatgtgcactacaaacacacacacacatacacacacatctgagatcactgttatcaggtggatgcggcagccaccggtgcagggagtggactgtatcaaggtaacaattaagtgcccagctcattgctagatgagtcatcattgatgggtctacgctttcactggatcccatatcttaaaaatggaaaaattgatcttagagtgtgaatcaatttgtccaagatcacacaacttgttagagggaaactgggactggaaccaaggtccatctgactgcaaaacttgtcatttatctccaaatgaggaagtctttatccaagatagccagaagaaccataactatgactcatgtgtcaaagtcacagctaggaagtgtatgaatgtcaagtcaaagaaggaaatgaagccctgattaagagaaaggtagcttttcaaatacaggtgtatcgtgaacacagcagcatagagtgaaaatattaagctgggacagaaactagaaacttcacaaggcacttggagcctggcctgggagcacaggtgatggctgagggacagcagcagactgaagagcttccaagggaatcgcacctgggctggagtttcctgggatgacttcagctactgtagctgctcctgaggtccagctgtccctggcttccgccagcaccatccagctgacctgtccagtgctccagtccccttcggactggtggaatgcccggaatatcctctcctccctgcctggatctttcccgtcctccttggcattctcaatgtctctctggaatctgcgtcagaagctgggtctgttattctagctttcacttcaccctattacttggaagcaatatgtaagtgttaaccaccacttcccctttctgcatctggagcagttactgctaactgatcgcagcgttcttttctaatgacctggtgacctccacacagtgtctagacaagccactcctcaactgatcagaactggcatacgaaacaaaagacacgggccaccgggtgacagttcccgaccgcacaccagccacctgcctttctccagcggcctattggtagatcaaaggaaaaaaaaaagtctatcacgaaaacgacaaggtattggaaggctcatccaggctgaaccccttcatggacagcacccacgtcttgcctactttaacgccccagcacatggcacgaggtctgcagtgaagaagcacttaggaaataccagtgaaccagagggtaatgaatgatcaatgtgactttctttttcctgtggaatgcacacttctaagcacttatgggaataagagtgaaactctcatgggagatattttaatcaggcacattcacccaacccccttgaccttccatgatctctagtggctggatcacaacagtgaccagagccccaccattaattagtaaacttggaaagaccaggatcttggactcaggttggaatttaaacactaattcactcaggaacacactgtgcggtccaggcaagcccccgatcacttctgagttcaggtccccctttcgcagagatcagaggtgggtcctcttgccttttttgcctcaaggggtagatggaaagaccaaaggcaggcctgtataccgcgaagggctctacaacgtccgtggttgttatacatgccccatttggtctcttctctctgaaacttagaaattactttgcctgaggtttcctgacagggatgtaagaagaggtaccaggacttgaaatcttttctgtcccacttgaaaaaggctttcatactgttcatggggttctcaaggcactacttctaagtagcttgccatt

SEQ ID NO: 50283 - DNA, 501 bp, Bovine  19866880497989
taataaggtgatgaaagtcgtgtccagtctcacaaggaaattaaaaagaaagtaaaggtccattgggacttgatcgtgggacgggactctcctagctttgagaccaagaccatcttcaaaatgtagtgacaggagcattgcggaggacaggtatcttggtagccctggaaggacaggaagaggcagagagaggggctgggtggctggtgtctcagggcggcgaagccaaatgcgcaaggaggcaggcagaagaatgtcaggctgggaatgtggttcagacacagttaagggcactgaatgtttggcaacagggtatacagtcttttagcatgcagcaggcaatcagtggagtggacttgatctgagagctggtcctgagtccattaaaaacgggtcaaagaaacagtagcataactgaggctcgttcttgaaattccctgctgattgattttccaattgcattttccctctcctcttcccctgctccctccatataaacat

SEQ ID NO: 50284 - DNA, 1816 bp, Bovine  19866880499891
agagaaggtcgccccagtagaaagtggcagagtaagaacttgaacttggacctgcctgattccagacatgcccttccccgggtgaatcagtgaatgagtgcacggctcctccgtagttacctgggttcatctgtttatgttcatgactcaaagaataggcaaaaaaaaatcagtcctctgaaagatgctttctgcccccctctccattcatccatcttcagagtggaatttccgacagaacttgagaggccgtccgaggatgtggagaaggatactgatttgtgctaaacgcctcctatgaattgttttccctcctctctctcccacacagatggagacttgccaaacagatgtaggtatacatcagtcacctaccctccaagaagcatttataatggattcattcattaattcttccaagaagtaattgcagatctactgtgtaccatgtaccattcaaatttattcagaaataaataaaaccctggccttcccttcactgcctctcactgtggaaatacaatcaacacataatgagatctactcaggattggacccggggcttggtcttgggtacacagagttgattaaggatgctctccgggggcactcaggtgatgagagggtagttggcagacagaaggaggagtcactgagggtcctaacaggtgaccgtttaacaagccagagactgcaggtttcacaaaggtttgttgagaactcatgacccaagaactgaggtttaaaggactagacaaatcagcaggagttggtcggtgggggggagggtagtgcggcagcgcacaggcatttcatgcagagtgaacaacctgagcgaaagcacagctgtatgagatggtgcgaggggcactggagggctcactggtgtagttagtttatgcttatacaactgaaatgtgaggcaggatgtcgtgattcacctggccacagatgcctccacgtttgccttttcctttctgttctagaatattggagctggaaggactgttagacaccagctgatcttatctactcgccccaaaatggggagggtccatggtcaaggtcacagagcttgaaatctgtaggaggagagcagggtgatcaggagaattctttggaaaactgtacagagactaccttatactttaatggagggagttcggcagcttcactattaccttgtatctgattttttttcaggaaataagaccttgcattaataccaaggattctaatatttcttgagacccataacttgcaaaccattatggtcagtatcatgtaatcctccccaaaccctctgagttaggtgttagtaacccaatttacagatgagaaaactgaggaaacgcaagcaacggaccagacactcacaggaaagatagtacagccaaatccatgtctgtctggctcaatgttcattagttttctccttgatgaattgctaaagggttcagaatgatcactgaaggtttctgatctgatctaaagataattaaggagattagagctggatggggagtgtgttccaaaaaagcttctgcattttcactttattccttcggcattatcttgggaaataaaatagggttgctagtagacacagtgtaagtagatgattagtttaaaagaaaaaagtttcattttctataatgggacctccttaaataggtcactctatatctgtctagaggcaaagagataactctacataaatacagccaactataggtacataaagataggtctcagtgtatttttatacacatggatacataggtacatgtatataatatgtatatgcaaatctttg

SEQ ID NO: 50285 - DNA, 4035 bp, Bovine  19866880528341
cttctgcttctgttaggtcctacctttctgtcctttatcgagcctatctttgcatgaaatgttcccttggtatctctaattttcttgaagagatctctagtctttcccattttgttgttttcctctatttctttgcactgatcactgagcaaagtgtgcttatctctccttgctattctttgtaactctgcattcagatgggaatatctttctttttctccttttcttctcttctttcctcagctatttgtaaggcatcctcagacaattatttagcctttttgtatttcttttccattgggatggtcttgatccctgtctcctgtacaatgtcacgaacctctgtccatagttatcaggcactctatctatcagatctaggcccctaaatctatttctcacttccactgtataatcataagggatttgatttaggtcatacctgaatggtctagtggttttctgtactttcttcaatttaagtctgaatttggcaataaggatccatgatctgagccacagtcagctcccggtcttgtttttactgactgtatagagcttctccatctttggatgcaaagaatataatcagtctgatagtaaccccgttttcactctcctctctacagaatgctgtgtcagtctctgtgtgtcctctgcagtgataagattctgcatgttctacgggcatcctcccgctgcatgtgtgcagccttcccaccttcttgtctctgtgccactcctccgtcctaaactccccctgttccctgggcaccagttgaaattttgtccatcctgtaagactcctctctgaatactttctagattctgccacaagtcgtagcctctgctctaagcttcctgctttgatttatagctactcatagcatgctttttctgttccttggactgagctcctgaggatagacttcctcaatgccagatctcagaaaaggttggttgactaaatgaattttaaagcgagcatgtatttgcatctgctacagaggtaatatatattccatgtagaaagcgtagagaaaaatgaatcataacgattaaaatcacctctgatccccccattcttggtgttccagtgtacttctttccagctgtatatgcatatacttatgcctgaacagaatcttaagattgtatattttctatataaacttcctctgcctttccatgagaatgcaagccccttgaaagttaaaaggtctatctttctcttcatttgcattcttcagggtgcttaaacttgagccagatgttgaataaatttctatagagtagttacctggaaattaagccggcattgacatcctgagttgccatttcctctctctgtcttctgggaatgtccatctgaattcagatatggggcagctcagttcagctcaccaaagacttaaccttcttctttctatttggccactgtgttggtcacacggacactcatgtagctgttgtgtgtccttgtaccaaagtccagcgagagaagtcagctgtataaacagatcattttaacatagataaatgccatgttaaaataagatgctagagcagtatatatgaagtaatgtgtaagaaatggaactgcagaatgctcactgaggatcaagtttaatgttaaaagcttgtttatttgtatcatctcattgaattctcacaacaaccctatgaagcaggtactaattgatgttattcagatttgatagttgaagcttgaagaagctataaagcttctccaaagacgtacaacttgaacacggggcaactggaattcaaaatcaagcagttggtctccagtctgtgatcttacgcagcatgcaatatttcctctttatggaaacataaagagggtgttccatgggggtcaaaggaagtcttctggagtgagggatgggggttcagtaggacaggctatcccaaactctgaaaaagctacccaaagatgtagaattaggaaacaacattgtgtatgtggaggatcacataagaatttgatgagatttaacacataaatgcaaagaaaggtgtgaaataaggtaaggcagaggagaaatgcagatggccggctggtgaaattagttttctcctgatgggaatcaagagccattggatggtttttggcaaagaaatggcatgagcacatttacaaattaggcatataatcttggtagccacttgcgggatggctggaaggaaggaagcctgggggcaaggataccagttggggttgctaggaagtctccatttgcccaaagtctccatatgatccactccccatgcttttcctccctgctgtgtaccttggggagcccacctgtatggagcacccttgagtgtttgtgtgagcttggcccatatttaggcacttgcaggagattaactttagaaggtaggtgacctcagtgctgagtcgtgacctccatgctggatcatgccttgtcagcacttgggttattttcctggattatgctacgtgaaggtcgcagcagctgcctggcggccctttcctacagctgtggctcttttagggtcttataacccaccctccttttgccccctttggcctaggatggtaacaacactttgctttgccaactctggggagcttcatcattggttgaccttcaacctacctgtgatgattaatttgtcaacttgactgggctaagggattttcagtgttggcaaaacattacttctgggcttgtctctgagggtgtttctaggagagactagcatttaaatagttggactaagtaaggagaaagcctttgtgagtgcaggtgggcctcatctagtcccatcggggccgaatagaaccaaaaaggtggcggaaggccgggttcgcgctctgcttgagccaggacgtccatcttttcctgccctctgccgttactcgtcttggttctcaggcctttagctcagactggtacttacacctctgactctcctagttctcaagcctttgggtttcacctggagccataccactggctctcctgggtcttcagctggaatatggtgcactgtgggacttcttagcctccatcatcatgtgagccagcccttcataatgagtctctttcgacatgtttgtttatgttctgttgcttctgtttctctgagaatgctagtgttctgttagtccccaagttgtgtctgactctgtgacctcctggcctgtagtccgccagggtcttctgcccatggagttctccaggcaagaatactggagggggtggccatttcccttctccaggagatcttcccaacctagggatcaaaccccaggtctcctgcattcataggcggattctttactgactgagccaccagggaggcccaggtcacttgcaaagcctttgtaaatgatcacattattaaacacatctcgatcagcttatgtttctgctcttttcagatgagaccctgactggcccagagccacctgaagcagtccacaggagagattagataaaggttggcaataaggcagccaccatagaggtgacaatgtagagactgacgttgtagagatgacagtgaggggcatgtacttgaggtctgcttcccaagcccagtcagcaggtcttactgcagagaagtgaccgcccatggaggctggaacagctaattgcaggggtgcgtgaagtcagtgtccctaccttccccagttctctctgcctaggcagtgagttcatcccacataatgtctggccccctcaaaccgccccccccccccatcaccctgctccccagcgagacagagaccatttgcaaactcatcagaagcgctctctggccttttgtgaataatctgctggagggtcagctggtgctgtggaatctgaggaccggttagttagccacttgggagatgttaccaagatggctggtgatcagaagagctgcttattttcataatgaccttcaggaattaaataaaaatacaatgagtgccatagattaggaagaacaagccaattaaaaccacaacacgccttcgggatttttttattt

SEQ ID NO: 50286 - DNA, 953 bp, Bovine  19866880553298
tcgtgtccactcttgctatcccatgaactgtagccagccaggctcctttgtcctgagatttcccaggcaagaacaatggagtgggttgccattttcttttccatgggggtagcttctgtaaaaggtggggtttctcatttcaggttggcaaccttaggatgtgcagaagggagaggagaggtcaggaggagagagggtggagaaaaaagatcatttcacgtcagtttcagcctcaaagatcactctccagctgtcagctgagcccacaatcactgcggagctttattaaggagcagaagtcacagaagagtgaggtgacagatttaaaattaacttgccaaactccccatcagtactgtgacagtccccaagaatcagttcagcgacccagcgtaccaacttgacaatattaacataactttgtctgaacaaaagcttcccctctgtcttttcaagaaaaggtaatttgggggagacaggcattctttgccttttctggcacctctgtgacaggtccctttgggccaacccaggagtgcacgttccataaacttccattctccttccatctttctggggactgccacccatggcatgatggcaaagacgggcagagaggtgcttccccccttcagggacctactaagtgaatgcagatgaggaaagagaccctcacattgctgccactttctgaggtccagcttgaatgccctttagcctttctgtttggagcagcatgctctctgtgccagctctcatcagcgcaccatagtctgtccccttctttcccgtcacctagtaacgcatctcatctcaaacattactccctgaggaacacctacctggactccaaacatccccatgtgggttctagatgtttgttcaaggtgtaccctgacttccaaacatcacactgcacaactcactgatgaatttcactgaatagcaccttc

SEQ ID NO: 50287 - DNA, 1352 bp, Bovine  19866880586230
ccttaaataatcctacttaggtcagagctgagtatggcatgattcaggaaatcctggggaactaacagggcagtggtaaggccatggagccttatgttggagttggtacagtgtggggagcgatatttagatcttggtaaaagaggtttaaatgaggttttgggagatggaagtgaacttcagggtttgaccaccaatacctgtcctatgaaccttgtatcttcatcgctaagtcagactctggttttcctgggatgctgtttgttcaaaataaattaggcttccatctgtatgtcacttcacttaaacattcagggtgggggtaggcagactcactttctgtgtgtctgcctgtgagtgagacagacacattcttagctgtgttttatgaaaacaataaaatctaaagccccagtagctacagcttctctatccttttcagagaggtgtccttggggattcaagccttacggcgttgtctagcagtgcgttagaaacctgttaaaagcctttgcctgttagttagggaagtgatacatacttttgttgttgttgttgttgttcccgataaggaagggatttgcaggaagagaggggtgaaagcagcatttaagaaacagcgaccatcagtgtcgaggcacaaaggaagaaagaaaattccagagaacgtttaaaaccttgagaagacggatgttgtctggtctggcttttaagacctagatacgcttttccgatttgccaggagacaggcaggccctggtctgcagtgcaggtgatgactctatccagagctttctgatcacagatgatcgcgtggttcacactgagatcatcctgtgtctgacacctgtcgggatgggcgatggcggaggttcacgtctcccgtgactttgcaaggtcacccggcagcccgtgtccccagtgtcatgagccaggggcacccgaggacttgttttccttcagcgtgggttttgcacttttgtgtccaaaaatcttttcctgttatcttcacctggcaaacatctgtccactcttcatggctgcactggggcgccgtctgtccaggagacttaccgcgcttgccctttcaggtaaagttaatcatcaccccttttgtattaccgctctgtcgttcgcacgattccggagctgcatttctcactctgatgcactgatgagccgaatgctactcccaccaccctgaggcctcactgcagcagggggaggtctgattgctctgtctcttggaagtcctgtgctcacaggctcctcggggctagagctcgggagatatgaaataatccaaagggaagagtcaggtcggcaccaaagcccagggttccagtgtcctg

SEQ ID NO: 50288 - DNA, 2863 bp, Bovine  19866880589073
ccttttgttccttcattcccacctggcatatgaagacccagctatgctttgtggtggtacccagcatccagactcgaagcactgacaggagaaattgatccatcaatttggctgtgatgtaagaggccttttaactccaaaccctttgctctgcagcaaagtctctgtggagaaagtactagagtgaacacatggttttgtcagtaaatactctttgatcaacactcaagtcaaatgtaaggagagtagagatggcgaatgcttaaactgtaattgatggcatggcttttcctatcctatttaatttggttcaacaactgtttattgaacaagtaacatgtgccaggagaaagcctagatgttcaagagtaaagagagtcaaagattaataaagtataatatttgctgtataaatatcttaaaatctaggcaaagacacatgtgtcacctaaataacttgactccaaagtataaaaagaaagattgattctatgaaggcaggggaagttatttcaactagagcataagtgagtagaccttcattggggaaaacagaggaaaaagaatattccagggagagagagagaacaacagaggcaaatgccaaagggggacagtcacatctcaatgtttctccacgagcatagaatccttgtccattccctgctgcctgaaacacatctcatggtttcatagtttctcagccggagtccacttactattcctacatacagcttcctaaaactgcaccaaaaatgcttgtacattttgaataccaaaacgtctgccattttatgcctctctaataaatcttgcatttgctatctgggctcaaaattcatttatctacctgaaaaggatagataaatgcctcaagttcaaatattacctccttcatgaagccttccttgatgctctcagatgatatcacaatatatcacaactctttgcttgtctgatgtgatgttctttgaatgaatgagtgattgaatggatgaatggaatcatgtataaagtattcaaaaaatggcaagtctggagggattgggacctagcttatttgagaacacagtgtgcttggtttatatgacagcctaagggatttcaaatttatctcctataagattatataaatgaccggaatcatctcctaagaatattaacctaacagtagcatgtagaaaattttggcaagggagaaagcggaggaaaccatacaatttagatgatgaaacaacaaaatgcaatacctatagtcgaaatgaagagaagaaagaggaggatattctagagaacgaacaaaagttggccgtggattggttaaaagggggaagaagagtaaagggtcaaggataaggctcatattggcctgcttaccactgcaaacattgttgggaagagatgttcctataccgttctccttccttcccctgcccccttgctttaagaaaagcgtaatctgcttacttcagatttcaggacagagatagggagaatggaccccagggtgttgttgtttaatggctaagttgtgtccaactcttttgtggccccatggactataccctaccaggctcctctgtccatggaattctccaggcaagaatactggagtgggttgccatttctttctccaggggatcttcctgactcagagatcaaacctgtgtcccctgcattgcaggcggagtcttcaccactgtgccaccagagaagactggattaggaaccaaattgccatggtctcttctagtcttttcttttactgcagccagatccataaggtagctgatcaagcttgcaactccccccacctctttcctgtcgataaccctaggaccttggtacacaaagcatggtccctgaaccagcagagccagcagcagcagcaccaagacacttgtagaaattcagattcttgggccccactccagagttactaaatcagagtctgcattttaataagatcccaaatgatccatacacacatgagagtttgagaagtactgttccagggaattgtcacttaagtgtcagacaactagcttagacagtatgactctcaacctgggttgcatgttagaatcatgtgagaacttttacaaatcctaattctccaatctacatctcagaccaattaaatcaaaatctttgaaaaaataaataaataaataattaaaaaaaaatctttggaagtaggaacagggcctcagtgcttattttttaaatttctactttctttttttaaaaataattttatttatttatttttgatggtgctggatcttcgtcgctgtgtagcttctctccagttgcagcgagcaagggctacgcttcattgcagtgtgtgggcttctcattgcaggggcttctcttacggagcgtgggctctagagcctgggagttcaggagttgtggtgcacaggcttagttgctccaagacatctgggatcttccccaaccagggatagaacctgtgtctcctgcattggtggatggattctttaccactgagccggggaagccccaggctgtggtgctctaaaaagtttcccaggtaattctaatatgtggctaaagtttaaaaccactagactaaagttaggagttagattgcaggacttccgtggtggtccagtggttaaggcttcaccttccaatgcaagaggtgcaggttcaatggctggtcagtagagctaagatcccacatgcctcttggccaaaaaccaaaacataaaacagaaacaagattgtaacaaattcaataaacacttagaaaaaggagttagactggacataacaggagacatcatctccctttctccttcaccattcccatttaaccccttagttctaagccaag

SEQ ID NO: 50289 - DNA, 1189 bp, Bovine  19866880593406
ttaaaaaaaaaaaaaaaagtcagcctccttgcctggcagagaattggtgaatttttcaagaatcatgagttttctttataaatagactggatgaatctagaaatattaaagaggatgatgataaagtaatacaggaacttgaacccaaacccagacaagtttcagtggtagacctcacagtctgtgttggagagaggagtgcatgagtgtttgaacatggccttggtgaataccactgtagacagggcaggcggtgcctgtgctgtagggtggcatatcaggctgaagcttgcctggtgtctgaaaaccaacacaacctttatgcctttgcagaggcactcgggtctgccttgtcttcaccctcctctcgctgtctctgtctcctcccctatcctccgtatccttccctttcccttctctttattgtttttccagctctctcatctcctttccactcttccatctctcgtttccacaccctgaccttgattccagagcacagctttcctttccattcttgcttcatctccctcctccctgcacctttttcctgttctcttttctccatcttggcttgggggctggggcttcagtctcctcgggccccagcggttcattcccattaagcttgacaatctctcatatgtcaattagaaagaggccgcttccccctcttccccctccctttcccgggcctgccgcgatgctcagattaagtaccatctgttgcattcatccaggcgacgggtgagcattttgctgctctggggaggcagagctcagcgggtaccaggaggtaatgtggcttgtttggacaacttgatatattgatattgatagagctaccggatgggattgagagggacgggggcgggagagagagttaccgaggatgaaagaggccatggaggggtttgcataagcacttcccgctctaagcctgtctgggctcctggcaccgtcaccaaggcaagagcagccaaacagatggataggatttgctatggttgggatcagaaacccctgcagcccaggggagcaaaccttgcctctctgtgtatcttcctctgctcccagctggtcagatcggcatcagcttaggagaaaggaaagcagaaataacaggctaggaagaggctgaccttttggagttgctgaatgtcagagcacgatgaaaagggatgatgta

SEQ ID NO: 50290 - DNA, 936 bp, Bovine  19866880641146
ccccacttctaccttctcccctcagccacagacacacacgagggatacacaataggcagccatctgcaacccaaggacagaagccttactggacactaatccagttgctcctgaaccttgaacgtcccgtctccagaactgtgcaaggacacatttctgtcatttaatccatccagcagcctcagcagattgacagcatcgtgtctacatatacagtccttcgtatgcctactgctgttcaggtgctcctctgagcgagggagccaattgtagacctcttccaacagcaagctacaaccctccatagacagctcatcaagagcctcctactcttccatgacagttgatgaaagaggcattgggttctcgtgtcctgattcctggttgtctagctcaaagtcacaaccacattccatctgtgaccgtttgccagccacaaagagagtagcttcagctttcccctcctacttcttttcaacttacattttattgacattttaagcatcttccacttaagatgtctgcatgtggacaccccgtgagacatgcatcccagctacaaagaatattccaatactgacaatatcagtccaggggcctgccttggtccagataaaaatagagtgagaattaaaaaaaaaaaaaaaaaactacatgtgcattgctgtttcacccaatttttattccctcaaaagatatcatggagatgaatattcatgctgagaaacgtgaggtttcagccttggaagcataatttattgttatttcgaatctcattagcgctttacatttgtaaaacccgtttggggtgaggcatttcctttctttcctcccttgcctttttcttccatgcctccatccttccctaaacaccctgtcctcttccaaaagctaaatcagacactgtcatttttacagaaataaaaaatcaggagt

SEQ ID NO: 50291 - DNA, 1305 bp, Bovine  19866880671080
ccaatggaggagactcagcagatccaggtccgatccctgggtggggaagatccctggagaagggaatgaccaccccactccagtattcttgcctgggaaatcccatggacagaggaccctggcgggctagagcccacggggctgcaaggagtcggaaatgacttaggacctagtgactaaacaacagcaataaactgtgatgcaagtaatgtcatgcatttaattctcacagcaactctatagagagacactgctgtcatcgcttttctacagatgagaaaactgaggcacagcaatgttaagtaactcgcttaaggtcacacagtgagaagcggcaagctacattaccagccacgtgaccttggacacattacctaacctaaatggagtaataaatgccctttgcactctttacaaccagcgttacattaaggcagatattattaaaattttagagattctagagactgaaggtcaagggtcctgagagtcttgcctgatgtctaagagaaagttagaggtgatcaggattggaacccaaatgtataccaattccccttgaccctggcagtctgctatggatacaagaggcagacagtttctatgtcaaaatccattactgctgtggtcccctgctgtaaactgctgcttgcaacagaaggacacccctccccccaagtacaatagcgatgataagaacacagctgattcggtattcaggcctcagatctaagcccatgcataatttactcagcactgccctgcagtcacttcagctgaggagagaccctataaattcaggtctgcacacactaatttatttcttatttattttactgatacatatctagggcctccagcgagctgctctaacacctgctcaaaggcgcctctggcaccaagcgtaactggggctggggtggggagcccctgaaatgagtcccagaaggaaaaccagatcccacagactagaaccatgcaggtaaaattaatttcctgttaaactgaaattaagcacttacgcattcctccacctcctctttcatagttcttggggctgaaaaggttgttaaatgcatttttctccttttctatcttagtaaagccctgtgtgcattcagctgctcagttgtgtccggctcttcgcagccctgtggatggtagcccaccaggcttctctgtccctggaattctccaggcgagaatactggagcagctggctgtttcctcctgcaggggatcttcccagctcagggatcgaacctgtgtctcttgcgtctcctgtatcggcaggcagattctcta

SEQ ID NO: 50292 - DNA, 1040 bp, Bovine  19866880704487
cttagcacataacaaagggcatctaagcaaattctcttccctacaggcagccagatctgaaaaaaacaataaagacacacagatccacattgagctttgcatacccatttttggcatagaactcaacaatcagataagccgctttcctgggggtcatagaagggccatgattattatgctaattgaagttcctttacacggaaatatgagaagtcaagtgtaagtctttccatttaatgctattattggtatatgaaataccttgtgttatctgcaaagtctcccaggtaagttaagtgtaactaacctagagtgcacagaacccttagggtccctgagagaacaactttcaagcacttgtgtagctggcgtgttatacgctagttatcaacgaatatttttctattttcctccacatgtccccatagggacttgaattaaatccacaacacgcacttctgaagtttagactggccttcccttaattaccagaaatgaaaggtctggctcaaatgtagatgagttacatagttgactcaggttagctgcatcgtggcaggaaggaccgttttcaacattagcccaactttcgcctgcttggaattctctgaaaagcctccatttgaggggtaactttgtcagacccatttcttgtcataagctggaggaaaatcaatcccagtatttgggaactggactcaatctgaaagcaataggctcgtcacatttaattatttcacactccactcaccaagcctcgaaagtgtcaatttcacctgagggctaaggggaccagggaagagaaatctgaccaagtgtgggaaaacaataaactatggttaacagcaagagcaacctttgaaagttagggaaaaaaaaagtttccccattgaggaactagaggagggttggaagagagagatttgcagattgattttcttctgatatttttggtaaaaaattagaattctggaaaaaacgtgctgaaaggaccctcagagatgatcaggtcaaacaggtttagtttattgatgcagtga

SEQ ID NO: 50293 - DNA, 909 bp, Bovine  19866880721750
catgggaaagagggagactacagtaaagatgggagttctcaagctagtgcaaagcgcagggagaagggggtgggggcggatcagggagtgaaaaggtagccacagcaaagaacaaggacctagggtggtcgttcccaactgcgccccttcacgtctgcctgggcgatggccacaagtcctgcatggcctctgccagcagagggcgcccggggccttcgcatcaatcagctctccccggaggcaaaacaggacacgcaaggaacggagctgggggagctggggacgctcccctgggctggggaccccagacacagcccagagggcagctcagaatccacccatctggggaaggtgacggggaggatagcagggtgcttgcctaaactcagttggctcgaaaacaaatccagattctcagacttgggtatgggtgggtgcgtgtgtagtcgaagctaccaggcaactaccgaatcctaatagcaggaagataggaagcagagtaagtactgtctgtgtattgatcctatctgttgatcatcagctatgtgcttggtagtgtgccaagacacatgtgagtgcgtgtgtcatttttaattgcacgagaattctgtaactactattattattcccgtttacacgtgaagaaatggatactcagagaggtctaggaacctgtccacctgagggccaccatcaggaagtgacaatggggctcctagcttagcatctggtactcagggagcacacgttcaaggcatcagtccagaccacgtgctcttgatccagagtaacctgagagcagggcagagacaggtgtgcttctgagcccagggatgcagtcatgtgtgtgtgtgcataaatgtatgtgtctcaaatagcaacaggggcactgtttctttgtacaaacct

SEQ ID NO: 50294 - DNA, 827 bp, Bovine  19866880734566
ctcttcaaaaaatggtgctgggaaacctggacagctacatgtaaaagaataaaattagaacacttcctaacacctacacaaagataaactaaaaatggattaaagacctaaatgtaagaccagaagctataaaactcttagaggaaaacataggcagaaccctcaatgacataaattaaagcaagatcctctatgacccacctcctacagtaatggaaatagaaacaaaagtaaacaagtaggtcctgattaaacttaaaaagcttttgcacagcaaaggacactataagcaagatgaaaagacaaccctcggaatgggagaaaataatagcaaatgaaacaactgacaaaggattattttccaaaatatacaagcagctcatacaactcaatgccagaaaaacaaacaacccaatcacaaagtgggaaaaagacctaaacagacatttctccaaagaagacataagcacatctgggtcttcttcagctcagaggtttgtaaggtgtgcttctcctgtctcagtttactgatctgcgaacctggggaaagggtgaggtcagaaatctggcctttcaagtcctgagattctaaagtgtctcccgtctccctggtgcctgctccagttcatttactcctccaaaatatgtcagaaaacacacataaacagacacacacacacacacacgaaaagatgctcagtatcgctcattattaaaaaattaaagtgaagtcgctcagttgtgtccaactctttgtgaccccattgactgtagcctaccaggctccgccagtactattttccaggcaatagtactgggagtggatt

SEQ ID NO: 50295 - DNA, 593 bp, Bovine  19866880764361
cagtgcctgctcacagcctaagactcccccaatcatctgttcaactgtgtgccgagggggaggtggcctcttcagtccccatgccaccagcacaccacctccaagtcacacaaacctgggcagcatgcccccagagcccgcgcctcctgtagctttcctgtcatcagccttgccccatgctgataggaatgccaagcaaggggagccggccaccctcccccacccctcacaaggtttcacttcttgcctgtccccatctaagaatatgtataagcattttggatatattaatacacagcgaccagcatgcaagagccgatcacccctcagttctggggaaattagcatttaaattgaggtatttcagggaagtaaatcaccccagagccagccagcactgtctgcagccttttcttatggagagaagacaaggaatcttggcctgcgtgctgctgagttcgcagggaggggccactctccttggcactccgaggctgtccacagcagccccaaaagggtgcccccaaactcccaacactcacgagggcatctccccggtttaaacaaggacctgtaacttacctccagctaag

SEQ ID NO: 50296 - DNA, 1487 bp, Bovine  19866880842306
taccccaggcttattcctctgagtcgtcagccccaggaaaagttattgttttgtgagttggttgtttttccttctgctttagaacagctggtccaccttctagacctgggggtggggtggtggaacagctcattacaaattttgtgctcggagcaatttgcattccataattaatgaacattaaaatgcataattacaaacagaaacaaatggcttggtgctgaggaaaagtcaggctgggaaggagccagagcaggcacagggggtggaggaggaagctggagagagcagggcagtgccagcctgtgagagaaacagctgggaatcccccagccctcccttctcagatcctcaaggctttaagactcagggacccaggcccaggatcttcctgtggtttctcttctgagatggagcagaatggaggctgtgaaactctggagcctggctggcctaggttaggccccaagctccgtcacctacttaccatgagacctcaggcaaaggagcaatgctgcaagaagtggggtcatcgtcagctggacctgccccctctctcctgcccgcttctggtcccacagagcctgcctcccaaggctgcttctgtgagctccaaggaagtacttagagataattgaattcacttacttcagtaatctcttctaagtagcaaagcagatcactccagtcctctgccaatagacctccagtgccttccggttacacttagaataaacttgagatgccttctcatgaccagagatgagggttagcaccttttctgtatgaagggccaggcagcgaaacattttagaatttgcaagtcatgtgtgatcctttcgtcatcatcttctttaaaaacaaacaagcaagcaaaacccttttaaaatgtaaagagacatttttagctctagagctgtgcaaaaataggctgtgaaggagtggatttcttttccctatttctcccactaaaaacaactaaagcctccagaggtgatatataaaacaaattaagactgtgggcttcacaggtggtgctaatggtcaagaatcctcctgccagtacacgagactcaagggatgtgggtttgatccctgggtcgggaagatcccctagcataggaaatggcaacccactccagtattcttgtctggaggattccataaacagaggagtctggtgggctacagtccatggggtcacaaagaatcaggcacgactgggcacacccaagactgtgaaaggtggagagaaggaggcaggtcagtttaggggctttgagaccaaggaagacatgttggtcattccctgcattttctttttgcctcatgtcccaagcttggagtttaaggagccagcaactaagaaataaatgcctgtagatagaccaaaacaaacaaaaagcagaaaacctccaccaaaaaatcaaataaaacaaaaaaacaatcaaaagccagctttcttcagccagagtattaggaaaagg

SEQ ID NO: 50297 - DNA, 2206 bp, Bovine  19866880878143
ctgcacttcaccagtcaagtcgctgacccagaacctgggcgggggagggagccatgggtatgtggggtagaggcctggtgcaccggtcagcatctcctagactcacaagtgcctgtgcacaaggtgccagaaggcggcagaatctattctctggagttcctcttccactgaccaaagcctttgtctaccccatcctcccattttctaactctccacatattttcatttcaatcttaaatcatcctacaagtatagttaatggaatttttaatgtaattaatcttcccatctattaaaaaatatcttatgtaggctattcaggcagttcaaaaataaagacatttaatgaagtagaaaataaaattcccatcatccagaaatagccagaattaatattttcttgaacattcttaaaacacctctctctctttctcgatctgtatgtcaatgagtacacaaacacacaaacatgccaactctcaggaaagctgtttagaaattgctgtttttttctcattggtatgtcaaatacctctttccttgttaataaatacagacatacatgtgaaattaaaagatgagagtgttcctatatgagaataaacaggaaagcaactgggttgtccaaattatatgaagattagacacgcagtctaattgggaaagtcttcctgggagagttgaaggaactgagggctgttgtttctgcagatgagaggccttcggtgggatttattcatgcgtcaaaatctgaaagccataagacgatagcatgagaagaactgagaactgtcccatatgtaagaaatgtttatctttttaaaaaatatgtatgtagttttagacagttttgcataacaatgtaataggatattatcacaaagaaagcttcatctatcgtttgcggtcatgtcaacagaagtcagaactggtaagaaacatcaccatcagaatcatcctcatcctgccaaatagttaataattgcttgtaggagtggtaatactagctactatttactaagaaatactgtatgccatggagtaggaaatggcaacccactccagtattcctgcctggagaagcttatggacagtgcagctggtgggctacagtccatggaatcgcctggagtcggacgtgactgagcgcctgacacacactgtgtgtcaagctccttactaagtattttaagagcaatgatagccacgaacattaagttagcatatgctgtgggcattctagcactttccacccactgatttatgtcatcctcaccatggccctgtgaagtagaggctgttatcatcctctttatacagataagaagtggcagtgttaagtaactttcccacatccccctgatgggaagttaaagagccaggacagtgcaattaccacttcacaattaaacccttttgagataccatggcctccattttgcagttgaaaattctcaataacagagaggtaaactgactgtctcaaggtcaccatctagtgagagggaaagtaaggattcagatgtatatctgactgactccccagccctgggcttatcttctaatccaacatgtcacatcacttcccattttatagaaccgaaatgaaaatgtgaatcccctgaactgttcatctgtgtcgctgtcacatgcttttgagcacctgcagtgtcccacctaccatgctggttacttggaacacaatgggagatgagataaaagtggctttagacatcgtggtgtttagatacagtgtgcatgtgtgtgtggcatgcaatcttaagtacttaatttatagcaggtattgtgaagtaaaaacacagtgttccaggaaatcaattaacagtgggatctaatttagttggagagagtgaggggtgggtacatccactggattagaaagcaataagaaggctcacagtctagtttccaggggaagtgttatttaactaatacctggaagatgagtgggagttagcactggaaaagttttcaagcagagacagatgttctaagagggaaaggaacttgactgacttcaggaaatgaagaatctggtgtggttgaagctgagaaagtagggaggagtagtgggaggtgaaggcagagtggtaagcaatggcagatcgtggggatcttgcaggctaaggctttactgtaacagtaaagagggaaactcttaaatggataaatgaggggggtatgt

SEQ ID NO: 50298 - DNA, 1484 bp, Bovine  19866880913960
tacaagactagcctgattttaaagaagcgacaagcactagatggtaagagagatacaggtaatgtgccatggggacgctttgtctggagggatcagggtgagcatcccaaagttgatatttattccaatcagacctagcaggacagtctggctttatccgatggagcgggtttgacgatgcaacctaggctgacggaactgccccagcaaatggcagcaggtgaagacgtgcaggctgcgtctgtgggtgcttgggcagaaaacagaatggaatcttaagctagaaaggccactctggctaaattaacaacaggtaataggtggctcagacagtaaagaatctgtctgcaatgcaggagacctgggttcgatccctgggtcaggaagatcccccggagaagggaatggctacacattccagtagtcttgtctggacaattccatggtcagaggagcctggtgggctacagttcatggggtcagaaacagttggaaacacaatgaagtgactaacactttcaatggcaatcagaacaggaaaggaaggaagggaaaagggtgggtggggatggttgcagctgagggtgggtgaggatggttgcagctgagggtgggtggggatggttgcagctgcagggacaggatgacaaagcagaatgccgaagatgggactgcacacaatatctcagtgagtgccacatatgtatacacacacatatgtatatctggggttaagtaacatgtttaaggtaaggaaacagcagagccaggatctacactcaggctgtccatctccaaagtcagggcttcccatgccctgctacacttcacccaacgtcaggctaagaagtggagaattgattacgaaggccaagagggagccgccacagttatatgcgggaatgacgcgattcaacaaatgcttgcagaagatgactctggtgtcacgcgtaccccatcagctttgggcaattcctacttccttattttctaatgaagccccttctggggtgagtaggggcagacatggtccatttgtagcagtccccaagtgtcccagaggagccctggacgggctcagtccctctgacaaacgctccagcctcccacggcccctgggggtgatttatcagagcagcgtcaacgcctctgcccagcagcctgtgacccaaggctggcagctcaggctggggtttttaattagccgagagagggaagagtcaggcccttcaggatggagagagagagacaccccgacggctcataaatccagatccaggggtccagaggctggtgtctggcacggggcagggaggaagggaagaacagactgactggctagcttttcagccttttcatggtctcctttgctttctggttcagatactgcaggggctggtgggaaactgtgccgccttttacacagcaacccctggggaggcactttctctagcttggctgcacgaccaaaacccagggaccgt

SEQ ID NO: 50299 - DNA, 1056 bp, Bovine  19866880995675
ccatgggaggagcctggtaggccccagtccatggggttgcaaagagtccgacacgactgagcgacttgacttcactttatcaaaactaagcatcatgtcatatgacagtataaccattgaatttatttctttttgtttttctttgcttcttattttctttttaagtaagcatttgtatcattttctcgattacaaatatgatgaataatgatctcaaaagtaatgcacgttaaacttagttttaacgcagtgatacaggtgtctctgggatttaaccgtcccctttctctccaagggaggacgcgatgctgtccacctacttcgaaaccatcaacgacctgctgtcctccttcgggcccgtccgtgactgctctcggaacaacgggggctgcactcgcaacttcaagtgcgtgtctgaccgtcaggtggactcctcggggtgtgtggtaagtgcccttgcccgtgagcatggtgctggcccgggggccaaggctgctagcgggaggccccttctgtgagggggcagctggtcaaggtcgtagctcctgcctttgtggccttcagtatatcaggctgctgtccttggattcctcatctggacagtgggatcccgatcacacgtaactcctgtaagtgttggaagaatgaaatgagctattagagctttagtgcccactattcagtcggtcctcgagagcccctggcctctggctcaccaacaccccagccctgcccctgccccaccccacaggtacaaaagccgctaaaccactgcaagctcttacttggattaagagtctgagggcatagtcaacgaagagtgagcatctctcaaggagatctgtttataaaactcgggaaaacacctctggataggatcatgtataaaggctcccagaatggaaatgagttggcacgtttgccctccccaacgtattgacgctgggatttagccttccaggaagttcacaggccatttgggagtgagatagggcctgttcttgtctctgtgcagtcagtggggaacacggcatctgttcggaagaaaagtagcag

SEQ ID NO: 50300 - DNA, 1847 bp, Bovine  19866881006575
tatctgtgtttatgtgtatgtaaacatatgcaagcatatatacatagacacactcaattatacagttgtatatatgaaatacacgataatgtatatgtatagacaagggcttcccgggtggtgctagtggaaaagaatccatctgccagtgcaggagatgcaagagacatgggtttgatccctgattcaggaagatcccctggagtaggaaatgggagcccactacaggattcttcagttcagttctgttgctcagtcatgtctggctctttgcgaccccatggactgcagcacgccacaattccctgtccatcaccaactcccagagcttgctcaaactcatgtccatcaagttggtgatgccatccaaccgtctcatcctctgttgtccccttctcctcctgccttcagtctttcccagcatcacggtcttttctaaggaatcagttcttcacatcaagtggccaaagtattggaatttcagcttcagcatcagtccttccaatgaatattcaggacaggattcctgcctgaataaattctatggacataggagtctggcagactccagtccatgggggcacagagtcagacgcaactgagtgactgaacacatggatagaagtattaatataattatgcatagaatgcatttttgctgtgtaagttttattccctggaatagtgcaatgcagaggccctagccaggcacagtcctgtccttaggcaattcaaatatattttatttaatagtcatagaagctccatgaaataactattcctattgtagacatatggaaattgaggagtcctgccaagattaagtgatttgttccaaggtcacacagttatcgaatgcctgggctaggatgtaatccatgcttgtttgactccaaaatccagacctttgccttccacccaagttcatgtcttatgtgagcaactgacagagaagaaagtttttcagtattagcaaagcagagctaaaggatctttgagttttctgagcaactgtctatcaggttcattcaagaagcactgatcttagatcaaaaagaaatctgataccaagattgggtttgatgcataaattcccaatgaattaatgaagacattttttttaaaagaaagggagacaaaacaactgaattattaaattaaaagtaaatagctgcttttaatctcctcaattattctttaaaattttaagttacttaaagaaaaacaagaagcgttttatgactttgttatttttccctgctgcctagcttgataccaaattgttatatccctggggagagaaattattttttgagatttcaacacttcaaacctcttttgttcagactcaaacacccctaactcagctatgaagcaagagcaggcatatgtaaaagcctgtggaattctgtggcaatctgttttagccagactttgatcacaatttgaggtgggaaagacagaaagtggtagaaacacaacaattgcctgacctctatatggggagagggagcaacacttggaaacaagtttacttggaagtatgtctttttctaacatagaataccagtgggctgtctatatccatgcttccttttctgggacatctagtgatggattcttcagtgtctcttatatgacatgggcttcacaaatatattaacatttcattttcccattgagggatctctagcttatgacagcttatttccatggaatctactcttttattcttttttaatttaatttttattgaagcctctttaatttgcagtgttgtgttagtttcaagtgtatggcaaagtgaacagttagtattatttttcagattattttccattataggt

SEQ ID NO: 50301 - DNA, 1091 bp, Bovine  19866881063333
tttttgagatgtctgtcagagataacattccaaggcttgctgatttgagatggccactgttctgagccctctagatcgaacccaggtctccagcattgcaggcagattctttaccatctgagtcaccagtgaagcccctcggtacacataaactcacttaattctcacaactagagaagataggagttactgtcctcattttacagatgaaaaaaatggggttcatggaagttaagtggctcagctgaggtcacagagctagtagagctagaattcagactcaaaacatcaagcgccagagcccgtgctcataaacattacacaatatgcttgcttcacacactttatgtgacaaaatctctggccttctcccaaacacatcctatattttctgttcctgggtgttcaacatcatcccattctctgcagatcccaactgtcatgaatattcaagaccaaattcaaggggtgtctcctccatgaaaattttcatggtctctcctgctgtaagtggtatctcccaattcaactcccactgagcattttatcttttcttctcttgtggtgattaccatttggggactgaaaagaaagttaatatgactggagtatagcatggcaaataatcatcagatatggatgcctcagcactctcctacagactgtgagcatcacgtgggcatggggtaggtgtgctggcatgcctcacaatccctagaacaatgctctactcttagtagttatatcaactgggattagttcagtggaaagtaacaaaaaatcaaaaccaatgaatttaatgatagaagtctggttatcgttctcataaagcaagtctgtagataggcagcacagaactattctagtagttctttggtcatcaggtacccagattgcttctgtatttttacttcttaatccctaagaagttgatcttcttggcccaaaatggctgcttgagttccagccatcacatgcatgatctaagtagtcagacagaataagaaaagacttcatagggatgccacacagcacttcttatatcttatggaccagactttgttacacagtcattcctaactgctaaagca

SEQ ID NO: 50302 - DNA, 1356 bp, Bovine  19866881099716
gtcaggggaggctggatggattttccagatagctcttagagatgtaatacagtagaggttcaggaaagaggcagtagagaagattggctggcatgcttgaagagtctccatgagaaattgtgttaatgaaatttgcacatggtttgccccttccgcatgccttctgcagcctggtggattcccatccaggctggagtgtttctgatctcatcttcttttcttcccagagagacccaagggcattgagaccatctggtctggtgtgcttctctggattacaccccacctaggggcttgcagtgggagaagggaggcatgtgccctcaatttgtctcctcttgaaaaaaaagagtcctgaaaatccagaaaccccatgtactagcctcttgtccccagtcaatagcaccgcctccactccactaccaagcacacagctggcaacagtgctgtttccatggtgataatgaatggcaagaggcagtaatcaagaagggttgctggagtcataagtcattacagattgcatttaaagggacacagccacctttaaaatgataaatgacttcatagcctctccctgccccagtctcccagaaacaaaggtttgctgaacatttggtttgcatgttgattttcttgatatttcttttcatttggacagtgggatcagatgggtcaatctttcatcaggatatcctaagcctagcagttcacacgctaaggtttacgatggctaggatggcagcctattcaaagaggaagtccttcctctttccctggcagaaccttgcatgcatgcgtgctaggtcacttcagtcttgtccaactctttgcgaccctctggactgtagcctgccaggctcctctgtccatgggattctccaggcaagaataggggagtgggttgccattaccttctccaggtgatcttccccacccagggataaaaccgtgtctcctgtggctcccacagggcaggcagattcttaactgctgagccatgggagtcaagcccctccaaggatcttaaaagtgaaagtaaagtcgctcagtactgtagtaggttgccatttccttttccaggagatcttccccacccagggatcgaacccaggtctccctcattgtagacagatgctttaccgtctgagctaccagggaagtccaagtaccttactgaaagtcaaatgatcgcagaaaaatctgacattcattgacttttaagctgtatttcagaataaaaataatagaaactcacattgaatttggactcagaacacattgcttgggttccagccgtcctcgaaaagggacctgaggcaaatcccttaaacttgtggacatctatgcctgcac

SEQ ID NO: 50303 - DNA, 1658 bp, Bovine  19866881129716
tctaactgtaataggtggcagagacaagtctcaagcttctttttataacctcctggctccaggattattcccaagtgtcccaaggaggtcagcagagagagcaatcgcttcctcatcatttcccttgtgaatgaagccttcggagaccagatgcatccacttcattataattacgttaagtgccgcctgattgggcgctgttcatcacccctccggaaagcggcttcgcccagtggacatacaagcagcctgcttgggctcagcgcacctccctctcatccgtctgtgtccttggcaatggctgttcgtggtgcccaaggctgtcctctggaggagaggaagcagtgggggtaacatgtgtggcctgggttgactccccctcctcctccctggggctcagagtaactgtgcacaatcagctgcaccatgagacctctgcaccctcatccagctcttaacttgtcaggatgtcgggaggaaggtgaccttggtatccttacaggtgaacctcctgggaggttccttttgtcctgaggcatctgattgtccttgctgcgggattctgtgtcctcaccttgtaagaaaatgaggtctgccccatccttcaaaagggccagagcatggtggagactgttctgatgtcaagggcggccttttgtaacctcagttgtctatgcgtgggttcagggaagggggatgtgagttcccagaattaagagaatggggctggcaaataagcaaagagtccgtgggagagggaggctctaacccgggtatttagggctgagaaggactgagacggaaggtgcagggaggaagctaaggtctctctagagcctggtttttaggtgtgtggttctggagcaaggctgccttggttgactcctgatgttagtactttctgagatctactaggcatgcataacgttgacctaggagtaaatgtcgccgtctctcattgtcctcatctttaaaatggggaaagtcagagttggcagagttgttgttagactaaatgggttaaaacatgtcacagggcttagaggagtgctttttacagataaaaggctccactcatgttagttattatcctattgagagtctcctgcaaatagatgaggcacttcgtaggctgctttatttagttctaacaactgctcagcagttcatttgttcattcattcaccaaagattcattaaagcagtagcaaaagtggctggcatgaccctgccctcaaagatgttgtcctttaatgggaagaaatggcaacctgctccagtattcttgcctggaaagttccatggacagaggagcctggcgggccacagtctgtggggttgcaaagagttggacatgactggacaatggaaccgcaatgggaagacaagacttgagacgtgaactgaattatcagttactgaccaccatggacccaccaggaagaaaatgtgctgagttctctgggggaggagagagggggacttggcctcagtttggctgttcagcaagccctttctgaggaaggaataaactgaagtcagaaggatgcacagtgtttgccccaatgaggggctgaagaggcagtggaagaatttctacaaagaaagagcctagcccgtcctgtgacctggaaggccaatgtgactgggacacaggg

SEQ ID NO: 50304 - DNA, 822 bp, Bovine  19866881169560
gagccggcgctccccttaggttcttccaagaagcccagagagaaggtgtcaacgagatagctctcacctcccctacagtttccccagcctcctgaccttggcagttgttttgagaggacagagtgggaaacaaggaactcgcagtagaaggccagagttctggagtccaccctggggtctcagaaaacgcctgaactttaagaatcctgaggaatcatcacacggtccctcattccatccccggtgaacatgaagccctgagaggcgcagggacttgtttacggccgcccagttcctacgtggcagagccaggatttggctcccagggagctcagttatctccccagcagcctgacctccatgtctcagctggccgccacctccagcaagccctccaggcttacctttctggtactggagccacagctgctgctggaccttcttgctggggaagtgaatgatgcaggtgagctcggagccatagagggcctctgcgatgtagtgtgagccatagtgctggatgaaggacagcagctcctcccggctgctctctttggtcaggatcttgaggacgttggtgaagcctggacagaggaggagcatgtggaggtggtcagagtttgggaggctggcgcccagcaaatggcaagcccggatttggtaccttgtccctcaccataacttcggccaaatgtgcatagtatccctcccttacttggcaaagactgctctctctggtggacacacgagacaccacccagagggagtcaacagcagaggaaggacaaacgcggcgacccaaaagccacaatcaggaaaaat

SEQ ID NO: 50305 - DNA, 1199 bp, Bovine  19866881197019
attttagtctttaatccaccagggcaggctctgttccactcgcagcctcacctggtgaagtctggcgggatttctccagtttcaaattgctcttgcctttatttctcagaggtgtttggtggagagaaattctatctcctcccccagggtctgttgctgcggttacccaagtgcgccccccagtggttgtagactttttttctcactctgagagcaggagcgttttgtccaagcttgcattcatctctcaggcacttatcagtcctgcgctgggtgggcagtgcatgcttaccctgtggtgggcgctggagagagacgatggatccaacctccttcctggccctgggaaatttagtctgctgggggaagcaggataccattaaaactgagatataaagtccattgtgataaataatatgatggcggtttctggggtgttacaggaacacagaagagagccttccaaccgtgtctggaatggaaggtggatgataggaagagcagagaggagggtttttaaaggagaggggagcttagaggattaggggaaacgaacctagggatatccaggagtagggtggagaaacggagaaggcaatggcaccccactccagtactcttgcctggaaaatcccatgggtggaggagcctggtaggctgcagtccatggggttgcgaagagtcggacacgaccgagcgacttcactttgacttttcactttcatgcattggagaaggaaatggcaacccactccagtgttcttgcctggagaatcccagggacgggggagcctggtgggctgccatctatggggtcgcacagaatcagataggactgaagtgacttagcaatagcagtagcagggtggagaaaaggagtggtcaaggtattcctggaggcagaaagctgagcgggggaataggaatgggtgggagagatcaaccaagttcaatcagagagggctgggggcctggggaaggagctggatacaagcatgagagagtgctaaagcatcttcatcagtcagtgacgaaagttatctaacgccagtcttctatttctgtaatggccctgtatctgaatttctcccgcactgtgttatctttgcctttttctgttttctcacacctctcctgcctcatcttcctgttgctcatctcttttcttctccttcatagatgtcttgtttcacttccat

SEQ ID NO: 50306 - DNA, 1843 bp, Bovine  19866881215821
tgggttgccatttccttcttcaatgcattaaagtgaaaagtgaaagtgaagtcgctcagttgtgtccaactcttagcgaccccatggactgcaggcccaccaaggctcctccacccatgggattctccaggcgagagtactggagtggggtgccattgccttcttctgatatctagattaggggtgaacaaacccagtgattataccctgtgacttccccgaccagctccactccgggaaacagcagatctgtgggtggctccaaaactcagcattcatgagcaactgagacagagctgtctttcccaagcagtgtatcacctcagtatcttaatgaggtgctcctcaagtcctatcacacagacctgatacaccaggaagcagatggacctgggaaggaaatgaaaactcacagttgctggtgtgatcatttaaatcaagagagttgggccaagaaccaaattaccattgctgatccctcaaacacattttaagaagccagtgagaggagcaaattcattgcaaggcatcatcaattttgtaaacacagatgcaagtaaaaggatttcaaggggtgaaggtctgattctccactcaatttcttattaaatggaattcagaggctgaagttgaggtcaaatgcaaggtcccatggaagataaaactcatgcaaacgtctgaaaattcaaatgtttggtgcttgtggtctctgtaacctgtagtgggcaattcagactatcagtctgataaaatcacatgtgcacaagaaaataaatatatctctaatggggcactcataattttgaatagataatattaatgctaattataattataacccaatttaattgaactgatcggttataattattagtaacatgcggtcagcttacatttaagttcctactatctgccaggcactttacatgttatgtcaccttcctcactgttgattctccagtaactagaacatttcctagtgcataataggggcttgacataaatatatgaaataaatgcataaacaaatgaaaatcccttcactggctccgataaatagttctcatcttctttatgcagagaaagaaacagttttggagaaacaaggtgtctttctcagtatccaacagatattgctaatatacacatgtcagaatcagcatgggggaaggcctcttcctgagacactgtagaaatgtgtatacatgtatggatttccatgacaactaggatctgaacactttgtggcgattttatacattgtatttcctttcattctcctcctagctccttacaagttagggacccatactcccagagaaagaaaacggagctttaccaaattaaataattgcctaatttctcatataaaattctgtgatagaggcagataaggttgattccagtgccaaggtataatactctgaattagaatgtcccagttttggttttctttaatctggccaggaactaataatatggcagtttttaataaacaatgtatgaacttaataaaatgtatcatatttctgcagactttgagtccttaaagagcaagaaccctatagcatgatgtatgccacacagaggttctttttttgtttttttaattgaagtatcagttcagttcagtagctcagtcatgtccgactctttgcaaccccatggactacagcttgccaggcctccctgtccatcaccaactcccggagtttacccaaactcatgtccatcaggttggtgatgccatccaaccacctcatcccctgtcgtccccttctcctcccgccttcaatctttcccagcatcaggggcttttcaatgagtcagctcttcgcatcag

SEQ ID NO: 50307 - DNA, 1411 bp, Bovine  19866881219388
agaggctgggctgccatcagcggacgccaaggaggcccctgtgttcctggatgtgactctgtctgctgaggggtaaggtgaggatgggaaagatcaaagtattggagccctgaaggggaaagaaccggttcgaccacaaggtggaaggcctaggccaccccagctagtaggcagggagggtctggagagcgccaacctctgcacaacctactccaccagccacatccttgattgcaaggaaattcaagagacattttgggtcttggtgaattctttccaagctaaactcactgagcagaaaaaaaaaaaaaaaaaaaactaaggatcactgagagtctttggggagaggtctgatttagtatcattaacactgggtgtggaaacagagaaagtccatgcaagactagtattatcattggtataattcagtcaaagtccctgggttatgggaggatgtaggtgagtaaatgctatgctgaaacagaaaatgcttaataaatgtgaatccaaaccgagtttcactcccagacattcaaagaagagtcgccccctgtccagtcttcttcacgtcagatggcaccccagcctgcacgaggtgctcagcaagcacctgagaagtgcccacaaacttgcaacccagcgtcagcatgcaggcacccacttggcttggcatgtggctgcaacactcgctaaatataaaaatgggaaaagtctatcacactcattccatgaataacacaaaggccttgatttgttcctccacgtgatgagcatgcgttaggtccaaatttaacgtggctgtctggctggggtatgtgcgtgtttttccaaaaagagaaaacttccaagcacttactcagccctaatgagaatgtctcatgcacagtaagggttaagaggggcctggagcacggagaccatgacgaaaggtcagctccgctccatcgcaggttcttggtaagtaccactgacgactgaatgaaaggcagaaaggaagggctggctcatagctccattctgctgagtgaccttaggccaaccacttcacctctctgagccctaccttccttacacgtaggctaggagtgacatttcctacacttgtgcatctgtgctaaaggtaaaaaggagaaaatactgtagagtggcctgaggagtgaaaagcaccagacttgagttcagttgtagctattatctgatcttttctagagccagttagaccctgtacattcttcactttgattctttttttcaatttactgtacaaagccattaattacagcttttcaaatcatcgttaatgtgagtctacatacatcatagacttaccattccagtgatttctgccctggcatccttctttaaggaggcagcaggctcagagttccagatcctgagcccaacagagatg

SEQ ID NO: 50308 - DNA, 1440 bp, Bovine  19866881239197
gccttggaaagggtaggtccccattgatttaaagtgaaatatagagtctacaccatatagcaataagaaatggaatacaagaagcccggggtctaaaccctatcctgtcaccaatgtatgatgtgacttctaggtcttaattagctcatctgtcaaatgagagattcatgttagaaaatctcaaaggtcccagtgagcactgatattctttgatccttatttctgttttatcaggactttattcattagagatcatttattgagtcttagtagtgactcaaaattacagcaaataaaagagttttctgaaaacatgagaagactgtaggggatgacatgaccgttctctgcaaatatctaaagagttttatggcaagactgctgatcacttgttctcactttcaataaaaagaacagactttggttactgcaggcaaggatgtaattagacatatggagagatttcttgattactgcagggataaaatgatgcttactttcatactcctctacaggtgagagcttgggtccccaatgagtcaatcaatgaatcaacaaatctttgctaagcctgtttgctgctcattttcctcttcatgacattttactcaaagtatggattgtgagccacctgtatcaaaatcacctggagctcgtgttaaaaatgtatattcttagactcactcctactgaatctgactctctggagctaatgtctagaatctgtgttttaataagctccccaaatgatatttctgtatatcccaaatttaagcaaacactgtttttgagtttaatagccttaaacaatactttctccctacctggtggctgttaatataaataataatcacagatactatttgttaagtgccaactgtggccaagcatcttacttatataactcataactgacacactcaccctgtgaaatagggattatcccacctaggagatgaataaaacagatactaagtgacagagtgatatgatcagaaagggacaggatcacggcttgaaccctggtctcctgaatctctttccatgactccacagctgcttccctgacatgctggcttccaggaaggacattctgtgagattcatgttctgaagccatgaccttgcttgtatctgaaagaggaaaagaggtaaagaaggtcacagagatgcaagctcatccatattcagcttggtctgttcacttcaagtttcagaaaggagattgagcaggagatgggtttctagctctgtgcaaagatcccaatgtatagtttcccagaaaattcatggatttttttttcttttctttcaaggagaatgtgggactttgtgtgtgatcttactgtgacccctacaggttactcaaagcagaataagctgacgacctctttcacagatccctgtctaaaggagaggctccagggagccactttcaatg

SEQ ID NO: 50309 - DNA, 1217 bp, Bovine  19866881294890
cacgggctaggtgtagttttccaccttgtgcctcagtgacccggggggtgaacattccatgaatatttattggttgaataaatacataagtgagcacttccaaaggttaccaaatacctttgcttttggaggctgggtaaaaagaaacatattcaagatttagaacaagataaaggtgcaaatgcaattgaagtttaaagataaattaataatagctgctgttctctgactcctagttgatcctggtatgtatttcatttgttttataaagatttgttattttttactgaactgtcaagcgacgtgataaactcagctgcaaagagaaacacatcttttctgccctcagaaagctcacagtctaactggggaggcagatacactaaaacaaagctcacaaaatatattttgacttttggagcctataccaagccaattttcttggcacacatcatttctaattttcttagcaatctacaagacaagcgtttaccccatttttacagatgaggaaactgaagtacaaggagatttgcgtagagatttgtgtaacttggtttatttaatctaggtaactctctgctcagtcatgcaaagcagtgacagaaatatgaactggtcctccttaacactgctttcgtgctatattcccttaattctcactccactctgctgtaaaacacttgaacagcactttgtacatttgccatcatttgtatgcatattacctcatttcagtctcacaaagcattctttcctatggagacaaggatactattacaatcctccatttacagagaggaaaattgagacccttaagaggctggatgacaacctcccaagtcacatattagtgcaaacgggaacaaaaaacaggtttcttggtgggggagggcatattctttgtcacttgacaaatacaacctccaaaatcatgcccctccaactccagacatgtgattccacgtgtctacaagaaacactgacatttttttctcgcggcagatccatggcactgcgctacggctggatggtggcagctttataacccctgggtgccccaacaatcccccgtttccccaagcagtgcttacattaagcttgctttcaggcgcttttccattgctcccctttccactgatgcatggaagggctctggagaccatggccagctctaggccccatttgaggacagcccattggtgcaaaccacagca

SEQ ID NO: 50310 - DNA, 646 bp, Bovine  19866881369117
tggcttgctgccccctggcagtgaggaaaatgagaggtgatggtggaaagagtaaggacgtgttgcctgggcccttgagagcagctgggctgagggcagggggccagtcccaaacctccgcagcgtctgctcctctatggaatggaggaggggactgtgaggctgtgcgtgtgtgtggtcgtttgtgagatactgtgagcgtggctgtgtgtgagcttgcgtgtgggtggttgtatgcatgtgtgagattgggtgtgtatgtgcaatcgcttgtgtgatgtgtgtgcctgtgtgtgtgcgtgtgtgtaaaggtggacagtcatgaagtttggtgccggcatgagcaacggctaaggtcatttttggctctgtggggtagggacagagaaaggagaagaaacaggagagagagagttcctagaagattcctagggttagggaaatgatttgattgaaatctctggcaaagagtcagctcccagttagactgatttaacccctgttcttctccgaccccttaatttccttcccgcccctccatctctgtgtcttactccttctctctcctctcagtctccactctccttagtgttcatcctctttcctgttacgctctgctatgctaagttgcttcagtcatagcccg

SEQ ID NO: 50311 - DNA, 820 bp, Bovine  19866881401008
cacccaagggtttatcatatactgtttatgaagccattctataaatgttcaaagactatataaaataaagcagctattactgttttatactcctctaaactgtgaccttttaggaaaggaccatttcccattttgctctgtatcttctgcattaaatacggtgccttgcacatagtaggtgctcaaggtgctcagtaaagatctgttaaatacatgaatagtgagtgggtgaatggctgagtagtaagggggaggtgtacccaaagataagatgcaggaactatactggcagctgtctgcaaatggctgataaaggtgcccaggagccagaaggtacagcaaacaggccctggaacagtttccactgcagatttcaaatattgctttcaacaaggagaggggagaggcagttaggtgtgaagacatcagggtggtctggtggaagaaagtcatattcaaagctttcttctttgtgtgctacagagctggaatcccagtatacagcccagtttgaaacgatgctgcctatcttgctttccactgatccctggtagcccgggaagcaccctgaaggtgatgtcaaaataagagccgctgttatgaaggactttccccaagctctctgagaagctctttctgggccctgggacagctgggaagaggaaggtgttgagttgtggcttaaagaatgggtggtctttcccaggcagggagcagggttggggggagggggtagaagcaaaaataaacaaggaaagaagacgaaagagacacaaagttcctttgggagggcaggtgggtgaagtttcaagagatgatg

SEQ ID NO: 50312 - DNA, 1004 bp, Bovine  19866881431134
taactcgggcggaggattcatttcccttccctgtccctcagatttctcatctgtactatgggatgactttataagtacccagctcccattccatagtcctgaacttctggaatattttattgtaggtctctttggggttcaatgtcaaggcctttaaggagtatttcaagtgataaataaagagtgtttctttttatcctgaagtggtcacattttagtgaaggcccctcggatcttactggatgaaatctcccagaataaggcacagtaataatgatcattaatattgcatgtaatcattaaagtaagtagcatcatattaccctcaactcagatgttatcttttagctgagagtcttctgatgctttcgcaaggcaaagcaggattgctatttgagctactcacgttaagcttcctggcttaacctaagggaggtgacacatggtagggaagacacactggactggctgtaaaagctgtgtcttcagcatcaggttctttgactttctaggtgtgtgaccctggaccagtgactcaacctctctgggtctccatccccttagctgggaatgtttctctggctcacatcacatggctgttgcaacaatcatctaagataatggatgtgaaaatttgttgtaaactgttaagctctctgcaaacacaaggcattgccattatagtaataaaaagcaaatggcacatgaatatttcacaagcatggactgggaccagttatttgtaaagtattcccacctaatggggttttataagtacacacaccctctccttattacagacttcctaataatctctccccaaatcttcaaactccctttgtctctccataatttcttcttaatgtccccttactttcataactatttattactgaactctgggtcccatctggggagatggctagaaaaatacatacataaatattttgtacagagacataaacacaatgaagccaggacatttcaattctaaactaagatac

SEQ ID NO: 50313 - DNA, 2713 bp, Bovine  19866881488913
gaagcctcaactctgcctctagcagagaaaatctatttcaggaaacttactggcaccaagtatgagagtatccaaatataccctctgagataacagatagatggataaaaacagagagatggagtaagacggcccagtttccaattcatcctccatatccccgtccacttgactatctttctcctgcatctcggcaaccagaaaaatctctcttcattttacaggtgcaaacgatcatcctatcatcagacacaaaagcagaaggacctctaaataccatcaagttcagaggcggtaaatacctgacccgtctgtcaccactcccatctgctgaagtcaggcctcatgagtcaatcctaacaatctttccagctgagtcagtctgtagcatcagaaatcttccaagcttaacatccaaggcagccccgcccatttgtctgagttggcacctaagaggtcttctctaatttagtccaacctctcgggcagatggatgcaccgaagcccagggaggattttcaagacaagggttggagtcgctgtttggcttatggtcccccgactcacttccatgcttgtctctctgctttatgatcctgttccctcattgtagatgactaagccagaggtcagctcctaactcaagccaggccaataagattccttctctaggattcttcaaactgcagctcaaggaagagaagcattcactgtttggtggtaagaacatgagagccttagaaactcatggttatcacaacccaaccacgggagtgggagtggggaggaatgaagccatcgcggaatgatgcagagaggaaagacagaattctaatgccacataattcactcaacttccttcatccctccggccaagctgatctttcacccttcccatggcagccttccaacacagttgccattaagctaatttgaattaggtttctttctcctggagccaaaaacatctgactaataaagagcagaaaggatttccacgcagcatgggggcggggggcaacacggtggcatgctggatagagtaaaggtcttgagatcagaagctttgtgttcaaattccagctcattctcttaccagtggttctacttaagatcttagaacatcagcttcttaatctgtaaaacggtggaagaggggaataaaaatagccttgactttagaagatgactgtaaggatcacatataagatgctatataaaagcctctgcccagtcaagcgagaccaaaacgctgcctatgcctgtcttcagtgtggaatcaggactgaaacccaggcgtcttgactctcagcccagggagcttgccaaaaaaaaaaaaaaaaaatcatatttttatatgtctttctcccttctctctctctttccccactgaaagatctgcggtcccattttaacactagaagtcccatttgaaaagtgtttaacttctaatgcagatataacaagtcgtttctcagtttcactgtatctgcaaagccttctataattcaacatcaaatatttattattacatttattaaacttttaataatttagcatctcctgcatgtaagagagaagcttagctaactggttcccctttatccaacctgggtcacttcaatatttatattccaaagtctccatttgagtttcatttagcagaggctgcgccgcgggccgtccaccccagctgacagtcgatgtctgctacagcctccccagtggcaaagactaacagaaatccggtgccggatggtgtttgaggagatttaccgaggctgggcagaaacacatcctaatagacttcacttttattatgattgctaaactaaaatgggggaaaatatacgactctgggctcactggctgagtgacagccagcgaggctgggaagagatgcgggtagagcgcagatccatttgttgcggagtgcaaagctctttatgttaatgcttctcagaggagcttcacatgcctaaagacgggtagggaggtggtggtacagggcaaattccaacatccaaatcccatctgtgagtgctaaacagatgccctattgcccccaaagtctcccctgaccccgtttcatatttcaccttccacttgaatggaacagacttccacacgcactcagtggattcagtggtcagcaaagatgaggacagacggtccaatgcatggatccctcagtctcacagagaaccccctgcaccagcagcctgggggtgcacaagcctgatgcagacccaaaatccacgcttctggcagttgccctgagtgtgtctgtgctgtcgtgtccagctctttgtgactcatggctcctctgtccatgagatttcccaggcaagaatactggagtagcttgccacttcctcctccaggggatattagccaacatttactgagcactcaccctacaacttgagttcaaattctgattctgccacacactgcctgtaacctgttgggtaaatgatttaaacttctggtgcctcagtttcctcctctatgcatggtatagtaactccatcattgagtcattgtggagaaatcagaacgaacccacctaaagtttagacagggcctgatccaaaataaacgcttaatacatgtgagccatgattatttatgactgtggtgctaagagtttaagtgtgttatcttattcaaccggcaaaaacatccaaagatacaatagcaattatcattc

SEQ ID NO: 50314 - DNA, 1439 bp, Bovine  19866881523725
aaacagctaccaaggattagtgggatttgggaagttttcaggtaggtcctgatagactcttacacagaattatcacaggtagagctgaggttctgagcattaccaagagaattggaattatgctcctgggtgcatgcaggcacgtcccctttggctatgccaatcagagaaggatgaattgaagttacctttgctttattattttctccatttcaaaaatcacacctattatgggtctgtagaacctaatgggaccctggagattggaatcaatacctaatctatgattaagcaggtctttaatgcctaacccaaattctgactattctagctacactctttaattttgctttttaagtctgaaaaatcaacaaatgttgtttccctggcattgctgcaaggatttccttctaataaggtccttccagaagtctgagtgtataacctctgggatgaactgaacacctgaatggcagtaagaagacacagactgtactaacaaatccatcatgtaactgtgtgatctggacaagtcacttccccttctgggccctcgtttcctagatctgaaaaaggagagttactgacatatgtaaacttgcaagaccttttaacgctgaatgtttaggatattacggatgatcctatcatagatccacttagagtaaagtcagtgttatgtgaggatctatcatgttaggtgtttaagaagacttctattaatagctcgcctaaaagtcaagatatgcctgttagtttctgcacaaacagtatcacttttaagaatctgcagagggacagtaagggtcaggcagattaggtaatacacacacacacagagcaagtcaggggcaacgccaggtccaagccctggggacagtacatgtgtggggtcaaggctatacctcctgcttgagttgtcacattataaatacccccatcctagaattagaagctctccttctgggcatgacaagctggatgagaaattccatttcctttcccatcatttgaatgagaaaggggccaacattaaaatgggggcaattgtctttacgtcaccctgggcaccacttctaatcacaaacttgcagaccaacggcctcctgtggcactgatatggtgtgtggaaattatcatgtaatttacgacaggcagtgcctgaaagtgacttttcagcatctgctctctagtagtcccaagagcaggcaaatgaagaaagctcctgtggctgctggagaaacgtaatctcctccagttgcatccaacagcctccccttaaactcctcaaacagatccctttcctccgtttccctcatcccatcatgcctctctctacccctgatactgaaactctattcacccttcaaaacttccgttcataagtcccactgtgctctaagaatctgcctatcccaactcactccccgctgccccat

SEQ ID NO: 50315 - DNA, 1298 bp, Bovine  19866881784874
agcaggcaagaacagaagactccaaatctgagagggcttttcaagacttgtcaccttgcagccctctcagtgtataatgtggtacccaaggttcacaggaaatgacttgctcagtgtcatctgtcaagttggataaccagggttggatggaaagatctgtagagtggaactagattggctacttctctcttcgcttctcacagatgggacaagtgtggctcagagatgggaaggtgctagtaccatgtgctagtattcatctggcagcaaaactgacccttgagcagaaatctcttgatgtggttaggctcagtcatgtgttatgatgagaaagaacccatgatttgtttaagtgaaggttatcttgggtttcacttttgtctttgaatcaccagttcattccagtacttccttgatgagccatgccactctgtccccagacttcccaagataccttgagttctgggtgaaactagactctgtgatccatcccttctcttgcaacccagcctggtcctgcgtgaccacactgtctcctcaccttccaaggaccacccttgtaacttagtccagccctgctcaggggcccaattttaccacccagatgtgggctcctctctgaatattcccaggcatccttcaatccttgaagctggcggttgaagctgggtcccagacactgaggagaccaggttcttggctgtcgacggtagataagcggagacttaaatggtgattttctggcctgtgatcccctgtttgtggatttcatcttttaatggaagtgcagtaaataaaagccgttttcacaatacgccaagcaacaggtcagaaacatctgagcctctggaattgatagaagggagctaagcgtaacaaatctccccaaattgcacccggctccacttgtatcagctcccagactgcatcccccaattattgtgcaaggcaattatttctgagctggagctttcggagaataccacgtgtggatggtaggtatactttcattgcttctcgccagatagaatttttcaccccattttttggctagtgtctgagctctgattgaatcttatccctactctccttcagcattttcttccccaccttagaggctgaagtcactcttcaagacttgttcaaatggcacctccctccatgcagtcaccctcctcctctccccagtgtttcagttcaaagcaatagtgttaggtcgagggtaaatttacatacagtgaaatgtttcactctcagtgtacatttcaatgagttttgacaaaggtctacatccatgt

SEQ ID NO: 50316 - DNA, 1332 bp, Bovine  19866881886816
tacttctgaagaagtaactgaagggattcattctgtaataaaatgaagtatgacctatgttttagagcttatagctatcctgcaaatgaaatgagtgcatgagtgaacagatatttctttctaaataaaattttgtactgaaggggctttttcccttcatgcctccttctagactttttctgtatacctgtgcatctcaggatactgacagatttctaggtctgcaaatcattcagcatgataacgagcttcaggccagtttcttgtactgtatactggtatctttttcctttagtatcagatattgctttaaataaaagtattctccgctgaagcttaaaaccttgatttcaatcatatttaacctttaaaaaaaataaataataagtcaaaaatagggctggaagcagcttagaatcagttaattttcccagagctggtctgcacccacacctgggttgaatttcaggtttgcccttatcttctcatctgccttccacctttgcactgtattctgagtcagtattgagaacttaaaaccacacgtcttttactccgctttctgatagcatcatgttgttactctttttcttagtcacattcagctttgtaacttcatgtttgtttctttgaatgtctgcgtccctactctgtggggagtctgccttaccacagctggatccagcccaccacctgcttttgtggagcccctgtgctaagaatagtttggttgtttttttttttttgaatgcttgaaaaaaattcaaaaggcaaataataattcatgacatttgaaaattatatgaaattcaaaattcagtgtccataaatgaagttttattgttacacagcctctgtggctcttttgtgctaggcagacttgaatacttgcaacagagaccatatgaactgcagaggttaaaatatttacttcctggccctttacagaaaaagttggctgacccttgggttagacagtaagcttcatgaggacggccactggttcataagtgctgttgcactaatcccaaacctggtagcattcagtaaatgtttgctgagttactgaatagtggagtaaataaatttagggattctggctgcactgtacagggttctagcctgtgttgtccaccctcatctgagttctgagatttaggatctctgtgtatatggtagggcttcccaggtggcgctagtagtaaagaacccacctgccaatgcaggagacgtaagagatgcagggtcagtccctcgattgggaaggtctgctggagaaggaaatggtacccactccagtactcttgccggagaattccagggacataagag

SEQ ID NO: 50317 - DNA, 650 bp, Bovine  19866881889490
ctcctatttaagccacatctggaaagcaagccccagaagccctcagcccctggtcgcacctagcgttaagtttccatcagtagtctttccctcccctagctagagttctagttctgccaccgtcatttactggctgtacaattgtctttcctccccctggcccttaaatccacagccctgagacagcctccttggtttaaacatctttctccaggccctattaggttgagcaagagtgtgtggcatcccctgccgttggctcccaatggggcgaaagtgtcctgaacttgcactaacatctcttgcttcctcctgagccttcgacagctcagcgccggagggggaatgagtcattttgttaaaaataaaaacacgaccgtcttccctctaatggctttgttcatgatcactgcaggctggcgctgacatgcattccaagcagccaggcacagccagtgggcagcccggaacctggtctgcctggaaccactgttgctgcttggctgaatctcaggggtccagccagccccaccttgaccaggctgtgggcgatgtgggtgcatggatgacattagcacgagctgggcgggatggcgacgttccagaacatttagttaggggacagagggtaagattcacagcctacaaag

SEQ ID NO: 50318 - DNA, 3601 bp, Bovine  19866880562118
gtgttgttgttgcaagtcgctcgtctgtctgactctttgtgaccccatggactgcagcacaccaggcttccctgtccttcaccatctcccagagcttgctcaaactcatgtccgttgagccagtgatgccacccacctatctcatcctctgttgtccccttctcctcctgtcttcaatctttcccagcatcaaggtcttttccaatgagcctgctctttgcatcaggtggccaaagtattggagcttcatctccagcatcagtccttccaatgaatgttcagggttgatttcctttaggattgactggtttcatctcctgggtgtctgggtatgttcttaaatagatattcctgagggagaatgattgccttcaagagaggaactaaattattctcatttgaatgagaggggtgttatagatcacagaacatagaggacttcccaggtaaggtgccatactgaatctatcttggagaatgaatagatattctcaaattaaacaaagtaaggagaaaggaagtggcaaaaggaagcacaccaatagcccagagctcagaaatagtatagagtgtcctggcagctgcagacacagttctttgtggctgacagctaggatgcaggggttggaggaacaggagctatagtgagagagtgagctgggggctaaatccaaaaggaagactggccctcgcaaccatgagtgattggctttacgaagaccacgcctcagccagcactcacgagccttttggaaagggaaccaccatttgcaccctgggatccgtgccggttcttcatgctggcagagtcccagggctgattctggtttgtgtctactgcctgatttgggtgtagccttctttgtaacagattttcccagctccttatcacagctcttgctcttgttatggcaacgcacgaacatctcagtggggtgggacatgcctccagattagttatctctgctccatttctcagtgttgtttcagttggctggacagggtgaagaggatgggaatgctactgagtatcactgaaccttctttccctctcactgagccgtcatgagcaaacattagcctgctgtaagctgaggtctaaggcttgtgtttgactcctcgtgatcctggatgcccaggaaaaatcaactggctgtccatcagagcagatgacaaggtcatgcgctgtaatgcctgattatgggctttgagagtcaggcagacctggggttcatatcctgcctctgccacttcctagctgtgttttcacaaagtaacttatttggtctttaagtttcctcatttgtaaaatgaggaccattatacctaccttctaggcttactttgtagatttaacagtgcagacccttaaagcaccttgacagtagttttgtgtaaaaacataatagcaatcaacattactaaatacctggagagtttcagattaggtaacagctgctttttctcacctaaatttctctaaagctttccctctagcaccttttctctcagtccggcagagtctgtgtatgtggattttcagccctcagagcccttatggcaccagggacccccatggcctcttttatagagggagagtgcttctttttctttctctgtgttctcagccccagtcacacggcagggcccacggtgagttatgtgcgtggatttatgagtagaataaataaaagaataagtgaaggagtcaatgaatgaatgagcacacacctctgattgctcctcatgtttacatgcacccaaaggatatgcaggtaaaatttttctgggcactggaggaccctagagaccacagagagttataatctactgctcttctgacgctgagactctttccagtattccaaccgtgcttgtctgtgttaggggatggagggctcagtgccacaaggtcatgcttttcactttggggaaactatgactgtaagagaggcctttcttctgttactacgcctgcatctgtcttctgctgcaatgtgaggtgacaggtgtatagacttagcacctctaggctacagatggccagacaggcaaagccaccgtgtgtgtgcatgtgtttaggggacgtcccatatgatgggacccgcaaggcccaaaaaactgtgtttactttgtgatagcagtcagagctgagcagacctagaaaagtagttcatgctaaccaagtttacaggatatcagtatggggtcataatttgttcattcaactgtagaaccttctttttacattgccagagtacatctatgtgctattccaggcatgtgggaagtcggctagaacctcagaagttcgcttactgtggtgactctgatatcatgagaggtggatgagatgacatccaccacatcagagggtaccctctcagaggatgggatgaggagcatcctccaggccaaattctctttcatgaaagagattcgctatataaatggcctttagcctcccttttctgctctggtatagaccacgttatctctgttgcaggacatggaagttttttatattcagtgcatgctcagtcgctaagtcatgtctgactattttgtgacccccatggactgtagcccaccaggctcctctatccgtgggacttcccagatgggaatataggagtgggttgctattttcttcctccagggggtcttcctgacccagatatcaaacctgcatctcctgcattggaaggtggattctttaccactgagccccctgggaagcccttcattgcaacatagaataaaccaggtcaatgttttctgccccttttcattgtcattgattgagttaagcagctgtttccagtgatcggctgtccctgtagctggtattaaggtttgggtacgccaacacagtagcgtcattctcagatacaccctggtcatcatgataaactcataccttcccacattcccatagccctcccatttcctgactttttgtgggttgagcatgtttacatgtgcatgatatcattcattatttgaggatcttatcagggtaactgtcagagagagaggcaggagcgataggttagtttcctcaaccttccttctggcccccttctccattttgacttcatctagtgtagacagattttccagtctctgcccaatgaagcactgtcctgcccaatgaaatccttcacacttcctgcttcctctcctctgaactacatagattggtgtggccctatacccattagtgaatcaaatccatagaactggaatccatgttgtgacctggagtgttccaggctcattcctctgcctttgggaacttcttggcctttcagctataattcagcctcttgaaggtctgaggtcctgtcttaccagctgctggagttgtcatcctgtgtgacctgaccccaaactctgagagagtaacatggcaaggatttcttttgtatggttactagtggaagagctagatcaggaaatacaatggcttaccaactttgtcaaagcaaatggaaagactcaatagataattttattccaacaaacctgggcgtaccaaagaggagagttgtcttttcatcctaaagtcctgcaacttttaaggtagtttaaaaggcag

SEQ ID NO: 50319 - DNA, 950 bp, Bovine  19866880581009
cccgatttgacctcatcacagcctcataagacgggcagttcttacaccttttgttccattttacagaaaaacgaaagcttgaggctcagagagaaagaagactcattgcccctgaggccacttcctcagttctctctatgaagccctgggctgaatatttccacggccgggaaaatgcctggcctcgagaagcacgtctgctcaccccaacttccagcttatcctgggccggctttgctgaagaaatagcatggcgtgcatatgtgaaggggcctggaaggcatgccttccgggaaacggcatttcttgtgacgtagccgccatgcacggcacacaattatttatagtgctcaactttatcttccaggctgtgggtttcctctctcaccttttaaactctcaaatacgaagcctacttgaccactaatacactgtgatggcttcagagtaagtccccacaaatggaagctgctctttaattattcagaaatatgacaaaacccatcatcaatccccaggtctgagtcacagggggaccccggcagcagttcaagcattactcccaaaccgcagccactcagacaagaataacagcagatgcttgggcctccccaacaactcacccagcaataaacccatccttggggctctgtccctttggctgttgcatgccgggatgacaagggttttcaattggtgctgtgaggaaaggaaacctcccctcacaatacatacacactcacacattcacacacatgctcacagtgtcaatcaatctaagaggcagactaagaatgaaagatccttaagttaccattcagacaccgctatgcaatcagaaagacaaacctgtttgcctcattgctttcaaccaatcactggaagttgcacagtgatgtctagataccttgtgcatctccttactatatctttatccattccctttgttt

SEQ ID NO: 50320 - DNA, 1833 bp, Bovine  19866880735748
aatttccttttgcccatctcacccactgtactaaagaaaccaaaattgaactttgttcctgcctcccatgaaagaacctaataacccacaccaccctcgcgaatccatggaatcttttaaaaaatcagtccccaaattggactgttcctgtgtgtatatattaagtagacatttgggaacatctggataaagaatgactttccttattttttatccatatggctgtgcctctcagatacaacctagctgactttagttgattatgaaagctaaatgggccctgtatggactcaaatcttttgtttaaaacagttcagttcagtctcagtccatcaagtgctttatctaaaataagaccatggtgtcatagatttacataacaatgctttatattttgatggggagtagaattcatttcacatccctgactcagactttccgttttgattgaaagaaagcaagtttttttctgtgtgtatatgtgtgaatatgtttatgtatatatgtatttgtgtgtgagcatatatttatgtacgtgaatgtatatgtgtgtctacatatcatgcacacgtgtgtgtatatagataatttcatgtatcagtgagaaaaaatatgtggctgacataaagccatatatatgctgtgaaagtaaaaaagaaaatttaacatattggccaatctgcatagaacacacatacacaaatgcagcccatcttggaaggcaaaaaaaaaaaaggtactttcctgcctctaatggcttgataatagccattatcggcaacaatgcaaatgaaaagaaaataaaaagaggcatttttatgcactgcccattaaaagcagcatacacataaactcatgaacttggaaaataaataagcagactggttgctaaacaaaagcttggtttcatttccagtgctatcgatggatagtttgttgttaaaaagatagagctgtttaagctgtcccaagggaaagacttaaagtgggataaaaaagaatccagtggagtatgcagacctgggccaattgtaaataattgccattccaccatgagtccaaagagattgtgttgagacacggcccatcaaccacagcgagcagggctttcctttgggacaggatccaccaggttgcccgtggagccccatggggacagcccttggacaacgacggaggcgtctctgcctccgctctgtgataacacggttcttaaagccccacctgtctgtttttcttgctagtttgtcatgtgtcctcatatatctttagaatattgtctgttaattccggaatggaactcaagaggtcattaggtccggctgcctgccttaacctctctcatcaatttacctccataagttacttcaatatcaatccataaaagggtactaactttatttctcggtgcattaactcattaaatgaggtatgcatatggagtgtataatagtggctggcacataatacctgctcagtttatgaccagtttcattgtttctgtatttactattttttgaaaggcagttgatataaaagaaactttatcaagttcagaattagacagaattatgttcaaatcatcatcgcatggtcttagttaaggatttagcatccatgggccttagtaccctcatttagaaaacatggttgatgattcttggtatgttttttgactcttatgagaagtaagtgaggaaatacttgcagtgagggacatagtaaattctcggtaaggatcaggtaccattatcaacacctctagtgataccatttacatctcagtggaggacagtcacttctattactgaaactgccgacatcaatgggatg

SEQ ID NO: 50321 - DNA, 1113 bp, Bovine  19866880803624
caggaaagggtgagcagcctgctgtgcttggctgtggtttatggggagggaggttaagccaagaggcgccaggcactacttcaattacactttgcctgttccgagggctttaatcatgacccctttctcaatggatcctttcagaaaggccaggggggaaataggcaattggaaatactggtagtaatcagggtgccagacctccaactctactgagaaacatagctgggacataagattcattaaaggcaaaaagaaaactaagagagactagccattcctgaaggatctacgtctgtcggggacagggtggagggtttcttggagatcataaacaataagtggaaagagtaggtgacaataattagtttctggttttaattaggaggtctctgaggccagatgttcactgagaaagaatgaagacccctcctgagatatgtaatgaaacttagaccccatggctggggaagtgggtggaggcgctgggtttggaagcattaagggctccataggtttttggcctgaagcatcctgtgaatggggggagggaggctcaggcatttgtattctctcctgagcagtctgttcagcccagtcgagcacgcctgcttctgattaacataaggaggagagcccggagacctgactccctgcctgggctgtctgtgtcaggaatctggacctctgtgtgctgtctgggtctcactgtcatgagaaaacaatgggtggaggcatcgcacgagtcttccttggttggcatttctcaccaccaggctcctgtcccaagaagggtgggatacatggctagctttcaccatgggaaggggggtggtgcgggagggggggctacaagtaaacttttaccagccctctcatttcccagacacattcccatcctgtaattttttgctgtcgaccagatcaattattgcaccatgagctaccagctattaaagagccaaactcctaaataaagaaacatgggagatggacatctgcccagagggatgaagaaagaaaataacagccattgtaacagtagctaaagaacatccactgggcactttctaaacagtttccattggagtatcccattaaagtcccaggaga

SEQ ID NO: 50322 - DNA, 2534 bp, Bovine  19866880860417
atgggaaaagatcctgatgctgggaaagattgagggcaggaggagaaggggacgacagaggatgagatggttggatggcatcactgactcaatggacatgagtttgagcaaactccaggagatgatgaaggacagggaagcctggcatgctgcagtccatgagattgtaaagactcagacacgacttagcaactaaacaatgatgctttccttgccttctcatgctccatctgaagatttgaagtcctgaatttctcaggtctgtcataaatttctagagtaaaaactagatttattaaattgggcacatttgtttcaaacctattcaatccagataacaactcattttagcatgatttttccacttaataagaacactttttccaactcgatttggcagctcttaataatcgcagacagaataactagagatgcaagatattaaaaagtagattgttgaaagaaggaacagcagtgcatgagttgaatagcagaatgtacccagcaatatgtcaaacacataatagaaggcgatttcataggatttaagaatctaataagttcctagaaagacaaatcttagatgtcgagctgaataaataaatgaaaaattaaatccacacaagagacaatgtatggtgaaattttaattcattaatggaaattccaaaaacttctggagtgaagtacggtgggctgggtgggccgattacctgcagaaggatgtgaatcgggttgacatcagacttctcagcagcaacaatggatgcagcaggtaatggatcaatattcccaaatgtcgtggagacaattaactttgaatctggattgctagatccagtcaagtttaattcaagcttaagggtaaaatccagagattttctgatatgcagaggtttggaaaatttgccacatgcaagatcccttgaaaagaattaactagcaacgaagaaaaaatccagaagagaagaagtaggataaaagaaacaacagttgaacaaatacatcaggaaaaaccttatttgggggtttaaaaaattaatttcctaactggaatacttcagctgatttcaaatgcagtgtgcttgggttgcataaaggaggcagatggaatttaaagcctgctgaaattcttgtaacatagagaacgtagatgctgattatctctaaaattgttctgaataatccatgttcaagtatgtttatcagaagtataaagtaccaattatagaaatagatctggagtacagtccccaggccactaactattctggttaggggaaacagatcaaaagaacctcaactggttcaagagaagtcagagaagaaacaaagaattagaaaataactggaaagaatggcaaatagagaatgaattaactccttcatagtattgtaattactaattatagacttggacacttatatccaatactatgaatgagttaatgttgcttgttaaaagacaatgattctcatactgagagagaaaacccaatcttctttatgccatttgccacagggacgttaaatcacagtaataaaaaaaaaaagttcacgatgaagggatgtaaatatgtccacagatcagagtgcatttagatcaggggccaaaatgaggaccacatacagattgtggaggctcttcagggagtatcagaaacttgaaatctctcctgaagggaaatgagaagaaatgtaaagaatggcatgacttaataagatttgctaggcccatcaggaaagtttttgaggcaggtcaagcttgtggtggggaacatgcagtagatattcaagaaattcatgcatggagcagtaaagagctggaccgtgtcacagcagtggagaaaagatggtcagtattgttgatttcaaggagacagactcagtaagacttggagatgaggggaagagaattgcaagttggtgcacaggtttctgaagtgcaagccctggggggcatcttcaccaagatgggaacacacggggaagaagatacagggaaggagatgatgaacttgtgccttggtgtactggggtgttgagcgacagttgattctcaagattcagattttgattggctatgcagatcgtagagccactgtcttaccaggggaaggagtcatcattaatttataatcggagcttgtactacagagccggacttgcttctaagaggtaatattctttagatccatcgtctgaaaagctgtaactctgacacgaggcctgactctttccttttacattcagtggagagaaaaaaaggaatgaaaataatcacgtcttcctcaacccaattaggaaagctaaagatttgatgaagcaaagatcatctcagtcactgaattcccaaggctgtgcagcaatgggaatggtgtaggtgagaaggggaaggatgggactgttcttgatgccttctggcatgaaatgaagcactaacagcaaaacatttaggaaaattaagaagccccttgttgctctctgaggaaaagcaaccccttgggtgaaatggttgctaattatccttctat

SEQ ID NO: 50323 - DNA, 1166 bp, Bovine  19866881129724
ctttcagagcctcattccacactcttctcctgcatcctgcctttccaaatcaccagcaggaagtgaatttcctcttctctatacaactcagaatcctaattggaatgtgctactccatgtcatcctgaacacacacatatcaccactttcaagagattataagcaacttggaggtgataattgcttaattcatttctgccctttccccctcggtgctggctaaagcaccttccacatagtaggtatcctgtaattactggtttcaatgcctgtctgaatgaatgaatatatatcatgggtaagtgggaaacagacttctgcattcatttttcaaacataagcaaagggacaatcacatagatttttaagctcatatgtattccaaggattgagtctagaaaaaattactaatcagggttcttttctcttttcctttgtagaccatactctaattttttttttcaaaccggaagagagaatgaagataagacagtgattctggttgagtttggataattatatttttcacactgcttagcagttaagattgacaactactgattatctaagacactatgtatttttcaaaataattcacaaaacaagagtaataattggatataattgcaaaaccaatggacagtttcagcacactcctgaatttacagacctcagtttccccaaccataaaataaaaggtatggaattgatcggtgtttctcagtgtttgtttcctcaagacatacaacataattcatacagggttcattcattcacgaggtcaagccctcatctcccgcattgtaggcagacgctttactgtctgagctactagggaagcccaaatatacagtgagcatctactacggtaaaccgaaaccatgttgagtaaaggagatatgcattcgtcaacagtcatatatataaatgtctgcaccactgccatgcctggggggtaaaagtattttaactgagtgcagtgtggaagtttgagacagtcatagaggtcagaaataaataagaaaatggaaaaagctcctcctggagtatgggtacatgttagggattttcagagaaacaatgaataaaagagatatatttaaaggaattgactcgcaagattgtaagggctgatgattctgaaatctgtagggcaggctgatagg

SEQ ID NO: 50324 - DNA, 1341 bp, Bovine  19866881152384
ggaagaagagtgcaggtttttgaagtccccactgggaggcaaatacagaaaatgagatggcaacatcccttcttcctttctttgttgtaaaatttccctgccttaaactctttcttgtgcccttcaagaaaatcgttgtgctattggacaagtctttctccacacccaggccacatcatagatcttcttagactgcgagtattattcatcagcatgagctacgtttttaatatttccaggttcacacacataaaactttaaaattatataggtctatagatttctcttattactttttatattcaaatccattaatatgaaaaatttcaaagccattttagattggaagtaattcagccagatacgatttgaatatgaagtctgattttagctggtttagaaatagtgagagggtgttgcatatggctgcccctatttcaagagcctggctaagctcaaaaccataaagttcaccttccatagaactgcctctctctctgaatccaaagtgctcgcataggccagagctaggcatgagggacaaagctttcctgacctttccccaaataaccttgcaacacacatacacacacacacacacacactcacactcacacacatagaggaatgaataaaagaaaagaaaagaacaacaagctaaaaataatctctggaagtgaaatttctaatttttaaaaggaagaacttgggaagcatttttcacaggccttaaacatgtccaaatctgtatacctagttattctatttatagaaattaattccactaacttactggagatattccaaaaagagagggggaaaaaaaagactatgttcaaacatctcactgtaatgatatttatagcattaaaagttagaaaaaaatccagcatcagtggagtaggagtgattacaaaattcaacatacgtccattaacggatgcttaaagacaacagcttcactaactagcacagaggtgtcatgagcgagcaatttctcattcagtttaatagtcattaatattatattaatattgttttggcagggaagggcattttaatttaaataatttgcttctggaagcaaaagtggaagtgcatccacagaacagaaatttagattctttaattgtattaccggagaaggcaatggcaccccgctccagtactctcgcctggaaaatcccatggacggagcagcctttgaggagatcattttattgtttctcaatggcttcaacttggcatgaggagaggagtatgaatattccttaatcacttcttgtccacaatttcttacaaatgttttgggataaagtcatcataaaacatgtcaaaata

SEQ ID NO: 50325 - DNA, 751 bp, Bovine  19866881168045
agtttaaggagtttatgttttaagagagactgtaaaaataacctagattgtgatactgccatttttaattttatctcagttctgatgaatgtttctctttaaaatgcttgccttcgtaaagaatactgataaccaccccccaaaacagattcccccaacttcctgcatttctaatcctttgatttgggttcttaataaataccaatggtaaaacaaatagtgaatgatggttttgaggttttggggatgttattttcatctacttttgggtttcatagatttaatacatattgctgctgctgttgttcagtcgctaagtcaagtccaactctttgggaccccatggacgacagcacaccaggtttccctgcccttcactatctcctggggcttgctcagattcatgtccattgtgttggtgatgctatccaattctttactttcaatatgtgctttatttatttcaagaattcaagtcatttcaattccatgagcatttatagaatgtctactgtattccaggctctgtgttaggggctcgtggttctgaaacatgaaacagagtgcctaactttaagtagttctaagtctgagcccgcgatttcaaggagtaagatctcaggaatgatggcaataaaggaagggtgtttacataaggggtaaagtttagactgactctgttggggaaggtggctggcaaaattgacttcaaaatgtggtgactttttgagctgggctttgaaggctgaat

SEQ ID NO: 50326 - DNA, 1759 bp, Bovine  19866881186773
ctcctgatgtggtcaggggagagataacagcatgtctgaatattctgtaaatcaccagagtcatctatttttgtctctctctagagaaaggagaaagttcagtcagtcttctggttttgaccataaatcattaaaaatttctctccaaagaatgttgttctaattgtcctacagaatcctcccaagtgtcctctaaagttacacactgtaggaaaactggatgcggggcttcttagggtctgtgtgtgtcgaagaaagtctagatgctacaacgcttttttcctccaccaacttcacatttccctgtctgtgcccaagcctgtcctccgcagagctgctgatgacctgagtttgagaggcctatgtttgggaatctcctgaatggccagttgacttagctactgtctggagcccagtagagacctgattctccacctggcttgtgtctcagatagagggccaggctgccttcaacacaagtgtttctgtgctttgtcttgcctgctcaacatgcagagctgatgtgcagggaggcccctcctcttcctcctccatctcctctcccaccaccagcacactcctactatcatgcaatggagctcgagactggagtggtgattagagcagttaaccttcatctcttaatactgaattgaagaaagggagaaaaaaagacagcagagcatcctctgatttctctcctaaccaggggttgtgtatcacaccagcagagagaatgcccaattgatggctctgccagcctgattaagccttttttatcttctctaagactgcagaggagcaaaggccacctcagccatcactgctctgaaccagaatctagcagtagagtcccattcccttttatccttcgagctctagagtcattccctggggctcacctagcatagcttcttgaattttacagttgggaaagttaataaacaaagaacacattcattcattcatccaaaaatctgtacacagcaccctttctttgtatcgtaggctttgtgctaagttagggaatcagagaaacatgagtcaagtctttgctgctgaggaggctctctgtctggtaaacaagggaattaaccagagcctggggagagctctaaccttgcaaggtactgatagctcatagggagagagtccagagcggcctggccctgggcccaaggctcttagagaggctgaatcaaaagttctatctctcttacaaagtattttttccaaaagcatctaacttggtcagccttggagttgaacacaatgttttctccctaccttgtgtttttcaaggcaagagtatttcaattactaccgtattaggcagataaatgtatattttagtgctttagtttggatccaggaaaagatactgcaactagttaccatattaagtgctgacgatgtgctgggaaatattggactctcctctcttggttctcagttacatatggtgtctgatgagttatgtaccagcaggcatagtacaacttagaacacactgtcactggagatgtaacagtagtgagggatggcttagtggaagacagaacctttgcctcagtcctggaagagtgggcacagtgttgacagagggctgtgtgctgcagaatgtcctgccgcgtatcatcctggataagctattcgccctgtggccactgagtttcctcaactataaagaaagaggttaattaataagacctacctacctacctcatgctgtgccaaataaagctttaatgcaaaccca

SEQ ID NO: 50327 - DNA, 1806 bp, Bovine  19866881188351
atgcatgatatagttaacttctccaaaatagttcaaagttttaaaaatgaatcatgtttccaacagtcatcaacggcaggccaatttgcctggcattaagtgatttcctagatgcagaatttaccaaatgatttctctttgttccatcgtttattcctgacagcatctaagaatcacaaaggaactaagcatttctggaggaacacacaacaccagtaagcatggttgtcatttgtcaagcccctttatgtgcccggcactctgttcaggctatatacacactactgtacttgactatcacggcaacactatgaagtaggggttactatcacaagtttttttttttttttaagtatctatttgttttttcagctgcgttgggttttagttgcggcatgcgggatctttctttgcagttcactggctcctttctagttgtagcacacaggcttgtctgctgtgggacatgtgggatcttagttccctgaccggagatcaaacatgtgtcccctgcattggaagatagattttcaaccactggaccacagggaagtccctatctcaagcctacttaatgaggataataaggctcaggaaggttaggtaatgttcctaaggcttccctgcatgccaatgcaggagatgtgggttcgatccctgggttgggaagattccctggagaagggcatagctacccacttgagtatttttgcctacagaatcccagggacagaggaacctggcgggctacagtccatggggtcacaaagagttggacacaactgagtgactgaacaacaccagcattttcaggttctgggcagctagccgcggggtcagtctgagcagacagccttccattctgggagggccaccactaaggaaacactcccatattccaggccagaggagggggcgtgatggcacctgttggctcttcatccatgtgaagcacatctcagaacagcttaatacagccattttacagagcagcaaagtgaggattagacgtagcaatgcattctgcatggtttctcctgagtctgagattctgaacctgcctgcctgcctccaaaaccagtcttctcttcccagcggtgttcttgcctctctgtttccatttagtgcacagggtccttttggtgtcccaagccagtgcagagtggctttcctctggcaagctgggcgtaaacgctgcagagctcattttcactctctgggaggagtcctttcttggatctcagatgcacggttccaccgcaaagctggatccatgtacgagggaggcagtaacgcttctggggggtggtggggagttcgttggttagatgccagctggctcagaggatcgtctcttttcccttttctggagtaagtgatgttgcgtctggccatacttgcctgctctggtgcccaattccatagccatttcaagtctttcctctccccaaaatgagcatttactctcccatggatcactcctgtgatatttctaaccatgtagctccagcttaaaaaacaaatcaggagtggcattctgtattttcagctatagctcataatttggtgtaaagcctgtcattgtctaagaaacatatccctgtgcagggaacccattggacaccagaatgaaattgactaaataaaagcagtttcatggaacaatttgcaaatatcactgcttcttgccaagcctttttggcaaaactgtcttcaatgactcgagagcttttccagccagaaagagatttgggttaccttatgcttccctctctcatttttctatataaatactttcattaaagc

SEQ ID NO: 50328 - DNA, 983 bp, Bovine  19866881334668
acatcactttgccaacaaaagtctgtatagtcaatgctgtggtctttccagtgatcgtgtatggttgtgagagctggaccgtaaagaaggcagagcaccaaagaactgacgcttttgaactgtggtgttggagaagactctcgagagtctcttggacagcaaggagatcaaaccagtcaatcttaaaggaaagcaacactgaatactcactgagtggacagatgctgaagctgaagctccaatactttggccacctgatacaaaaagctgactcattggaaaaaccctgatgttgggaaagattgaggacagaaggagaagaagatgacagaggatgagatggttggatggcatcaccgatgtaatggacatgaacttgagcaaactccacgagatgctgagggacagggaagactggtgtgctgctgtccatagggtcatgaagagtaggacacgacttggcaactgaacaacacaacatgtcgtagactatatctcgggtgggcaaatattttctataaaggaccagagggtaaatattttaggcttttcaggccattcagttcctgtagcaactactcaactttaccactgtagtgcaaaagtagccatgggcaatacttaaacgatgagtgtgtctgtgttttaataaaactttatttataaaaacaggcctgtgagatttggttcatgggctatagtctacagaccctggactagaaaaaagggaaaaaaagaaaaccctacatcacagaggtgagatgtgtttgggtaaagagaaaccctagactggccctgctggtgaaaagaacaaacagaaattgaaacactcccagtttacttcagccctccacatcccaccctcttcctaccatgggactggagctcatcctctcctcttgcagaatcagcaagagctagaacagactgagactatgttcatatccagcggaggccacacgggcagaatatgcatgtccctt

SEQ ID NO: 50329 - DNA, 1112 bp, Bovine  19866881409981
atgaaggggatgctgtggaagcagggagcacctgcgggtaccaccaggcattccacatgaatgaggaggaggcaggcatctcctgaggtttgtgtttcctgcttctccaggcacaatcaaggcctggcaccgacccagaaggagggcagatttaggatatgaatgcctccttgtagtttgttgaaactagcttgtattgtcttgcaggattcaatcgttacacactgaaacattttaggagctagtcattgaattgttggtagccagaaacagaacatgtagggatatttacaccagggaaattggcaaactctccagtaagtaggaaagacttgaaacctagcattgcctcagcacataccctctggaccagagattatcttgagaagtatttgttgtcagtgagatggctttaagcaaaggagtcccttaccaacctctgcacatgctaagagtcggacacgactgagcgacttcacttctacttttcactttcacccactggagaaggaaatggcaacccactccagtgtgcttgcctggagaatcccagggacaggggagcctggtgggctgccgtctatggggtcacaaagagtcggacacgactgaagcgacttagcaacagcagcagcagcagcagcagcacatgcctaaactttccatgtctctcaactgttgaaaacagaggaaaggaatagctcttcctccttttttctcttactccatttccttccactctggtctgcatcaccagactctgcttcccaacgaagagcagctaggttctaacatggccattttgatgagttatttctacatttttgacagattttcgcagactatgatctacctctgaagtgcaataacatcccagatggcatcttcaatgaggtatctgaatggccgttaattctgaatcaatatgattactcagagcgagctgtgtgtgtgtgtacagagcgcatctgtgggtgttcccagcagcaggcatgcgtgacttaagagcagagagctggggattctttgaggaagcagctgcagggtggggaaacagttagcaggatgggcagggtagaatgatggacatttagttatcttgtattctacag

SEQ ID NO: 50330 - DNA, 746 bp, Bovine  19866881453412
aatgccttggccttgagcttggccctgcctgctgcttataggtgatgttcacgtactgacaggtcttcctcctccaggtttacttgaggtaacaaagcttatgtagagggcaggtccagtgtacaccccacacccagacataaagatgggccactttcataagttttccttgcttggcaagtgccacgttcatgaccctagcactccccaatgactgtacacttccttcatgttttttaatgatggtgcttctgacatcccttaccctggacaattttccttgtctcttgctccgagtatcacaagcagtgggggaaaggacagccccaaagaggaggtgcccacaaaaaggaagctcttgtgccaacacctgtcaaagggagaggcaatggcctttcagtggctccccttgggctctcctggatgcaaatctgagaagcagaagactgggctgctctctgcaaaaagaatccatcacccagccattttcccaggtcccattaaaatgctgacaccattaatctgcactactttacctctcattatgcggaaatgtgctcttgatcaaaagtccccttgtgtagcagcctgattcatcaccaatagctatgggccacacatcagaaattcataatcagctgacgttatccacccaaatcattcccaggatctgaaaagctccgaacatgtccatcattgggaggaagcagccacataggatgcagtatgcaaacaggcctgatagt

SEQ ID NO: 50331 - DNA, 991 bp, Bovine  19866881539364
tgccctttgatatacccatcccgctaagtggagctcctctttcacacacaagttaggagagaagagattccagacactcaaatcacaccactcacttgccattaatttatccacatgtctcctcaccaaagggaaatgtccattactcattatgatttgcaaagctctcgccctgcctctgctcaaaacagcatctctagcatcccctcctctcaaatcctgttctcagctctacctgcccaaccacacacacacactcccaacagcaacaggaaagaaatggataaatatttccacagtgaattcttctgagtataaatattataagtttatttgcttccttccttgggattcatttttgcattttctgaatcttctatggcagacactttattttcataacacatagtagagatcacaaacaataggaagtgacgatttctttcacttgaagacaaagacactattttacttctgttttcctcacaggatccacctgaatatctcttgtaccattgcaggaatgaatgagctgaaaggcatgcacggttcattgtgtacacatgggcagagcagcctcaatttatacactaaatatatttttaaaagtataaactttaaaagttcttttttttaaattattgatttgtgttgttttatttgaaaggtactcccagtgaactatttttgttgttgttgttttgttttgttttttaatgaagaaatgctttggtgaagtaactcatcattctataatttttttttttttttgaaatcagaaagccagagtttcttaaaatgagtttctccttctgtatctatgtttataaactaatgacaggctcttaaacattcatttagcaatgaggaagttccaaggcagtgtgctatattctgcttaggaggatgcagtctaactaaatatatataaacagtgtacacactgaagagagatgaggtctgcaggaatagtaaactccagggtacagat

SEQ ID NO: 50332 - DNA, 1207 bp, Bovine  19866881620505
tggtatataataatttctagtgcctgaagaaggtctgtgtttttgagttacccaccttcctgtggctcttttataggtggtttcctttgagtcataccacgtacctgccatacctccattttttaactgaatttcagcattttcatgattttttagagtcacatcatctttgactagcagaattaaagtatacatgtatggttgacaagccattagcccaggattctggggctcgggaccctctaagaagtgggtctctaggtagagtcatgatccatcagagaggcttcaaaatcagccactccctctggctacctgatttcctctctcttgcctgataagaaacccagattcctttttatggatgtgggaaataaaatgagatgaatgagtcggagacttaaattgttataaaactattaaagagaaatctgtcttaagttatcacctgaggggccggtaaaaattggtcgtcatagaggtggatttttaaataaaggttgaacaaaattacactcagatccctaaggatgcttctaaatgatcttttaaaacagggggttatgcaggggaggtgaccttcctgcctcactgcctgcgagtgttatagcaagataccatgtgtcgagcaaggcttaaaagatctgcacatcctcaaagagtccgtgtgtccccctgggtcttctattatcttgcccagagtgatgcactactcttggaaacagggcagtcagggcttccttcaaaactgagtactcacctgaaatttcaacccttgaaaattcaggatcctttggagaatctttgacttctgcaaatatctgcatacataatggtctagagccccacctccaccatgtcgctcccttgcttagaaagctgccacgcttgccctggctttcatggtgccttgccccatcatcaacaccactcctgactctgcatgatgttctatgggactccaccatacacgggtgagtagaaacttcctcaaccatcacctcctgtgttaagagtttctaaacccagtgtaacagagataggtttttgtttcttcgtgtcctgtacccaccccgccatctactcagcacacaggtttgtaattgcctgcgactgagtctgtaagtctgcagttacctccaagacagagacagtggctcaagcagctcttccccccatgcttcgaggagggtttgatccactttag

SEQ ID NO: 50333 - DNA, 1136 bp, Bovine  19866881778257
ctcctgaacccccacaccctagagcctgtgctccacagcaagaggaagccaccacaatgagaaacctgtgcacctcaacaaagagtagaccccacttgccacaactagagaaagtctgtgggcagccccaagacccagtgcagccataaataaataaataataaataaacagattgctcgcagtccacaggaaagacccgatgaggaaagagacaagagaatgaagaaaacaattaggagactgagaattggagcccttaaagaaatacattcaaagacatgaaggcagaggtcttcattcataaacgagaggtggagcaacatgaccaagccaccttcctcaacccacaccttgcatcacccttatcagcaccaacctggctgcttttaaggccactcttgactttctctgagctaatctcaaagattgattttcttaagaagacagatgtggagtaagcttttgggtggcaccatttgcagtatttcagattcctactttctgctttccctttctcacattcctatttctctttatttatttttcttaaactgctgagtctgataaattagggctattaagagactgtttgttattccgtcctgagttactatttttagagcttaaaacactcataaatatatggatgccctgactgtaaatggatacattttagccagtgaaaaattcattttctctaatacacgtttttaaagtgtcctcctgaagttctgcacaatatctcaccatgatctttcactgttcctcccatttttatccgataaaagcagatccatcatccgtgtggttcctttttctctgcaccataaataacagctgggaaggggggcatctcccacaacactgcagcttcgggttttaaccagttttggaatttattgttcagccttcttgggatgggagccagaggtacctgcatgcccctcagttatctcatggcctctctcgttttggacaaaggcactccaagtacaagcagagtgaattttgcatctgatttcatcctgactttctggatggaaaatcagatatgaggaagtcttcatatgatggtcatacacccaaggggtcttcccaggggcctcagtggtaacaaattctcttgccaattcaa

SEQ ID NO: 50334 - DNA, 1336 bp, Bovine  19866881878767
gagagaatgatcacactaacgaaggcggtaattgcacttaccaggacttgtagagcactttgctgttttgtgagtgctttcacacatggcacccctcttatatcatcacagcaacccaatgagtaaactgggcttggggcttttgccctcacctgacaaggaggaaaccgcagtgcagcgaggtaaacggaggagcagaatctcatgcggtgcgccggcagcaagtgcatcgcccgaggccgccgcctctctcctgactagctctattatttgcattaccacccctcagagaacacggtgcaaacagacctgtctcttgccggtgtctgtgctttccaactgcccacttctattctttcctccttcctccatttagaatgaaaatttcaaaatcctgagatatgcaaagagaacagccactcataatcccaccgtcctgagatgaccactgcgtatttgcatctagtattgttttatgcccatttgcctgttattacattttctcaaaagcatacttttaaatgtctgcagtgagtttcattttatcttactttacattatccttttgttgttgggtgtttagaacgttttcgtattttctataatttaagtaacatgataaacatcattatacataaattttggggagcttaaaaaaaaaaacaaaacactgtccttgagataaatttcttgaatgaaattttagagtcagagtgtttccagatatttaagactttgggtggatgttcaaaattgccatttagaaaagttttactaattttatagcaccatgagcaataattttctgcacttactattactctttttgaacttttaaaagttcacaggcattgttttaatttttgtttctttaattaccagtttggatgattttctctttttaaatactcacttttggttggtcatttttatttcttcttttgctaatttcctgctcatgtccattcttattacaatgatcattattttgctttaggtatgcttttcttattaatatcttaggaatctttacatattaacggggctaatatttatgttgcaaataatgtttcccttaggttgaaatcataatgaggtaaacactgtgaggcatgtttttaattgatgagagaacttatagggggtaagatcctggctcaggatgaagaacacatttctagtaaggaaagaaaattatgtaaagaagggatttatggttttgtgttaatcttatttcatggagaggtaaaccaagactcagagagttccagtaatttgccccaggtcacatagcacaaaatcagaaacaagattgaacccaggtctgtcgtctcca

SEQ ID NO: 50335 - DNA, 1182 bp, Bovine  19866882021803
gagaatgcgccatgtcccagtttctatttcatcgtgcctctgagttgtattcacagtgctaacttttctacaaagaaatacttgtagaaatgctggatgcaataggaagcttttaaatgagaaaaatggagattctatatgcctacttggataccaagattctgcccaaaagttaaatttatttggaaagagtctaaactggtgtttccctgcccctgatataatctcttctccctctctccccttctttctccccatcctcctccctctccctctcatgagcctcatatgagggccacatggttaaaatgactcttgactgttgtttttgtccattgaaaacgtgaccagtatctgctgggtgtctgggaaccttacaagcttgccttctgcagcccctgtaagtggctgaattagtgtttctcaccctgtcctcagacagaatttgttatcaaagcccaaggtacagtggaggccaaggcaaccagctcagaggccaacagagccttgaggattgtagcagaagatgggcatttttttttcctctaaagaaggattttaaagattatcaagttgctccctttcagacagagaacagaaataccagaggctgtagttgtcgaaggaaagttgacaaagttgaaagttggtcaagaggttggagagaggaagctattttcagcatactgaaagggcaccatctgaatttagtcagaaaaatgaggtccttggttcaaattccagcccccttcaggggctagcaagcctgagccaatcattgactttctctggacttcagcagaaggatattccttttggtttcagggaaacctggatttactggggcactgtcactcactcaccatgtaaccctgggtgtgatgtttagccatatctctcagcatccttatctcgaagtggagattataacatccactcatttgggatggcttttgcgaggaaggctctcagctcactcctactaggtgagtgtcattcccagatactgcctgtggcgataggatggtgagaaagataatgaaatggtactttctggaaatccgactgccctcccagtgctcctgcacagtgccagggccagttctggaaggcgacatctcacagaccccagctccgtctacatgcggctcaacattttgacttggctcccttgtccagaga

SEQ ID NO: 50336 - DNA, 1119 bp, Bovine  19866880485789
tgagggaatttgcttgttggtttggacattgtttgtattcgtgtatattgataatgaaagaaaccagaaatacagatagtggcaatttcagaaatgttgaaagagaaacaaggtacagttgaagtcctgttttttaagttccagtggaagtggtagaaagctgtagtgcagccctttcatgggtgagatttagaccgcagagaggcttgtcatttgtagagtttgcgtgcacttttcctgattgactgacagcatctttccccggatttaggacatctctgggcttcaggaccatgagtttcagattcggacatccggattcccctgcccttctttaccagtttcgattgggagatgaaaaactccaggtaacatatgggtgtgtatttcccatgggtagaaagaaaggcagccaggttcagtcagactgagagaatgtgtatttgctggaaacctcatgaagtcagaatgccaactggatgtaaattagctgctagcccaacatttaaacccctgatagagtataggtcagaagagatctgagccatctttttaattagccactatgtgaggagttgctatttagagagaggcaccattctgggaaattacaaagtagtttcagttcagttcagttcagccactcagtcgtgtctgactctttgcgaccccatgaattgaagcacgccaggcttccctctccgtcaccaactcccagagttcacccagactcacgtgtagtttactaggcacgtattttgcattcactttgagattactctctcaggtgttacatcacccattcagtttggtgatgaagcccattacacactgaagaaataatgctccttccaaaagagaatgcttacccaatccaacttacaggatctgacctgccagttttgtttttggaaggacacaatttatttaacggggtcagttttttcaggaggcagtagccttgattggtcattcttttccgtccccgcacaggctccaatggctttgttttatccagcaacttttggaatcgttggacagaaaatgacaactttacagcacagatcccagggtgaccctgaggatcctcacgatgaacagtacctgctggccacgcag

SEQ ID NO: 50337 - DNA, 1302 bp, Bovine  19866880489815
accgaaaaagatggactcttgggcagatcccaggcccttggctcttattcccttgaagctgaaagtaggagtcacgtccccatgcttaatgaatctctgcagttaattctggcatcataaaataaatgatgcgtccagtgctgattagcccttgaatgagaattttaataagatgatctgtgttatgaacccagtgcactgagatgaactgagtgtgggttgtgctgtattcttgctgttagggttgttcccaattaaatgggccactgttgattcaaaatcctgatgagctttttctatataaaacaggatggttacttggttccttctgttctcttctctgtagaaaagaaagtctggaaaataaaaagaacaacaaaccagaagtcaaccagatagccaacagtgacaacaaggtatatgttacattttccgctttgtttccaaatcattttgttgatatcaccataaatgtgtcacctttataccatgacagtgttgtgggtgctattttagagtgaaagcgtggcaccccgtcacagatgctggctttccaggagtgtctgcgtgaagtggagcacttaactggttgttaacagtatttcagacagagagctggtgtgatacacatttaactggtctcacaccttattttttcttgattggaatggtgtgggcacatctgaccagtgtccctatcttctcggtggggattaaaatcaaagattggtaatagatgtctgtccctgggaggtgggagtgggggtgtctcaggatcagagggtttgggcactcagggccctactgtgaacactcaggcactgtggcagctgtggatttttcctgaatttgttgatttattcactgagtcagtaagtcctttctcagtggcgatggtgtgtcagataccagggatcaggaatgaccaagagcagtgagatctgcgctcacatggggctcgcagtctggcgaggaggcaggaacctgcgaggtggttctcatgtagcgcgtgctccagtgctggctggccatggctggctaggggggacaccagtttgctcctcatctgctctcaggctttctctctgaagcaggggcatcatctgggggtacctgctctcctgacacactcacacagcacccactttggagatcacacccctaccccgggctgaatggtagggttaggtctttaaccgcccctctcgagtccactgaagtcagagtctccctcctcccaagacttctctgtcctcccaggttaccatcgacgactacagagaagaggatgaggacaaggac

SEQ ID NO: 50338 - DNA, 996 bp, Bovine  19866880490721
atgtttcctcctttggagtgtgaccctcttcatgactctcttgagtccttgtcacttagatttagaagggggcctccctcttgcttctcttcctcccagacactacaatcaactctctgtctttccctcaggcctctctgcactgtggctccaggggtggcaggtggttgatggcagagagctggcttagtgagccctgggtgaggaggcggtgagtcctttttctcggtgacttagaaaatgagatgcttcgtattgaatacttcttgttttccgcggggagccctgtcctctggtacctgagtaacagcacacatcgcagccagctcctgtttaagtacagagttaagccttgcatccttacccacaccgcctgccatagcgcatctgtacacacactgagtgtcacatgcagagcctgcaccctttcatggggctgtcttctcatggttctggttttctgtctgtgacagtggtgtttgtcagagcctgaggaccacttcttgtagaaggatgaatgttaagtcttatttaaggctgttataatgtctcagaccacctcctgccccctaaaagcttagagagtcaacctgcgctgttctgggtctgctgtacgctgccatcagtgctgacaggccaaattatagtactctataacccagttctaaaggatgaatgccatggcaattcaagtattttgcagaaactattattttaactcattttcacagtggctctgggtttttttttttaaacagtctcgtaggaactttggttaaatacagagtaaaaactgaaagcttcttggggaataatgaggagggaataatgaggagtcaggtccatcaaggtctttcaaaaaatattccgtaagtagcagtttctcttgtgcctgcaattccgagttgttgtttgcctatccacacgaagataagaaacatacgtgacggtgcatgtgtgtgtttccagagcctctggtcactgtaattttagtgc

SEQ ID NO: 50339 - DNA, 1005 bp, Bovine  19866880505026
gggaaaagtgatcggctacactgggcctctgagtgaagatgttcaggaagctggtcaataccctcatctcccacagcatcttagcaaaagacttccttacgaagaaagggtcctttggatggaaaacgcttcacaggtgatgacccacagaataccagagctgcaggactgcaccattgctgtcccagggtgggggcgtgtgggagcggggtctggaatagcatttctcccaaggcctggtcacccccctatacccctgtccaagcacaggaaggccaggaagagatgaagagggcaaaggcaaagctggaacaggacaggggtcgggggaacagggggcctcaacactcaggcacagaaaggggctgtgaaccatcttcccttgcactgtctgcccccctacccctggcccccagccactctcaagcactctgcaggatccgggggagatggggcagccacgtgactagaaaggggatatttacgggttggtcttgctgagaatgaagaaagcactcccttccgggatgggggcgattttctctttcatgttcaactcagagattctgcgaggacgggggccagcaggaacctcaggttcatcctcttcctcctcctcttcctcttcacctactttaaaggagatactttttttttataggcatgaaataaggattgcatttgtgtttgaacgctcattttcaatttcacatgaaaatgtggcttaaacaatgtgtatcagcttacacagggcttcccaggtggctcagatgtaaagaatctgtctgcaatgcaggagacccatgtttgatccctgggttgggaagattcccctggaggagggaatgacaacccactccactactccttcctggaacattccatggacacaaggtgggctacattaatcaaaaccttccaaatatgaactgacagtgtatgggttggggctgagaagcgctcccatctggtgagtgtgtccctttgtggggaatgaggccccag

SEQ ID NO: 50340 - DNA, 1410 bp, Bovine  19866880517329
ggttcccctcaagccttatgccccacctccctccctctatctggagcttctccttttttttcctttccagaaatggacaggaaagtgggccagttcaagagatatgatatgatttttagaaggattctgagagaggtgccgagccgagaggacagcaagtcaccttccgttggaggctgaggtcaggcccgtctaaggtttctgcaggctcttggctctcaaccccaacaagttaaaaggcgcctgcttcccacataaaacacgtttgaatcactttataagagctgtgctcttctcttacgtgtgctccaggtgacaggttgtcctaatattacacttggcagacatttaaagaaacatgtaagaggtgcaagcttcctgtccctgagctaacaccctgtgctatgtgacctcaatctactcctccaaacacggcaccaccatgaaccccctcttacaggggagaagacaaggtgagcgtggtctggcacatagccagggagctctgggccaccgtctgtctgggtctgcccctccccacagcccagacctttgctacctggattcccagctctgcctcggggattctggggcgtggacttgaggtctgtggggttcacatctcattagaagagctcggagctgctgaatggcctggcctgctggacagagccctcctcctggcccagttagatgcttgatgcaggtgccctggaactcctcccaagggtgagctgcagggcacgtggtttacctgccaggagcccagaggcaggaaaacaaacaccgtaaatcatcaggaagcccgtgtaaatattttatagatgggacggtaaataatgcagctccctagatgcacccgacctagttcatctgccccacatccagcacccaggtcagtctgtctgggccccctctcctgccttgcactttttaaacaaatgctgaggcccagtgctgagccctttcatatgcaccatcttcactgctaaacttttgctcaggctgctccctctgcctcgaacacctttctccttaagtctagctaattcatcctcctccttcaagagtcacctcctccaggaagccttctttgatttcctaggtggagtcaggcattctcctggctctcatagtacctaagcttcccccatgtgagctctgcttcctggaggtggtcatttcctagtgacttgcctgctctccttctgattctcagctccaagagagcaatcgtttccctggagctaaaggcaaagcatggcatatagtaggtgctcaataaacagtgttgaagaataacataaattatcttgtttaatctttaaataagtctgtgaagtcttattggggttattgagtttcttattacaatcatccttattttacacaggagaaaaccgaggccca

SEQ ID NO: 50341 - DNA, 920 bp, Bovine  19866880593467
ttctcctggctccccagagtagtctttgcctccggggctgggcagaggtggatctctagagactggggggatcctgaactcttggagcctgcactcagaggtcagcctccttggaagggtctcctccccaaagaactcaatcttcatctgtgtctaatagtggccagcaggtgtggggctgcccaaggtcactgaatgggcagcaacataaaacttgacaatggtttcccccgcccagtgccacagagctctgctggaaggtaattatagatgggattatagcctgggatggctaactctttccacagcccagagctcagcggacccagaggcctcggggctgcacaaaacctctgcctggcccatcagactctgccccaggccttcaggttcagggcatcccaagtccccagccctccaccagccttgatgcctaccaatcttagaagaggtcccccaggagtccaggtggaatcaggactctgcagaggatgtggtaaacatcaacttggtctccgattagaatcataacaggaacaataattccaaccctcacatatcaagtattcactacctaccaggccctgaactaacccttgatatttattaactcacagtctttccacaaagcctttacaatgtggagaccatcgttagccccgttttacaggagaggaaactgaggcccacagaggcaaaatgacatgccgattctcacacagctaggatgcggccagactgagcctcacatcccagactattctgaattccaggccagagctcataggcactaggccagggtacccctaaagtcacaggagcagttggggccaggggagcagttggtaactggtctgggtgaagtcagatgagtaatgggtgtggaggtgttggctgctaacagggcgaggacacaacac

SEQ ID NO: 50342 - DNA, 2634 bp, Bovine  19866880593527
ccactgtctggaacacagcctgacatataatagggactttgtcaattttgaacctgaatagcaaccttatttcattgtacagaacaaaggagcaaggagagacgaaaatgctttgcgaattctcaaacactctaagattttagtgatggctgttgctattctgcataatccagttccctgctggggacagttcctaagggctctgacaaagctgttgcctgcatttttaagtctaataccagggtatataattaaaagcacctacagaggtaagagggcttccctggtggctcagtggtaaagaatctgcctgccaacgcaggagacatgggttcgatcttcccctggagaaggaaatggcagcccactccagtattcttgcctggggaatcccatagacagaggcatctggtggcttatagtccatggggtcgaaaagagtcagacacaagtaagcgcacaggcaggcacagaggcgagaggcagacccgcacagctgctcagagcataaaccctggagtcaggctgcctgcgatcaaattccactcaatggcacactttctggctatatgaccttgttgttcagccactaagtcgtgtccgactctggtactccatggactacagcacgtcaggcttccctgtccttcgctatctcccagagcttgctcagactcatgtccattgagacggtgatgccatccaaacacctcatcctctgttgtccccttctcctcttgcccttaattttttcccagtatcagggtcttttccaatgagtctgctctttgcatcagccggccaaactgtggtgagtttttcacctctgttggcaacccactccagtattcttgttggggaaatcccatggatagagcatcttggtgggctacatacagttcatggggttgcagtcggacacaactgagcatgcaaaacctctcatcaacatgtacaaagtttatatccataacccatgagttgtaggtgtctggtcttatgtcactggtctggattttagggctttataacagaagtatgaccaaggggaaaaaaaacgccttactacaatgccagagaggggttgaagctaggaaaaaagggatgagaagttctggtgaaaaggaggaataatgctaagccccttgcttctccttagctgactccgtatttccatacctgtggcaacgactgcatccgacaaagaggaaccgtggtgcagtgcccacaaacgggagtctcttctcctcaggatcatggtaggtgcccagcacagagcctcaggacaggaaggaccccagccctaccccattcagaatgcaacaggctgggggtgtgggggtagagtgagagagggtcctggcctgtgggtgctgaacagggtgcagggaaagatagcggttctgtgcccaacagctacaataggaataggaatgaggcttcatttatgagatcaagatcctgaccaagcaggacatacagaagaagggaaagaaaaaaaatcagtggtgcaaaatagatgttcagaacaccccaagggtctgctgaaaaacgtcagtggtgtaaaaggactgagtgaatgaaggaacgtgcatttcactgcattttgactttcttatctgtctcagtagcccagggctggctgttactgtaactcgatgcggccacacagacatttggataacaaattaggaatagtggccccggggagacacacctcgttggtgcctgagagcagcctgttctggagaatgtctctctggatttaatgatgttagttctttcaaattaaatgcttccggaactagcccggcatagggtcaaaagttggaaggtgctgtttttagatacccagcctcctgacaatcctgctgtgtgggcacagtgccgacggattcctgagcagtttcacaccctggagcttaactgactctcagcattcctgtgaccgggtggcattaccctcacatttgtcagtctgacagaacagcctttaaagatgccctctatgcatactatgtattatatgaagtaattgcacccggaataacattaattcatcaaagaacaacaacaaaaaaaacctgaatgtaaactctggttaccacagtgaaaatgtggagtaaaaggccaaagtgattttgaaggaccattcctaaactcctgggccccctctcctttttgagcatctactgaaagacctggacactctataaaaaaaaaaaaataccgatctgcagagatctactgactgttggctttgaaggaacccaaacttgtctacaaagcgtcaaataaaaattttagtcttcaaataagagaaaaatctggttgtgtgctgcttaagataaataagttctgttctccccagacagaagtgtgctgggtggctggctgcctctcctcctgtccgctctgcttgtggctcatgggtgctggtggctggcatctatctgatctggaggcacggtaagggttataattcagctctttaaagaatgacgctgattttttcttttaaaggagcttcctccagaggcaatcacattttggcatcagaatagagtcagacaacatttatttaataccttagagctctcctaaagactgatcacacctgcaagggtaaagcaa

SEQ ID NO: 50343 - DNA, 2024 bp, Bovine  19866880619697
ttagctgagaaggaaacttgtgcaaggattctgtcagtaagtagcagatctcacttagatttgaacctgactctaaaagactactactttcaaacttggtgtgtattttcaatctggtttgtaccctgttgctgaagtggtctgtgtattactgttcaacttgcagcctcccttttggagaggggtgctggcctgtggatccctggtgcagagcatgaaccccagggtcctgccatccacgcaggctcccaattttctcccactgcagacctccttccctgattccaggacacagaggcttgatgacgccacagatgggcaacaccatcaggcatggaaaagagattctgccacacgtaattttactctgaaaatatcactgtggaagtgtgtagctgagtcacagagttggcaagggaatgtcacacaggccaggcccttctggcaatgaattccatggggctctacacgggggccccgggcatggtccttcactgatctaggctgacagttgctgaggccaagttggaaggacattccttgcactaccactgaggtggagacacttggatcacgcagagaagtctgccctaaagtcttctaaaattccttccaggcctcccattctaatttatacacaagaaaagcctttattttgtaatctggtcttcttataccatttgtatgactcaggctcccactgaatcacaaatccacacttgagcgccaccctttcacctaagctccagtgccacaccaccaagtgcctggcaactatagttggcatcaaatctaagtggaaatgtcttaagtcaaactaacgtctttgcaaaccagctcccagcagcaaattctagcacaactattttctcaaccgggcaagactcgacctggtggagtggccttctgtttcattttgtgtctttggttcattgccactaatgcctctttcctgagcacactgctcatactgctgcctgccttatctttattaaatctttcaccgtgctattgtctgatccaatattttcattcttgctatacagccatgaaaacagtacttctcaaccttgactgtaggttagagcttcttaaaacctttcatgtccaagccccatccccagaaaattctgatttgggaggcctgggggtcagagatcagacatcctatcattgagaaccactgtcctgaatgacagcacttatcaaactttaaggtgcacaggaatcacctttattgtttagtcactaagttgtgtccaactctttgtgaccccatggactgtagtccaccaggttcctctgtccatgggatgtcccaggcaagaatagtggagggggttgccatttccttcaccaagggatcttcccaacccacggattgaacctgtgtctcctatattggcagacaggttctttacctctgagtcactagggaagcctgaaatcactgctgatcttgttaaaatgaagatctggattcagtagggctagggtgggcctgagatgctgtgtttctaacaagccccaggtcataatgatgctcccagttccaagcccatactttgggtctcctgggttctagcacaccaagtataggagcttcagcattacctgggggctttggtgattgtaaggcccttcctcatttcccaggcttcctgttctcactagtacatctcctgactcctcctaacacaccagccctgccttgcattctgatttatttgggaagtctgactccctcctctctgcctagttaaatcttagccctatgtcagtttccagcctaggccctgttctgcaatttagtctttcccaactattccatatagtttattaattttttttcctccaatctcccacaactataggaagtgtcatgatcattccatcatataacaaactccacagctgacagcaagaagaaaactgtaagaagagagatctggaaactaggatccatttttgacacattgtaaccactggcacatcattttccctttctctaaaatttctctgaa

SEQ ID NO: 50344 - DNA, 1639 bp, Bovine  19866880715404
cactaaattacatgtgaggaagcaaacttggtgagaacaaacaacctgcccaaggccacacaacacatggcaaaactaacatatgaatccaggtatgttggcctcactgaatgtaggctccacatgttaagtggaagtcacttcagtcgtgtccgactctgcgaccccatggactgcagtccaccaggcttctctggccatgggattctccaggcaagaatattggagtgggttgccatttccttttccaggggaccttcccgacccagggatccaacccaagtctctcaagtttcttccactgggaagcaggttctttaccacaatggcagggaactgtcgtctctctgttcgtttagtctgtttcagcccagtgcctaaaacagttcctgaccacaggaggcactcaagaaatatatgatgaataagtcaatgagtgaataactccaaactcccaaatcttattcagtatgttataccacttccaatacagtcactgagtcacacagccccacctccatcctcacaggggatgttcagggcatgctgtaaatcacagatgccaaggagctgagcaaaagccaaatgcagaaacctaagacaaggtactaatatcgtcattttctcttttgaaatgtgaataatattgtatctggcagccaccacaaattttttcctattctcagaagggttttttgaataaagctattttcaggcaatccccctcacttgacagttacttttgctctttcaaataaacatttttttttttcaaataaacatttgttctttggaattgttgcttgtttttcagaataaatagaaatttgcccctttcaaacagaatcgactcaggccaatcagattgtggaaatgattggcccagcaacaaagaaaaggtttccaaagtttaattagcagctaaagtagaaactctgcccccactggcatgcctcaggatagccaagacactaagtccataaaatacagggtggtctgattacagccctgatggggcagagccatagcattctggggtgtttaaagacgggtcatttgttttaataacagtaccacaattagcagtgaacttaagggggtgggaggcagggcaagtggagcaggagtatgtcaggtctttaccttttcaaagctacagaaggcaagctctttctggttatgggaaatgtatcccatttatgacaggtctctctctctctctctcattagcacagttttgtcattactgtaaatcccccccagtcaaggctgatgttaaaagtctgccctcccaaacaagttcacagtgtcacaaaaacaaagccaaaggaagaaagaaaacctccaactcttctgaaatgcagcagccacaggaattttcatcccaaagggttaggaaaataatttacgcaggtggtgacttaagattgctttcaagtatgagtgttttgcaatgtacacaacatggccctttgctcccgttcttaagtgacgcccttgaaaacaggtgaacaatgcccccctcactgaggagcctgagtcagacagggaaagctgactgttgtttccaggcggccagaggcctcaggggccaggccttgcttccattcctaagagctaggaggttttaggaaagtct

SEQ ID NO: 50345 - DNA, 1298 bp, Bovine  19866880716233
tgtccttcccattctaatattctgtgagattaccccctttcattgtcctcccccttccacccaaccaaactaagtaccgtgtgcctgaagagatgaggacaaaagaagaaagtatttgatcctcagttgttattaaaagcatatctccagacagaaggaaaaggcaaggagctacccaaactgacacaaattagaactaagggaatgagcccctcgtgttcacaaagcttacgtgatgagcttgaatgcctgcaagacatgtttatcggaaaatttagaggagaggaatacaagttggctcagatcaaacttttctatacagagaattacatcagctctggtagacacgttgaaccttcctgtggtcacattataacagttaacattttagaaaatatcaattactttcctaacgtctctgttattgggaatcttgacaaaagcaataggtcatggttgacttggaatggaaaatccattggattaagatagaatcggcagttggaaactttggtgagtaggaatttgattcaagtaaagacataacaattaaattttcctttttaaacttttcttctgctctttgactatacttttgtacatattttaaataaaggataatctgatgttctaaaggtcttcatatttaatgagaaaaaaagatcgaggccagttcaacttgagtttcttagatgattttttttacgtaaaccaactttactgtggcttactttatataaaataaaatgcaagcatttaatgagtacagtgagacaggttttgacaaaggcatgagcccaagtaacaaacactcaaacagttctctcatgcctctttacaggcatcctcagctcagcctcaggtgtccactgactttatccgttttatcatgtagagttgttttgtttttatttccttttctagaatcttacatgaatagagtcatacagcatgttctccttttatcttgtgttcaccatagtttcgagatcatccaagctgctacatcggagaaggcagtggcaccccactccagtactcttgcctggaaaatcccatgggcagaggagcctggtgggctgcagtccatggggtcgcgaagagtcggacacaactgagtgacgtcactttcacttttcactttcatgcactggagaaggaaatggcaacccactccagtgttctggcctgcagaatcccagggacgggggagcctggtgggctgccgtctatggggtcacacagagtcggacacgactgaggcgacttagcagcaggagcagcaagctgctacattt

SEQ ID NO: 50346 - DNA, 1203 bp, Bovine  19866880730232
gactcgctccaggagagacggctcaagcccagggtgctttcgaagcagcaggggcatccttaggagacacatggtcctggtactcacgcagggccagccctcgaacgtggagactgtgaacagagcccatcatagccgagaggacgttgtcaaagttgaaatcactgttttgccagatcctctcacggaccacagggactatcaacatcccccctccttgtagaggatgaagagccccctagacaggaaaagaggtggggtcacccaagctggacatggaatgggatgacacgccaatccctctgcaaccccgggcaccatcccgctcagtccacagccaggccacagctctgagcacagcacaggctgcccttctccatatcctggcctgtgtttagtctactctttggttcaaataaccagttaaacgagtattctccaaagctaccaagcagacacctagcacatgcctgatcacaaaggagaactactgaacaagaaccatctctcctacaatgggctccaagtgtgcaatgaagaaccaagagctttggccgtgcagaattccacagctctgggaaaccagcccaggcctcctcttatctctgtcttagttttaatcgaattccttttctgatagtagcaatattcccagctttctttccaaaagaattctgtaattgctggcacacagtatttctcatacaatttcacttctggaagggttccagcccctttgttccacagaagaggaggctgacatagtgagggacgggaaggcttccatgctgtcacctccatggggacccccccaacccacagtgtgaacggggcccccaaagcccacagccacagtcacacggcagtcagataactctctgagagccctgaccgctgaaaagaagtgcccagtgagcccccagtgcaagcggccccagccgtggctggcgacatctcaggacggggacacaagaacatctacgctaaggtctcagcacttcaggctgtggttccgtgtctgccttcagagtcaggtggatgagctggagcaagaggaatgagtattcaccacctgctctctcctgtcaccattactgtgaatgaaaacgagaccaaaaggcaggtgaggggagcacgtggggagaagcagcctgggacttaagtcagcagaggcggccaatcctggactcccggcaggttgag

SEQ ID NO: 50347 - DNA, 713 bp, Bovine  19866880760599
ccttgccagccagctgattatggcacaggaactatagagaccaaacaggtcagcaacccaaggtgactctagccatttccaatcgcttctccacttttctgcacatatggtcttcaacacacttgtgaaatatctcagtctcaatgtgaaagactgggtgccactaaggagtagctaaatccattccaaatgaaaggaaaataacagcaagcaacactttggctgctgccagattccattttcagagtctccacttcatacttctcatcaaaaccaagttagagtgtgacagcaaaagagatggattcctgataattgtgaaagatgatttttttgaaattaagaaccttatttgatcttgggtgatattcaccaaggtcactaactgtatgcttgtgttatacagctggtaagaaaaaataaggtgatgttgaggcaacagcagcagcacatcttactacctagttgaggcaatggcagtcccgtttagagccttggaacaatctttccaaggaccagtgatcactggaccataaagaactttcctgaggacaccacaaaatgaatctgttttcattgagcctttaattaaaaggaccaagaatatcaaaccaaagtaaggttttattcatctacttgggctgtggaaagattaaaagcaaaatgtttatttgtaaaatatattttaaattcactcacagtttttactattt

SEQ ID NO: 50348 - DNA, 1601 bp, Bovine  19866880763338
aaaatgaaaatttagctggaacatggaagccttttgcacagtcagtggggagctttgtgagatgcacaatttcaagctgtatgggattgtttttaactctttttaataactttgtaaacagagtgccttgaagtgtgagaactttctagaaaccatacaagtaatttctattgactctagtgactggagagcaaattctttgtaagttagtttccagttcttttctttcaacagaattgaatggggaatctaatcaagctgtcagatgttaggttgctaaaaataataatcatttaaaaattacagtgtaagtgtctaaaagagagaagacaacaaaacaaacatccctttatactaaaagaattgatgtgcttgtatccagtggttgatgcatatcaaagggagtttcagctggttctccacttactgatacaagttgcatttgaaaataaataggattttcagtttaggaattttgactaaatcaagctgccttcctcccaaattacttaggttttgatctaattgaaaaatattttttcttaaaatttcttgagggtctaagccttatatgccttctttctttctttgcttgatccaaaaaaggtgtgcgacgggggaggcctggcaggaaatcatgttagcctgcctcccggggaagcaatgtgacccggactcggattacaaccccggggaggaatacacatgtgggagcaacttcgccatcgtttatttcatcagtttttatatgctctgcgcatttctggtaagtgatcagaattgcctcacaaacccctgcactcctctcatggatattcatgtagcatttgagattcagaccagtaatattgccccatcaaatagctgtgcggtatcttatgttgacgaacactctagactccactgggcagttgaggtttctgctgagtgaggcctgtgttaatataaacgcctttgttgtaataggggttttggtgctcactaacaggcttcaccactctagcttcttagggctgctggttcttttataaaaatctcaaagccactgcacatagtagtaacttacgacagtgagttattcggtgcaacttataaaactccagtgtgtttcaaaagatcagacaattacctacccaccccccgccaccctccccgccacccctggggactatacccaaaccatttgtgaaagctggaagcctgctttttcttaatcattctttagaaggaaagtttttcagcctttctgggagaaatgggtccagatgtcttgtgacccttataatcaggaagcactcactaggattgaacccagctaaactcactgcacctgaaactcccctcgattggcttttacagatcatcaacctcttcgtggctgtcatcatggacaattttgattatctcacccgggactggtctattctggggcctcaccatttagatgaattcaaacggatctggtctgaatatgaccccgaggcaaagtaagtggaaaagaattccatgtggcttgtatgagctgtttctgggtgttggctgtgctccctgggaaggtgggagggaccgcaagccggacaggtggtgccacccagccctca

SEQ ID NO: 50349 - DNA, 1412 bp, Bovine  19866880799410
tggcacagctgactttagaaggctgtctatgccctgctcccagaacttaaaggaaactgtcaactgaaaacaacacatcacatatcgtttcagaatctcttctgtaaatgcttcccgtctgcagggcggcttctccctgtgctggcagccacagcccctaattcctgcacatacgtgtctggtggtgcgggaaagggagtcagcagcaccatccaggagttcactccgttcacataaattactatatacaaattacggagcacaaagagaaacagcaccaggcctcccacctcactccgcatgaaattaatgaccccactgagaggtctctgcttactcagagtcacgtcaagccaacctgagggggaggagagctttgtgactaagtacgatctgactaagtgctcctaccatgtcgctgagagaccacccctcctgagggacaccccctccctgtggatcccactccctcctgggccaacaccagcgttcagtcctcagactcaaaaagaacctatacagaaaaacacatccacacaaccccagccatgtgagagacaccgcagcacccgctggagaagagacatctgttctggaaaggaaacgcacatgaaaacccctcaaatcctaccctgggctactctctctacaacctttctagacagttacctcattttaactctccgtgagcacagaaaatagccagctgagacagaaggctgcctcgctaggcactcaaatgataagggggttccagctccactcgccagccagctggtaaccagtatcctctctttagagcatggcctcttgacccgggctcggtgggaaagccctacatacatactccttcccaagcctaggaactgctcaagggcccgggtcgaccccaaatataattctgggaaaaggaaatgctgtgctttacccaaaccagtgaatcatctgactaattagaaagctatttgctcagaaagaagacctcagtcaaccttttctgatgggtggcaggaactagagcctggcctccaggttaagggaggggctgagcaggcaatgcaccccagttttccaagatctgagccctaataacctgcctggggcatttggagttcaggtttaaaaatacaaaggagaaacccagaaatgtaactccagtccaaggatacagaattttttttttataaaggcaacaactgcaaattcctccacggagaggcctgggcgctaactcacacgggctttggaagaagaggcacacacaaacctctccctccacaggctccctcatgctcacatttcaaatgctgttttggaacttgtcaaaaggaaattccaggaaatcatagcactgatgaccaaatcgctccctccctgtgaagcaaatgttcatatttgtagctacctgaaca

SEQ ID NO: 50350 - DNA, 986 bp, Bovine  19866880812998
tctgggaagaaggaaaaagaaaaattaaaaaaaaaaatgacacaatgagaatccagtgtcagaagaaagctgaagtggttccccatcaagaagagcagggaaatcatccccatgtttgcactggaaacctcatattctatttttcagaagcagggttaggtcagccagagcagcaagaaagtccctgagctctgcccagagtgtcaataacacacgaccgctgcatttcgcccaatgggttagtacctctctacatccatatcttcacaagaagtctttcagtgccttacttcagacaaactgaggtcatttccacttatactccacatcttttctgactttcaaaacccgtgtatctctagtgagttaacagatatataccacagctttcctccaaaataactaccatcaccaaaaaaaaaaaaaaaaaagcagtggcaataattcaatagtcttaatcattttcagggtgttactccaacatctttccacagccacaaatgcatttttttcagcatgggaaaaataaataaaaactggcaccactggcaccagggcaataccaagagccccataacaaatacctagattatgcactgacacttcctgcaaatgaaaattcatgatgcttgggactcatttcctccacaggcttccgaaaacagaaaacatctttgggcttttttgcattttaaattgcagcgacagcagccaaaccagcaaccagagaaacagacaaggcaggcagcctgcatccttacacctagaagagacaggctgagttatgtcaggggccctcaaggcctaaacaggaaccatctcagcataggctgggacccaagtacacacaggatagaaccccaaggaggcttcatgtgcaaagccctctccagcctggggtcaggccaggacccaggcaggtctcccaggaacctgcctgccttgggtcacaacctccttactgagacagaagtcacaacgagagg

SEQ ID NO: 50351 - DNA, 983 bp, Bovine  19866880819624
cattccattttaatagctgccagcactcgctccttgagaagactaatgtcctggccatggcctgttttggccatgggccccttgatcagctcaggcctcctcggggattgtctcccattttcatcccttatgcctcagctggaaagagctgtccagactgtccgcatgacctctagggtggtcccccaggaggataggtctggaactggaaccctcttcttttcctctggaaactgacatttctttggagtatggaatcgttatggaatggttttctgatacttggggcaaaggaatggattccctgggcctttctctgtctccagacttgaagcccagagggtactcagtgaatgaatgaatgagttatgccagataatcaagttctaagtctagaaaggaagctcaggagcctcccagaggcgatggggaactctgaaaagcaggggcaggggggaggaatattcatggatcagggtaggagtcgctcttagaatcgcttgaccagcacccgtggaccgactagagcctcccgccctggagtcttcccattcgtctccgggcacagagccgggactagccggcctggcggcgggcaccgagcccggctgcgtccgcactccagccaacaggaagagaaagagcgaaggcccggcgaggagggccagctggcgggcagggagtcccgggcgccagcgctgggaactggggaacccccgccgtcgcctcccgggctccgtgtgcggggcgtagggtggggaaagggcccccggggcctccgcgccctcagtaaaatgaggccccttctgagggcccgttcgtgccctaagtggggcgaggggtgctcgggccggcggagaggcccagacactgaggggcgagcctggggaagccgagctgctggacccccgggggtggccggcgtaggcggggctcggaggggcgggcccagggcgggggcgggccgagactggggccggcac

SEQ ID NO: 50352 - DNA, 1710 bp, Bovine  19866880833082
cttgggttgtaaagtgatatgtcactgtggctttgacttgcatttcccctaatggcttatgatgttgagcaactttttcatgtgcttgttgaccatctgtatatttttttgagagacatgtctcttgaaatcctttgccatttaaaaattctttttattttagctaacatttactgagcacctactgtgtactgacttactgggatgggcaggggcacacagagccatggactctgcttggggcaggaaggcttaccctgctcccctcccaggattgtcacactggagcatgtgtgtgatagaaggcactctgatccagaagggaaggaagcacaagctggagaagggccttgggtttcggaggctctgtctgtgccatgtacccttccaggggcctgccttgcccattggctgccctgccacactcaacaccagtgtgattgatacctggcagtcagaagctgactgggcatggcagccacccaggtcaccaacagaggaggcaccctctgggtatgtacccacagggagtcccaatttaaacccatgaccacccagccagagctcccacacagtccctggtcatctccaagcagctctgcagggagagtgttggggacagcgaggcttctggagcctaaacaataggaagataaatggaccctgctctagcccagactgctgtgtgctttaggcatgtctcttgacaagcctaaagcacatgacagaaaactgagcctcagttttctcatctgtgaaatgggaaactaacagcacagtctcttgagtcccttatgaagctgaaatgaaatgaggtatgcaaaggggtttacacaggttgggaaaaaggaaatgttcactagatataactcatgtcatctgaaaactgagagggacaagatgatttacaaatgcttgactccttcctagaaaagagaggtcataaggagtcagggccaccctccctgtcatatgaaaggagcaaagaggtgggccagactccccaagccacagctgccgctatggggaggagccatcctgagctcagggttatgcaaaaagaatttcagaggcagcggcctcagccgcagggaaggccagactatcctaggaagctgtctggcctccggggctcttggtctccatcccggtttcgcctcagcctgtgccacggcggccaggcaccttctcactgatctgacaagctcatggccgaggggaagtatgtttccagatagagtgaaaatagatccttctccaaatatgctcactgtggctaagaaaaataaatagaaccaagaaggaaagagagagcagctagcagccatcagatggggccaggcctgggcaggtctggagaggcaagctgcagatgggtggaggttaggtttgtgcaactgaatgatgtgtgtacatgtgtgtgagtgtgtgcatgtttgtatgactgagcatgtgtgatagtaattgtgagtatgtgtgagtatgagagtggatatgcatgaatgtgtgtgagtgtatgtgtgagtatatgcaggctgagtctgtgagttcttttgtatataaggtgaagtctgagcacgtgcaagcatgtgactgaatacataagcattgtgagtttacgtgtgagtgtgagtgcatgtgagagtgtgcaaatgagtgtgagcatataggagtgcgaaagtgtggactgcatgcatgtgtttatgccag

SEQ ID NO: 50353 - DNA, 816 bp, Bovine  19866880836837
cttaggttattattattattttttttaacacacctatgatgcatatttggttctgtgtgcacacctggccttgggcaaatttgcgaaggaagcagttacttatagtgacctgaggtaacgcttccagggtatggtttgcaaagcaggcaagggtgtcccactgttcaggaacaggacattttacctgggaagtaaagggctggctgtgagatttctagggctgttggcatttcagcttaaggctttaagctctgatgatggaatttctggcatcggtgagctgggtggaaaagtgcagaattagatctttccagtatccttgaaacctcagtacacaggcttccattcaggtgttaggttggctttgtggtggaataattctcagccctcagagatgtcatgaattgtatgatccacatttaagtgctctgggattctgtgaaatggatccagttgcattactttgtcgaattttgagagaatccaggagagaacagaggagagcaagctattgtgctcctccggggataagtaccactgcagtacaagggcattaatgttcctgacggtggcagaatctattcagaaccatcagaagcagcaaccagcagaaatctcttgaaaagcaattcatctgtacagtgcagcatcttcaaacgttagcaggcatctgaatcacttgggggccttgttaaagcactgatggctggacaccacccagaaactgtccagagtttctgattcagtaggtctggggtgagttgacgaatttgtattttaacaggttttcggagactgctggtgctattgtacgag

SEQ ID NO: 50354 - DNA, 1675 bp, Bovine  19866880871302
atgtgtccatgccaaaggatgaggccggggctctgtgctgttggatgatgccaggggatgtcgtcaagtgggaaaccaatccatgggacagtgtgtactgagtactaggctccaggctttgaaaggtggtgtgagatgcacattataacatgccgtccatgccttgactcactctagggaagtaggatggtgtgtgtcgaacacgcagtagccagcttacaggaagcacatatatttagcacttctttgccctcctcagtgctagactgacagggggtacatggcggggggagctgcctggaggaggggagtgggccctaatgactccttctcctgtcctttccccacagggacctcaagctggacaacgtgttgctggaccacagtggccacatcaagattgccgacttcggcatgtgcaaggagaacatgtccggggacagacaggccagcaccttctgcggcacccctgactacatcgcccccgaggtgagcggcaccctcccggccccggccaacacctcgcctccacagggcgggcgtgagttgtgatgtctgagccacaactgggaagctgaggagatctggcccggcttgtattccggggccccttcagctcccacactttgtctactccagatcctgcagggcctgaaatactcgttctccgtggactggtggtccttcggagtccttctctatgagatgctcattggtcagtcccccttccatggtgatgatgaggacgaactcttcgagtccatccgtttagactcaccatactatcctcgctggatcaccaaggagtccaaggacatcctggagaaggtgggaggccctgggcggggctggcccggggtgagggctggcagatgccaggtcttgggagtgccagaagccccctgtctcagggatggcggccttgctgatgctctggtcctcatccacctgggggagtcaccctccttctgtgatcccaggacctcctatctgggttccctgcactgagttaatctggcatggcagtgacaggcttggggtcaggagacagatagaccctaggctaaactctgagtctgtctccttatctacaaaatgaagctaggagagaacctttctcacagacttctgggtggggggaaacataaatgtgtgatgctcaggcctgtgccaggcagacggtaaacacccagtaaatgaccattgcttttactcacaaatcccacctgctgagagtcccagcagcccccatccatgcagacttgggagcagagacaagagaggactcctctaccccagaggctctggggtgtgatgctgggctgggccagactggcctgggtacccctgggcctgcttgggggttttctggggaacccatttcctgcagcccttgggtgctaaccaggttcctttgctgggttgcagctgcttgaacgggatgtaagcaagaggctgggagtgacagggaacatcaaaatccaccccttcttcaagaccatcaactgggttctgctggagaaacgtgcagtggagccacccttcaagcccaaagtggtatgtaatccgactccggtgggggctacgactccacattgccccctactgccttcccaggtgggcttctcctgctttgcccttccctcctgcatcatttacatgctctcctcctctc

SEQ ID NO: 50355 - DNA, 1534 bp, Bovine  19866880893183
gctgaagtgcttgtcccggttatatctctggacccagtagcaactttgaattcaggctctctgactctaaaattcaccacgctattcagcgtaccactgctcattctaccagctttccttatcctggcttgaggggtgtctggttgcttaaaagtcgggagcagactggtagagtgtaggccttacaggggtgttacaggacacttgattttggggacccacctgttcaccttttactgactgtagtgaggggtagtcttctctcatatctttgcctttttctgtgcttatatatgtctgggctgtgaaaaaatgcacgactggatgtcacagttgaactattctggatttggatttttttttttttaagtttggcatttgtgcagaatcacaagttttagaaagtggtagtttccagacatttcaggtctgattcaccaacactactgtaattaaagaaaaacctgtatttgtttgccccattttatcctaactcactaggatgttttataaataatgaacctagatattttagcaaatagcatctatttagttgttgaagctttcaggggattgatcatctgctcataggtctcaaagtcatcctaatgatgggagtttgcccgaacactaattcattgggaagtgactgtggatagtgaactatattgtcatgtaaaggcagcttcaaaatacagagtatagaaattaagcagctcgacagttcttttaggagatacattatgaagtatcgagagctcaagtgtaatgatttcagtcggtcacagagtgttaatgaattttgaattgaggcagttgtgattaagcctgttgccttttccaacactaatcattattaaaatgatgattgatctgagtgattatgaaaccattaaaaaggcatctgccttatgcctgaattaacaggatggatgtaggttttgtagttgtagccaaacaggacttgtagtgattttgatttcaaggcgcttgtttatttaggctccttcctgtgtttgccaatcctacaatactattttctagtaatatttctactattttcacagggtaaaaacattggggttgggggtgtaacgcttggtgtggctacttgagcctcagctctgcggcgtgtgcagtggcaggagtagggtggcttctcaaattcccacaaccccacccttgattgcggagatgcttgtggaggcccttctgtgagcatcacagctccttcacagcacagctgcacggtgacagcagcccctcactgagtgcagaacgtgtaccaggcatttccaccatcgttattaatccttagctcccccgggtcgtggtggtggcaccactgagaggatgaggaagctgctgcttgaccatttgaggtctttctcttggaccatacatcttgtccagcagaaccagggtttggattcattcttcattatcttcagttttgtacttccttaaaagagtgttcttttggtagatcactgcagtcttaagaaaactgaggaaagacttcacctcatccaag

SEQ ID NO: 50356 - DNA, 3300 bp, Bovine  19866880899388
ccttctctactggggatccagagagtatgcaagaaagagaggcaggcctgaggcccttgcttccaagcagagaactggagtgagcatggctgtgagggtgccccgtgggggtggaggcaggagaggccacgggaggctgcctggatctcaagacagggccagcagagaaaggtgtgtgtgtgttttttctggtttctaagagaagggtgcctaggtatttgatctgataagttgttcagcggaactatgacatgccctttgggtggaggaacatggtttgactaaggagactctatttgaatttatggaaaagactcctgcagcctgcacaagggctgtgtttctaggtgccagagtcccacctctgggacccacccttttctggtcacctgcaggcgggccgctgctctagctgggtttctggctcttactccaccaggaggaatcctgtgctgatggagaggttcacacatgggcttcttcagtggggtctgtgttccgcagagcctgcccataggcacgcacaccgcttccgttaggctttgtcaaccgttctgggaaatgtacgttctcctgttcggggggcactgcaggctttctgctaaggggcttaacaggtgtcttcgcagttcctttagaggctgagtgccctccatgcccttcgggcctgcctgactggctcaccctccccgattgcggtcggcacttccctcccctctctggcctcctgagccaacagccccctttctttctgcaggcgatgggtccttcatggcgctggacccttcagacagctggtggttaggacacaggccactgctccactctgcccggccagccagcacttagggctcgagggggcagctgcctcagagagaatattctatctgaggtctggaccccaatagcagtttcctgttgggtgtcggctgtatgacactcacgcttttctcctgtgaaacgcacctgtgtgtgcggcagtattgtgtgatggtacgccatgagcgggagaggggcctcggtgccccacagtacgggcctccccccgacacacgcagttttgctcacctacacacgcacaccagcctatcagctgctgtgtcagaggctgaaggcaccagagaatgcaggtctgaatggccacgtctcctgccatgcccccccgaggaggtaagttcagtcaccagctgggaggtgtcactctgtggccctcagagtggggggtcaggacccccctcctgcagcccttcacccctgccagcggctccagacccagaggagtcctgtgggctggtgggggcctctctaggagacagacgtctgttgacagacacagaattttctctcttgaccctctgctggaacagaaaataaagacacaggtaagatcaaataagattttactcaaacatttttaaaggcaggccggtgtgatggctttcttccttctacctttctagaaatctttctcaaccgtggggcctccaaggcacttcaaccgcctctgatctgggttaaagcctggaatgttccatcttccttccctctgattctgggtccaatggggcaggtttccaaacgggagttcctttccttcttgccagacaggggcttctggatacagtcagaaaaatcaatacaaaacgcatccacatgttctttaccttgtaacgacagtctggataatggatctcagttcaaaagtaagttatggggttgccttattgaattagaataagtttaaagatcagagatctgttttaaatgttactttgtttttcccccaagctcaaatcttcgccaattcatttgtctttaaatcaattgcgttttttttcaggacgaggatcatagctctacttgactgctttgtccgtcagcctggctcccgcctggtctgttgctggggacatctggagaatgagaattagccagccgtggccactgctcagtccccatctccccgggctttgcgcagagcaggctggggtacaggtctgctctgggtttctaggtttcctggcaacaggaagatctttaaaaatgctaaatcctaaaacccatggtagtaaagaggccctgcagactcctgagtcctgaagcaaggtccagaattccggcctcaggctgatggtgttagtaagaacaaaagcatcatagaggtgggctacaaggccccttggagggacccagctgaacaccagttcctgtctccctctgggggtgaagtcaggaagcagcagagaaagaagcctgtttctttcagcaggcagctttccctctgcccaggcatgttggaggctcgtcacacatcccagctgagctccacgctccctcactccaggcctccggtgcagttttcagccggatggggagaatgccctgggctctgtgcaagctccctgttcctggactggcttgcctccagacagagcctgggaaggacccaccgacccagaccctggaaggcggcaggaccctggactggagagcgctgtggagcgcgtgacaaggacctgccaggagttgcccgttctgcaccagcctcccctcccctttgctatcctgcccagaggcagggagaaggggccccagaatgcctgcgaggacatgctggtaagaaagaagccagttcactaaccagtactggtcccctttcttaggagattatccaagtctcggccactggaggataacattctagacaggttcaggaaagtccatgtggagcaagggctgtgctgggccttcgcgggcagggccgacctcagcgctgggtggccagggtcctgggcttgtagaccgggacatcctcgtcccagagcgccggccgcccctggatgatgtcggctgccttctctgcgatcatgatggtggggggcgttcaggttgccactgaccacactgggcatgatggaggcatcaaccacccctgaggttttccacgccgagcaccctggtctgtggatccaccactgccgtggggtcagagggctggcccatcttgcaagtgcacgaggggtggtaggcgctgtctgccttcgcccgcacgaaggcgtctatctccacatctgactggatgtggcttcccggctggagctcctttcctcggaatggtgccagggctttctgtgcaaaaatctctcgggtcagcctcacacagagacggaagtctttaatgtcagtttctgttgacgagaagaaacaggtgagacatttcctcttaccatgctggccctgctggaagattctccacttggagagactcaagaagctgcccaaggggacacagttcaagga

SEQ ID NO: 50357 - DNA, 1243 bp, Bovine  19866880918438
agggaggggggttggctcatcctaggctctgtgtgtggtgctgggcattcagaggtgaagaagagttcctcagtgtagtagaggaagaatgtcagtcccggacacccagacaggagtctgtaggagtctggcaaggactagaggacgaggtcgtcaactcgtattcccagtggtgaagggcacgagcagcagcagagatgggatggtggaaggggaccatgggctgatgagcagctttgtttctggggcagaaggctcacaaggaggaggtgagaaggagcaggcagtggaggaccctgggtgtcaggttcagatgttcgctgtgattctctgggcagtggttctccagagaaggcttcacaggcctgtgaccactgcagctgcccggggccccatgcttggcttaatgttctgctgttgtctgaaagttcttagcaactttttttccttttaaattgatttattttttaattgaaggataattgcagaattgtgttggtttctgccagaaatcaacatgattcagccatgagtgtacatatgtctcctccctcttgaacctcccttcctccctccctccccatctcttagtaactttgaaacaaagggccctgtgttttcactttgtgctgggctctgagaatgatgtagcctgcagtggggtgatgtggtagcggcctgagctgggcttcgggacgtgtcccccagagtgaagaagagagaaagggtggagggggggatgtggtttagcagaggagagactggggacctcggggaagacagagagggaggcttgcataagacacctgtggctgagcctgaacctcagactgaacagaatgggttggggagggaggagccagagttggcttctgctcttgacttgggggctcatcatgctcagtactgccctctgagccagggaacttctggtggataaggctggtttttcaaaccgaaatttatgagactgtcttaatatttttactctcaatagtaagctgaagctgacattggcaggcttattcaatgattgtaaaataaccagaaaagacattctggaatcaaacagatggaccaagcaatcatgttaaaaacagcaaatcatcacttgaacttcagctaatcacaatcacattttgctttatttaatcttgagacatcttcctaagtaatttcctattttatttcttttacttaaaggacttgttattatagagtaccccagttaaagatgcctata

SEQ ID NO: 50358 - DNA, 1152 bp, Bovine  19866880926510
tcatccatatagcaacgggcctctgaaaaagtaactataagatcttcacatttctgatcttaccacaggaacacttacctccatagaaaggaaatcgtgcttcatattatccactattccttcaagcatttgatgagcactggctacaaacaacaaaacctcactaagtatgtttctcttagaaggtgctttcccccaagatcagtgtcgggtactttcattttcatttctgtgggtatcttccagggttaacatggtaacctggaatttgttgtatatatatgtatatatacttctgaattaattatgagatatcaggtctaacatgcacacagagtagaataatcacttctcttttagctaaaaccaccatcacacacttgtctaaggacagaataaagtttgatgtgagaagagaggggaccttaaggcatagacaccctgtaaccagcttaacagcaacagcagatcaccacaccgggaacaattggaaataaaaatcttatcactgtttaatattttgaaagaacttacctccaaaaatctgtgtgaagtaccccttcatttccgcttcacttgtcacttttcctttatatcgagcatcagtctcttgatatagagcatttttaattaaaattagatcactagaaaaagcagggagattcatttccatagcgttgaaaatgtagctgccaaatggtaagttttattagaagaaatattgtagtgtgtacgtgtgtttttcttggtctctgcttggcctttctcggttcaagggcaagagcagtagagatgctaggtggctgttggcatttggtacaaatcttcaaacttaaaagcacaatacaggaaatttccttgcaagagtaattttacagtttggcaactcaagtaatgtgagttctaccaccaggctaaaagacgactttatgaacagtttctaaagttccacagcccatactttgtgatctttgaatccagtacacactgcttcttacgtagcctgaagagaggcaggcagtcttcccccatcagcagcagcagctgcggctggtatgattctgcaatcagcgtaagaggaagaaatctttggcactgcattcgtctggccttctgaaccaagataaagaaagagccttgctgttgtcacat

SEQ ID NO: 50359 - DNA, 682 bp, Bovine  19866880928334
attacttttagggactaagctgagttaaacaaaatgaaactggttttttaactacagactttcctggagcttttactgagttaatgtgcacgataaatctttaagagagcaataaagtatatggaagtatcccaatttatttcactatagaatcattttatcctggagcatgtcataggactaacaggaggaacttagacattctattatattattctcagaatcatgttctatgatgattagttttgtcatgctctacttctgcaacaatagctgatgtacaaaatctacatgataactctctacttaccagaaaaatcgaccaaagtaccccaaactcccaaataacactagataaggggaaaaaagctaacattaccaggaagagaatggcagaaccaaaaaaaaggctacatggagagaaaagttatttttaaatctgctacaaacctcttccatgaaaagtttcacatctatttatacaaaattcatgactttaaacacttcattcattcagtataaatttgagaatacagctcaaaagagaaaaaaaaaaaaacccactgctgcaaaactctgtgaaacagtcacacgcatcattgtaaatttcaaccactcagaaagccagctgcccacttcagtactgaggtcaaagacaagcacacatcaagacaagcagcaa

SEQ ID NO: 50360 - DNA, 1231 bp, Bovine  19866880935474
cccatacaaggttaacagcaattctgttgtgaattccttggcgccctgtgtctcctaaacccaactaaactgaggccatggaaacgactaattttaacagtgccagtgacatgccttatctctgagcttcccagagcaggaacatcaccccggcaggatggggcagacttaagaagggaaaagggggaaaagccgggagggacccctgattataatgctggatgctaaatatgcaccctgtgggggtacccacagctggaggataaagacacacacaccatgatggaacagccagtttgctgaaatatattttggggaaagtaataagtaactttaaaatatttttaaaccagaacaaaactagatctcttatgaaggagaatgcaaatgacatttgaattcttaaaataaaacccaagaattcccagcaatattcagtcagttccacgacgtgccccagctcccccggggctgcagctgaccctgcctggacgtgcgaggccacttgggtaggagatgtccagcagtgctctggctgaaggaggaaccacgtccgcagagcagtcttccagtgtgttcgcaaatttggtcgcttttcctgagttcttgctgcatgtctggctctgggcccaggggccagggtgccaagatgtctaagacacagatgggggccttgtgcgcagacagtcattgtctggggtggaattgtcattgggcagtgcaggatggccaagctaaagtaggggcagggacagagaaactgcgaaagcagtatgtctatgagctggatgttgaaagatgataaggtgtctgtgggggtggcggtggggtgggctaggggtggagaaacccagagaacaggctgctcccacctttcctaacagttagttacttgggcttctctgcctgggtactcctccttgactttcccctaaagcaacaaaaaatcaaaatcagtcatttgtatttatttttttgtttcagagaaatgaaataaaaaaaatttttttagtttcaatcttagggttcttcccaacttttttagggaacattggaggaaatacaaaatcagaagggcataaatattcaaaaggagatggcttatgttgcatagccccttagggaccattggaccaccacaaatgtaattccaaaagccctgaattaaaaggctctcctgttttagaccatactgctgctttctaatgaagggtcgttgtaagatgctgtg

SEQ ID NO: 50361 - DNA, 1821 bp, Bovine  19866880959358
ttgtagcttattaaaaacgcagaacaatgttgctgtttaaaaaaaatctgtatttaatattgtttaatccgatgttttcaaataagagaaccatcccacacacactaataggagttcctaggcaggctgttttaaagcagtgaactgacattgggtaccctgttctatgcctcgtagtccataaaaaaaaaagccttttactactgaattattttattgcctgtcatcctcactgtctgaaagttctcaaattaattcagttatcaagctgtgactgtgcctatactatcccgtggcaagtaggcctgttcattacagttggacttgaaacctgaatggatgtttaaaagaaaaaaagattagttatcttattaaaatttattacattaatttcaagcttgaaaaaaaatataagaagcaataaaacatttatgtgctcaccacccaacttttagtttctcacattttgcttcagactttaagatgtggcagggagaaaggatgttcctaagaaatgaaacccctcagatagatttgcagaccgcaacccttgacttagaccttgacttttcatgctttttttaatatatattttcaagtgcaaaattagcttaagtagcactagtcaagataaagagcattgcctcaatcaccctgactttagttacccacttagtgatttttttaaggagacaaggaaaatcttttgtttgcttgtagagttatcgctgatttttgaagattcaccaagatcttcattttcaagatgctaagctttttccttgctccccattattaatacacactctccgtagaagttgttcacctgtacagccttcctttgtcttggtggcattgtccattttcagatttactttaccagttagtttgactgatcctgagatacttgtaggaaagagagagaaataatgagtaatttagtagattttaaacgtatctacttctaccaaatctggaaaggaattctgtatttttggccttctaacagtgaactatattggttgatactgttgtgagtgagatggtgaaagaaatcagtcatgtcttactgggatgaggtagctgaggctctgtgttgtgtattgtgaggaaggcattgttaccatgaggcagtcttccagtatccttggaaatggacgccaaaatcttgggtcatattgtgtcaaaaaaggtctttctaaaacttggttctcttcctctagtgtggtagaagaggagacacggcggtcccagcaagcagctcgggataagcagagtcccagccaggccaatggctgcagtgaccacaggcccatcgacatcctggagatgctaagcagagccaaggatgagtacgagagggtgaggctgtgtgcgctgagcaggaaaaccagagcagggaggagacctgtggtgggtctggtggactggggagctcacctccagggccagcaggaataagtagttcagaaagaaaacatgtcttatagataaggaaggggattttcttacctctgaaaattcagagtgttctttttctattcctaaaaaattactgcgggagaaaaggattttggaaaataaaaggtcccacttcctgggtaaagaaatgtacattagaacccatgagacgtttcaagttctaccagattcctcaatgtctgtcttagagaattacaaagaatttatggatctatgaaaattaatacaggaaaggcaatcatctctataatgaattcattgattcttaggaaactggatgaagtaaataaatttcaagaatcatttctgagcttttaagttaccatgtattaccataaa

SEQ ID NO: 50362 - DNA, 1285 bp, Bovine  19866881012555
atttttaattgagggataattgcttcacagtcttggtttgatttctgccatacatcaacatgaattagtcatagctgtacacatgtcccctccctcttgaaccttcctgccacatcccaccctttgccactgctctaggttgttacagagccccggtttgagttccctgagtcatacagcgaattcccgttggctacctattttacgtatggtagcgtatatgcctccatgctaccctctgcattcacctcaccctctccttcctccaccgcggccccccgcccttgtccgtaagtctgttctctgagtctgtatcttcactgtcgccctgcaaataggttcatcagtaccatctttctagattccatgtcaccaggggttttgaatgaagagtcagtgtgcttgagcccctgtatttcagcggcttttggtgctctgggccccgaaaggtcttttatgccataacgtcctcatgtaaaacttaagtgttacagagaactgcaaactgcatcacacgtaccaccctatgttcactgaagagtcttggctgggcatcaggctcttcctaaatgtcagtctgcttctataatctctgtgagtgaagcactcagtaacttctcctggcccttacagcaaagcccaccagccccctgtgcttgtccacagcctgtctttggtctgtctatcacattcactttggcttcatttcctggagtacccaggccatgtctcttctgctcctttgcaggccttgcaccctctgcctggagcaccctttgccctccttgtcgcctgactgggttctccttacccttcagtccagtccttgtcctcacttctcctgcaagccttccctggtgccagcccccagcctcagggatcccctgagcctgttctgtgcttcctgtggggctggaccagccgaactcccattgggagggctgcctgtctggttatttctgcatcccttccccagggtaggaacttgccgagctgaggatgtgcccagtggttagaagagagcccagcacacctcagtgggatgaatcaagtgccaggcattttgggtattgactgaacttgagttctaaattcacatgtggagggctttttttttttttttttttcctccatatgataaaattttttctttttcccctaataatttctctctctagatgttcgggaaagtggccatgagagataacaaccagatcaacagaaacaacaatttccagacctttccccaggcggggctgctgctcttcaggtgaccgagtccagt

SEQ ID NO: 50363 - DNA, 1093 bp, Bovine  19866881023858
ttcagtcactatacaaactgagctataactttccctatatacatgtcacctctcctcagactcagactcttcaattaaaggcaggggattcacagacgcagaagcccccagaggtagcctcactggggaccttatgcaggaaatgctcacaagacaaccatggagtcggaggaggtagatttacacatttgtgagagagtaaggcaaggaccacctgaagaaaggaggacccctttctgctatgctttaatggcaaggaaagagaaatgttaggacatctaaatgaaaaacacaggagaatatattcccaccaaggtgagaaccttaaatcaagtccagagtctgtgcctacacacaaatgatggtagccaggaggggggccccagatgtagatctatacagaaaatcagcacgcggagagaacagtccgaaaacaccagctgcttcaagatgctcaggctctatcctcagatacagcggcgtccccaaacccagagacaaacacaggttgaacaagcactggcttgtctgctcaaagcaccaaccccatggaggccccggtgcctccactttaactcatcagcagggagcagagtggcaagaagacaccaggtgaggtactgggtttcagctctgctatcatccagctctgggacctgggagcctgctccatggccccctcaccccaaggccatagttttcctgtacttaaaatgagaacattcaattgtaactcagaatctttccagccctgaggttccagaaatctattgagtatttagcaaatatcttctctgtctcacatcagacaaggcccggaggaagttatagaataatgttaagacagcactctttcttctgaattgaccactgttgtagactgcttttgaactgtggttttggagaagactcttgagagtcccttggactgcaaggagatccaaccagtccatcctaaaagaaatcagtcctgaatattcattggaaggacagatgctgaagctgaaactccaatactctggccacctgatgcaaagaactgactcactagaaaagaccctgatgctggggactgaaggtgggaggagaaggg

SEQ ID NO: 50364 - DNA, 1154 bp, Bovine  19866881062392
tttgaactgtattctctgtcgtaggcagtacccgtaaagcaagacttcagatcatagataaagcagaagataaagcaaggcttatctgaaaatactgtagtgaacataaaaataggatgaggaagtagaaacaggaagcagaaagggaaaagaaggacattcaggtttccttcactagagatgcccaaaagaggggcatttgcttaaacgctcagcttgttttactagaagcagtggtattgaaagtgattagcaaatgcctgcatgaagctgttgatagtgagttttcaagtgtctggcctatttatggctgaagagaataccaaatatgttcacattaactttgtgataaatggcgttctggtcaccaaagataaaaaggttatctttgtcttcctttgctctgactttgcctgcatacagcctcttttcgctacgtatttcagaatataatctctgttagctggagagacaggtaaaattctctgggacatattgtgcatctaaataaaagtgcctgccactgcccattctgttaaatctagttctttctaccactgttttgacagctgcaatataataaaaattcttgaagtaaaacattgatttattccaaaaggttgttaataagaactaagaaggtatatagaacaggtaaacttctagacctgttctataaataaatctggaaattctctttgatcagtagcaaaattgaaaattcactaaacttggaaaatgttgcctctcctaaagaggaaatgcagtctgccaaaaagtgtttttaacaaaacctagtctgaatgtttgcctatacatagactataaaatttggagaactgatagaagtgagccctattcctgatcttacaaatgtcttggggcatactttgggtttgggaggaagggagaggggcagggctgttcttcccagagtgtgattagaagaggccttagagtccagagctcggtgtgccttccatgttgtcagccagtttctgctctcagcagtggagagctttataaggtagcccgttgggtggatgaacagtggtgattattagaaatgtttttcttttgagtgaagatcacaaatccagtccaggtcagagaggtgaatactagaggtgaatactagcaggctaagccagaca

SEQ ID NO: 50365 - DNA, 1839 bp, Bovine  19866881066262
taggtctcttttgccctgaaccactggcaggggaaatggggttaatccactgactatagtgactaattccggctggcaaggggaaactgggttgcttttatacaacggagaccagcaggcggtacagcaaccaggcaattctccagggcttctcttagtacttccatgccctatcgtaaaggttaagagaaaactctggcaaaccaggcaaggaactgtagatttggacccttcaggaagatgtaggtcattccaccaagtaaagaatcctgatctgctgatgctgtgtctgagagcagagcaaatacaaactggggagcagataaaggaaaccatcgatggcaactatggtcacatggtgagttacagaaattaggactgtagcaaacagaaattaagactgtagcaaattttttctgttcatctgttatatgtttattttttcatttgtacatgttattttcttttctctccttcccattttgatgtcatgtatgagctgttggaagttaacttagttaagaatttcatcaataggcaacagaatattcaatgggattgtgatgaggaggagtaattaataaagtcaggcaggaattcagtggctcctgggactgtgtctcctcactggggttacgggtgagagcttcttcacatgtaacaaagtaagctgcatctccttaggcagaaacagtcctaggtcctcaccttgtcacacagcagttcaattgtgtcgacattctaagtcagctaaagcacacatcactgagtccttctcactctcttaacctgactacttctaccacaccactataactggtttttctgccctgcttttcagatattaagggtccatggaactcactggtccattaacccaggataatcccctacctcaaagcctgttgatcagcaaccttaattctatcgacaaagttccttttgtaatatattcacaggtgtatcacctagggcgggggcaaagacaatggggacctaaattcagcctaccacaccatacgatccagcaattccaatctgctatttttcccaagagtaaaaaaacattgtattaagaaggttcatagcagttttatttgtaataggcaaaaagatgtttccagtgtttggacccaaatgtccaacatgaactaagtggataaactgtgccgcatctatacaatggaacatcatcctgcaataaaaaggacaaagctttcataacccacacaagagtacatcctgaattatttcatttctatgaaactccaggaaagacaaatctaacctgtaacagtaataaaaagcagatctgtgctttccttcagtcaagaataggggtggagactgaccagacaaggcacaagggaacctgacggtgatgggaatgctctgtatcttcactggggtggtaaatacagaggtatatacatttacctaaactcaacattctgtacaccgcaacgtatacatttcactgtctataaattgtacctcattcaaatgggtaatttccttcctcaagcccttgcaggaaccagaccccacatcatctacaacctctgagaatggtaaagaatgtccatattcctgggcctgccactgtgccctgcacccagatcctaggcagctgtcatttccaggtctaccctcctgtcttttccttccatggtcagggatatcaaagcagccagctcccatcaaggtgtgcaggcaataatgcggttacatgtagttcaccgtaattgaaggtaattcatgttgtcacatctgctgtaccagaggtcttgtgagccagtgagactgctcacattaattgtaactgacacctcttctctc

SEQ ID NO: 50366 - DNA, 1904 bp, Bovine  19866881094395
taaataaatgctcattagataatatgagagaggctatacaggcaaacttgtctgaaagaaaattcttgacacctgaaacctggggttgagagtctggctctgttttttattaaggtcagtgttcactggctgactggttctcttgccatgggggtgcagtggtgatggagactgttaactgggtgaggcgtgagggtgtaattgaaaagatttggaagtgggcagtttttgaatcctggtttgtggatggcacactgggttcccattctgaatgtgtaggtggaatggctctgtgggtgcgggattttgcagaaggaaaagctgcaggcagagggcataatacagaagatacggtgagcaggcatttgggtgactggccagcagacaggaagttagcctagtcattccgaactcattagtctgggagcaaagaatgagctgtaggctgtagttcaatgaaaagagaggcctggcatatccttaagaagaaggattaggaatggagggtttattaaagggtcattgaacacttcctcatccccatactcatttctttctgtctgtagctaaaaagcctgtaaaagtttcttagtgaagcgatcacaaaagctaagtgggatgccagggtgggtcggtgatagcccttggaccagcatctagcagctggtttggtttcagttttgctatgaatggggataggcatccttcctttttcagagctgccatagagctggaggaagcagtggttatgaatggcagctttgttaaccattaagtgccattcatttatatggaaacattgcctgtgatgtggacatagcatccaccttggcactggaagagagagcagtctctgcccctagatggggctgggggtactccatagtgaggatagggccccagatctaaggatctagagacatgtgccattaccttcaaatcatggtctgagatgcaggaatggctccctcctaagtccattgcagggcagggctctgtgctgactctggtggtacagctgtaatgactgtctgtgatggtttcccactgaggctgttgcattgcgtgacttgttatacccagtttccagaactctgctgtgattccatttctttgtcttcaagagtgtgatcattagaggtaatcttggattcatctaactgattaaccccacccccccaaaaaacaatagattatgcatggattttgctactgttctgttaggaataaatgacatgcgataccccacacagcatttgtcgagataagagccatgaacccaggtagagaccaccatggtgggctaccccgtgtgtctggtgctgaggaagttattggggagatagatggactgtcgtttttctggtcccttaaagtacttcagtctttctgggaagatagtgaacaatccaaatgactggtaggcttttaggttttataggagttgttcagagagagaagaggattcagaataattgaagtggtgtaattgatcagcacgctgaagggcaggcaaccatggatcacgcaaaccagagtaataacttcaatgcagaacgttttacattttatagctttgtgaacctgggatgtcttcaggagccagacaggcaacaagaaatcagagaagcagttatagatagtgagggctgcgctataaaaccagcattcaggaatttagaagagaagcatggtatgctgctgctgattttcagagctcaggactattcttgtccatggataagaaaacatcaaacacagtcaaaccaaggcagtgctggcttgtggcctgaagcctgcagtgccgatgggcacagctgtgctgtgcttcccctaaaggcctgggccctggggactgagccacttgggaagaaggtggtatgtctcctagtgtctgccctgtg

SEQ ID NO: 50367 - DNA, 1264 bp, Bovine  19866881240638
acgctataatgcagataaatttaatcaatggttcagaaaatagaaaagaagaagagcattctgactcattctacaaagtagacttaaactgatttcaaacttgcagagcacacacacacataaaaactgtgggtcttctcacttacagatagaaatgcttagagcaaaccttacaatgtatttaaagaatgctgtattccaactatgttagatctagtccctcagccctcagcatccactcccacctccttcatcgtacctaccattgctatggagaatggaaagctatgaatgacattttccagactctcccttattttcttgatgcaaatttgtaaacaccaattaaattcaatggtgtgtgagacttgggagtaaaaatgaagcaggagctaactttctattgataataaaggttttgccttccaatgcaggaggtgcaggtttgatcccagttcaggatgcaaagttcccatggccaaaaagtcaaaacataagacaacaatattattacaaattcaataaagtctttaaaaagaagagaaaatcgtgatgagggtggcatggaggcaaaactctctggatgctgcagaccctgggatcaccgttactgcagtatgaccttgacctcaagagcatcattcaagaatcaccaactcggagagatatagaagctgaaagggcccaggcaccaccattgctctggaggggcaatggacatcttagattgacaagtgttggacagcaagagtcaatcccaatgaacattatcttttatcacaggtttcttctgtggaatagctgagtttgtggttttgtttttcagaactctacttcagcaagatgtgaaaaagagatgaggttatggaagctcatccaattccagatatgatgaaggaagagggccatcaggaaagtaccccctgtccccagaagaataggttgaatttatcacttagccacctgcttggccctaatcctccttcagtggccagtggatgaggaaggtgcatgtctgcattaagaagcagacaagtggacatgaactttcatggcagaaggaaaccagcaagaaacagaatgctgaccacgctggacaagccagatgaacatgtgcatctaaccaaggactgctctgtgtcctcgcactcgaatgaggttgtgctgggaattcactctgcagggatctggcaggactgaaagcagctctataaatgcacaggtttgtctcatctttttgtcatttatctaagtattaacacac

SEQ ID NO: 50368 - DNA, 926 bp, Bovine  19866881368125
tgtaggacggttttagagtatgcagacgacaagcactctggtattagttattaaagcttgaagagtttaattcagggaaaaattatttactcagtgaaggggtcagttcttgaacctgaactcttcactacataaaagagatgttgggcaatactatggctccagaaataatcctcacaatgaactttcacgcgcagcccgtattcatctacccaactcccaggcacagagttgaagatgggtgattcttgctcttgggggaggcagaagctaggataacaggcagaagttatattagggtatgtttttctttatgtcttcctgttttcctttctcttattccttttgttctttctctcctcccagccccaccccacctttctttaaaaaataggcacagagaatacatactatctgtttgcgttttctgttctagttcagaggagcgtctcacatacctgtggcctgacactgactatatacaatgatctattccaccctttatctctcatatacaagtactgaacatcttattatgcaaggcatcacgtgagactcatggccccaaggagcttatgattgagctcatgactcagggtagttcagcatacaccatatattgtacaggtggacagggagagagtgtgttatgggtaggtaccacaggaaagagcttctgttctggggatttagctttttgcaatagaggggttttcttcttttggaattcacttcaattttataatacagccatgcttttgtatatactcatgaaatcgtgcttagtggacctaggctcggcaaacagatgtctttgcccaagaaagttggaagttgactgctgcacgtttggagagatgaactttccctgcatttcacagaatgggaggatttgtttggtagaaatgttaaacacgggtacttta

SEQ ID NO: 50369 - DNA, 1165 bp, Bovine  19866881379170
ccctgcccagctgtaacacaagcagagaaggctgagctcggaggggaacccagaaacctgtggcccaggtttaactaccagacgcccctgcgtctgaagccaccagatcttcctcctgaagttgaaagtctagttcatcttctttgcaaggctcccaagcagggtcctcagatctccctgtgatccgaggcccccgttccagtgcccacctggggcaacttggtgcacctgcatacagctagcctgagtcttcatgtccccgtcttcctgtctagagtgagggtgtaaagggtcccacatggtctgaacctgagggtttaaattatgtatcccagcctttgacccaaatgtcacccccatccggaaatttcagccttcttttggaactcctccttctattgccacgggatgaccgcctggtgcccacagaccctgaggggctggcctgggaaccggctgtgtttctagccccaatggctcaccatcctgctgtccaaggcctgcctaatagcctggccacctgcctagccactgtggccaagatggcctcagcctgtgcctacagaaggctacaggcagaggcaaggccaaggcatgtgaaagtggtagggtgggcaagtagcctaaaggtgagacttagctccctggggaagctcctccttgccaacctgtctctttccactgcaggctgctggacattgacaaggatgcatatgtgtgcctagggagctcagagcctagggagacagacgtgaacagctcagctgtctgggtccagtgctgggcacaggtctagaccctctgcaaccaacatttcaatccatcctcagagcagcctcatgggctccggattttacaaatgaggaaactgaggctcagagatggctgacacttgctcaaggtcatacagccagttagtgtggaagcagcatgtgagttcttcctactgtggagcctctgtacatgtggtcagtgccccaggaaagaccctggaccgtgccagtagtgggatggaggtgagggcagagctcataggaagcagaggccctcctcagttagagacaggaatctagaggaggaccttttgcatggggtcttgttagatggttaagagcttaatggaatggcattttaagagcaaagcacaacctgagcagtggccttg

SEQ ID NO: 50370 - DNA, 715 bp, Bovine  19866881395287
ttcccacactgggcgggggatggccctggccaccccccaagtctctccaaccccagtctccagcccaggctagcttctccagggggcaaggagaaggaatggaaggcaggcgggcagagggctcttccccccatggggcctcgcatacgtggcacgggagagctcgaagcggcctttgtcctggatgtggtacatcaggtcgcccccattgaggaactccatcacaaagaacaggtggtcctgcgggggcgggaggatggtgagcagagggacagaaaacgaagggaggcaccctgacaggatcaccaggggcaggccctaacaggatgtagggaacaacccctgtcctgggggacctgcggggggaagaatagccctgccctgagacatctgaggatgggggaactcagccctgccttcagggatctgaggaagaagaaggggccctgttttggcaagtctcaatgggagatacagccctgacctgagcaactgaggagggctgtgggccaggggcactgacagtgggtgggccaggcacctttgtctggaaggtgcagaagaggtgggtgagaaacggatgatccccggcgagggccagcacccgcttctccaccatggtgcactccacgtcgtcatcgatcaagaccacgtctttcttgagagccttgatggcgaagaattcctttttgcccttcagctctgcgagcagcac

SEQ ID NO: 50371 - DNA, 1453 bp, Bovine  19866881423033
ttgagaatgcactgtaacctaggaggtagcagcttaacttttctcaggactgcttagacccttttaagtttgtttctatgccttaaaagtcaaactacctatatgagtgacaggaagaattaaaatcatcctgaagcagccatcctggaagcacaaaatgctgcagagaactggtcataggcactacctggtatgctcacctgtgctgggcttgtctcagataagcaagctgcaaacctgctgggctagttactttattaaatcttctatcagtgataatgtaatgaagggactggaccaccaccaagttactgttcactgatcaaaaacaatctgacaagaaaagcaaatactcaggagactctggtggcctagtggttagaattctgagctttcactgtggtggcctagattcaatccctggtcagggaactgagatcccgcaagctatgcagtgtggccaaaaaagtgagagagagagagaaaagcaaatactcaaaatgctagctagacaatttagacctaaaaacctactgtctcccctaaatgacttgcctatataaagctttgctgtgagtgtgactgccacaccagtgaaagacacagagctaacatacacacttctgtgggaaagcacacagcacacactagggctttcatgaacccaatgatgtgagctcacattgttgttgtttttagtacttaagtcgtgtcccaactctctgtgatcccatggcctgcagcctgccaggctcctctgtccatgggattccccaggcaagaacactagagtgggttgccatttccttcaccagggaaccttcctgacccaggaactgaacctgtgtctcctgcattggcaggcaggttctttaccacggagccacccaggaagcctgggctcatcatgtcagagggttccaacggaaccagtttatagccttattatagcagaaatcaccagtttatagccttgttcaaatttgcacttccacaatctcagtggcttcattaaaaaaaaaaaaaaaaaaaaagtcaacatataattccttaaaaaccttctaactcaagatgcttctagttgaataggctgtaaaggaagaggaagcagagaatacctctcaagctcctcaccgagtgttccgatgagagaccccatcctccacacagcacacgcttgtcttctggtctccgacatctacaatacacgtgctgcttaagccacttccaaaggtggcacacacagactcctgatggaccacaatccctgaaaaacaaaaggcagaggggtgatcagctggggagcagggaagatcctgtgacaaatatctagttaaagtctaggaacccccaggcaagcatcactgaccctcccagaataagcatttcagtcaagcagtgaattaaatcaactgtgtcaggaaaaaacaaaacactctcatttcaggtaggt

SEQ ID NO: 50372 - DNA, 1070 bp, Bovine  19866881465058
cctgagggtggcagcattctcccccagcctctgcaagccatggtcaccggtcaccagcctcgtgggcaccctgggcaggagtgggggtgagcaccttgggagagcaggcctcgtggagaccccgggcacaccggcactgccagggtggtttcctgggagacagcaagagccactgttctgcctcatgcatcgcctttaatcaggctcagcggaggcccagctccctgggcacgcacggtggggctgcttctgaacaaagcagagacagggcagccagctctgaggtgagctgcagctgtcactcgcagtatcgaaaacaagcagttctgaattacaaaccgagacacggcatgtcgaggctactggcagagaattaagggggcacttggaaatctgggtctgcggtcacttttcggaattggcctctccttccgagcttgtctgtcacctttctgagttctctatctttctctccaggcattggggtttggatggttaattgtccttggtgttcgcggtaattacacatgcaaatccctatgcacgggtgaaactatgacccatgaagcctttttttttgttctgtaatttttcttttgagtcaataactgagatggcacttcatggtgttactaatacgctgctctatgaaactcatgacaagtccattattttctgcaattttgagtatcagtttatgtaactgattctaattttggggcttaactgctttgcacaatcttgcttttcgctagatttagtttcccgtgtcctaagctgagagctcagtgcccctgccccctccctgcccaaagcaagtgttgaggctcttggtgcaaatgtgctgattcgggagagctctgtctggtctctccgtttagatgatgaggtaaccgtggggaagttctatgccactttcctgatacaggactactttaggaaattcaagaaacggaaagaacaaggactggtgggaaaataccccgcgaagaacagcacaattgccctacaggtgaattgttgtttttgtctttttctctttttcactaacaattttacaagctttattg

SEQ ID NO: 50373 - DNA, 819 bp, Bovine  19866881631727
aacatatattttaaaaacatgtttctgaaggaatcacacagataaaagggaaacacaactctgcatttccccctttcaaagtgaacggtattgcatcagagcatttcaaatgaagatgtcacacacaaagccaagtgaaacattgcacatgtctctcttgctgaaaaaaaagggctcctggaggcgacggcccactcagggaaatgttctcaagcacaccttttaaagagctcagtgtaagttgctttacttctttcagatcttaacattttagacacctgaaaacgcagggcgctactggttccagcaggccctttgaatacaactgaagaaaaccaaagacaggtaggaaagaaacatgtgctcagcagcaaacgtgcagcaagaatgcaggacacacgtccctgtgagtcctcgttttcactcacacggaccgagcctacccgtgcctgtgccgcctctcattcctctgtgtttcattttgcccagagttacagtatgatggctgatttcgttttttaagcagttaggcaccttcaatttcatgttgcattattagtaatacaatggcagttatggcctctactatcaaaatgagaaaaatgtcaaactacattctttggggaggagagtaataaagctgcatggtttaaaaatatttacctagtagatttgatggggtttaagattttttacaagaacacacaggtggaaaaagaacaattcttgacatgcaaaatcgggtcctattctcaactaagcctgtgcctctcggcagagaagtacccaggtcaactgggctctaacaaaacccagctc

SEQ ID NO: 50374 - DNA, 1365 bp, Bovine  19866881634056
actgtaaagaaacccctaccaccctacaggtagaagatggaattactacttagttgacgcaactcaaaacatgatgtgaaagggcagaggtcagctgtcctttttatgtatggcactgaaaatcctacagttacaacccaccccacctgaaacagagtactctgaacctaaatagtttctgtgaatttatgtgaaaagggatgggcttgatcaagagaactcagtgacagggacttagaaaataaatcttttgcagcatctttaaggtttaagtactggtatatttcagatcatgtgtatgaaaggaactttagggatattttcctctctggcagtagtaacacctctgatgctcagccagcgtgccctagcaaggggtcatttatctgccatggtttcgactggcgtgaaagcctgttacttgctgtgcagagatgacataatgcttctctcccccacagaaaggatcaagaagacttccttctcaactaccacgctactgccctccattaaggttcttgtggtttacccttctgaaatatgcttccatcacacagtttgttacttcactgagtttcttcaaaaccgctgcagaagtgaagttatccttgagaagtggcagaaaaagaaaatagccgagatgggtcccgtgcagtggcttaccactcagaaggaagcagcggataaggtcattttccttctttccaatggtaacaccacgtgcgatggtaactgtgacgagaaggagggcggcccctgtgagagctcccgagacctgttccacctcgcttttaacctcttctgcagtgatctgagaagccaggctcatctgcacaaatacgtggtggtctacttcagagagggtgacatcgcagacagctacagggcactcagcgtctgccccacgtaccgcctcacgaaggacgctacaggtttctgtgcagagctcctccgtgccaagcagcatgtgtcggtggggagaaggtcacgcacctgtcactacagctgctgctccctgtagcccagccacgaagcaggagaccctaaagccttctaacccctccaatcacagggaaaaaagggtctgtaagcatctcaagtttaccatataggctacttgcagggaggattacagctgaaccctgaacaacccaagggtgctgacccctctgcagcggaaaatccagggagaacttcacagtccatcatctctatccatggctcaaccatctgcagatgtgtagtgcattacttactgaaaaaaatgcacttaagtgtatctgcccagttcagacttgtactgttcaagagtcaaccatatgtatatctgcttgagcaaaaggaatagggaggatttacaacagg

SEQ ID NO: 50375 - DNA, 2266 bp, Bovine  19866881663276
ctgtaggtctgtctgaggagatgaaattatcagtgcaataacgacagatttctacttatctctgtaaacttgtctttgttttccttgacgtgctctatttttcatcagaacagccaatgtgtgtcattcatttctcttctaggtttctgtgactctccgtccctgtttggcatcccccatccagccctctgtcctcccagccagggcgctggttcaggtgccttggacaacactctcgcccaggctctcggttacgccatccatgaaatgggcgtgcccgagcctctgactccgggaccgcgccagcagctaagggcgagagggcgccgccgcggcccagaaggcggcgccactccagcctccaggcgccggcccgatccgggaatagagccgggtctcttatagccgggcctgagtcatgtgacggggcggacacctctgcccgcggctgagaaaggcctcttgggggcccggcggggcggggcccggtgcgtggtagacacatctgcgggggcgtgtgcgcggcagccgctgctgcgggcgaaactgttggggtggggtcggggtgtgcctggtggtcgctctgcaccttgtcagcttagggccgctcctacccgcggtccctgtttcccaaccgccaaaccgggcttggtgagctgcccgctgcggagggagactgaggcaggtgagcaagccagggagctgatggagcccgcggcccttcacgccctgtgggtgacggagccccctaccacccccgactcctcaagtgtcagagcctacagtgagacctggcagatcttagcagccgggggtactgctgtgtgcgggtgagaggtaggggtggtgctggaaactgggagttcctctgggtctccttgccagggaatatctattactttgtgactgcccctgacaacaacacccacccatgcccctttggtgggcagaggggtagaggaggcggaagagcagacccggaagagcaggggttgtgcggtggtcagagcaggaccggggtagtccaggggctccttaccctgtaagaaccctaggaaagctctgtgccctgaactcccagaaagcaccttccccttgtctactccaagtatttctgaagttccacccaaacactgatgtattgaggacaggagctgtgaaccattagctggcctcactaactctttcccagttaacaccagtatggattgagctctgctcccagagtaccccacaagcttgatcttgtccatcttctcagccacctaccaggccagtattactgttatcgtgcccattccacagttgagaaagctgaggcacagttaagacatagggtgtaaacttggcctctccaggcccctaatctggcacttcctgccgtttggtactaccctcaaagcctctgcccttactacccagtgtctgaggcagaaatccaggcccacgatcatttcagtgacctgaggcactgctacatgttggactatgttccaagtgcccttctcgcttgcgctagacccagcaggatccatccaggttctgccatccctaggagttgcggaggagcaccatctctgctagcctggcctttttaaccctgaaacatgagccccactctcccttggccagcctagtgctctgggtgtgatggggggtggtgctggcagccaaagcctcagggagagggatggtgatagagaagcagtaacaggctaaatcaaggaccaactcttggcagggctcaagtgagggaccccttcctgccggctcaggtggacagtccgcccccagagattgagggatgtccaggtcctttccacgttgcttggttgagtcctggacttcctgtggaggggtctgcgggcctccagggttcgtggcctctgtggcgtagtggttgcaggggtcaggctgcccctcctctggtctgaccctccgggagcctttatggggacagagtggatgctgggggtgggagtctggtggctggctgctcagtgctgcctctgatgggcccgtttccttggctgcaaacctggagagggaagaagggaaagtaccacttctgggtggctgctgtggacccagccaagcttagggatttatgccccatgtcatgacaggctatcgaggactcttccaaggctgacagcctgtgacttggcaaattgaccttacctgtgccatggccaaggtgagctgagcctcaccaggtgtccaccctggctgaagctccacgcacatcatctcacacaacacttag

SEQ ID NO: 50376 - DNA, 1836 bp, Bovine  19866881675874
tgctcctccccatgagaccttgcctgcactgaccccctgcctgcacctctgtacctggaccatgtgcattgccgggctgtctccctgtaaaccttcgtgtccctttgaccgagaactctgtgaggacatcctttcaggacatgccctctgcagtacttggactggcgaggaggggcagggatactggtttgtttccagggcacacagtgagaatgtgtgaaatgccggtcatagtgctcaagtgggctaaaggaagtggggtagttggggcccccatgcaaggagtaggagggccttctcctccctcagcttggggttgtgactctgggtgccagggcaggatcgccacgtgcctccctcttatttgtcctgcaggtatgtggcttggtccagtgccgcctaggaccaagatctgcattgagtgtgcgtgcatgcatgtgtgtgtttgcgagtgtgtatggactctttcacacatttaggtgccccaccccacatccctctccactggtggacggtgtggtcacgtccctttggctcctggtttccgtgggtgctgcggggcctgggtatgtccccatgtggtcggcgtggcgtctccctcctacatgctcatgaacgtctgcccctgcctgctctgtccaggggtactttagtgacgcctggaacacctttgactccctcatcgtaatcggcagcattgtagacgtggccctcagcgaagccgacgtgagtatgtgcccgcccagggtgcctcccgtcctgtctctgtctgcacaccccccccaccctgcactgcatcacctggacaagtcacagagcccgatcgcacttgatccaaaaccaggagtttgctagggagagcatggaagagaggccttttagtgtagaacttgatccgcaagccttttgagacacgaatggtctttggcgggactgacgatggtacagtaggcagggcaagacagactcgtgactatttttatttgctctgtcagaagcgatacccaaaatgacgtacctagtatatttttattttagggcgattttttaagtagccaagcggctccgtgctagaatgttcccctttgataacactgtccttttcttctttttttcctgttgtgcttcctcccttctgtggcttctggctgcttgcctaacagcactatttcactgatgcatggaacacttttgatgccttaattgttgttggtagcgtcgttgatattgctataactgaagtgaatgtaagtagccaactttgtgtcctataaacctaattgtttttgttaagtctaacgtggaagagaccagaaaccctcccccatgcgtctctatacacgtttagaaattcacgcacacatttgttccaagggcttccttggtagttcaggtggtacagaatccgcctgcaatgcaggaaaccccagttcgatccgtggattgggaagatcccctggagaagggaacggctacccactccagtattctggcctggaaaattgcatggactgtatagtgtatggggtcgtaaacagtcaagacacaactgaacgactttcacttttgttccaaaagactattttccctcccgcccccatccccttcccctgaatgacagtggggaagtaaacatggaattgccattttggaatgaaaacatgattagtaaagaccttcttaagatgttaggggctgggagttaattgtgtgggtatgtgagcgttgccgctcggtagctgtctgaccttggcaaggcccccagctgcttcatgcctcaatttttccagctggaaaacagagttgataatgtgagccctggtgcccacccgtggg

SEQ ID NO: 50377 - DNA, 1178 bp, Bovine  19866881925116
aagtcttttaatcaatgtttactaaatagacataatttaaactttagaaagtgagctctttttctgccatgttagtgttcagtggtgtttaagtatgtctattctttggccccaaaaagttaagctgctgctacaacccggttacacttagcagccttgcttatgaatcacagcgtttcctcacctgcctgtttgccagctggcacactgttgtgctgtaatcccaggtccagcagtctttggctcagtaacttttcacctgtatgtgtgtattctaacctccaccccagagactttctcctctgtctctttcccaaccttttgatattgctatggagccaccaggcttcttcttatcttaaaggaaatggtctgtcaaagcgtttgtgttttcagttgtcagggcatgcttatgtatatgtcatctattctattcttacagtccttttgttatcagaagagtcttccttattccacagtaaatatttctggttatgttcaaagtacattttgttgtgtttgtttcctggtctagaggacatttgttggtgccatcttcacaaatgttataagtcataacaccattgccaaaagctttatcaaacccccttttcagcttggcagcatactgagaaaatctccagccacctcagatccttttagaaagtaggtcagatgtaactaataaatgagtcaaaaaggcagcacatgcatgaaagtggtccccaggtctgttttagtgacattttaccagattgctagaagtctcaagggattttgtaagggctccaaattaatttggattttcttgacctcgtgtgtgtcatacaccactcctgatgagaagcagaatgaggtataacatcagatcataattggctgctgaatcttcaaacaggactctccagggaaacagatgacttgcccttcagcttttgaaaatttctcagcattaaataatccaacaactttgatctttgtcagttgcacttttcatatgttcaaaagaagagggctgtcatttgagaagcaagggaaacagttaattttgaatatgcttttctgcattttgatattttttatggaagtacaacataaagttatttaaatgtcctgtcacacccgctaactcttcagggacagcgtgactaattgggacaatggttaacagccacgat

SEQ ID NO: 50378 - DNA, 1100 bp, Bovine  19866880357522
caaccctgtggactgtggcctgccaggcctcctctgtcatggggttctccaggcaaggacacgagtgggttgctgtgccctcctccaggggatcttcccaacccagggatcgaacctgcatctccttcacctcctgcactggcaggtgggttccttatcagcagagccccctgggaagtgcccagatgccccctgcccctccctgtcacaccgcacactcacacactcattactctcacatgctatcacactcaccttgtcacacataccgtaggagcacacagcctcccacacctgtgcttcccccttgacacaccctatgctcagggtcctgccctgccagccgcagggcacacacacacacacacacacacacacacacacacctgcctagctgcacactctccctcagacccacacgctcacgtgccgagggccactcagggtcacacacaccacgctttcctctgcgtgccgcccacccacgcacccacccacaagtccgcagccccgagtccaaatctccacgagtacccttgtgcctgagttcatgcctgcaaacctgtaggtctcccttgacccccccccacccctgccaccaatggctctgagcccatgagagcctccctcggggactctgtggatctgtctctgcagggagcaggcggcctgtgaccccgagcgggggccggcccacagcagcagagacgggtgagcccgccccaagcctgtggcagggaccgtctgggtcgagctggctgtgtgcgagtgggctccccatcacaggaggtttgcaagcagggtggacgccccctcagtggagaaggggaggaagggcctcagcccagagacgcttggaggcagaggggccgggtggcaggctccagggcgatggaggggccggctggggcatgaagggggcaggcaggaccggaggggcacgcaagggtggggccggccggcccagagggtgagggctgtctcgctgtggccgccataactcagctggggtggacagtttcctttctcctgcctgatttactgcctgcttcggaggggcgaggcccattctttaacttcaaagggagcagggagggaag

SEQ ID NO: 50379 - DNA, 1367 bp, Bovine  19866880609810
taggtgcccaggagggcctctgccacggggcagcgcagctggcaggactgtgggcccccgtggacagctgcggggcctccctgtcccagggccggcccccacgggcatttgctgaggacctctgaggaccacgggccaacttggcttgactgtgctcccctccccctccagccctgaaactggtaggatttctgcagaggaggggtcaccccggaggctctgtggttgcgagctgagcgtcattgttcttgctgctggaacaggtctggagccgtccgatcccaccctagggccgtccctaagctggcccagccaagccgctgtccacttcctctgaccttgccgatcccccatgtgactctggagtgtgacggctgcatcccgagcagagttctgagacttatttggggagtggggaagcacactgcggggtggggatccctggtctggaagtagtcagaagaccctggagttcaagttcagaccccctcctcccactcgctgtgtgactttgggcagacggctttccctctctgagcctcagtaggccccacctgtaggggtttggacctggtgacgggggtggcatttggggacagctcccttaggcggcaggggtgcagacatgagcctctgcgggtgcgtcgcacccacacacacacactggctgaggaaggccagtcccaggccagagggccccgcgggggacagagggagagcgccagcccttctgagggaattcgtttctcctgatttcacactcagctattggcatgcgagcagttctgggaaagtgtgggagcctttcttctctctcccagggctttctgcgaaggcggcgggtctgagggtctcacagcagcctcagaaaggaggtccctgctgttgggtgggtgccagggagggcggcccgccgtgcgtctgacctgtgcatcctccacatgtgcaggtgggcccacccttcccgcaagccggggagcttgttcttaggggcctggggctcctggaacattccagctgttagtgattaggtgtctgcaaggctgcacttcaagctgtggtcagtcttcctccccactacaacaggggtcctgaagctcccctttgagcagctgagacccgagggcaggcagccaggtaagtgtgaccacagggtttggacccaggcctctctgttccaaggtggactctgtctcaagtgctctgcagctccgacgaggagggtgccaaggtcctgggtcgggagggatgatggatcccggccccaccccaccggggtcaggcatacaccgtgggaggactggatctgggtgtggggctgcatggaggaggtgacggctgagcagacggtgacgtgtctgtgggag

SEQ ID NO: 50380 - DNA, 1626 bp, Bovine  19866880738963
ccaaaaaaaaagaggggtgggggaggtagttaattccataatggaacaatatagagaggaggacttcaggcatagctggatccaggtgcccaaatgtctccaggaacaagtttctccccctcggctttcagctcttctctcctctctccgctttccacccatagcatctctcctggtgaccaaaattcccaaaagttccagcccacaacccttcatgtctagacgaaatgaagcaatactccactggccttaaggttctctcctgatggaggggcttaagtcagatgctcagccctggaccaatcactgcagccagaggaacaggctgtgttgattggcttagccccgatcgtacgctctcccaaaagcctgggtgtgggagtgagcctctcaatggaaactgggggctgttgccagatcctggagaggaatccgtgaatgaccctcacagggtgactgcatttgcgttcttgggtttgaacttgatttcttctgcattcgattcagatgctgtcagataatagcaaacatttctgaagcatgttctctgtaaaatcccccaaaacacacatttctgaagtgtgttctctgtaaaatccccagcagacactttggggacttcatcgagctcatcagtgattggctgtcagccaacgaagccctgagccaccagccaatgagagcccagagattcctgcatctcacatggtcgctgactgcggctggactgggtaccaggaaccccggcagcaccggggaagcaacgtgggcctgataggaatgccgtcgcctgcggctggtgactaataacaaaacaagcaggctacacccattgcaaaaatgtgaagccagcaggagggaatgtgacacgagcccagtggctgattcccactttgtgaaaataccagaagcaggggattgtggacgacggggtctaccagatccagaaagcctctcctaggcccctccccggttgcagcatctccccttaaaagcagtggccagctctgggtacatccgtaaatcgttaagttgtttgggttggttttgaagtggaccttagcagaccccctgtaaacgttcctctttgcatcagtgagcacgcgcacgtcggtctgggtttcctttcagtgctgcgtaatattccaccagggtgagcacagcgggtgaatctgctgtctggatgttccaggctgtggtctggtttccctgttacgcgtgacaccgctctggctgctccagtgacataggttctagtcctccagggccagcgtccggccgggtcacggctgtgcacgttttcaagtccaccggctcaagccaaactactctttccaagtgtttgcacccacacgggctcccgccaactgctgctggcggcgtggggccgcgcctcctcgccaacccttgttaacgttggcctgtgcagtaggtgtgaaatggtgtctcggcgtggttctaatttacatgtccctggtcactaatggggatgaggattctgacatgtttgccaggggtctgcagctgctcttcagtgaagtttccgctcaggcctttcgcgcctgaaaatattggttttcttctcggcaatcactgatttgtaaagcacagtctgcccatgtgact

SEQ ID NO: 50381 - DNA, 1814 bp, Bovine  19866880796298
gcccggctcgcaggtcagagccttgtagcagtggaaggagcccaccgtgttcacgcagtgctcgcggcggctgcacgtgtgcaggtctgtcacgcactcgttgatgtctgaggggagggccaggccgtcaggggctgcggggtggtcctggggatggcagcagccaaccagtcccgccctcaaggtgctcgcctgccagacagcagcaggctctgtgccaccacccattcaacaaagatttatggagcacgtgcctgagtgccagcagcactgtgcttggccccagggcaccggtgaactagacagacaggagccctgccatggggcacactcagaagaggatgccccgcagacagacctaagagggagggtggtctggagtcttatggaagaaacagtggggtggaggagaccaggagaatggggcacgaagggtcatcagggcagagggcacttgagcaatcatctgaagagacccaggacgagccaaacacacatcccaggcagagggggcaggttcatgggtagggtccagatggtgcggtgtgggaagaggtgatcaggagacgcggggggaggcgggagccatcgagggttccagcagaggaggagagtggactgacttgtttgtaacaggggcccctggtggagagtgaacactccaggaatgaggggttcatagaataggagatgaaggggctgaggctgccatccacggaggtgaggagacgcagtcacgttctgaaaacaatgtgaaagtcaaagcaacagatctatgatgaatgagatgaaggagagaagaaaaaagaagccaaggggtcttgccaaagcttcttggccaagcagctgggcagctgaggatggggccagctgaggggagcaggctcacagaggaaggctgggagccctggaggtgacactgagtttgagggtcaagggccagccggggtcctgccttggagttcacagaacaggtcttagtgaagctgggactggtggatgctaaggtcagctcggggacaggacaggcacagaagaggcctaggacggacgcctggtgggagcaggcagtggggagacgcccgtaaaggagggagaagcagccccggggggggcggccgaggggactcagagcggtgatcaacgcagacgtcccacaggcgggagctaagcacgcgcggaggacagcgcctgccgaccccacccggccgcggagacgcagcagtccttgctgattccttcattccctggacacacctcaaccagcacctattctgtgctgagcccaggtggcctagccgcgttgggggccaccccgagcctggcaggggagaggggacaggcgggtgggagacactggggaggaaggcggcacggtctcagaagcaccacctgctcgggggctggaatgtcagggttgctctgggggacactgagattagagctgatcctacaagcaggacggggacaaggtggagaggaggggtaccgggctgtggggcatgtgtgtgttagtcactcggccgtgtctgactctgcgaccccatggactgtagcccaccaggctcctcggtccatgggattgtccaggccagaatactgcagtgggtagcctttcccgtctccaggggatcttcctgactcagggatcgaacccatgtctcctgcatcgccggtggattctttattttctgagccaccagaaaaaaaatgctcccaaagtcccaggtgagccgactggtgtataagccgagccaagcctggttggtggggatgagggagaagaagaggggattctggacccacagtttcca

SEQ ID NO: 50382 - DNA, 1741 bp, Bovine  19866880855703
ctcccggcaccttccccagaggtgtcctccttccttccctactggggaggtgagtttgctgagacccgcaggcaggccaggcccctccgtctgattgcctggcctggctaaagagccggcctccctgggacaagtccagcccaggggcagcggagcgtcgccaggcttggctccgtcgcacggcactcggatgggctccccagacagaccctgtggctgccgttcagtcactggtgctcccgtcaccattgagcccctccgccgggccaggtgggcacagagctctggggccgggccattctgccttcacccacccctcgtccctacctcgcccacttctcgggctgcacggtagacgcgaggaaggaaccagcgtggcctcggagcctggtagaggagaccaggcacttatgcattcgttagtgccttcagtcattccgtgtgaaagcggtgtgtgcggagaggccgtgagcgtcacgggtcaggcggcggccccaagggcgtgtgcgatgtcagccccaccccaccgcggctcaccctgctcataccccagcaccccatgctcatgcacagggccaccctcagctgctctgtacctcatcagctccagagggtgggggtgtttgtctgtcttgtttggggccgtgtctacaagctgggcacagacccggcgcttgtcagagctcagcaggtctcggctggatgaacgagagacaagtcccttcctgcacagagctcggggtccagccagtgctcccctcactgtcctccactcgctccctccccgtccgccgcagaccggctcttgcttctcccccagccccgtgaagggggttgagggcaggtccctgtcagcgcctcaggtgacattctcagagccacctgcccaagctgccatggacctgcattggaccagcatctagttccccacgggggatctacgcaccactgtggtgcctcctccaggcagcaggccagcattccaccactcccgcctctgcctcgccacatgtccccggctgaccccttgcctttttctggacctcgggttccccatcagccccaggcggaggctggacccgatggtctctcgagagaaggctccacatgagcgagacctcgggtcccggctctggtctgggcgggctcctccgtgaccttcggccggtctgtgcgcagatgtgaacgagtgtgaggcccagcgctgcagccaggagtgcgccaacatctacggctcctaccagtgctactgccggcagggctaccagctggccgaggacgggcacacctgcacaggtaccacctcccctggcccgcccggggcccccgcccggaggcactgccccgtgtgccaggctcgagagcccccgccgcggtgaggggatgctccggacacacagaggcctcggcgtcggagcggcggtcccatccctgacgtgcggcttcctggcacctggacaggggctccccaagtctgacttcaggcgccttccctgcaaagcagagatgatggtcgtgacctcagcggggtgaaggtttaagttacatagttgaccttgaaccctgcagggctcagggcctccccgcccctggagtcacgtgtaactttacagctcgccctctgtatccgtggttccacatgtgttactggcccgagggtggatcccacagtaatttttgaaaaaggtccttatgcatgtggatgcacgcagcccaaacccgtgtcatcaggggtcagctg

SEQ ID NO: 50383 - DNA, 1563 bp, Bovine  19866880913318
gcatgccttacccgggcgcctccagggggaaggggcggcggcagggcctgggtggggaggggcccgggcggaacggtggccctgtctctgcaggccggtacctgtgctccgtgacgatgctcccgctgacggagcggcagctgaagcacctcagcctgaagcggacggcgctgctggtcacagcgagcctcccaggcagcccctccccggcggagcaggtcggggccgaggtgcccttcagcccggggctttacgctgaccaggccgaaatcctcctgagcaaccactacaccagctccgaggtgaaggtctttggcgccatggaggttctggagcacctggaggtgagccctgagcaggcgggagccaaggcccctgggagggggaggcgggcaggaccagctgcagccgtgaagtcctgggccgcctctcctggaaatgagcacagagctgaatgatcttgaccgttctttttccccagagcagaatccctgtctattgttgttcagttattaagtcgtatccgactcagtgaccctgtggtccgcagcacgccaggcttccctgtccttcactgtctcccagagcttgctcaaagtcatgtccattgagtcagtgatgccatccgaccacctcctcctctgtcgccccctcttctcctgcctctgtctttccgggcctgtctgtcggctcgtatgattgtgtgaggggtgtggctgctcctttcctctgcagcacgtgctagtaagcacgtcacgtgtccacgagtgagttcagggcaggacgcgtggtgaccgagagcagggcgagcagctgagccctcacctatcgcagatcctgcacgcctgccgacagcgggtccccagctctgggcctgggccaccctgtgtgccgaagggtggtgtaggacaggggttctggggcccggcagggtggaggagctcggggcgccgtgtgcagggctcgccggcgtctcctcggccttctctggtctcgctgcggcagccttggctgcagagtgaggcagagatgaattggctgctgacgggggagcacctgccgggccctgggctgggctgctggcatctgacagcccaatgacagagctccggctgccccctcgggaagcgagtttggggatggctcacgtagcgcagcgttatttaaaaggagctgttgattagaattccgtggtactgatttgtccttttaaaaaacacccggcctagacagcgtgctcctctgactctgttggttgcgtgcctgtcggctggatatgcccagctagcagggcaccatgagtgtcaggaagaagtgggggtgcacccctcagccctggggctccccaggtggcgcagtggtaaagaacccacctgccaatgcatgagatgcaagagatgcaggttcgatccctaggtcgggaagatcccctgcaggagggcacagcaacccactccagtattcttgcctggagaatcccatggacagagaagcctggtgggctacagcccccagggtcacggagagtcagacacaactgagccggcgttcacatcctcagct

SEQ ID NO: 50384 - DNA, 2001 bp, Bovine  19866881132148
agcccacctgactcttacagaaagcggggagcacccacctctgggcccctgactttggcagctgctgccggacaacacgtctccacgcccagctctggtgcccagacacgggctctcgggttccacgggaccagaatcagccaagaaatttcttaaccagctaccacccccagcgctcagcaggaggcagcacaccccggaagctgacctttctggaaagcagccagcggttggggctcaaggccggggcacagggtgaaatggagggaccgccttgggggtgcagcggtgccggcgccggctccccagccacctggtcccaagcacggctcacagcagaccctggtccccacgtggcatctcctctccactagtggacacgccaggggcccgtgcgtccagatgccgccccggagccagggccgcccaagcccaccttgtacacggtctcctggatgcgcgccttgagcttggagctgccggtcttcagcccagacaccaggatggtgtcgccctgcttggccgccttctccatctctgagatgtacgagggggggatgtaggtggactccaggaatgtcaggatgctggaaaaggagcgtgtgctcagctatgacatgtggaaccaggaacctcacacatttcctctaaatgcctcctctaagtgcctcctccacgtgctgccaggcgccacagaaatgacccagtgggtgttgcctagaaaaccgttcccagaatgtcgtgcctcagaacttccagcgtccccggaaacacctgggctctcagtccctggcctggcccttggtctgcacctgggaacctgcattttataaacatccagctgtgattatgatcaaaggcagcactgaaatttgaggactgcccacttagctgagggcttccctggtggctcacacggtaaagaatctgtccgaaatgcaggagacttgggtttgatccctgtgttgggaagatccccttgaggagggcatagcaaccccactcccgtattcttgcctggagaatcccatggacagaggagcctggcaacctacagtccacggagttgcaaagagttagacacgactgagcgactttcactcactcagtcaactttatgaaaagctttggtctcacggacgtgaaaggtgagccccgggaccagaggcccagcctgggctccccactagtccccgtgtcctctccccggccagctcctgcgtctgggaaacagttctctgatgacccctcaagtgtcaggaacaagggatcacgttgcatcctaccctggccctatggttaggctgtgggaagaagggagggagaacttgggatggagtgggacgccagagcgcaggctggtgagcggggccagcctgagtctttcctgacagcctgagatctataaataagccccccatcccgcccgaacgggagcagtcagacacgttcattctccccaaggtctgccgagtgctgcggtgattcatttcctcgtcgtttcacgaggtactacgtgctgaaattctttttctttgcatacagaagagctttggttctttttttatttatcattttttatttttcagagggtaattacttaacaatattgtgatggttttcaccatacatccacatgaatcagccataggtatacattacgccccctccccaccccgcccctctaggctgtcacagagcaccacatctgggttccctgcatctgacgtcatgactgccactggctatctactttacgtatggtaatgtacatgctaagtcacttcagtagtgtcctttttgtgactctgcgactctatggactatagcccaccaggcgcctttgtccatgggattctgcagacaagaatactggaggcggggtgtcctctcctcctccaggggatcttccccacccagggatagaacccacatctctgacatctcctgcactggcaggcgggttctttgcctctagcgccacctgggaagccaaaaatg

SEQ ID NO: 50385 - DNA, 2462 bp, Bovine  19866881189745
catacatatactcaaggatccaataatacctctactacttatatactcaacagaaatacatccatgtgtgtaccgaagacttaaataaaaatgttcatagcagcattttttttgttatatccccacacgataacaaaaacgtggaatctagtagcatgtccaccatcagtagaatggctaaatcagttgtgcgtacatgcggtagaatactacactgcagtgaaaatgaaggaactcctactacgagcaacctggatgaagctcataaacactatgttgaaccaaaggatgcagacagaaaagaatgcagactgtatgatttcctttgcacagagttcaaaaactaacctatggtgctagaagtcaagaagccttgtttgggggaggagggtggggatagtaggcaaggaggggcacaagaaggtggagcttctgaagggctaataaggctctgtcccttctctagcctgtcttagtgggaacataggtgtgtttaccttggtaataattgagttgtgcacttaaaattgtgtatttctggtgtatatattgtacttcaataaaacgtttttaaaacaaaaatcagggtttcattatctgtattaatctggtcattgatcatcttcccgtgtctctctctgtctctgtctctgtctgtctgtctcttcagcttttcacagaggtcctccgggatcaaggggaccaatgatcccaccactgctgagtctcccacctcctccccggggcagaggcccaattcggggaggcctaggccccaggtctggcccatatggtcgtggttggtggggggtcaatgccgagcctccttttcctggaccaggccacgggggtccctccaggggaggctttcacaaagaacagagaaatcctcgaaggctcaaaagctggtctcttatcaagaatacctgcccacccaaggatggaccccaggttatggaaggtgaggtccatttttttatgcctgcacacatttaatacccatcactcccagagcgacctcatgcctagaatccccgtggctcttgtgctttgggttgtcctttgtccttttgaagtaggagtagccctgaatgtgttttctcccacaagaaagactgtcattccataatacctggaaatggtagcaagcaggaagtctgaccgccttctctatctctgctttttgttagatatgttcgttcttacattttaaactgcccgattttcgcttgttcacagacaaatctgaccgccccgtctgccgacacttcgccaaaaagggccactgtcgatacgaggacctctgtgccttctaccacccgggcgtcaacgggcctccgctgtgaggccgcctccccacccagactggaaggggtccccggcctggcggccacgttctcccctacggccctgtgctggccaccgtgaggctgttgctcgcgccacccccagtcagtgacgcccaccccctcaccgccccctcccactgggggtccagagttgtgttccatgactggtgtgcggcgtgcactcttctgatccagtctccagagaagtctccaggaccatcattgctccattcaactgcctcctggctcctcttcccccctcgccagctgactgcggaacaggaaacctctttggtgctgtttcttgtgcatctgtccacccagccctgggtatcgccctggattcctgagagccctggagcagtttcctaccattccctcctcgctgcttgttttttaagtccttttcgtgtgacacccctgccccagcgtggtcagcggccctgtgacgctcacccggttggctgacctggggtcaagtgcggatgactggtgcagagtcactccctgagaggccacgctcccccgctcttggatctggtagttcctgcgtcagtagcatgatccccaccgctgtggtctgtggtcactgtgctttgtgaaactctgcattcccctgcccccaacccccggagcctttctcagtgtccttggcattttcgtgacttcccaacactagcgtaggtttttccgccaaaatgcgtggggccgttggtgccccctagactttcccccacctcccaacgaggtagaactgtgaaacttcacaataccgcctccctggtcgtctcaccctccccgtgttggtttctcgggattgacacaggcccgagcgatgtcgtccaaaggctcagatgggcctctcctctctccagcccattttagttagactgcatcattgtgaggccaccagccatttcatttgaattctgtgaatctccacctggccagcgggtggaactcggacagtactgtcgccctcttccagccttcttcccctgcatccctggcactggttgttttctgtgaaaacggcagtgaacaggttcagttttgaactggccctgaggaaatgggtcaggagttgtgtgggcaagagggagggatgagagc

SEQ ID NO: 50386 - DNA, 1552 bp, Bovine  19866881194280
cgctcccggccgtctgtgcctgacggatcgccctcctgatatctttattatcgctttgaaaagacgccgtgggggctcctgagccgccctcctttcctggagaaatgttccctccagggcgttccgatgtcagcgggttaagggtgtgacaccacgggcagtccctggccagaagctccccctgtcactcagatggctccataaataacgcccagcccctgggagcacctcccacccctcccagggagctgcagaggctccgggaggcgctgccgtttccacctttcctgccagaggtcggccggccgctgcttagacaagtttcaggaaacaaggatttccggagaaaacaatcaataagtaaattcaaggcccacgggggtgtagacagcctccaaagactcagtttgaattcagttctttcccactggttttgcaaaagcgccttggaggatgtgagcgatcgttcactaactcactcatttgttcattccaaaacagtactggtctgccgggcagacgacctggtttgtttcagaaacaaaaggcacagaaataaaaaggggggatacgttacaaattcaaagacccgacttataagtcagatggaatatgcgagtctggcacagatcctggtttgattaaatgaggtgtggggagaggaaggcacctatcctgagcaggaataagtgaatgcactctgagttggaaaatattaaggaattactgtcattcttcagacacaataatggttttgtggttactttttaaaattcgtatctgtaaagtctgggattttctttcctggaaattattccaggtaaccccccgactcctaaccccccacaacacacacacacagattcgacttgaggacgaaataagatcagcaagtttgatgatgtttgactccggtgaggtgtgagaggggacatgagtgcgtcacgattatgccatctctccaattctgaccactctttaaacacaatgcccgatactgttacatgaggaagtcacatatgtgccatcaccatataacttgccatatgatacaattttacattatgactacacatacggtatcctatgctagaggcaacgctgtaccatgtagaaacatgacataacgcatgttacaacattagacagaacagacacggaacacagtgcgctgtatatttattacggtattggaacgaaataacctcagggaggtgttaactgatgcctttctttcttttttttgcctcaccctgtagcttgtgggatcttagttccccaaccaggtactgaacccgggcccttggcagtgagagcagagtatcaaccactggagcgccagggagttcctgacttagggcttttggttgggatccagcgggcataaaccctgtgtaagtctgagatgtaccagtgttgatccgggtgcatccccattctgcagcaggagtggtctttgccaacacctctatcacaactcactggaggagggcatggccatcccccacagtgctcctgcctggagaatcccatggacagaggagcctggcgg

SEQ ID NO: 50387 - DNA, 921 bp, Bovine  19866881284095
acgtctgatgatatgaaatgctccctggttactctgagcctgcaactggccctccgttgataaaagagggaacccgaacgccgggcgctgggacccacttacactggttttcgaagagcagaacctgcatgccgtacagggagaaggactgccggaagctgtacgtcactgagttcttcttcttctggaagatcttggtgacctgggggcaggcagacacagaggctgagccccaggcccgcactgcaggggcaccccggggaatcggttctcgcagcccccggggctgtgttctcctgtgtgaggacctctacccctaccccgccgccccgcagctctgaggccagcaggctcctagggcagcgaagggccggtaggagggacactcatgcctgcaggccccacgcaagcccagcaaaacccgctgacggatgagtcgaacagcggaggacaccaggcccagaggtctgcagcgacttgctcaaggtcaggggctcttaaacgactggaagctgcgtgtctggactccaggctcgggggcctgagcacagcggctgctccttcatcgggcggggacaggggctgggggtcccggggaagaaggcggctgcaggaccacgttcacccccaggctgcctgttttgggggcaagagctcagcgtcctcttggggagcccctctctgccgcgtccagccctccagtcctggggctgagactcaggccaacagggtggcaccacacccgccagctccagctcagggagctgcgaggcctctgctagcagtgtcaggaagaggctccccagaggccgaggggccgggacaggagctgcagaggccgaacgctccatcctggaggaaggcggcccaaggcgcccggggggtctgcgcacccagccccgcacccatgggccccacgta

SEQ ID NO: 50388 - DNA, 1933 bp, Bovine  19866881426392
atgaaacacaatatatcgttggggacgggtacgcagttgagtccaaagctccgactggtcgctctttccggtcttggttgccatgtccagcctccgatcctccgaccccttccacggggcaccagcgatggcctggaactgccctcacagctccgtcccgggcccaggagaggccagaacgcgaggaaggaagtcagcaaaattaatttacagggtcggaggaaaccggccacagcgccagtcccccacgcggccggcgggagcgtggaggcgggtgcgcggccagggcgccggaccagcgggggaacccgggctccacgcgctgtccacggtgggcgccgcctcacagggcaaaggcggtgaagaaaatgtgcatcttggccaggaaggtggtgacggagccctgccgccagagcttcatctccacgtccagcgcgaagtcgcgcggctcgcgcacggtgcgctgcaggaagaccacgcccgtgtaggcgttcaggcggcgcgtgccgaagtagccctcctcgttgcccttggtgatggtcagcgcgatggtgtcgccggcgaaggcgggcaccgggctgatgcggaagatgtgcgcgggcaccagcagcccggtctggaagttgagccggtagtgcgtgatgcgcgcgggcgcgttctggcactccaggaagtcgtggcacagggcgcgctcgcatttcctgcggggcgcacgcgggggcgtcaaccgagggaggctcctgctcgcagctcccacccggcctccacccgcagctccgccctcggcagcccccagcagccggagctgggtcacctgacccccgtcggacctcagctttcccgtctgcaggatgggttaacagccacgcggtgtcattggtgaagttataacccaggcagcgcgcggcacagtgcccacagcgtctggtccccgcgctccttcctgtctgccttcattcttacctccctacccctagtttttttccttcccacactatttgcatggattccctggccatggtgtttctattactctaatcgtttctcagattcccttttctcccgtaattgactctccttctgagccgtttcccccactgatggcctgcccttgtccctctccgagtatcagagagctctgagtcacgcctgccccagaggaggctggggagcccagccacactacagggtgaccaccaaaccccatgggacccctgactcgatttccaagctcagcaataatctggtctcttcctggcgcaatgagactctgtctcctccatcactaaacccccgtcttgaagctcagtgcttccaccaggggcaccagggctccgcagttctagaggatgctctgagcagagttcccgaacgggggcaccacagcaggcaggaccaggccacgtcacgccctgtgtaaactcatgacctgttctcgctcatcacgtgttctcaccctccctggggttggcgctaccatcacccgtgtggcaggcagagcagctgagacccagggaagggaggccactggccactcgacacactcatgtaaacaccccaccacatctgcacactgagccgcccagcactgtgtattagagagcacggcacagggtcagtagggcagccaggagtaaaccgcgcaccacgggcgcgtacgtgccaggaagggccgcctgaggcgggccatgcgcgcagaggcaaaagaggctgcaaagcagagaaagcaagctcggaacacccgagcacgtccgcgtggcagcaccgtgcagaggacggatgccggacactctggcaagcacttatggaaacgtgtgtttagtaagaaaagtgaaagtgaagtcgcttagtcatgtccaactctttgtgaccccatggattgtaacctatcaggctcctctgaccatgggattcttcaggcaagaatgctgga

SEQ ID NO: 50389 - DNA, 1536 bp, Bovine  19866880431133
taaggttaaaacatttttctcctccagaagaaaagtgaaagtgaaagtcgcttagtcgtgtccgaatctttgtgaccccatggactctacagtccatggaattctccaggccaggatgctggaatgggtagcctttcccttctccaggggatcttcctaactcaggaattgaactcaggtctcctgcattgcaggcggattctttatcagctgagccacaagagaagcccaagaagaaaacaggatgtcaactaaatacatttggatttatcctttattgcagtgtttgctatccttggaaagagggataaaaatgcacagcaactgactacagtttgtcatacacacaaacaatcatggcttttatccaatgagaaagaaaattaaataatgcatactgcatctacctgaccacaatagttatactgaccttgacggagttatctccatgtgctagttctgttgctgtgccattgagccaaacagtgtctctgcaggtcttttcagaattcttggaccaaaagtgtagcagacacaggcaggggttagggaagagatgctatttattctgcctgtgtagtttggatggaaaaatactttttaggtgatctgtttctaagaagtgcaattttcaggaaaccagacactgtattctcaaaattattttccattctctccctcaaaacttactctaatcatctcaaagtaaaggattattctcaatagcaacaacaaaaaatgctgctgctcacattaaatttgcttttactccaagagaaaactacttcaaatttcacaaaggtagtcttttctccattatacctggattatgtacccaatttatagatggaataaaccctagaatacactcttctggagtattttggggtggcattctcctgcaataggattgagcctagcatatctagggtttgggctagttggagatataattggagtttgtgtctgtaaaccccacaggctcccatcctaagagataggaattaacagatacaggtttgatcatccagcaaacatatatctaccattggtgttatgagaggtgtgaaaacagatcaatcagacacagtggagagtatctgcaatctgcctgaaattatatcttgaatgaggacaggctgtaagcatatgtgtgaatgtatgcactcttttaaatccagaaaaaatattttccacatgaccaatggtggcactgaaaactaaataattattgtagtatagtggcatttacagatatcagaaaacttaaatcaaaaggggagcattgctctgccctgaatataggatgttcatactttgtaaattgctgtgtcacctccagggtaacctgccaagtgcattttcatattatgcttcaaataacactcaccaataagtggaacttagaaaaatgtataaacatgcacattcttttgttctaaacaataagaaatacagaatgtcaagtgaagacctaacaacaaacacagaattccaatcttttcaggttagcttgtgacatcgagtcagaaaacg

SEQ ID NO: 50390 - DNA, 1557 bp, Bovine  19866880659918
caatgagatgctgcgtctgataagatcatcacgtttatctattgaagacctctggtttcttcagctgtatttcataaacagctgtagaactggaaagggagagggtaagcagtagacaagaagcctcttccaacatcagaagcctgtagctttaccctttgagtgagaccctgctcttaaggaagaagacttcatcaaaccatcactgtatctagcagataatcttgcttctccttgcacaagtaccaactatcatctattgctagtgccctggcatttttccttctctgtggcaaacatctccaggcaccagactcaactcttgtcctccacccacttccctctatcctctttctgggtttgaaaatctgagcaaaaaaagcctccagaaacatccctattaaagttacgtttatgcacttcctcctgcaagggagaaccaaaagagaaccaaggggtatctcagatgacgtggaggaggaagggagtgaggacagaggtttgggggcctgagtaagtcctaggagggtcctggcagatatcggccataatttttaaactacaagagttgctgcaccataagatggaatttgtgaatccctgtaagagcttgtatttggtttgtttatctaggattctaattcaggacacatggtgtgaagaagctggagtgaaaatagtttgagctgaagtaggtggtattcatgactggttaggcaaaatttttgttttgtgagtcgcagaaaagactgttttgctagctgcaacttctgtatcaaacctaagatcaccctcataggttagctgccagagagagagattttcctggtcatccacagcagtgatgtgtcatggtcctagctaatgacaggtaagcagaagtcagataaagtgttctgagaaagtgtttgtttttctaatacagaggttccaccctccccctccattatccttgttcaaatatagataccatttcttgatcatacggctccaagctccagtgaaccagagtcagtaaccactttccctcctttttgtgggaaggaaagcaaccgttgtttatttaaatcactgtgagtcaaatattacttttatcgaagctgaaagcatctgtgctttctttatcctccatgtctaaaatcaaccaataccatcattttaccagaacatagagggacaaattcctaattatgaaaatgactttgaaagagaagatgatacatttattttcagatgtattaagctgcatgccaatgatgtcctttagagattggaacttggggactaaatggctgtttagaggacaaagcaaattcatattgttaatcagcatctggtagaaaaagcagttaactagagtcttctttaccttttctgtaacctcccatgtaaatatattaagaaacaaaaccaggaaatgtctggatagcacagagagcggaaaaggaagagtaaacatcgcgggttaagtgcagcccacaaaattaccccttgagaaactgaatagactggatcctatttctgagttagtaattaagtcttcattttatttttgga

SEQ ID NO: 50391 - DNA, 1509 bp, Bovine  19866880718602
tgtccgtaaagtgacagagtcacatgaaccctagtctcagtgatgttctccatctttccttcctaattattgcccataatccacctcgcgtggtactgaagaaggttcagtaccataagcccccatcggcatccttctaattctctccagtcattgctgataccagcaccgctcactccctgaaacattttcttagttccactgaatggaaattcaagattcaaacaagagaggcatgaaggactgagagtaggcagtcagtggctttatgaaagaaggtttctctagctcatctcagtggaatacaggaaggaataatagtgtttggggtccttaggggagggaaagaaagatatgaaccaattatcagcattagagaagaccatagtccaccaggatactctgtccatgggatttcccaggcaacaatattggagtgggtactcccttctcgagccccaaccaagggctcaaacccagatctcctatgttgcagacagattctttaccgtctgagccaccagggaaactctagaaaagagctagtgaccagtaactcttcaaatcagcttatgggcttaaaagcccacatttcctgtgtttaaaccctcaggatcatggagaaacagctattgtagactcagagtgccaagcaaatcattgagcataagataggcttacatcaaattgatcactgactctgaaaaaaattgaggtttgcttattacaaagaagtaaagtagcaaatgaaagaaggaaggtgggagaagggcaggaagggaagaggaagatggatacctaggaaggaacattagtgcccaacagtctgtactacagagctatcataatattaatttctgagtccacagggaagcagccccaccataaccagtaggaaaagttggccagagcaagtcgggtcactcttattggaaaaagaaggtgagcaatggatagagagtctgcaccatagaagaagctttgtgttaatttgaacttttgtatcagtcccctattattaacccagactaacatggctactatacttgagaatgagaataagaagcagaaatgaaatttaaaaagaaatgtagctggccagaatatttaaagctgtacgttttcatattttcaggttctggtaagtcaggaattaaggcccttttggacacaagataggtcagtctcatttagcagcatgccgttgtgaattagacaacttctcgtcactcttccttgctccaggagtgttacaaatgcctgtcaaaggctttatggtaatacactaataatgtatcccacagtagctgttacaatagggtaagtctttgtgactgccagggtgggtaaagatctcagtaatatacttgcaatacatgtgaggcacataatcacaaatgtgcgtagcctcaggatttgttctgttttcagcttaatctgcctgtagatcaaatatgcacagaacgaactgaggaaccacggtcctggaggaagatccacattagcgtc

SEQ ID NO: 50392 - DNA, 2590 bp, Bovine  19866880799459
tacaatctcattctgggagaacttaatttcttcacccgaagtatagacaggggttacctttgttcacgttgccaactcaatacattgaaaagaataacctgcacaattatcactcttggctttgtttgtagggtgctaaatgattcacttaacagattcttttcaacaaattagcagaattgacttttctgaacaaatatgcttgttatattggtgtcgtgatacatcgccattgggtttttagttagaacctgagagaaatagccagttacagctcctgatttacagaaaatccatactgcagtgtccatctttaattctctttttttcctaacaaaaagtgatccattacttgtgcgctgtggtgattgtttctagagcctggttatattcccctgtacatatgaaaattttatttgctttctgaattaaataatttaacaattcaaatgaatgatcacaactttaatttctgaacacattttcctcaactaaaaggatgcgtatgtaaaatgtaggacatgcggaagatacagaaatcctctgactttaacaaaaacattattcagagcaaggttttttgtttttgttttttttttccccctccccaaagcactcaggtatgatggatgcagatttgtactaattttatggatatttttcatcactgagataaaaagtcatacattttttttagccaattctataaaaccagagattctgggaaactaaaaatagagagcctactttgactataccctttgaataaatgtcaaaaaacaaaacttaatagctattaggtttcttaaggaataaaacagtgctattcaggtctattttattcaacatatctttggaaaatatcctgtgaaattatctagaggaaagatcgttaacatgacagaaagaaaataaaaagtaagtgtaattaaatctctaatggaaattagacattaaaagaataaaccaaatattatttgaaactatgcattaattttcctatttaacttttagtgtgatatgaggaaacaatttacttcttgaattgtataaatatgatataaataaaaatctaagacacttgaagacctaatcaagagattaaactaatggagcaatcatatgctgttcataatgtggtttaaggactgatttaggttcggtgatattttgctactttaataagccaacgtaaaatataaaaatctgactttgcattccagtcatcgtatttacagagttttcatattagtattctgctgtcatctcgttctactctgcaatgaactgtttatgtatgtttcacgtaaacacctaggtaggcatcataacattttcatgtacagcttaggatcctatcttcaattttatattcatcaagaatctcccagcaatgtaaataaatttaagttttctagatttaaaaactgatgatgtcaaataagcatatgcattgagctccctgaaacgtatacatgtaatacatacacaaggaacgagagatttaagaactttaaatcatatagcaatctataagcttgacattttttgcctttcaaatgtttgttttgaaataaaatgatgtagtggttgcaaaaatagtatagagagttcatatgcactccttcctctgcctctttcaatggttgtgaaagtgaatgtgttaggtgctcagccgtgtctgactctttgagaccccgtggactgcagtcctgcctactccaatggtaacaccttacttaatcatagtgcaataatcaaaggcaaaaagttagcatcagcacactattattaactaaaccacaaactttattctgatttaactaattttaatatccactcttttctgtgaggtagcacatacatggtttatcacttgcgtagattcaattttatattcatcaagaatctcccagcaatgtaaataaacttaagttttctagatttaaaaactgatgatgtcaaataagcatatgcattgagctccctgaggaattgtgatgtagaataattccatctcacaaaaggaattcgtcctttcattttaaacttaacagcacaaatagtagaatgtgcttagaaaagccagttttgcttttatttctgaattcagtcctcaccgtaatgtaccctgttcctttatttcttgccacttatgggcaacttggtggctgtcactggaatagttaacggacactaagtgtaaatactaaggatataaagaaaacaattgagactgtttctaaagatagcatttaaattctaagtgagaaaatgttcccaactgagattaaattgggatcaatatagagattaggggaaataaagagaggagttcaagagtaacttgtctctagttcagccccattgactgctcatgcaaatgagaaagtcgagcatgaagaaaatacttatgggagtgatcagcttttctacagtattactgtgaaacctaaagagttttggaaccaggaggactccatcacatctcttgcggtgatgaagggattcaaaaggcagctggaagcacacacaacttcgagggagcacagaagtctccaagtcatggcaagtgagcagcagtcaagtg

SEQ ID NO: 50393 - DNA, 1699 bp, Bovine  19866880859771
ttaaaaaaaaaagatggcaaaaaatgtagatttttttcatatctttaaaaggaaggtacttagatcctagaatataaaattcagtgtatctgaataatcagatttctttgtaccaaatagaggaagcatgagggggagaaggaagcttcaattaacagttttcttttccttttgtacattcatgtcactgtttctgaaagcattaatgtattaagatatatgcacatttcatgggaatgtaaatgagagtttgagttgaataacaaaataatctgttgttccattgctcagtcttgtctgactctttgcaaccccatagactgcagcacgccaggcttccctgtccttcaccatctcccagagcttgctcaaactcatctccattgagtcagtgatgccatctaaccatcttatcctctgtcgtccccttctcctcctgccctcaatctttcccagcatcagggtcttttgtaatgagttggctcttcccattaggtggccaaagtattggaacttcagcatcagtccttctaatgaatattcagggtgatttcatttaggatggattggttggatctccttgcagtccaagggactctcaagaatcttctccatcactacagttcaaaagcatccattcttcggtactcagctttctttatggtctatctctcatatccatacgactaccgcaaaaaccatagctttgactaactagttaataggtatgggggttaagactcaagaatatttgccccatcctagtttaataaacagcaactaacattcccagtgagactagatttatatattaataaataattgaccaaggccatccaaaagaaaacagaggcatctcctccctagctgatacactgtcagttgtgggggaggaggaagcagctctttgctttcttcagaaagtccagtggtccactcccaagcccaccacacagggatgtatccatttcatagccagcccatcacaccaggctgtcagtttgtcaaattcatgatgcaaggtgcttgcatgaatccctcagtctgatagccagctgctgaactctgttagctacagcagaaaggacatgccaggacatgtcctttcaaggacacatgaatctgtgtcacatgactgcacatgggaattgcacacagctcaagctcgggtttgaaatgtgtatacctctcacttggtcagctgtcttacctgggtgcttgttttattctacattttcctcaaagcatgcccttctgtcttccagggaaatttgagtttctcgtgtgtggagccttacacagtacctgtctttttcaacgctaccagttatctggaggtgcccggacggcttcaccaggacctgttttcggttagcttccagttcaggacttggaaccccaatggtctcctgcttttcagtcattttgcagataacttgggcaacgtggaaattgacctcactgagagcaaagtcggtgttcacatcaacgtcacgcagaccaagatgaaccagatagacatctcgtcaggtcagtgaatctattcgacgttcgtgcctgaaactgctgttgtgatttcctcagctagggttatgtttttactttgttgttggcacactctcgtgattatgtttggattcagactgtgagatctttccttggcttccctgagtgcagacgaatgagggaaacttagaaa

SEQ ID NO: 50394 - DNA, 858 bp, Bovine  19866880945665
tttcaccaggttgcaggacatggtcaagaagcaagccgctgacacaccattataaagcaatcatcctccaattaaaaaaaaaaattaaaaaaggaaaaaaccagaaaacaaaatcaaagaaatcacacacaaaaagaagcaagccactgcagagcatactgtcaaggggacttcagaaggaaagacagtccctcagaatcctcacaccccagccatgaggatggtgaatgggtaaaaaacagaagagcttaagttttgaagctttcattccaaaatctttgttgttaatactgaaggtgtttgagataactacatgtggtgtcaggaataaaactctcccctcaaaataaaattacaaactgataccgagaaggaagaaataaaaatctccaaaagttttatttaacagtaagtgacgtccatacatttggaattattattaattcacaattctcaagcatgcattttacacattctaatacgtgatatatgctattgttgcagacattgttttattacagcacttaatttctgacacgttcagatttcacattcagtagcatactcacaactttaaaaaaaaaatgacaacagaggaagcattattttccattgttctgaatccagaccaaatagacagtgaactgctctgacggttcatacagacaactccaggcctttttagttttccagccctctggctatcttttttatgtcagtgacaaaaggcagtacattttagtacatcatgaatatgaaacctggcgcttctttgaaccataccttgcaccttctccttttgttctgatcttcatacactatttaaagagtgatgcaagtaccaagaattcatagcat

SEQ ID NO: 50395 - DNA, 1930 bp, Bovine  19866880945810
ttcattatctgtgataggacagcatttttgccataaactatttacttcttaattgccccgctgatgccttggggtttttaatcagagaacacattttaaatgaaatcagtttataagccattaagcaattattatcaattttagctcttaattcagccaggagtacacatttctgagagctttcatagaataacttttgtatttcttgtgtacttgggttaattatcccttaggttttaagcctgacttttttattgttacagcgttgctacacattgctgtctcagtttctgtggcacagcaaagcgaatcagccgtacatatacgtggaaagctactcagtgctctgtgctgacctaaatgggaaggagatccacaaaagaggagatatatatgcccgagttttaggacgatttaaatactactcccaatgtctagttactttttcagtgtaaaatcttaaactgagtctaacaaaatctggctttagaaggtaatgagattgaatggaactctgttgggtgttatcagcaatatttaatgtgattgcagtgcctcattccctgttcttgcaaggaaactggctagaaatgaagacccacacagctttcttctctccaaaagcttattaacacccacaggccaggcaggacgatgccgctgccccttcatgttcctggagtgccgtgcactctctctctgatgtatccacgttttaaagtataagcctcaaaacactgtcttcttccattttattccctccactcatttttatttttttcccatcaaaggcgtttgccctcctctttctgtctcctaacccagtctgcttcctctgccgttaacattaacctgcacgcagaatagttctctgtcttctttcacagtcatccccttttcgtagccttctcacaggctgtctttgttataaacctttataatcactcagcaactcctgcttcatgcgctcagctatttcagttcctcacaatcagtgtaaatctttgaattcaattctgttcccacagcttcaattgaaaatctaggagccaactcagtgatcaaacgcagcctgaaaggagagctcgtctctgtaactgattacccacccgcccaagactcccattcagactcacactcctgttccacggatgacttctacctgccaaggctcctttgagatctcttcattgtgtgtcagtcacagtgataggttaatactataagagtcctcaagtgcttttcgaactttaaatcaagaaagggagaggggagctacaggaggtctggtgaagcccacgccttcagacaggagccaggaagggaagggagggcaccatgtgaaaccaagacagagtggtcttggatctggaacaggcagcccagccacctctgagcctccaaaagggtaccccgaatgcaaatgccccaccttcaaacgtttttacacacctgattttaaacacactgcgtttctggtgctttgaaagcactgtctcggttgtgcaatttcaaaacctgctcaaaaacggagaatggtttcacactgtctatgatgatggactgctgtttggcttcctctgtcatttggggtctgaaactctagtctagtctacagatatcagcttgtacatctggcaggtggggggggggaaaaaagcctttgtgaaatccagttaaattagctcaaagtgcaagaataacctcacacttactcactaggaattcctcccttctgactaaacttaaagccactatgcctgagctcctatctttccaatccctaggttttccagtttgctgagtcacctttcattccttctcagtaaatcaatttccattttgaaagattcctggcaattttagcaagagaatctcatgtagcaactggtctgtctttttatctttcctcttagtctaattgatgcaa

SEQ ID NO: 50396 - DNA, 725 bp, Bovine  19866880981196
ttcaaaagcatcaattcttcaatgcccagctttctttatagtccaactcacatctatatatgactactggaaaaaccacaactttgactatacggacctttgttggcaaagtaatgtctctgctttttttttttttagatatttgaaatacaactttattctgattctaaacgaaaaggaatggaaatgacagtaacaaacaagatcccacctctcaatattgttgtgtgactacagcagtcttatatttgaaactcaaggaggaaacagttgtgttccaaaccacctaaatatgcaggtccaaaaaatgaaagtttttttttttttttaaactgccacattcactccaaagcccatccatctccttcagcatccaaagattaagcacatgttctgcttagctatataataaagtggcaaacacgccacaccgctgacatcacaggacagttgcctataaaactagacttctgatgctgggccccagcttcactttctcacaggtcaccatcttcatccgggagagcagttgtctgagtagcctctaaatcgtgctcatactgtgctgccagggctgggtccatgaccacctctggcggggcaagagcagacacagcaacaaactccaagttagggtctccggtcagttttctagcaagccagaggaagggcttttcaaagctgaagttacttttgccagaaatgtcatagttctgaagattctt

SEQ ID NO: 50397 - DNA, 1415 bp, Bovine  19866881041779
agtgcaaactggcgggttactggcaaatcttaatttcatttttggttcagctaatttatttctaagaatttatcacacatatactagcacactttttcaaagtcatatttaaaatgtctgttgaagccttatttatatcagccaaaaatgggggcaaaagatactcattgattaggaagccactaataaatgaaggtaatacataatgaaaccactgaaagctgttaaaagaacaaggcagatctatgtgcactgatcagatgcaatctctaagatatattgccagcaagagaaagcaagatgtacagaccagtgtttataatacacctccatttgttttaaataacgattgctgtggtgttcgagtgaatagtgaagtgaatatgatgatacatgaaggtaggaaatcatccatttgcagcaagtcagacagagaaagacaaatactgtgtgacttaatgtagatgtggaatctaaaaacactgaacttgggacttcgctgtcagtccagtggtaaaatctttgccttccaatgcagggaatgtgggttcaatccatggtcagggatctaagaccccacatgcctcatggccaaaaagtcaaagcaaaaaatgaagcaatattataataaacttaataaagacttaaaaacaacaacaacatgaactcatagaaacagcaggttggtggttgccaggggcagctgtcgggggttatagttaacaggtgaatgtagtcaaagggtgcacatttccggttatgagatgactatgttctggggtctaagttacaatattgttactatagttaacaatactatactatatacaggaaagaggctaaatgggtagatcttaaaagttttctccacaccaaaaaactgtaactatatgaggtgatgtgttaatttaccacactgtagtaattatttcacacaatcagttcagttgctcagttgtgtccgactttttgtgaccccatggactgcagcacaccaggcctccctatccttcactatctcccagagtttgcacaaagtcatgtcttttgagtcagtgataccatccaaacatctcaatatctgttgttctcttttcctcctgccttcaatctttcccagcatcaggatcttttccaatgagttggctctttgcatcatgtgaccaaaatattggagcgtcagcttcagcatcagtccttccaatgaatatttatggttgatttcctttaggactgactggtttgatctgctttcaaccccagagactctcaagagtcttctcaagcaccacaatttgaaaacatcaattcttcggagctcagttttctttatggtccaattctcacatccatacatgactactggaaaaactgtagctttctaacacatatatacaaaatccataaaaatgcta

SEQ ID NO: 50398 - DNA, 1043 bp, Bovine  19866881132194
gctgtttgcattaaagcactgtgggcaagggacctgtagttcctgcctggattgtagccaaaatacaacctgcagacatcaagcaagatctgttaagaagtaaagaacaccaaggtgatagagatttaaaaaaatctgtgctttcaacagcatcagaattccctgtctaatcagtaacagcttatcaagcatgagatgggagaaaaacaatcatcaggactccagatggaaatgtttaatgcatatgctgtttacaggatgaatataaattgcaaacatggtggtttggggttaatctgctgaataaaaaatattggatttattctactttaattaatgagtaactgaatatttgacagggcaatacacttaaccctttcatataaagtcaactgccaatgatttcacagatcatgttggcaatggcaaagttattctccggaccaatgtcattctctcagagtatgttttgcagcagaggtgaaatcttagctggattgcaatttattaactgcactgatgatacagtaagtcttgattgacctaactatgcagagtaccctggagaagaatacaagttttgtttaaaatgttcagcataccttgaataaaggaagaaagataaaccagatgtcatgatgaggggaataagggacttattattccctgtcagagggtaacaagaaagctgaggatgttagaggataataatggggagtaaataaaatgatacatttctgtttgtccctgtttctctgttggttgctgtcgttgttcagtcgctcagtcgtgtccgactcttggcaatcccatggcctgcagtgcagcaggcttccctgtccttcaccatttcccggagcttgttcaaactcacacccattgatctggcgatgctatccaactatcctgtcctctgtcatccccttctcctcctgccttcagtccttcccagcatcagggtcttttccaatgaggcagctctttacatcaagtggccaaagtattgggagtttcagcttcagcatcagtcctttcaatgaata

SEQ ID NO: 50399 - DNA, 988 bp, Bovine  19866881145934
acttgcaagctattttgccttaggctagactctaactttctgcagactgtggtttcccatccacaaaatgtgaggatcaaagaggattcccacagcccctcaactctctgcaggcaccccattctccttcttgttctctccttctagaatgtacagagtgagttatttatatatcctttccccctccttttcccatctttctcattgagaacatttcctctgatacatgtatctttcagtcttccaggtaagagtcctgctttttttccttatcatttgaatttagtcctttaaaaaccataatgagcttatgccaggaaagggacaatattcagcccaagtattatatcataatcatttttctgtcttctgagatcaattcagttaacatttttcatatctccttcacaaagcactttatgtaagtataatgttacagtgaatttaatctgactaacagtgacatagtttaatgcttcataaattctctggtttgccagctaactgaatgctgcaaactaactgacaaagtgatgggtacaccattacttgcagtgatttatgcaaatcgactataattatttcttcttctttaggaattgtcatgactagagtgcatatcaatacctccagccttcaggccaacactaccacaatactaatgtcacaatcagtgttcactgctatggaaattacatgcagatgatttgtgataatgacctaaagaaccattgatagaaatttcttacttggacaatctcttagccagaatttgtaacacactctattcgcagagaaacttcatttcccggcatggctttagcaacagaacaatatagaaaaccacatgacattcctagtttcttttctgagcatatcaaaaatatgtgctcagaacatcaaaatatcaaaacatcaaaacttgttttcatattcgattttgccatatcagcttctcaagaactaattccagacgcttaaataataa

SEQ ID NO: 50400 - DNA, 1832 bp, Bovine  19866881171197
ctcttttattttgtaagaaggctggattctctaagaaccgtcctggcatttccccctagagttttcactcacagtaaatccaccttacgacctaacttcttacatgcagatcttcattgctacaggttttccacctccccacactgcttccgttcagctctgctgctaggtctccaaagtgtccattccagtcccaattcccatcaccctcctcagtcagagatatcacttctacaaagtgtactttcaaatgcttgtcgttgagtttcagacccggcatttgctgttggtgcttttctctcctcctaaaattttaggtgtttagctggcgtgtccacttttccctctgaaatttattcctaccgccctacctctttgttcttattaccaccacttagccagggtcatcctctgtgactccagagacttttgctatgctgtgttctgcttccacatctgtcatccttacctcacttgggccatttttatgctcagtgacctatgctaatatggcaaagagaaccataatattttacatccctagaaaaatgcacgcaccaccaacccccacccttttcaatgtcatgatcaacaccacttcaaatagccctttggagttttactctctaaagacgatgaggtccatctttctcgctcatgctaagaatcaggagatcacattttctccctgtgggtcacacagtcttgctccccaacaaagacaggtcctataactatggtgtgttaaggaaataagacatgatgcttgcttagccactaactcatgagcatctcccttctcccttactccaaagtggtatatgtaaataacaaatttatttacataaataaataattagaatttctaatttctaaaactaagcatgggtcttattttttaaaaccccatttcacccatccttttccctgctaaaatatggacagagatttgtacccatcgtttttatgcaagtaggtaaaagtgattttattataataggtatcatcatgttaattattctctatttttgacagcatgaaaactttatttaaataattataaaattctagaacaagtcgaaataataaacatgtttaattttcatttaaaaaaatatttagtactcaaagcctaaaacatagtattcaacactgtaagcaaatataagtgctaaaaatgacaatgaaaaaggtgaagtccagactgctgctctaaacatttactctgcctaaataaataatcgcataaacaaatagaattcccttcccttggcagaagatcactgtctgtgcaaactttctctttgttgcagactttttccatcataattttgtgactaaactgttcacatgtgctgccaatatatgattgtaattataatttaaaaataaaggcaattctatgtttcttcccctttctgagcaagataattatatttctttggaatataaattgccaccatttttagagttaaaaattcttcaaagaacaattaagtctttgctgaaacatgaaatagaagatagttctagagaagattacagcgtttcaattcagtgcttccaatgagaagaaaaaaattggcttaactgttgcccaaagtcaatgcttcagattctaagatgtcaagctatatactttgaatgagcttaaatatgttcagcagtataagcgagccttgtaaactataaagctattgaagtgaatcaaatgtttattttctctacataatagaaaataggaaaaaatcatatggttgtgatattaaacatcatgcacttttaaataaaagtttaaagcatttctccattaccttatttctcttacagga

SEQ ID NO: 50401 - DNA, 761 bp, Bovine  19866881255299
atagaaataaatcttttaggagcctttttaacatgaccacacagcaatacacatgtaaaagcatttatgtctctaaatacacatatctaagggcttcccaggtggctcagtgggaaagtattctccttctaatgcacaggatgtgagttcaacccctttgtcaggaagatcccctggaaaagaaaatggaaacccactccaggatttttgcctagaaaatcccacagacagaggagcccggcagcctacagtctatggggccacaagaagagttgcacgtgatttagtgactaaaccaccaagtgtgtacctaaaggacaccgctgtctttcatattgcaattattccatgaacagactcagagcagaaacacttccggcgggagatgcgtgtggatataatcatctcatttctcagttggaatctcttgcttgatataacaacagaaccttgaaaatgaacagtgtttgctgagtagaggaaagggacaaacaggcagctatcatcattcaggcagtaacaatacatttatgctaaagtggtaatttctttttcgtgaactcttataaaggcattcagcaatggataatcacttctccatcacgccattcacattgttaggatctgaatacacaaatcaccataacaacaaggaaaatgaagaaatatgatcactttgagttttgttgttcaaccatctcagcgattttcctgattcaatatgtgctcaattgttcctatgagtgaaactgagtcatttt

SEQ ID NO: 50402 - DNA, 1166 bp, Bovine  19866881362960
tctgtcctccactgtcttccaaagtttgctcaagtttatgttcagagtcattgatgctctctaagcatctcattctctgctgccccctgtaggtcaaactatagttcagtatttaatatccccctggatatttactaaatgctagatgttgggactgggtgctgagagatggctggggaggggggaatgctgagcgggtacagaggccccaggccgcagtcttcctggtgcccactgagacttctgttgatgaatcgctgctgctgctgctaagtcacttcagtcgtgtccaactctgtgcgaccccagagacgacggcccaccaggctcccctgtccctgggattctccaggcaaaaacactggagtgggttgccatttccttctccagctagcgccacccaagtttatgtgactaaggagaaattcatgctcacagtctgtattctgaaatttttgaaaacccaacttagtataagtgagaggagagcagctgaaggcatcatgaagaggcactcagtatattttcagggcgaggataacagtgctaaattcttatcgcaaatgtgcttcacctcagcggtgagtgtcagggtaaattatcacttgctatcactcccttttgaaatctggattcctagttctttttccacctggaaaaatcttgtctgtattttaaactttaaaagtcaaatctttgaaataaaggtccaatttgtataaaatctaccgattttgcatacctgcaaaagactcaagtttcagtaattttcttgggagctgacaaaagtgtcagtcacttcacaagaccatcagcctgacaatctctttggcattcagaacagtatgattgctctggctttgttctttgaatgggtactataggctccttcctccgtaccctaaggaggcttaggccagaggaaattgagctctatcttcttaacaaataacattctaaatggcatcataccaagtgatttaaataaaacatctcccatcattagtctgtcttttaggcttataccagggtttctcaactcagcaccaccgacaattcgggctgaaaaattctttcttgtagggctgtcctgtggtttgtaggatgttatcagcatcagtggcttccattccctacaggccagcagcattcccccttccaaatca

SEQ ID NO: 50403 - DNA, 1309 bp, Bovine  19866881486517
tttatcaattgcaagagctagctaagttctactcaaattagcaccgatgtgtcagaaagtttttgaaaagttgcacagctttcaatctcctagcactcaaatagaaaattatcaaatttctagtgttcccaagggatgaacacggtgcacaagcaatgaaaatcaggtaagtactataaaaaatattcaattaaagtagactttgcaaccggatatactttataataaagtctattgctatgcagaagaggtgacaggttctttgccagtcattcctaagaaggaagaaatagagggccagtgaagaattagcttctaagttcttactatatttggacggtacaccttggagccatattccaacaagtcagataaatatgagttagaattataagtttggttgtggtgtaatgggacaaaaagtggtttaggagatttctgggacctctcttttctatatttataatatttctagtgtttttaatcttttttaaattaaaaagactacaactttcagaaatgatgaaaaatgtgaaaaattcttgataaaacagcaattcaatgactcaaaacatataaaaatataaacaaccaagaattattacagcctacacattaccacagacacattacatcactgaaattcttctttatgaaccttgacatcagctcagcatctcactgacagagccagtcagtgcaagtatgaacacttgtctgtgaggattatattatcaccacgatcactcactaacgaaaatgagtttctaggtattataagatcatggtatttctaaatggataatttttctaaaaatcagaatgacatttttttttggataatgtcaatattctggctacagaatattaaaaaaaaagaatcatctactgtatttgaagacaaaagaagacaatatcattaaaaataaaaagtgccagaaatgtcttaagagcatcttaatgtttctcagttcacccactgatcttgcccattttacagatcaggaaactgaggccaaatgttttagcagtgtgtcccaaggtactttgttcatcatttctacaccctttaaccccagactagtcctgaatcaagaggaactaaactatattaatcattcctttatctcatggttttccttttttctggtcccatgtttcccaaacagcctaaaaagcaaatagtatgaggatttaaaaaaaaaaaaaacattctgtaaaaagcactcataaacattcattgaacacaattaaaattaataatttgctgaaataatttaagaaattaattccttagcatttcaaaaaa

SEQ ID NO: 50404 - DNA, 1092 bp, Bovine  19866881891494
agataagcagatgggatctaagcatgactctggtcttacataaaggacaggatggagtcatgtctagaaaatccaggtcaggaagaaagaatccaaaagaaagtcaactacaggcaaacaaggggcagagcccagacagactgtggagacccagtcctgggagaagatatttcatctctctcattctttacacaacctgctgtgcttgagaagagaagccctacaactttaagaatatttaatagttaaaatgagatcttccacctttcacagggagaaagaaagagaaaccacaagcaagcaaaggcccagaaaatgagattaattagaggttacaaaaagtaagtttgattactatgctaaatgtgtttgggaaaatggtaaggaagaggaattgaaagtaagtagtatgttgcgccttgaaaactaagcagctaattttcaatcttctgcagaagggaacaaggcacaattaaaggtttctaaacagagaaattgcagagtaaagtacagggaaagttaccaaaaaagaaacactgtttgggttttaagcatctttagagaggaggttcccaaagtatgaatttcagatggaaaaagaaaatgcatcttgagaaaacaatgtgatcagaaataaacaggaaactgagacaacccgatttacagaattctatcctgctgaagttcatgcagctatagagatgtgaggagtgttgttggttttacattctgaaatgacacagaaccatagcaacaataaataaatgagacatacatacattcataaccatcatgatggagagacagcttcagtctcaagcaaacaatcatattgtttcccaagacacctacacttttccaaaagctggcctccaaacttgaatatagaaaacccaagttctaattcctattcagtctccaactctcttgagcaagccacatatgcacattgaatctcaatttctccatctgcaaaacaggaactattggacatacaatcctcagggtccctttcacggctgacattcctggattctctaacgttataaagcgctctagcgttagtgccagtgttcagtcgctcagtcatgt

SEQ ID NO: 50405 - DNA, 719 bp, Bovine  19866882135630
atctattcaatttaacaaggtgttatcatgatctagacaagctgttctttcatgaaacgacttaaagttctattttaaaaacttaagttctacatttgataatattactcaaaatgtaatgagctggcagagatacaaggtcttctacaactccaaaggaagctgatttctgcgaaggaaaaaaaaaaaaaaagaccaagcatacaaagcaattctatttcagtctttcagtctttgctagggcatcttaagagaaaaagaagagccatgaatgaaaagaaccacaaatcttgatggagagaatccagaatgaagctgccatcccagtaaataccttagtgactaaacaaatgatctgattttaaaatacagtcacgtggttcacagatcataccagcagaatgtgtacaaacaccctcttgtggtgtctgcccctgtcatctacggcccctgaggtgccaaaagagaatttctgttaaagtagaaggcttctaccagatctataaatacaagcctgcatttgcatgattctgagtagcagtataatcaacttttctgggctacacaaggaatcattatttttctcagactctagaaagactggtcctgctgttattaacagcccttgaaataagggccacttaagagtttactcaggaaaacaatggtaaatatccatgactatggatgtgctaaattaagataaggagatgcctaaa

SEQ ID NO: 50406 - DNA, 1335 bp, Bovine  19866880349490
caccccctccgagcagggaagaaaggccaaggagaaagaaaagaacaggaagaggggcgggaggctggggactgaggggcgaggactgtctttttgttctgaagaaacttttggcttttcccaacaaatcagaaaatccggcagggggaagccatttttccctccaggcccgcctacgtctgaatcaggcaaacctgagacacacatatgtttttgtttctaaacgaatcagaaggactccaggcttgtacggggtcctaaaagtactcgttgaaaattgctcacgttccaccctctcccgtgaaacttgtttccatgacttaaacatttccagcaacttgccatcgcttgctctaacctcaagcggcactgggcctcattgaagaagtgccagcgtgtccaagtgtgctgggggccgggaagtgtggagcgagagggggtgagggcctggggttgaaatggattgttctctggtcacagacagtggtcgaaccatctagttctgccccctcatcttagagccgagaaagcagtccagagaaagtcacacagccatgcgacatgggagggctccgggctggcctgtgtccagccagccgctttacagcctcccctggatgcctggaaacgcatcttatttgtgatggagccacgtctgtgcatgatgtagaggctgtatcataggaggcacacggtggggctagcagtgagtgggacctgactctgtgcctgaagttgggggctttcccagctcagtttcctggtgtgtgatattgggagcctctcgtctgggccctccgtgccccacgtgaagatcctaacagttgtaactgtactaacatttgtcatttaatgagtgcttacttacctgatgctgggaaagactgagagcagaaggagaagagggtgacagagggtgagacggttggatggcatcaccgtctcaatggacacgagtttgagcaagctctgggagatggtgaaggacagggaggcctggcgtgctgcagtccatggggttgcaaagtgtcggacatgactgagcggccgcacagcagaacgcttcctctgcgcacttcttgcatttcctcccgttttaggctccagcactttcaggtggatcccatcactggctccactctgcagatgaggaagccaaggcttcggcaggttaagtcactcagccaagatgcggagtcacgtgctggacttgggtgtccaggggcagatgttaccctcttactggctactctgctctttgcccccacgcttgggatgaagggtcagcagggtttctggatggagaaagtgaaaagggctgtgttcactattaaa

SEQ ID NO: 50407 - DNA, 1638 bp, Bovine  19866880379342
aactgtacactatgtgagtttattgtatgtaaactaaagataaacagaaaaaagaaaatgctgttaaggctgttggtaaacagaggcatgtataaaatagtcgtgttataaagccatttatagttagtgtgggtgtgtttatgcatgcgtgtgtacacacccatatttacccgttagtaaatacacaggcaaaagtatcacatgtgcaacataaataatgctcatctctgattagcaaaattccaggaaacttgcttttttcttttaacttactgctgtttcctgatttttttcccctaaaataaattagtactatttgtatgctttcttttaaaagtaattttaaaatcaacagataaaaagaaaaatgcaagctcctttgggaagctttccccggatccctccacaaattaacctttcacctctcagacttcccctccacctcctccaagcacttgaccacaggctgccctgcagcctcagtttctctgagaatgaggagccttagtctcctctgctgaactaagtgaggaagtgcctcctcacccaccttactcctgtcttcactccactttaccccacgaggcgcctgcctcaggactcatgtgtatctggttccctgctttattccacaagtggccctcaacaggcactcactaaagtgactcaccaagcaactgggagtgcacaggcatctaataaacgaccagtaaagcacatctacaggtaactggatactatccacaggatgatggtaattaatgtttcacatcaactcacaatatgggctcaggtgaagggcctttgaaatgacccatgcccacttcagtttctagaaattatttgggagagaacgtacaaagctggcttatcacttaccatatttgtggataagacttgggcttgttaatacttaaaattacgtttcaaaatcattgcaacaggtgataaagtggatgctacctggaatatacctgaaagttcaaagagccaactgagagagacttgataaaacaacagcagagagcagacttggtaaaaacagacctggtgatctgaggtgacatcagtcatgctgaagctaaatgtctgtcagtaaaggaggaagttacaagacaaaattttggtggtagggttgagctgagtgatcataattcttttctcatctaggaccctcaattttcacatccacaggctgaagtctgtgtattagtttgaaaagacattaagtctgaatcttattaaaatggtcgttttaatgattccattcaggtcaggaatatttagagtgacgttttaaatatttccttacttcaaaaacaaaaaaacaatacaaacaaaccaaaatatgacagcattctaacttctctctagcctaagcagaccaaggtcccagcagcctgcaagccaataatctctctgctgaataaaaacataacagaaagcttccaaatgtcacaacttcagaatttcagttccagttaatggagtaagtacactctcccctgaatgctgctatcatgtctgcacacattgcatggagcagctatttcaggactctgaaaaataaacagtagcagataaatgggaggaagaagaccagaacgcaaaagttccactgggcaagccggcagtttc

SEQ ID NO: 50408 - DNA, 2388 bp, Bovine  19866880472981
tgagagtcccttggactgcaggagatccacccgtccttctgaaggagatcagccctgggatttctttggaaggaatgatgctaaagctgaaactccagtactttggccacctcatgcaaagagttgactcattggaaaagactgatgctgggagggattgggggcaggaggagaaggggacgacagaggatgagatggctggatggcatcactgactcgatggacattagtttgagtgaactccgggagttggtgatgggcagggaggcctggcgtgctacaattcatagggttgcaaagagtcagacacgactgagtgactgaactgaactgaactgaacgttacttttgagcagggaatataaaaccactccagtactcttgctgggggaaccccatgaaccccatggaagctcggctgtccatgacagggaagtgctgcagtccatggggtctccaagagtcggacaccactgggtgactgaacaacaacaacacacttctattaccctaactaatgatgaagcgtcctcagtgcctctcctgtgtgtctcccttgtctctgggcagctgcccttgatttgttttttaagcccaggtgctgggtctcgaactcatccttgtatatcacatattgttacttcaaaccacttctttaccctgtcaagacctcttggatcccaacactgttacccaaggcattctccatcccatcagggtctgaacagctcatcagtttgattagcagaccgtcggtgccttcttctcagttactgatgaaaaatgctgagggagatgggcctgaggtggagccctgtggcacaccactgtagatctttctctaggtcagtgtttcccaaattgtgctcccacagaacctttatcttccatgagatgcaaatgtgtgtttgggaataaaggagccagatgaggttgacacacactgataataacagcatttgcacacaaaaaaacaaagatataataacatctaatggtaagcttccaggctagatggtttaccttccaatagatgggaaggtggtattcaaatcccttttgtccactaaaatttaattttataaaagaatttcaagctacatgtaaagatgcttcatgttactaatcatttcagacatgaaaattaaaaccacaatgaaatatctcacttcatattcataaaggatgactactatttagaacacagcagaaagtaacaaattttgtgagaacgaggataaattggaagctctgtgtactactggcaagaatatacagtggtgcggccactatggaaaattgtatggtggcccctaaaatattaaaaatataattaccacatgattcatcaattctacctctgagtttacaccccaaagaacttaaagtagggtcttagacagatatttgtctatatttgccatgtttatagcagcactactagcagtagccaaaaggtagaatcaacccaaggatcattcgacagatgaaaagaaaaaatggtgtatatatacaatggattattattcagccttaaaaaaggaatgaaattctgacatatgccaaagacggatgagcctggaggacattatgctcagtgaaatcagccaatcacaaaaagacaaatactgtttgatttcacttagatgaggtccagagtagtcgaaaccgtaaagataggggctgaggagggaatgggagcagctgtttaacgggcacagagttttgttttgcaagatgggcagatggggaagagtggtggtgatggttacacttcacgccactgaactttgcattttaaaacggttgagatggtaaaccttccgttatgtgtgcctcctgtgagtgccttccccacggccaatcactccttccttcctcagacactttatttttttcaatgcccctgccctgggtgagaaccccagccataccagcatttgagagcttcttgtttgcttctttggctctccagggaccctcgcttggttctccagcagccagcagtgtgggcagcagccatcaattctgactcatctctgtgggctcctattcaaatcctgggtgtcagcttcaagaagtgaagtgaaagtccctcagtcgtgtccaactctttgcgaccccatgggctacacagtccatggaattctccaggccagaacagtggagtgggtagcctttccctcctccagggtatcttcccaacccagggagcaaaccgagggctcccgcattgcagacggatcctttactagcttagccacagggctgcccccaactacagccgcctcagataccccagactagggcactactcccttcccacctcaccagcctcccctggaggccctcccaggaccaagaatagacctgatagaccacaggaga

SEQ ID NO: 50409 - DNA, 1280 bp, Bovine  19866880543179
taactggtgtaaatcacagactacccaaaatgtccctgtcctagaagaataacaaggtttcagtgactgctgactttgagaaaagtaacatattttcagtttgctgatttaactctttccttacaagtgtcagatggtgccaaccccaccatgggctccttattcaggttacttcttacaacattttttattgatatatttattttgaacacagaaaagatacattgttgcttatttagcgcttaatccagggacaagaaaagctgcttggctccatcccttcaacactgatgagcatgtgggggtttttatctccccccccaacaccggcactctctagggttgcagaagcaagatgtgtttcttaaaagaacctcagccctggagtgcattttaaaagctatacagtacaacagacaagagattatttttttgcctagaaaacacgtacaccacaaaggtggacagaactgcgtgtaaacaaggtcccttccccgggcagagtcaggggcgccaggatgctacagaacctctgggtggattcctttcagttctgcaccagaagaaatgctatttctacagaaaataagattcacgattgccttcctcgccacctctcttcttaagaaagggattactaaattgtcttagccctttattggaggaatggaaatgtaggggagaggctggttgggggtgctgcagtttaaggagcgggtggggagggaggcggggtgggttggagggactgccgccggtgatgctggtggggatgctctttatgggcgctgggctgccaccctcgtgcaggctgggtctgcaggcatcagctctgttacctgcgtggtctcggatggaaattgctgggattcaggggccaaggtctaagtctgtttacaacgaggcccatgtactcctttctgcggtagccccagcagcaaggctgagatgcaaccactggtcctctcgcggtggcacagtagggcccacatccccttgatttcatttgcgccagcaccatggagggcagaccagaaggtgctggctcccaactcccaaccctgagcccccacctagagcgccagcactgctcctggggtccgtctccagcccactcgagcttaggccatgaatggccggcagggcatgcccctagtgaggggctgctcctctgcctcagcgcctgtccccagcaaggccccaccccatcttctttgaagcccctcagtcccagacagggttgaatgggcatgggcaccgccgtacccactaaccaccac

SEQ ID NO: 50410 - DNA, 1249 bp, Bovine  19866880549248
aatgcagagctgagtggttgctgcttaagaaagactcattacctgcagaggaaaacatgggagctgcctcctcccattatgcaaggacaatgatcattctggggacttaatgtgtgtcaggagctgttttaagtgctttgtataaatactttaaatcctcacaattctgacaatataagagagactggagggacagtttggcagcttgtcagtgatggtacaagtaaccgggggactgactgggctgctatcccaggagatctgcctccatgcacctgactttttaccactggtctttaacaggggatggttcctttaaagtactcccacatctgggtagcttgaaagagagtagggctgaccctactgggtcagttgaattggatcaactgatcgaatctctacccataaatactctgaaaaatctaggatctgaacttggtccttagatatatgtgtgtgtgtgtgtgtgtgtgtgtgtgtgtgtgtatctagggatgagatttgtagccaagcagtccgctggaacaaatccttcttcacaagtggggtttatacttgaggaaaagaaaaagtatacccactgagtagtcacatttaggattaatcaggacacagtgttccctgagtgtggcattctgggtacttgtctttcatttgtgttacaaaaaaaaaaaaggatcaggttttgctaaaagcagacaacaaacggcagcccatgaagtgttagagaggcaatcgtttccctgaatattcccattcagagcaccaactggataccctgctggcgggtctctgtctctgtccgtgtcaggaaccttccggaggaggctggcaggtgccggctgttcatgctgtctgaactggaagctcttacctgggctgggtgagtgtttcctcctgagatctggggtctggctctttctgaaccctggagaacctttattctctggtcacacacccccttgggacttgcctcttgactttgggagacatttgcccttacagttttgttagtctataataaatggtcttattcacttatacctatttcttcaggtttaaccttttggaatcctagtgatagcattgttcagtgaggttgatgacagtgaactcaaggccatcactgtgaggaataactgatggactcaaaggcatctctagcaaaggagacacctcagctcatgtctcttccccctaacggttctgtttgtgtgatgcaagagagaagtcctcttccttttgt

SEQ ID NO: 50411 - DNA, 1097 bp, Bovine  19866880556577
tgtgtgtttatttgctttaaaacattgtaattacatcctccgctttggaaacttctgggaaccagaaactctgcacatggactttggctgagaggactgtgagccagtgctttgctcggatgactaccgccagtggaagttgtgggataagctttcagaagcagaccatgccttgccctgtcctcactctaacactctcagtggctccaaagggcttactagcatcagaccaactccactgtatgcagaggagagggaactgggcagcaagcctggagaggtgggttctgcagtaccccaaagtggttccctaacctctccactctttgcttcctcttccaggaggcagttctagttgcaccagccctgaagcaatgctggtttccagaaccatcactgggctctccccttccaatcctgcagtttctcctcatcctgcaagaaaacattgagcttcagtttatatttaggttatatttatttcttctatttctgtatatgttagaatatacatgtgtgtatatatatattctttaccagcttagccaccagggaaccccatatatatatatatatatatatatatatatatatatacacacacacatatatatatgtattttgtgaccctatgtactgtagcccaccaggttcctctgtccatgggattttccaggcaggaatactggggtgggttgccatgccctcctccaggggatcttcccgatccagggattgaacacatatctcctgtgtctcctgcattgcaggtggatactttaccactgagccactggggaagcccctatatgtatgtatatatggttggtgatgtgtccggtctgtaaaaactttttactaaaaattctgtgtgattaaaaaaaaataagtggagatagttagtgtgaagagggaggaccctataggtgaaataaattggaatctgaagacctcctttaggatcctggtcctccctctgactcagtgcatggctttgggcagtacttgaccttccttgtccggaaataattctggtctggagagttcattataaggggaggatcttctgaaggctgagttacatagtgcatgctaaa

SEQ ID NO: 50412 - DNA, 1477 bp, Bovine  19866880585313
ctgcagttgtaaaatctacagttatctcccagcctaaaggcctcagcaagggtgactgactctgaatgtcatccgtcctccccctgggctcaggagtagggtataagggacagagggggaagctgggctttgcaatcacaaaagcccaagcaaaggggctggggggcactctgggctcagacacttgccaggcagctggcactgagtgtggttacttaggtacactgattccaaggccagcacaaaagttcaatactctcttaactcttatgttcatcaaccctgtgactgacatttccacttggcctatagtggggcttctcaaattaaatgacttctaaaccatccctttgatcttcaccccacagttaatccctgttacccaggtttccagctcttaagggcaacaccatccaccttgtgttcaggccaaaccccagggtttattgtttatccttctttttctctcatccttccagtctatcatctcctttaacatgcagttttgtaatcagttaagtgaggataatatctcccttcctcagatgatgtgaggattagatataatctatataaagcaccaggcacataggaaatgctcaagtgatatccattttcaataccaggctctactcactgaacaaaagcccccattctcctgaatagacacataggctctgattctgtgcattaaaaaaatgaattggaaaaacatatatcctagagtctaggtttggagagagaaatgctaaaggcctcagggtgagcatctaagagcctgtgggtaaggcagtggtgcattaaatgagagtgctctcattttagcgtgctccaaagtagcccactaataagctatgatcatcacaggtaaatggagatttcccaaaaagaagagagaaaaaaaaaaaaaaagacaaggaaaataaatgtgcaattcaatcaaaagccatttggctgaagttatgcaatttcaagtttgggatcaggcattatgcttattgccacctctgataactaacacattagttttctgctgtatgcaattattatggggaaaaaaacaaaacaaaattcaattcacctgcatttgtcactagagtattgcgtctgctacacaaaggcaggagattgaaaagaaagatgcctcttactgaattttgagaaaatgtgactcttctctgagccttgaatacacagtcggatggtttgaagaagggtcggtgttctgcatacaacccatgtctttggcaccaaggcaccttctctttaggcacgtctgtaccctggccccgccccttttcatacttgcactcaagatctttagtcttttctattggtggactattgatacagatgttcacccagaacaatgtgaagagagtcccagctcctggaaacacccatggtcactgactgggaaaaatagaaaatgcctgctctcgcataggtctctgttcaatgccatgtcggttgtctg

SEQ ID NO: 50413 - DNA, 2941 bp, Bovine  19866880610698
gccctgcccggggtgacttgcctcttttctaaaatctggcctctttctgtgtttcctgctcttgcccgtgttccctctgctctccctctccttatctacctcaaccttgctccaaaatgagattccaaaggcacctcctccatgcagtcttccttgacttgcagtgtgatgttgaacagtccctgctgtggacctctgagtctccaaacctgtccttctgcccacccctccttggcacctccttcattctgcctcccagatggctctctctcttgctgaagtggacgctctctgaggacaggggtcgtgtcacagactccacgctgtatccccagggtggcacaggagctgatgtgctaccactgctggtggaagggaggcaagggcaaaaatggaagccatcgcctcacggagccatggacccaggtgtccatgttttggccccaatatctccttaccaggagaaccccactgggatgggggtgtaaaaagataagcccaggaactcccctggtggtccagtggctaagattctgctcccaatgcagggaacccagggtcagtccctggttggggaactaaaacccacgtgctgcaattaagacttcacatgccgcagccaagacccagaacagctagggaggtagctagctagctaaataaacaatatctttttaaaaataaaaagataagcccaaacaaccaggcattttccagagatttcaatattacactcatggcctaaaaggcatggctccctccactgggatctgggcttgcattttggagtcaggcagaatcagaatcataacccagctgcccaccttgctgtgtggtcttgggcaagttacacaacctctctgagtcttactttcctcagcctagacagaaagataatcagaattcctccagagggttgtcgaaaggttgtaatcagataaagtaagtagaagtacctagcacccaagattctcaataaatgccacgctcctctcttccttgcagagttagctactgtgagattttagatcacaaagcacctcaatctttccatctgcagaataggcaggcatgctcaaagcttctcacttcactgttcaaagatcaagtatgtataaaaaatatatatttataacagacttcacttattcccagtatcatgtcagtgtgaaatggtcacccattcttcctaaacactgcaggaattatcctctgtcacttctaagaggatcgagagattgtcacccaataagaacatggctctttgcaaagaaaaccatggcccatggaagaggcctgtactctgctctctgttgggccccccagtggtataaaagggactcatgtaatctttaccacagcattttgagactgggagtgcccttcccactttactgatgaggaaactgaagctcagagaggtttgctgagtccagatgcagagctctacacccaccactgcccgagacgctgcaggagagagagttggttacagagttggttacagagacctgtacagttggttacaggtcgagcaagtgtcagactccccagtgctacaagaggaagcgcaaagggctgaaattactagaccttgcttcccctccggttctcagaggggaggtacatgcagtaggaaactgggacattgaaaacatgtgaagatgaagatgttagtcgctcaatcgtgtccaactctgcgaccctatgaactgtagctctccaggttcctctgtccataggatttcccaggcaagaatactggagtgggttgccatttccttctccaggggatcttcccaacctagagatcgaaactgggtctcctacattgcaggcagatttttaacaggactcaaaatcagattcctgacactctcctataatcctctacaatactgtaaaattaccaaggtttgcatccacttagaaattttaaaaacaacaacaaactataatcaggtactcttagaaaacaatttttggggtctctccaggtgaaatcagggagaccgtgcattctagattgcctaggacagccccaaacatcagaatcatggtcaacttgctactcacactcaaaaatatcctcatatatatggtgggtcatcccagatctgtggttctcaaccttgcctacacatttggatcacctggggagcttcataaacatctcgattaaataaaaatctatatggcaggagggagggtgtgggatccaggcagtgatcacttcttaagctttccccagtgactgtcatgggcagccagggtcaatgtcacaggtggaagacacacccttccctggcaggcaaaatggaaacaagtcgccagacagcagaggacagggaactccatccagccctgagccgtcctgcccccaggggtccgaggtcagcagaggacggggcacaaagctggtccgtggaccccatctgtgggcacgacgcctgctttccactcgcctgtctgtatttcctcacctgtctgcttcgggaacgggctggaggctctgtggcagctccactgggtgctagctcagccctgagcgcatcattactgctcgctggctccagagaagagatgaaggaaatcacctgtttcaccttgaagctaaggaggagaacctgaagagggagatttgcccacacttgctggagaagaatgccagagaatgccatcaagactcgaggagccaggctgctggcacagagcagccgggagcccagggtgcaaacgtgtcccgggcagggtttcctgaacagattgtctccaaatgttgctctctcctaattaatgctgcgagcgcagtctctggtctctcatctcacaccagggaggttcctgcagaaagaaagtccctgccatctccttgtcccagccacagagagcagagtctgtccccaggcagttcccctgggtttctgaaccattttcaagg

SEQ ID NO: 50414 - DNA, 1636 bp, Bovine  19866880654094
ttctccctgaaaaggcaggtggcacgtccgtcaccatggtcttcagtgccccaggtggagcatctcctgcttcctgcgtattcacggtcactctgcctccccagcagggctgcagatcaccatgcagatgagaaaggaaggaacacatccctgggccccatgtgtgtcctgggagctcacacgggtcagctttcctcctggctcccccaggtgctcccagcaagcaaaactcggcatccgcacaatagccttttccctggtttctcggagatcaaggctcacaagcccaagccagtaaccacgtctccttaaggcaaggaaagcaaatcggagcagcggatggttcagcatcgtctgtgggaccagcagccacgtgactcagtggcccaggcagccgggcgcagcacctgcccccggggagagggcgtttcggtgcctggctcgggtggccccttggcccaaccagagtctctctgagagttgagacactgtcccgatttataacaggtggcgctagtggtaaagaatccgcttgccaatgcaggagacacaagagatgtgggttcgatccttggtttgagaagaccccctggaggagaaaaatggcaacccattccagtattcctagcctggaaaattccatgggcagaggagcctgctgagctacagtctgtggggccacaaagagtcggacacaactgagcgagtgagcacacacagcctgtgtataacagtatctttcatctcacctggaaagattatggccagagggcagggcaccttctcagcatgaggagctgatcaagaagagcatcaggggggctaacagtgacccgggcccttcaaatcagccactgtttctaggaagcgaatgcactgacagtgcctgcacaggacaacctgagaaaaaccttgaatctttacatttaagctcaaatcatatgatgggcatgacctctctgaatggaagggctggggatgtgaggatcatctgatccacgaaggaccatcagatgcagcagacgccgtgtcgtgatgtgaacagcatcctcccttgttgcccttatttatattttattacgactttattgaatgttttcttgtaggtcagctgaaacccttgggggaataaagcaaagcaaaactaaataaacgctttgagtcatagcggaggagggacggcattccaaggatagaagtgagcactcaggtaatcaggggggctttgtacagagacaccaaccccagccacaggcagcagctcccgtctccacgtggctaaacttgcttaatgcccaccggacacctcctacgttaaatccaccaaccagcatgcttaacccagcatctggacccgctccatcctcggctccccgagcctgcactgtgcgtagggcagggtggggcggggtgggggggggggtatccagagtgtggggctctggatgccagagcacctgaactccagccctgggttctgtttcttctgctgtgtgaccctgagcacagctgtcacctcctcacctgaaacgggggtcagtccagcacctgcctccacagaagcacgtgggtggatatggaatgagcgttcagcaagtacccattctaaggcccagccccccgggagtcacctccc

SEQ ID NO: 50415 - DNA, 662 bp, Bovine  19866880678869
ggcaaggtggcaggtggtcttttccccaagactgaactatatttggaggcaacccccaccctccctgtattaaaggcatccaaagaaagcctcaggctagattaatttgactccttaaacttgggagatttttaaattcttattagggagactgagataacttattagataaaataatccttgcaaagttggcaatctttggccagcccatcacttcccctgcctgcgtctccgttttcttatcaatgcaattgttagactgatagtgtcgtacttcatgaagctctgcagatcaaataagttcacataaattataaaatgttaaacaaatgctgagatttgatggtcattattatgagcatagcatcaaccatccatctcagaacagaggaaatctgcaaagtgacctggagaattaatgggaccagtgacatttatccttcaacatccatctcttcccagttgttggcgtctgtctccgggactcgacgtggaagggggtgggcaggtagtagaattgcagtgagtttctctttttggttttagcatttctggctgggggcatatgtgtgtgttgctaagggatacgggtagaatataaaaccctaggtcacgtgaggagagaactgctagcattcaagctcttccagtgtctgtctggg

SEQ ID NO: 50416 - DNA, 816 bp, Bovine  19866880679372
ccgaggaagactttgcatgtaggaccgtaagagccttgacaccagtgggcagagatgcagaggagatgctgtctgagacctgaacagcatcttggagaaggtggtgagtgagggcagccctagaaggctgcggggaggacgtgagtctgacccatgagtgcttatgggcctctgatgtgaggagctacagtttctagagtattcctgcacagagaagtgcttaatagatactggaggaatgaatgaattggataaataaagggaatggcaagggaatgagagaggacactgtgaacggatgaagacatccagtagagatgtaactcaccattggctgggctcttaatctgtacctgtgccttgacttctagtatttcatttaactggctcatcaaccatgcaggcagatgtgtttgtacaggtttcaaaactgaagaaagtaaagccagagagaggttgagagactctcccaaagtcacccagtcaggctatgagaggaccaggcttttgtccttcgatgtagctgcaaagcccttgttcttgagacgtgctttctttcctctccactgtgactcaggagaaaagtcaattttcagtggtcgtggttgtttgctaaaaagagcaattccctttcctctatctctaattttcctccaactaattgcaaattagtggtaattttcaaatgaaaagagggagcctgcatgccatccatttgtgcttacccagcaaggccctgggcctgtgacagctccgttgccaaggcaaccctgcatcaaggccttccctggatccttggcggtgctgccctagact

SEQ ID NO: 50417 - DNA, 2357 bp, Bovine  19866880731033
atgctccctctctgtgtattctgtgaaatttattttccaagtttattactgggacatgtaagaagctcccgaggattattacagtttggggaaaaaaataaatgctaaaatgtgctagttttattacccttggaaaagcagagtgtgaagagcactatataacttttagggtgtaagatgaacaggatgtgaccatgttcatcatctctttgggataatttagctgagtcctttctgccactaaatgatgttacaggaccacctaaggaaggctttgtcatctcctgtccagaccttactgcagtcaggtccagctccacagtggagagatgcctcagagatcctatccttcccccagctctccactttggggactttctcagcttgtgattagcctgaaatgcttatcattggctttcaaaagtggttccagaaggtgccaccttaaggcatgtttatggtttgagaatagctctaaagtcctctcttccttaatacgggttgaagtgaagtgttagttgctcagtgtccagttcccggcgaccccatggactatagcccaccaggctcctctgtccatggggttttccaggcaagcatactggagtgggttgccatttcctactccaggggatcttcctctgacccagggattgaagccgaggctcttgggtcacctgcattgcaggaggattctttacctgctgagccaccaggcaagtcctctaatacagggttatcagcttggatacgagtgctctggaactcaaaaggatgagaccagtgcagctacctgtctggccaaagggtggaaagccagcacaggtctcagaaaggagacctaaggacacaagattctggggctaagacttgaaagaggagtgtgaagttgctccggttttcctagaaccagcttatggtccaggctgacaggccaagaatcttagctaatatcttcaattgcctatttcaagagtttctggaccatttgggcacttcactgggcagctgttcctaaagctgtgagtatgacaggtaaagcccctatgctactgaataaggttctacaagatgagttaaaaattatttatcatcaataatgacagacattttaaagtaagataacattgtgctttattcagcctctaaattattttgattttccatttagtgatcagggatatgtaagatgtagatacttgtgtatctggctccgtctctgttccctaattttgaggtcatatcaacatgaacttcaaagggaggtaaagattaagaatgcgctatgattttatttgaccatgatcttaaatttaaatttattttgatgatctacccctaagtgaatttccctaacagaaacatcagccgttatctaccaatagatggagctccgaggagaatccatgctcggaggttgctctggttcgctgaggatctccccagagcacattagcagtggatagagatcctccttcctaagcctgttagagattccttaaaggtttacgaaaaacaacagagtttattaaaatgtctctctatggcaggaaaaagtagttaacaacgaaactgaacacttacaagtaaaggccaaaataaacagctaattaatcgatcaagtctgagtatatataaaagtatgaaaaagaaagtagaagcgacttcaaaatccagtgacgacaaatgtacggctctggcgcttgtgctaggatgaaaagggtcatagatgtcgcagctagtgcctagaggggaaaaaaacacgacctcttccagtgatgattgaacaagtttaagctgtaaaaatgatcgattctaaaatgtcaaaataaacgggtttcttctttatacacacacacatctaaacgaggcagactgaaatgtacgggtgtcgacttctcttctcattttaagagaactaggtatcccttcctgttttgtttaattaatttctccacttgtatgcctaatgccatcacttcccacagccatgcccttgatcttttcccactaagtagctcggtttccctctcacaccttcactctctcctcctgccctagctcctttcctcatcatcttatcaacatatctaagttatcttctctctctctttttaaacaatatttatttatttatttggctgtgctgagtcttactcgctgcatgtgggatctagttccctgcccagggaatgaaaccgggtcacctgcattaggagcatggagccttagccactggactgccagggaagtctctaagttatcttctcttaaaacatacacaccccttcctttcatctgctccccacagaaattcccatttttctacttctccctataagcttctcaaaaaaagc

SEQ ID NO: 50418 - DNA, 1616 bp, Bovine  19866880767485
tttctcccacagtagactgcttcttggtataaagttgaaaaggaaaaaaaaaaagaccccagaatggcctctctcaaaaacagcagttctgtgtggagaacccagggtgcagggatgaaggtggattgcagcccagcaacttcatgctgcagaaatagaacaggagagccataatcagagacgttcccacccacccagctctgcagcgtgcgatggtgggttttgccagacaaagaagtcttaaataggggtttttaggaacatccaaactagagtttctcaccatgacatttcgttgcttggagaggttgctggggtggtttggtaagttttcaagataaagcaacacttggattatcacattcccaaatcatgactaagaagatccaggctgtctaaataaagggaaacaatcctatttagtggcctccaaatgtaattaaactgtcaagtcagtaattttctaaatgcggacacctcatgcgtgactaacaccttcgttccccaatcaaaacacactaaaggaaggaaggaaacaaaacaaaacaacagagagattgcaaaatgccctcctaagaattcagccttgaactctgcatgtgtgggacagatttctagccaagttagtcgttgctgagaaagtctctcttcttttcacgaagctggctgaatgctgatcagaatcttgacccaggcagcaggtggggctcccccatgaaggagaatgaaaaagttgtagctacagcccaagcatcgaagctgagaagcagaggtaccaggattgaccttgggtgtctgcctctgcggcctgccataccccaggcttattgccagtagcaagagctttcgccacatggacatttggtggttactggttttcctgcagcacagaggcctgcaggccctgacctagggagtagcatgtgcctgttcccttgtgggtcaggtcagagagatggggagagaaggacaggcaggagaaattccagatctgtagccctagctctgagataacttgggaaacagcagagtgtggtgagaggcagcgtccagtacctctgtgcttagagggggctgtgtccagtactgacctccctgcaagagacagccaagctgtggggaggggtccatttcagcaggaggctaaagaaagggccaggctgtttactaggctcgtctcatgaaaggagttggaaattggcagaaatttcaaattctgactgcgggactgagctatttctgttgaaaacatttgaatgactttctccccacccccacccccttcttccacaatgtcagatgggcacacttccaggcctgcctccgcacccagccagcctcccaaaagccgcctggcgctctctctgctgaaaccgtgaggagcccggctgaataaatggcccggcagagctccagtgagcgctcaagtttaatatgcacttgacctctttgtctttcagaaatgaaatttattgagtttggattccagcgcccccgggcccccactaacatctaattaaccagaccacactttgacttcaaaagtgcagggaaatgaggagatgtatttgctgcaggaacctcgagggaggggctggggagctgacgccagggat

SEQ ID NO: 50419 - DNA, 1743 bp, Bovine  19866880775077
acccacacactatatgcaaatcacagaatcctgtgaaaaatatcattggccttccttgccccctttattccatgaacacagacaaatttgctagaattattgctctaggaagattaaactggctgtccatggagaaaagattgactaaaccccatctgattctaaaactgacggccacctaagggagaggtctggcagagagaagaggtgaggcagagccctttggtgtcagtggtcacctcagctgcatgtctgcatgtgtgcagtgctctgacagagggagtgggggcagggcttgaagggcagacaggcaccatttacacggaaacaacagctcagagaacagacctgtagtcacagacacctttacaacctagctgtgggaaataagaccagactccatctggttcctaccaaggccaactccacagccatggtccaacactcccagcgaaaagtgttaacatttagtcattgctttgcagaccctgctctgtcctgagtttcccagggagtggcaagggatttctttgccctagagtctagagaaagatgtttttcaaagcaatgaagagctatttcctctcacccacaggtagcagatataaaagaaagagaagaattactccaattacatggtagacactgaaaatgcagaggacaagctctgggtctaaatgttatttctccataagaaaaaaaaattaatgcaaccattctttctctggaccaaaggcatctgatatggatgctccacatttagagcaatataccccacaggatatttgaaagctctgatttaatctttaatttctccccaacaaggtgaatgcctgaattgaaccactgcaataagacagaagttccaattctatgactagctgttgctctgcgttcataaatatttactcaccttctagaggttctgggaaaggggaatggtcaaaacttcaattgcctccttggtacctgaccccacttatcttgctgctgaacacctccaagagtaagtctcaagacccaatgagttgggagaaaaatatcctttaatatagaccaggataacatgggcttttcaccctcagtgtccttacagagagccacttccattattgctctggatttttcttaaagaagcaccaaacttgccactgagaacattcaaatcacttggctttgactgggctcgagataattactggagaatttcccccataaaatatgtctgctgctgtcagccttgcccgctccagtccgtactccttactaagatccaggtgaagttgtaaaaggcaaatccaatcgtgtgtgtggatggtgctccacatccctgagcccactggagtaaaggacagtccactgcacacacccagtatcccatctcaagtgcacactgagatattgctttgttttttctacctctgggcgttctctagagtcacacagcccagctgaaacccatgattgattaaaattcctttgactgtgaaaattaccatcacacaaggaagaggtcaggcagagggaagaaggtgaggcagggtcctttggcatctatggtaatttactctccatgtccgcatgtgtgcagtggtctgagagaggcagtgagggcagggcttgcagtgcatttgggcattagttacatgcaaacagcccatacgtgcaaggaattatggcctctgagagcaacctccaattaatgaaggatgaaggtcaggggataaatggctccacctccca

SEQ ID NO: 50420 - DNA, 1753 bp, Bovine  19866880809980
tatgcctcatgtggtctgtctgtctgtctgtgtcattgtgtatgtatgcagacagctatttgtgcgtactaggattctgaaatctgaggctataagccacacctagcccagtgaccgatctctagtatctcacacccagtgtcataagatctctgaaagctacacatctgaaatgtgacatttatactcttcccccatgtccctacccaccagtttgaatacttttactggatctttggtttgatagcatttaatggtaccaccaccagccctcatgggagcagggccaatgcctctcttgttcttcaatgagctcctgatccttcaaacagtgtctggctcatagtaggcactcaatagatatctgttaactgttgaataaatattgctgaatatgttgcgtaaagaaggaagggcctggtgagaattttcagaggactgactctaaaatgttactgatgatcatgttcattccataccatggtgtcctctgaagaaggaccctggggagaaggaactttcttgttttcagttcaattcagtttagtcactcagttgtgtccaactctatggactgcagcacggcaggcttccctgtccatcaccaactcctggagcttgttcaaactcatgtccatcgagtcagtgatgccatccaactgtttcatcctctgtcatccccttctcctcctgtcttcagtctttcccagcatcagggtcttttttaagcagcatcaggttcttcttattttaggaagggaaatacttttgcctctcatgggggaaaaaaaaatcacatagcttcagttgtgtggacatagatttcctcttcaggctggctgctaggaaactcaaagtgtctgttgattgaccccttgtgacaacacaagattttatggaatgcattgttttattagggtcagttcttctgtattttctctctaagcaaacatttctcactgacccctagtattttgtgattgtgctatatgtgtctttgtaaatagtcttcagttctggcgagtgaatgtgctaagttgcttcagtcatgtctgactcttcatgaccccatggactgtagcccgccaggctcctctgtccatgggaattctccaggcaagaatactggagtgggttgccatgccctcttccagtggatcttcccaacccagggatcaaacccaggtctcccacattgcaggtgaattctttaccttctgagctagcagggaagcccattatagagtataaaggatataatataataaaggatacagatgaacaaagaggtacacaaggtgagttcaggagatcctaatcccatgaattgggatgtgccgccctcccagcacatagacatattcatcaaccccggaaatgttccaaaccttatgctttaggggatttttattgaggtttcatcacataggtatgatcagtaattaactcaatctccagcccctctcagagaaggcaatggcaccccactccagtactcttgcctggaaaatctcatggacggaggagtctgggaggctgcagtccatggggtcgctaagagtcggtcccgactgagcgacttcactttcacttttcacttttgtgcattggaaaaggaaatggcaacccactccaatattcttgcctggagaatcccagggagagcctggtgggctgctgtctatggggtctcacagagctggatacgattgaagcaacttagcagcagcagcagccagcccctctcctctcc

SEQ ID NO: 50421 - DNA, 1731 bp, Bovine  19866880836127
ttgctccggtgcagaggttctcacattctggcataccagactcacctggagggcttgttgggtggaaaaaacccaaaagaacatccatggggattctttttagtaaatctggaagggggcccgaggagtcatatttctagcaagtactcttgtgctgctgaggccattcttctgaggagccacagtttaaagaaccactagctgagaaatctgtaggtcattccacatggggaccatctggagtgtggctcctattgtcagacttccctgggtgatgctgctgtatcaatccacaaatatccagactgcatctccactcatcaaatcagcttctgaatatggttttgatgacagaattaagaattattatcttaggccatagtggagaggcaaaaaaaaaaaaaaaaatcccaacaagatacagcctacatgatagatagaaaacctcccaattatttggtttgactcattgaatcagccagcaaatatttcttgaacgtgaaccttgtaccaggaattgggcagacagcagagacagaaaaatgcatcagctatggtggtaaataataggcaacagatgtccaccaaggtggtgcatgtcgaggggaagcaggaaaggtggtatcaaggcatgtgtatgtacacgtaacggccttaggctctctcactgctctcctcggggaggaacccagctgcctgcacttggcatatggttcctgtacatcattcactggaagcagacacattggttctcagagtttccttgcgtgcagattcctctacccatacagcaccatgaatatagactaattacaagcaaactctcaaaaagagtgattatgtggcggctgatttacagcattctttttttactccttccctgtctgtggctgggaaatggaagaggcggctttctctgttaaacttcaatgagccctggtccccttgcctgccttggggagggttgagatttctgtcgactgggtgaagtttcccggtggttcccctgggcaccccctcaaagcagcagagagcagccttagcacccaaactgggctgggagtgggtggagctggagtatgggtggaagatggcattttttttctccctctagtgctgcttttcttagcagtaaaaaaagaactaagacaaatgaccctattccaggtgtttaggtgtgtgtatatgtctgggtttaaaaatgtaaagacttcagcgttaagaaacctaaccttcaaagtctctgttgtgtcaattttgttgtgtgacctcaggcaattcccttcccctctctgggtctctaatgacagaattggatgaattggctttaacatccaaaggattatgaacttgcaaacagttgacccttgaacaacatggaggttaggagtgcaaaccctcctcacagccaaaaacctgcctgtaacttagagttgaccctctgtgtccatagtccctccatgtatgcagattcaaccagctggggattgtgtaccactagtgttaccactattgtggttcagtcgtaagtcgtgtccaactctttgtgaccccatgggatctttgtgaccccatggactgcagtatgccaggcttccctgtccttcactatctcttggagtttgctcaaattcatgtgcattgagttggtaatgccatccaaccatctcatcctctgtctccctcttctccttctaccttcaatctttccaccatcagggtcttttccaa

SEQ ID NO: 50422 - DNA, 1143 bp, Bovine  19866880882253
gggagagcatgggaccacctctgtaactggcccatggtggaactccttctgatccctcttctcaaagttctagaatactctctagagccttttctcattggctttcagatgcactgtctcagtttcatactagaacccagggctgggggatcccatgcacaggagtgtaggacatcccgacaagatgcctgcatgatggtgtctttaggggagaattgagaggctgctgcctcaagtacgtgtcagggatccttccctggggaccacactcaccttctacactgaagaccctggcagaggaaaaatagaattttctaacagccccacatgctgatctgtctagataaagccttgggaaagaacattattatccaacagcgatgctggaacattgcccagatatcaatttctggatgagtcaccacagattctgcgagaatgggccagacagattctgaaaggtcccagagctcttggctcatttgcagcccgggtctaaacgtcgtcgctttgctgaggagactgagggtcatgccagggtgtgtctggcttcccatcccataggcgggcaatgaaccttccaggcccaggaccagaagagcccatctagccctgcatctcagggtcacgcctggttggggccgtgcctcttatccacgctagtggtgtctgtctttgctgctcacatctgggcacccagcccctggaccaggccttggtccttggcggctgcaggtgcgtaattgctgaccacgaaggcacgttccccactctgtgccaccagtgggacctccttggagaaattttaactcttgtggcctctgtcaattgggattacaaagacactgaaagaggaaggggcagaacatttgaaaataatccctcgcatctgtccagggaagctgtctcaagctgggttctcccagaagcaggttttgattgcaggtgtttggtcttgcgggtgatcagggaagcacctcctgtgggatccccagatggctctagtggcaaagaacccacctgccaaggcaggagacataagagctggaggagggcatggcaaccccctccagtattcttgcctggagaatcccatggacagaggagccggccggctacagtctataggatgcaaagagtcgg

SEQ ID NO: 50423 - DNA, 4508 bp, Bovine  19866880974165
gtggaggacagattccaaatgacacaaaacagccctgcgttacactcttttccagagctgtggtaaggatcccaggctgccctttgcttaaatcacagcaatcagtaaccattttgcccctggtccttgcagctgctgccaactcatgattgagacagtgggaggtgtcgggaaaaagaaaaccagcctccagcaggtcccaggccccagaccccgctgctcactaaccagtgtgaccttgaacgtgtcacttaaaacgcctggcctcagtctccccttagtgaatcatcttcaagggatttcccactgacaataatacatgcttaataacctacttctggtttgcctacttggggcaaacagagatgcctcttacaagcccactgagacaggccagcatctgtgtgcccagacctcctcatgccctccacccatcagcatcctccgggcacggggttcaatacctggaaactcttgggagtctcaggagcctgactgccgagccaaccttggtgggctcatctggcattttggccacatttgcctctggctccaggaggaagtgtccctgtcactctgatggccaccttggacactcagaaattaaagaactctgaggcacccttctccacccacaggacgctggagacacctgccacttacggccttaagaagagctggtccccaccctggcagccggagtcggtcttaaattacctaaagagcctgagtgctgggcctgggctccatttgtttacaaaataggcactttcaaaggccctttactagggcctggcaattcccaggtcccctgctataggctgatgcataatgcataagatgctgggaaatgtgtattcatgagggcggcttggcttttgtcaaaaagaactgtgaaatattatgatggaacaattttcatttctgccacattgtttttatagcgcattcacgatggggattgagggctttccgagttttgtctggtgcagatgttgcagtgctgaaagctgcttcagacctccttattttccaactttgttgctgacaattacaggaggtggggggagggggcctctcacagggagacaaaggatgcctgtcctcaagtgatctcaccctggcttcattcaggagggtgggatggggatgagggtgaggaggaaaggaggaaacggaggggacactgacctctggaggtgctcgacaccaggcaaactgccctcctccgaggatccattaactgccttttacatctgaggaaatgcaggcccggccgggttgagccacttgtctgaaatcctatccaccaatggatggcgaagcctgggctggaatccacatcaaatgcccaagcttacggtttcttccagccccaggcaaccaggagaactcaagctgaggggaggcgctctctctttgcagtgtatccgagagacaaagggatgagaggcgcgcacgctgcccggatccagaaaacactgaggcccccaccctggggaagaaggactgggagtatgacctgagctggctgccagcattgtgatccgacaggcgcccacctcttggaactttctaaccaagaatccaccctcctgccttctggggcctgtattcaatctcaagtcttgtggacggcaaaccccagcctgtctcactgtgcccccgggctgcctcctagtccaggaaatgctggccccttcacgcccctcagcctgaaagccatgcgttcccaggggcaggcagtgtgggtggggggtggggtaattgtccctggatccctaggacttgcaaagctccaggcaagctcagggcaaggactcccacaactgcttccaatgcacccagcaggacagagaggccaggctccaggcaaactgagatgccaagtgatgagaagaatccaccctgggacagtcaggggaacaagcaagagagagagactggagtggccaggcccacctcggggctggaggacgaggaggaggcataatacaggggaaccctaaggccaccatgacttcagagcccagagcgggtgaacgcagagctgcgcagggactggaggggcgccacaggcacgggggtttcgttctcacaggttaggatggaggcagagcctcgaagcccaagctgcagggcttttggcttcggggaccagcagcaggaagtccctgaggatcccctatcccagctatggagggtctgccaggcagcacaatccacccccctgaaatgtctctctggcatgtggattcctttgcgctaaaaaagaatcaaggcccaaaagacttaggaagaaactttgaccatccccttaactgaataaaagtatttagctagagggcttgttcccataatagagtaatcaccagagacctcaggggtggggctggggccgcaggggacccagagatgagcatccactctgtgccccggtgtgtctgcagggggcccggcaaacatttatttacccagcactttgcttttccatctccttgtgcactaccttcctcccctctgaagtcctgaaccactgcccctacctcctcttttgtctttaactgaagatggtctttgaggtgaggacttcagccactctggcaggctagttttcctgggtctttctacagatacatgttcagcaagcttttgtttgatcttctcctgttaaggtgtcctacatgtcagtttggttcttataccagccaggagaacctagacggggaggggacaatgtcttcctctccagaatatgaaagtccgggggagaaacagaaacatgtggggagaatgacgtgtctcctgagaaactccagacacgttcagatctgctttcttctccatgctgaagtcatcgctgttccagaaatcttgtccacagggcaactagttggaatttcttgtgctcagccactactgctagggtggtgggtctccctgtgaatccagtcccacaaactgctcttcccatttctgaaacaaaccaaactctttcccactcaagggtcttagcattgactgttccctctgcctccaacagcctccacccacctccgtagtcagagccttctcagacttcagagctcaggttgcctagccggctctctcatccctagtgtttctcatcagagcgtgctgtttgggtttgctgctgctatggtggttgttactgtcttgcggtctgtccccagctgtgatataaagtcatgagagcaaggatcaggctgttcatccttctcccagaagcacccagcatcatgccaaggatggggtcagagctcagtaaatgctgagagtgaatgcatcagttcacagtatgctacacaagaacattaataaggcataccaaaagagatgaaaacccaacagcttgctgtcctgccacatagggggcttctgcctattcagaagcaaaccaggtcaggggcaagttcctaagcatgcaaaaacagatcaaagctcactgcaaccaagtccaagaggttgccctgaccctgctccacctcagcagtcaggtagaatcttgtcaaggatgggaacaaaggtggtttcaaatccctgcgctcccaggtacaagttttgtaatcattagcctccgtttccctacatcagcataaaggagtgaagtcatctgctgagattgccacaaggttggagtaagagcagcatcaacccccagggaacatctggcaaaagtctgaagacatttctggttgtcacaattggggaagaggccagggatgatgtcaaacatcctacaattcaccggacagcccccacaacagagagtcagcccaaaatgtcaacagtgtcgaaggccagagactgtatcagagagaccacaggcgcacaggaagcctgtgtgtctgtcccctctctgtgaccagatgcacccacaggcacccaactgcagggtgtgatcagcctcatatgaccacttgctgagcgcgcccccaacaggcctctgcccacaccagcacctcaccaggaggccctgctgtttcagtctgtttgggttgttacaacacaacaccacagactggaaggctaaagccacaaacacttctcacagctctagaagctgggaagcccgagaccaaggaggcagcagattcagtgtcttgtgagagcccactgcctggtacatagagggccatcttttcactgtgtttaaagctggaaagggccatggaactctctggagtctcctctgaaagtgcaagtgtgagtcacgaagttgtgtccaactctgcaaccctatggactgtaacccacagacttctctgtccatggaattccccaggcaagaacactggagtgggttgccatgcccttgtccaggagatcttcccaacccagggattgaacccgggtctcctgaattgcaggtggattcattaccatctgagctaccagggaagccctttacaaacatgctaatcccatttatgagggctccaccttcatgacctcgtcaccaactcccaaaggtctcacctccaaat

SEQ ID NO: 50424 - DNA, 951 bp, Bovine  19866880989312
accgctgccttgaagctaccttgaaagaatgggatgatgagccccataagagactcagccagaatggatggggccaaagtcacgcagcatgagaggcaaacaagacaagaacccagggctcaggacccgcccccctaccctaccagcctcacttatcctatggcccagccggctctccatacagcaccattctttatccgtatcagtcagaggacccagcagggcacataatgagagaagagaggaggagcaagaaaggaaatcaaggggaaaaaaaaaaatcactctcagcccgcaagacataggccaccacgcttaagaattacagatttgattttaagatattgtcttcccccttttctccttccacaaagtggtacatggcccatttatatatttaattagaatggattaaaattaataacatcttgagtggttcctgacccttctggagataatgggagacacctggggtgatgtgcaaccaggaagaagaaccgctgacctcatcaacagagcctgcactttctcatgtgcatgtaatcagcacagcccctaatcaccctctgtatattttttttaactaagacaggtatctttatgatgtggaatcgcgtcctgtcccttgggctccagggccaaaggcatgcccttggcaggcagacttgctgaaatctgtcctgtctatgactgccgaccgatacatcactctcagatattttaagattttcttttcctttttaacatatttttactgtattatttttattgtatctccatgggtagctcaaacagtaaagaatctgcctgcaatgtgggagacctggggttcaacccctaggtcaggaagatcccctggagaaggaaatggcaacccactccagtatgcttgcctagagaatcccaggacagaggagtgggcaggctacagtccatagggtcacaaagaga

SEQ ID NO: 50425 - DNA, 1048 bp, Bovine  19866881115112
tttccctgttgaatccacccagtcagcactgtgtagctggtttaatagtacaccatttatcacctgtgcccctttcttatattacttcctcacttccctactgatatttcctaggatcacctctccaatcagctacatgcgtttcaattttgcctcatgatctgcctctggggtaaccccaatcaaacctgctcagggcttccttttggagtatggcttcattgttgagatcaaatgagatcatgcacgtgaggcatggaatgcacagcaagtgggaatcagtagcagctgctactgctttcacatctaacgtgttcctttgagaggcatggtaactgaagtctggagaggagagggggctttttcagtgctgcttcatggctcagcatgggctcgcttttggctacacccagggtaggtgatgccagaggcagacagagcactggctggctcccttctcgctttcctcaagctgttgcagtatagggtgtgatggggccactattcaggactctcttttgtccacatgggcagggatgcccccaggtgctcacagcttgtgcacaaatctggactgtccaatggagagggtggcattggcacattggtagcgtggggttgcccagatcagaccagagggaggactgggcagggcatcaggagtaagggccccgtgctgccaagactaccttggctggactgcttggtccaaatggcaggaatcttgggtggaagccttgtcaaaatgtcagcttcaaacagactgagggataagacagatgagcattttggagcgacttctgattcagctgaaagttggactggcatctagagtggaaaaaacactcccctcctgctcaactttggtttagatggggcaggtgggaaatggtgacagatggtgacctcctgagaaactccttggaaagaagttgccttactgtgttggacacaattctgggtttggattctggccctggctgtgttcctaagtcagtggcaaaaccctaacacatcaagccagtttcctcctctgtcaggtgggaat

SEQ ID NO: 50426 - DNA, 1317 bp, Bovine  19866881132967
tgagggcagactccagggacctcccagtcactggcagggggcagcccacattcgtctgcacctgaatctctgtcctcttggtgcagtcaacagcttcctgggtctgaaggcccaaggctgttccagcttaaccctggagctaaaactgaaacacgtggaggctgtgctacttcctgtgtgacgtcattaaacatgtcctgggactttgctggtagtccagtggctaagactctgcactcccaatgcagggggcccaggttcaatccctggtcagggagctagattccacatgccacaactaagagttcgtgtgcttcaactaaagatcgggcatgccacaattaagaccctgtgcagccaaataaataaatacttcaaaataaataaatgcgcccactaacaacatctcagagctgatgtaaaggtagtgagttccctgtcactggaggtatacaagcagatattgatctaccgtatgcacgtcagcagccgggtaccagcagctctcaactaaagccctggacttctcaatcactgaagtccctccaattccaggtgcgctggactctgcgaatttcaaatttgactcccaccactgaggtcaaaaacatccacattctgcccacacaggtctccgacactcagactggttttgcacaaagtggtaaaataacagtttaagtatttcctaggtgtcagaactgtgaggagcaagaacaaattaatcaaccaagaattccttttcaatggttttcaagccagccagtgtctgtcaccaaaccacaggtgaaatgctaataaaattcagcttgtgacaacagcataatgatttaactatggcctgtttttaccaagaaatatatatatataatatttttccaaacatggccttttcaatgtgtgaatttttttttataagaacaggattagaaaatagcagaagtctcctgacaactgcagtgaggtggagtctctactgaatggccttgggaatgatccaagaggcccgtgggcgggtgtgaatgccatcgtccttggatctaacaggggggagtcctgagagaagaggcaactggcaaaacagcagcgatgaagtcatttcacctcttcagcctaatttgaagagacgaggccatgggaactggctccagccttgcctactgactgcaaactgcagcaggagaactgacgtctgcatccctgagggtctgcatccctcacagaccacgtgctgtcccagaggcacaggcgctgccccacagctgcccttcagcctcactgcttgtggccctgcccgggggactgcctcttttctca

SEQ ID NO: 50427 - DNA, 1048 bp, Bovine  19866881185973
gcattagaaaacatgctcctgcatatgtcagaggagggaaggcaggcttcagaaagcattaactccaacttgtcaggcagcagtaaacctgtttccattagaattactgtgccggagtccccacattcttacttgtcttatggaaatgtttgattttgaagcctggatgcatccacagactttgacatacacctttgccctgttcagatgtccacactggcaacatcactcctgatgtatcagctgggtgtatggatcctacctatgctcccagggcatttcagaggaggtagaactggggaaggagccttggaatagagctaaaatcacccctccagcatttactactttagtagttttccaaggttcagccccttctggccctggtgtctttaactaccaaaggaagaataacaacatgtgacttgtagccctgcaaggattaaccgtgatcactaaggtatgagcacgtgcatgctcagctgtgttcaatctttatgattttataaactatcaccctcggggctcctctgtgcatggaattttccaggcaagaatactggagtgggtagccatttcctcctccaggttatcttcctgacccagggatcgaacacacgtctcttgtgtctcctgcttggcaggcagattctttaccactgcgccatcctacaaggattaaatgtgatcaccaatgtagagtgcccaaaataaggcttagttaaatggccattcattaacattacattaccattggtggtgacgttatttcaaatattaggtgggttactcctggcttggatttttttgtaagtattcataaaaatgtgtacgggcctgtttcgcccctgggctttttctcccctctccaaatggagttccttgccctacagtaatcctaataaattctacagactcccacttacatgacaaatactccactggcttcagcccaaacaaaaactaattgtcccctcgtttgtctgtgagtgcctttgtttcttccagataaacatttcaggctctgttttcttgtccctggcgtttt

SEQ ID NO: 50428 - DNA, 1252 bp, Bovine  19866881196880
aaaaggtaaggtccaggcaaaaagcaatttctatcagggtcatttgttaaagtctgaaagcagttaatctgtgccaagttctgaggcccattcatccacaggcttgccttagctgagtaagacaggttatcagctgatcacctacgagtggtttctcagcttttacttcaagttccaattatactaggagatcttggtgacaagagccagttggagttatccaggtagctgtgcctaatagttctgcctcttgtgcataccctagctagtgccgctgcctcctaatgatgtgttttttaattgcaggcaaatgcaaatcagaccatggcaacctctccagcattgtttcttaatcttggttgcatattagaatcttaatcttggttacatattagaatcacctggagatttaaaaataccaacacctgaagaccacctccagagagtatggcttaatttgttttggtgcatcccgagcattgggatatttaaagtttccccaggtatttctaccatatggccaagtccaagaaccattattctagagcagacataggcaaacttttctgtaaagggccaaatagtaattcttttaggcttttcaggtcttatggtgtctgtcacaattactcaattctgcccacatagtgtgaacatgccatagacatatataaatagatggttatgtctgtgctccaacaaaacttaactcacaaaaataagtagcaggccctagtttgccaaccccttctctagagattccttactcagagtgaggtctggggatcagcaccatggacagtacccaggagcttgttagacatgcagaacctcaggattccacgagcctcccaggtgataacatatgcagagtcaaacttgcaaggcactgctccggagggttcactttgtgaatccatccctgccagcatcacagcactgaggtgatgagtggagactcatcactgtcagcattccccgtgcctgtcacctccatcagcctggctgtctcctagctgccacatttctgtagcatcttctcattggtgacacagacaatctgagtagctgtctacatttgattatggtgtttccaaagggtcaacagagccacacacccagtttctatttttcaaaataaaatgcggagaggatgggggctgtggagccatatgaggggatatgccccttctctcaggaactatccattcatttaaacttgtcaaatgtcatataggttctcaaacacccc

SEQ ID NO: 50429 - DNA, 860 bp, Bovine  19866881257894
atgagctgtctggagtgatcctggggtctccagctgggctttgtagatgctcttaggctcctggcatcattgtcccctcaaggcagctccagagtttggaccttgcccttgctggcccagaggactgcaggggccgtcgtctgtggattgaattgggcaggtggtcccctccctcctcctttgccccccgaatctagctgtagctgcacccttgtggtcttgtggaccagaaggcttatgtagatagatcacactgtggtgaatattggggtgcttggcccaggtccccaccttgagggctcatatccctatccgtcggttgctgagtatatcagttcccagctgcatctctcactgggaattgcctcgtgcagcgttatggtaccctgaggccagtacacgtgataccaagacctgcctccccagctccaaaactttcattggattggctgagacctcagctgctgcattgcaggtcagcttctccctccacccaaccctgccttcttctcttcctttcgagtgtatctcccagaaacgctccccagtaagcctcatgtgtgcaaagttccatcccagagtttcccagcgaacccgctctaggacaccatctttctggcagttctttgctaagaattggcatcttttcagcacctagaaaatcatctcagaacatctgggtccttttacggctggaaattttgcagagaaatgggccctccagctgtggctcatggcccagcgtctgctgttggctcagaaagtccccggatcgtttggagactgttgcggccacctccaatgtgacataaaacaaggagaggcagtgagaagtacatttcattaaaaagccaaatcca

SEQ ID NO: 50430 - DNA, 1185 bp, Bovine  19866881286096
acatcatttgaggagtccaactgtgcaggttaccgtgtagctaattttgttgggaacaaacagccacacatttaagtggtgggtgttcaggggcttgcagattggcacatatctggatgttcccctttgctttgctgcccattaggaaaatgcaagtcttacaaaagcggtactgtggctcagaacatttttcattagagtaaatttgtctccaaattgactgtaaattatattgcattttgtttgaaagaactttctgaattaaagtagggagccaagtatgcagtactcagtgtgaaacataagttcaattacctacagttacgagcatgttctcctccacgtgtgcagagatggcatctcatatgtgaagggttttcggactggaagctgttttatggatcactcagttttggcattcccaaaatagagatgagaggacagagatggaaagaaaactggctgaggtcacatagcgagttaatggcaaagatggaattggcctaggtaccctgatgttgctttgtgatgagattaaagaaaaaaagaaagtgtttctgaattttcattccacagaatattcagtagttctttctctccagaataatgttagaatagctgtgcattgagaacattctagacagatctagagagaaaatatatctgaagatgtcaaatcccaattcatgacactgaaaattctagaaagggcagcagagctaccacgtgctgcagttttcagtgttgttcaaatgagcagcctaccacagtcctgctttcccatcaagtctgatttcatgaaggctgattttattaggctttggcttaacctgacacaggtgagcattcagatgaacacctaaggcccatctgatgcttgagtctttctcactccctgcagacagtcccttgccacattctgctgatttcacttcctggatctcggctccatgtctcctgctccaagcccaagtccaccactctcattggaaccatttaaatagccgcctatcagtctacttccctcccttgctgacaaaaccgacagtccagtccccagagagcagggagatttgatatttttagctcaaatctaatcactttgacctgttacccccacagacatcctcactgtggcctggtgtaacctggtccaccccagtctctggcctgctcaccctccag

SEQ ID NO: 50431 - DNA, 1259 bp, Bovine  19866881375853
ccggaggctgaccctccacttctgcacggccaggaatgtgttcaccgcataggccgctgttgccaagaagccgaatatctacaagacacaagccgggttagtccgcagggcccctgggcacttacagtgagcgaggtgcattagcctctcctggctataaccccaacacccagaccccactacatgtccagctgtcagaccctagccaagttcatagtcatgtgacccacaaaaaggcagcctcaggactctttcgaagtattctggatctacaaggaaaaagagatcacagaagggcctctcttacagaccttcatgacactggtccctgggagaaataccatgtagacaaaacaccatatagatgaaaaatcagggtctcaagtgtgaccccaaatcaagccacaaggcccagcattccatatcttagcccccagccccactgcctctcatgtgggcagctctggtgggcagcttgagagtgagaagtggtggtgttttaatgattagctaacgaccgatgaacctattgagtgataccttggagagctcatagtttagtattctcaataaaccttaaatcctctcagttataaaagtgctgcatattctttgtaaataccgaacaataaagaaacgcagagcacagagagagacagtcttaccttacctggtcccatcctctgcccccaccccccactgtgctgactgccatgtggtgtccagactgcatcttcttcatgaacaccccacactggcaggcaaggcccttaaaagcaatagccctttcagacatccagggctccgctgggcagagactgaagcagaggtgctcaagacagagtgtgcatctgagagctagttaaaacacactgccaagttggcagctctggggaaggctgagaacgccatctccaacaaactccgggatgatgctgccgttccagggaccacactttaagaaccacagcactgaagggaccggggcctccgctggcccagtgacttcattagcaaaggagaagctgaaggagaagcaataggacacaagcccaggggacagagcagcaaggcacagaaagtgtatgaaccagccttgttttgaccttttgagttcacttaccacggcagcaatttctgctccggttttgtgatttaaagcagccagtacgattgaagcaataaagaaaaagaaagtgctgagtccagtgttgaccaaatcctaaagaataagataaagtcatttgaaaaggatcatt

SEQ ID NO: 50432 - DNA, 747 bp, Bovine  19866881416464
tcggctgctctggtggggtgaggatgatgagaatggaggatgtggaggaaatgagaggaggctgccgaggcaaactgttgaataaggatgaaggcactggagaagcaaagggaccagtttggaagcttccaggttttatctctggtcttttgactggtcctaggatctcatccacagtttccccatctgctaaacaagagctcctctcgaatgttttctcctagctctgggtatcttggagggtctgttcactccgtccccgggagcttttccaaggtctgtgtctgtttgcttttgctctctcaaagctgcaaaaccctcactggaaagaattttgatttgtggtttaaagataaatctaactttctaaagtctgttcctatgctaagcacgtgagtaccctgcttcttggtgggaggtggtgagtgagggtgctacattattaataaaatacgagtacattaaaaacatgcatcttcatgtaacttatgtaggaaacgtgattgtcggcggagctttttggcaagtggttggaagtgtgtgtttgcctctaacctttgaaagctcttgatcaggctggggtctttgtttccagcaaagcccttgacccctcgtggtttcagttctgtttactcttggcaagcgtttctggttcaaagggagaatctttaaaagctggattgggaaagtctataaaatcttaacgcatctttgacatcaaatagctctttcaaagcagtgatttga

SEQ ID NO: 50433 - DNA, 1097 bp, Bovine  19866881432118
tatgccttacatatataaagacatacatatatgtcttacatatatatatatatatatatatatgtaagacaaaggggtggttgggaatactgccgaacaaagaaacaacttcatcttgagaatgatctgttgtgtaagtaggatgtggagggcacatatagaatgtttggtaaaacacaggaagttgggaccccaaagcaccattggaaagccttcttgggaacaactacaacacagtctgatatgggaacaatggagtgagtaatgtcagaataagttccaaggaagctaacactcagctgcccatggtgaagacagacatacatgatcagaaagtaaaatccaagctgagtaggaaaaatctgaaaacatgtccccagaccagatccttgcttccctctctccctccccaccccccatccttccttttctttccttcaagactgtgtatcaaacagctgacatatatcagagaaatacaaagcaaaagatgaggtaaggacagagagacaggacgggtataactcacacacggttttagatatttctaaagattaaaagcgagcaattgagagaaaacaatcatcaagggtgtaattagatacaattttctgaagctgaaaggatctaaatatggagatcaaaaatccccactgtattgtttaaaaagataaagaaagatctacacctagaagagcagagtaaatgccaggaaatgaaacaacttagtcagtgtttccacagaaaagcgtgtgacccaagagtgctctgcctaaatggccacttatgggtgaagggaaagaaaaaccctaaacttcaaaaaaaagaaaagaaaaactctatagacaaacacaaaacaaaacaaaaaccatactgaaattgaaaaacttccaaaatgcattaccagtaaaatcttatttgaggaaaaaagagcttgaatacaatctatactcaacaagtaactgacttgaaattagtgactcaaaaatgggaaaaccatggcattaagagtgattgtgagaaaagaaaacaatataaggtcaaaagctacaaatagccttccatttgaatgtatgttccaatgtaattctcaaaaa

SEQ ID NO: 50434 - DNA, 1521 bp, Bovine  19866880366295
cagacaatcccctggggaagggaatgacaacccactccagattcttgcctggagaataccatgaacagaggagcctgggtgggtacacacagtccatggggctgcacagtcagacatgactgagcagctatcattttcactttcagaatcaatctacatttctgaaactacttgccacttctgatttaaaacacacacacacacacatccaccaagaaacaaagcaaacagtattccatctcttctagagcttctcacaagaaattaattagatactaaaattgggagacactgggaaaattatacccagattattattattggccattacttcacaaaagtttgcattgaattaaaataaaacttttttcctagtaaagagtttggtggtttcctgttattaacttatttacccttagtaatgaagtatacactgagaagcttatggttagacaagttttagcctgaggagttagcagcctaattataatgaagataaacaggcataaacacacgtaagtgctcctctcatcaaaataacctgcaggcagggcctctgctttgcggcttctcaacacctttatcttttaaatatggcgcctaagatggcggagcgttctaggcgtctgtagtgctgggtgactgcacttatgagggtagagtgtggctctgcatttttggagcctgagctttgaacccacagatgggtagtagcgacccttccccactgctcggttgactggaagtgtcaacggcagccagtccacaaacccctagtaggctaggtctgcctaccccaagaaaggagcttgcaccaaaaatgccaaccacccatgtcgctaagcacactgctaggttctactgacattttagaataagacctctagatcaaagcttggccaactttttctgtgaagggccaggtagaaaaatattctaggaagacttccctggtggtccagaggttaagacttcacaattccactgcgggggtgggaggtagggggatgggggggcactgggttggatccctggtagtggaactgagatcccacgtgtcccgcagtggggccaaaaaaaaaaaaaaaaaaaattccaggctttgctgaacagtctctatcacaactagtcaatgctactaaaatggccatagatgacacacctcatatgggtatgacagtgttccaatacaataaaaaaaacaacaacaaaaaacagaagttggtaaaggcaggaaatggaaagtgggttgaatgtggcttgggatgggggagacacagtagtttgccaatctctgctttatgtgaaagaagctgtttgtgatgacgttttggtgtgagttcctcatcttgagtatcgctggactaggcaatctgtggaggccagcagatgggatcccacggcccatccgttgctggggagatcaccgacacaaatgttacaggggagggtggcagcttcagtacacaatagtgtaactgatgggaaaagcggaatccttcaatttttctttcaacaaac

SEQ ID NO: 50435 - DNA, 2387 bp, Bovine  19866880371356
acattatttaaggagggatgatggtcctttgttagtattggggtaccaagaacttcttttatctgacttttaatcaagagagaggatagacagggctgctgatctgacaggtggcaaataggttgctgctgttctctgctgtttctagagtaagaagctcatggaatttgttcatctacactccaggcagcggcttatgccctagagacatagggatcatagcactgccacattggctgagcctcagaataaatgatacagggaggaaggagcacccaccttcctacactcgtcgagtcacattctgcctcattacctttcttgccagacaagggaaacagacactgagagttcagcgtatttggtcttggagttaaactgcctaagttcaaattctggctctgttgagtatcatctgtgtagcctagagcatgttaatgaacctctctgggctgccctagtttatctgtaaatgggggtattgcctgtgactccctcataggattgtggggtctaataaaaagggaatggggaatgcttaataaatgttagccatcaataactcttattttttaaaattcagctgatctacattgataagaccgagcatctattgcacacatacccttgtagacttaaaaagtattcacaacctaaatgttatgttttatttggcaggaatttttaggacttcaaacccaggaggcagtagctcaagtaaccctgagagaactggtctggggaggcacagccaggttcacaaaagttttacaacaaagggctggtagtctgaacaaagggcaggtagtcaagagattattgtgaattaaaaggaaaataagttaaggaatttagcactgttctttgtatgggaagatgcaagagtctgggctcactaaaatcatttatttgatatgcacctcagctctctggggtcagcatcctgtgttttcacatcctgagtgtcctcagggctcaccgtagggggaagctgcagtcggatggctactagatggcaggtattcttttccttcccgagttcccccagggctcactggctgatgaccatgacagcctttgtgtactgatatggcaggcagtattccctttcttgcccttactctacggggtgactggggactataaatcatcaaggaagagggatgtaactggagacggtgtcacagtgatcagagttacagctcagttttatttagaaaataaaggaaaatacatcctcgaggcatgagggcatgccgatccaagaggagagagagagacccccggccctttggctcctctttttgtatgttttttctcctccccctgggccttccctatgtaaactgggctagccaggagagctgtttgttctacctgaggtcctcactctgaggtcctgggaccttccctggttctatttttgagggcttttcccttccttgtctcttagccacccccattctggactctgtcctattctaacagattcaaagactcttgagctgggacttgaaagatgggtagaggatagatagggaggtggggggtagattctaggtgtgggaggcaaggtaagcaaagtcacggagcatgaaagtgggggacgttgcaggggaaccagcatttattctggttctgctagagggaagggaacccaggaggaagaggcacgatgtgagaaaaggctgtgtttgagccagcacataaaatgactttttgatgaaagtctgggctgcccaggtggcgctagttggaagaacctgcctaccaacgcaggagatataaaagacaggttcgctctccgggtcaggaagatcccctggaggagggcatggcaacccactccagtattcttccctggagattcccattgacagtggagactggcaggctacaatccatgagatcgcagagtcagacatgactgaagcgactgataattaactccttgccaagaaaaggtgattcagattttattccttgtttgattatgagaagactctatgcagcccacaccttcagtctaccctggccatttcccaccttacatggattggtttctgattctgcatgtgcattgcttcagtctatcttcttattcctagagaattatggttgctatagaaaccaaatacttggaaggaaaacctagagcttgtcaaggatataaattcgaaggcaaaacctatggcattcaatcaaataaatacccatctgcgtggcatgctatgaagctttaattacagtgctcaagatcaaagtaacattactcaagagtggagaagccaaatgtaaatgaaggtcttaacctgagctcagccaagcattgcacagtacaatcacctgatgacccctaagtatctgtgtaagcaggagagtgtgga

SEQ ID NO: 50436 - DNA, 1762 bp, Bovine  19866880378782
tgagcgaaatttcctgcctgggcaactgagaagcattatgtgttttattttaaatgcactgtacatccccaggcagccctgccctctgttctaaatccattaaatcgattcctttggccctttatttttatgcattagaaaggggcctgggagagaggtggggcttccctgatgctcaaacaataaagagtccacctgcaaagcaggagacctgggttcaattcctgggtcaggaagaactcctggagaaggaaaaggctacccactccagtattcttgcctggagaatcccatggacagaggagcctggcagggtacagtccatggggtcccaaagagacacgacggagtaacaccactttgggagagaggtagggaaagaagctaaaaaaagaagattctccgtaaacagatgagccttgagggtcccttgtgctcctatgctcttttctttctcctctcttgaatgtgtcaccacgtctcatcaaacggcaagcttgtatctggtctcctcaccccgaggaggaaggggctgccttaactgagctgaaatatataatgtcaaaagagttggcaataattaaaggacaaaaaagacatctgtgtcttcagaaactaacacatatgcatactgcttttaatttcaaactaataacaatgtcatgttaatataattaatgtctcatctattaggtctagtgggaaatgaactgttctacataattgattctcccagattcctagagtctagcatttggggactcaaattctttcaacatttttcatcggtatggaactctttctaaatatatggtatcattctgtatctttctaaatacaactcacccaatcatttatttataggtttccctggttgctcagtggtaaagaacgcacctgccaatgggggagactcgggttcaatctctgggttgggaagattccctggagaaggaaatggcaactcactccagtattattgctcgggaaatcccatggacagaggagcctggggggctacagtccatggggtcggaaagagttggtgactgtttagtgactaaacagcgacagcaacagaggtcttccatgctctgattgtttacccccttctctccccaaaccctggcaactgttggtcgtttcactgtctctgtactttcgtcttttcttgcggctggcatcattacgttatgtagactcttcagattggcttctttagctttttcttaggcgcttaaaatttcctccacgtcttcatgacttgatagctcacgttgcctaatattccattgtctgcgtggaccacagtttatcctctcaccttctgagagacactctggtctgcttccacatttcagccgttttgggtaaagattctgtaaacatccctgtgcaggtgtttgtgtggagctgagttttcagctctttctggcagttacccgaggcggaattactgggtcacttggtacgagtaggtttggtttcggaagacaccagcatgccgtggctgtaccggtttgaatcccaccatcagggaatgagcgttcctgtggctcttcgtccttgccagcgtttggcgttgtcacggttttggattttggccacttgaatggatgtgtagtagtatcttgctgctgttttatttttgcttgcttttgaatactctttgcaatatggattcatgaatttatctggctttgttcctcatactccccagcctgcagcatcggtagttgtcatgaaggatttatccgtgtct

SEQ ID NO: 50437 - DNA, 2761 bp, Bovine  19866880498144
cgttttgttttggctgtgcctgtggcgtgctggaccttggttcccggaacagggatcgaacctgtgtcccttgcattgggagctcggagtcttagccactggaccaccaggaaagtcccctaatattctcacaaaattaggtgctgtcccattcaagtaacactgtattgaccaaagaagattgacattaaccatattcaggctaaaatgtttttggaaacaaccctatcacaagtgaaaaggtttaaagatatatcctggaatggaagacttcttgtgtagataaggaaggctttaaaggaattgaaaatatgctgtaaaaaattcttaaacatgtaaacgagtcaaaaataaatgaagatgcatgatgctaagttgcttcagtcctgtctgactctttgggaccccatggactgtagcccaccagactcctctgtccaggggattctcaggcaagaacactggagtgggttgccatgccctcctccaggggatcttcctgacccagggatcaaacccacatctcttgtgtctcctgcattggcaggcgggttctttaccactagtgccacctgggaagcccaaaggaagatatgtgataccaaatagaaaaattacaatatctgtaatgttagaagtaatgacagaaagagtcaaaggtatttacttccagcagtagataatactgagagataggaaatattaatacttaagtcctcataaatagttcgtggcttttaaaaacatctggcgggccataagtctggaggcttccctcatggtccagcgtgcaatacaagggacgctgggttgatcacttgtcggggaagatcccacatgctgcggggcaactgaaactactgagcttgcgctacagagcctgtgctctacgagagaagccagcgaaacgagaagctcacacactaccgagtaacccctgcttgctagagaaagcccgcacgcagcaatgacgatccagcacagccaaaaagaaataaattattttgaaattctatatttttttaaagtaagtctgatagggccccggggtaaatttgactgctttttttttttttttcctctctcttaaaaatggagaaaactgaagcaaaatttggagaagtcacttcgtaaaataagaaatgggtcccctgctgaccttctgaagtcacaggtactaaaaccaagcttcctcctggattaaccaggattccaatctttttttccttaaaaatgcaagacctggaagaggagccctgtcagatttccattcagcaaacaactcggggtttactaaaacttatactggaaacaacctcaaaagtgaactttgatggaaggtgggtttttttttgttttaagtttctaagcaaaaacgcaggctgagtttcttttgttttgttttttacttactctatcacaagtgccatggtaagtttaagcatcttcaggtttgagtcggtagaataaaatgtgcttgtcttatggggggtctgttgggtaaatcctcaggagatttgtgaaagaaggtacctggtcattaactgttggctcttcatctgtctctgtcctaacctccacaggcatccagggtctacttggctgctctttaaaagctcaaagccatagcatagcaatcaggtctacccagatctctccccttcttagaacgcctatccttcagaactgtatatatacctcctctttactcccaaacctaaacctaatctttaggtggcaagtatgaggccaaaaaaaaaaagcaccaccacattcatactaaagtgtcaatgactaatagcgatgcttagcaagtcatctcttagaaggggtagcttagtcttaaagagctgcttattggccaaataagtatattttccatttttttctgcaaacatgggtacactttattctttcccgcctgagagttttataagacttagttattttcagtagaaacggtagttgggatgacactgagaaaagttgttgagttggaggtgacagtttcagtacgttggtgaaggggaagaggtaagggaaagtttgagcagggaaggttttggttccttgagcttcattttctcttccttatttttatgctgatcagagctttttttccttcctcatcaacagactttttagtccttcttggccttatttcttttgctcctgctaacaagctagaagctgaattatgtactcattctgaaaatgttcctttaggctcttacttctggactttctaaccagtgcagagagtaagtaggtactgtgctgtatgcaaatgtaggcatatttgtccgtgtgggcaaaagggggaggggcatttcgcaaaatgcctttagaacaaaaccaaacttttgagatggaatattttatagcttcatgacaataaagtcaaacttttcagaaacaaaaagcacagaggaatacttatctataaaatacattggggaaaaagaaaaccacacaccaaacaaaacagaggactaatacttcaacagtgagttcacctcaagcatttcatgaatttcacatgacccacccactttttctctgtacctctgaagagtaccatatcagcggcaataacgctctgttgttctagtgccatatttacatatccacgtagccatggcattcctgagtgcagaatatcgtactgttacccttgtttgtggtttctaaatgaggttaatttttgttcctttaccctcctcacttaatctcatgccaccccctgcctctcttcaatcag

SEQ ID NO: 50438 - DNA, 790 bp, Bovine  19866880520689
tccggagaaggcaatggcaccccactccggtacttttgcctggaaaatcccatggacggaggagcctggtgggctgcagtgcatggggttgcccaagagtcggacctgactgagcgacttcactttcacttttcactttcatgcattggagaaggaaatggcaacccactccagtgttcttgcctggagaatcccagggacaggggagcctggtgggctgccgtctatggggtcgcacaaggttggacacgactgaagcgacttagcagcagcagcagcagtatgatctttacaaatgtggtaactggagggaggcctgatgtaatgtgctcatggccagtgtccatcaacctggtgaagaaagagcagtccctgggatgttttcagttgcatatcctttcatcaagctcaagatggaaagacatttggccgacatgcatagaatgcagttaattagtaacagaaggacaatgtgagattcataaagcagctggtggggcatcttatctcttaagaatatatatttttagtccatttaaaagtttaaaggtcaaacactgaagggaatagaagagcataatgttattgtaatggtttgctttattatgtgtaacttggaatgattctgtgcccttggataaactaattcatgatggaagtgatttacctttagctacagtagagtgtaggcgaaagtctgtgtaaagtatagtgcatgtcacagagtaggacacactatagtatgttttccgaaaacacttggggctggtacagttgcatctctttccta

SEQ ID NO: 50439 - DNA, 1272 bp, Bovine  19866880535677
aaaaatatatatatttctccgaaatgaccttgatctaaccctttctataaactagatccagctgcagctagagtatgtctaatagagcgcgagcagggtggtgatgttttgacataagaaccctggtgtccctagtggctcgcggtgggaaatttgccagtcttcaacatctgattcctctctgcaggcagccttcctttctgctgaagtggtgtaagacctgcaaattagaacactaagtctttccctgacatctagtgtcaatgtgtgaaataacagaccaggaaccagccacacttgagaatgaagatactcatcacggagcactccttaagggttggctcttggccccagccctgaaggatccatcaagaagcagctggcagcttcacacctcacaggtagccctaagacagaaggatcgaggtgggatccgaaacatggaatgcattaatttccttcttgtaaaatatgcctgactgacccaagactgacatagcatcctttaggtttacttatcttctggctggaaaaaaaaaaaaaaatcagaaattatggcttcggtcttcataaactgttttcttattgcaggtcattttactctgagtcctctccaactcattctctaccttcacctgacctttttactcttaatttctctgctatatggaatttttacacaatgtacaatataggtcaacggatgtcaatggagaaaaagatgggtgggaatagtttctgacttctgtttcttgacacttgctatctagcaccaggaatgatgtactgtattttttagcagagggatcattggccccttatgttttagttcttcagcctccttggctgatgacatcattgatgtaatagagaaggtatcatctctgctctgaaaatgactgccaggaccattctgtcaaaaatgctgcaggacccaaggctcctgtactgcagtgaccataaggaaattagggtcatctgggaaatagacacagccagtttggggagcagggaaaaagggaagcttcctgagaatcaaaaccagcatcaagagaagaatgagaggctgtgagtaactagtccgtgccctcctccaggcagcctactgaaatcacttcagtacagtggacatgtgatcacgggtctctttagattacatgaaactcagtaacccataacagacttcaacaatattccctgccaggaaaccccctgcaaatatagcctgtatccctgacgcttcaaggaagtctatttctccttcatcttaag

SEQ ID NO: 50440 - DNA, 1052 bp, Bovine  19866880578532
ctgaccagagccgtctaaaatacatgtttcttcctcaatgtcttctaccacgcttctgaaaaaaggagacttcagtcgaaagctgttatcctgaaaaacaaaagatttttttccccttgctatatgctatgctatgctatgctaagtcacttcagtcgtgtccgactctgtgtgaccccatagacggtagcctaccaggctcccctgtccctgggattctccagggaagaacactggagtgggttgccatttccttctccaatgcatgaaagtgaaaagtgaaagtgaagttgctcagttgtgtccgactcaggcaggtattagaacttttttgaaaaatagtgtctccttttaaattgctataaccttgtgagtacattataaaacaaacataaacttacacattataaaacatatacaaacctacaaaggtacacatactgcctttaactatcctcaaaggaaaaaatgaacaatctggtttgtcaccaaggtcctctcaaccctaaagttctgatttggggtgaggtttcacatgaatattagagcttccctggtggctcagatgctaaagaatttgcctgcaatgtgggaaacctgggtttgatccctgggtcaggaagataggaatggcaacccactccagtattcttgcctggagaatcccatggacagaggagcctggcaggttcatgggatcgcaaaagagtcagacaggactgagctacgaacacttctacatgaatactatggcagagtccaaacgtaaaatgtattcattttctagagacttgctgaaaatataaaactacggaggagaggagaatcttttccactccccacctcaccctcagtcctttgaattccactcacatcaatgaaatggacacagaagccacagattaactagaatgtgatcaaatctctacttcattttgtcagtataagctcaccatgctaatttcctgaacatccttggatgaatttaagaaatcatggggacttccctggtggtcaagtggttacgattttgcgggaatgcaggtttgaag

SEQ ID NO: 50441 - DNA, 1506 bp, Bovine  19866880606290
atcaagtccagatgaaggtatgtgctagagaccccgcggtttcgtggctgaaatttggctcagaggatatgataccttctgttttccaggccattcagagattttgtcttggcttacatgctggttaagggcttttgatttgtcacaggtccagaaaagatgcctaggtagttctgtaaaatgcataattcaccacagtaactgcctattgaagaaaaatgagatggacattgtatacagtgataatgaataaaacaaagcactccctgctgaaacagatttttttttctttgaatcctggaaagagggaaaaaataatattactgacactagccagatttcatattgtcactacaatcaaatcctgcttcatgcttttcagctgcttattctgtgtccatgttcacaaaggtaattggctgtggctgagggagcctgagtgggctagcatgctgtttctttgtgctgtgtgatcgtcttccttctcatgtccctgataccaggattgcttgtgattgttttcagctttctgttagggatggtaggctgtccacccaatctcgtatctttcagaatagctaccaagaaggctcccaggaagttctcaaaggaatcttccagagttataggctaaaagaatctgccatgcactcaaatcttgatccttttggttatttctacccagcacaaagagaggaactagcaaatttacattttattttgtctttatttaacaaatacttataaagttcttgctatgtgtaaggcatcattctaagcacactcagttatttaatctgtataataaccttctgtgggagttattattagtacccacattttggagatgaagaaactaaggcacagagaagttaaggaactttcccaaggtcacacagctatcaaataggagaaatggggtttagactgaaaaaacttgacatcagagtccatgctgttaatcactgaactatgttgcttccctgcttccattattttaaatgatgtcaacagttgatttggctacaaattgtgttcagctgacactactagaacatttaattggcttgcctggctaaaacagatccccagtgcagtctgtatttaattttgaattatcccactagtcacattctgtacccccaaataactcagtaagtaattgcctgttcttctcttcccttgtgctgtatagatatgtggtagtaaaacactgtgttgctatggtgaccaaatgatatctaaaaggaaaaaagaaatctaaaattacatcatggttgatttttttttttttttaatcaaacccagaaacattcttccatcctcaggacctagtaacaagaccagcctaaccatattatctttaacagtacttacctggttttcaaaataaaataaataaattaaaaacttataaaattataaacataaactatgttttatcaaactgactagagttattgctttaaaataacattatcatactttaaaatagggaatagacct

SEQ ID NO: 50442 - DNA, 1663 bp, Bovine  19866880629453
aagactgagggcgcctgaccgtacttctatctgttgatgttctagaaagctaagtacaggttcctactagtttggcatttttctcagctgtggcctgatgcacttgcactccatttgtgatgagcccctcgttgagcatgaaagctggtttcctttttcctgccagaaatcctggctctctcatttgccatattttctgggtctgttggactcagctcagaaacgccccagcagagtctgtctctagggaaaagcagcccccaagaaagggcgatgaaagacagtgtctgtctctgattcttcctggcagccatgtgcaggtgaagatgtagaaaagggcaagcccacggctcacacgcaacctgattgtgtagcttagcaactttccacaagcacttgagctggtgatgcacttgcacttcaaggagacttcctcctggcccccgctgggagaggcagatgggggtcatttacctcaataatgaggtaagtgtcctacttgctgagtctggaaaggtgggtggcaagagtggtggcacccatttttttctgagaacacagtttgtctctttggctccatttcccgctggtagcctccctagacaggacagtcctggacttcaaggtcatggctaaagccctgtgaatcaaagagcactcaacagaaggtaaccagcaacactttcagtgcagttttcccagaaaacagcatcagtggcttttgcatagcctggaaattcagatttagttcagatattccggggaaatggaaagaagggtgaatcaatttagataggagttgtcatggaaaatattgtctaagtgacttatgaacagaatcagttttgacgggactcccctggtagtccagcggtttacacttcgccttccagttcaggagatgccagttcaatccctggtcagggaaccaagatcccacatgccccgtggccaaaaaaccaaaacatgaaacagaaaaagtattgtaacaaatttaataaagattttaaaaacaaaccacatcaaaaaaagtcttaaaaaaaaaaaagaatgggttttgacatctctttattgttgttgtttagaagattctaagtaagaaagatttgaatactacttaaatttcatatttaatttataaaaggtgctaccaaaaaaaaaaaaaaaaccccaacatctcaaaaatgtcttagtcatttatctggactgataaacattaattgtaggagttatgtaatctcctggagaaggcaatggcaccccactccagtactcttgcctggaaaatcccatagacggaggagcctggaaggctgcagtcaagggggtcgctgagggtcggacacgactgagcaacttcactttcacttttcactttcatgctttggagaaggaaatggcaacccactccagtgttcttgcctggagaatcccagggatggcggagcctggtgggctgccatctatggggtctcacagagtcggacacgactgaagtgacttagcttagcttagtttatgtaatctccagtatgaaatataaaaccaaaataaagatatcagtgaacactccagcacttttccagttggttcctcaagattccttttatcatggtccctaaaatatcagatactgtctattagtgtaaacttaaactgaaga

SEQ ID NO: 50443 - DNA, 976 bp, Bovine  19866880669520
ctgcttcgctgagggctgcccccctccaccagatggtccttgacagaccccttcaagaggaggttctgcctgctggttccaggtcacttcctcctgtgcccacccccagtggcctccttcccaatgctgccccagtacagggcagccaggagaaatgccaggcgtccctgtgcaaggtagcacttgcgtaccagtggaggaaggaggccttccttttgtgggaggcctggaattcttccttgacaacagttcttagatccttgcttagttacaggagatccccctcccacttttcaagttctctcaagagctgctcccacacaggcccagcccgcctgctttcagcctgccactggcacctcctactgaggctgcagaatcaactctcatcgagggccctttgaacacacacacacacacacacagaatgaccccacaaggccagtggagagaagcactccacgtggggggtccaggaggaaccagtgtgatgacagtggtggcgggcggtgttggatccgcacaaaacgacacaaaactagggcatcccacctagagatgatcatcctaagtgaagtaagtcagaaagagaaagaaaagtaccatatgatatcacttacacagagagtctaaaatacgacacaaaagaactgactgacaagcagaaacagactcatagacacagaaaacacacttctggttactgaaggggtaagggggtggggggaatttaggagttccagattagcagataaaactactatatataaaatagataacaagattttactgtacagcacaggaaaccatatcataatggagaagaaaatgaaaaagaatacatatgtggagatatatataaatatatatattaggctcctcaggtggctcagtggtaaagaattcagtggctaatgcactagccacaggagatgcagttttaatccctggatctggaagatcccctggaggagga

SEQ ID NO: 50444 - DNA, 890 bp, Bovine  19866880675555
attatctttttgctctctgcctcttagtctgggaacttcaagggggggcgggaatctgagttgaattaaactacaggaattcctttcctgggatttttttttccccctccgacccagctgcagttcattatcggggtttctctcctcttgcatcctcagctttctaacccctgcctccccactactccgcaaaccccacccccgaggatttcaatcaccgaacccagcgcgctctgcctcagtgcgcctcacttaccccgatgcctcggcttcggcgcgtgaacttggcgctgcttcgcgcgcgcggagggagaactgtagcccctataggttctgggagagcccgtgggcagggatcgcgccctcgcggcgccgagcagttataaaggcggcagagggaggagggagtgagcagagggacaaggggcgggagagggtcagggggagaggacacgcctattccagttccacggcactgcgcgctgttatgaaaataaagtccccgggccagagcatgagccaaaagccgcctgacgtcagcgccacagtcacccttggaatgggtggtggcggcggtggtggtggtggtgggaagggggagagccagagcacccactccgctccgcgtgcggtgcatcacctggtcgggacgtcccagggcatagggtaaaggaaggggccagagagcagatgcttcctatccgtttggccagctgtcacctccaggagagagccacccccgccctcccactgggcactccagtctgcccaggacacgggctggacagttcgcaacatcccatgtgattcctgggtaccctgggaagccaggccggggaaaggaagaactggccagcgcctgggtgctccgcagtggcagtcaaggcgga

SEQ ID NO: 50445 - DNA, 4503 bp, Bovine  19866880751657
gaaacatacttcttggattgcggcttctggcttttgtgaggccatttatctagtcttaagtgggagatacactagacctacacctgaactaggaacaattgtgaatgctttatgagtttacaggagaaaagataaatgttgtttaatgtgacttgctggattattttaaataaagaacaatttgaataataaggtcaatcccttgtataacatttggactatcccaagttaggaactgaattctatacatttgtctctttaggcatacacataacctgtttatttctaactcagaattctaagcatagcaattctgaatactgtatttctatgggggggttcaggtagaaatactgactttcaatgtgcagtaatgcaaattctgttaagaaaagaggtagcatagagaagctccagtataattccatgaaattgaagctctttcctggcctaatgtccacagcttaagacatgtttacttcttttattctaggataagaatcaagttaattctagtttttccatgtaaggctcagagaaattcaactctgttaattctaacactggcccctttcagaaaattagtttatcaggaaagttggacatgtatttgaagaaattcttaaaagagttagtcagatggtgacttaatatcatctctcttttcttagtgaataataagaataataataacagcaacaacagaaccagctaattatttatcatgagccatgatctcatttaaccctcctatccaaccagagaaaaacttaactgtatttttctcatttattgaatagactccttggaggtttagcctgacttggtaaaagaaattattgtatttttaataaaacattcatcacactggtaaaaaaaaaatatcgggagtggggtgtgatgtattatgtttctcagcaaattatggtggctcagacggtaaagattccacctgcagtgcaggagacctgggttggatccctcggtcaagaagatcccctggaggagggcatggcaacccactctagtattcttgcctggagaatccccatggacagaggagcctgacgggctacaatccatggggtcgaaaacagttggacacgactgagcacatccaaccataagacaggtactgttattaacattcctgctttacagacaaggaaacttagggagaagtaatatgcccacaatcacaccactagttagcataggagctaggacttgggactatttagtctgaccccagagcaggtacactatactattctatatcataaataatggattcatttaaaataacttattaatttaatatgactgatgtgattcagtactataggcctttgacaaaagaaatcagaaagaccgctttaaatcatttgagagcaaaaaaagaccaaattattcattctttttagaatgaccgcacatgtacatcatagcttaatgataaaataataaaaattatttcataaggaatcataatctgaaatattaatactataaaatgctatgtaatatactaattctattaaaaatatatttataatcaccaaacttattcccagcctttttgaaaaaacagttgtcttccatccaaacccataaaatcccacaaatccataatatttgtgtaactggggtcatattttgaaaataacttacgtgattttttttttctcctctgcctgcctggggaagcagttggccttggggatagagaatgtggcactcttcagagttaccaaagtgatgggaaaaaaaaggaataaatattcagcttccaaaatttaaaacaggagtgtacagcaagacaataggcttgaaatccaagctactgttttgaaagccattctcaaaattcctttatttgtcatcaaccaaatatagaagactttgctcagattgtctggtaccatagaataggccttcagactggggcaggcaaacattttccaaagggtcccagagtctgtagccagttctatgggtaataatttttagatccttaacttccacaaactgatcttcctgtgaactgctgcagtcgaaataccatgctggttcttgattcccatctagaagtttttcttcccttttaccacagactggtgaacctctcacccaccttacctcaaatcctaccatggtgaattgcttggattttaaaaagcccctgggagccaagcaaggaaacaactggaaacactgaggatgctattgagatattagttaacttgagttaacacatccttttaaaaaacaagagctctccaactactttaaacaaagctgaaagcaaaccactatccaattgtccactgagagattcattaaaacaagttctcttaaaggaaagctctatttacaaaagaatgccagctaataaatgcagaatataatattttgaacaccatttttgcaggccccagtgtaataaatgattcaggcaaggaccacaacagatattcaaactatgagatgaaaagttgttgggaacaggttgtttgtagattatttataaactttcaatggtgagactgggagagggggtcatcgtcttaaccaagtgaccaaatttagcatcactagcaatggtgggtcacagtccataggtgcgcagagtcggacgtgactgagcacacttaaaacgggacaccctgaaattagtgcctaatgtaaagcaatgtaacctacccaacattactaatgttctttctaaaaacatttatctgaatataatcaaacctctatacagtgtgcctctcagggaggggagaggggtggggaaagtagtagttggaaaaacaaatcaaagacattataagaaaaaaatcaaccaaattgagaatatagaatattctgcaaaagaactagtctggacttagcagaaggtcattgttttaaaataagaagggtgagctttgcacagattaaagagactaaagaaaaccaattgcaaagcacataatttgatgagatgctgactgaggagggagagttaaaatacatagttaaaatatataaatagtttatatatatatataaatatataaagtagctctaaaatattttggggacagttggggaaatttgtcttgtgatttgtattagatggtgtcatgaaatcattatttctattaggtgtgagaaaggaattgtagttaaccagtggattttcttattcttaggagacgttgaagaagttaaggatgaaaggtcaagatgaattcaagttacccacatgtggttaaacaagaaaaaacacgtacataaaaaatcagaaagggaaagtaacaacaggcgaatctagctgaggagtctgtgggtgtttactgtactgtactttcaactctgtcgtctgaatgaaaatggaaagtaataaattctgctctgtggtggacaaggacacgccacacagagagtaagagtctttccctctagatctcaggttcagagacaaagagataaaggagaataaagcagccagtcactggacctgactccttctagaccaaagaaggatatgagagtattcattttctcttggtgactctttcaaattactgcaaacaatggcttcaaaaaacacaaatctattgtcttatggtattgtaggtcagaaatccaacatgggtcttagggctcagattatggtgacagcaaggctgtgttctcttctggagactacagagagagaatctgtttccatcctttggcttgtaattcccttactccatcttcaaaaccaaccatcttgtagctctttaactattactccagtcacagagtaatggtaactttagccattccagagtcactccctgtgacttcgacctcagattggaaagtcactagggttggatccacgagataatccaggataatctcctctctcaaggccttatcttagtcatatctacaaagtcccttttaccctggaaggtaacatattcacagggtctgagtactagggtgaaatatctataggtgtcctaactctgcataccacaataagttacctccaggttgagaggagcactcagggcaaaagatctctgcttttgctcccctctggagacagctgccaaggcccctcacacctcatcctgaacttcgcacggccatttgggccaatggcaaattttctacagtgtacacaggcatacagagcagctgaccatcccaagcgtttcctgttcctttgaagcatggatgctgaactaacagccatagggcctgctgtggtcaggtgaagtgacttgatagcaagagccaaggagaagcagtctctaaaggggagaggctgttcctccctgggagatttgcctgaagccaaaaatgggccatgaattcgtgagatccaggcttcagcatcacaggccagcaggttccccagtgatcaggccagcaaggggcatcatgcgagaaccctgccagtgcacacactaggtccagaatgaagccagggaataccccttactcatgagtccacaa

SEQ ID NO: 50446 - DNA, 1209 bp, Bovine  19866880774083
ccctgtcctcgccccgtgggttctgagccatgatggctttgacctacctggggtaaaccctagagaagcagaattcaaaggaacatttgcaaaaatgattgacaggaggagaacagcaaagaccacaactcatttggaagagggatcttatcaagagagttgggggaaaggattgaatgcttcactacacaattatgtgaggcttgaagaagggaggggagaagaaaagccaatgtagacacaagcatacaccctcccctgtgcttaaggtgcccttcccagtaatagaacaaaactaatccaaggaaagtcaaatcttccttttgcatacaaaggtgaatgtcagacatgggtcgggcttctgttttctatttaaacctttctcttccttctgagcttttgtctctaacatgccttaggctgaactcgttgagagttaagagagagaatcctagtgtcagaatccccaggaaggaagccgatgggcgttctccacagttagagtcagacagacccaagacctcaagggaatgctttccttgttagtgcaggctggtaccctgcctggctgcgggaaggtcagatcagctctcccctctcactgacttcttgcccttggagtcttggcttctaaaaaagagggagcccgcagtgcgagcatggaggcgcgttaactccggtgatgcttcaggaagggccatggagcctcctacttgggcttctccctttgcaacctggtccccggctcccttcaatttgcactaccttcttagtaactctgccagttgaaggagagccctggttttcaggctgtagttgatacagtgtttcccatattctgccattgctcagggccgaagcttattccttggcatcaattgggaaagtaacaggcttcctgaacccccatcacagcagccgctgcatcacatgggggccgggactcggcaggcggtattcaacccataataactccctgttcttttcccaattatcccaaaccaataggtctaacgccggctccatgttttgcctttgcaatttagatgccacaggtagcttcctgtttggatggttgagaaaggaaaataataagcttgctttgctcgggccgctgcggtgggtgttccagcgtcctggggcttcacagcctgggtctatcagacccatttaatgccctttctttccaatcacaaatgcaaacccttc

SEQ ID NO: 50447 - DNA, 2021 bp, Bovine  19866880791839
caccaccaccaccaccaccaccaccaccactgatgcgctgcgggggccttcttctgtcccttcctcctgcagctttacaagtgtgtccgacccccgccatacacacacacccccacccacacacacacataccctcctggaaaggggacaagggaggggcttccctcgtgatccagtggttaagactccacacttccactgcaggggaagcatgtttgatccctctccagggaactaagatcccacaagctgtggggtgtggccaaataagaaaaagaaatgggacaagacagcctgaggagttgttgagtctaggtctcacctgattgatggcatgacttttctgattggacctaaaagtgctgcacatctgtttactcattcagtacaccaagaaactatgctaggtgctaggaaaaccaatgaaaagtaaggccagtaaaagggtaaatgtgtaaataagctgtctgccatattataatgaaattctaaaataattataattgacagataaggagctaagtggcagagaaaaacagggacccaattttgcttggaaaagggaagaaaaggaaaggcttcacaaaggagaccaaggtgtaagccagggacctggaggaaaggtcccttcttcaggaagacaggggtttaaaaaagaaaaaaaagtcccaaacattccaagggagagagcgagcatgtggaataacttgggggtcatccttctagggctgaccttttgggggccttttccccttcagttcagttcagttgctcagtcatgtccgactctttgagaccccatggactgcagcacaccaggcctccctgtccatcatcaactcccggagcttacccaaacttatgtccattgagtcagtgatgccatccaaccatctcatcctctgtcatccccttctcctcctgccttcaatctttcccagcatcagagtcttttccaatgagtcagctcttagcatcaggtggccaaagtattggagtttcagcttcaacatcagtccttccaatgaacactcaggactgatctcctttaggatggactggttggatctccttctagtccaagagactcttagaggtatagttttctgcagaccatactgcccagaccatacagtctctaaatgccctacaatcaaactgacctacatttttcctgtggttacaatgagaaattacattttccccattcatgggctgaaatgtagtcaccccggtggatgagaacattaacatatgcagaatggctatggttccctctttcatagagcattttgttactccttttcccggtttgttttgctttagagccatgctggatgttcccagggagctttacaaaatgttgatgctggggtccttccctagggattcagatttaattgctctggggtgcagcctgggcatcaggaggtttcaagagttccccaggtgatccccatgtgcagcccggattaacaatcactgctttagaattgcttccacatttctgtcttctcccattaactatggggtcctgggaaaagggcgttattctttgtctatgctccacagcttcctctgaagttctttacattaataatcgcttattagctattgaatgaattgacttcagaaagacagagagctgaaatacaggcctcctactctaggtggctctgctaggagaattaaaagcagagatacaaaatcactgtgtgttctcagagagctggaacgctggcgaccatggtgacagggggaaacacagctcctgacaagagcagggcaggtgaaactgaagtcacccaggtcaactctcgtttaagggcgagtaaaggcagtttaggcaacctcagacagcctcctgtacccactcgcagaaaacatggtctgccatgttataactaactaaattctagaattctaaagtaaatgttaagaaagctctcccctgctccattaatttggaaataaatatatctttaagggagtatttctgaaatacagaggctacgtaatta

SEQ ID NO: 50448 - DNA, 1612 bp, Bovine  19866880846468
tgtgcgactctgtgcaaccccatgggacggaacccaccaggctcccccgtccctgggattctccaggcaagaacactggagtgggttgccatttccttctccaatgcatgaaagtgaaaagggaaagtgaaatcgctcagttgtgtccaactcctatcgaccccatggactgcagcctaccaggatcctccgtccatggggttttccaggcaagagtactggagtggggtgccattgccttctccacttgcctcacagtgtggccaaatatatattaatatatatatatataatatacatatgtatatatatgtaatatctatctatctacaaaatactctactgcaaaacagcagaatacacattcttcttgagtatgcatagaccattctctgggatggatcacatcttacaccacaaaactagtattaacaaattttagaaaactgaaatcataacaggtattttttctgatcataataggatgaaatagccaacctccccacccaaaggaaaacaaaagaaaaggggaatcacaaatgatggtttggacccttctagattattctagtcttcccaaagaggccataacgcagtgaggtttgttgtgaggagaaaacaatataatttcatgtatattatctgtcacagtgtgggtactcaagaaatatatgtatttccttccctcttttcaaaaatttttacttatttagcttttttcctttttggctgtactttgaggcatgtgggacttccctgaccagggttggaatctgtggcccctgcagtgggagctcggagtcttaaccactggaccgaccaccaggggagtcctcctccactcttttcttttcttctgagtttgtggcctgtcaatccagcaaagggagctgagtgagggcgaagccaccaaacactccggatttgcttcctttttaaggaaaacatgtgccaggcctttgtagcccctcaggggtcatccttaagtcaatctcttcagaaacacaagaggacatgaatatggcacttgtcgctagagactgctttctcttccaagggatagtttggaccagtagaccatcctgtctctgagttctttttcttgcgggtggtggaagaatgttccccattcaggcagcaattgttgccacccccaccctcccttccagaggctaatctgacttcaggtctctgtgttctgcacataattaaactcttttattaatagggccaccccaggggctggaggtttggacatgtgagaatcagtgtgtgactggagaagagggtttcagagcccttcctccaggtctccatcgccacctgggctgaaatagaatgggcaaattgagcccagcctggtccttgaatgatgccaattgattgatggctgggacccaagacggcgtctcccaggaactaaacgggtggtaatgaaatgaagctcagccaccttcgcctcatctatcactgtcagatgaaaaacagaccgagtctcatctccgcctctcccttcaggctgaagctgtcgacagccgccataccctctgctcccactggatggcgctaaagcctcaggcatcagccctcagggactccgcaaacatgcaca

SEQ ID NO: 50449 - DNA, 733 bp, Bovine  19866880880806
aaaaggagattctacagagcatagacagaagcagcagctagaaaaattacaattattttatgaacacgccccactgagttctcaccgttcaataaaccagtaacacacagagtccaacattctctgcccaccagttactggggaactttgccaggaatgctctcagactgtgtgctggttgccatgacaatgtaggtgagatacaatcctgtaacttccccagtttatagcatagcaccagtagcacagtgcctctaaaggttctgatcactaatattttgtgttgaaatctgacatttaatgatgaactctcagaatgacaaatttctgaaatcggagggtgctccaagggttatgactgagctccctcaactgaagagctacttccccaacagcttagagaaaagaccctcttccacatcttgctcttgtctgtagaatagcacgaggaagctccatacccaagagaatctccaccatagtctaattccattaagctctactagggtaatggacctagttcttcatctctagtgtatcctgctgacgtgtaccattaagtttatgcttgaccccaagagggtgtgggctgcaagctgagtttctggggtggatggctactcaggatctctcttcctctccttcctggacactgaaggcagggagcaaagaactttgtcaggatgggaagttagttatgttcatcctgctggacctcagcagggactgagtt

SEQ ID NO: 50450 - DNA, 2315 bp, Bovine  19866880941133
ggcctgtgaaggcgggaagtttgccacagtggaagtgacagataagcctgtggatgaggctctgagggaggcaatgccgaaagtcatgaagtatgtgggaggctccaatgataagggtgagtgtccctggaggatgggctctggtcacccaggccagtgctgcagtctcacgtcatcgatggaaagcacaggaagggacccaagatgcctgtttcagtgtcctgtgaccttgctgttctgtgtgggcaggggggctctggggagacccactgatgtcatgccggttcaggagcactgagttcatgcttctctcccgggtctgagacacaggcttcgtttgttcgtccatttgttattttttcgtcttgaagtgcttatctctggattggtaaactgggaaaggtgtgtccgcggtaagccaggcctcagaacaaagcccgcctctgcctcgagacctctgcccccaggccaaaaatctcgtcagcccctagtagctcagattctacggggttctgaagatcagtgagtgatgagtgtggctggtccctggctgtgttctggcaaataaagagcctgagagttcttagtccccttctgaaacacttgacagtccatggggattccctggcagtccagtggttagtactcagtgctctcactgctggggtccaagatctgatccctggtcagggagctaagatcctgcaagccacgtggcttggtctaataataagacttggtagtccatgctggctgcctccctgtttttgtgataaaatgagaggcctgaagtttcagtatacctgtttgtatgtaaaccatatttaaataggactttaacacttaagggcttcccttgtggctcagctggtaaagaatccacccacaatctgggagactaggttcaatccctgggttgggaagatcccctggagaaggaaaagactacccactcaagtattctggcctggagaattccatggactgtatagtccatggggtcacaaagagtcggacacgactgagcaacttttcatttaactcttaagttctctaacttggcctgcactttagaatcagtacaaacccaaaatggttcagtatacaagatgaaaaaaaaatgtatttaatatttaggatatatctcaagttgataaatgagaaagaagcttgtatcaagcttagtaatatttgctagaaccaaagaaatcaggctttggacataagtcaaccagtaggaggtcacgaagaagtcttttccttcttagcactggcataaattttcctcagaagaaaatatgtgtaaaaattataaactcaccaaacatttttgaaaataacaaaacagcaccccagtccatcttttctaatgtaatcattgtcatatttgagtgtatttttagggctttataataggtttttaaaatgtaatcataatagtatcttccttggtggctcagatggtaaagaatctgcccacaatgcaggagacccaggttcaatccctgggtcgggaagatcccctggagtagaaaatagcaactcactccagtatgcttgtctggagaattccatagacagaggaacctgatgggctacagttcatggagttgaaaagagttgggcatgactgagcaactcacacacaatatgtaatcgtagggtttgtgcaatatatcctgtttctgttccttatttcataattattttccattgtagctaactagtcctaagcatgactattcatagctaaatcatattgcatcatgtgcctataatttacttaaacatattcctcttttgaacatatctaaatttttaacaattataaattctgctgaaaggaaaatcctattccctaaatagcctttttcatattttagattatttcattaaaatcaacaattatgacttctctggtagtatagtggttaagaatccgcttgccaatgcaggcaagtggggttccgtggggcaactaagcccatgcacacagctgctgcagctcgtgtgcccagatcccaggctcggccacaaaagaagccactgcaatgagaagcccaagcatcgcctctagagaacagccccgactctctgcaactagagaagtagcccccactagagagcagccccgactctctgcaactagagaaagcccgtgcacagtggtgaagacccaacacagccaaaaatgaaaaattaaataaaatttaaagataaaatcagcaattagacaggatgtactctgttgttatttagttgctaagttgtgtctgactcttttgcgaccccatggactgtagcccaccaggatc

SEQ ID NO: 50451 - DNA, 908 bp, Bovine  19866880948723
acaggtttgaaccctggatggagaagattccctagagaaggaaatggcaactcactccagtattctggcctgaaaaatttcatgaacagagaagcctgccaggctacagtccatggggttgcaaagagtctgacacgactgagtgattgagcatgcatgcatacaagagaacagtccagagcccattaccctatgaagacttagactcttcctttgatgaccttctacgtggtgacctcagatagacctcctgtataggggtagagattgaattaaatgatcttcgagttgggctgtgtacgagtcatggaaagcttccccgagaaagctgagccaaatctaaaatgagatgcagtgaggcacaacagcgagaggagaagagaaaacggcattccaggtggagggaagtgtataagcaaaggcatggtgatatgacgatactgcgtagcaggagctacagataatttagtaccatattttcacagtatcaaatgccaggtaagacataggaggggtgatgttgggaaagaagtagggactagccaaattctagaggtcctggtgtaccatgatcagaagcttaggttttagcttacaaatgtttgaagggcttttaaacaaatgaatgacctatagtaactgggataactctctatataaatatactgatgagcttagcaaaaaagtatacaatgcaattttgtacttggcctaattagtgaatgctggtgagattgttgtcatttatatgctatgagatcatcatatttattctttcttaaaatttgtatttattcatggatgtcctgggtctttgttgctgtgcaaggggtttctctagctgtagtgcgtgggatcctcattgcggtggcttcttgttgcaggacatggactctaaggtgtgtggg

SEQ ID NO: 50452 - DNA, 719 bp, Bovine  19866880992820
aaaccaactcattttttctcattttaattactctaaaaggtaactgttcaaaggaataataatgacaatatattgggtgtttatagcatatggataagtgaaataaatgacagtaatgtcataagggagaggagagaggacatagtattctctgttagaagaacctacactaaagtgtagtggaatagtattatttgaaggtggacttagataaggtaaaaatgtacattgtacattctggaacaaccactaagttttatttaaagaaatataattgatccaccaagagagaagataaaataaaatcatataaaatgctcaattaagaccagagaaagcaaaaaaagagactctgataatgactaaaccacagttaaaacattgtttatattaattcaagaatatcagttatcactttaaatgtgattagtctaaaaacaccaattaaaggggagagattgtcagagtagattaaaaaaagaaagctcaactgtatgttgttgatgataagcctgattcaaatatgaaaacagttaaaagtaatgggatggagaaaagtatacaatgccaacagtaatcgaagcaaagactgagtatctctattagatttagacaaaacacacttcagaagaaaagttatcaagaataagaaggggttctatataatgatgaagggatcagttcttcaggaagacttataatcttaaacatgtatacac

SEQ ID NO: 50453 - DNA, 1659 bp, Bovine  19866880997394
attgcaagagagagcatagcttggcagcatctcatgtggaaaggcttagcagtgtgtccacagaattctgcagttgctttgtgaagtctccctgtaaggttgcctggatcttgggactgtaataatagaagcagagagtccccagctcaggagatgatcttcccattctgtactgtcctggtccaatgtcattgggaattttgccttccattctggacatcaatgctaagaagctgggaccattcgaaatggcagagagaagctaactcttaataaaatgacctgaaacactctcaatcaaggaagagaaaagaaacatcggagggggcatttcaggagtcacatgggagagggcattgctgtgtgaagttgtctgagatttctctgatttcctcaaaggtggaaggagcatgtatgtgagaaagctctggaggactggcttagggctcaatgtaaagttctccagagatggagaatgctgggcttgaactaatcccaacacacaaggacagataagtcaacatgcagctgatgtggaaattgtcagaggtctgccttgcaggtggaaggggaaacgctgtactcagtttggtttcagaaaaactccaaaaaaaaaaaaacctttaatggccagaagcttctttcttggccatcctaaaacttccccatttgtgagcagtccctgtaggtgaaggctttgattcctgttccatacaaaccttctggaggttctatcagagagtccctgggacagcaaggagatcaaaccagtcaatcctaaaggaaatcaactttgaatatccattggaaggactgatgctgaagctgaagctccagtactttggccacctgatgtgaagagctgactcatttggaaaagactctcatgctgggaaagattgagaccaggaggagaagggggtgacagaggatgagatggttgggtggcatcacagactcagtggacatgagtttgagaaaactctgggacatagtgaaggacagggaggactggagtgctgcagtacatggggtctcaaagagttggacatgacttagtgactgaacaacaatatatataaatgtgaaagaaggagagaagggggacttccctggtggcccagtggttaagactctgtgctcccaatgcagggggcctgggttcgatccctggtcaaggaactagttatcatattctgcagcttagacctggtgcagccaaataaaaataaacatatttttaaaaggagagaagtgagaaaatttaaggcgaggagagtaaagagagggtgtgaagataggaggctggaggtaaattggggaggctttaaagtgtaggaaacctggcttcatttccatttgcctggtctgtatcaccactgctgatgaactcagatgatcccacgtccactgactcagtggactgttcccagcccaggtcctggtgtcaatatctctaagcacaggtgggagcttctgctgctgactcaggcctgggagcagaccatgtgcagactcccctggctcctgccccaaaatcgatccccagtccgcaaagctggacacgaaaacctcatgccagggagagcagagggagcaggtgcctggccccctgcaccacccgtcctggcaggctgggagtctggctggcatcacgcc

SEQ ID NO: 50454 - DNA, 3650 bp, Bovine  19866881031500
ataaaatacttgtctctaggatccatttaactaaacttgacttaaatcctggtagaggctcccatctctataacagacacaaaagaggatgaatgatctttcactatcaaaacaaactcctaaatagagctaaagtttattaaattattcaaatacatttactatgctcctataatgtgcaaagtactgttccaaaatagacacccttccttagatgtacagtaggccactaaaataataatttcaggagcttaagacactggtacagtcaaaataccctaatgatatgaaatggtctctgttgctgctgcttccaaaagtgcccggtttatttctaaggaacagctcaggcatttggaagaataattcaaacttaagctttaatacaagatggagttaggcaatgattgtaccttcaaacataatataacagtatgaagtacattctggtgatctaaaatgctagcatctgtgcaaggtaacctaagaaatttgacaccattttttttttaaggtaccaatttcaaaataaatcaaaatacaaatcaattgccattttaggaaaaataaaaatataggcacgccaactcctctcccagcactgaaattacacttcctcagacacactgccatcattggtaagcatgggggatcaactgggtaaatttaaacacattagataatcacataattcaacctagcttgggtatatgtgtgatcccaaagacttttcaacatatttttcagcaatacagtggtagcaatagaaattgaagaaactggaagtattttcttagagacagcttacagatatcttacaggttccaaagtgaaaatataacacatcaccatcataacacaagctactttgtcgctcctaagacccaacttcgcaggacatcaggcttcctagtgtttccttcatatgcctctacttgggttttctttcccctgaactaaatagggagggcctttcaggtcaagtgttatctgctggccagttaccttcaggatagatatgcttgcatcatttctatattgacaagtcaagcctccatttatgaggcttaaattcagctcctggtctctttattcagaacttcccttatttacttataaaaagaacagcaaccaaaaaaaaaatccaagagaaaaaaagaactaccctcatttacttaaaaggatcattcaaaacactagggaaaaaatttccctctgaaggagacttatttaaggaacacaatactgtttacagctcatggcccaccttagaaaggcaaactcagctaagtctcctgaaaagaatctcagtagtctcccatttggaaacttgctattcctattattttctaatgtggttaaataaaattaaatgttaataataaacagtaattaaataataaacttaaaataaataataattaaaaaacatggtctggaggtttttagaaaaggtaataaaggtcaattttcattaaattcacattcctttctgtaccagtttctacaatgagcaggcaacactgccctctaacgggctgattctgttacatctcttagttcaactggtgggaaattgctccaggaagcattgacacaaggcccccacgcacattctttcttttacttctgggacacagtctgtccttgaccgtctgtgaatgacactaaagacggagcagcccctagagaggcgatagacttagagaacgctcatcaggggattacaaactaacacccattgcaatggtgttcaaacttcagcaggcatcaaattacccccaagggcttgtttaaacacagcttgctgagccccacctgtgttgctgactccttaagtctagagctgagtccaagaattggcctttctgagaagccggggcctggtgggctgccgtctatggggtcgcacagagtcggacacgactgaagcgacttagcggcagcagcaacaagttcccaggtgatgctacaagcccagagaccactctttaccacccagacactgtgcttggctttatcttactcaatacttcccaataaggtggggttttagcacccattttacagactaggaagccaagtctcacacagaataaacccaggactaactcaaaagccattgctcccttctctacagtatgaagtcaatatacgaagctgttaaccatttccctttccttcaatttcttccgtaagggggcgggacttaggtgacggtttagtggatttcccctctcagagcaccttggaggtctggctatgaagtcacctaggaaggtccactccatctccaggttggatttgtgagcagggcacgctgagagaggagggggcgcatatcagcgggaggtgcctcccttgggtcctgaaccctcctacatagttcagagagagtctgattagctctagattctggagttcttcgtactcagaaactctgccagagaggttttaaagctagtgtctcttctcacgggtgtttctgaggacctcaaagcctaatggggctcgaagaggacccagagggtgggggtgtctgcaccgttctccagcctcggctcaaatcacccgccgaggcagggacaggcacgtggcaacaactttaaatcaggagtgcccaaggaagggtgtgaagaccgaacggttatgataaaatataaaatacttttcaggtcatatatcccaccaggatcaggcaggtagaagtccctagcactcagcccctggcaggatgtcagcgataggtaaagaagagttgggagaacacactcccaccccccatcctcgaatagtttttctcatccttcgcattcagctcctagcccaacttcgtgttttcctgagggagatacaaatatggagcatcccatggggatgattttctggcttcggtcattagatgggaaaagatgttttcagaaaaactgccccgtgggccggtcagccgagatcttgaggtcgtggccgcggctcctcttcgtgtagagctggactctgaactccagctgctcgctcagctcgtccagagcccgggtgcaggactccaggctctcggccagtttctgaatcttggcctttagcacggcctggctaaccctggtggccccctcggcccgcctggggacaaggaagccgcgggagccaaagaagacgatgaagtataccgagttgtacagcgcgatggaagcgttcctcccgcactgcagcagctggcggtctccgccgccctgcccgcggcagaagaagtcgaggcagctcagcatctcgcgcatctggtcctggcaggtggccgcgatctcctgcacgcgccgcagctcccgggagttgcagaagatcagggagaggtcagacgtgatggttacggccccgccggcggtggccacccccagtcccacggccgaggccagcagcgagacccccagggtgacggggctgagcgagagtcccacgatggcggccacagcgcccgccgcgctcagcgagctgccggccacgttggccgccagggagcgccggcgtaggcgctctaggcgccgggccacctcgcgcagacgcagtagctggccgtgcagccggccgcggcggtccagcagcagcccctggaagcgtcgcagagcatccgcgccctgcagctcccgggccgccgg

SEQ ID NO: 50455 - DNA, 877 bp, Bovine  19866881059345
tgaatttctctgtgttcttccttacatgtgaatgtatatttttctcagaataaaaattttaacttaaaaaagaaagtaaaggcagaaatgcttttttaatattacaataatattttgtttatttatttggctgcaccaagtcttgtttggagcacacaggatcttttgttgcagcatatgggatctagttccctgaccagggatagaacctgggcctcctgcattgggagcacggagtcttagccactggaccaccagggaagtcccagaaataatttttaaagtgctaaatttagggggaaaagaagactacaaaaaagttattttctcatctaattcaaaagcaaataaagttgaaaaccctcaatagtaaccatttattttttaaaaagcaaataactagaacaaaaacaatcaactttcagagtatagcagcatacactcttgcttcactgtaatgtctgatgtgaaatgactgaattcttcttattaaacataggctttaaacaaagttaaaaaggaagaccaatatcttaacattctttcgcctgtaagacacatgctaaaaatgaaactattcaaatatctgagatttgagggagccctgaagatttctgatgcctctctacatacagaacaagcaggggttaggatccaggttgcaatgattgttatgaatgcctgagaacttgggagaaaatgactaagtctgggaaaggaagagaccaaggtaatagtttgccccgtgtcccgggagataagagaagctttaggttaccaaagggatgtagactcagctgtagtctttgtggcaccagaggaaaaggcatgtggtaaaagaagttatactataatagagcctgtggggccaatgctt

SEQ ID NO: 50456 - DNA, 851 bp, Bovine  19866881133079
gaatatgaggcttgactgctgaaggagaaaattaatgtcaaaaggaaacttcttgcattggggaacagaacttcatgtacttatgagaaagaggaaggaggggggagagaaaatatttttgatagaaaggaggaaataacttcaagcaaaatctcttaagagccctgattcagtatttcaggcctcagaagggttaccatatggaatgaggattaggccttgtttgctgtggctttgggagggcaaattagattgtggggtggtggtcatgggtaaccatcatgacataatccaatagtggatttcagctgcataaccaccagctcttaggagctgataatgtccaagcagggatgaagtgactgaggattacagaagcaattcctacttggtggggattagattgcagacctctgagaccttgcaacattgatatcagcgctattaaacacacacttgaatccccttcagctggtctgacactggacacggtggagaggtgggtgttgggggtgtgtggctctgttgtcatagacttttggtgaatggggtggcgaggaccttaggaaatatttctagcagagcctcatcagtccaagcagtctgatttaaaatatattgcatgggacttgcctgatgtccagtggttaagattccacacttccacttcagggggccctggttcgatccctggttggggaactaggatcccccatgctatgtgtccagaaaatacatgcagtgaagtgaagtgaaagttgcttagtcgtgtctgactctttgtgacccatggactatacagtccacgatctccaggccagaatattgagtgggtagcctttcccttctct
